United States Patent 9,238,822 (COMPOSITIONS AND METHODS FOR CONTROL OF INSECT INFESTATIONS IN PLANTS) - sequence listing, part 7

SEQ ID NO: 21081 - protein, 293 aa, Diabrotica virgifera
  misc_feature: Coding regions on vcDNA: vcDNA=SeqID_778; Strand=+; Position=101-980
  misc_feature: Homolog annotation: Hit_ID=AAH27911.1; Match level="QueryCoverage =78%, HitCoverage=53%, E-value=2e-37, Identity=41%"; Hit description =Hypothetical protein FLJ13798 [Homo sapiens]
  misc_feature (265)..(265): Xaa can be any naturally occurring amino acid
  misc_feature (284)..(284): Xaa can be any naturally occurring amino acid
MDMKHPLNLQRELKKFIYSDLELHRIPLGYFNRDVRGVLTHCLKDALNLKVSSEKRLFEINVIIDYLNDELNLGHWCKVPLKVRHCFTICSYVKCLILLNSGRNSRPNLLKECLNTLDMGLLLGAPLEENPDLLTGSAEYLRKELQIYNVAENKADIRENLSKRKIDEPNDFMNLKGRIVESVERPSLQEFIEQYFFAQLPVKIKGCLNHWPASKKWTDLNYLLEIAGDRTVPIEVGSQYTHENWSQKLMTLKDFVTKHYLSEDXNIGYLAQHNLFEQIPELKXDICIPDIAV

SEQ ID NO: 21082 - protein, 104 aa, Diabrotica virgifera
  misc_feature: Coding regions on vcDNA: vcDNA=SeqID_779; Strand=+; Position=185-499
  misc_feature: Homolog annotation: Hit_ID=EAA14122.3; Match level="QueryCoverage =80%, HitCoverage=59%, E-value=7e-34, Identity=75%"; Hit description =ENSANGP00000013411 [Anopheles gambiae str. PEST] ref|XP_553822.1| ENSANGP00000013411 [Anopheles gambiae st
MKTSLIIFLCCMIVSVLSAKDMMRKSIVFDKNTPDVFYCPIHKPTGFDKMIVKAKPLKKLCEFEGKPLPEDYKSDCYQDVDESDYACKEKYRIMKRLKKDSAED

SEQ ID NO: 21083 - protein, 163 aa, Diabrotica virgifera
  misc_feature: Coding regions on vcDNA: vcDNA=SeqID_780; Strand=+; Position=147-638
  misc_feature: Homolog annotation: Hit_ID=EAA14122.3; Match level="QueryCoverage =61%, HitCoverage=71%, E-value=6e-42, Identity=73%"; Hit description =ENSANGP00000013411 [Anopheles gambiae str. PEST] ref|XP_553822.1| ENSANGP00000013411 [Anopheles gambiae st
MKTSLIIFLCCMIVSVLSAKDMMRKSIVFDKNTPDVFYCPIHKPTGFDKMIVKAKPLKKLCEFEGKPLPEDYKSDCYQDVDESDYACKEKYRIMMRMHPPGSDEAFDGKRMSRFMNVDKEYYIMKMDNKYRNKEWTTNAEARKARESRNRVKTRLRKRLTTKY

SEQ ID NO: 21084 - protein, 244 aa, Diabrotica virgifera
  misc_feature: Coding regions on vcDNA: vcDNA=SeqID_781; Strand=+; Position=241-972
  misc_feature: Homolog annotation: Hit_ID=AAH82900.1; Match level="QueryCoverage =80%, HitCoverage=92%, E-value=1e-28, Identity=34%"; Hit description =Unknown (protein for MGC:85298) [Xenopus laevis]
  misc_feature: Gene Ontology Annotation: Molecular function=protein binding; Cellular component=cellular_component unknown; Biological process =biological_process unknown
  misc_feature: Pfam annotation: Pfam_ID=TBPIP; Match level="Score=103.9, E-value=4e -28, Copies=1"; Pfam description=Tat binding protein 1(TBP-1)-interact
  misc_feature (154)..(154): Xaa can be any naturally occurring amino acid
  misc_feature (179)..(179): Xaa can be any naturally occurring amino acid
MACNEVVLKFLEEHNRPFSANDIQSGVKGDFGKSAVQKALDFLVKKEQVREKAYGKQKVYCIVQETGESASTLREKLLEMDRSINEINIKVKGVAEQYKTKSKLISDAKGKISLSSALHQKANIEQQTEEIKNKLNQYSSKELVCPQKKNQVLXYEKYLKETKKRRRIGMDMLNAILEXYPKTKKHLFEDIGIETDEDVGFSLESHNILFSFSPFRGFDILFKCNYYYIIQDMLPTCFLTSSHI

SEQ ID NO: 21085 - protein, 165 aa, Diabrotica virgifera
  misc_feature: Coding regions on vcDNA: vcDNA=SeqID_782; Strand=+; Position=102-599
  misc_feature: Homolog annotation: Hit_ID=XP_311473.1; Match level="QueryCoverage =94%, HitCoverage=85%, E-value=9e-54, Identity=62%"; Hit description =ENSANGP00000013724 [Anopheles gambiae]
VRFFTKMTSIETVGTIVLKLLKLVINLICLILYRTGYQGYFLGVGGTWNLNEEKNPDAEIVASGVFVGFMIYTFVSLISLCFASGDHKTTFTDILMNIVGIFMWIAVGATALHYWLGYLSEYKYTTIDSERQVGLALGAMCIINGAVYLVDGVLSAIFILKAKMQ

SEQ ID NO: 21086 - protein, 93 aa, Diabrotica virgifera
  misc_feature: Coding regions on vcDNA: vcDNA=SeqID_783; Strand=-; Position=237-518
LKEKILCIIKSDLKSEEVIECGSPHFTLRNGLFLKITILSCFLYHWSFLHETCHLALSRHFKFPKISSYHITPKDDISPSFIFIFNVTMNNRK

SEQ ID NO: 21087 - protein, 88 aa, Diabrotica virgifera
  misc_feature: Coding regions on vcDNA: vcDNA=SeqID_784; Strand=+; Position=672-936
  misc_feature: Homolog annotation: Hit_ID=EAL24948.1; Match level="QueryCoverage =92%, HitCoverage=18%, E-value=2e-15, Identity=49%"; Hit description =GA22083-PA [Drosophila pseudoobscura]
  misc_feature: Gene Ontology Annotation: Cellular component=membrane; Biological process=signal transduction
  misc_feature (49)..(49): Xaa can be any naturally occurring amino acid
MVSLWSTFVNIHYKKHLLISIILRIVLVVYGIHHDQISKLKYTDIDYKXVFTDASRHYLEGNSPYNRHTYRYSPVSSYTLNSKYHTPS

SEQ ID NO: 21088 - protein, 124 aa, Diabrotica virgifera
  misc_feature: Coding regions on vcDNA: vcDNA=SeqID_785; Strand=+; Position=56-430
  misc_feature: Homolog annotation: Hit_ID=NP_609843.1; Match level="QueryCoverage =100%, HitCoverage=100%, E-value=1e-34, Identity=58%"; Hit description=CG5110-PA [Drosophila melanogaster] gb|AAF53620.1| CG5110-PA [Drosophila melanogaster]
  misc_feature: Gene Ontology Annotation: Molecular function=SH3/SH2 adaptor protein activity; Cellular component=cellular_component unknown; Biological process=phosphorylation
MVEEAKKYLQDILGRVNGLHCILITDRDGVRMLKVSNDKTPEQANKPNFISTFGLAIDQGSKLGLGKTTTLICTYSQYQVVQMNKLPLIVTFIASDSCNTGHILALEKQIDGIVSDLALAVTES

SEQ ID NO: 21089 - protein, 309 aa, Diabrotica virgifera
  misc_feature: Coding regions on vcDNA: vcDNA=SeqID_786; Strand=+; Position=17-946
  misc_feature: Homolog annotation: Hit_ID=EAA12193.2; Match level="QueryCoverage =87%, HitCoverage=99%, E-value=1e-109, Identity=67%"; Hit description= ENSANGP00000018575 [Anopheles gambiae str. PEST] ref|XP_555675.1| ENSANGP00000018575 [Anopheles gambiae s
  misc_feature: Gene Ontology Annotation: Molecular function=endonuclease activity; Cellular component=mitochondrion; Biological process=DNA fragmentation
  misc_feature: Pfam annotation: Pfam_ID=Endonuclease_NS; Match level="Score=307.5, E- value=2.1e-89, Copies=1"; Pfam description=DNA/RNA non-specific endonuclease
MNKKLFKYVTVGSLSFLAGIYTEKYKLIYDPNTIIVKNVPGLPIFGTVSAATPFTPVPVPDIAEPQKKLSRVSEIMKYGFPSLDQIRSFENYVLSYDRRNRVAHWVFEHITKESIQPNDQVDRSKCEFKVDDSIHKFFRSENTDYKKSGFDRGHLAAAGNHKCSQKQVEQTFFLSNMAPQVGKGFNRDSWNRLEKHVRKLTRVYANVYCCTGPLYLPRKESDGKNYVRFEVIGANHVAVPTHFFKVVVGETAEGKLEMETYVMPNQVIDDNVPLTSFQVPPESIERAAGLLFFDNVARNKISKINGKKN

SEQ ID NO: 21090 - protein, 189 aa, Diabrotica virgifera
  misc_feature: Coding regions on vcDNA: vcDNA=SeqID_787; Strand=-; Position=278-850
  misc_feature: Homolog annotation: Hit_ID=XP_313621.1; Match level="QueryCoverage =94%, HitCoverage=44%, E-value=7e-28, Identity=35%"; Hit description =ENSANGP00000024261 [Anopheles gambiae]
  misc_feature (82)..(82): Xaa can be any naturally occurring amino acid
  misc_feature (155)..(155): Xaa can be any naturally occurring amino acid
  misc_feature (179)..(179): Xaa can be any naturally occurring amino acid
LRPETEAQVCIQGQITDAFTITQGLKQGDRLAPTLFNLVLEYVIRRLTVSGNNILTNKSTQLAAYADDINIMSRTMNAAEEXAVGLAINTNKTKLLIQTRSNRPAQQHFIDDIEHVNRFTYLGMDLVASNEEEPEINRRLVLANKAYFAMGHIFXSRDVHRKTKLRVYKTIITPIVSYXAETWVVNTKI

SEQ ID NO: 21091 - protein, 206 aa, Diabrotica virgifera
  misc_feature: Coding regions on vcDNA: vcDNA=SeqID_788; Strand=-; Position=64-684
  misc_feature: Homolog annotation: Hit_ID=EAL39934.1; Match level="QueryCoverage =73%, HitCoverage=19%, E-value=3e-34, Identity=50%"; Hit description =ENSANGP00000028171 [Anopheles gambiae str. PEST] ref|XP_556470.1| ENSANGP00000028171 [Anopheles gambiae st
MKYKIFTNILNRRLQPLTEKIIGEYQAGFRQNRSTIDQLFTVKQILAKAWEYDMDVYNLFVDFKQAYDSIDRTILPNILEEFGTPSKLIRLVQMTMTETEAPVCIQGQITDAFTITQGLKQGDGLAPTLFILVLENVIKRLTERENNILTNKSTPFKQQTRMDIKLNGEEKRNGGGKKPYVSAEAVGVEKIRGDFRSNQTGAKTLY

SEQ ID NO: 21092 - protein, 265 aa, Diabrotica virgifera
  misc_feature: Coding regions on vcDNA: vcDNA=SeqID_789; Strand=+; Position=33-830
  misc_feature: Homolog annotation: Hit_ID=XP_319873.1; Match level="QueryCoverage =86%, HitCoverage=86%, E-value=3e-32, Identity=32%"; Hit description =ENSANGP00000010625 [Anopheles gambiae]
  misc_feature: Gene Ontology Annotation: Molecular function=plasma kallikrein activity; Cellular component=extracellular space; Biological process= proteolysis and peptidolysis
  misc_feature: Pfam annotation: Pfam_ID=Trypsin; Match level="Score=151.6, E-value =1.8e-42, Copies=1"; Pfam description=Trypsin
MVGLKVFVLFALLATTYGFHQIKFRNTRNGLGLDGATEATDGQFPWVVSLQSSYERINTHVCGGVILTENWVLTSAECEGAVKVVAGAVKPRLADPNKQTVDVERWVVHPDYNSQIVGPNDIALVKLKQPLKFTDAVKAANLPEQGAAVTGLADVVGYGNSARPDFNNLTYISDLPLISYDDCNQALEDVLQEKSSLDEKSNICAGVLANGANNCDGDTGSPLTQDNFVIGITSWFISPCQGMGAPNVFTNVANFVDWINENISQ

SEQ ID NO: 21093 - protein, 338 aa, Diabrotica virgifera
  misc_feature: Coding regions on vcDNA: vcDNA=SeqID_790; Strand=+; Position=1-1017
  misc_feature: Homolog annotation: Hit_ID=BAA19572.1; Match level="QueryCoverage =100%, HitCoverage=56%, E-value=1e-110, Identity=59%"; Hit description=DEAD family RNA helicase~germ cell specific in Bombyx 5th instar larva, a material factor [Bombyx mori]
  misc_feature: Gene Ontology Annotation: Molecular function=DNA helicase activity; Cellular component=polar granule; Biological process=pole plasm RNA localization
  misc_feature: Pfam annotation: Pfam_ID=Helicase_C; Match level="Score=124.5, E -value=2.6e-34, Copies=1"; Pfam description=Helicase conserved C -terminal domain
VSPTRELTIQIFEQAKKFAHNSIVKAVVAYGGASVSYQRNHVLAGCHILVATPGRLNDFVTRGHLSFASVQYFVLDEADRMLDMGFLPTVEQMLGHATMPATGERQTLMFSATFPEEIQHLAGKFLLNYVFVAVGIVGSASTDVEQVFYQVPGKEKIRKLKGMLSENGGERTVVFVEQKRTADFLGSFLSENGMKSTSIHGDRLQREREQALWDFKKGICNVLVATGVAARGLDIEGIEHVINFDLPKSKDEYVHRIGRTGRVGNKGKATSFFDSSSDSALAPALAVILKQAGQEVPDWFGDMSSQSSYHDSNSFGGTDIRGGEFGKAQVAEEADEEW

SEQ ID NO: 21094 - protein, 288 aa, Diabrotica virgifera
  misc_feature: Coding regions on vcDNA: vcDNA=SeqID_791; Strand=+; Position=71-938
  misc_feature: Homolog annotation: Hit_ID=XP_396394.1; Match level="QueryCoverage =78%, HitCoverage=95%, E-value=5e-57, Identity=51%"; Hit description =similar to ENSANGP00000001283 [Apis mellifera]
  misc_feature: Gene Ontology Annotation: Molecular function=ribonuclease P activity; Cellular component=nucleolar ribonuclease P complex
  misc_feature: Pfam annotation: Pfam_ID=Alba; Match level="Score=44.2, E-value=3.8e -10, Copies=1"; Pfam description=Alba
  misc_feature (135)..(135): Xaa can be any naturally occurring amino acid
MADNKLESKSTPYKKNPKKSLKDHTRLPRPPKKTETGENVLYVSSKTNVKAQLDRCNKLLNNKHDEIIIYCMGAAIQRGILLALQLCEEHITYKVSTSTLTTELLDDLEPSVDDADYEIQKRFNSALRIRVYNSXQCYPEMFFTTEELIRWLGLTVFELWINLISLLLFTIIFALKYDPTSDLDSIDWWFIFFPLFAGDALNAYFVIIIFIRMLLETTLKFALIRFSWSGTVLLNMFLFKYLLCKRLLGQTALDYSEVFAPVYILLQLIAVRACQQSNNCDVYKLIYR

SEQ ID NO: 21095 - protein, 128 aa, Diabrotica virgifera
  misc_feature: Coding regions on vcDNA: vcDNA=SeqID_792; Strand=+; Position=3-388
  misc_feature: Homolog annotation: Hit_ID=AAA52482.1; Match level="QueryCoverage =84%, HitCoverage=29%, E-value=3e-26, Identity=51%"; Hit description =alpha-L fucosidase
  misc_feature: Gene Ontology Annotation: Molecular function=alpha-L-fucosidase activity; Cellular component=cellular_component unknown; Biological process=fucose metabolism
  misc_feature (16)..(16): Xaa can be any naturally occurring amino acid
DAWVLYQLVSTVSCGXRGLMNVGPTKDGIIAPIFQQRLKDLGTWLSINGDSIYSTRPWTSQNDSLTNGVWYTSKGSDVYAISLRWPKDNILDLGSAIDLFKNTNTSVHLLGHESGEALKVIGNFLCLY

SEQ ID NO: 21096 - protein, 245 aa, Diabrotica virgifera
  misc_feature: Coding regions on vcDNA: vcDNA=SeqID_793; Strand=+; Position=127-861
  misc_feature: Homolog annotation: Hit_ID=AAQ97603.1; Match level="QueryCoverage =97%, HitCoverage=41%, E-value=4e-34, Identity=34%"; Hit description =N-acetylglucosaminidase [Manduca sexta]
  misc_feature: Gene Ontology Annotation: Molecular function=beta-N -acetylhexosaminidase activity; Cellular component=lysosome
  misc_feature: Pfam annotation: Pfam_ID=Glyco_hydro_20b; Match level="Score=17.0, E -value=0.00011, Copies=1"; Pfam description=Glycosyl hydrolase family 20, domain
MIGVNVVLAVLWVVVNGADSSNWLCENSHCIKENSQPEREGYVSLELCRLVCSKYLNIWPQPTGTVQSTQETIFINSKSIVFSFNGPANTIGHLNKFTHYFEEQLKKEEPFSCEDNAYNLKVYLTPINDDLRLDLHTDESYTIKMDYKGTDIYANITAPTVFGIRHGMETLLQLLIPINEDGTKCLVTVNNLVLTDKPKFHHRGLLIDTARNYLSVKTIKKQLEGMAASKLNVLHWHVTDSQAFH

SEQ ID NO: 21097 - protein, 280 aa, Diabrotica virgifera
  misc_feature: Coding regions on vcDNA: vcDNA=SeqID_794; Strand=+; Position=40-882
  misc_feature: Homolog annotation: Hit_ID=EAA10769.3; Match level="QueryCoverage =94%, HitCoverage=98%, E-value=1e-106, Identity=74%"; Hit description= ENSANGP00000011323 [Anopheles gambiae str. PEST] ref|XP_557328.1| ENSANGP00000011323 [Anopheles gambiae s
  misc_feature: Gene Ontology Annotation: Biological process=positive regulation of cell proliferation
KLYSKENISKIQTMTDCEKEEATNLQKEFEWVLNQEVHKGLEQIHQILVECARRFPVALYGHDNSSKQDKFVLSVPADQLKCVVTLTGDSITHADINFKVVRQTNTTMVRTTIQSEYPWKLQQVQDAANHLQQAIYHIDDVGKNYKFKSSDEVLHVLGNILGSLQRGRTSLIVPRKKTIYDLLKSRNMKSLAPPLAEDLAISFYIQSHKLVFVMYHLMNNQGVMTPDSTPAECSVPWLNEVLVLFTVGLQLCQQLKDKICVFSQYKDFTVGSRPASPVPS

SEQ ID NO: 21098 - protein, 304 aa, Diabrotica virgifera
  misc_feature: Coding regions on vcDNA: vcDNA=SeqID_795; Strand=+; Position=6-917
  misc_feature: Homolog annotation: Hit_ID=XP_517403.1; Match level="QueryCoverage =82%, HitCoverage=19%, E-value=1e-33, Identity=30%"; Hit description =PREDICTED: similar to ankyrin 2 isoform 1; ankyrin, nonerythroid; ankyrin-2, nonerythrocytic;
  misc_feature: Gene Ontology Annotation: Molecular function=structural constituent of cytoskeleton; Cellular component=membrane; Biological process =protein targeting
  misc_feature: Pfam annotation: Pfam_ID=Ank; Match level="Score=191.2, E-value=2.1e -54, Copies=7"; Pfam description=Ankyrin repeat
MEISGFFAVLSPSFCSGLWLNLLFKQFLISKTKLFRQVNAVLHVFLNMSQIEFPLHLASRLGNLDAVQQLIEGGAEINEVDSSGLTALHVATFSQHKKVAKYLLAHGADLNAIETYQQETPLNISTGINDHEMVRLLIEAGANMQCLDISGNMPIHIAAKKGYLNIVECFLENGINVDILNEISKMTPLHMAACGGYIEVVDYLLLNNANVHLKDCRSRSSIHHGVLGGKAKIVKMLIEKGVDVNVEDINWTPLHLACRHGNLEIVKLLLENGAVYDNRQGKSRNYSPLLVAIEMGHLEIIKYF

SEQ ID NO: 21099 - protein, 219 aa, Diabrotica virgifera
  misc_feature: Coding regions on vcDNA: vcDNA=SeqID_796; Strand=+; Position=125-784
  misc_feature: Homolog annotation: Hit_ID=BAD51413.1; Match level="QueryCoverage =90%, HitCoverage=92%, E-value=1e-85, Identity=73%"; Hit description =Mn superoxide dismutase [Bombyx mori]
  misc_feature: Gene Ontology Annotation: Molecular function=manganese superoxide dismutase activity; Cellular component=mitochondrion; Biological process=superoxide metabolism
  misc_feature: Pfam annotation: Pfam_ID=Sod_Fe_C; Match level="Score=224.6, E-value =1.9e-64, Copies=1"; Pfam description=Iron/manganese superoxide dismutases,
MFGFRQLATVTRTTARSAVRAKHTLPELPYEYAALEPIISRDIMSLHHSKHHNTYVTNLNAAEEKLQAAASKGDISTVISLAPALKFNGGGHLNHSIFWQNLSPSKSNPSAELCAAINEAFGSLDNMKKQLSAVTTAIQGSGWGWLGYNPNTKKVQIATCANQDPLHATTGLVPLLGIDVWEHAYYLQYKNVRADYVNAIFEIVNWKDVSERYKKASGC

SEQ ID NO: 21100 - protein, 460 aa, Diabrotica virgifera
  misc_feature: Coding regions on vcDNA: vcDNA=SeqID_797; Strand=+; Position=30-1409
  misc_feature: Homolog annotation: Hit_ID=XP_310329.1; Match level="QueryCoverage =74%, HitCoverage=63%, E-value=1e-76, Identity=43%"; Hit description =ENSANGP00000005580 [Anopheles gambiae]
  misc_feature: Pfam annotation: Pfam_ID=GMC_oxred_N; Match level="Score=309.4, E -value=5.7e-90, Copies=1"; Pfam description=GMC oxidoreductase
MFLKFLSFVLLVNASNGALVYRDDIDTLVDYVNDYINYTNYYTLPTDNSDSVSVIDETIYEHGSYDFVIVGGGTAGSLLARRLSEVSDWKVLVLEAGSNGNDFTDIPFMNLFTRNSEFNWGYKTVPQSNSCFGMVNKQCVYPTGKGLGGTSIIGDSVYARGNRADLDEWESLGLDGWGYEDLLPYYKKTEKIEIEDYEKDYHGTDGLLRVNYTYPNPLDYDAYLEASQLSGLKSLDYNGKNQIGISKFQWTVAFNTKVTAGNAFLTPILDTQTNLEVVLNAFVTNINFSDLKATGVQFVKDGKKYRATASKEVILSAGPINSPQLLMLSGVGPKNELEELGIKVVKDLPVGVELVDHPVYVGLYIRTNLTADPGTVKSNLEGWTKGLGYYTTVFSADNIAFINTKNPGVEPPNAEILTINNPTSVPPATFHLNDDYATVFLTYTLTDFLVYCIKLAPKSR

SEQ ID NO: 21101 - protein, 243 aa, Diabrotica virgifera
  misc_feature: Coding regions on vcDNA: vcDNA=SeqID_798; Strand=+; Position=179-907
  misc_feature: Homolog annotation: Hit_ID=XP_393309.1; Match level="QueryCoverage =99%, HitCoverage=13%, E-value=8e-40, Identity=39%"; Hit description =similar to Na/Ca exchange protein [Apis mellifera]
MNGNSKSEDKKESPGSGSYKPVPNKEMEVLGDTVIRSKAGSKSNNKETDGADERMLPKEDTKVSPKSEISLKDVKIVMGEKNGDAKLDIVEPKATFGGMTKEELMKYANDPFWVRLRWFLFVTFWLLWAAMLIGAIMIIYAAPKCDPPPPRTWWQVGPLATLDPDAKPESLNSLNKDIKGVIIVWPEDSYKPFDETHNTIQLIKKGKELGTKIIVDLDPAATDLWYTESENSSEAFSDYYIWQ

SEQ ID NO: 21102 - protein, 94 aa, Diabrotica virgifera
  misc_feature: Coding regions on vcDNA: vcDNA=SeqID_799; Strand=+; Position=2-286
  misc_feature: Homolog annotation: Hit_ID=XP_317243.1; Match level="QueryCoverage =57%, HitCoverage=6%, E-value=1e-19, Identity=88%"; Hit description =ENSANGP00000021902 [Anopheles gambiae]
GRVGQTDEDAMQALKGMAATFRVTSSQITKTSAERRLPSTDAVLTMLKWVERHLGRRKPSLDGGYVRRNSAQIQHTIQMELPLGQQSNNSTKDH

SEQ ID NO: 21103 - protein, 278 aa, Diabrotica virgifera
  misc_feature: Coding regions on vcDNA: vcDNA=SeqID_800; Strand=+; Position=78-911
  misc_feature: Homolog annotation: Hit_ID=CAG32225.1; Match level="QueryCoverage =78%, HitCoverage=36%, E-value=6e-19, Identity=27%"; Hit description =hypothetical protein [Gallus gallus] ref|NP_001006136.1| similar to Very-long-chain acyl-CoA
  misc_feature: Gene Ontology Annotation: Molecular function=long-chain acyl-CoA dehydrogenase activity; Cellular component=mitochondrion; Biological process=energy derivation by oxidation of organic compounds
  misc_feature: Pfam annotation: Pfam_ID=Acyl-CoA_dh_M; Match level="Score=-41.6, E -value=0.035, Copies=1"; Pfam description=Acyl-CoA dehydrogenase, middle domain
MWARKSLNNRVYLKRIINTDVSYFGTTHILHQQVPAVKDTQDEKYEKQLKDFQTITNVTKKVRTKKPQKPPFVKNFLLGKFDTDLLTFPELNKEDTKLLEQDVSLVRNLMKQNHMVDSTQMTRKFRQNLSDFKALGLQAAQLMNGRECNVTETSVFLEALSEHNLRNSIVNNEQWGIQTLNRFGNDQQKVKYLTKLMNGDMLSATCISEPHAVDFNSFKTKAQLSSDGKYWILNGMKSAVVNGLSANILFVYAVTKVLKRDTLVETSLTVFAIDKDAP

SEQ ID NO: 21104 - protein, 363 aa, Diabrotica virgifera
  misc_feature: Coding regions on vcDNA: vcDNA=SeqID_801; Strand=+; Position=1-1091
  misc_feature: Homolog annotation: Hit_ID=BAD86655.1; Match level="QueryCoverage =93%, HitCoverage=24%, E-value=1e-80, Identity=44%"; Hit description =reverse transcriptase [Bombyx mori]
  misc_feature: Pfam annotation: Pfam_ID=RVT_1; Match level="Score=110.1, E-value =5.4e-30, Copies=1"; Pfam description=Reverse transcriptase (RNA -dependent
  misc_feature (327)..(327): Xaa can be any naturally occurring amino acid
AALFFFFWFRCIYYCSNFTICFLKAFNIRLEMMNQIVSNSKILDLINSFSNVFTSKLGNFNHKEISIKVVENAKPVFCKHRAVPLAYAKEVELELDRLEKEGVIELIDNSDWGTPLVFVQKSNGKIRICGDYKTTINKHLEDVKYPLPKIDELWNKLKKGQRFSKIDLQLAYMQFSLNIESSKLLAWNTHRGLYAVKRLPFGIKSASSIFQREIENLFKGMKNVTNFLDDIIVTGETAEEHMTNLREVLSKLEKAGLTVCKEKCVFFKEEVEYLGYKISKEGLKKTDSKIAAIINAPKPENITEVRAFTGLVNYYHKFIPRAAQILXPIYKLLKGNVKFFWSKECERAFNIIKDIIASDNCLV

SEQ ID NO: 21105 - protein, 473 aa, Diabrotica virgifera
  misc_feature: Coding regions on vcDNA: vcDNA=SeqID_802; Strand=+; Position=3-1424
  misc_feature: Homolog annotation: Hit_ID=NP_995599.1; Match level="QueryCoverage =98%, HitCoverage=99%, E-value=1e-161, Identity=29%"; Hit description= CG32019-PD, isoform D [Drosophila melanogaster] gb|AAS64599.1| CG32019-PD, isoform D [Drosophila
  misc_feature: Gene Ontology Annotation: Molecular function=structural constituent of muscle; Cellular component=sarcomere; Biological process=striated muscle contraction
  misc_feature: Pfam annotation: Pfam_ID=I-set; Match level="Score=304.7, E-value =1.4e-88, Copies=3"; Pfam description=Immunoglobulin I-set domain
  misc_feature (15)..(15): Xaa can be any naturally occurring amino acid
LRVRYKDKRELSKYXYSMSHSDGVITMEIVGCRPSDSGKYSCVATNEHGVDETSCVVIVEGQTSTPEQQELANKLLYSGDRKYIEHPIKPAPIPVTVRKPIPSSNPHPLQPKSNNPSTNSLAHSSSTLSVGDGDKRTPRKYGRLDSTGSPNRSRSATKELALPDDSTMYAPQFTKNLTDLTINDGESLTLTAHVKGDPDPQIVWTKNGKALSSSEVVDLKYKNGIAKLHINEVYPEDEGEYVCRATNSVGTSETKCKLTIKPMANATNGKKKSSEDKPPRIVDHLKSAFVEDGKPVTLSCRIIGANKFDVVWLHNNKEIKPSKDFQYTNEANIYKLIIAEIFPEDSGAYTCEAFNDAGESFSSCTLNVVVSGEQPKSPVFKTFPISATVSEGESATFVAETEDEPLQINWLKDGKAIKESSAKYNFTADGKRYTLQILSCNSNDIGQYQAKAIGKKGETFAAFSLNVVPPSEV

SEQ ID NO: 21106 - protein, 276 aa, Diabrotica virgifera
  misc_feature: Coding regions on vcDNA: vcDNA=SeqID_803; Strand=+; Position=64-894
  misc_feature: Homolog annotation: Hit_ID=XP_394680.1; Match level="QueryCoverage =98%, HitCoverage=98%, E-value=1e-118, Identity=72%"; Hit description= similar to ENSANGP00000018548 [Apis mellifera]
  misc_feature: Gene Ontology Annotation: Molecular function=endopeptidase activity; Cellular component=26S proteasome; Biological process=ubiquitin -dependent protein catabolism
  misc_feature: Pfam annotation: Pfam_ID=Proteasome; Match level="Score=225.0, E -value=1.5e-64, Copies=1"; Pfam description=Proteasome A-type and B -type
  misc_feature (265)..(265): Xaa can be any naturally occurring amino acid
  misc_feature (269)..(269): Xaa can be any naturally occurring amino acid
MSLAEICGLSDYGSHESRLYKHDLQQFCTNFNSNMNLEVPPFESPATNLSRFTKDDTGKALKINFDHGTTTLGFMYQGGVVLAVDSRATGGQFIGSQTMKKIVEINDFLLGTLAGGAADCVYWDRVLAKQCRMYELRNRERISVAAASKLMANMVYNYKGMGLSMGMMLAGWDKRGPQLYYVDSEGLRTAGKVFSVGSGSIYAFGVLDSGYKWDLTDEEAYDLGRRSIYHATHRDAYSGGFVRVYHMKETGWVHIDNNDCNDLHXQYLXEKKALAQ

SEQ ID NO: 21107 - protein, 293 aa, Diabrotica virgifera
  misc_feature: Coding regions on vcDNA: vcDNA=SeqID_804; Strand=+; Position=148-1026
  misc_feature: Homolog annotation: Hit_ID=XP_312265.1; Match level="QueryCoverage =96%, HitCoverage=67%, E-value=2e-57, Identity=45%"; Hit description =ENSANGP00000021041 [Anopheles gambiae]
  misc_feature: Gene Ontology Annotation: Molecular function=bile acid:sodium symporter activity; Cellular component=integral to membrane; Biological process=sodium ion transport
  misc_feature: Pfam annotation: Pfam_ID=SBF; Match level="Score=58.5, E-value=1.8e -14, Copies=1"; Pfam description=Sodium Bile acid symporter family
  misc_feature (246)..(246): Xaa can be any naturally occurring amino acid
  misc_feature (256)..(256): Xaa can be any naturally occurring amino acid
  misc_feature (269)..(269): Xaa can be any naturally occurring amino acid
MCPISGLVQFLIVLVTVLLVCHAVIVKSCKVTFKPNSTKIHMYDSVQVAYNVDKDQGGEYILFSEDDNIASLDKEYLISTIYDNWKGSFNITGNFLGKTRVSCRKKIEGTKTPNSSMDVIVIRKKRFIDKMFTGSVATLISILYINFGCALDWKELKTILKRPIGPAIGLFGHFVIMPLLSYTLGVLLFPTSPEMQLGLFFTGVSPAGGASNVWAVLLEGNISLSITMTAASTIAAFAFMPLWIFXLGRVIFQNAXFEVPYVEIMTYVXLVVPLAIGYLIQRYFEKGLLLFYK

SEQ ID NO: 21108 - protein, 278 aa, Diabrotica virgifera
  misc_feature: Coding regions on vcDNA: vcDNA=SeqID_805; Strand=+; Position=98-931
  misc_feature: Homolog annotation: Hit_ID=AAV34818.1; Match level="QueryCoverage =92%, HitCoverage=99%, E-value=1e-133, Identity=89%"; Hit description= ribosomal protein L8 [Bombyx mori] gb|AAL26575.1| ribosomal protein L8 [Spodoptera frugiperda] sp|Q95V39|
  misc_feature: Gene Ontology Annotation: Molecular function=structural constituent of ribosome; Cellular component=cytosolic large ribosomal subunit (sensu Eukarya); Biological process=reproduction
  misc_feature: Pfam annotation: Pfam_ID=Ribosomal_L2_C; Match level="Score=232.2, E -value=9.6e-67, Copies=1"; Pfam description=Ribosomal Proteins L2, C -terminal dom
  misc_feature (249)..(249): Xaa can be any naturally occurring amino acid
  misc_feature (254)..(254): Xaa can be any naturally occurring amino acid
MGRVIRAQRKGAGSVFKSHTKKRKGAPKLRYLDFSERHGYIKGVVKDIIHDPGRGAPLAVVHFRDPYKFQTRKELFIAPEGMYTGQFLYCGKKANLQIGNVLPVGTMPEGTIVCNLEEKTGDRGRLARASGNYATVIAHNHDTKKTRVKLPSGAKKVIPSNNRAMVGIVAGGGRIDKPILKAGRAYHKYKVKRNCWPKVRGVAMNPVEHPHGGGNHQHIGKASTVKRGTSAGRKVGLIAARRTGRIRGXQVDAXKEDIRVKSFCTICISVFLVDYIYT

SEQ ID NO: 21109 - protein, 258 aa, Diabrotica virgifera
  misc_feature: Coding regions on vcDNA: vcDNA=SeqID_806; Strand=+; Position=123-897
  misc_feature: Homolog annotation: Hit_ID=AAV34818.1; Match level="QueryCoverage =99%, HitCoverage=99%, E-value=1e-134, Identity=90%"; Hit description= ribosomal protein L8 [Bombyx mori] gb|AAL26575.1| ribosomal protein L8 [Spodoptera frugiperda] sp|Q95V39|
  misc_feature: Gene Ontology Annotation: Molecular function=structural constituent of ribosome; Cellular component=cytosolic large ribosomal subunit (sensu Eukarya); Biological process=reproduction
  misc_feature: Pfam annotation: Pfam_ID=Ribosomal_L2_C; Match level="Score=232.2, E -value=9.6e-67, Copies=1"; Pfam description=Ribosomal Proteins L2, C -terminal dom
  misc_feature (23)..(23): Xaa can be any naturally occurring amino acid
MGRVIRAQRKGAGSVFKSHTKKXRKGAPKLRYLDFSERHGYIKGVVKDIIHDPGRGAPLAVVHFRDPYKFQTRKELFIAPEGMYTGQFLYCGKKANLQIGNVLPVGTMPEGTIVCNLEEKTGDRGRLARASGNYATVIAHNHDTKKTRVKLPSGAKKVIPSNNRAMVGIVAGGGRIDKPILKAGRAYHKYKVKRNCWPKVRGVAMNPVEHPHGGGNHQHIGKASTVKRGTSAGRKVGLIAARRTGRIRGGKVDAKKED

SEQ ID NO: 21110 - protein, 468 aa, Diabrotica virgifera
  misc_feature: Coding regions on vcDNA: vcDNA=SeqID_807; Strand=+; Position=73-1478
  misc_feature: Homolog annotation: Hit_ID=XP_393931.1; Match level="QueryCoverage =90%, HitCoverage=92%, E-value=1e-119, Identity=51%"; Hit description= similar to ENSANGP00000009426 [Apis mellifera]
  misc_feature: Gene Ontology Annotation: Molecular function=carboxypeptidase C activity; Cellular component=endoplasmic reticulum; Biological process=vacuolar protein catabolism
  misc_feature: Pfam annotation: Pfam_ID=Peptidase_S10; Match level="Score=413.8, E -value=2.2e-121, Copies=1"; Pfam description=Serine carboxypeptidase
  misc_feature (353)..(353): Xaa can be any naturally occurring amino acid
  misc_feature (377)..(377): Xaa can be any naturally occurring amino acid
MKSFLSISFGLFLFLGIESKSLNDNIVKKRVFADLYGKLNPTVRGDPGEPLILTDLIEAGKLDEAQDKARVQGLDTDIESYSGYLTVDKEHDSNLFFWFFPSQGNASFDPVVLWLQGGPGSTSMFGLFKENGPVLLKDGKLDIRETTWNKNNSLIYIDQPAGTGWSFTTDGYASNQTKVAADLYEALHQFFTLFYQYQHQDFYVTGESYAGKYVPAISYKIHQANTEAELKINLKGLAIGNGHTDPIEQIHYAEYAYQIGVIDLNARNILQGTQQRVVELIKSEDYAEAYDLWSDIIQTIQEFSALNIYNYLTIKDTVNDETEMNKFLSTEEVRKAIHVGNATFNPPDEVLRXLQEDFPKSEALHVAELLKYYRVLXIYSGQTDLMIPYVLTESYLQNLKFPGSDDYAKAERIVWHDENDPDVVAGYAKTAGNLTEILVRNAGHLVPTDQPEWALQLINKFTRNVTFI

SEQ ID NO: 21111 - protein, 143 aa, Diabrotica virgifera
  misc_feature: Coding regions on vcDNA: vcDNA=SeqID_808; Strand=+; Position=57-488
MMSAALVRKSLQIVDPQYGSKIGKRKSKSDVFALAHQSQKLIGKAQRKGKTEKVNLLSTEKKLTVTEARKYNKSKEQILKDNLKKLELIKRASKVELDEKLVKQIINRDVSRRPIKKIKPKQQKKTAFTEEDFKKFEEEYFDE

SEQ ID NO: 21112 - protein, 267 aa, Diabrotica virgifera
  misc_feature: Coding regions on vcDNA: vcDNA=SeqID_809; Strand=+; Position=120-920
  misc_feature: Homolog annotation: Hit_ID=NP_609062.2; Match level="QueryCoverage =100%, HitCoverage=76%, E-value=4e-96, Identity=57%"; Hit description= CG9232-PA [Drosophila melanogaster] gb|AAF52419.2| CG9232-PA [Drosophila melanogaster]
  misc_feature: Gene Ontology Annotation: Molecular function=UDP-glucose-hexose-1 -phosphate uridylyltransferase activity; Cellular component=cellular _component unknown; Biological process=galactose metabolism
  misc_feature: Pfam annotation: Pfam_ID=GalP_UDP_transf; Match level="Score=282.8, E- value=5.7e-82, Copies=1"; Pfam description=Galactose-1-phosphate uridyl transfer
  misc_feature (236)..(236): Xaa can be any naturally occurring amino acid
MSFNRDEHQHLRYNPLKSEWILVSPHRALRPWSGQVETPQVEVVPQFDPTNPLCPGVTRASGLVTPKYTSTYVFTNDFPALLEEGPEPEPSDDPLFQTKAAKGTCRVICYHPHSNVYLTNLKLDEVVAVINEWINQLNDLGKTYKWVQIFENRGAMMGCSNPHPHCQIWASTFLPNEARVKDENLREYFAKYNRPMLADYVQKEIQKKERVVYENDEWVVVVPYWALWPFETMVLXKRNIARFSEVDTKQKEALALTLQSIVAKYDN

SEQ ID NO: 21113 - protein, 83 aa, Diabrotica virgifera
  misc_feature: Coding regions on vcDNA: vcDNA=SeqID_810; Strand=-; Position=130-381
GRGHGGFIDVKTNVHFLMRSHIPRTVHGLPIHSRDLSSRFTAMSMPEQNSLFCHDRAVDRVVNFKFIGLYHLCSDLHCMGSTT

SEQ ID NO: 21114 - protein, 183 aa, Diabrotica virgifera
  misc_feature: Coding regions on vcDNA: vcDNA=SeqID_811; Strand=+; Position=58-609
  misc_feature: Homolog annotation: Hit_ID=NP_609936.1; Match level="QueryCoverage =100%, HitCoverage=100%, E-value=1e-90, Identity=88%"; Hit description=CG10470-PA [Drosophila melanogaster] gb|AAF53747.1| CG10470-PA [Drosophila melanogaster]
  misc_feature: Pfam annotation: Pfam_ID=DUF841; Match level="Score=473.5, E-value =2.2e-139, Copies=1"; Pfam description=Eukaryotic protein of unknown function
MWADTLLIVFISICTAFLGEGLTWVMVYRTEKYQKLKTEVEKQSKKLEKRKEIHGDSLDKQHKKKIEREEERLKNNNRDLSFVKMKSMFAIGFAFTALLSMFNSIFDGRVVARLPFQPLTWIQGLSHRNLPGEDYYDCSFIFLYILCTMSIRQNIQKLLGFAPSRAASKQGNSLFGPTPGQFK

SEQ ID NO: 21115 - protein, 314 aa, Diabrotica virgifera
  misc_feature: Coding regions on vcDNA: vcDNA=SeqID_812; Strand=+; Position=12-956
  misc_feature: Homolog annotation: Hit_ID=EAL28521.1; Match level="QueryCoverage =99%, HitCoverage=28%, E-value=1e-105, Identity=61%"; Hit description= GA10419-PA [Drosophila pseudoobscura]
  misc_feature: Gene Ontology Annotation: Molecular function=protein carrier activity; Cellular component=nuclear pore; Biological process =protein-nucleus import
  misc_feature: Pfam annotation: Pfam_ID=HEAT; Match level="Score=19.8, E-value =0.0086, Copies=2"; Pfam description=HEAT repeat
MAAEQEQFYQILTTLLSTDNVIRTQAEDAYSNLPVETKVSHLLGAIHNTSLSHEARQMSAVLLRRVFSNDFMEFYPKLPVESQNQLKEQVLLAVQQVETEQLRHKVCEVVAEVARNLIDDDGNNQWPEFLQFLFHCANDQNPVLKEAALQMFTSVPGVFGSQQNNYLDLIKQMILQSLQPTEEYEVRFQAVRAVGAFMLINDKETQILKHFADLLTPMLHVIAESIQQQEDDTLLKVLIDLAENVPKFLRPQLLPIYEMCMKIFSDSGALDSWRQLALEVMVTLAEMAPAMGRKNAAKYMEQLIPLILQFMGRP

SEQ ID NO: 21116 - protein, 206 aa, Diabrotica virgifera
  misc_feature: Coding regions on vcDNA: vcDNA=SeqID_813; Strand=+; Position=8-628
  misc_feature: Homolog annotation: Hit_ID=NP_649643.1; Match level="QueryCoverage =84%, HitCoverage=94%, E-value=9e-57, Identity=56%"; Hit description =CG10298-PA [Drosophila melanogaster] gb|AAF54137.1| CG10298-PA [Drosophila melanogaster]
  misc_feature: Gene Ontology Annotation: Molecular function=phosphatidylethanolamine binding; Cellular component=soluble fraction; Biological process =regulation of proteolysis and peptidolysis
  misc_feature: Pfam annotation: Pfam_ID=PBP; Match level="Score=235.6, E-value=9e -68, Copies=1"; Pfam description=Phosphatidylethanolamine-binding prot
MAKSVIFLVLCVLLVAADKTKDVTRELEAFKSNKVSPDVVSAIPDKLLQVTYKADKKVELGNELTPTQVLEQPQLSYEGDNKSFYTLILTDPDAPSRSNPKSREWNHWLVVNIPGSKISQGETISDYVGSAPPKGSGLHRYVFLLYKQPEKLKFDEPKHSPTDGNRGKFNTENFAKKYKLGNPIAGNFFQAQWDDSVPASHKKLGF

SEQ ID NO: 21117 - protein, 248 aa, Diabrotica virgifera
  misc_feature: Coding regions on vcDNA: vcDNA=SeqID_814; Strand=+; Position=163-909
  misc_feature: Homolog annotation: Hit_ID=XP_310821.1; Match level="QueryCoverage =90%, HitCoverage=81%, E-value=2e-75, Identity=53%"; Hit description =ENSANGP00000022752 [Anopheles gambiae]
  misc_feature: Gene Ontology Annotation: Molecular function=heparin binding; Cellular component=extracellular; Biological process=regulation of TGFbeta receptor signaling pathway
  misc_feature: Pfam annotation: Pfam_ID=Tsg; Match level="Score=186.9, E-value=4.1e -53, Copies=1"; Pfam description=Twisted gastrulation (Tsg) protein co
MLIQFVPLALLTASLFLLIDTGESCNEAVCGSVVSKCLLTKSCNCDLKNCTCCKECINCLSYLYSECCSCVDICPKPNDTATDLSRKSHVEEFDEGVPQLFSLLTDFPDTYKRWDSKSFPIDMELNYYEPKKEIKISMLSVEQEVDPAKQNTITVNCTVAFWAQCMSWRKCKTSCQSMGASSYRWFHDGCCECVGEYCIKYGINESRCSECPQSEESKQDSDDNEDDYDYGEHDEDDEDDDFHNSPNL

SEQ ID NO: 21118 - protein, 307 aa, Diabrotica virgifera
  misc_feature: Coding regions on vcDNA: vcDNA=SeqID_815; Strand=+; Position=3-926
  misc_feature: Homolog annotation: Hit_ID=XP_317705.1; Match level="QueryCoverage =69%, HitCoverage=29%, E-value=1e-56, Identity=56%"; Hit description =ENSANGP00000010250 [Anopheles gambiae]
  misc_feature: Gene Ontology Annotation: Molecular function=transcription co -repressor activity; Cellular component=nucleus; Biological process =locomotor rhythm
  misc_feature: Pfam annotation: Pfam_ID=bZIP_2; Match level="Score=77.9, E-value =2.6e-20, Copies=1"; Pfam description=Basic region leucine zipper
SLIRTRRVFSEIHCYYCAFVDIVSCSKVIKIFLRDVEKNFATTSANTADVIKQHIMVAEFVGRGQSGSPVNGEIPHLNSNLPSSHQLEMMASTSTSGDEFPPGSYGMSSVKHKELFSQRKQREFTPDNKKDDSYWDRRRRNNEAAKRSREKRRFNDMVLEQRVVELTKENAILKAQLEAIKEEYGICGENVVCVEKVLANLPSSEQVLSLSKRQKLAHPATPILYNPQTPIPTPVIHQPVMGSPPPQPIPHSHSVLHAPPSSHLEPAYREPDYHHPHYQLAYHTGISYDSNNALNLSRSRSRVQSPF

SEQ ID NO: 21119 - protein, 70 aa, Diabrotica virgifera
  misc_feature: Coding regions on vcDNA: vcDNA=SeqID_816; Strand=+; Position=953-1165
ERNTAMKCQHNVSYILKFKNIKEYQSKEETVIKNIAKGRRTNKIKCNDLNREVKREVITKKLGLGKSANL

SEQ ID NO: 21120 - protein, 307 aa, Diabrotica virgifera
  misc_feature: Coding regions on vcDNA: vcDNA=SeqID_817; Strand=+; Position=18-941
  misc_feature: Homolog annotation: Hit_ID=AAT38514.1; Match level="QueryCoverage =96%, HitCoverage=59%, E-value=1e-47, Identity=32%"; Hit description =antennae-rich cytochrome P450 [Phyllopertha diversa]
  misc_feature: Gene Ontology Annotation: Cellular component=membrane; Biological process=electron transport
MSFLYSSWALNYVIFCITIFFLLYKYFTRQFDYWNKRGVYTSKPVPFFGNVFDVVIFKRNLSEHIKKLYDETDEPYFGIFVFDKPVLVLKSPKLIKDILIKDFHMFCNRSLADGSHDKTISNFVFFQKNPKWNLTRKKLTSFFTSSMSKAFFTNIELINQKFIEHLENISEPVDAKAIAGHFSTEMIARCFFATDPRCFEKEPSKFRHCVHRIFQFSVRNGLIQTFYFLKPSLIKLFKLNFLETSVMEYFHKIFLEAMECRKDYDGKPVNAVDVVKQVQKKHNGEFPDQYLYISNTMFLLVAGHETN

SEQ ID NO: 21121 - protein, 265 aa, Diabrotica virgifera
  misc_feature: Coding regions on vcDNA: vcDNA=SeqID_818; Strand=+; Position=153-947
  misc_feature: Homolog annotation: Hit_ID=XP_392708.1; Match level="QueryCoverage =93%, HitCoverage=60%, E-value=3e-90, Identity=64%"; Hit description =similar to putative Na+-dependent inorganic phosphate cotransporter [Apis mellifera]
  misc_feature: Gene Ontology Annotation: Molecular function=inorganic phosphate transporter activity; Cellular component=integral to membrane; Biological process=phosphate transport
  misc_feature: Pfam annotation: Pfam_ID=MFS_1; Match level="Score=47.3, E-value=4.4e- 11, Copies=1"; Pfam description=Major Facilitator Superfamily
MARIRWLTRTSRIVALCSFANFINSADRVIMPIAIVPMTDIFGWSLHAQGWILSAFAFGYFTSQLLGSFWATQVGAKNVLICSVLLWSIATFTTPFLAGSLVSLIACRIILGFAEGLGLPTIFHLFAHNIPVEERSRAFSYLLASGSVGQTVASIVCPHLSWEACFYWFGSFGFLWLVLWHCFYHEDGFSSEETLPLHSQKVISHNIRWADFIFSKPLWAIYTAHFAMNWSSYIIMQWLPTYLSRYLGGMLIVKFNRGTYIVTLY

SEQ ID NO: 21122 - protein, 231 aa, Diabrotica virgifera
  misc_feature: Coding regions on vcDNA: vcDNA=SeqID_819; Strand=+; Position=320-1010
  misc_feature: Homolog annotation: Hit_ID=NP_729863.1; Match level="QueryCoverage =98%, HitCoverage=65%, E-value=2e-68, Identity=55%"; Hit description =CG11255-PB, isoform B [Drosophila melanogaster] gb|AAF49853.1| CG11255-PB, isoform B [Drosophila
  misc_feature: Gene Ontology Annotation: Molecular function=adenosine kinase activity; Cellular component=cellular_component unknown; Biological process=ribonucleoside monophosphate biosynthesis
  misc_feature (168)..(168): Xaa can be any naturally occurring amino acid
MEGDFIKNNLLIGMGNPLLDISAVVEKDLLQKYELKEDNAILAEEKHKPIYDELTAKYPVSYIAGGSVQNSLRVAQWLLEKPNVVTFFGCVGRDKYSKILYEEATSSGVNVKYQYSSASPTGTCAVLITGYNRSLCANLGAANDFTIDHLSDPENKKLIESAQFYYVXSGFFLTVNPAAQMEMAKYAVSKTRPFVMNLSAPFICSIFFQAFADALLLNTCWFGMDLKPKLY

SEQ ID NO: 21123 - protein, 293 aa, Diabrotica virgifera
  misc_feature: Coding regions on vcDNA: vcDNA=SeqID_820; Strand=+; Position=65-947
  misc_feature: Homolog annotation: Hit_ID=XP_392190.1; Match level="QueryCoverage =96%, HitCoverage=38%, E-value=1e-128, Identity=71%"; Hit description= similar to ENSANGP00000011385 [Apis mellifera]
  misc_feature: Gene Ontology Annotation: Molecular function=oxidoreductase activity, acting on single donors with incorporation of molecular oxygen; Cellular component=inclusion body; Biological process=cellular osmoregulation
  misc_feature: Pfam annotation: Pfam_ID=DUF706; Match level="Score=569.5, E-value =2.7e-168, Copies=1"; Pfam description=Family of unknown function (DUF706)
  misc_feature (66)..(66): Xaa can be any naturally occurring amino acid
MRVLNETGPVNIIDPSELLRPEPKFAKKPVGQFRDYSIDENDPIKERVRKTYELMHTNQTVDFVKXKIEKWTKFDHLKYSMKEALIKLNDLVDESDPDVDIPNIVHAFQTAERIRKDYPDDDWFHLTGLIHDAGKVLAFFDEPQWCVVGDTFVVGAEWSDNIVYRETSFKNNVDGKNPKYNTKYGMYKPNCGLENVMMSWGHDEYLYRVLVHNKTKLPPQALAMIRYHSFYPWHTSGDYKHLTTEKDEETKQWVLKFNQYDLYTKSTEVPDIEKLWPYYEKLIDKYIPGTLEW

SEQ ID NO: 21124 - protein, 245 aa, Diabrotica virgifera
  misc_feature: Coding regions on vcDNA: vcDNA=SeqID_821; Strand=+; Position=218-952
  misc_feature: Homolog annotation: Hit_ID=XP_315881.1; Match level="QueryCoverage =93%, HitCoverage=32%, E-value=1e-36, Identity=35%"; Hit description =ENSANGP00000017374 [Anopheles gambiae]
MGDTKNELIGRIETEEFYVNFLNPNSDNILNESIGIKEQVKKLAEGIELINQELHRQILEKHEDLLQQANNATKLETVLNSMNSHVKTLFIDAERLKTQITIPYNELEKHTKVLGRLHLASHILRQVNRLQQLSKRLTNTNDPVQKAILLQELEQLASDPELKDIDSVKNELRNIRVHQQKVVQLATGSLNQGAKNENITQTTTALQIFINIGTIESVANSFVDNNLHECRESLKLALSVSSFAS

SEQ ID NO: 21125 - protein, 211 aa, Diabrotica virgifera
  misc_feature: Coding regions on vcDNA: vcDNA=SeqID_822; Strand=+; Position=80-715
  misc_feature: Homolog annotation: Hit_ID=XP_392437.1; Match level="QueryCoverage =86%, HitCoverage=40%, E-value=3e-89, Identity=84%"; Hit description =similar to ENSANGP00000019428 [Apis mellifera]
  misc_feature: Pfam annotation: Pfam_ID=Oxidored_q6; Match level="Score=226.9, E -value=3.9e-65, Copies=1"; Pfam description=NADH ubiquinone oxidoreductase, 20 Kd
MLRSALVPCKDALTNPNILRNLTGSFGVVQLQKRGQSTQPVPAQRPYSPFKPDKNNLGEYAFARLDDLLNWGRKGSMWPLTFGLACCAVEMMHMAAPRYDMDRYGVVFRASPRQADVIIVAGTLTNKMAPALRKVYDQMPDPRWVISMGSCANGGGYYHYSYSVVRGCDRIIPVDIYVPGCPPTAEALLYGILQLQKKVKRMNTLQMWYRK

SEQ ID NO: 21126 - protein, 166 aa, Diabrotica virgifera
  misc_feature: Coding regions on vcDNA: vcDNA=SeqID_823; Strand=-; Position=203-703
  misc_feature: Homolog annotation: Hit_ID=CAA10770.1; Match level="QueryCoverage =87%, HitCoverage=44%, E-value=6e-21, Identity=31%"; Hit description =reverse transcriptase-like [Bos taurus]
  misc_feature (107)..(107): Xaa can be any naturally occurring amino acid
RIGKARSAFIMIKSLFRSHDLPLGTSIIIFSKLLYGVESWTLSEASLRKLEVFEMWCYRRILRISWMDRVTNVEVLRRIGKECEIINIIKERKLEYLGHVMRNEQRXGLLQLILQGKVFGKRGPGRRRISWLENLKKWFNTSTTGLFRIAASKVRIFMLIANIRNG

SEQ ID NO: 21127 - protein, 315 aa, Diabrotica virgifera
  misc_feature: Coding regions on vcDNA: vcDNA=SeqID_824; Strand=-; Position=459-1405
  misc_feature: Homolog annotation: Hit_ID=CAA10770.1; Match level="QueryCoverage =98%, HitCoverage=92%, E-value=4e-38, Identity=29%"; Hit description =reverse transcriptase-like [Bos taurus]
  misc_feature (86)..(86): Xaa can be any naturally occurring amino acid
  misc_feature (115)..(115): Xaa can be any naturally occurring amino acid
  misc_feature (119)..(119): Xaa can be any naturally occurring amino acid
  misc_feature (180)..(180): Xaa can be any naturally occurring amino acid
  misc_feature (189)..(189): Xaa can be any naturally occurring amino acid
  misc_feature (191)..(191): Xaa can be any naturally occurring amino acid
NQTANIKVDDQLTEAVSIGRGLTKGCILSPVLFYIYSKYIFEQPLGELQEGVLANGVRLNNIRYADDAVVFADILDGFQVRMSLIXDVSKKHGLDLNRKKPSTCVFSTSEILKTXAVGXLITTIDTFLGTQINSQWDHLSEIKQRIGKARSAFILMKSLFRSHDLLPATKFSIIRCQVFXTLLYGVEAXHXSEASLRKLEAFEMWCYRRILRISWVDRVTNIEVLRRIGKECEIINIIKERKLEYLGHVMRNEQRYGLLQLILQGKVFGKRGPGRRRISWLQNLRKWFNTSTTGLFRIAASKVRIAMLVANIRNG

SEQ ID NO: 21128 - protein, 560 aa, Diabrotica virgifera
  misc_feature: Coding regions on vcDNA: vcDNA=SeqID_825; Strand=+; Position=399-2081
  misc_feature: Homolog annotation: Hit_ID=XP_396585.1; Match level="QueryCoverage =93%, HitCoverage=68%, E-value=0.0, Identity=70%"; Hit description =similar to CG4928-PB [Apis mellifera]
  misc_feature: Pfam annotation: Pfam_ID=DUF895; Match level="Score=-13.2, E-value =6.5e-07, Copies=1"; Pfam description=Eukaryotic protein of unknown functio
MTASLGVGGDSGGDNASHGHDGTNNHNDVYTVSVTGAYDNKAFKGDANNGEPKKPPREISDEEAFQQGKFKMSTREKWRILKNVSAISCAFMIQFTAFQGTANLQSSINAKDGLGTVSLSAIYAALVVSCIFVPTFAIKKLTVKWTLCFSLLCYAPYIAAQFYPRFYTLIPAGILVGIGAAPMWASKATYLTQVAGVYAKLTDQAVDGIIVRFFGFFFLAWQTAELWGNLISSLVLSNPHGSASNHANATPNYDVCGASFCVSTINNNGNLERPDDKEIYEISIIYLACILCAAVVIALVVDPLTRYGEKQGRRASQVELSGIQLLSATAYQLKKPYQQLLIPITVWIGMEQAFIGADFTQAYVSCALGIPSVGYVMICFGCVNAICSLLFGSIMKYIGRAPIMGLGLLVHAGLQTWMLIWKPHPDTPYQFFMAAGLWGVGDAVWQTQVNGLYGTLFRRNKEAAFSNYRLWESVGFVIAYAYSTHICARMKLYVQLTILLSGFLLYVIVEIHHLHKIRRQKEKERKAAEAAKNKEILPPEPEETDDEKDDIDDEIIVTHL

SEQ ID NO: 21129 - protein, 244 aa, Diabrotica virgifera
  misc_feature: Coding regions on vcDNA: vcDNA=SeqID_826; Strand=+; Position=38-772
MVILCILSVFFLCTTDALPSKRGLWRHVEPSQSGYMIGGYYKNPSPNQDYYPSMTAFVTKDVVATNTFAGLPQEQGWNSDSREEFTERVPATQDIPNRTPEIAIENGDSAEGSAANNNNINKTNRKGRKPSRPQQEEEEESPWWASKSGGPSFTSFFPINISGGGGGNWKRRSAGSGAQDDNDIPYSPSSGSATAIANSFSTGRGGVATSHATSFGDPYLAAMFLRNGYNLKGHGQQRGGATNY

SEQ ID NO: 21130 - protein, 136 aa, Diabrotica virgifera
  misc_feature: Coding regions on vcDNA: vcDNA=SeqID_827; Strand=+; Position=211-621
  misc_feature: Homolog annotation: Hit_ID=AAK92192.1; Match level="QueryCoverage =97%, HitCoverage=100%, E-value=2e-64, Identity=91%"; Hit description= ribosomal protein S24 [Spodoptera frugiperda] sp|Q962Q6|RS24_SPOFR 40S ribosomal protein S24
  misc_feature: Gene Ontology Annotation: Cellular component=cytosolic ribosome (sensu Eukarya); Biological process=protein biosynthesis
  misc_feature: Pfam annotation: Pfam_ID=Ribosomal_S24e; Match level="Score=160.7, E -value=3.2e-45, Copies=1"; Pfam description=Ribosomal protein S24e
MIAKMTEGTATIRTRKFMTNRLLARKQMVVDVLHPGQPSVKKTEIREKLAKIYKVLPDVVFVFGFRTNFGGGKSTGFALIYDTLDFAKKFEPKHRLARHGLYEKKQQTRKQRKERKNRMKKVRGTKKSKVGASAKK

SEQ ID NO: 21131 - protein, 535 aa, Diabrotica virgifera
  misc_feature: Coding regions on vcDNA: vcDNA=SeqID_828; Strand=+; Position=12-1619
  misc_feature: Homolog annotation: Hit_ID=XP_393670.1; Match level="QueryCoverage =94%, HitCoverage=77%, E-value=1e-115, Identity=45%"; Hit description= similar to putative carboxylesterase [Apis mellifera]
  misc_feature: Gene Ontology Annotation: Molecular function=carboxylesterase activity; Cellular component=extracellular space; Biological process= acyl-CoA metabolism
  misc_feature: Pfam annotation: Pfam_ID=COesterase; Match level="Score=262.2, E -value=9.2e-76, Copies=1"; Pfam description=Carboxylesterase
MISSVFLVLFYLTNPSFCDERGPRVKRIVGGIPAEEPPADDPTIFTNFAGRSARVQGILDYPHYVFRGIKFAYPPIGKNRFLRPREKLLDGLINATYYAPPCIQPRPGTNQVIGSEDCLALNVFTPELPTGTEGLPVVVWIHGGGFRYGSASQYGVRHLVGKRLVVVTIQYRLGSLGFISSGTKHLPGNVALWDMALAVQWVRNYIGFFGGNPYRINVMGHGTGASSVLMIALSNIAKGIPAGVIAMSGTAVSSWAVDNTPQHTAYNIARQNGCPTADPLTMVKCLQTLPPDSIIRGDSQIEFTQISNRGFMAGLSGGLGSAPVTEGRDDGRSLPGIILEDSMDEMQAGKTKGIPLLTGICKDETKRAVKGPFKDDVLNKLNTIPNFLNTHLIQNLRKLIPLKIQINLKEIKAKFEENFQKGLESIENILGQLVPPNFSNYVKLKTGKLHEALDKVADITNDALFNVPAFLTADTWSIHGAPTYLYSFDHFGKNKKGHTFLKGSPLVGNDTHFVELNDTSGHGDDLAYLFDAYDV

SEQ ID NO: 21132 - protein, 73 aa, Diabrotica virgifera
  misc_feature: Coding regions on vcDNA: vcDNA=SeqID_829; Strand=+; Position=371-592
LIVGHHKPLPTRFTKYIHRTSQLQTAPHRCYSAQRFPKSSGPSYEYTQELQKIRVFFSLFQFIPINILVFTLQ

SEQ ID NO: 21133 - protein, 161 aa, Diabrotica virgifera
  misc_feature: Coding regions on vcDNA: vcDNA=SeqID_830; Strand=+; Position=144-629
  misc_feature: Homolog annotation: Hit_ID=XP_313999.1; Match level="QueryCoverage =92%, HitCoverage=85%, E-value=1e-54, Identity=64%"; Hit description =ENSANGP00000009917 [Anopheles gambiae]
  misc_feature: Gene Ontology Annotation: Molecular function=structural constituent of ribosome; Cellular component=mitochondrial small ribosomal subunit; Biological process=protein biosynthesis
MAMLVPAINKSFMLLGQCVPCLKQGASKFKVKRLELDTNLNMFFPKHEFVYAHDPEKKCKSGDIVIVELLPERLTRLITHRVKEVLYPYGDITDPVTNKKVVAGKYRDHIEDINKVYGEKKSSFNYKNAPSRGWQEDKKDFTHLETYIKYHESGEDDPKAV

SEQ ID NO: 21134 - protein, 117 aa, Diabrotica virgifera
  misc_feature: Coding regions on vcDNA: vcDNA=SeqID_831; Strand=+; Position=72-425
MKSVFVIVFFACFGIILSAKLPTPAPSPTPEPDDLVCGVCFMIGNIMEAFKKEDIPKETATSQKTFVCEVVFATEETRQLCLDSYLEEVDSFYDEVDTDTVMDKCIQLKKCPASGSY

SEQ ID NO: 21135 - protein, 248 aa, Diabrotica virgifera
  misc_feature: Coding regions on vcDNA: vcDNA=SeqID_832; Strand=+; Position=108-854
  misc_feature: Homolog annotation: Hit_ID=CAD43178.1; Match level="QueryCoverage =99%, HitCoverage=99%, E-value=1e-107, Identity=77%"; Hit description= triosephosphate isomerase [Tenebrio molitor]
  misc_feature: Gene Ontology Annotation: Molecular function=triose-phosphate isomerase activity; Cellular component=cytosol; Biological process =gluconeogenesis
  misc_feature: Pfam annotation: Pfam_ID=TIM; Match level="Score=566.8, E-value=1.8e -167, Copies=1"; Pfam description=Triosephosphate isomerase
MASRRFVVGGNWKMNGTKKQIEEICNFLQAGPLDPNTEVVVGVPAVYLEHVRSKLPATIGVAAQNCYKEEKGAFTGELSPLMLKDIGIDWVIIGHSERRQIFKETDALIAEKVKFALEKGLKVIACIGETLEQRESGKTEEVVFSQTQTIACLVKDWTNVVIAYEPVWAIGTGKTATPQQAQDVHKALREYIAKNIGEDVAKSVRIQYGGSVTGGNCKELAAMPDIDGFLVGGASLKPEFVSIVNARQ

SEQ ID NO: 21136 - protein, 294 aa, Diabrotica virgifera
  misc_feature: Coding regions on vcDNA: vcDNA=SeqID_833; Strand=+; Position=41-925
  misc_feature: Homolog annotation: Hit_ID=XP_312568.1; Match level="QueryCoverage =92%, HitCoverage=58%, E-value=9e-50, Identity=39%"; Hit description =ENSANGP00000014917 [Anopheles gambiae]
  misc_feature: Gene Ontology Annotation: Molecular function=acid phosphatase activity; Cellular component=integral to membrane; Biological process=regulation of cell cycle
  misc_feature: Pfam annotation: Pfam_ID=Acid_phosphat_A; Match level="Score=-60.3, E- value=9.7e-05, Copies=1"; Pfam description=Histidine acid phosphatase
MREIVVLLLLVLFQLCLGKPVENNGDELVGVAVCYRHGDRAPVSSFPNDPYIDAKYWPDGIGELVNKGKVHQFQLGQWLRRRYKNFLSTRYYPIELYVRSTDVDRTLNSAASNLAGLYYPDGSPYPVEWPQELPWNPVPIHTVEYKKDAVLAMKKECKNFEKLYQETLDSEYFKNVMKNHTELKEFVESKTGWNVTLDLFRNLWTVLYIYNETNSSYVPDWANEIDQAELAQLAGLSFSTETFTTKLQRFKVGPFFDYLNNYFDRILNGTNPKFLMLSAHDGTIASILNTLRRL

SEQ ID NO: 21137 - protein, 176 aa, Diabrotica virgifera
  misc_feature: Coding regions on vcDNA: vcDNA=SeqID_834; Strand=+; Position=8-538
  misc_feature: Homolog annotation: Hit_ID=XP_318997.1; Match level="QueryCoverage =81%, HitCoverage=35%, E-value=3e-17, Identity=32%"; Hit description =ENSANGP00000014755 [Anopheles gambiae]
  misc_feature: Pfam annotation: Pfam_ID=Chitin_bind_4; Match level="Score=54.5, E -value=2.9e-13, Copies=1"; Pfam description=Insect cuticle protein
MLLKALICFCALWSVASARPKAQYSNDGQYDNGNQYDNGNQYDNGNQYDNNNGFAPSAGGHNQAYQDSRSAVITRYDSDNDGAGTYNYNITQSDGIYNEQYGTIENEGTEDESSRVYGYYAYPGPNGEFYYVEYVADKDGFKPAGKHIPQSAGVGRVGQLGIPSAAIASLAGGGLG

SEQ ID NO: 21138 - protein, 422 aa, Diabrotica virgifera
  misc_feature: Coding regions on vcDNA: vcDNA=SeqID_835; Strand=+; Position=17-1285
IFNTQTSDIYEKVIMSIFEVLIILAGYTTVLFLDQEVDINKNNCNIIGGSGTFSKLTQLQHNLSHCVDEHSKGIPINKINVAKIPIYHTSCLGRQAISGCYEPLISASKQCLNITESYLVDIWQNIDKELIAYTCKNEDKVQKYTKEYTAECMNEGILKIQEKCLGLSSNPMSPMREMSQITCKKFEDAEDCIMETLSNHCSQNITDVVVSVIKILKTNACSYAPKHRSRRSLHRVVRQLAMSDKMDRIEEHLKTKCIKNGLDSKKLEDSVTKMKSCIKEKPLFLTPKHIYIKHVDGCTKEVIKTLKACLPEKYKYLPQLIFDVFDSMISFMYDDFILISSELTPCLPKLKSEESTTEYNECNRKVTDIVEDELVESKEKFCERYIHLNECFIAQVKKQCAPSAELTKFEKDYMNAVKKPCE

SEQ ID NO: 21139 - protein, 355 aa, Diabrotica virgifera
  misc_feature: Coding regions on vcDNA: vcDNA=SeqID_836; Strand=+; Position=2-1069
  misc_feature: Homolog annotation: Hit_ID=NP_651221.1; Match level="QueryCoverage =98%, HitCoverage=63%, E-value=1e-95, Identity=53%"; Hit description =CG6178-PA [Drosophila melanogaster] gb|AAF56245.1| CG6178-PA [Drosophila melanogaster]
  misc_feature: Pfam annotation: Pfam_ID=AMP-binding; Match level="Score=142.4, E -value=1e-39, Copies=1"; Pfam description=AMP-binding enzyme
PRVRCSSGTTGLPKGVMCTHDNMTAYVDISRAIMGDMVERHDPDRERPPLIPFFHSFGFMLMFLNLLRGKCMVVLGRFKPKIFLESVVKYKVARMIVPPPVLLFLLKSPMTQNYDLSCIKEMRSGAAPMGKDMEKELKERFNVKHVSQAYGMTETTLGVLVSPHGKGKIGSCGKIVPGMMAKVIDDNGVPLPAYGEGEVCFKGPLIMKGYIGDPKSTHSTIDKDGWLHTGDVAYYDSDGYFFIVDRIKELIKYKAFQVAPAELEALLLTNSAIQDAAVIGLPNEEAGELPMAFIVKKVGKDITEREVEKFIEDNVSPQKRLRGGVIFLNEIPRNPSGKILRRVLRERAVKYTSKL

SEQ ID NO: 21140 - protein, 271 aa, Diabrotica virgifera
  misc_feature: Coding regions on vcDNA: vcDNA=SeqID_837; Strand=+; Position=271-1086
  misc_feature: Homolog annotation: Hit_ID=NP_651221.1; Match level="QueryCoverage =93%, HitCoverage=46%, E-value=3e-32, Identity=33%"; Hit description =CG6178-PA [Drosophila melanogaster] gb|AAF56245.1| CG6178-PA [Drosophila melanogaster]
MALESLKNIVVGPELERIIDTSLGELLLLVLKTFEDNVIQVDGETGEELPANLLLKRSIRLSKWLTSQGIKVGDNISINSENRLEFCIVPVGTLLSGATFAPLNPDYTPLELKHVLSLSKPKFIFCSNKTIDKMVSVLPEHPYIQKLILFGNEACKYQNVIRYADIVRGVESEELDDDFHSVPLDPVDSVATILCSSGTTGLPKGVMCTHDNMTAYVDISRAIMGDMVENDDPSDAMMGLIPFFHSFGFMLMFLNPLPGGRRRGLGFKGTK

SEQ ID NO: 21141 - protein, 326 aa, Diabrotica virgifera
  misc_feature: Coding regions on vcDNA: vcDNA=SeqID_838; Strand=+; Position=92-1072
  misc_feature: Homolog annotation: Hit_ID=EAL39852.1; Match level="QueryCoverage =95%, HitCoverage=98%, E-value=1e-109, Identity=64%"; Hit description= ENSANGP00000027407 [Anopheles gambiae str. PEST] ref|XP_556168.1| ENSANGP00000027407 [Anopheles gambiae s
  misc_feature: Gene Ontology Annotation: Molecular function=molecular_function unknown; Cellular component=integral to membrane; Biological process= biological_process unknown
  misc_feature: Pfam annotation: Pfam_ID=UPF0005; Match level="Score=142.1, E-value =1.3e-39, Copies=1"; Pfam description=Uncharacterised protein family UPF000
MSQWNKEQYPPPPGGQGYYGGQPGYGQPGYPPPQAGYPPQGGYPPQGGYPPQGGGYPTAPQPGYPPAGPQPGFQPPPPQYGADYAADNYGTGYNGGEDPEVKGFDFNDASIRRGFIRKVYSILSVQLLITLAFICWFVYHAPTRKYVQTHHALFYISLVMVIVALIALACCGELRRKAPANYIFLLIFTLADAWGLACASSTYKADAVAIAVGITAAVCLGLTLFAFQTRWDFTMMGGILFVAVLILFLFGIVAIFVHNKIVQLVYASLGALIFSVYLVYDTQLMMGGKHKYSISPEEYIFAAINLYVDVINIFMYILAIVGRARD

SEQ ID NO: 21142 - protein, 370 aa, Diabrotica virgifera
  misc_feature: Coding regions on vcDNA: vcDNA=SeqID_839; Strand=+; Position=44-1153
  misc_feature: Homolog annotation: Hit_ID=EAL24704.1; Match level="QueryCoverage =93%, HitCoverage=51%, E-value=7e-81, Identity=44%"; Hit description =GA18446-PA [Drosophila pseudoobscura]
  misc_feature: Gene Ontology Annotation: Molecular function=RNA binding; Cellular component=nucleolus; Biological process=rRNA processing
  misc_feature: Pfam annotation: Pfam_ID=RRM_1; Match level="Score=130.3, E-value =4.5e-36, Copies=2"; Pfam description=RNA recognition motif. (a.k.a. RRM, R
  misc_feature (353)..(353): Xaa can be any naturally occurring amino acid
MVGHGRKKKPLAKEEVKEKLLAKKKEAKQLLKEKRARLVVKNISFKVTPEKLKKHFEKYGEVKSVELLRKPDGKLTGCAFVQFSLVQKAAKARHYTNDQEFLGRKIVVDFAKAKNKYQKEQQLKKVEIKNEDGTKEIIEIKEDDDDVSVKSENVDDQEIKDEPENSDSDSEKFDNEDANSDDSDDKDEDIKEEKQLDSVKKPYLSHDVAEGKTVFVKNVPFDATNDDLKQCMKQFGRVYYALVCFDKLTEHSKGTAFVKFVNAEDAQKALSAGTELKLLGNILDCHPALDKGDVNKKVTQEKESKNVPKDSRNLYLVKEGVILAGSKAAEGVSATDMAKRLQIEQYKTQMLRXLNMFVSKERIVVHNLPS

SEQ ID NO: 21143 - protein, 186 aa, Diabrotica virgifera
  misc_feature: Coding regions on vcDNA: vcDNA=SeqID_840; Strand=+; Position=404-961
  misc_feature: Homolog annotation: Hit_ID=XP_314330.1; Match level="QueryCoverage =98%, HitCoverage=68%, E-value=2e-52, Identity=54%"; Hit description =ENSANGP00000012724 [Anopheles gambiae]
  misc_feature: Gene Ontology Annotation: Molecular function=protein binding; Cellular component=integral to plasma membrane; Biological process =cell adhesion
  misc_feature: Pfam annotation: Pfam_ID=Tetraspannin; Match level="Score=149.2, E -value=9.3e-42, Copies=1"; Pfam description=Tetraspanin family
  misc_feature (149)..(149): Xaa can be any naturally occurring amino acid
MFTCCIKYLLCAFNFIIFLSGTAILGVGLWLKIDKNSFIGLLKIVPYDQVQDFTKPGVIEHLSYLLMGIGGIMFIVSFLGYCGAMRESQCMLTTYGLLLLVILILEITAGCLAIIYKGTAETEVKNVLKTSLSKYYSNSENGSAANLAXDGVQISLKCCGVDDYADYQKNENWAQGDKSIPRSCCV

SEQ ID NO: 21144 - protein, 117 aa, Diabrotica virgifera
  misc_feature: Coding regions on vcDNA: vcDNA=SeqID_841; Strand=+; Position=97-447
  misc_feature: Homolog annotation: Hit_ID=XP_308810.1; Match level="QueryCoverage =97%, HitCoverage=80%, E-value=7e-28, Identity=51%"; Hit description =ENSANGP00000009906 [Anopheles gambiae]
  misc_feature: Gene Ontology Annotation: Molecular function=tubulin binding; Cellular component=cytoplasm; Biological process=tubulin folding
  misc_feature: Pfam annotation: Pfam_ID=KE2; Match level="Score=59.2, E-value=1.2e -14, Copies=1"; Pfam description=KE2 family protein
MTNTSSKGNFQPDSDVHITYEDQQKINRFARLNAKLEDLKDEIKRKENDLKSIEDACDEIALFDDDEHIPYLVGEAFIYQNVEKTQKCLEDTKNKIEEGIKELKVKSNEVKDTMSDL

SEQ ID NO: 21145 - protein, 218 aa, Diabrotica virgifera
  misc_feature: Coding regions on vcDNA: vcDNA=SeqID_842; Strand=+; Position=74-730
  misc_feature: Homolog annotation: Hit_ID=XP_314570.1; Match level="QueryCoverage =99%, HitCoverage=81%, E-value=7e-61, Identity=55%"; Hit description =ENSANGP00000017984 [Anopheles gambiae]
  misc_feature: Gene Ontology Annotation: Molecular function=neurotransmitter transporter activity; Cellular component=clathrin coat of coated pit; Biological process=synaptic vesicle coating
  misc_feature: Pfam annotation: Pfam_ID=Clathrin_lg_ch; Match level="Score=85.4, E -value=1.5e-22, Copies=1"; Pfam description=Clathrin light chain
MSGFGDNFGVADEDPAAEFLAREQDELAGLEDEVKPAAVIAPVLNGDDPTNSASSFEMVENNGPDGFLEEPKFNDIPADFDPDKEYRERVSPLTIRQEDRVEPEKIRLWREEQIKRLEEKDQEEEKKKQELREVAKKELEDWYKNHEEAIAKTKAANRNAEKQFVAEDDELEPGTEWERIAKLCDFNPKAKQGSKDVSRMRSIVLQMKQNPVPIKNKA

SEQ ID NO: 21146 - protein, 304 aa, Diabrotica virgifera
  misc_feature: Coding regions on vcDNA: vcDNA=SeqID_843; Strand=-; Position=3-914
  misc_feature: Homolog annotation: Hit_ID=AAR82779.1; Match level="QueryCoverage =100%, HitCoverage=77%, E-value=1e-114, Identity=42%"; Hit description=LD31436p [Drosophila melanogaster]
  misc_feature: Gene Ontology Annotation: Molecular function=molecular_function unknown; Cellular component=synaptic junction; Biological process =regulation of protein activity, epigenetic
  misc_feature: Pfam annotation: Pfam_ID=Ank; Match level="Score=90.4, E-value=4.6e -24, Copies=3"; Pfam description=Ankyrin repeat
LAFFQESHEVVSLLLDRKANIEHRAKTGLTPLMEAASGGYVDVGRVLLDKGADVNATPVPSSRDTALTIAADKGHVRFVELLLCRGAQVEVKNKKGNSPLWLAANGGHLPVVELLYNVKADIDSQDNRKVSCLMAAFRKGHFKVVKWMVHHVTQFPSDQEMMRYNATVSDKELLEKCQECVKIIRAAKETQAAKANKNASILLEELESEKTREESKRLAAARRRERKKKKKLEKKEERRKLLEENKKNENYDDKGDSKDEEKVEEEESSVPEVNPTIRNGDSNDKEEGDSGIDANSQGSCSSAD

SEQ ID NO: 21147 - protein, 68 aa, Diabrotica virgifera
  misc_feature: Coding regions on vcDNA: vcDNA=SeqID_844; Strand=-; Position=599-805
  misc_feature (12)..(12): Xaa can be any naturally occurring amino acid
CPFVSKAITIFXITSHYIVNCQQTSVQYQNKCYYDVKKSKRDVISILFLRLSETTHLETLQKKRALLC

SEQ ID NO: 21148 - protein, 399 aa, Diabrotica virgifera
  misc_feature: Coding regions on vcDNA: vcDNA=SeqID_845; Strand=+; Position=16-1215
  misc_feature: Homolog annotation: Hit_ID=AAB94557.1; Match level="QueryCoverage =97%, HitCoverage=98%, E-value=1e-80, Identity=40%"; Hit description =hemocyte protease-1 [Manduca sexta]
  misc_feature: Gene Ontology Annotation: Molecular function=serine-type endopeptidase activity; Cellular component=integral to membrane; Biological process=cytoskeleton organization and biogenesis
  misc_feature: Pfam annotation: Pfam_ID=Trypsin; Match level="Score=228.6, E-value =1.2e-65, Copies=1"; Pfam description=Trypsin
MKAIAVFLLVKLLNLCHGIAINSEIKTDVSRSIYDEKVHAAFLNRDHIRRKRYLGLSKKFKLNKRYQECIGPGDVKGHCKHIAYCPTSIFQQLNTLDYLCVIEQSFVGVCCPDDIASAGVVGSQLIIDLPAGGDDYDVGDKYTGCGLAVEGRTKVETKTTSTQEWPWMAALYRYRQHMILHIENQFCGGVLITDTHILTAAHCTQGLVASEIRVRLGEYDFNRPDESRSKDYEVAEIIDHEYFVLPTYENDMSILRLKTATSFNSYIWPICMPPRDGDYTNETVVVAGWGQTVFAGSVSPILLQVAMPVWPLDKCMDAFVQKITDDNICAADYEGGKDSCLGDSGGPLMYKLKNGRWITIGIVSWGIGCGNKGTPGIYTKVGNYLPWIIKHTMAKKIAT

SEQ ID NO: 21149 - protein, 328 aa, Diabrotica virgifera
  misc_feature: Coding regions on vcDNA: vcDNA=SeqID_846; Strand=+; Position=26-1012
  misc_feature: Homolog annotation: Hit_ID=XP_309465.1; Match level="QueryCoverage =78%, HitCoverage=96%, E-value=4e-29, Identity=30%"; Hit description =ENSANGP00000022079 [Anopheles gambiae]
TRFVKICRYLSDCYQYLFVIFAKAWSRSLVSFGIVTLVLHLHCVQGLKDDCDKLGILLYEDVGCTPVLAPGKSCPIKYECDLAIRNNTCLFRGTEISTTTRPTDVDFGSCNVGCFCNKDLPYDPAEIDKMFNNQPYNIPGKFTCAILDCPEWLGAFPLQKDCYRKYKLDQCCADGQMCPQDKPGNCEVDGKTVLEGQRFYPKDTCTHCVCPKNFNGKLEAPHCRRQFCNVQVRKQREVSSYCAPYYSEFEGETLCCPSSWICPSDEQKIITVNPKAEKSADLTCQYGKKKVQLGEGFETTVKGYDNVERAAKCECVIPPFLTCRQVKK

SEQ ID NO: 21150 - protein, 124 aa, Diabrotica virgifera
  misc_feature: Coding regions on vcDNA: vcDNA=SeqID_847; Strand=+; Position=503-877
INLNKSKIYLFDISIWRLFVSAETKTYISGQQFRVLITSVYSRSHALVWHTYDIFICIFAVPRLKIIRDIEMPFSDLDSGCKITWRSIGRSAPSIYSSGNAQTKRLCEFINKTKFSLKRSNRSN

SEQ ID NO: 21151 - protein, 449 aa, Diabrotica virgifera
  misc_feature: Coding regions on vcDNA: vcDNA=SeqID_848; Strand=+; Position=25-1374
  misc_feature: Homolog annotation: Hit_ID=BAC99308.1; Match level="QueryCoverage =98%, HitCoverage=98%, E-value=1e-126, Identity=48%"; Hit description= beta-1,3-glucan recognition protein [Tenebrio molitor] sp|Q76DI2|BGBP_ TENMO Beta-1,3-glucan binding prote
  misc_feature: Pfam annotation: Pfam_ID=Glyco_hydro_16; Match level="Score=-27.3, E -value=9.1e-06, Copies=1"; Pfam description=Glycosyl hydrolases family 16
RFRLWSFGFAFVKAQYEVPDAVVEVYEPKGFTVSIPDEEGIKLFAFHGKINEDFDGLEAGTFARDILKPRNGSWTFRDRETRLKKGDIIYYWLYVDYNNGRNTLGYRKTDQQYEVREFSNNPNAPVNRVKPTTEPTSTAKLILFDDFSTKRDDFWTVEQRYADAPDYEFVLYVNKPEVFQIKDSNLHIRPVPSEDIFGNGFLTSEYDLGNSCTAPIGTTDCKRKYDAGFILPPIASAQLTTKNKVAFKYGKIEVRAKLPKGDWIYPEIYLTPANEKYGLKSQSGQIRIAFTPGNSDLNHVLHGGLTIGRSVAATNYFDKTIESKMSSWSDDFHTFRVDWKPNEISFSVDGTVYGNIYPPARGLASLGPTLNLNTDKWKEGTLMAPFDQEMYLTLGVGVGGFVFKESPSKPWRNGERNSFQVFNSARQQWQRTWSDDRKLEVEYVQITSL

SEQ ID NO: 21152 - protein, 162 aa, Diabrotica virgifera
  misc_feature: Coding regions on vcDNA: vcDNA=SeqID_849; Strand=+; Position=103-591
  misc_feature: Homolog annotation: Hit_ID=XP_392758.1; Match level="QueryCoverage =95%, HitCoverage=48%, E-value=5e-81, Identity=93%"; Hit description =similar to ENSANGP00000011120 [Apis mellifera]
  misc_feature: Gene Ontology Annotation: Molecular function=protein binding; Cellular component=ubiquitin ligase complex; Biological process =reproduction
  misc_feature: Pfam annotation: Pfam_ID=Skp1; Match level="Score=192.4, E-value=9.6e- 55, Copies=1"; Pfam description=Skp1 family, dimerisation domain
MPNIKLQSSDGETFEIDVEIAKCSVTIKTMLEDLGMDEEEEEVVPLPNVNSAILRKVIQWATYHKDDPPPPEDDDNKEKRTDDISSWDADFLKVDQGTLFELILAANYLDIKGLLDVTCKTVANMIKGKAPEEIRKTFNIKNDFTASEEEQVRKENEWCEEK

SEQ ID NO: 21153 - protein, 244 aa, Diabrotica virgifera
  misc_feature: Coding regions on vcDNA: vcDNA=SeqID_850; Strand=+; Position=65-799
  misc_feature: Homolog annotation: Hit_ID=EAL34400.1; Match level="QueryCoverage =77%, HitCoverage=50%, E-value=2e-56, Identity=59%"; Hit description =GA19915-PA [Drosophila pseudoobscura]
  misc_feature: Gene Ontology Annotation: Molecular function=RNA binding; Cellular component=nucleus; Biological process=regulation of transcription from Pol II promoter
  misc_feature: Pfam annotation: Pfam_ID=dsrm; Match level="Score=147.3, E-value=3.4e- 41, Copies=2"; Pfam description=Double-stranded RNA binding motif
MESQNMTMMHSAGPIQPPPREGGGPHPNRRGNRKGHGPLHGNLPTERLSLGEEAKLLYSQEMASMPSKTPVSVLQELLSRRGITPKYELVQIEGAIHEPIFRYRVFLNNDLVATGTGRSKKDAKHSAAKNLLDLLVGKVTPEQANQTNGTPGAADITNQVVTSFDDKVMGNPIGWLQEMCMSRRWPPPFYEMEHEEGLPHERQFTIACHVLKFREIGTGKSKKLAKRMAAHKMWQSLQDLPRGG

SEQ ID NO: 21154 - protein, 290 aa, Diabrotica virgifera
  misc_feature: Coding regions on vcDNA: vcDNA=SeqID_851; Strand=+; Position=18-890
  misc_feature: Homolog annotation: Hit_ID=AAH60482.1; Match level="QueryCoverage =63%, HitCoverage=40%, E-value=4e-32, Identity=41%"; Hit description =MGC68721 protein [Xenopus laevis]
  misc_feature: Gene Ontology Annotation: Molecular function=phospholipase A1 activity; Cellular component=extracellular space; Biological process= phosphatidylserine metabolism
  misc_feature: Pfam annotation: Pfam_ID=Lipase; Match level="Score=60.7, E-value =2.8e-16, Copies=1"; Pfam description=Lipase
MKLQYLSLLVLVAVFTATNCSTYLPERLLGDITSPVNFDDANLNETEVVFDAYKVLDRGTNKNGIKGSHFDIYPTRFFIHGYSQNGQSYWVLTARNAYLEKKVPHNVVIVDWAKGAANFEKAAANTKKLGELIGKYIIDNEIELEDLQLVGFDIGAHAAGQAGKYIANLTGHYVSRITGLDPAAPKFELDSVPPENKLQKTDAIFVDVIHTNVQKLGYKVPIGHVDWYVNGGNEQPGCPTLMMPETDVCSHLRVCDLYVEFNHYQATPYECTVTIENGTSTVTKRPSGKP

SEQ ID NO: 21155 - protein, 466 aa, Diabrotica virgifera
  misc_feature: Coding regions on vcDNA: vcDNA=SeqID_852; Strand=+; Position=26-1424
  misc_feature: Homolog annotation: Hit_ID=XP_310255.1; Match level="QueryCoverage =98%, HitCoverage=54%, E-value=1e-134, Identity=49%"; Hit description= ENSANGP00000015103 [Anopheles gambiae]
  misc_feature: Gene Ontology Annotation: Molecular function=molecular_function unknown; Cellular component=cellular_component unknown; Biological process=biological_process unknown
  misc_feature: Pfam annotation: Pfam_ID=C2; Match level="Score=98.2, E-value=2.2e -26, Copies=1"; Pfam description=C2 domain
  misc_feature (446)..(446): Xaa can be any naturally occurring amino acid
MALSDSNERLDSLFVRIVKRVVFYGLLYSIGYANWSMTWVLIPALIVTLSEEYAHTKKKKRTFAKEAASGKEKEIIENWGELPFWVVFPDVERAEWLNKAVKQCWPFINFYARDLIKTYVENKLKKNLEKYSLKGFHFERIILGSTPLRTGGIVVYDNVSREEIVMDVDVSYAGDCDIKFRLRGLLGGIKNFQMYGKLRIVLKPLIRHFPLIGGVQLFFLNNPDIDFELDGIAGILDVPGINESLRKCVCATVASLMVLPNKFPVKFTPEVSSEQLNTPNPAGVLRVHVIEAKDLVKKDITFTGKSKSDPYAQLVVGEQSFKTETIQSNVNPKWDYWCEFVILESTGQEILITVWDEDATDDEFLGRVSVDIASLIKAELSDMWLVLEDVKHGDIHIRTNWLTLSTDYSNLKAALYESQQLQLSHMSSALLIVYIDSATNLKQVRXQQNRDPYVQLQLGRQIKTTN

SEQ ID NO: 21156 - protein, 275 aa, Diabrotica virgifera
  misc_feature: Coding regions on vcDNA: vcDNA=SeqID_853; Strand=+; Position=679-1503
  misc_feature: Homolog annotation: Hit_ID=EAL26641.1; Match level="QueryCoverage =94%, HitCoverage=46%, E-value=2e-25, Identity=29%"; Hit description =GA19791-PA [Drosophila pseudoobscura]
MKNVKMFQECSVLVLCFAIVQARMYNQSDIDLSKCKTHYSRSGSVYKDFYSITETPSANDTLLLDFHFSVLAPSDAHILLATSDKVQKTDPAYEIVIGAGGNTFCDIRRKQKSDVKSSIRVKGLLNALDPQSFWLHITKDGDIAVGKEGEELPFISWVDPDPLPLKVISFSTWSGVEAKWYFDCQFKHETEEIQKPLTHLDRLRRDYLYHYNPYVRPVTEHNTTTTVSVAININHVALDEKRSVFESFGSTKMGWQDEKLIWDPHDYSGIQVMHI

SEQ ID NO: 21157 - protein, 302 aa, Diabrotica virgifera
  misc_feature: Coding regions on vcDNA: vcDNA=SeqID_854; Strand=+; Position=127-1035
  misc_feature: Homolog annotation: Hit_ID=EAA00853.2; Match level="QueryCoverage =87%, HitCoverage=62%, E-value=1e-19, Identity=28%"; Hit description =ENSANGP00000011627 [Anopheles gambiae str. PEST] ref|XP_551262.1| ENSANGP00000011627 [Anopheles gambiae st
  misc_feature: Gene Ontology Annotation: Molecular function=molecular_function unknown
  misc_feature: Pfam annotation: Pfam_ID=DUF227; Match level="Score=60.5, E-value =4.7e-15, Copies=1"; Pfam description=Domain of unknown function (DUF227)
MGEVLNKDALHSWIQRAIGTENFNFTVENTTQKGEGYVGDLFFVKIDLQQPINGLNVLYLVVKTNKRDPGSIRLMQDFCKREVFFYGTVFKEYQEFLNNKKLPVLLDMVPKCYKTFSENGNEVIILENLKKGGFMLHAREEPMNIAHLKMGLKSYAKLHAMSLALKDQKREIFENMSKTCTSLVNQLFSTSKKVFNTKTPMLVETLKEAGRPDLSILFNKYIHDKSMYTRFMEIGNTISKDQAIVHGDCHNGNMMFQYKDDDKSVPLRMVLIDFQASFIHSPVLDLSYFLWMNLSPTEAPKK

SEQ ID NO: 21158 - protein, 80 aa, Diabrotica virgifera
  misc_feature: Coding regions on vcDNA: vcDNA=SeqID_855; Strand=-; Position=83-325
  misc_feature (3)..(3): Xaa can be any naturally occurring amino acid
INXTNNIFDTSIYSVCNHNTGIVSTNLHSNIKPNNSYVPLSAPSTTALVRTGPSTTDLSFSSCTSPVTSMGVSSFTGGIC

SEQ ID NO: 21159 - protein, 277 aa, Diabrotica virgifera
  misc_feature: Coding regions on vcDNA: vcDNA=SeqID_856; Strand=+; Position=133-964
  misc_feature: Homolog annotation: Hit_ID=NP_788727.1; Match level="QueryCoverage =97%, HitCoverage=50%, E-value=9e-74, Identity=50%"; Hit description =CG12268-PB, isoform B [Drosophila melanogaster] ref|NP_651197.1| CG12268-PA, isoform A [Drosophila
  misc_feature (249)..(249): Xaa can be any naturally occurring amino acid
  misc_feature (274)..(274): Xaa can be any naturally occurring amino acid
METSEISKWYRNQHVFITGATGFMGKILIEKLLRSCPDVAAIYVIIRSKKGKNATQRLEELLNSVVFDNIRQLPDAKSIFEKVKCITGDVTEENCGISPKDQELLEKSVTSVFHMAANVKFDLTVKTAVLLNTGGTFNVLEWACKLQNLKIFVHVSTSYCHCDVTELEEKLYDAPQDPRKMLDMVKWMSDDLLETLTPKLLSKYPNSYAYTKGLTEQLVSEYSTKLPIVITRPSIVFAAYKEPIPGWIXNLNGSTGILCGAGKGVIRTMHCNAXVIL

SEQ ID NO: 21160 - protein, 511 aa, Diabrotica virgifera
  misc_feature: Coding regions on vcDNA: vcDNA=SeqID_857; Strand=+; Position=117-1652
  misc_feature: Homolog annotation: Hit_ID=EAL29479.1; Match level="QueryCoverage =98%, HitCoverage=94%, E-value=9e-64, Identity=33%"; Hit description =GA10426-PA [Drosophila pseudoobscura]
  misc_feature: Gene Ontology Annotation: Molecular function=transcription co -activator activity; Cellular component=nucleoplasm; Biological process=regulation of transcription from Pol II promoter
MEKEPQPESMATVTIKPEYTPSEYSASEPPPAYMKMRSTSVQIAKIIAVTVVACSVILGGFLLASAYVSANASCRQLEHELELLSEAADRFQSPLQPEALIQDPPSSVNAKRQVETLNVEEQSPTTKELTNHIDDDSSSSSSESESTDSEDLPTKEPKGAKVPVQMDMEELISHLLEKNQKSKMNCVVEKKRAEEFVDHQPKTVRLPFGINLTTNPRFEKLTGERMVIVCESGTMQGAESPMRPKEEREDDSDEEDQETIMIQPVMIPIPQSPFNTHMPQQMAPMAPQRLMGEQMRPMGAPVFHIENMRPPMMHQQPPSQMPVRPPMQPQIQIQMQPQQPQQGDFPPNPILQHIVQQIVAQKIMESQKLREQQMREQQQQQQQQQQQKEVRPEPTQEIEERPRFLQIEQIGQPVNGQRLPIPEEVLTQLNRLPNRDVIVAVSETDSEDAPQEVQYVQEQRQSANEMNGRQTYTRALPINLPVHVAPQDQESQEQEQQQDELRPHFVQPRSV

SEQ ID NO: 21161 - protein, 256 aa, Diabrotica virgifera
  misc_feature: Coding regions on vcDNA: vcDNA=SeqID_858; Strand=+; Position=98-868
  misc_feature: Homolog annotation: Hit_ID=XP_322009.1; Match level="QueryCoverage =100%, HitCoverage=93%, E-value=1e-127, Identity=89%"; Hit description=ENSANGP00000012072 [Anopheles gambiae]
  misc_feature: Gene Ontology Annotation: Molecular function=DNA binding; Cellular component=nucleus; Biological process=regulation of mitosis
  misc_feature: Pfam annotation: Pfam_ID=14-3-3; Match level="Score=517.8, E-value=1e- 152, Copies=1"; Pfam description=14-3-3 protein
MSEREDNVYKAKLAEQAERYDEMVEAMKKVAKLDLELTVEERNLLSVAYKNVIGARRASWRIISSIEQKEESKGTDDKLEMIRQYRSQVEKELRDICSDILGVLDKHLIPAASSGESKVFYYKMKGDYHRYLAEFATGNDRKDAAEHSLVAYKSASDIAMTELAPTHPIRLGLALNFSVFYYEILNSPDRACRLAKAAFDDAIAELDTLSEESYKDSTLIMQLLRDNLTLWTSDMQLESEEGNKEQLQDVEDQDVS

SEQ ID NO: 21162 - protein, 282 aa, Diabrotica virgifera
  misc_feature: Coding regions on vcDNA: vcDNA=SeqID_859; Strand=+; Position=95-940
  misc_feature: Homolog annotation: Hit_ID=NP_524777.1; Match level="QueryCoverage =84%, HitCoverage=61%, E-value=1e-92, Identity=67%"; Hit description =CG3433-PA [Drosophila melanogaster] gb|AAF52469.1| CG3433-PA [Drosophila melanogaster]
  misc_feature: Gene Ontology Annotation: Molecular function=coproporphyrinogen oxidase activity; Cellular component=mitochondrial inner membrane; Biological process=coenzymes and prosthetic group metabolism
  misc_feature: Pfam annotation: Pfam_ID=Coprogen_oxidas; Match level="Score=296.7, E- value=3.7e-86, Copies=1"; Pfam description=Coproporphyrinogen III oxidase
  misc_feature (219)..(219): Xaa can be any naturally occurring amino acid
  misc_feature (259)..(259): Xaa can be any naturally occurring amino acid
  misc_feature (269)..(269): Xaa can be any naturally occurring amino acid
MFFKVFVKNFTLVFYQREQKLSKLLKYGTVFTGSAAFLSNKSKSVDTNEFMALPITPLQKLSSNPDDMKTRMELMIMKVQKEFCKALETEEDCNKFIVDRWERQEGGGGVTCVLQDGRVFEKAGVNISVVSGNLPAGAVAQMRSRGKKLDSNGPLPFFAAGISAVIHPVNPMVPTIHFNYRYFEVKSGDETQWWFGGGTDLTPYYLNSADAVHFHQTLXDACDKHDKTYYPKYKKWCDDYFNIPHRGERRGIGGIFFDXLDTPSQEKCXPVCESCANAVIPS

SEQ ID NO: 21163 - protein, 74 aa, Diabrotica virgifera
  misc_feature: Coding regions on vcDNA: vcDNA=SeqID_860; Strand=+; Position=315-539
KIVMSHLFKVINCIPLKKTKYYSYTFHQTIKKKKPRYQMRKNMEFSSFRIDCFEKLKLIDFCKLTADKECSYTN

SEQ ID NO: 21164 - protein, 403 aa, Diabrotica virgifera
  misc_feature: Coding regions on vcDNA: vcDNA=SeqID_861; Strand=+; Position=7-1218
  misc_feature: Homolog annotation: Hit_ID=XP_311178.1; Match level="QueryCoverage =93%, HitCoverage=92%, E-value=1e-122, Identity=55%"; Hit description= ENSANGP00000019033 [Anopheles gambiae]
  misc_feature: Gene Ontology Annotation: Molecular function=phosphatidylethanolamine binding
  misc_feature: Pfam annotation: Pfam_ID=PBP; Match level="Score=71.9, E-value=1.7e -18, Copies=1"; Pfam description=Phosphatidylethanolamine-binding prot
MASSLWNICCKNINGSINSAVNISVRHGHHLRGLAPGVAKSLETKLAEANYKDPAIHYRVDIGLPPPKISRSKVLQERLKILKEQKKNPTLEKLARDKKLLINLEETNKEWLKTQAPVDIKKVADHYGVFEHLYGDAYFHPRVPLNILYETENGSLPVYYGNVIKPSESKNAPTVSYDSDSDTLWTLTLVNPDGHFTETSSEYIHWFIGNIPGNDLQKGEKLVEYLQPFPPKGIGFHRLIFVLYKQDKKLDFSSYKKEGSCLTLSDRTFNTYDFYKKFQDTMTPAGLAFFQSDWDASLKEFYHNKLNMKEPIFEYDFAPPYIKKQAWFPIKEPFNLYMDKYRDPKQINKEFLMRKLKDVHPFKAPPPPLKYPNAVYFEGYVPSWLKLEIKKSRLKWGRINDIE

SEQ ID NO: 21165 - protein, 134 aa, Diabrotica virgifera
  misc_feature: Coding regions on vcDNA: vcDNA=SeqID_862; Strand=+; Position=79-483
  misc_feature: Homolog annotation: Hit_ID=AAV91378.1; Match level="QueryCoverage =97%, HitCoverage=100%, E-value=1e-42, Identity=63%"; Hit description= hypothetical protein 17 [Lonomia obliqua]
  misc_feature: Pfam annotation: Pfam_ID=Ribosomal_S30; Match level="Score=120.3, E -value=4.5e-33, Copies=1"; Pfam description=Ribosomal protein S30
MQLCLRGTATHFLECQGSETVGEIKDRIASLESLKASEISLYAAGVPVSEERLVADFENTDIELTVGLPGGKVHGSLARAGKVKGQTPKVEKQEKKKKKTGRAKRRIQYNRRFVNVVASFGRRRGPNSNSAPAS

SEQ ID NO: 21166 - protein, 276 aa, Diabrotica virgifera
  misc_feature: Coding regions on vcDNA: vcDNA=SeqID_863; Strand=+; Position=582-1412
  misc_feature: Homolog annotation: Hit_ID=EAL31878.1; Match level="QueryCoverage =92%, HitCoverage=51%, E-value=8e-82, Identity=54%"; Hit description =GA13109-PA [Drosophila pseudoobscura]
  misc_feature: Gene Ontology Annotation: Molecular function=tyrosine aminotransferase activity; Cellular component=cellular_component unknown; Biological process=phenylalanine catabolism
  misc_feature: Pfam annotation: Pfam_ID=TAT_ubiq; Match level="Score=94.4, E-value =3e-25, Copies=1"; Pfam description=Aminotransferase ubiquitination site
MFDRELEKRASRSIIEDPKVDIWRVEASSAAKNTRNFIREIVDNLDLQPNPDKPVIALSIGDPTVYGNLKAADETIDAVKAVVEEGLFNGYVPSTGHQDAKEAVAEYLSNDGVEVSPKDVILCSGCSSSLEHCITALADGSKNHNILIPRPGFPIYRTLAEHIGVEARYYNLIPENNWEADIDHLESQIDKNTAAIVLNNPSNPCGSSFSKEHLRNILEVAYNNRIPVIADEIYENLVFPGEQFTSTASLNSGVPILICGGLAKRFLIPWWRLGWI

SEQ ID NO: 21167 - protein, 220 aa, Diabrotica virgifera
  misc_feature: Coding regions on vcDNA: vcDNA=SeqID_864; Strand=+; Position=245-903
  misc_feature: Homolog annotation: Hit_ID=CAG07237.1; Match level="QueryCoverage =97%, HitCoverage=50%, E-value=4e-52, Identity=43%"; Hit description =unnamed protein product [Tetraodon nigroviridis]
  misc_feature: Gene Ontology Annotation: Molecular function=ATP binding; Cellular component=cellular_component unknown; Biological process=protein amino acid phosphorylation
  misc_feature: Pfam annotation: Pfam_ID=Pkinase_Tyr; Match level="Score=-70.0, E -value=8.3e-09, Copies=1"; Pfam description=Protein tyrosine kinase
  misc_feature (185)..(185): Xaa can be any naturally occurring amino acid
MESKMSAYKANISEYQTISILGQCFDNKAVVQLAKHLPSGVMVAVKKFNVDKIPGDIKLLEREIILTRQLSHPNILPYITAFVSGPEVCVVSPLMAYGSCRDLLTRHFNEGLLESAIILIIKDVLSALVYIHKKGYIHRAIRASHILVSVTGQICLTGMRYACPIVKNGRWQRTIHSFPRSIEKXLNWLSPELLEQNLQGYNEKSDIYSLGILTCDLAND

SEQ ID NO: 21168 - protein, 325 aa, Diabrotica virgifera
  misc_feature: Coding regions on vcDNA: vcDNA=SeqID_865; Strand=+; Position=12-986
  misc_feature: Homolog annotation: Hit_ID=XP_321391.1; Match level="QueryCoverage =100%, HitCoverage=13%, E-value=3e-96, Identity=55%"; Hit description= ENSANGP00000008519 [Anopheles gambiae] gb|EAL38547.1| ENSANGP00000029378 [Anopheles gambiae
  misc_feature: Gene Ontology Annotation: Molecular function=translation factor activity, nucleic acid binding; Cellular component=ribosome; Biological process=regulation of translation
  misc_feature: Pfam annotation: Pfam_ID=HEAT; Match level="Score=75.0, E-value=2e -19, Copies=6"; Pfam description=HEAT repeat
IAPILPIFREAILNGDGDEKEAAAQGLGEIIKVTSAAALQPSVVAITGPLIRILGDRFSANVKTAVLDALATLLAKVGIMLKQFLPQLQTTFVKALNDPNRAVRLKSATALGYLIVIHQRADPLFMELHNTIKNTEDISIRETTMHALRGIITPAGDKISEPLKKQIHATLVSYLGVPDDTVRKCAAGCLGALCKYLPPDQLESTLFEHILCDDSSANNTLKEGRGSALTVALKEAAVSLWDEQYRAKLIQTLLSQLSSQSVVINQIAIRSCGYLLQFLLMSEEPIPSNLLVPFVRAMNNNSNDVKQLLARVSFHLAKIIPPEKM

SEQ ID NO: 21169 - protein, 183 aa, Diabrotica virgifera
  misc_feature: Coding regions on vcDNA: vcDNA=SeqID_866; Strand=+; Position=36-587
  misc_feature: Homolog annotation: Hit_ID=EAA12276.3; Match level="QueryCoverage =75%, HitCoverage=69%, E-value=1e-58, Identity=74%"; Hit description =ENSANGP00000011588 [Anopheles gambiae str. PEST] ref|XP_555419.1| ENSANGP00000011588 [Anopheles gambiae st
  misc_feature: Gene Ontology Annotation: Molecular function=structural constituent of ribosome; Cellular component=mitochondrial small ribosomal subunit; Biological process=protein biosynthesis
  misc_feature: Pfam annotation: Pfam_ID=Ribosomal_S18; Match level="Score=8.8, E -value=0.0046, Copies=1"; Pfam description=Ribosomal protein S18
MFSIPFLRQNLSLTKSNLPRNLFTSVVYQQSKEDQRVIETREITKDRTQQIPVETSIRYLKSAAYQQTYEGQPVWVLYRRNHKGLFPPRKTRKTCVRGGQISTGNPCPICRDEYLILHEQNVDLLKQFVSPQTGSILSYSKTGLCQKKHQQLIVAITRAYDRGLLTFDVPFRKYDYSEYYSEK

SEQ ID NO: 21170 - protein, 64 aa, Diabrotica virgifera
  misc_feature: Coding regions on vcDNA: vcDNA=SeqID_867; Strand=-; Position=235-429
LRTKSANPFDRLKLVSKSKLERWTSSFKLVICVLKRHQTNAHASDDFKPLETDARTNLMYLRLV

SEQ ID NO: 21171 - protein, 262 aa, Diabrotica virgifera
  misc_feature: Coding regions on vcDNA: vcDNA=SeqID_868; Strand=+; Position=1-789
  misc_feature: Homolog annotation: Hit_ID=NP_727758.1; Match level="QueryCoverage =92%, HitCoverage=78%, E-value=8e-23, Identity=36%"; Hit description =CG32603-PA [Drosophila melanogaster] gb|AAN09580.1| CG32603-PA [Drosophila melanogaster]
  misc_feature: Gene Ontology Annotation: Molecular function=calcium ion binding
NHQYNTAFKVIIFAAFLAFANAGSWDSTLAVPAAPVVSAYHSAPVLAAPAVSKSIVQTYTSHPAPVAVAAPVLAKSVAPVVSAYSAPLALPAHGPVVSAYSAPLSLPAHGPVLSSYSAPLSLPAHGPVVSAYSSPLSLPAHGPVVSAYSAPLSLPSHGPVVSAYSAPLVAKSPLSYAAHSPVVSAYSSPLLSAYSAPVVAKSVFPLAYAAPSPVVSAYSSPVVSAYSSPILGKSLAPAPVAYAGHAAPVLSAYSAGPVVQPW

SEQ ID NO: 21172 - protein, 186 aa, Diabrotica virgifera
  misc_feature: Coding regions on vcDNA: vcDNA=SeqID_869; Strand=+; Position=40-600
TLAFQQFVVYFTVYKTLSIMIFFILVSVLIASATAQNRPSFAGLSGKGVPDVAARFKPGGALYNPPQDVVNRFGPADTPTERIPVDANVDLKNRINTWPEENKPFWYVNAEAIQKHIGASPNRETNLNGNQPLFDSGNQVFESRFGSGSSQSGPEVAGNSFSIVMNNQWKTYVYDPITDAWYARRN

SEQ ID NO: 21173 - protein, 118 aa, Diabrotica virgifera
  misc_feature: Coding regions on vcDNA: vcDNA=SeqID_870; Strand=+; Position=65-421
  misc_feature: Pfam annotation: Pfam_ID=WD40; Match level="Score=20.1, E-value =0.0068, Copies=2"; Pfam description=WD domain, G-beta repeat
MDLTRFSCFAGTSRGFLLTLGEKPKDIKHVKPEASSEVTALAFSKDQNTIFVGFKNDAIQPYDPLLNEFKETISDLSGKGSVVGVGFTENGLLAGTADGTVSIWSGRNNEHFNTHNWN

SEQ ID NO: 21174 - protein, 520 aa, Diabrotica virgifera
  misc_feature: Coding regions on vcDNA: vcDNA=SeqID_871; Strand=+; Position=119-1678
  misc_feature: Homolog annotation: Hit_ID=AAK69410.1; Match level="QueryCoverage =97%, HitCoverage=95%, E-value=1e-133, Identity=45%"; Hit description= cytochrome P450 [Blattella germanica] sp|Q964T2|C9E2_BLAGE Cytochrome P450 9e2 (CYPIXE2)
  misc_feature: Gene Ontology Annotation: Molecular function=cytochrome P450 activity; Cellular component=extracellular space; Biological process= electron transport
  misc_feature: Pfam annotation: Pfam_ID=p450; Match level="Score=214.7, E-value=1.8e- 61, Copies=1"; Pfam description=Cytochrome P450
  misc_feature (503)..(503): Xaa can be any naturally occurring amino acid
MIEIVLIVTALAVLMYYVGYKPMQYWKDRGIKQGKPAWFFGDNLGMTLKTESFADMVVKVYNAVPGVRYSGAYQFTAPTLVIKDLELIKQTGVKDFDHFTDHRTVISEDADPLWAKNLFALTGQKWRDMRPILSPSFTSSKMRAMFVLISETAQALTQHFLELDQDVIEIEMKDTFTRFTNDVIATTAFGIKVDSMKNKENEFFVMGKDITSFKGFWKNLKFLGIIFFPRLFGYLKLGMFTRRVRKFFTDLIDHTIKVREEKGIVRPDMIHLLMEARKGVHQHEEKVIDTGFAVVEEADLGKGVVKEMTNLDIAAQAMIFFFAGFDSVSSLMCFLSYELAINPDIQNSLRTEIEDTLEQYNGNVPYEAILKMRYLDMVVSEALRKWPTAVAVDRICTKPYTIEPATPDEKPVYLEKGTTIWFPIYGLHRDPQYYPDPEKFDPERFNDENKSKIQTYSYIPFGVGPRNCIGSRFALLETKVVFFHLLANYEIEPSAKTQIPLKXSKKAVHLAGEGGLLGSS

SEQ ID NO: 21175 - protein, 294 aa, Diabrotica virgifera
  misc_feature: Coding regions on vcDNA: vcDNA=SeqID_872; Strand=+; Position=3-887
  misc_feature: Homolog annotation: Hit_ID=XP_321429.1; Match level="QueryCoverage =81%, HitCoverage=96%, E-value=6e-36, Identity=44%"; Hit description =ENSANGP00000022064 [Anopheles gambiae]
  misc_feature: Gene Ontology Annotation: Molecular function=structural constituent of eye lens
  misc_feature: Pfam annotation: Pfam_ID=Chitin_bind_4; Match level="Score=94.2, E -value=3.4e-25, Copies=1"; Pfam description=Insect cuticle protein
STIPGTHWKYSNMAVKITFSILIAVLLARNRVDASGVAPLFAPAPVLAPAPVLAPAPVLAKVSDATIDPNPAYSFAYDVQDALTGDSKGQVESRANGVVRGQYQVADPDGTRRIVDYYADPVHGFNAVVRRVPLGVAVAPVVAKAVAPVAPIAPVARSLVLPAPGLPVAAAPVPVAPALPFAAPAVAPALPFAAAPAVAPALPFAAPAVAPALPYAAAPAISPYLTRAGFFPAPAPAVVPAAPGPAYLPAAPSRLVSPYSVAAPLPSGLRSLVTPFSAGPAPLAVGSGVAAPYW

SEQ ID NO: 21176 - protein, 141 aa, Diabrotica virgifera
  misc_feature: Coding regions on vcDNA: vcDNA=SeqID_873; Strand=+; Position=46-468
  misc_feature: Homolog annotation: Hit_ID=XP_317364.1; Match level="QueryCoverage =97%, HitCoverage=42%, E-value=6e-54, Identity=68%"; Hit description =ENSANGP00000010445 [Anopheles gambiae]
  misc_feature: Gene Ontology Annotation: Molecular function=racemase and epimerase activity, acting on carbohydrates and derivatives; Cellular component=cellular_component unknown; Biological process=L-fucose biosynthesis
MTKNKVILVTGGTGLVGSAIKEIIQLEKRTDETWVFLSSKDGDLCDYNETKKIFEKHQPTHVIHLAAMVGGLFHNMSHNLDFLRKNLKMNDNVLQISFESGVQKVVSCLSTCIFPDKTEYPIDETMVHNGPPHPSNFRYSY

SEQ ID NO: 21177 - protein, 306 aa, Diabrotica virgifera
  misc_feature: Coding regions on vcDNA: vcDNA=SeqID_874; Strand=+; Position=8-925
  misc_feature: Homolog annotation: Hit_ID=EAL40433.1; Match level="QueryCoverage =98%, HitCoverage=60%, E-value=7e-46, Identity=32%"; Hit description =ENSANGP00000026204 [Anopheles gambiae str. PEST] ref|XP_558354.1| ENSANGP00000026204 [Anopheles gambiae st
  misc_feature: Pfam annotation: Pfam_ID=p450; Match level="Score=-185.0, E-value =0.0099, Copies=1"; Pfam description=Cytochrome P450
  misc_feature (258)..(258): Xaa can be any naturally occurring amino acid
  misc_feature (267)..(267): Xaa can be any naturally occurring amino acid
  misc_feature (277)..(277): Xaa can be any naturally occurring amino acid
  misc_feature (301)..(301): Xaa can be any naturally occurring amino acid
MFLVLLVLVITLLAVLIQRRYSYWSKHGIPGPRPLPLVGNFGKSFIGKKSAGEIVTETYRKYADYPFVGLYRTITPILLIRDPDFIKHILVRDFKHFQDNDIEVDLEVDKILGRNPFLMKGASWKQKRSQLTACFTSGKIKGMYQFLEKSSQRMVQYVANEIRNSKPLEAREIFVRFTLDNVAACAFGLEGKNFEQPFSNFRELAENFMSPQSLKSKIKWAPFFLCPEVFKYLKWKLIPEEVEDRLIEIIRGSLNYRXRNKVVRNDXLDVISNLPTXYGLFTEIDIVAHAASFFSDGYETXSQGNV

SEQ ID NO: 21178 - protein, 252 aa, Diabrotica virgifera
  misc_feature: Coding regions on vcDNA: vcDNA=SeqID_875; Strand=+; Position=32-790
  misc_feature: Homolog annotation: Hit_ID=XP_395277.1; Match level="QueryCoverage =93%, HitCoverage=78%, E-value=2e-37, Identity=45%"; Hit description =similar to Larval cuticle protein A3A (TM-A3A) (TM-LCP A3A) [Apis mellifera]
  misc_feature: Gene Ontology Annotation: Molecular function=structural constituent of eye lens
  misc_feature: Pfam annotation: Pfam_ID=Chitin_bind_4; Match level="Score=93.6, E -value=5.3e-25, Copies=1"; Pfam description=Insect cuticle protein
MVLALTVFSAILALTSASGVVAPAPVALAAAPVVAAAPVVAARLADDTFDPNPSYSFAYDVQDALTGDSKGHIESRANGIVQGQYNVAEPDGTRRIVDYTADDINGFNAVVRKTPQAVVAAPVVAAPAAQVIAARAATVVAARAAPVVAAPAAQVIAARAAPLVSARAAPVVSAPVLAARSAPLLAQPAPYIAQAAPLVAQPAPYIAQAAPLVAQSAPLLAARASPYFAPSAPLLAARSYGLASAPLTYAVL

SEQ ID NO: 21179 - protein, 247 aa, Diabrotica virgifera
  misc_feature: Coding regions on vcDNA: vcDNA=SeqID_876; Strand=+; Position=161-902
  misc_feature: Homolog annotation: Hit_ID=AAH75267.1; Match level="QueryCoverage =91%, HitCoverage=96%, E-value=3e-56, Identity=49%"; Hit description =MGC88883 protein [Xenopus tropicalis] ref|NP_001004879.1| MGC88883 protein [Xenopus tropicalis]
  misc_feature: Gene Ontology Annotation: Molecular function=molecular_function unknown; Cellular component=integral to membrane; Biological process= biological_process unknown
  misc_feature: Pfam annotation: Pfam_ID=UPF0005; Match level="Score=77.0, E-value =5.1e-20, Copies=1"; Pfam description=Uncharacterised protein family UPF000
  misc_feature (202)..(202): Xaa can be any naturally occurring amino acid
MSQTVSLILNEDVEHGGKEYDEDDIENDFAYRNNVLNATKQIRLAFIRKVYGLLSMQILLTFIIASICLFTPPIKSFVHTNDWMMMFSFIASIALLVPLHIKRKESPTNFILLIAFTVVQAYTIGVIVTFYSKVVVLQALVLTLVVLVALTAFTFQTKRDFSATHSALFAGLCILIVGGFMQIFIQSSILELGIGLGGAFLXFCLFIVVDTQMIMKTLSPEEYILATINLYMDIINLFVYILRILQE

SEQ ID NO: 21180 - protein, 418 aa, Diabrotica virgifera
  misc_feature: Coding regions on vcDNA: vcDNA=SeqID_877; Strand=+; Position=52-1305
  misc_feature: Homolog annotation: Hit_ID=XP_343419.1; Match level="QueryCoverage =87%, HitCoverage=12%, E-value=6e-17, Identity=25%"; Hit description =similar to chorein isoform A; chorein [Rattus norvegicus]
  misc_feature: Gene Ontology Annotation: Molecular function=intracellular transporter activity; Cellular component=intracellular; Biological process=Golgi to endosome transport
MRIHSVTPTSSLVESSSSDDSDSSDNTQHNLNKKVHKDKIIIYWLCYREGLQRTLLLTQELRIYNKVLEMFLEKCQIEGLIALSGVGLSIFTSENDTKEHIYATISDNPAIWEVNVGQKWKTLTLELASWVEDKYRLHYKKCQLKEYVHIDFEKMYMLKPFFAELRRSYCPAVYFHFRKSQNYQYYNLRLQSLQIDNKQTNNIVFHPLPAQNIKDNTPFAEICVSKLSSKTASVYRYIKFNIGSFFLNIENDLFLQICNLLKKTRKFTDEDSGIYVNEIKAIHKSITARNNETPPINKSYIEYLILNSFGVQLNISNKLQMSLSGSKGPLYRVLDYLFPYNLSPYMPMEGVHHKISSVEQVDICDTLNNAVNLFDQIYTQFLQQYYSHVLGLQVLVNTFAIQPGYKVISSQNKWTFSS

SEQ ID NO: 21181 - protein, 282 aa, Diabrotica virgifera
  misc_feature: Coding regions on vcDNA: vcDNA=SeqID_878; Strand=+; Position=442-1290
  misc_feature: Homolog annotation: Hit_ID=XP_313013.1; Match level="QueryCoverage =94%, HitCoverage=96%, E-value=6e-51, Identity=42%"; Hit description =ENSANGP00000011258 [Anopheles gambiae]
  misc_feature: Pfam annotation: Pfam_ID=DUF1676; Match level="Score=107.7, E-value =3e-29, Copies=1"; Pfam description=Protein of unknown function (DUF1676)
KFSAQVRLSSVKMRKIVLVLFFVICAYAQDSFENTGVKLALKIYDDCSKGDGLSPCLKKKAITFIDRLGRMDKFSLVDGVTVQKAADAPAEAPAMTEQQLDETLPRSSDAKDEALTTMLFEKVGNFIGSRSIEIALPKIQASDLIEEGRKGSFGDSGGKRKGGKGGKGGKKGMMGMMMMGIGVKLAAMIPLAIAGLFLLAKKALIISKIALLISGIIAVKKFLAQKQGGGGGSGWQSGGGSSGWSSGGGHGGGGGGWQSSGGGWDKRSYEASDLAYSAYNPK

SEQ ID NO: 21182 - protein, 264 aa, Diabrotica virgifera
  misc_feature: Coding regions on vcDNA: vcDNA=SeqID_879; Strand=+; Position=103-897
  misc_feature: Homolog annotation: Hit_ID=XP_319012.1; Match level="QueryCoverage =79%, HitCoverage=75%, E-value=5e-65, Identity=54%"; Hit description =ENSANGP00000024010 [Anopheles gambiae]
MNINVLFRNVRNYSNLNLCKFNSTITNHFLCKHASFCTKQPSYFLNNKSLNSGLNQRRWYSDDPSSPSNKLPPLLPDSPIFVWPSLFKTIRNFILATFIIRPYLDQEFNLPDFVSASKKAVEVVSHKLSEGDIKSLDGLVTNDIIGSLQKAISMMSMSQREQIATSVDDIYFSFPYQVGVIFNEEEGKEQKRFVEITMVYHSLKGLAGMRSRGEEPPLNMGMLPEYQQKISICNYRFIREFTKGVEGDWTVNLLNHFKPIDEQK

SEQ ID NO: 21183 - protein, 230 aa, Diabrotica virgifera
  misc_feature: Coding regions on vcDNA: vcDNA=SeqID_880; Strand=+; Position=81-773
  misc_feature: Homolog annotation: Hit_ID=XP_392756.1; Match level="QueryCoverage =71%, HitCoverage=77%, E-value=9e-20, Identity=34%"; Hit description =similar to CG17233-PA [Apis mellifera]
MSKYSENEDDPYESSGDEWKEEEEVKKNSRRSSQRLSKKPRMTVVEYGSSDDSDSEPARKKSKNGVTKKAKVQEEDEDDDDYSAEEDEDEEIKEETEKVKNSGTKATSGTTGSPVPAVRQMGNRKFIPKTLYSEDYTTGSFVILKKDAEGDASKHPCIWRIDGKALLQKYEAYDEDGKVRHKNTSIYTGWSPMDKDLYAPVTVDVIQHNNQNLRVELHWDKLKDINADSD

SEQ ID NO: 21184 - protein, 66 aa, Diabrotica virgifera
  misc_feature: Coding regions on vcDNA: vcDNA=SeqID_881; Strand=+; Position=609-809
SVFYIIISKQFYCIDFLILFYQHSIHACGKWGVPVRINKNKIYVVFFPVFILFSIFLKVLKKNIFL

SEQ ID NO: 21185 - protein, 219 aa, Diabrotica virgifera
  misc_feature: Coding regions on vcDNA: vcDNA=SeqID_882; Strand=+; Position=223-882
  misc_feature: Homolog annotation: Hit_ID=BAA88238.1; Match level="QueryCoverage =97%, HitCoverage=91%, E-value=1e-83, Identity=70%"; Hit description =Rab-related protein 1 [Drosophila melanogaster]
  misc_feature: Gene Ontology Annotation: Molecular function=RAB small monomeric GTPase activity; Cellular component=cellular_component unknown; Biological process=small GTPase mediated signal transduction
  misc_feature: Pfam annotation: Pfam_ID=Ras; Match level="Score=134.8, E-value=2e -37, Copies=1"; Pfam description=Ras family
MSNANQSTSKPKDHLYKILVIGDLGTGKTSIIKRYVHRFFTQHYRATIGVDFALKVLNWDENTLIRLQLWDIAGQERYGNMTRVYYKEAVGAFIVFDVTRKPTFESVANWKADLDSKVQLPDGSKIPCVLLANKCEQPKEGIASSPTKMEEYCRENGFHAWFETSAKDNINIDEAASCLVEKILAYDSVINSDSKRSSDQFSLRRDSDGNSSSRRSCSC

SEQ ID NO: 21186 - protein, 103 aa, Diabrotica virgifera
  misc_feature: Coding regions on vcDNA: vcDNA=SeqID_883; Strand=-; Position=208-519
NLYFSDKIVQIQCTKLPLTALAKTVKSPLLIGSQRISLCVCYTATTSSRKTKLSINLDNCIRKMACTNEVPKTTVKKTFEHVENKLFSLDFCLLFRRKSEQKN

SEQ ID NO: 21187 - protein, 128 aa, Diabrotica virgifera
  misc_feature: Coding regions on vcDNA: vcDNA=SeqID_884; Strand=+; Position=244-630
VLVWYRHTNDYLAEHPAVIWRDSHSDLILFTRPSLRPPALQSYIYPPIHSVCANNTRRVTVQITTSSEETTCVNQCDMGFSKIANRWNSDRTIKFSSVVPISHTRAYEISNLWNIKINKKVMQHMYRL

SEQ ID NO: 21188 - protein, 340 aa, Diabrotica virgifera
  misc_feature: Coding regions on vcDNA: vcDNA=SeqID_885; Strand=+; Position=869-1891
  misc_feature: Homolog annotation: Hit_ID=XP_321163.1; Match level="QueryCoverage =98%, HitCoverage=97%, E-value=1e-135, Identity=71%"; Hit description= ENSANGP00000020184 [Anopheles gambiae]
  misc_feature: Gene Ontology Annotation: Molecular function=L-malate dehydrogenase activity; Cellular component=mitochondrial matrix; Biological process=malate metabolism
  misc_feature: Pfam annotation: Pfam_ID=Ldh_1_C; Match level="Score=233.6, E-value =3.7e-67, Copies=1"; Pfam description=lactate/malate dehydrogenase, alpha/b
TINSKMFSRIVRPTVVATRSFSTSKQNNFKVAVCGASGGIGQPLSLLLKINPLVSQLSLYDLVHTPGVAADLSHIETAAKVKGFNGPECLKDALKGADVIIIPAGVPRKPGMTRDDLFNTNAGIVKALAECAAEVAPCALIGIITNPVNSAVPIACEVLKKAGKLDPKRVFGISTLDIVRANTFIAEAKGLNPKDVNIPVIGGHSGVTIIPLISRATPSVSFPADQLQALTVRIQEAGTEVVKAKAGAGSATLSMAYAGARFANSLLRGLKGEPNVIEPAYVQSDVTEASYFSTPLVLGKNGLEKNLGLGKLSDFEQDLLKKALPELKKNIEAGVKFANQ

SEQ ID NO: 21189 - protein, 191 aa, Diabrotica virgifera
  misc_feature: Coding regions on vcDNA: vcDNA=SeqID_886; Strand=+; Position=99-674
  misc_feature: Homolog annotation: Hit_ID=AAG30944.1; Match level="QueryCoverage =76%, HitCoverage=79%, E-value=6e-27, Identity=47%"; Hit description =heat shock protein hsp20.8 [Bombyx mori] gb|AAG30946.1| heat shock protein hsp20.8A [Bombyx mori]
  misc_feature: Gene Ontology Annotation: Molecular function=chaperone activity; Cellular component=cytosol; Biological process=protein folding
  misc_feature: Pfam annotation: Pfam_ID=HSP20; Match level="Score=106.0, E-value =9.2e-29, Copies=1"; Pfam description=Hsp20/alpha crystallin family
MAFIPRMFHDNFWGPNCPRRRPCSGNVAGNISEDILNSIAIAQAMFGPEYGRNNQEVNTNSQHRSSVTVDKNKFQANFDVQHFKPEEITVKVNDDKSITIEAKHEEKPDEHGAIFRHFIRKYVLPDNCDVDRVESRLSSDGVLTIIAPIINDNAVGHRTIPIIRTGEPVNLQESISNEGKKQVEDKEVMES

SEQ ID NO: 21190 - protein, 339 aa, Diabrotica virgifera
  misc_feature: Coding regions on vcDNA: vcDNA=SeqID_887; Strand=+; Position=171-1190
MPQSIIKELKVTVALDMINKQQNIEPPSTSPSTKPNMVSNTKKIVENKKSMKMNDTKQSPSHDDLLVPNSLIPPGITITKMDSSGRREQNALLKNDIGSMVTVAETEKLLRKGQGNNSPYREPVDSKRKTKKKIKIPQDTQLSTLPPVKEKTVSLTPEKNMIFDPLKSKFGQFDVNAKSCNPAIIFTNENGTVTVTRNSRLQQSSSDRDRVVSVPLRTISSQIKYPEIQKLPISAVFTNSQTQDPAGLLQAQEILSGLQEIQITKVDKKNIKPELKENIYCPRDQITIIPVSKNGREAFHFDENDWLCDSVVSPESKPKKVGQWDPRALELEPFMLFHP

SEQ ID NO: 21191 - protein, 427 aa, Diabrotica virgifera
  misc_feature: Coding regions on vcDNA: vcDNA=SeqID_888; Strand=+; Position=96-1380
  misc_feature: Homolog annotation: Hit_ID=XP_395050.1; Match level="QueryCoverage =98%, HitCoverage=58%, E-value=1e-139, Identity=55%"; Hit description= similar to ENSANGP00000022091 [Apis mellifera]
  misc_feature: Gene Ontology Annotation: Molecular function=tRNA (cytosine-5-) -methyltransferase activity; Cellular component=nucleus; Biological process=tRNA methylation
  misc_feature: Pfam annotation: Pfam_ID=Nol1_Nop2_Fmu; Match level="Score=58.7, E -value=1.7e-14, Copies=1"; Pfam description=NOL1/NOP2/sun family
  misc_feature (416)..(416): Xaa can be any naturally occurring amino acid
MGRRNNRFRKNHHFNHGKKGEESNKQAHVDTRKPYNDIIRENEKFCQYYKRVGVCKENEFDQFISCLKTDLPATFRITGSKGVANKLLGIVEEQLIKHCVNQVDGTEQPSIFPIPWYPNKLAWQMELTRKDIRRCEAYYKLHNFLISETENGTISRQETVSMIPPLVLDVQPHHKVLDMCAAPGSKTAQLLELLHANEDPIPSGYVIANDIDNKRCYMLVHQAKRLNSPCVAVINHDSAILPNLTTTASDGSVEQVQFDRILCDVPCSGDGTLRKNPDIWMKWTAANGLNLHGVQTRILRRGVELLNVGGKLVYSTCSINPIENESVIHRLLAEHEGVLELVDVSEVLPGLKYSPGMEDWLVSSRNLEFYETFEDVDEKWRTTIRPQMFPPKAEDREKFRLNRCIRILPHQHIPDXYFVAVLRKLKP

SEQ ID NO: 21192 - protein, 454 aa, Diabrotica virgifera
  misc_feature: Coding regions on vcDNA: vcDNA=SeqID_889; Strand=+; Position=2-1361
  misc_feature: Homolog annotation: Hit_ID=XP_396589.1; Match level="QueryCoverage =99%, HitCoverage=23%, E-value=1e-174, Identity=67%"; Hit description= similar to CG31729-PB [Apis mellifera]
  misc_feature: Gene Ontology Annotation: Molecular function=cation-transporting ATPase activity; Cellular component=integral to membrane; Biological process=aminophospholipid transport
  misc_feature (175)..(175): Xaa can be any naturally occurring amino acid
  misc_feature (430)..(430): Xaa can be any naturally occurring amino acid
  misc_feature (446)..(446): Xaa can be any naturally occurring amino acid
LEGADLGLLRTSESLGEVFVRTDQLDGETDWKLRLAVPVTQKLASDRQLFEINASIYAEKPQRDIHSFIGTFSRLDSLNGDESLDLNNTLWTNCVIASGQATGVVIYTGPETRSVMNNSAPRSKVGLLDIEVNTITKLLFAAVIGLALIMMALKGFSGPWYRYMFRFILLFSYIXIPITLRVNLDMGKSFYSWAIGKDPAMKGTAVRCTTIPEELGRISYLLSDKTGTLTQNSMVLKRLHMGTVSFATDSFDEVGTLLRSSYNNENVKVNSDKFRRSENTRIKDAVQALALCHNVTPMYETNEKKDTDSGSFTSETEADQHLQMPDKDVTYQASSPDEVALVHWTHQVGLTLSNRDLNSMQLRTPNGRFMNYAILQIFPFTSETKRMGIIVKSLYTGEIIFYLKGADMVMSAIVQYTDWLDEEVGNMARXGLRPLVVAKKILQKSXYWGFEARY

SEQ ID NO: 21193 - protein, 184 aa, Diabrotica virgifera
  misc_feature: Coding regions on vcDNA: vcDNA=SeqID_890; Strand=-; Position=222-776
  misc_feature: Homolog annotation: Hit_ID=XP_316971.1; Match level="QueryCoverage =100%, HitCoverage=90%, E-value=1e-73, Identity=72%"; Hit description= ENSANGP00000019926 [Anopheles gambiae]
  misc_feature: Gene Ontology Annotation: Molecular function=protein binding; Cellular component=cytoplasm; Biological process=cell adhesion
  misc_feature: Pfam annotation: Pfam_ID=efhand; Match level="Score=41.6, E-value =2.3e-09, Copies=3"; Pfam description=EF hand
MGQAKSQFTDDELQNYQDLTYFTKKEVLHAHQKFKALAPEKVGHNKNAKLPMEKILLYPELSVNPFGERICKVFSSNHDGHCTFEDFLDMMSVFSETAPKSVKAEHAFRIFDFDGDDMLGKSDLQEVIRTLTGEYKLTDAEIDTLIENILEEADFDDDRSLSFAEFEHITDKSSDFLSAFRIRL

SEQ ID NO: 21194 - protein, 262 aa, Diabrotica virgifera
  misc_feature: Coding regions on vcDNA: vcDNA=SeqID_891; Strand=+; Position=71-859
  misc_feature: Homolog annotation: Hit_ID=BAB09704.1; Match level="QueryCoverage =94%, HitCoverage=40%, E-value=4e-14, Identity=26%"; Hit description =unnamed protein product [Arabidopsis thaliana] ref|NP_198918.1| myb family transcription factor [Arabidops
MSFVSYISETPVKRSAEEHEEVVLSPKKKSKKNKQKNEESTVVGISNPSFNPMGTPVKVERHSLNPIEEVSTEIEDSLKKKSKKEDNLECSLDNLEDSSRKKKKKKKNTSIDTSEGASEVVTKKSKKVEQNLEGIANPAFAPMGTPVKIQRHSLDVIEESITEIDDSMNNSNSKKKNNLSTNIEQLNDESVESVKKSKRKKNTNDVCEFNNPTFCEIDENTQAADTENNSYEVSTKKLKKEKKKKKILVIQMKQLIPLEKFS

SEQ ID NO: 21195 - protein, 305 aa, Diabrotica virgifera
  misc_feature: Coding regions on vcDNA: vcDNA=SeqID_892; Strand=+; Position=111-1025
  misc_feature: Homolog annotation: Hit_ID=EAL34565.1; Match level="QueryCoverage =85%, HitCoverage=37%, E-value=9e-43, Identity=37%"; Hit description =GA21641-PA [Drosophila pseudoobscura]
  misc_feature: Gene Ontology Annotation: Molecular function=molecular_function unknown; Cellular component=nucleolus; Biological process=ribosome biogenesis
  misc_feature (251)..(251): Xaa can be any naturally occurring amino acid
MAALKLKKKEMKQKKVAKDPKTKKSTKKVIGYSKKSKEKLKIKQKPSKHVEKNIDVEVEEDSDDCNIWEMDETLNDSDQDATVNDDQENIEESDEEDSAEKHKRDLEKLKESDPEFYKFLQENDKKLLEFNLSDEEDGEAGEEKVGDDDEDDDIHKPSDKLSVASDESDFEDEDNDKPKDSRVITLKLLKHWQTEIQTDKSNKTIIAVTHAFHAALRTVVSEEEDQEPAEYKVEGSAVFNGVIQLCVLELXPAVRRFLGLQAKSKQPPHKCKKFIKIKKYLKAYFTDILKLLQSVHRQYTNSAFK

SEQ ID NO: 21196 - protein, 160 aa, Diabrotica virgifera
  misc_feature: Coding regions on vcDNA: vcDNA=SeqID_893; Strand=-; Position=91-573
  misc_feature: Homolog annotation: Hit_ID=CAD22154.1; Match level="QueryCoverage =85%, HitCoverage=53%, E-value=3e-44, Identity=60%"; Hit description =pherophorin-dz1 protein [Volvox carteri f. nagariensis]
  misc_feature: Gene Ontology Annotation: Molecular function=protein binding; Cellular component=nucleus; Biological process=mRNA processing
  misc_feature (89)..(89): Xaa can be any naturally occurring amino acid
  misc_feature (127)..(127): Xaa can be any naturally occurring amino acid
  misc_feature (134)..(134): Xaa can be any naturally occurring amino acid
MGTGFGTAILICSVCSIIVGGPPEPPPNPGPPPKSGPAPPNPGSIAPPKPPSPGPPNPAPPPNPGPPPNPDPPSNPWPPPSPGPPPNPXPPPNPGPPPNPLPPKPGPPPVPNPPPILIPPPIPPEPXPTDIPPXIPPPPPPPGPNPTPYTADGTGGIRSL

SEQ ID NO: 21197 - protein, 302 aa, Diabrotica virgifera
  misc_feature: Coding regions on vcDNA: vcDNA=SeqID_894; Strand=+; Position=37-942
  misc_feature: Homolog annotation: Hit_ID=XP_317561.1; Match level="QueryCoverage =96%, HitCoverage=58%, E-value=2e-46, Identity=34%"; Hit description =ENSANGP00000009927 [Anopheles gambiae]
  misc_feature: Gene Ontology Annotation: Molecular function=UDP-glycosyltransferase activity; Cellular component=microsome; Biological process=metabolism
MLRKSFLVLVVIIVISDVEAYRILGVFPHTSKSHATIFLAVMKGLVEKGHNVTVVSTRTFDTDRNNYVHVDLSKDIRVTMGTVNISIVNNDKALTRYLTAYHLFNRNIDKCEKGLSSPTFQKFLKTRGEKYDVVIFEYFAVDCFLGVISKINAPIIGLSSSTLMPWVAERMGNPSNTAYVPNNLLAFSDKMSFWQRMENTVISIGHKLLFQFYKLPRDKKLARKYIGKKGSKLEKFLYNSSLLLSNTHFSLNLPRPLVPNVIEIGGIHIEKPHPLPEYLGRWIESSPSGVIYFSLGSLYHGQ

SEQ ID NO: 21198 - protein, 294 aa, Diabrotica virgifera
  misc_feature: Coding regions on vcDNA: vcDNA=SeqID_895; Strand=+; Position=2-886
  misc_feature (281)..(281): Xaa can be any naturally occurring amino acid
GRVGLKILISSFLLVGISQATLLGRQGILAQTANKLGIGNIISVNADAEANLLGNKVGVDGAVGVGGQGIGAHLSGDADVLGQKVNVHGDVLEGHAIDQHNHEVFRDNRGRQYTLQRQYIGSNSVLVRKYLDNGQIYVDGADQDNVLQHSQSGRVVISGNSGSNGGYMQQGGLLINRVPNINVIATSRDRDATVRIPLTGHLPNGILELDPGFSGPWGNMKLDPGFAGPWRNMLLNIKRVSPLEWQEWLLEQKQRNRNLDLTLIEQWINQQHLLLKVDTTXIEGWIMQQQKSNP

SEQ ID NO: 21199 - protein, 320 aa, Diabrotica virgifera
  misc_feature: Coding regions on vcDNA: vcDNA=SeqID_896; Strand=+; Position=16-978
LNCYNMKLLVISVLLLVGVSNASLLGKNGILANTANQLGIGNIINVGADAEANLLGNKVGVDGAVGVGGQGIGAHLAGDADVLGQKVNVHGDVLEGHAIDQQNHEVFRDNTGRQYTLQRQYIGSNSVLVRKYLDNGQIYLDGANQNNVLQHSQSGSLVINGNSGSSGVVIIGGNQGQQGGLIINGGSGWPTTNIGVETGLAGLLRNIKRVSPLEWQEWLLAQKQRNKYIDLTIIENWINQQHQLLKVDTAVIEGWIIQQQNLNPNFLYNWIINHQVPNILGNVRPPIDQGWNGTLRPAKSILQKLGKMGNSTKNKKQPLF

SEQ ID NO: 21200 - protein, 198 aa, Diabrotica virgifera
  misc_feature: Coding regions on vcDNA: vcDNA=SeqID_897; Strand=+; Position=38-634
MKIVLLVLFAACLSQAKINQDIHFDWVQYTGEIPENAIIGGSTADGDPTYVARSFLSADEDDENYSGSDYNGYVAGGVLPGKLSIDLCTPQSIYTLTKNIEILTVVNGTKIEWIKSYQHTFMDLFNSDDYRPVRIGWLANGETWNSTLYLGSSLGAGVETIGHIMTSAIPTYNNQQNWYPFYGSQFGDLMYKVLVYYI

SEQ ID NO: 21201 - protein, 302 aa, Diabrotica virgifera
  misc_feature: Coding regions on vcDNA: vcDNA=SeqID_898; Strand=+; Position=2-912
  misc_feature: Homolog annotation: Hit_ID=EAA14735.3; Match level="QueryCoverage =96%, HitCoverage=55%, E-value=5e-30, Identity=30%"; Hit description =ENSANGP00000005268 [Anopheles gambiae str. PEST] ref|XP_553067.1| ENSANGP00000005268 [Anopheles gambiae st
  misc_feature (242)..(242): Xaa can be any naturally occurring amino acid
  misc_feature (274)..(274): Xaa can be any naturally occurring amino acid
PHPGRIISILVLFLIHSATSAKILSVIPSASRSHHLPFQPLWRELALRGHEVTVVTTDPQRNASIENLKEIDTSFCYKIYEKHNVVNAIANESLSSLEKAGVLRRAFLECEDYHFSLPPIREMIINKKIHFDLLIVEAQLPSMLAFSWRFKCPVIAVASMEPALQYHDSLGNPVHPVINPDYNLDVIDSENLTFKERMLSFLPVVIYKYHIYNRAFPAYHEHVKKYFGKDLPHLKELQESIXLMFIGSHPLVPNNKTLKLKNRNQLEGGRVIKXPKKLPNDPQKILDRRKTGGLYFQPRKKT

SEQ ID NO: 21202 - protein, 235 aa, Diabrotica virgifera
  misc_feature: Coding regions on vcDNA: vcDNA=SeqID_899; Strand=+; Position=115-819
  misc_feature: Homolog annotation: Hit_ID=XP_397319.1; Match level="QueryCoverage =74%, HitCoverage=20%, E-value=7e-20, Identity=34%"; Hit description =similar to ENSANGP00000013156 [Apis mellifera]
MAFRPLTEAECGQANPLTKLTSHITRDHTFSDNHGQVFQSSSDQLVEQFLQETRAIPQSYRMDDLMREMHEIESQRSALPPIPASTVKDQLHDNAWALQYIEDGKRFNEVYNNENVWAEIMSQEQRQHEFQRLADTWASQGLEGPLDASELFSQEDNLEDSKYVYSKFMKFMKEEGNDSKIEEGKLTEQEAAQWTKEYFDTDEKPATKVETVAQEWSEELERRFVDDREFTVRFG

SEQ ID NO: 21203 - protein, 74 aa, Diabrotica virgifera
  misc_feature: Coding regions on vcDNA: vcDNA=SeqID_900; Strand=+; Position=25-249
YLECAFFLANQIHVLRTFDKSFVHFGHFLEVSKSQVTVIIQVSILCTCHFEISNSTSLVFHNVFVHYFVFWFRI

SEQ ID NO: 21204 - protein, 76 aa, Diabrotica virgifera
  misc_feature: Coding regions on vcDNA: vcDNA=SeqID_901; Strand=-; Position=14-244
RTLEINVTTLTAALRLYKLCEKSLVSRTSVNNDNTAFHIQLQLSLQAHANLLSVSITSQFVPRTHFKRRCCRYLIL

SEQ ID NO: 21205 - protein, 229 aa, Diabrotica virgifera
  misc_feature: Coding regions on vcDNA: vcDNA=SeqID_902; Strand=+; Position=429-1118
RKHHGQRFLYIAAWNLTAPWSKFLINQLEKRQCFPYKIIISVCTLLLAAGVVIPPHFIIYGIFGGTFSNIIYTHLKHIARRRYKSTERSFEGNIQSARAISLLVMPHVVLLLIGNYKIQYVSLIHAAIILNIIPATLIIRLPKVDPENMPGYSRYQTLPIFSQQMKEMKVFTSSSHTSDIKRSESFSVKEESSCDETESEEETEESDDLLMQEEIWLLPIELLRDIYQF

SEQ ID NO: 21206 - protein, 78 aa, Diabrotica virgifera
  misc_feature: Coding regions on vcDNA: vcDNA=SeqID_903; Strand=+; Position=68-304
  misc_feature: Homolog annotation: Hit_ID=BAC40247.1; Match level="QueryCoverage =98%, HitCoverage=100%, E-value=2e-35, Identity=80%"; Hit description= unnamed protein product [Mus musculus]
  misc_feature: Gene Ontology Annotation: Molecular function=molecular_function unknown; Cellular component=nucleus; Biological process=positive regulation of cell proliferation
  misc_feature: Pfam annotation: Pfam_ID=LIM; Match level="Score=75.6, E-value=1.3e -19, Copies=1"; Pfam description=LIM domain
MPNCPKCEKPVYFAERKTSLGKDWHAACLRCEKCNKTLTPGSHAEHEGKPYCNNPCYSAMFGPGGFGRGGAESYVYKK

SEQ ID NO: 21207 - protein, 160 aa, Diabrotica virgifera
  misc_feature: Coding regions on vcDNA: vcDNA=SeqID_904; Strand=-; Position=13-495
  misc_feature: Homolog annotation: Hit_ID=AAG45420.1; Match level="QueryCoverage =68%, HitCoverage=56%, E-value=7e-13, Identity=37%"; Hit description =vegetative cell wall protein gp1 [Chlamydomonas reinhardtii] sp|Q9FPQ6|GP1_CHLRE Vegetative cell wall prot
  misc_feature: Gene Ontology Annotation: Cellular component=extracellular space; Biological process=cell proliferation
MYNVYLNFCIFQFYLYKTQQNNFFFVIIFVYQCPAPHPCPHPPTPKPACPKAKAGAPQTPTPLGPVGPTAPCPLTTPEGPTAPAPVTTPDGPAAPAPVTIPEGPIGLRAWGLMIPAPWPHPKPPNPAPQPKPTTEAEAVAAMQAKARITKEFMLETCSSR

SEQ ID NO: 21208 - protein, 299 aa, Diabrotica virgifera
  misc_feature: Coding regions on vcDNA: vcDNA=SeqID_905; Strand=+; Position=59-954
  misc_feature: Homolog annotation: Hit_ID=NP_731021.1; Match level="QueryCoverage =81%, HitCoverage=49%, E-value=8e-36, Identity=34%"; Hit description =CG1213-PC, isoform C [Drosophila melanogaster] ref|NP_731020.1| CG1213-PB, isoform B [Drosophila
  misc_feature: Pfam annotation: Pfam_ID=Sugar_tr; Match level="Score=-121.5, E-value= 0.0036, Copies=1"; Pfam description=Sugar (and other) transporter
  misc_feature (264)..(264): Xaa can be any naturally occurring amino acid
MADEHTRLTEPVYRSLSIDRRDNLKNGNSQEKRSRWFLYMSAIVVNLLSFTVASGFSWTSSALQKISSDDMSINPLGKPATPTQESWVASLYPLGAAVGPLIAGKLCDTLGRKKTMLAIAVPKLICLVAVCFANDVRIYYAARFIMGMVLGTSFAILPLYLAEISEIHNRGTISSIFSVALNCGILYCLLIGPLCSIKLLTLLCTVPLIMFIFIFGLFIPESPVFLVAVGKHKEALKVLQRVRNTDDVKEELQEITKSLEYTQXEKKGVLDLFKDQHLRKGFDHNKLGWENAFAGPLGI

SEQ ID NO: 21209 - protein, 296 aa, Diabrotica virgifera
  misc_feature: Coding regions on vcDNA: vcDNA=SeqID_906; Strand=+; Position=69-957
  misc_feature: Homolog annotation: Hit_ID=XP_395914.1; Match level="QueryCoverage =93%, HitCoverage=56%, E-value=7e-56, Identity=42%"; Hit description =similar to ENSANGP00000010632 [Apis mellifera]
  misc_feature (232)..(232): Xaa can be any naturally occurring amino acid
  misc_feature (249)..(249): Xaa can be any naturally occurring amino acid
  misc_feature (265)..(265): Xaa can be any naturally occurring amino acid
  misc_feature (275)..(275): Xaa can be any naturally occurring amino acid
MLRNFSSLLTNRPIILHNRNFTSIEVSTALRPFYFAVHPDLFGKYPSERATNESSLQQLSSILEKIQKSKSVPPVSLSFYVKDKAKKTDKFRFININIQGNDIRTTLCTILKSCDLPTDYVDSIIPPPPPSADNNPNSPNFKFRYKNEIDLTKVNQNHPIYAHIKMQMDMKRAQELLRLRNYLKKYAPEALKKSRKGDIHREEVKRLQEIITNELQVEELRWDCSWNEEHRXGCLLSFMSLVNQHASIXDVLRGRVLIFSSFFTXCSLDGHIMLXSGESRHNWVDFFKNIDRYDAA

SEQ ID NO: 21210 - protein, 283 aa, Diabrotica virgifera
  misc_feature: Coding regions on vcDNA: vcDNA=SeqID_907; Strand=+; Position=193-1042
  misc_feature: Homolog annotation: Hit_ID=XP_322007.1; Match level="QueryCoverage =95%, HitCoverage=72%, E-value=1e-118, Identity=74%"; Hit description= ENSANGP00000012066 [Anopheles gambiae]
  misc_feature: Pfam annotation: Pfam_ID=DUF525; Match level="Score=78.6, E-value =1.6e-20, Copies=1"; Pfam description=Protein of unknown function (DUF525)
  misc_feature (270)..(270): Xaa can be any naturally occurring amino acid
MDIVSITLRCNVIPVVSRLLVARRNYARLAEVGRLETPKVSGKYETGQLILHRVFGYRGVVLFPWLARVYDRDLPSRNEGDEEASAAVGKEVRGRTHTFYQVLIDQRDCPYIRAQTEAVTFLGNQDSSRSLYAIPGLDYVAHEDIIPYASAEKTPLNHELFDKFLMANPKGDPPFVAQETLKAWQNKNHPWLELSDVHKETTENIRVTVIPFYMGSRDSHASSVYWWRYCIRLENLGSLSVQLRERHWRIFSLSGTLQTVRGRGVVGQQXLLQERLPAFHDSN

SEQ ID NO: 21211 - protein, 388 aa, Diabrotica virgifera
  misc_feature: Coding regions on vcDNA: vcDNA=SeqID_908; Strand=+; Position=3-1167
  misc_feature: Homolog annotation: Hit_ID=AAL39579.1; Match level="QueryCoverage =98%, HitCoverage=72%, E-value=1e-141, Identity=63%"; Hit description= LD14125p [Drosophila melanogaster]
  misc_feature: Gene Ontology Annotation: Molecular function=transcriptional activator activity; Cellular component=nucleus; Biological process =regulation of transcription from Pol II promoter
  misc_feature: Pfam annotation: Pfam_ID=SPOC; Match level="Score=140.7, E-value=3.5e- 39, Copies=1"; Pfam description=SPOC domain
  misc_feature (122)..(122): Xaa can be any naturally occurring amino acid
  misc_feature (354)..(354): Xaa can be any naturally occurring amino acid
  misc_feature (367)..(367): Xaa can be any naturally occurring amino acid
HRAKVELSGQYIGKFQCKIGYGKATPTTKIWVGGLGPWTSITQLEREFDRFGAIKKIDYVKGDNQALILYDSIDAATAAVKEMRGFPLGGPERRLRTDFADVTPGVTYRPKPPLLLQKIIEXREVEYDYDYERDPYRMRPYPEKRGTSRDPYRYPEGREDEWGRSRDPEFERRRSGSRGFDRSRSRSPRRSPDSDSDGGSRRAGLLASSRTLPEVARKCATVWQGALILKNSLFPAKFHLFDGDTDIVDSLMKDEDGKHQLRITQRLRLDQPKLEDVQKRISSASSHAIFLGLAGSTASVTNDDATVQTRPLRNLVSYLKQKEAAGVISLLNKETEATGVLYSFPPCQFSTELXKRTCPNLSDEAIXGDHLIIVVVRGGTALVFLSTH

SEQ ID NO: 21212 - protein, 353 aa, Diabrotica virgifera
  misc_feature: Coding regions on vcDNA: vcDNA=SeqID_909; Strand=+; Position=233-1290
  misc_feature: Homolog annotation: Hit_ID=XP_312436.1; Match level="QueryCoverage =87%, HitCoverage=69%, E-value=1e-84, Identity=51%"; Hit description =ENSANGP00000023709 [Anopheles gambiae]
  misc_feature: Pfam annotation: Pfam_ID=AMP-binding; Match level="Score=-99.6, E -value=0.0059, Copies=1"; Pfam description=AMP-binding enzyme
  misc_feature (329)..(329): Xaa can be any naturally occurring amino acid
MLARNRIAFLIQNSPNGIIALLPNSLGNKRTYSVQLNNPRKRNVVRSNERVGQFVRNLGSGIVKSPLGDSEPVPNSNLVEYVFEKSDEWGDEIAATCAVSGRNYTFSMLRFLVNRFAQAALSHCAMKPREVVGLLLPNIPEFVIVCHGAMEAGLVVTFVNPLYTPDEIKRQFQNAGVKMIITVPLLLEVATTIAPSLTGYRTTVCIGGEDDISKNVNGLESLLRAGHESELPGINPRELALLPYSSGTTGLPKGVMLSHYNLVANLVQGDRDDLIARKTKAGGRHTVLSVLPFFHIFGFNGILNIVLRTGNHMITIPRFTPEDYAKALXKYRPTFLFVVPSLLQFLASHPAIT

SEQ ID NO: 21213 - protein, 246 aa, Diabrotica virgifera
  misc_feature: Coding regions on vcDNA: vcDNA=SeqID_910; Strand=+; Position=37-777
  misc_feature: Homolog annotation: Hit_ID=AAR22385.1; Match level="QueryCoverage =95%, HitCoverage=98%, E-value=2e-69, Identity=50%"; Hit description =cellulase II [Apriona germari]
  misc_feature: Pfam annotation: Pfam_ID=Glyco_hydro_45; Match level="Score=292.9, E -value=5.3e-85, Copies=1"; Pfam description=Glycosyl hydrolase family 45
MLSLKIAVAILSLAGVTIAQDLTPIPGGKSGDGVTTRYWDCCAPSCAWYPRIHTQNGVPIQTCKADGVTPSDKDLNAQSGCEVGGVAYTCTNQSPKIINETLAYTFVAASFAGGLDYADCCICLVMDFKGKLAGKRLLAQVTNTGEALGQNHFDIQMPGGGVGIYNLGCKTQWNAPDDGWGERYGGVTDIKGCKQLPEQLQEGCRFRFTWMKGVPNPPVSFYQIKCPEYFVGVSKCGDLFVKELTN

SEQ ID NO: 21214 - protein, 152 aa, Diabrotica virgifera
  misc_feature: Coding regions on vcDNA: vcDNA=SeqID_911; Strand=+; Position=398-856
  misc_feature: Homolog annotation: Hit_ID=EAL25384.1; Match level="QueryCoverage =94%, HitCoverage=97%, E-value=7e-68, Identity=84%"; Hit description =GA17915-PA [Drosophila pseudoobscura]
  misc_feature: Gene Ontology Annotation: Cellular component=cytosolic ribosome (sensu Eukarya); Biological process=protein biosynthesis
  misc_feature: Pfam annotation: Pfam_ID=Ribosomal_S9; Match level="Score=275.2, E -value=1.1e-79, Copies=1"; Pfam description=Ribosomal protein S9/S16
MQAPTTKPKRDPIHSVQVFGRKKSATAVAYCKRGRGVLRVNGRPLSQVEPKMLQDKLQEPILLLGKDKFSAVDIRVRVNGGGHVSQIYAIRQAISKALVAYYQKYVDEASKKELKDILIQYDRTLLVADPRRCEPKKFGGPGARARYQKSYR

SEQ ID NO: 21215 - protein, 328 aa, Diabrotica virgifera
  misc_feature: Coding regions on vcDNA: vcDNA=SeqID_912; Strand=+; Position=60-1044
  misc_feature: Homolog annotation: Hit_ID=NP_730023.1; Match level="QueryCoverage =98%, HitCoverage=51%, E-value=1e-134, Identity=73%"; Hit description= CG6854-PC, isoform C [Drosophila melanogaster] gb|AAF49665.1| CG6854 -PC, isoform C [Drosophila
  misc_feature: Gene Ontology Annotation: Molecular function=CTP synthase activity; Cellular component=cytosol; Biological process=pyrimidine base metabolism
  misc_feature: Pfam annotation: Pfam_ID=CTP_synth_N; Match level="Score=643.8, E -value=1.2e-190, Copies=1"; Pfam description=CTP synthase N-terminus
  misc_feature (307)..(307): Xaa can be any naturally occurring amino acid
MKYILVTGGVISGVGKGVISSSFGAILKCCGIEVTSIKIDPYINLDAGTFSPYEHGEVYVLDDGGEVDLDLGNYERFLNVTLHRENNITTGKIYKHVIDKERHGDYLGKTVQVVPHITDAIQEWVERVAQKPVSESGKTPEVCIIELGGIVGDIESMAFVEAFRQFQFRVKRENFCVAHVSLIPQPRTTGEHKTKPTQSSVRELRGLGLSPDIIVCRSEKPIGHSVKEKISNFCHVAPEQIISIPDLKSVYEVPVFMENHGMAEYLCRRLQLGITPLPPLKKYMKPWIDLGDRMTNLKNQVTIGIVXGKYPRLEDSYTPITKALNMLE

SEQ ID NO: 21216 - protein, 464 aa, Diabrotica virgifera
  misc_feature: Coding regions on vcDNA: vcDNA=SeqID_913; Strand=+; Position=10-1400
  misc_feature: Homolog annotation: Hit_ID=XP_312883.1; Match level="QueryCoverage =95%, HitCoverage=98%, E-value=1e-122, Identity=48%"; Hit description= ENSANGP00000014744 [Anopheles gambiae]
  misc_feature: Pfam annotation: Pfam_ID=EMP24_GP25L; Match level="Score=83.4, E -value=6e-22, Copies=1"; Pfam description=emp24/gp25L/p24 family
  misc_feature (208)..(208): Xaa can be any naturally occurring amino acid
  misc_feature (444)..(444): Xaa can be any naturally occurring amino acid
MATESDSSQISDNFNKIALENGNTTTSNKSTATLETAEYGLPLKEVYKLGFNFYKEKEGKAVHYSYEDKLQLVAFSQQVLHGPYADAVHKLPPLGTLDVVGRDRRVAWQKLGQLSADQARAGFVELLSRKCPLFSTYIEAHRREKKEQERRAHQEEERQKVEEEERLKKLEEEKVLQEEMWRQEAIKRQIQLALNQQTYEQFRKYAEXQYPGDPEKQGSLIKQLQEQHYIQYMQQLQATQREKENHKDAHSDKEDAVDVAEQADEKSISNSQNNDSEEMNIVTASMWTRAEVDAFKQSVSQGEGDGVVRVGHGETVTVRVPTHPHGSRLFWEFATDHYDIGFGVYFEFGTPKTEEVSVHVSESDDEDLDELDDDDEVFDEETIRTSDLESGSVTLNGISKPLLHEIVPVYRRDCQNEVYAGSHPYPGKGVYLLKFDNSYSLWRXQTLYYRVYYTRLCIKYFFIL

SEQ ID NO: 21217 - protein, 228 aa, Diabrotica virgifera
  misc_feature: Coding regions on vcDNA: vcDNA=SeqID_914; Strand=+; Position=178-864
  misc_feature: Homolog annotation: Hit_ID=XP_392226.1; Match level="QueryCoverage =92%, HitCoverage=82%, E-value=4e-66, Identity=61%"; Hit description =similar to CG11638-PA [Apis mellifera]
  misc_feature: Gene Ontology Annotation: Molecular function=calcium ion binding
  misc_feature: Pfam annotation: Pfam_ID=efhand; Match level="Score=114.6, E-value =2.4e-31, Copies=4"; Pfam description=EF hand
MSQKESESVDATSHPPMLIETTEKSDGVPSRSPSDELSKLRPEDRSRNQSFSIRNMQVSRSQMKEYREAFRLFKDGDGSITKEELGKVMRSLGQFARTEELKQMLQEIDIDGDGNVSFEEFVDIAWSASSGRDPDHTMSLEEEEKELRDAFRVFDKHNRGYIVSSDLRAVLHCLGEDLSDEEIEEMIKEVDVDGDGRIDFYEFVNALGEPGNEDSYDDDDDDYLSFYN

SEQ ID NO: 21218 - protein, 190 aa, Diabrotica virgifera
  misc_feature: Coding regions on vcDNA: vcDNA=SeqID_915; Strand=+; Position=58-630
  misc_feature: Homolog annotation: Hit_ID=CAH04319.1; Match level="QueryCoverage =100%, HitCoverage=100%, E-value=4e-97, Identity=94%"; Hit description=S7e ribosomal protein [Timarcha balearica]
  misc_feature: Gene Ontology Annotation: Molecular function=structural constituent of ribosome; Cellular component=cytosolic ribosome (sensu Eukarya); Biological process=morphogenesis
  misc_feature: Pfam annotation: Pfam_ID=Ribosomal_S7e; Match level="Score=475.7, E -value=4.7e-140, Copies=1"; Pfam description=Ribosomal protein S7e
MATKIIKSGGAEPDAFETQVAQSLLELEMNSDLKAQLRELHITKAREIELNNKKSVIIYVPMPKLKQFQKIQTRLVRELEKKFSGKHVVFVGERKILPKPTRKTRAANKQKRPRSRTLTSVYDAILEDLVFPAEIVGKRIRVRLDGSQLIKVHLDKNQQTTIEHKVDTFASVYKKLTGREVTFEFPEPYL

SEQ ID NO: 21219 - protein, 263 aa, Diabrotica virgifera
  misc_feature: Coding regions on vcDNA: vcDNA=SeqID_916; Strand=-; Position=519-1310
  misc_feature: Homolog annotation: Hit_ID=CAH64513.1; Match level="QueryCoverage =96%, HitCoverage=47%, E-value=1e-50, Identity=40%"; Hit description =putative esterase [Tribolium castaneum]
  misc_feature: Gene Ontology Annotation: Molecular function=carboxylesterase activity
  misc_feature (31)..(31): Xaa can be any naturally occurring amino acid
PSGLVVDSWAEDPVFPEHPFLLLQKGLTQDXPWMISYTSSEGLYPASDFYFDEYTEYLDKNWDSIMPLILHYHESVPKYQMDKVSQKIRQEYLKKTPVSRRDYAKFVKILSDRLFIKDIETAARLQSEATKSSVYSYYFNYRGAHSSSEYKTHSSVDIGVSHADDTAYTLKAAKMDTLSTEDDRQMTKLMLDMLTSFMDTGKPNVSADWKPLSKKASDPWVQLHIAGPRKTFLEEKDHIGNKKFWDSLPIEENERLFTKKDEL

SEQ ID NO: 21220 - protein, 475 aa, Diabrotica virgifera
  misc_feature: Coding regions on vcDNA: vcDNA=SeqID_917; Strand=+; Position=136-1560
  misc_feature: Homolog annotation: Hit_ID=EAL28693.1; Match level="QueryCoverage =94%, HitCoverage=16%, E-value=3e-20, Identity=27%"; Hit description =GA15524-PA [Drosophila pseudoobscura]
  misc_feature: Gene Ontology Annotation: Molecular function=protein binding; Cellular component=nucleus; Biological process=embryogenesis and morphogenesis
MDEMSVQQTNENPEESDSHLPQELSQIYDPEKDTASPIHDSSQAGDSSVLDHTYDPENCIRSEETLNTDAEKTLDLDQGYDPENIYEENSNSNEKDVDIEKAIYQFNSQNADTSGISTGDRYDPALPFDDDADADSKRDSDNDTQNEGNTTVIPNNEIVTNQPQSDKKSKSAKSKRKSKSKGNTLYSDSEDDENIVKKGANSFGVTDINEMTEDICEEERSYTPCLDEKSQKQGLEGLETELISDEDRNDFDEAQELKTVSDGDALEINAKESELDLARPEDYEEGEIVDKNKDKDVPNEEPEVESEAEKSPKEATPELKTTERKKKDASKSPAVDKGGNKENEESGKDASFKRLSKSSKGRNYRDKEKRPSDSRNRSRTPDREYNKKEKRREKRKELERYNVRAIIADKPRPLIAKDQFGRDIRNTPSRSRSRSYTPPPRSASRPVRSPSKTIRRSPSRSRRSLSKRKSPSGRV

SEQ ID NO: 21221 - protein, 195 aa, Diabrotica virgifera
  misc_feature: Coding regions on vcDNA: vcDNA=SeqID_918; Strand=+; Position=376-960
  misc_feature: Homolog annotation: Hit_ID=1N5D; Match level="QueryCoverage=97%, HitCoverage=66%, E-value=2e-41, Identity=50%"; Hit description=Chain A, Crystal Structure Of Porcine Testicular Carbonyl Reductase 20beta -Hydroxysteroid Dehydrogenase
  misc_feature: Gene Ontology Annotation: Molecular function=carbonyl reductase (NADPH) activity; Cellular component=cytosol; Biological process =biological_process unknown
  misc_feature: Pfam annotation: Pfam_ID=adh_short; Match level="Score=24.9, E-value =1.2e-07, Copies=1"; Pfam description=short chain dehydrogenase
MSSQKVAVVTGGNKGIGYAIVKGLCERFDGLVYLTARDVERGQAAVAQLEKENLKAVFHQLDINSQTSVDELRDFIQKEHGGLDLLINNAAIAFGRAATESPFVQASKTIEANYFGTLRVCEALFPLLRNNAKVVNVSSSEGHLSKIPTENLRNELSRNDLTIPELSKLLEKFVKLQKNTHTLKDGWGNSTYAGF

SEQ ID NO: 21222 - protein, 282 aa, Diabrotica virgifera
  misc_feature: Coding regions on vcDNA: vcDNA=SeqID_919; Strand=+; Position=86-934
  misc_feature: Homolog annotation: Hit_ID=XP_416721.1; Match level="QueryCoverage =91%, HitCoverage=94%, E-value=3e-57, Identity=46%"; Hit description =PREDICTED: similar to Carbonyl reductase [NADPH] 1 (NADPH-dependent carbonyl reductase 1)
  misc_feature: Gene Ontology Annotation: Molecular function=carbonyl reductase (NADPH) activity; Cellular component=cytosol; Biological process =biological_process unknown
  misc_feature: Pfam annotation: Pfam_ID=adh_short; Match level="Score=87.5, E-value =3.4e-23, Copies=1"; Pfam description=short chain dehydrogenase
MSSQKVAVVTGGNKGIGYAIVKGLCERFDGLVYLTARDVERGQAAVAQLEKENKKAVFHQLDINNQASVDELRDFIKDRHGGLDLLINNAAIAFGRAATESPFVQASKTIEANYFGTLRVCEALFPLLRNNAKVVNLSSAAGHLSKIPTEKLRNEFSRKDLTIPELSKLLEKFVKATENNTHVEDGWGNSTYAVSKVGVTALTIIQQRLFDEEQPNRNISINAVHPGYVKTDMTSHNGLLSIEEGAKSSLFAALDADLKGKYIWKDCTLVDWYSKEMPNPPY

SEQ ID NO: 21223 - protein, 87 aa, Diabrotica virgifera
  misc_feature: Coding regions on vcDNA: vcDNA=SeqID_920; Strand=-; Position=559-822
KWVTGLLTGHCPLRYHLKKMGKSDSENCRFCDNEKETAEHILCNCVALFCTRLKFLEEVTLTPSDIGNKSPRMLINFIKSIGILEFN

SEQ ID NO: 21224 - protein, 300 aa, Diabrotica virgifera
  misc_feature: Coding regions on vcDNA: vcDNA=SeqID_921; Strand=+; Position=67-966
  misc_feature: Homolog annotation: Hit_ID=EAL25760.1; Match level="QueryCoverage =95%, HitCoverage=42%, E-value=1e-108, Identity=62%"; Hit description= GA17312-PA [Drosophila pseudoobscura]
  misc_feature: Gene Ontology Annotation: Molecular function=14-alpha-glucan branching enzyme activity; Cellular component=cellular_component unknown; Biological process=glycogen metabolism
  misc_feature: Pfam annotation: Pfam_ID=Isoamylase_N; Match level="Score=79.8, E -value=7.2e-21, Copies=1"; Pfam description=Isoamylase N-terminal domain
  misc_feature (295)..(296): Xaa can be any naturally occurring amino acid
MGGKYTKLDPMEVEVPEIDALLNRDGYLRPYEREIRRRYACFKDIEENIEQNGGGLDKFTQGYKYYGINVQQDNTIICREWAPGAQQLFLTGDFNGWNRDSHPYKKLEYGKWELILPPNQDGSPAIPHLSELKVVVQTWEGHKVDRLSPYATYAVEPPKHEGTIYKQKFWNPPQTQRYIFRHKKVPRPKSLRIYECHVGIATQEPKVGTYDNFTDNVLPRIVKQGYNCIQLMAVMEHAYYASFGYQVTSFYAASSRYGTPEELSVWWTEHMSWGLMVLLDLVHSHASKNVMDGLXXIDGT

SEQ ID NO: 21225 - protein, 123 aa, Diabrotica virgifera
  misc_feature: Coding regions on vcDNA: vcDNA=SeqID_922; Strand=+; Position=30-401
  misc_feature: Homolog annotation: Hit_ID=NP_727016.1; Match level="QueryCoverage =100%, HitCoverage=100%, E-value=1e-49, Identity=82%"; Hit description=CG4111-PA, isoform A [Drosophila melanogaster] ref|NP _572243.1| CG4111-PB, isoform B [Drosophila
  misc_feature: Gene Ontology Annotation: Molecular function=structural constituent of ribosome; Cellular component=nucleolus; Biological process =protein biosynthesis
  misc_feature: Pfam annotation: Pfam_ID=Ribosomal_L29; Match level="Score=87.3, E -value=4.1e-23, Copies=1"; Pfam description=Ribosomal L29 protein
MGKVKCADLRTKDKKELTKQLDELKTELTSLRVAKVTGGAPSKLSKIRVVRKAIARVYIVMHQKQKENLRKLYKNKKYKPLDLRPKKTRSIRRALSTHEQRIKTPKEIRKRSAFPARKFALKA

SEQ ID NO: 21226 - protein, 314 aa, Diabrotica virgifera
  misc_feature: Coding regions on vcDNA: vcDNA=SeqID_923; Strand=+; Position=63-1004
  misc_feature: Homolog annotation: Hit_ID=XP_392002.1; Match level="QueryCoverage =97%, HitCoverage=46%, E-value=7e-51, Identity=35%"; Hit description =similar to ENSANGP00000024998 [Apis mellifera]
  misc_feature: Gene Ontology Annotation: Cellular component=membrane; Biological process=electron transport
  misc_feature: Pfam annotation: Pfam_ID=p450; Match level="Score=-198.0, E-value =0.04, Copies=1"; Pfam description=Cytochrome P450
  misc_feature (288)..(288): Xaa can be any naturally occurring amino acid
EYFRLGQKMLQLILLGLVVVLFYWYAIKPMSYWRKRGVLQQKPMWLFGDSWRIFLRLESFASMFQRAYDLDPNSRIVGIYQFTTPVLLIKDPQLLKKVTLKDAEYFMNRRQVLPENGDPLFTKNLIGLKDQKWRNMRHILTPSFTSSKMKTMFALIDECCIKFVKHISQKDQEVVKVTMMDIVGRFACDVIASTAFGFRSNAMEDPNNDFYVMSEDLTNFTTARKSFKIIGFMLVPKLLELFNVFLFDGYSRQYFLDLISKTIKDREEKNIVRADMIHLLMEKQEEIXKSSSAIQEINVEDITAHAIIFFLCWF

SEQ ID NO: 21227 - protein, 115 aa, Diabrotica virgifera
  misc_feature: Coding regions on vcDNA: vcDNA=SeqID_924; Strand=+; Position=135-482
  misc_feature: Homolog annotation: Hit_ID=XP_392014.1; Match level="QueryCoverage =83%, HitCoverage=80%, E-value=5e-31, Identity=69%"; Hit description =similar to CG17248-PA [Apis mellifera]
  misc_feature: Gene Ontology Annotation: Molecular function=v-SNARE activity; Cellular component=plasma membrane; Biological process=synaptic vesicle fusion
  misc_feature: Pfam annotation: Pfam_ID=Synaptobrevin; Match level="Score=138.4, E -value=1.7e-38, Copies=1"; Pfam description=Synaptobrevin
METPGASRAPSKLEQTQQQVNEVVGIMRVNVEKVLERDQKLSELDSRADALQEGGKRFEQQAQKLKRKYWWKNIKMMIIMGVIGLIILIIIIISIANAVKGDDTTSSSVTSAPPK

SEQ ID NO: 21228 - protein, 292 aa, Diabrotica virgifera
  misc_feature: Coding regions on vcDNA: vcDNA=SeqID_925; Strand=+; Position=56-934
  misc_feature: Homolog annotation: Hit_ID=XP_312138.1; Match level="QueryCoverage =93%, HitCoverage=49%, E-value=1e-34, Identity=32%"; Hit description =ENSANGP00000022011 [Anopheles gambiae]
  misc_feature: Gene Ontology Annotation: Cellular component=membrane fraction; Biological process=steroid metabolism
QKMKLLIFLLSCTFGHSAKILGFFAIPSISHQIIFQPVWKELSLRGHDVTVITTDPLKDPNLTNLTEIDTSRMYGRLFDMGWPHKASSANSIFGRVAFLCDITSGVVEEQLGEVLSLLNKGEKFDLVLVQISYNLNLALAAAHAFGEPPVVGISSLGLFLHSHDALGNPTHPIVSPDMMLNFSGKLSFFDKVQSFLYNIWYRMFYYWYALPKADKIARKYFGDDMPYLGDLEKNISLLLLNVNPIIHNVRPNVPNVIEINQMHIKKRKPVPKDIQDYLNSAPTGVVLLQFGI

SEQ ID NO: 21229 - protein, 574 aa, Diabrotica virgifera
  misc_feature: Coding regions on vcDNA: vcDNA=SeqID_926; Strand=+; Position=136-1860
  misc_feature: Homolog annotation: Hit_ID=NP_727489.1; Match level="QueryCoverage =100%, HitCoverage=100%, E-value=0.0, Identity=79%"; Hit description =CG12101-PB, isoform B [Drosophila melanogaster] ref|NP_511115.2| CG12101-PA, isoform A [Drosophila
  misc_feature: Gene Ontology Annotation: Molecular function=heat shock protein activity; Cellular component=mitochondrion; Biological process =mitochondrial translocation
  misc_feature: Pfam annotation: Pfam_ID=Cpn60_TCP1; Match level="Score=680.1, E -value=1.4e-201, Copies=1"; Pfam description=TCP-1/cpn60 chaperonin family
MYRLPNTVRSVALRKAHINNQVQRWYAKDVRFGSEVRALMLQGVDVLADAVAVTMGPKGRNVIIEQSWGSPKITKDGVTVAKGVELKDKFQNIGARLVQDVANNTNEKAGDGTTTATVLARSIAKEGFDNLGKGANPVEIRKGIISAVEEIVKSLKSLSKPVTTPEEIRQVATISANGDESVGNLIADAMKKVGKEGVITVKDGKTLHDELDIIEGMKFDRGYISPYFVNTPKGAKVEYQDALLLLSEKKISSVQSIVPALELANAQRKPLIIIAEDVDGEALTTLVVNRLRIGLQIAAVKAPGFGDNRKATLQDIAIATGGLVFGDDANIVKLEDVKLSDLGNTGEIVITKDDTLILKGKGKKEDIDRRADHLRDQIETTTSEYEKEKLQERLARLASGVAVLKVGGSSEVEVNEKKDRVTDALNATRAAIEEGIVPGGGTALLRCSPSLDALKPANKDQEVGIQIVKRALRVPCMTIARNAGVDGASVVAKVEQQQGDYGYDALNNEYVNMYERGVIDPTKVVRTAIVDASGVASLLTTAEAVITEIPKEEPAMPAGGMGGMGGMGGMGGMM

SEQ ID NO: 21230 - protein, 106 aa, Diabrotica virgifera
  misc_feature: Coding regions on vcDNA: vcDNA=SeqID_927; Strand=+; Position=103-423
  misc_feature: Homolog annotation: Hit_ID=XP_310592.1; Match level="QueryCoverage =83%, HitCoverage=46%, E-value=1e-14, Identity=43%"; Hit description =ENSANGP00000025057 [Anopheles gambiae]
MADQSELRSNELLLPLQTKQAAIALGKLMFFSVLMFTLPFVAFFGTKYILQEHFDVIGFTNTVWSVLFSVVTVNLIIVAYAYIAYLEPDYDEKGNVKEESRNKKQM

SEQ ID NO: 21231 - protein, 75 aa, Diabrotica virgifera
  misc_feature: Coding regions on vcDNA: vcDNA=SeqID_928; Strand=+; Position=73-300
  misc_feature: Pfam annotation: Pfam_ID=Kazal_2; Match level="Score=45.2, E-value =1.9e-10, Copies=1"; Pfam description=Kazal-type serine protease inhibitor d
MKAVFIFSMVIFVTMVATEIREDHDCICPDYWEPVCGTDNKTYSNLCFINCEAQYNPGLEIAYLGCCVDDPDPCA

SEQ ID NO: 21232 - protein, 103 aa, Diabrotica virgifera
  misc_feature: Coding regions on vcDNA: vcDNA=SeqID_929; Strand=+; Position=24-335
  misc_feature: Homolog annotation: Hit_ID=XP_320593.1; Match level="QueryCoverage =85%, HitCoverage=15%, E-value=7e-28, Identity=65%"; Hit description =ENSANGP00000015219 [Anopheles gambiae]
  misc_feature: Gene Ontology Annotation: Cellular component=lamin filament; Biological process=nuclear envelope reassembly
  misc_feature: Pfam annotation: Pfam_ID=IF_tail; Match level="Score=-8.2, E-value =2.5e-05, Copies=1"; Pfam description=Intermediate filament tail domain
HISFHRSLKLEGNGFVTIWSSDLNKDHEPPTNLVMKSQKWVVGDNMVTTLLNNNGDEVAVSERVKRQLTSSHLRHRELAAGYLSEELHHQQGDPQVDERCRLM

SEQ ID NO: 21233 - protein, 460 aa, Diabrotica virgifera
  misc_feature: Coding regions on vcDNA: vcDNA=SeqID_930; Strand=+; Position=42-1424
  misc_feature: Homolog annotation: Hit_ID=AAP94045.1; Match level="QueryCoverage =93%, HitCoverage=46%, E-value=3e-92, Identity=41%"; Hit description =membrane alanyl aminopeptidase [Tenebrio molitor]
  misc_feature: Gene Ontology Annotation: Molecular function=receptor activity; Cellular component=integral to plasma membrane; Biological process =pathogenesis
  misc_feature: Pfam annotation: Pfam_ID=Peptidase_M1; Match level="Score=374.0, E -value=2e-109, Copies=1"; Pfam description=Peptidase family M1
MTPLSFLSVLLVFLPFVYLQEYRLPKTVVPSHYALSFTFNRQVFAGTIFEFSGSTVITIKTSESVANIQLHADPSFLRIGAISLDQGGEIDSYNVDAVTQILTITTKAALNPEIEYKLTITYRADISTKEMIGLYQSTYQDANQATNYLVATQLEPTYARRVFPCFDEPSFKATFQVSFTLGPNITPRTNTKLESSNQMTPSILQYTFVTTPVMSTYLLSFVISNLDCTDAATINGVQNSVCSRPGTENLRDWAVNIAPKILASLGEYTKLDYNLSMNKMDYVAIPDFSVEAMENWGLSTYREQSLLYDPEHSTNIDKQNVATLLAHEIAHQWFGNLVTCNWWSETFLNEAFGDYFEYFAAHMILPAWQLDKQHVVNNVQKALRADEGNLPALQSTVSSPVEILGRFNVGSYTKGSSILRMVEHILGSKNFKDGIYHYLNSHKFKSTTSSDFVERVPTRI

SEQ ID NO: 21234 - protein, 233 aa, Diabrotica virgifera
  misc_feature: Coding regions on vcDNA: vcDNA=SeqID_931; Strand=+; Position=1-702
  misc_feature: Homolog annotation: Hit_ID=AAQ01583.1; Match level="QueryCoverage =78%, HitCoverage=73%, E-value=1e-54, Identity=53%"; Hit description =reverse transcriptase [Aedes albopictus]
RLMPNIGGPNQNRRMLLSSVITSVLTYGISIWADALGTQKSRRKIASVYRLSALRVASAFRTVSDDAIHVIAGMLPIGILAEERKTLYRQRDERGEHRRTERQNSIRRWQIQWDSTTKGRWTHRLIPQLNLWLNRKHGEVNYYLTQMLSGHGCFRAYLYRFKHDDSPECPSCLGISEDVEHVFFVCPRFNLLRNYHQPTNKTRDFSRNDAFIDSSLGCHKHLCDASAPGTSSN

SEQ ID NO: 21235 - protein, 210 aa, Diabrotica virgifera
  misc_feature: Coding regions on vcDNA: vcDNA=SeqID_932; Strand=+; Position=2-634
  misc_feature: Homolog annotation: Hit_ID=NP_788857.1; Match level="QueryCoverage =77%, HitCoverage=20%, E-value=1e-34, Identity=46%"; Hit description =CG2930-PB, isoform B [Drosophila melanogaster] ref|NP_788856.1| CG2930-PA, isoform A [Drosophila
  misc_feature: Gene Ontology Annotation: Molecular function=proton-dependent oligopeptide transporter activity; Cellular component=integral to plasma membrane; Biological process=transport
YLILDTDVKYTLKGKSININSGNTSAKEFSSPGHWSINVGKKQFNKTVNLELGGTYAVMLNKNQMEMAYTIVTKPNSVHIAWLLPQYFIITAAEIMFSITGLEFSYSQAPASMKSLLQACFLLTTAFGNLIIVIIESMEIFEKKSNDFFLYCGLMVADMLIFSFMAMRYKYIKKEESPPISEIEPIATKENQNGGIDNPSFVKSSNNVNA

SEQ ID NO: 21236 - protein, 165 aa, Diabrotica virgifera
  misc_feature: Coding regions on vcDNA: vcDNA=SeqID_933; Strand=+; Position=160-657
  misc_feature: Homolog annotation: Hit_ID=XP_312872.1; Match level="QueryCoverage =77%, HitCoverage=59%, E-value=1e-51, Identity=76%"; Hit description =ENSANGP00000014750 [Anopheles gambiae]
  misc_feature: Gene Ontology Annotation: Molecular function=protein binding
  misc_feature: Pfam annotation: Pfam_ID=HLH; Match level="Score=76.9, E-value=5.3e -20, Copies=1"; Pfam description=Helix-loop-helix DNA-binding domain
MMSDDDRDIDVESDEGDDSDSRQATSRQNAGGQYYSQAEKRAHHNALERKRRDHIKDSFSSLRDSVPALNGEKASRAQILKKAAEYILFMRKKNSSHQQDIEDLKRQNNLLEAQIRTLEKAKTTGDIKDDVFIETESDTSDFEGSIQQRRPKKMKVVSYHSINKE

SEQ ID NO: 21237 - protein, 245 aa, Diabrotica virgifera
  misc_feature: Coding regions on vcDNA: vcDNA=SeqID_934; Strand=+; Position=842-1582
  misc_feature: Homolog annotation: Hit_ID=S34399; Match level="QueryCoverage=88%, HitCoverage=30%, E-value=2e-51, Identity=49%"; Hit description =dynamin 3 - fruit fly (Drosophila melanogaster) emb|CAA42067.1| dynamin [Drosophila melanogaster]
  misc_feature: Gene Ontology Annotation: Molecular function=protein binding; Cellular component=coated pit; Biological process=synaptic transmission
  misc_feature: Pfam annotation: Pfam_ID=Dynamin_M; Match level="Score=19.8, E-value =1.2e-11, Copies=1"; Pfam description=Dynamin central region
  misc_feature (33)..(33): Xaa can be any naturally occurring amino acid
  misc_feature (68)..(68): Xaa can be any naturally occurring amino acid
  misc_feature (91)..(91): Xaa can be any naturally occurring amino acid
  misc_feature (181)..(181): Xaa can be any naturally occurring amino acid
  misc_feature (212)..(212): Xaa can be any naturally occurring amino acid
LFITNCLITKLKLISVGTAVRDILENKLFILRXDTSAVISESYRDEVFVSHPSYRHIAECLGMPYLQXVLNQQLTNHIRDTLPSLKDKLQXQLLQREKGMDRSLKTKAMYVTYYDPASEPRQNHRKFRLAQINSSELSGGAQIITLFHEKFSFEIVKLEFDVKKLRREIAFPGMAFEAIVXITLLREPSLKSVDLVVQELSNVGRMCSYRMXRYPRLKPTTKIWPIALFLFYSVSTEHKIKILYV

SEQ ID NO: 21238 - protein, 130 aa, Diabrotica virgifera
  misc_feature: Coding regions on vcDNA: vcDNA=SeqID_935; Strand=+; Position=67-456
  misc_feature: Homolog annotation: Hit_ID=CAE47500.1; Match level="QueryCoverage =95%, HitCoverage=36%, E-value=1e-21, Identity=44%"; Hit description =cathepsin L-like proteinase [Diabrotica virgifera virgifera]
MCKGIKMKYFVIILIAIFVTIEALTDKEQWMQYKKKYNKNYKFRSVDNERFIIFQQNLRQIEEHNARAESGLSTFEMGITKFADMTAEEFSRWVSRSQSDHNRFFSKGQQSLHTDLSIKANPPSEVDWRK

SEQ ID NO: 21239 - protein, 396 aa, Diabrotica virgifera
  misc_feature: Coding regions on vcDNA: vcDNA=SeqID_936; Strand=+; Position=176-1366
  misc_feature: Homolog annotation: Hit_ID=XP_392829.1; Match level="QueryCoverage =97%, HitCoverage=52%, E-value=1e-155, Identity=71%"; Hit description= similar to CG8635-PA [Apis mellifera]
  misc_feature: Gene Ontology Annotation: Molecular function=molecular_function unknown; Cellular component=cytoplasm; Biological process=biological_ process unknown
  misc_feature: Pfam annotation: Pfam_ID=zf-CCCH; Match level="Score=31.6, E-value =2.4e-06, Copies=1"; Pfam description=Zinc finger C-x8-C-x5-C-x3-H type (an
MPPKPKPGAPSKKTEQKKKEKVIEDKTFGLKNKKGAKQQKFIQQVEKQVKSGGIHPLGTAVDQKKLEKEKKLKEQKELAALFKPVQIQKIDKGADPKSVVCAFFKQGQCGKGDKCKFSHDLAVERKAEKRSLYFDMRNDEDDNDTMENWDEAKLKEVIEKKHGEKGKMPTTDIICKHFLEAVEKSKYGWFWTCPTGEGCIYRHALPPGFVLKKDKKKLEDKANEITLEDLIEKERAALGPNQTRITLETFLAWKKRKIQEKKDQLKKDEDKKRNEFKAGRQVGLSGREMFSFNPDLATEYDMEDGDELFDSTAYPTEEEDAIVYKEIDLSIIGDDVQEVDGTGTVATEDRFKDVKPTTSDEKPAEGATAVAINENLFLESDLEDLDEELQELDLEE

SEQ ID NO: 21240 - protein, 184 aa, Diabrotica virgifera
  misc_feature: Coding regions on vcDNA: vcDNA=SeqID_937; Strand=+; Position=529-1083
  misc_feature: Homolog annotation: Hit_ID=XP_393322.1; Match level="QueryCoverage =95%, HitCoverage=100%, E-value=2e-86, Identity=88%"; Hit description= similar to ribosomal protein L18A [Apis mellifera]
  misc_feature: Gene Ontology Annotation: Molecular function=structural constituent of ribosome; Cellular component=cytosolic large ribosomal subunit (sensu Eukarya); Biological process=protein biosynthesis
  misc_feature: Pfam annotation: Pfam_ID=Ribosomal_L18ae; Match level="Score=409.6, E- value=3.9e-120, Copies=1"; Pfam description=Ribosomal L18ae protein family
MIMLPAPAMKAKGELKEYEVIGRKLPTEKEKTTPLYKMRIFSPDKIVAKSRFWYFLRQLRKFKKTTGEIVSVRQIPERSPVKIKNFGIWLRYDSRSGTHNMYREYRDLSVSGAVTACYRDMGARHRARAHSIQVIKVEEVKASNTRRPQVKQFHDSKISFPLPKRIQHKSMNRFSVRKPRTYFL

SEQ ID NO: 21241 - protein, 268 aa, Diabrotica virgifera
  misc_feature: Coding regions on vcDNA: vcDNA=SeqID_938; Strand=+; Position=59-864
  misc_feature: Homolog annotation: Hit_ID=CAE56378.1; Match level="QueryCoverage =82%, HitCoverage=77%, E-value=7e-20, Identity=39%"; Hit description =Hypothetical protein CBG24057 [Caenorhabditis briggsae]
  misc_feature: Gene Ontology Annotation: Molecular function=RNA polymerase II transcription factor activity; Cellular component=transcription factor TFIID complex; Biological process=regulation of protein activity, epigenetic
  misc_feature (208)..(208): Xaa can be any naturally occurring amino acid
  misc_feature (210)..(210): Xaa can be any naturally occurring amino acid
  misc_feature (250)..(250): Xaa can be any naturally occurring amino acid
MKMLIKVSDLLILCCVLLLIACIHDSDAKRGGGSRGGGSRSKSTSGGSSWWWSSNKKSSSSSSKTSSVATGAHAPAPAPKAPAPQHDTIKKQTSHVSHQQPVSNPNYGNNQQNPIGWNVPGNKQAGHHQTHSYPTGNQPHGSWPNSGQYPQQHGSWGTQHGSYGNQHGGWGNQQHGGWGGHQQSGWGGQHGGWGGQHGGYGGQNYGGXGXVGYSNPGYSGYGGMQRGGFMGGGYGGGMGGYGMGNGNGHXNGWYWLWRLRYAKEIRLL

SEQ ID NO: 21242 - protein, 254 aa, Diabrotica virgifera
  misc_feature: Coding regions on vcDNA: vcDNA=SeqID_939; Strand=+; Position=116-880
  misc_feature: Pfam annotation: Pfam_ID=RRM_1; Match level="Score=-0.2, E-value =0.086, Copies=1"; Pfam description=RNA recognition motif. (a.k.a. RRM, R
ISLKEFLLSSTLVLGAINNVFIGIENELQIVFAYVTFEYGDDARRVVNRLNGFYFQNKVLEVELIGPNLPYKRYKQTRKSSATVSTNTRFKTTNITSPTKSLHSQSNELDIDSSNCLDVRVNRGFSPIKILPGEYRNILTPASKIINTTQPAGNTARFSNKNNNEPSAAIRNSVKAGNSTPQAGTYTSTVFRSWSSNPHLSQKTNSFNRMPSKATHNKIQPSSRTGVYNRRPARHMFASRESIYTSTEFLDDYY

SEQ ID NO: 21243 - protein, 150 aa, Diabrotica virgifera
  misc_feature: Coding regions on vcDNA: vcDNA=SeqID_940; Strand=+; Position=128-580
  misc_feature: Homolog annotation: Hit_ID=XP_312199.1; Match level="QueryCoverage =94%, HitCoverage=36%, E-value=8e-69, Identity=86%"; Hit description =ENSANGP00000023556 [Anopheles gambiae]
  misc_feature: Gene Ontology Annotation: Molecular function=isocitrate dehydrogenase (NAD+) activity; Cellular component=mitochondrion; Biological process= carbohydrate metabolism
  misc_feature: Pfam annotation: Pfam_ID=Iso_dh; Match level="Score=-35.3, E-value =9.1e-11, Copies=1"; Pfam description=Isocitrate/isopropylmalate dehydrogen
KYNPIEYKKHPEVKFEEKYLDTVCLNMVQDPTQYDVLVMPNLYGDILSDMCAGLVGGLGLTPSGNIGLNGALFESVHGTAPDIAGQDKANPTALLLSAVMMLRYMGLNNHATKIENACFETIKEAKYLTGDLGGKAKCSEFTNSICEKIA

SEQ ID NO: 21244 - protein, 349 aa, Diabrotica virgifera
  misc_feature: Coding regions on vcDNA: vcDNA=SeqID_941; Strand=+; Position=76-1125
  misc_feature: Homolog annotation: Hit_ID=XP_312199.1; Match level="QueryCoverage =99%, HitCoverage=88%, E-value=1e-170, Identity=84%"; Hit description= ENSANGP00000023556 [Anopheles gambiae]
  misc_feature: Gene Ontology Annotation: Molecular function=isocitrate dehydrogenase (NAD+) activity; Cellular component=mitochondrion; Biological process= carbohydrate metabolism
  misc_feature: Pfam annotation: Pfam_ID=Iso_dh; Match level="Score=518.9, E-value =4.8e-153, Copies=1"; Pfam description=Isocitrate/isopropylmalate dehydrogen
MANILRKISTSQALGSRLFSSEVKKCTLIPGDGIGPEISAAVQKIFQTASVPIEWESVDVTPVRGPDGKFGIPQAAIDSVNKNKIGLKGPLMTPVGKGHRSLNLALRKEFNLYANVRPCRSLEGYKTLYDHVDVVTIRENTEGEYSGIEHEIVDGVVQSIKLITEDASRRVAEFAFQYAKENNRKKVTAVHKANIMRMSDGLFLRCCREMAKKHPEVKFEEKYLDTVCLNMVQDPTQYDVLVMPNLYGDILSDMCAGLVGGLGLTPSGNIGLNGALFESVHGTAPDIAGQDKANPTALLLSAVMMLRYMGLNNHATKIENACFETIKEAKYLTSDRVGKGECSEFTNSI

SEQ ID NO: 21245 - protein, 75 aa, Diabrotica virgifera
  misc_feature: Coding regions on vcDNA: vcDNA=SeqID_942; Strand=+; Position=1729-1956
DQSNADIQSNQSINKIKDRKLPGTDGVNKELIKYCSSEIVTELTKIFISISICTNRKFYFNNIFNFIEVKLMHFL

SEQ ID NO: 21246 - protein, 121 aa, Diabrotica virgifera
  misc_feature: Coding regions on vcDNA: vcDNA=SeqID_943; Strand=+; Position=89-454
  misc_feature: Homolog annotation: Hit_ID=EAA44035.2; Match level="QueryCoverage =96%, HitCoverage=92%, E-value=8e-53, Identity=92%"; Hit description =ENSANGP00000024961 [Anopheles gambiae str. PEST] ref|XP_556142.1| ENSANGP00000024961 [Anopheles gambiae st
  misc_feature: Gene Ontology Annotation: Molecular function=v-SNARE activity; Cellular component=integral to membrane; Biological process =nonselective vesicle transport
  misc_feature: Pfam annotation: Pfam_ID=Synaptobrevin; Match level="Score=140.1, E -value=5.3e-39, Copies=1"; Pfam description=Synaptobrevin
MSAGDALAPGAGAAGSGGDDGIVGGPRTPQQIAAQRRLQQTQAQVDEVVDIMKTNVEKVLERDQKLSELDDRADALQQGASQFEQQAGKLKRKFWLQNLKMMIIMGVIGLVILIIIVMNFM

SEQ ID NO: 21247 - protein, 334 aa, Diabrotica virgifera
  misc_feature: Coding regions on vcDNA: vcDNA=SeqID_944; Strand=+; Position=86-1090
  misc_feature: Homolog annotation: Hit_ID=NP_700900.1; Match level="QueryCoverage =97%, HitCoverage=91%, E-value=3e-23, Identity=25%"; Hit description =hypothetical protein PF11_0035 [Plasmodium falciparum 3D7] gb|AAN35624.1| hypothetical protein
  misc_feature: Gene Ontology Annotation: Biological process=embryogenesis and morphogenesis
  misc_feature: Pfam annotation: Pfam_ID=Vicilin_N; Match level="Score=-74.3, E-value= 0.085, Copies=1"; Pfam description=Vicilin N terminal region
MMKEVEFHIPVEKEKGNKNHEFKNDNNNKHNGEAKEESTKEKKSKQTSDEPKASSKQQIISVDITGSGSKDRSEKSTKEEQSKDRHRSERSSEDKEREKEKRRERREEKSNRDDKYEKQYSRSQEERYIEMLNRPSEEGRYSSEKQDRYYDYRNDSREERELNVSGNGSLGRSQDPEPERESSKRRKVDNSSKVSIQNSKHEERKSNSEQFQEKTEKRERSSKLKDKRDKMSEEEKEMRKERKLGRKRDRMEEALQQFEMKRRRDEDKASKMVSPNRSSNGEIVEPSIHVREKHHRSTRDISPYQRDRSNEKSEPRENIGGVQKTKKIANNARA

SEQ ID NO: 21248 - protein, 305 aa, Diabrotica virgifera
  misc_feature: Coding regions on vcDNA: vcDNA=SeqID_945; Strand=+; Position=953-1868
  misc_feature: Homolog annotation: Hit_ID=XP_319489.1; Match level="QueryCoverage =79%, HitCoverage=39%, E-value=2e-61, Identity=49%"; Hit description =ENSANGP00000002929 [Anopheles gambiae]
  misc_feature: Gene Ontology Annotation: Molecular function=transcription factor activity; Cellular component=nucleus; Biological process =intracellular signaling cascade
  misc_feature: Pfam annotation: Pfam_ID=RhoGEF; Match level="Score=160.8, E-value =2.9e-45, Copies=1"; Pfam description=RhoGEF domain
  misc_feature (276)..(276): Xaa can be any naturally occurring amino acid
  misc_feature (292)..(292): Xaa can be any naturally occurring amino acid
MILFIFDLLCFLVVIAKKIIFLVFSWMFSWMWCDPTFSALLIVLFGAYLFVNEHPQPTEKRDFVIKELLDTEKNYVDVLEKLRKNFMLPLINQMKPEHHTLVFFNIKDLKDVHAEFLEELFRIRTHPSTRISNIFMRFREKFLIYGMYCANLTKATQILQELCDSDEYFNQTVIKYEKEVNNGRFKLRDVLSVPMQRILKYHLLLDKLIEHTSESHEEYNDLKRARETMIDVAGYINEVARDSEHLEVINNLQETITEWNLAPNQKLSDYGRLGEXDASLRIKAHDDQKNKXRYVFIFDKWYFDL

SEQ ID NO: 21249 - protein, 83 aa, Diabrotica virgifera
  misc_feature: Coding regions on vcDNA: vcDNA=SeqID_946; Strand=-; Position=129-380
  misc_feature: Homolog annotation: Hit_ID=AAR10022.1; Match level="QueryCoverage =100%, HitCoverage=100%, E-value=3e-35, Identity=83%"; Hit description=similar to Drosophila melanogaster oho23B [Drosophila yakuba] gb|AAR09790.1| similar to Drosophila melan
  misc_feature: Gene Ontology Annotation: Molecular function=molecular_function unknown; Cellular component=cellular_component unknown; Biological process=cell differentiation
  misc_feature: Pfam annotation: Pfam_ID=Ribosomal_S21e; Match level="Score=187.1, E -value=3.7e-53, Copies=1"; Pfam description=Ribosomal protein S21e
MENDAGETVDLYCPRKCSASNRIIHAKDHASIQLSIADVDPQTGRMTESSKSYALCGAIRRMGESDDCIVRLTKKDGILAKNF

SEQ ID NO: 21250 - protein, 189 aa, Diabrotica virgifera
  misc_feature: Coding regions on vcDNA: vcDNA=SeqID_947; Strand=+; Position=258-827
SISLGSTSQRFHLRRFPSFIILFYYKLDKVDTFDCKRNKLAVFVLLFAIALQQTSAIFWPRQRRDVQDIQNLVPVEEMPPSRNLRIIAPPERKYGTYSLDAGNAEMTEEVNLLEQVLADKVEEIQQLWARIQSELNEFSKEYEQLIEEEVAEKVMEDEEEPAQRQKRMMSRHKRMIMSDAQIQKRAIKK

SEQ ID NO: 21251 - protein, 328 aa, Diabrotica virgifera
  misc_feature: Coding regions on vcDNA: vcDNA=SeqID_948; Strand=+; Position=2-988
  misc_feature: Homolog annotation: Hit_ID=AAS13459.1; Match level="QueryCoverage =98%, HitCoverage=36%, E-value=1e-75, Identity=44%"; Hit description =putative reverse transcriptase [Drosophila simulans]
  misc_feature: Pfam annotation: Pfam_ID=RVT_1; Match level="Score=-31.1, E-value =0.013, Copies=1"; Pfam description=Reverse transcriptase (RNA -dependent D
  misc_feature (158)..(158): Xaa can be any naturally occurring amino acid
  misc_feature (182)..(182): Xaa can be any naturally occurring amino acid
  misc_feature (211)..(211): Xaa can be any naturally occurring amino acid
  misc_feature (235)..(235): Xaa can be any naturally occurring amino acid
EINETFKQKSYCTTAFLDVSQAFDKVWHGGLLFKFKKSLLQTLYIIMESYLKERYFTVRYRQTTSEITLIKAGVPQGSVLGPLLYFMYTAELPVSNPTITASFADDKAINVKHKDPVIAARILQQHLVKIQDWTRNWRIKVTQVKSVQVTFTKCRGTXSFTLNEQNLPQSDSVKYLEMHLDXRTWRKHLFNKKKQLGLKLSKFYWLLRRQXKLGLKNKLLVYKVALKPIWTYGVXLWGTAANSNIEVLERFQSKLLRTITNAPWFIPNREVLDDLQVATIKEIVSEYSSRYLVKLENHPNNLALNLLDNSEQTRRLKRHKPLELPHKF

SEQ ID NO: 21252 - protein, 389 aa, Diabrotica virgifera
  misc_feature: Coding regions on vcDNA: vcDNA=SeqID_949; Strand=+; Position=37-1207
  misc_feature: Homolog annotation: Hit_ID=XP_310418.1; Match level="QueryCoverage =100%, HitCoverage=84%, E-value=1e-138, Identity=58%"; Hit description=ENSANGP00000017939 [Anopheles gambiae]
  misc_feature: Gene Ontology Annotation: Molecular function=molecular_function unknown; Cellular component=cytoplasmic vesicle; Biological process =autophagy
  misc_feature: Pfam annotation: Pfam_ID=APG6; Match level="Score=408.5, E-value=8.1e- 120, Copies=1"; Pfam description=Autophagy protein Apg6
  misc_feature (360)..(360): Xaa can be any naturally occurring amino acid
MAEDKLFVSFACQRCSQSLRLDESLNSFSEHTSAELNLPIYSNPEVDLESQATSFDHYVPPCRLSDSGNGANGFMLISDENEVDLISHQFKVQAALFDTLSGNSNIDHPLCDECTDNLIEILDQQLQIAQEDYDDYSRYYKMLQSDKDEPKLSDLEKELSDLKAEEVRLLDELSALEHEEEETKKAIQEQEAIAQKITQEEDRYWKEYTRHRRDFLVLEEEAKSLECQLNYTSNQLDKLQRTNVFNATFHIWHNGHFGTINNFRLGRLPSAPVDWSEINAAWGQTALLLSSLARKINLTFERFRLVPFGNHSHIVSLEDDKEFPLYGSGGFKFLWDTKFDSGMVAFLDCLQQFQEKVENXEKGSKAFCFPYRTNKGRIADKDARYSIKI

SEQ ID NO: 21253 - protein, 604 aa, Diabrotica virgifera
  misc_feature: Coding regions on vcDNA: vcDNA=SeqID_950; Strand=+; Position=23-1837
  misc_feature: Homolog annotation: Hit_ID=XP_310572.1; Match level="QueryCoverage =84%, HitCoverage=89%, E-value=2e-43, Identity=27%"; Hit description =ENSANGP00000007401 [Anopheles gambiae]
  misc_feature: Pfam annotation: Pfam_ID=Acyl_transf_3; Match level="Score=-55.6, E -value=0.0065, Copies=1"; Pfam description=Acyltransferase family
MRILCQIFLILVFWLGLSVPSDISIFPALPVTVTNTSNLLCNKHSREYLENLKNFTLWAYEMRDASAQSISSVLTGSSYSLGNQAECLTAHAPFPTQYCLAIIIGNIPNTTIKRDPLSLEFNSNENVLDKLYPYQDETKFPRNIAKMGWCFPASCSPNDAKESLDNYLQHVDYSLKKDNITFSAQVPSILCQCSDKQLKMDTVDFVFCGLVIVLVILVSSSSYLDNPDEDDSKNKQYKLLQAFSMKRNIKDLSKIEATEKPLRIFYGMKAFSLIMILTGHRSALFTAAPQITLDYVEELYRTLWAAIIFHADLFVDTFFLISGLLVTYGLLNNLNTGKKFNPVFMVVARYLRLTPLYAFCIFYQATLLYHMGNGPLWEPVLGQERQDCRKNWWTGILYVSNLIDSEHMCMVQSWYLACDFHFFLLALVLIYILHKNTRCGILVTILCMLATIYTTFSIIYVYQRPAFLRFLPKFLENPKGSYDYNLSYIKSYTRGLPYFIGIIAGYIYIKYKTKDYEISQGRYYGILVIASSLIAILIFSGKVFYNPYHKYNVLEASIYGSVHRLLWAVGNLAFLYGISFGQKDFCNFFMDNFVPLSSSHMEHF

SEQ ID NO: 21254 - protein, 311 aa, Diabrotica virgifera
  misc_feature: Coding regions on vcDNA: vcDNA=SeqID_951; Strand=+; Position=42-977
  misc_feature: Homolog annotation: Hit_ID=NP_650013.3; Match level="QueryCoverage =85%, HitCoverage=48%, E-value=8e-58, Identity=41%"; Hit description =CG31272-PA [Drosophila melanogaster] gb|AAF54546.3| CG31272-PA [Drosophila melanogaster]
  misc_feature: Gene Ontology Annotation: Molecular function=organic cation transporter activity; Cellular component=synaptic vesicle; Biological process=calcium ion homeostasis
  misc_feature: Pfam annotation: Pfam_ID=MFS_1; Match level="Score=1.1, E-value =0.0033, Copies=1"; Pfam description=Major Facilitator Superfamily
MDYTLEKVKNDKDNEGKTDQLKHKADFEEAVVATGFGKFNIYLLMLLIPSSFAQAFEQMGLSYAVPIAECDLNLTLERKGLLTAVSFGGMITSGIFMGILSDIFGRRKLILWGYFLNGLANIVAAMSQNFLMLMIAKFFCGLIFNGPFSASTTLLTEYHASQYRSKVQLFRGVTFALGFFILPLVAWAILPLHIEYEMFGFIKIHSWNIFILCSSMGTFLSAIGFWFIPESPKYLMAYGKNTEALAVFQKVYRWNTGKTNKDYPVKALKEELEATIRGTQKRRASVQIAGNKFFVHLKPFINLPVSSSDLA

SEQ ID NO: 21255 - protein, 387 aa, Diabrotica virgifera
  misc_feature: Coding regions on vcDNA: vcDNA=SeqID_952; Strand=+; Position=177-1340
  misc_feature: Homolog annotation: Hit_ID=XP_314727.1; Match level="QueryCoverage =97%, HitCoverage=86%, E-value=1e-119, Identity=56%"; Hit description= ENSANGP00000013140 [Anopheles gambiae]
  misc_feature: Gene Ontology Annotation: Molecular function =ethanolaminephosphotransferase activity; Cellular component =endoplasmic reticulum; Biological process=growth
  misc_feature: Pfam annotation: Pfam_ID=CDP-OH_P_transf; Match level="Score=39.8, E -value=8.2e-09, Copies=1"; Pfam description=CDP-alcohol phosphatidyltransferase
  misc_feature (340)..(340): Xaa can be any naturally occurring amino acid
  misc_feature (363)..(363): Xaa can be any naturally occurring amino acid
  misc_feature (368)..(368): Xaa can be any naturally occurring amino acid
  misc_feature (370)..(370): Xaa can be any naturally occurring amino acid
MEIQYLTKDHLIGFDNYKYNCIDSGILSIYVMHPFWNWVVKYCPRFIAPNLLTFTGFLFTVISYLIFALLDYNFYASDSDRPDIEPLGNWTFWAAAILLFVAYTLDGIDGKQARRTGTSGPLGELFDHGLDSYTAGLIPAAMYSIFGRGERYSLVPFRMFFTMWNVMMNFYMTHFEKYNTGVMFLPWGYDFSMWGTIITFLIAGIFGSEIWQFRFGSVTAGNIFELTLYISSLISNVPVISYNIYLSYKNKTGKMRPFSDAIRPLLPVGSFFLISLVWILYSPGNIVERDPRALFFLLGTVFSNISCRLIVAQMSNTTCDAFNLLLIPTSFVVAASLLTXWATLELMLLYLLCIFTSRAHIHXRTCVXRXMCRHFKGNCFTHQKQVD

SEQ ID NO: 21256 - protein, 262 aa, Diabrotica virgifera
  misc_feature: Coding regions on vcDNA: vcDNA=SeqID_953; Strand=+; Position=141-929
MSQVERKEYQESKVMRTVSPARRNYSSNQNLSQFDSNLDYLLEDLQNSVSRPGSSLGYNSSGSHTHRETSRVVDTGRSNSLNRIAQLKPSNPVEYSSDDAYNYTSPDGNQKVSGYKKEKYIYKTTSEDITPDKIRTQNSINQLDNLLDDLQQVKKSSFLDSETYNSPGSDPKYQSSISKKSINRELHYGDTPRSSSRSRTLERDGTLQRDVEYISEGTYSDTRTNRPVSPAVTSRTSTLASRPKSTTSTSTLSRSSKQSLQK

SEQ ID NO: 21257 - protein, 364 aa, Diabrotica virgifera
  misc_feature: Coding regions on vcDNA: vcDNA=SeqID_954; Strand=+; Position=26-1117
  misc_feature: Homolog annotation: Hit_ID=XP_317558.1; Match level="QueryCoverage =95%, HitCoverage=7%, E-value=1e-120, Identity=63%"; Hit description =ENSANGP00000007226 [Anopheles gambiae]
  misc_feature: Gene Ontology Annotation: Molecular function=calcium-dependent cell adhesion molecule activity; Cellular component=integral to plasma membrane; Biological process=calcium-dependent cell-cell adhesion
  misc_feature (346)..(346): Xaa can be any naturally occurring amino acid
MIGANGINVTADNVLSRVMHAAENSMSYHTDGDVIRGIGGHPLVGPELLSKKYKERDILQGELPRPQRPDIIEREVMNKGPPIRDEHHPPMPPTSNHNHDHVPNDLNSELPEHYDLENASSIAPSDIDIVYHYKGYREAGGVRKYKATPPPVAGYHHKGPGQGQHRHSPHHPAGFPPRAPPVTSPNVRPHQSTPLARLSPSSEMSAQQPRILTLHDISGKPLQSALLATTSSSGGVGKDVLHSNSERSLNSPVMSQLSGQSSSSRKAAAPPPVTSSSPGMGLTAEEIERLNSRPRTSSLVSTLDAVSSSSEAPRGGGNNHLNHLRHSPIPEAILRSLDWDAAHPDXFTCSEIEYDNASLTGDKY

SEQ ID NO: 21258 - protein, 337 aa, Diabrotica virgifera
  misc_feature: Coding regions on vcDNA: vcDNA=SeqID_955; Strand=+; Position=166-1178
  misc_feature: Homolog annotation: Hit_ID=XP_319522.1; Match level="QueryCoverage =60%, HitCoverage=29%, E-value=1e-76, Identity=69%"; Hit description =ENSANGP00000017788 [Anopheles gambiae]
  misc_feature: Gene Ontology Annotation: Molecular function=calcium ion binding; Cellular component=integral to plasma membrane; Biological process =signal transduction
  misc_feature: Pfam annotation: Pfam_ID=LETM1; Match level="Score=282.8, E-value =5.9e-82, Copies=1"; Pfam description=LETM1-like protein
  misc_feature (273)..(273): Xaa can be any naturally occurring amino acid
MLAILRAPHIKSARSRFAERCRRQQYQTRCICYMDVLSSNSIVERKRQYSISSHVIISNFNQNLLVSHNPKWNHDFYRQFSISSARFDKEPLKPSSKVEETVQELKKKQEEEQKVKTKEVTPVVVKKPLTTRVWEELVHYYHGFRLLFIDVKISSGLVWRVLNGKSLSRREYRLLTRTVGDLFRLVPFSVFIIVPFMEILLPFFIKFFPGMLPSTFQTATEKEDKTKQRLKVQLEMAKFLQGTLDNMAVQHKERYSTEAKQFVDWFHKVRTSXRILKSEDIMKFSKLFQDEITLDSLSRSQLIALCRVLEVQTLGTNNFLRFSLRMKIEVIWLLMIR

SEQ ID NO: 21259 - protein, 199 aa, Diabrotica virgifera
  misc_feature: Coding regions on vcDNA: vcDNA=SeqID_956; Strand=+; Position=155-754
  misc_feature: Homolog annotation: Hit_ID=XP_393431.1; Match level="QueryCoverage =100%, HitCoverage=100%, E-value=3e-97, Identity=86%"; Hit description=similar to CG8284-PA [Apis mellifera]
  misc_feature: Gene Ontology Annotation: Molecular function=ubiquitin conjugating enzyme activity; Cellular component=proteasome complex (sensu Eukarya); Biological process=protein modification
  misc_feature: Pfam annotation: Pfam_ID=UQ_con; Match level="Score=218.5, E-value =1.3e-62, Copies=1"; Pfam description=Ubiquitin-conjugating enzyme
MANIAAQRIKREFKEVIKSEEVAKCAIRVELLNDSYTELRGEIAGPPDTPYEGGNFVLEIRVPETYPFNPPKVRFITRIWHPNISSVTGAICLDILKDQWAAAMTLRTVLLSLQALLSAAEPDDPQDAVVARQYKENLEMFTLTAKHWTHAYAGGPCVISDCDEKIRRLIDMGIEEHKARVSLSSYNWDLEMATEQLFN

SEQ ID NO: 21260 - protein, 162 aa, Diabrotica virgifera
  misc_feature: Coding regions on vcDNA: vcDNA=SeqID_957; Strand=+; Position=1-489
  misc_feature: Homolog annotation: Hit_ID=XP_321816.1; Match level="QueryCoverage =80%, HitCoverage=82%, E-value=7e-17, Identity=50%"; Hit description =ENSANGP00000020962 [Anopheles gambiae]
PHASDYLRQLSKMASQKMIVALLVAIAVSGCLGGPSVPAVPAAIAAVPAAYSVPYASSYTASVVNHGIAAPVVAAPVAAPLVAAPAPVVAAPARVAAPLVAPAALPYAALPAAYSALPAAYSAYPAAYSALPAAYSALPAAYSALPAAYSALPAAAPLVVRK

SEQ ID NO: 21261 - protein, 268 aa, Diabrotica virgifera
  misc_feature: Coding regions on vcDNA: vcDNA=SeqID_958; Strand=+; Position=33-839
KLIKHISFYIKFSLRKHKNTDMHRFLKLQGTSFYKYSRESFSTLNTSANSCLLCKLNNICKGTFRYNSSNPNPNLKIRKPRKRNKKEYAELLIVTDNSSCQRRANVKKLTFSELELLASTNLNLSELHKLKEILQNPTVANEYSYNNLNIIDNLPSTSASNIDFVNINSGEMNEKTVNLTVPEHMVSQNVPPKDILKDTTSTNETTTTFFQQPLPAVDIVDKMNESDTAECPAEEEELESIKAVNTLFQPEVTDEQISEVEEVKDPPG

SEQ ID NO: 21262 - protein, 239 aa, Diabrotica virgifera
  misc_feature: Coding regions on vcDNA: vcDNA=SeqID_959; Strand=+; Position=101-820
  misc_feature: Homolog annotation: Hit_ID=AAL05409.1; Match level="QueryCoverage =98%, HitCoverage=100%, E-value=1e-24, Identity=29%"; Hit description= peritrophin [Aedes aegypti]
  misc_feature: Pfam annotation: Pfam_ID=CBM_14; Match level="Score=177.3, E-value =3.3e-50, Copies=3"; Pfam description=Chitin binding Peritrophin-A domain
MKYLLTAWDLAIAACTAAEIDFECPTPGNEATFYPDPVNCAEYIECFAGKANIMECPADLWWNQEKQYCDFKSNVDCKIDPSAGTEPPRTTVTDPTRPTDFTPDPHCPYPSNEITYDFVPGNCSEYYECDHGLRYLETCPHNRLWNHIKNYCDFPEEVDCSRAPVTTTTSGPSTTPNSICDGQKDGTFFADEDDCAKYYECVRGQAIEFTCPPGTLWDEEELTCDFPDRVDCKVTPKSF

SEQ ID NO: 21263 - protein, 254 aa, Diabrotica virgifera
  misc_feature: Coding regions on vcDNA: vcDNA=SeqID_960; Strand=+; Position=85-849
  misc_feature: Homolog annotation: Hit_ID=XP_308397.1; Match level="QueryCoverage =99%, HitCoverage=89%, E-value=2e-84, Identity=61%"; Hit description =ENSANGP00000019038 [Anopheles gambiae]
  misc_feature: Gene Ontology Annotation: Molecular function=electron transporter activity; Cellular component=mitochondrion; Biological process =carbohydrate metabolism
  misc_feature: Pfam annotation: Pfam_ID=adh_short; Match level="Score=251.0, E-value= 2.1e-72, Copies=1"; Pfam description=short chain dehydrogenase
MAALQRLTGRIAVVTASTDGIGFAIAQRLAQEGAKVIISSRKEKNVEKATAALKNEGLDVTGLVCHVSKPSDRRRLFEEAKKVGGLDTLVSNAAISPAVGGVLDCTEEHWDKLFDVNVKSSFLLAQEALPLLRNSKAGRIVFISSIAGLQPSEFLGAYSVTKTALLGLTKAAAVHLARENITVNSVCPGLIETKFSEAITKDEEAAKMAVPAIPMNRFGQPKEISGIVAYLASDDASYVTGENYVIAGGMASRL

SEQ ID NO: 21264 - protein, 340 aa, Diabrotica virgifera
  misc_feature: Coding regions on vcDNA: vcDNA=SeqID_961; Strand=+; Position=145-1161
  misc_feature: Homolog annotation: Hit_ID=NP_609382.1; Match level="QueryCoverage =66%, HitCoverage=58%, E-value=6e-76, Identity=63%"; Hit description =CG5037-PA [Drosophila melanogaster] gb|AAF52915.1| CG5037-PA [Drosophila melanogaster]
  misc_feature: Gene Ontology Annotation: Molecular function=farnesyltranstransferase activity; Cellular component=mitochondrial inner membrane; Biological process=heme biosynthesis
  misc_feature: Pfam annotation: Pfam_ID=UbiA; Match level="Score=99.9, E-value=6.6e -27, Copies=1"; Pfam description=UbiA prenyltransferase family
  misc_feature (233)..(233): Xaa can be any naturally occurring amino acid
  misc_feature (268)..(268): Xaa can be any naturally occurring amino acid
MYKGVILNIRLHKSLTTHTTSLLKQYKCGVNFVVPSTTYVNKTNSKSSPPLLVDIADNGALPLSELLPHKPKVAPAWQVTPSTDSSNLVKHYMKLSKIRLTSLVVITSMAGYAVAPAPFEITTFLLCTAGTGLLSAAANATNQFHEVPFDAQMSRTKNRVLVCGKLTLTHSMLFAATTSITGLGILYYGVNGLTASLGLTNLILYTSVYTPLKRISILNTWVGSIVGAIPPLXMGWAACADSLGPGAWLMAALLYSCQFSHFMLLSWXLRPDYSRARYRMMAVTDLFPPTPPPPHSPHPPISPSRLALFSFPPPSPYFPPAGSFFVISPSFFFLSSFFSP

SEQ ID NO: 21265 - protein, 130 aa, Diabrotica virgifera
  misc_feature: Coding regions on vcDNA: vcDNA=SeqID_962; Strand=+; Position=53-445
  misc_feature: Homolog annotation: Hit_ID=CAH04332.1; Match level="QueryCoverage =100%, HitCoverage=100%, E-value=2e-68, Identity=98%"; Hit description=S15Ae ribosomal protein [Biphyllus lunatus]
  misc_feature: Gene Ontology Annotation: Molecular function=structural constituent of ribosome; Cellular component=cytosolic small ribosomal subunit (sensu Eukarya); Biological process=reproduction
  misc_feature: Pfam annotation: Pfam_ID=Ribosomal_S8; Match level="Score=199.6, E -value=6.3e-57, Copies=1"; Pfam description=Ribosomal protein S8
MVRMNVLSDALKSINNAEKRGKRQVLIRPSSKVVVKFLTVMMKHGYIGEFEIVDDHRSGKIVVNLTGRLNKCGVISPRFDVPITHIEKWTNNLLPSRQFGYVVLTTSGGIMDHEEARRKHLGGKILGFFF

SEQ ID NO: 21266 - protein, 331 aa, Diabrotica virgifera
  misc_feature: Coding regions on vcDNA: vcDNA=SeqID_963; Strand=+; Position=43-1039
  misc_feature: Homolog annotation: Hit_ID=XP_320896.1; Match level="QueryCoverage =97%, HitCoverage=63%, E-value=8e-43, Identity=31%"; Hit description =ENSANGP00000012015 [Anopheles gambiae]
  misc_feature: Pfam annotation: Pfam_ID=ASC; Match level="Score=-164.4, E-value=1.9e- 05, Copies=1"; Pfam description=Amiloride-sensitive sodium channel
  misc_feature (307)..(307): Xaa can be any naturally occurring amino acid
MTWKRFNKYFNDYCEHSSIIGCNYVAEKRSRTERVLWIVLIAIAIALSVYFILEQYEKYDENPFIVSLATRERPIYTIPFPAITICPFTKADKNKFNYTSVLNRLWDNETVSPFEMQTAQYMSLVCEDNSIDDEDTINTHLLKNETFTNHFYERLDEIETLEELVDDFNCDFMGDNVASFNCTNIFTPIILDGGICYTFNMLNREEIFRPKVYQYMHTHEVSLEPKSSWSVDDGYSEGSGKNAYPRRALQSGADNALLVMLLAKSQDNDYICNTDVGYSISVHLPSTIPQTKKDFYILPLDTNSQIXLQPNLVTTSNAVQKYKIEDRQCFF

SEQ ID NO: 21267 - protein, 281 aa, Diabrotica virgifera
  misc_feature: Coding regions on vcDNA: vcDNA=SeqID_964; Strand=+; Position=40-885
  misc_feature: Homolog annotation: Hit_ID=BAA34642.1; Match level="QueryCoverage =85%, HitCoverage=69%, E-value=4e-28, Identity=31%"; Hit description =pro-phenoloxidase activating enzyme-I precursor [Holotrichia diomphalia]
  misc_feature: Gene Ontology Annotation: Molecular function=serine-type endopeptidase activity; Cellular component=extracellular; Biological process=Tl signaling pathway
  misc_feature: Pfam annotation: Pfam_ID=Trypsin; Match level="Score=-18.8, E-value =0.0081, Copies=1"; Pfam description=Trypsin
MVQQYIIAGFALFFVFVCCVHADYRIDCISPNKENTKCESIYKCKTFTDALKGTVTQSQKDFMKESLCGYYDNIPIVCCGTKSDYTSKRTRRSTESKTNSVIADTQCGVLVNDHLTSGQPQDYPWAVKLIYNQTLHRCEGTLIHKRYILTSAQCVNKFIANYHGKLAKATLGLSSCSEGKSCVKSALDVGIESVTIHKDYGTLRGAPHDNIALIRLDQDISFNENILPVCLPQQEEEPEVGDKVIAVGWYKRSSTKLNAELTIVDNKVCQEHYKKQIMIQQ

SEQ ID NO: 21268 - protein, 463 aa, Diabrotica virgifera
  misc_feature: Coding regions on vcDNA: vcDNA=SeqID_965; Strand=+; Position=28-1419
  misc_feature: Homolog annotation: Hit_ID=XP_312564.1; Match level="QueryCoverage =90%, HitCoverage=73%, E-value=5e-68, Identity=36%"; Hit description =ENSANGP00000014256 [Anopheles gambiae]
  misc_feature: Gene Ontology Annotation: Molecular function=carboxylesterase activity; Cellular component=extracellular space
  misc_feature: Pfam annotation: Pfam_ID=COesterase; Match level="Score=390.7, E -value=1.9e-114, Copies=1"; Pfam description=Carboxylesterase
MLLHLIYFLFICVYTNAQIIVDTPNGQVQGSEEAGTQGEPFYRFQQIPFAKPPTGSLRFREPQPVDKWEGVFDATRNDKVCYQQIADPVSGENEDCLFVNVYTPLYPLPNQGLPVMVWFYGGGFIGGTANFYTYGPHYYMEQGIIVVTVSYRIGILGFLSTGDTVIPGNYGLKDQQLALKWVQQNIQSFGGDPDKVTIFGQSAGGASVTHHLLNQKSTGLFRAAISQSGSALCPWGYQWKHKAIAYKIASIINPKFNPNSTSEELMSFLQSVAPENLVNASLTLLDVWDKNDPITGFLFTPVLEQEHETAFLTERMYTIIESGNAQRVPLIMGINSEEMLWNGMDPESMYRTAVGLDNDLTKLVEEDMQIHDANQKQIVGAKVKKVYTNGQFQDHLGDAVEFFSDTSFGRPIIQHAKLQSQFSDVYFYHFSYQGTIPGVRPYYQGAYKVSHGDRTSNYQRETC

SEQ ID NO: 21269 - protein, 317 aa, Diabrotica virgifera
  misc_feature: Coding regions on vcDNA: vcDNA=SeqID_966; Strand=+; Position=59-1009
  misc_feature: Homolog annotation: Hit_ID=XP_395260.1; Match level="QueryCoverage =97%, HitCoverage=95%, E-value=3e-93, Identity=50%"; Hit description =similar to tumor suppressing subtransferable candidate 1; tumor -suppressing STF cDNA 1 [Apis
  misc_feature: Pfam annotation: Pfam_ID=WD40; Match level="Score=46.4, E-value=8.4e -11, Copies=2"; Pfam description=WD domain, G-beta repeat
MDNENSVIYGLEFQARALTPQQAETEKIRFIIGTQFLKQTNNQIHLIEFNEEISTIKTSVFHHSAGEIWKLTSSPTDASKISTCYNSLVGENSCTMKSAILKLPENENHDTIENLEIVTKLDTSSFGNDIKTTEFHPTDANTAVTLTDSHVVLWDISETEGRAVSNIALEGKNNPKFTNGKWNPHQNCNQFSTATETHIKTYDIRSGELAWSIDQAHCQFIRDMDYNMNKLYHLATCGDDGFLKIWDFRQTSAPVFSRSDHSHWIWCVRFNPFHDPVMLTASSDARVLFISAASVSSENLSETLITDDKEGLDTKQN

SEQ ID NO: 21270 - protein, 279 aa, Diabrotica virgifera
  misc_feature: Coding regions on vcDNA: vcDNA=SeqID_967; Strand=+; Position=268-1103
  misc_feature: Homolog annotation: Hit_ID=EAL28571.1; Match level="QueryCoverage =98%, HitCoverage=74%, E-value=1e-122, Identity=77%"; Hit description= GA10892-PA [Drosophila pseudoobscura]
  misc_feature: Gene Ontology Annotation: Molecular function=mannose-1-phosphate guanylyltransferase activity; Cellular component=cytoplasm; Biological process=cell wall mannoprotein biosynthesis
  misc_feature: Pfam annotation: Pfam_ID=NTP_transferase; Match level="Score=221.8, E- value=1.3e-63, Copies=1"; Pfam description=Nucleotidyl transferase
  misc_feature (271)..(271): Xaa can be any naturally occurring amino acid
MPEEGKRALILVGGYGTRLRPLTLSRPKPLVEFANKPILLHQIEALVDAGVTEVILAVSYRAKQMEEELTVEAKKLGINIIFSHETEPLGTAGPIALARDHLSKSTKPFFVLNSDIICDFPFKALAEFHKNHGKEGTIVVTKVEEPSKYGVVVYDKDNSIQSFVEKPQEFISNKINAGLYILNPSVINRIELKPTSIEKEVFPYMAADKQLYAFELEGFWMDVGQPKDFLTGMCLYLKHLRQTNEDKTYKGPGVVGNVLVDPTAKMETICXIGSNVTIG

SEQ ID NO: 21271 - protein, 42 aa, Diabrotica virgifera
  misc_feature: Coding regions on vcDNA: vcDNA=SeqID_968; Strand=+; Position=1-129
ISIGCLSFMHYVSKCIKFQKQLNALSFKSNVDRIKKKFSYHY

SEQ ID NO: 21272 - protein, 77 aa, Diabrotica virgifera
  misc_feature: Coding regions on vcDNA: vcDNA=SeqID_969; Strand=-; Position=3-233
MIRLVFPPLRCAIIGVRRKFMKRGAYCLLDVLVTPWKNLSCKLKAVNQRVVPFIHFNITLYRKLIAHHHHHHYHHHH

SEQ ID NO: 21273 - protein, 237 aa, Diabrotica virgifera
  misc_feature: Coding regions on vcDNA: vcDNA=SeqID_970; Strand=+; Position=1089-1802
SPFLFVSSLPSFFIAPLSVNFFRYTGKVSLFLRKVSLSDCLSSLVFTSLFISSFVSFIFSPHLSLLRFPLASLYNLWENSVTREKRRKQKENNFCLFLLLFPLCDTLSRFLSISLSFFSPFMSFPSPFLTTLSFPHAFSHTGQIENKEGDCLLSSISYILSLGSFINFWEKSSMWEFLYKKFLKGEKFLPLLSKFIILALFPISLSFCFWFSPPRVFPRAKKKKKKTFPPKKKTKII

SEQ ID NO: 21274 - protein, 110 aa, Diabrotica virgifera
  misc_feature: Coding regions on vcDNA: vcDNA=SeqID_971; Strand=+; Position=179-511
NSSRQRQFRHINRQRQGDLIEHVKKKIMYRFPLRTCPRYEIFLILIVFSNSRTTFALPGQLRWSQWLSRVFAVFSMHRAALSIRQYRQLPRAANYERAAKILYKKIFVYV

SEQ ID NO: 21275 - protein, 346 aa, Diabrotica virgifera
  misc_feature: Coding regions on vcDNA: vcDNA=SeqID_972; Strand=+; Position=1030-2070
  misc_feature: Homolog annotation: Hit_ID=CAA10770.1; Match level="QueryCoverage =84%, HitCoverage=86%, E-value=1e-42, Identity=34%"; Hit description =reverse transcriptase-like [Bos taurus]
  misc_feature: Gene Ontology Annotation: Molecular function=molecular_function unknown; Cellular component=cellular_component unknown; Biological process=biological_process unknown
VHHKLIKILKDKGVDSQDVRIIEKLYWRQTATACINGKSTEICKIQRGVRQGCILSPLLFNLYSDRIFKEALHNLEWGVKVNGILINTIRYADDTIILSDDMNGLQHLLNAIDTVGREFGLNINCSKTKYMVFSRLAHQDSRLYVDGHIIQRVPSFKYLGCRITEQLDPDKEIKCRIEIARTTFLKMRSFFCNETLQLQLRKRMIKCYSWSVLLYGVEAWTLKISTINRLEAFEMWLHRRILKIPWTAMLTNVAVLKRANATRELLDNIKYRKMAYFGHVVRGDRYNILQLIMMGKIEGRRGIGRKQASWLKNIREWTGIKKAEHLFRIARDRDSFAMLIANVKGT

SEQ ID NO: 21276 - protein, 321 aa, Diabrotica virgifera
  misc_feature: Coding regions on vcDNA: vcDNA=SeqID_973; Strand=+; Position=137-1102
  misc_feature: Homolog annotation: Hit_ID=XP_308567.1; Match level="QueryCoverage =100%, HitCoverage=93%, E-value=1e-116, Identity=67%"; Hit description=ENSANGP00000016768 [Anopheles gambiae]
  misc_feature: Gene Ontology Annotation: Molecular function=electron transporter activity; Cellular component=ribosome; Biological process=electron transport
  misc_feature: Pfam annotation: Pfam_ID=eIF-5_eIF-2B; Match level="Score=259.7, E -value=4.9e-75, Copies=1"; Pfam description=Domain found in IF2B/IF5
MAEDDAIFDPTLKKKKKKKKTTFDIDAALAEGNIENDSGNAPAAEADNIESKPDDDQDDGNVDIDLDFTKKKKKKKKPFSADDLDSSPADNKAETTQDGAGDNDGGMDDNFDLDMDFSKKKKKKTKKPKNLDELIAETEEKDDDQENVDENSTQWVNSDRDYTYDELLNRAFEIMRDKNPDMAAGKKQKFVMRPPQVVKIGAKKTSFANFTEICKMLHRQPKHLLDFLLAELGTSGSVDGNNQLIIKGRFQQKQIENVLRRYIKEYVTCHTCRSPDTILQKDTRLFFLQCETCGSRCSVASIKSGFQAVTSKRAAIRAKTA

SEQ ID NO: 21277 - protein, 190 aa, Diabrotica virgifera
  misc_feature: Coding regions on vcDNA: vcDNA=SeqID_974; Strand=-; Position=448-1020
  misc_feature: Homolog annotation: Hit_ID=XP_308543.1; Match level="QueryCoverage =97%, HitCoverage=90%, E-value=1e-53, Identity=48%"; Hit description =ENSANGP00000016573 [Anopheles gambiae]
  misc_feature: Gene Ontology Annotation: Molecular function=molecular_function unknown; Cellular component=integral to membrane; Biological process= biological_process unknown
  misc_feature: Pfam annotation: Pfam_ID=TMEM9; Match level="Score=218.5, E-value =1.3e-62, Copies=1"; Pfam description=TMEM9
MKYYLLVFCIATTLTLSTAQSYEDKRCKCICPSISSVVTNKTESKNHTSRILYITNVPPNKCNCDEVILPRISQDIIGKEQEFCPRCECKYENRNTTIIKVVVIIVIWVISILVIYMAFLIILDPLLNKRIKGNYQEHTNEEDDVSAGPMSHNMSVRGNVLNRVGHQQDKWKRQVKEQRKNIYDRHTMLN

SEQ ID NO: 21278 - protein, 94 aa, Diabrotica virgifera
  misc_feature: Coding regions on vcDNA: vcDNA=SeqID_975; Strand=+; Position=1-285
  misc_feature: Homolog annotation: Hit_ID=EAA01089.3; Match level="QueryCoverage =97%, HitCoverage=37%, E-value=5e-13, Identity=43%"; Hit description =ENSANGP00000009724 [Anopheles gambiae str. PEST] ref|XP_551453.1| ENSANGP00000009724 [Anopheles gambiae st
RVGRQKHLLDIEIQFNDSVRRGGGRGRGQRSGGPRGGGNRGGGTGGSGGGGGNRARESDGGRPERRYHNDAVDERNDARQAPKVDDERDFPSLG

SEQ ID NO: 21279 - protein, 316 aa, Diabrotica virgifera
  misc_feature: Coding regions on vcDNA: vcDNA=SeqID_976; Strand=+; Position=113-1058
  misc_feature: Homolog annotation: Hit_ID=XP_392925.1; Match level="QueryCoverage =98%, HitCoverage=75%, E-value=3e-55, Identity=42%"; Hit description =similar to CG4170-PA [Apis mellifera]
  misc_feature: Pfam annotation: Pfam_ID=HABP4_PAI-RBP1; Match level="Score=103.5, E -value=5.3e-28, Copies=1"; Pfam description=Hyaluronan / mRNA binding family
  misc_feature (284)..(284): Xaa can be any naturally occurring amino acid
MENTYGIGIANRYALFLDDESDPLETLTLKEQEKELKKKSKVAEKENKVKTPTIPKGKPTPAQKKPVKDVNHKPQENKRDETKPAPRNNVDGKPERSFNRFNNENREERNNRRNREDRPYNGPSENRDREERPRREPATGDFENRNNRDRGERREGREGRAIGNRPGAPRGQRRNFDGDRRGKREFDRQSGSDKTGVKPIDKRDGAGAHNWGSHKDVIEEADRPNTDANESWGDEVKIEPIETEKKEEGRPEEGRGGEEQTPVEEEPKELTLDEWKAHALDVLXPPFHIRKAGEGEDPSHGKKCLNFRKKERMRKL

SEQ ID NO: 21280 - protein, 398 aa, Diabrotica virgifera
  misc_feature: Coding regions on vcDNA: vcDNA=SeqID_977; Strand=+; Position=90-1287
  misc_feature: Homolog annotation: Hit_ID=XP_392925.1; Match level="QueryCoverage =100%, HitCoverage=100%, E-value=2e-76, Identity=44%"; Hit description=similar to CG4170-PA [Apis mellifera]
  misc_feature: Pfam annotation: Pfam_ID=HABP4_PAI-RBP1; Match level="Score=61.3, E -value=2.7e-15, Copies=1"; Pfam description=Hyaluronan / mRNA binding family
  misc_feature (66)..(66): Xaa can be any naturally occurring amino acid
MENTYGIGIANRYALFLDDESDPLETLTLKEQEKELKKKSKVAEKENKVKTPTIPKGKPTPAQKKXVKDVNHKPQENKRDETKPAPRNNVDGKPERSFNRFNNENREERNNRRNREDRPYNGPSENRDREERPRREPATGDFENRNNRDRGERREGREGRAIGNRPGAPRGQRRNFDGDRRGKREFDRQSGSDKTEADRPNTDANESWGDEVKIEPIETEKKEEGRPEEGRGGEEQTPVEEEPKELTLDEWKAQRAGRAKPQFNIRKAGEGEDPSQWKKMFELRKKEKDEETDEEEYDVSEYPQRVGRQKHLLDIEIQFNDSVRRGGGRGRGQRSGGPRGGGNRGGGTGGSGGGGGNRARESDRDRPERRYHNDAVDERNDARQAPKVDDERDFPSLG

SEQ ID NO: 21281 - protein, 400 aa, Diabrotica virgifera
  misc_feature: Coding regions on vcDNA: vcDNA=SeqID_978; Strand=+; Position=17-1216
  misc_feature: Homolog annotation: Hit_ID=XP_393931.1; Match level="QueryCoverage =87%, HitCoverage=78%, E-value=2e-94, Identity=52%"; Hit description =similar to ENSANGP00000009426 [Apis mellifera]
  misc_feature: Gene Ontology Annotation: Molecular function=carboxypeptidase C activity; Cellular component=vacuole; Biological process=proteolysis and peptidolysis
  misc_feature: Pfam annotation: Pfam_ID=Peptidase_S10; Match level="Score=273.2, E -value=4.3e-79, Copies=1"; Pfam description=Serine carboxypeptidase
MYNLLYIIVLILFTIALKSVNTSGHKDFFKKPPFKDFYGKLDANIRVGDAGEPLILTDLIKNGDIIWAKEKAKVTDFMPEVSSYAGYFRVDETYNSNLFFWFFPSQNDPANDPVILWLQGGPGATSMFGLFQEHGPFEFNEKGELGLRNTSWNLQHSVIYIDQPAGTGWSFTNKGYAQNQTKVGDDLYSALVQFFTLFDEYQSHPFIITGESYAGKYIPAIAHAIDKYNPSASVRINLQGLAIGNGLTDPKYQVKYADYLYKHGLVDLNTKNNLEKTENQIIDYILQEEYHLAANYMTFDLDDIGVACGLDIYNYLTLVSDDRAQEYMEQLFQREDLRKAIHVGNTEFDDKNVYSNLSNDIPVSQAHLVADLLSKYKVLIYNGQLDIIVAYPMTIDYLQN

SEQ ID NO: 21282 - protein, 456 aa, Diabrotica virgifera
  misc_feature: Coding regions on vcDNA: vcDNA=SeqID_979; Strand=+; Position=82-1449
  misc_feature: Homolog annotation: Hit_ID=XP_308390.1; Match level="QueryCoverage =85%, HitCoverage=88%, E-value=5e-47, Identity=26%"; Hit description =ENSANGP00000009437 [Anopheles gambiae]
  misc_feature: Gene Ontology Annotation: Molecular function=glucose transporter activity; Cellular component=plasma membrane; Biological process =glucose transport
  misc_feature: Pfam annotation: Pfam_ID=Sugar_tr; Match level="Score=80.0, E-value =6.4e-21, Copies=1"; Pfam description=Sugar (and other) transporter
MGKQLYNVEKNGEELQEVTYVGLETEWAHSLKVNDEVRRTDTPFLYLTVFMIQIPILLSGAHTVWTSPTIPTIMSNDTTINPLSQPATTVDISMIVGVPHLPGLVSTLTLPKLADFLGRKRFLQLMILNVLLGSILLTFSTSVTMIIISKCIIGIFLGGSFAIVPIYITELCEDHNRAKFGCFLGLFHQIGHFYSFIIGPLFSYKVYNLLITFLTVPFLLFFIFFPESPVYLFSKGRKDECRTALSRLRSNKTTNEINRDIKVLEAHVKSEQNTKRNVTIFTLFKTKETRIGLLLAILPLAVQHLSGVSVIMSFLAPFFNSAGTSISGHKVAVIVSIVKISSFTFTSSVVERVGRKRMLLISSVGIGIPLFFLGCFFYLKHVNSPLIHQFQWLPIVLMLSNVLMYSMGLGPIPMAIIHEIFTPENRAAAGSVIMTVVGLIVLSLTSSYPMVAATIG

SEQ ID NO: 21283 - protein, 535 aa, Diabrotica virgifera
  misc_feature: Coding regions on vcDNA: vcDNA=SeqID_980; Strand=+; Position=221-1826
  misc_feature: Homolog annotation: Hit_ID=XP_309824.1; Match level="QueryCoverage =86%, HitCoverage=93%, E-value=1e-156, Identity=57%"; Hit description= ENSANGP00000018273 [Anopheles gambiae]
  misc_feature: Gene Ontology Annotation: Molecular function=sulfite oxidase activity; Cellular component=mitochondrial intermembrane space; Biological process=protein catabolism
  misc_feature: Pfam annotation: Pfam_ID=Oxidored_molyb; Match level="Score=342.5, E -value=5.9e-100, Copies=1"; Pfam description=Oxidoreductase molybdopterin binding
  misc_feature (459)..(459): Xaa can be any naturally occurring amino acid
  misc_feature (517)..(517): Xaa can be any naturally occurring amino acid
MFSRTFSRTNICRTAYQYFCYSTIGSQKHNFHKDDSSTFKVKNLLIGGLVTGCIGYYFVGNKKVVLAKESPKVDKSDAVPGNYRSNLPVYSLDEIASHNSKETGIWVTYKEGVYNITEFVEGHPGGDQILMAAGSSVEPFWMLYGIHENPHVYEILETYRIGNLKPDDRNYFTSDMSDPYSTDPKRHIALKPACVKPFNAELPPELLVESFLTPNELFYVRNHLPVPEINPDSYELEIDIEGKNKVTVFTLEQLKKMPKHTITATIMCAGNRRSEMIQVRPVKGLNWGAAAIGNATWSGVYLRDVLLLAGMDENDQKYKHVQFEGYDSDATGKTYGASIPIWKALDQRGDVLLAYEMNGVPIPRDHGFPVRVIVPGIVGARNVKWLGKIIVSENESDSHWQQNDYKGFSPSVDWDTVDFTKSPAIHELPVISAICQPTANGAIKVEDGKITVKGYAWSXGGQKIVRVDVTIDGGKTWHVAKFDHQDKTPSPKHWSWTLCSIKIPDDANLKKCRSLSXKAVDSSYNTPPGKPLKIF

SEQ ID NO: 21284 - protein, 441 aa, Diabrotica virgifera
  misc_feature: Coding regions on vcDNA: vcDNA=SeqID_981; Strand=+; Position=225-1546
  misc_feature: Homolog annotation: Hit_ID=NP_650013.3; Match level="QueryCoverage =98%, HitCoverage=81%, E-value=1e-74, Identity=33%"; Hit description =CG31272-PA [Drosophila melanogaster] gb|AAF54546.3| CG31272-PA [Drosophila melanogaster]
  misc_feature: Gene Ontology Annotation: Molecular function=organic cation transporter activity; Cellular component=synaptic vesicle; Biological process=calcium ion homeostasis
  misc_feature: Pfam annotation: Pfam_ID=MFS_1; Match level="Score=39.6, E-value=9.4e- 09, Copies=1"; Pfam description=Major Facilitator Superfamily
  misc_feature (389)..(389): Xaa can be any naturally occurring amino acid
MELQNKEKPTTDATTFEDAIAATKFGKYNIMLIVVIALPCVTQLLNTVELSYILPVAQCDLGLTLEDKGLINAIMFAGMISTGVYWGYLCDALGRKRIIVYGFLLSGFFAAVAALSTSKYVLLAAKFMSGAIINGPFSATTSHITEFHSSEYRGRVNMARGMFLSFGSLLLPILSWAILPRKMDIFLFGIVELHSWNIFLLVCALSTIFCGVVYIFIPESPKYLMSTGRNEQAMKVLQKIYSLNTGNAMEDFPVKKLVEEVENSAEKVNVVVALKKCFREMKYLLHKPYVNHLLLACFNVFSLLISVNTVKLWLPGIFQAISDYQNAHNGTSTNLCTMLEQMVPKETPTSENCTVDMNNLSVYINTFIVSLARIVAFAFSTVFIRMLGXKKVNIILCFATAALQFCIYFARDSATVTILSATGTAIGSVAENLLISLTLGL

SEQ ID NO: 21285 - protein, 240 aa, Diabrotica virgifera
  misc_feature: Coding regions on vcDNA: vcDNA=SeqID_982; Strand=+; Position=18-738
  misc_feature: Homolog annotation: Hit_ID=AAH46580.1; Match level="QueryCoverage =92%, HitCoverage=80%, E-value=3e-39, Identity=41%"; Hit description =Scye1-prov protein [Xenopus laevis]
  misc_feature: Gene Ontology Annotation: Molecular function=interleukin-8 receptor binding; Cellular component=soluble fraction; Biological process =apoptosis
  misc_feature: Pfam annotation: Pfam_ID=tRNA_bind; Match level="Score=70.1, E-value =6.3e-18, Copies=1"; Pfam description=Putative tRNA binding domain
  misc_feature (158)..(158): Xaa can be any naturally occurring amino acid
  misc_feature (168)..(168): Xaa can be any naturally occurring amino acid
  misc_feature (215)..(215): Xaa can be any naturally occurring amino acid
MSGKGTMERIKQNAQLAKQTIEELKNELNIINNEYNTLLSRQLQEENAKLLAAVEDAKKKLIKLEVQNGVKQVPVPNQTVNVSAVEAPQADINKDEPKAPAEAPKPKKEKKAPKEQKVAEELPIDVGRLDLRIGKIEDIKRHPDADTLYVLHIYVGEXKPRTVCSRFXLKHIPMEELRDKTEGALCILKPVKMTGITSQAMDMCASREAGVKTLXPPANSGPGELVPFEKLHKKGPFRDK

SEQ ID NO: 21286 - protein, 184 aa, Diabrotica virgifera
  misc_feature: Coding regions on vcDNA: vcDNA=SeqID_983; Strand=+; Position=172-726
  misc_feature: Homolog annotation: Hit_ID=XP_395252.1; Match level="QueryCoverage =97%, HitCoverage=43%, E-value=1e-43, Identity=51%"; Hit description =similar to arrestin homolog [Apis mellifera]
  misc_feature: Gene Ontology Annotation: Biological process=embryogenesis and morphogenesis
LATKLKMACATLKRSLDWEPVLGGRPAKRRRCVPFCSSPTQSGIGSPGPSSSPTGSSSPKSSVFPDVLSKTLTPENLIDNLKTEIKRLQKRKQLQYNCMETSDGSSSGGESSESPSRSEKPLFTFRQVGMICERMLREREVEIREEYDNVLTAKLSEQYDAFVKFTYDQIHRNYTNTAVPSYLS

SEQ ID NO: 21287 - protein, 87 aa, Diabrotica virgifera
  misc_feature: Coding regions on vcDNA: vcDNA=SeqID_984; Strand=-; Position=0-260
LFLECRTIRVFFDTCIIILEYCSSRCTFACFEAACKPCGPKARQYLLRRLKTSQAVWQSVMDNHSVYVDRAIDFNVHTDLFLSGPYS

SEQ ID NO: 21288 - protein, 155 aa, Diabrotica virgifera
  misc_feature: Coding regions on vcDNA: vcDNA=SeqID_985; Strand=+; Position=507-969
  misc_feature: Homolog annotation: Hit_ID=XP_391860.1; Match level="QueryCoverage =98%, HitCoverage=46%, E-value=1e-58, Identity=68%"; Hit description =similar to ENSANGP00000021579 [Apis mellifera]
  misc_feature: Gene Ontology Annotation: Molecular function=pre-mRNA splicing factor activity; Cellular component=nuclear speck; Biological process=mRNA splice site selection
  misc_feature: Pfam annotation: Pfam_ID=RRM_1; Match level="Score=86.0, E-value=1e -22, Copies=1"; Pfam description=RNA recognition motif. (a.k.a. RRM, RB
  misc_feature (114)..(114): Xaa can be any naturally occurring amino acid
KGCSLSMVGSRVYVGGLPYGASERDLERFFRGYGRMRDVLIKNGYGFVEFDDYRDADDAVYELNGKKLLGERVTVERARGTPRGRDQYASGGSRSSRNNDDRRSSNNDRYGPPXTRTNYRVLVEKPFSRIQWQDLKDYMRRAGESTYADAHKQHR

SEQ ID NO: 21289 - protein, 325 aa, Diabrotica virgifera
  misc_feature: Coding regions on vcDNA: vcDNA=SeqID_986; Strand=+; Position=339-1316
  misc_feature: Homolog annotation: Hit_ID=XP_391860.1; Match level="QueryCoverage =98%, HitCoverage=94%, E-value=1e-116, Identity=65%"; Hit description= similar to ENSANGP00000021579 [Apis mellifera]
  misc_feature: Gene Ontology Annotation: Molecular function=pre-mRNA splicing factor activity; Cellular component=nuclear speck; Biological process=mRNA splice site selection
  misc_feature: Pfam annotation: Pfam_ID=RRM_1; Match level="Score=148.1, E-value =2.1e-41, Copies=2"; Pfam description=RNA recognition motif. (a.k.a. RRM, R
KGCSLSMVGSRVYVGGLPYGASERDLERFFRGYGRMRDVLIKNGYGFVEFDDYRDADDAVYELNGKKLLGERVTVERARGTPRGRDQYASGGSRSSRNNDDRRSSNNDRYGPPTRTNYRVLVENLSSRISWQDLKDYMRQAGEVTYADAHKQHRNEGVVEFASYSDMKNAIEKLDDTELNGRKLRLVEDKKNKSRRSASDSSRSRSRSRSRSARRSRSRSRSSRSKSKSKSRSRSRSLSNKDDREKSKSRSRSRSNSRKKSDRSRSNSRKKSVGSDHSRSRSRSRTPDKRSKSREASKERSRSRSRSRSESKERSKSRSRSRSPN

SEQ ID NO: 21290 - protein, 326 aa, Diabrotica virgifera
  misc_feature: Coding regions on vcDNA: vcDNA=SeqID_987; Strand=+; Position=91-1071
  misc_feature: Homolog annotation: Hit_ID=XP_392780.1; Match level="QueryCoverage =99%, HitCoverage=92%, E-value=1e-138, Identity=67%"; Hit description= similar to CG8882-PA [Apis mellifera]
  misc_feature: Gene Ontology Annotation: Molecular function=molecular_function unknown; Cellular component=cellular_component unknown; Biological process=biological_process unknown
  misc_feature: Pfam annotation: Pfam_ID=WD40; Match level="Score=110.3, E-value=4.8e- 30, Copies=5"; Pfam description=WD domain, G-beta repeat
MKPIMLQGHERAITQIKYNREGDLLFSASKGNKPDVWYALNGERLGTFNGHQGVIWCIDIDWTSTRFMSGAGDNTCKIWDCETGKEIGNINSASAVRTCMFSYSANMAVYTTDQAMKQPCEIFVVDTRCVDDSTGSQKPILRVPINGSRVSSILWDSLDESFITGHENGELIHWDLKTGKQLNKVREHDLLINDMQWNKDQTMFITASKDHTAKLFDKNDLLLLKTYKTERPVNSAAISPIFDHVVLGGGQDAMDVTTTSAKAGKFDSRFFHMIFEEEFGRVKGHFGPINSVAFHPDGKGYSSGGEDGFVRVHTFDTSYFEYNFDY

SEQ ID NO: 21291 - protein, 70 aa, Diabrotica virgifera
  misc_feature: Coding regions on vcDNA: vcDNA=SeqID_988; Strand=-; Position=261-473
FFLISFFLQLFFDYRNIYFICIFCFFFFNPRVVALLDRISHFILFCDNLMKHVAILKKFRKCLEQWCSNA

SEQ ID NO: 21292 - protein, 297 aa, Diabrotica virgifera
  misc_feature: Coding regions on vcDNA: vcDNA=SeqID_989; Strand=+; Position=3-893
  misc_feature: Homolog annotation: Hit_ID=AAG35693.1; Match level="QueryCoverage =97%, HitCoverage=80%, E-value=1e-68, Identity=43%"; Hit description =endopolygalacturonase [Sitophilus oryzae]
  misc_feature: Gene Ontology Annotation: Molecular function=polygalacturonase activity; Cellular component=extracellular; Biological process =pseudohyphal growth
  misc_feature: Pfam annotation: Pfam_ID=Glyco_hydro_28; Match level="Score=90.9, E -value=3.3e-24, Copies=1"; Pfam description=Glycosyl hydrolases family 28
SSNKLIYSLLFVVISAAAKSLNEDCCTITEYSQVPDVVETCKNIVISNLRVPANKTLNLNLQDGSELTFEGRTYFDYFEWKGPLVNITGDDLIVRGAPGHVLDGQGELYWDHLGGKGIKKPKFIRLQGNNSRYENIYLKNCPVHCASVAVSNSIIDGWLIDVSEGDKNNFTGHNTDGFDLSSTNLILQNSIVKNQDDCVVVNVGANILVRNMACYGGHGLSISAGFSKDDFTKNSVYNVIFEDSLVHRSPNGIHVKTHADSGPGIIQNVIYRNIRFEDINNFALNIPQDYVNGEATG

SEQ ID NO: 21293 - protein, 55 aa, Diabrotica virgifera
  misc_feature: Coding regions on vcDNA: vcDNA=SeqID_990; Strand=+; Position=2-169
RFNLPKHAEGEEGAEKDESEYRQAGGRPAPVIRRDERTTQRTRERKQAINKPNQI

SEQ ID NO: 21294 - protein, 312 aa, Diabrotica virgifera
  misc_feature: Coding regions on vcDNA: vcDNA=SeqID_991; Strand=+; Position=14-949
  misc_feature: Homolog annotation: Hit_ID=EAA44227.2; Match level="QueryCoverage =82%, HitCoverage=54%, E-value=5e-69, Identity=50%"; Hit description =ENSANGP00000025056 [Anopheles gambiae str. PEST] ref|XP_557097.1| ENSANGP00000025056 [Anopheles gambiae st
  misc_feature: Gene Ontology Annotation: Cellular component=endoplasmic reticulum; Biological process=aging
  misc_feature: Pfam annotation: Pfam_ID=Glyco_hydro_1; Match level="Score=89.0, E -value=1.1e-23, Copies=1"; Pfam description=Glycosyl hydrolase family 1
MKVSLLLLLVVSSVYSTPDSLPFPEGFLFGVSTAAYQVEGGWNQDGKGENIWDHQLHTNSNITIDHSNGDVACDSYNRIKRDVDILNNLDVDHYRFSISWSRILPTGLDDNINEAGVNYYKKLINELKIVGIQPMVTLLHFDLPQKLQDMGGFLNESIVDWFGNYSRVAYRLFGDDVKFWITINEPLTICYYGYGTGAVPPFIQSEGILEYQCLTHLLKAHARAYHVYAEEFINKQQGKTIYGLLYKRPFYLEVTIPKISKPRKKVSNFIFGIYAPPNFSWNWPRKIKNPNEPSPGKLKRKKRIPPFPHFLP

SEQ ID NO: 21295 - protein, 230 aa, Diabrotica virgifera
  misc_feature: Coding regions on vcDNA: vcDNA=SeqID_992; Strand=+; Position=118-810
  misc_feature: Homolog annotation: Hit_ID=AAP93584.1; Match level="QueryCoverage =97%, HitCoverage=94%, E-value=1e-72, Identity=58%"; Hit description =thioredoxin peroxidase [Apis mellifera ligustica] ref|XP_392086.1| similar to thioredoxin peroxidase [Apis
  misc_feature: Gene Ontology Annotation: Molecular function=electron transporter activity; Cellular component=cytoplasm; Biological process=response to oxidative stress
  misc_feature: Pfam annotation: Pfam_ID=AhpC-TSA; Match level="Score=252.6, E-value =6.8e-73, Copies=1"; Pfam description=AhpC/TSA family
MAGLIKNLVTRVPQILKTVPLKQITHRNFGVTSSLFIPKVQEPAPNFCGTAVVNGCFKDIKLADFKERFVVLFFYPLDFTFVCPTELVALEDKLEDFKALGAEVIGCSIDSHYSHLAWINAKRSEGGLGSIRYPLLSDINKDIARDYGVLLEKEGIALRGMFIIDTKGILRHITVNDLPIGRNVNEALRIIEAIKFTDEHGEVCPANWQKGGKTIKPDPKGSQEYFSSSN

SEQ ID NO: 21296 - protein, 293 aa, Diabrotica virgifera
  misc_feature: Coding regions on vcDNA: vcDNA=SeqID_993; Strand=+; Position=88-969
  misc_feature: Homolog annotation: Hit_ID=CAG12225.1; Match level="QueryCoverage =88%, HitCoverage=92%, E-value=6e-75, Identity=54%"; Hit description =unnamed protein product [Tetraodon nigroviridis]
  misc_feature: Pfam annotation: Pfam_ID=ubiquitin; Match level="Score=51.0, E-value =3.5e-12, Copies=1"; Pfam description=Ubiquitin family
MECLDPENKNGEEKHLNSVEVTNTKEEDDRLTEPSESKIPKTDVKENTVANPVEAVESKENDLVEKSDPVEIKVIYNKKKYDITTTSNTTILELKKHLQDLLGVPDAMQKLMYKGLLQDTQTISNSGITKGSKIMLVGSTLNDVLAVSSVTKQDVVELEKATTSKEPLSKQKIHRKVLDKGLPEDVMPGLKNIKEGLPPVPLSGMLNKHGGKVRLTFKLESDQLWLSTKERTEKLPMGSIKSVISEPIEEHDEYHILGLQLGPTEASMYWAGTQYIQYRDAIKDAVLGKWQYF

SEQ ID NO: 21297 - protein, 114 aa, Diabrotica virgifera
  misc_feature: Coding regions on vcDNA: vcDNA=SeqID_994; Strand=+; Position=88-432
  misc_feature: Homolog annotation: Hit_ID=XP_308466.1; Match level="QueryCoverage =89%, HitCoverage=94%, E-value=1e-13, Identity=38%"; Hit description =ENSANGP00000018489 [Anopheles gambiae]
KPLSTGTQEHKKMSNEGFDPCQIVRGLWEHEMSMRRLLDVLRNSQSYCTDNECLDVGTSSSTANPDYMVLVVLAMFTAVFLYYFRPGSQTVHGDSKPRNNGNNSDGAPPSSTSN

SEQ ID NO: 21298 - protein, 95 aa, Diabrotica virgifera
  misc_feature: Coding regions on vcDNA: vcDNA=SeqID_995; Strand=+; Position=117-404
  misc_feature: Homolog annotation: Hit_ID=NP_723194.1; Match level="QueryCoverage =78%, HitCoverage=19%, E-value=3e-16, Identity=50%"; Hit description =CG11050-PC, isoform C [Drosophila melanogaster] ref|NP_723193.1| CG11050-PB, isoform B [Drosophila
  misc_feature: Gene Ontology Annotation: Molecular function=molecular_function unknown; Cellular component=cellular_component unknown; Biological process=biological_process unknown
MESLNPEDVLKFLDLINTLKHSSRRGWELCHVNNHEQIAGHMYAMGIMTFLLGNESKLDRFKCLQLALVHDLSEWIVSHITPHYCITIAKKNHFC

SEQ ID NO: 21299 - protein, 137 aa, Diabrotica virgifera
  misc_feature: Coding regions on vcDNA: vcDNA=SeqID_996; Strand=+; Position=81-494
  misc_feature: Homolog annotation: Hit_ID=NP_788350.1; Match level="QueryCoverage =97%, HitCoverage=90%, E-value=7e-31, Identity=50%"; Hit description =CG33184-PA, isoform A [Drosophila melanogaster] gb|AAM68563.1| CG33184-PA, isoform A [Drosophila
MSIYFSGGFTRSAGIISAINKQLKLVNLKPVKKIQVQFDPFHANAVTARDFLFHISTPKVIETNLNCVIKPNVVCDRSEPEIKIDLGDAGTVKFLANNLTVLEILQQFNKHISSKVPVEPVSSPITTKLEAKRKGKR

SEQ ID NO: 21300 - protein, 347 aa, Diabrotica virgifera
  misc_feature: Coding regions on vcDNA: vcDNA=SeqID_997; Strand=+; Position=99-1142
  misc_feature: Homolog annotation: Hit_ID=XP_392525.1; Match level="QueryCoverage =94%, HitCoverage=5%, E-value=5e-88, Identity=52%"; Hit description =similar to Zinc finger protein 208 [Apis mellifera]
  misc_feature: Gene Ontology Annotation: Molecular function=transcription factor activity; Cellular component=nucleus; Biological process=axon guidance
  misc_feature: Pfam annotation: Pfam_ID=BTB; Match level="Score=119.4, E-value=8.6e -33, Copies=1"; Pfam description=BTB/POZ domain
MDDDQQFCLRWNNHQSTLVAVFDTLLENGTLVDCTLAAEGKCLNAHKVVLSACSPYFEALLSKHFDKHPILILKDVKFQELKAMMDYMYRGEVNISQDQLGALLKAAESLQIKGLSDNRKGETERKPTPAPPPKSPQPTTLPKVQGLTIEQRAREDSREGSMSPGPRKKKRLRRKSEELDNHDASNSSESHSLPAQSIPTLPAISKMNMNADVPEQIETKSEILTRHKQTDDMPQVPIIKEKIETHTELMLEPKSEYVEEMNEDSIEDLTLDDDDLSNMEQVDDQAGPSHGAGEGSSQGFGGWHMGNQSQDEVFLAAQEAVGAHRDSQGKIFVFNCKGLSTVLQLTC

SEQ ID NO: 21301 - protein, 204 aa, Diabrotica virgifera
  misc_feature: Coding regions on vcDNA: vcDNA=SeqID_998; Strand=+; Position=444-1058
  misc_feature: Homolog annotation: Hit_ID=AAK92156.1; Match level="QueryCoverage =100%, HitCoverage=100%, E-value=3e-93, Identity=77%"; Hit description=ribosomal protein L13A [Spodoptera frugiperda] sp|Q962U0|R13A_SPOFR 60S ribosomal protein L13A
  misc_feature: Gene Ontology Annotation: Molecular function=structural constituent of ribosome; Cellular component=cytosolic large ribosomal subunit (sensu Eukarya); Biological process=protein biosynthesis
  misc_feature: Pfam annotation: Pfam_ID=Ribosomal_L13; Match level="Score=179.5, E -value=7.3e-51, Copies=1"; Pfam description=Ribosomal protein L13
MTGFSEKAILIDGRGHLLGRLAAIVSKALLEGNKVTVVRCEQLNISGNFYRNKLKFMSFLRKRCNVNPARGPFHFRAPSRIFWKTVRGMLPHKSERGKQALRRLKAYEGIPPPYDRRKRVVVPGALRVICLKPGRKFCHVGRLSHEVGWKYQSVVRTLESKRKVKAVLAIRKRDKLKKLTQQASEKVAKQTKPFTSLINSYGYN

SEQ ID NO: 21302 - protein, 374 aa, Diabrotica virgifera
  misc_feature: Coding regions on vcDNA: vcDNA=SeqID_999; Strand=-; Position=1-1122
  misc_feature: Homolog annotation: Hit_ID=EAL34571.1; Match level="QueryCoverage =97%, HitCoverage=70%, E-value=1e-180, Identity=84%"; Hit description= GA21647-PA [Drosophila pseudoobscura]
  misc_feature: Gene Ontology Annotation: Molecular function=ATP dependent RNA helicase activity; Cellular component=nucleolus; Biological process =rRNA processing
  misc_feature: Pfam annotation: Pfam_ID=DEAD; Match level="Score=248.0, E-value=1.7e- 71, Copies=1"; Pfam description=DEAD/DEAH box helicase
AGPSGLERFDALCKACEQLKWKEPSNIQKEAIPVALQGKDIIGLAETGSGKTAAFALPILQALLENPQRYFALILTPTRELAFQISEQFEALGSSIGVKCAVIVGGMDMMSQALILAKKPHILIATPGRLLDHLENTKGFSLRALKFLVMDEADRILNMDFEVEVDKILKVIPRERRTFLFSATMTQKVKKLQRACLQDPVRVEVSTKYQTVEKLQQYYIFIPVKFKDVYLVNILNELAGNSFMIFCSTCNNTIRTALMLRNLGLTAVPLHGQMSQNKRLAALTKFKAKNRSILISTDVASRGLDIPHVDVVINFDIPTHSKDYIHRVGRTARAGRSGRAVTFVTQYDVELYQRIEQLIGKQLPLYKTEEDEVM

SEQ ID NO: 21303 - protein, 335 aa, Diabrotica virgifera
  misc_feature: Coding regions on vcDNA: vcDNA=SeqID_1000; Strand=+; Position=1-1005
  misc_feature: Homolog annotation: Hit_ID=EAL31408.1; Match level="QueryCoverage =99%, HitCoverage=34%, E-value=1e-118, Identity=65%"; Hit description= GA19453-PA [Drosophila pseudoobscura]
  misc_feature: Gene Ontology Annotation: Molecular function=molecular_function unknown; Cellular component=Golgi apparatus; Biological process=ER to Golgi transport
  misc_feature: Pfam annotation: Pfam_ID=DUF1606; Match level="Score=161.5, E-value =1.8e-45, Copies=1"; Pfam description=Domain of unknown function (DUF1606)
VTSDGTYATQSAFNTVSQTTKEARPPLRQYLMDGDFFIGASLASTLTKLSLRYEDLTSPAASNGFNAKIMLIMAGILHLGKSGLPTKSITNDDKDHILFCLRVLSDRSPIIVEIFKKLCRSALNEMLLAKESVEAISQKSKEKNKRTIQTDDAISFLQLETDKSGELGENVFEMSLSQALVGGRTGGGESVLSSNKLDKITQLTGFSDPVYSEAYVHVNQYDIVLDVLIVNQTNDTLQNCTLELATLGDLKLVEKPQPVVLAPKDFCNIKANVKVASTENGIIFGNIVYDVIGAGSDRNVVVLNDIHIDIMDYIVPASCTDSEFMRMWAEFEWEI

SEQ ID NO: 21304 - protein, 279 aa, Diabrotica virgifera
  misc_feature: Coding regions on vcDNA: vcDNA=SeqID_1001; Strand=+; Position=2-839
  misc_feature: Homolog annotation: Hit_ID=XP_314768.1; Match level="QueryCoverage =84%, HitCoverage=47%, E-value=8e-67, Identity=53%"; Hit description =ENSANGP00000005086 [Anopheles gambiae]
  misc_feature: Pfam annotation: Pfam_ID=DUF715; Match level="Score=-97.0, E-value =0.0016, Copies=1"; Pfam description=Protein of unknown function (DUF715)
  misc_feature (209)..(209): Xaa can be any naturally occurring amino acid
  misc_feature (220)..(220): Xaa can be any naturally occurring amino acid
  misc_feature (259)..(259): Xaa can be any naturally occurring amino acid
TKQNDLDVAFDLLQPIKYDIVNEETPFGKEIDFNWLDVPLEANPNGGALPKSRADRKCEQLENLAKAVMKIAAQKRYSIVDFCSGSGHLGILLATLLPNCEIVLVENKERSLLRAKERIEKLGLTNVCIVQSNLDYFQGNFDIGVALHACGVATDLVIQNCINKKAHLVVCPCCYGGVRNCHHLTYPRSNQFKKLDLGLQNYLNLARCXADQTHDKENAXKRERGYFCMNAVDTDRRLYVESFGYKVRLGKLYPTSCTXKSNLLVGLTRRLFLDYIILC

SEQ ID NO: 21305 - protein, 314 aa, Diabrotica virgifera
  misc_feature: Coding regions on vcDNA: vcDNA=SeqID_1002; Strand=+; Position=77-1018
  misc_feature: Homolog annotation: Hit_ID=NP_610914.2; Match level="QueryCoverage =89%, HitCoverage=78%, E-value=1e-90, Identity=60%"; Hit description =CG16935-PA [Drosophila melanogaster] gb|AAF58322.2| CG16935-PA [Drosophila melanogaster]
  misc_feature: Gene Ontology Annotation: Molecular function=enoyl-[acyl-carrier protein] reductase activity; Cellular component=mitochondrion; Biological process=aerobic respiration
  misc_feature: Pfam annotation: Pfam_ID=ADH_zinc_N; Match level="Score=131.0, E -value=2.8e-36, Copies=1"; Pfam description=Zinc-binding dehydrogenase
  misc_feature (267)..(267): Xaa can be any naturally occurring amino acid
  misc_feature (276)..(276): Xaa can be any naturally occurring amino acid
  misc_feature (285)..(285): Xaa can be any naturally occurring amino acid
MKSTKLFNYTNISNVYKRFSSTTSSKLIYFEYGDPLKVVNLEEERIPDPNEQQVLIKMLAAPVNPADINTIQGKYPSKPELPAVPGNEGVGVVEKVGSGVVGISQGDHVVPLTNNLGTWRTHIVLNSNNVLKVPKKLGLVEAATLTVNPCTAYRMLRDFTALKPGDTVIQNGANSACGQNVIQLCKSWGVRTVNVVRNRPEIDELRKFLQNLGATYVLTEEEIRSTDIFRGAVDKPKLALNCVGGKSALDIMRYLQNGSPIVTYGGXMSREPVTVXTSALIFTDXIKVRGFWMTRLEQRTMELMRKDSKDVRKN

SEQ ID NO: 21306 - protein, 236 aa, Diabrotica virgifera
  misc_feature: Coding regions on vcDNA: vcDNA=SeqID_1003; Strand=+; Position=47-758
  misc_feature: Homolog annotation: Hit_ID=CAH04322.1; Match level="QueryCoverage =99%, HitCoverage=89%, E-value=7e-63, Identity=85%"; Hit description =S9e ribosomal protein [Meladema coriacea]
  misc_feature: Gene Ontology Annotation: Molecular function=structural constituent of ribosome; Cellular component=cytosolic ribosome (sensu Eukarya); Biological process=protein biosynthesis
  misc_feature: Pfam annotation: Pfam_ID=Ribosomal_S4; Match level="Score=160.7, E -value=3.2e-45, Copies=2"; Pfam description=Ribosomal protein S4/S9 N- terminal dom
  misc_feature (180)..(180): Xaa can be any naturally occurring amino acid
MVNGRIPSVHSKTYVTPRRPYEKARLDQELKIIGAFGLRNKREVWRVKYTLAKIRKAARELLTLEEKEPKRLFEGNALLRPYEKARLDQELKIIGAFGLRNKREVWRVKYTLAKIRKAARELLTLEEKEPKRLFEGNALLRRLVRIGVLDENRMKLDYVLGLKIEDFLERRLQTQVFQIXLPKSIHHARVLIRQRHIPGPPNKLGTFPSFIVRWISQKTFNFLSEIPLGGGPPGRG

SEQ ID NO: 21307 - protein, 194 aa, Diabrotica virgifera
  misc_feature: Coding regions on vcDNA: vcDNA=SeqID_1004; Strand=+; Position=64-648
  misc_feature: Homolog annotation: Hit_ID=NP_729506.1; Match level="QueryCoverage =100%, HitCoverage=100%, E-value=1e-95, Identity=91%"; Hit description=CG3395-PD, isoform D [Drosophila melanogaster] ref|NP _524004.2| CG3395-PA, isoform A [Drosophila
  misc_feature: Gene Ontology Annotation: Molecular function=structural constituent of ribosome; Cellular component=cytosolic ribosome (sensu Eukarya); Biological process=protein biosynthesis
  misc_feature: Pfam annotation: Pfam_ID=Ribosomal_S4; Match level="Score=141.6, E -value=1.8e-39, Copies=1"; Pfam description=Ribosomal protein S4/S9 N- terminal dom
MVNGRIPSVHSKTYVTPRRPYEKARLDQELKIIGAFGLRNKREVWRVKYTLAKIRKAARELLTLEEKEPKRLFEGNALLRRLVRIGVLDENRMKLDYVLGLKIEDFLERRLQTQVFKSGLAKSIHHARVLIRQRHIRVRKQVVNIPSFIVRLDSQKHIDFSLKSPLGGGRPGRVKRKNLTKKSGGGGAAEEEED

SEQ ID NO: 21308 - protein, 407 aa, Diabrotica virgifera
  misc_feature: Coding regions on vcDNA: vcDNA=SeqID_1005; Strand=+; Position=140-1360
  misc_feature: Pfam annotation: Pfam_ID=zf-C2H2; Match level="Score=44.7, E-value =2.6e-10, Copies=5"; Pfam description=Zinc finger, C2H2 type
MFKEKEINRYACKICSDVSVTYKYMYKHVLQHQQQFDINNIISLPKNPRLEIWLQNLIRMQCNIIVRSLAAPKEISPNSTPHKVLCRYCNKWYRSEQERNEHAIFHWKCIPFKCSECSFEAYTRTHMTLHITLPHGRGKTPFIIAAGPTVAGELQYSDFLHMKEAEEEKEKSKLTTSLNPPTKVNQTAIAQVLVPEVVRPDMIDESEQDGTVQGMVFLDESNDKVSVEVADDHHEPSDALDISDLLIVSKTDTNVPNDGDVFCCEYCPYMSHSEMQIRSHISGQHDHMHIKFKVLNRPQCESKKDDYVACTICNEVGSEITIREHHLDVHEGETFFIYRYICCCCQKRFTKSHGIRIHFNRRHPGVQLKCRDIFNKIHYFEPVITKVSEPSIRKNVAPLSLSGSKRE

SEQ ID NO: 21309 - protein, 384 aa, Diabrotica virgifera
  misc_feature: Coding regions on vcDNA: vcDNA=SeqID_1006; Strand=+; Position=56-1210
  misc_feature: Homolog annotation: Hit_ID=EAL31677.1; Match level="QueryCoverage =99%, HitCoverage=97%, E-value=1e-138, Identity=63%"; Hit description= GA14526-PA [Drosophila pseudoobscura]
  misc_feature: Gene Ontology Annotation: Biological process=protein modification
  misc_feature: Pfam annotation: Pfam_ID=ThiF; Match level="Score=144.7, E-value=2.1e- 40, Copies=1"; Pfam description=ThiF family
MSQEALLAQIKDLKEKLEAATQKNVRQKIKEMSSEVIDSNPYSRLMALKRMGIVNNYEKIRDYTVAVVGVGGVGSVTAEMLTRCGIGRLILFDYDKVELANMNRLFFQPHQSGLSKVEAAAETLRNINPDVDIHTYNYNITTVENFDNFTEVLRTSSLTGGPIDVVLSCVDNFEARFAINTACNEFNLTWFESGVSENAVSGHIQFIVPGETACFACAPPLIVASNIDESTLKRDGVCAASLPTTMGIIAGFLVQNTLKYLLQFGQVTNYLGYSALTDFFPTMSLKPNPNCEDSHCRSRQRDFALKPKPEIAVEAKEEKPVHEDNEWGISLVDESLDVKEEVDIAQGVQLAYTLPNQNVVEECEEATAANEISLDELMSKLKDI

SEQ ID NO: 21310 - protein, 250 aa, Diabrotica virgifera
  misc_feature: Coding regions on vcDNA: vcDNA=SeqID_1007; Strand=+; Position=125-877
  misc_feature: Homolog annotation: Hit_ID=AAQ20840.1; Match level="QueryCoverage =88%, HitCoverage=97%, E-value=9e-69, Identity=59%"; Hit description =mapmodulin-like protein [Rhodnius prolixus]
  misc_feature: Gene Ontology Annotation: Cellular component=nucleus
  misc_feature: Pfam annotation: Pfam_ID=LRR_1; Match level="Score=30.2, E-value=6.3e- 06, Copies=4"; Pfam description=Leucine Rich Repeat
MEKRIELEKRGRDPAEIKDLILDNSRSTSIVGLTDEFTNLRNLSLINVGLTSLKGFPKLPNLKKLELSDNRIANGLNLLETSPKLTTLNLSGNKIKDLETLEPLKNLKNLKNLDLFNCEATSVENYRDKVFKMIPSLKYLDGYDQHDGEAEEDEEEENEEDLNRNGNDSDMSSDDEEEDVRLSSVYDDFEEEDEDDDEYEFGEEQEGEDYVIEEELDDEQDSDEEDVALAVATDASRGTKRKLEEGDGEN

SEQ ID NO: 21311 - protein, 74 aa, Diabrotica virgifera
  misc_feature: Coding regions on vcDNA: vcDNA=SeqID_1008; Strand=+; Position=325-549
YVLISKNLHFTFFIFFNNDFDIPYSTNIRLVLDDRDNDYLTFRNMKNESTLQITLLFIRIISRAIYIRTSYVAH

SEQ ID NO: 21312 - protein, 124 aa, Diabrotica virgifera
  misc_feature: Coding regions on vcDNA: vcDNA=SeqID_1009; Strand=-; Position=26-400
  misc_feature: Homolog annotation: Hit_ID=CAD22154.1; Match level="QueryCoverage =68%, HitCoverage=51%, E-value=2e-35, Identity=74%"; Hit description =pherophorin-dz1 protein [Volvox carteri f. nagariensis]
  misc_feature: Gene Ontology Annotation: Molecular function=single-stranded DNA binding; Cellular component=actin filament; Biological process=actin filament-based process
  misc_feature (33)..(33): Xaa can be any naturally occurring amino acid
LDEIPPPDPPPIPPPIPPPIPPPPMPPPIPPPXPPPIPPPMPPPMPSPPPIPPPIPPPIPPPIPPPIPPPMPPPIPLPPPNPVPPPAVFWVLYLMKYTSGLLGCVGAAVGIVISGPSSGFLTKT

SEQ ID NO: 21313 - protein, 227 aa, Diabrotica virgifera
  misc_feature: Coding regions on vcDNA: vcDNA=SeqID_1010; Strand=+; Position=40-723
  misc_feature: Homolog annotation: Hit_ID=NP_651829.1; Match level="QueryCoverage =77%, HitCoverage=74%, E-value=2e-23, Identity=38%"; Hit description =CG12045-PA [Drosophila melanogaster] gb|AAF57092.1| CG12045-PA [Drosophila melanogaster]
  misc_feature: Pfam annotation: Pfam_ID=Chitin_bind_4; Match level="Score=40.2, E -value=5.9e-09, Copies=1"; Pfam description=Insect cuticle protein
MNYLSVLGVTLSLLLSCQCQRQYQHQQPAVQYNQEDSYSYQSTQPPPQILSHKQALNHDGNFKYLFTSENGLAQGESIAPDGSRNGGYSYVDPNGKKISVKYTAGKEGFRILEADHLPKAPQPVVPLPVPVQQPAYQPQYQPQPQQYQPRAYPQYNKQEDDGQYRPELYERPQQQLIQLPSHQRASYPAPLAVSPTPSSNALEEKDYFDEPGKAHSFGSGYIFEFGG

SEQ ID NO: 21314 - protein, 231 aa, Diabrotica virgifera
  misc_feature: Coding regions on vcDNA: vcDNA=SeqID_1011; Strand=+; Position=164-859
  misc_feature: Homolog annotation: Hit_ID=ZP_00357698.1; Match level="QueryCoverage =30%, HitCoverage=38%, E-value=2e-19, Identity=62%"; Hit description =hypothetical protein Chlo02002738 [Chloroflexus aurantiacus]
MGGGRPPPGPPPPKKFFGGGGGPNPQNWAPKGTPLFNFPGKTRQTARKKKKKKKKRRGPRAPPKFEVPLAVPPPPPPLKWPRQGGSPFPFRFGKFWGGGLGGAFFFFPPGGKGGVGPRGLNWGPPGFFPPAGFKTAPREFNFGAPLKRILPPPPPYLNLVPFKGPPLFFFFFFFFFFFFFFFFFFFFFFFFFFFFFFFFFFFFFFFFMFLIILLKLTKKYSKLTYMNILRL

SEQ ID NO: 21315 - protein, 303 aa, Diabrotica virgifera
  misc_feature: Coding regions on vcDNA: vcDNA=SeqID_1012; Strand=+; Position=129-1036
  misc_feature: Homolog annotation: Hit_ID=AAH44027.1; Match level="QueryCoverage =99%, HitCoverage=92%, E-value=1e-104, Identity=60%"; Hit description= Xm278-prov protein [Xenopus laevis]
  misc_feature: Gene Ontology Annotation: Molecular function=molecular_function unknown; Cellular component=integral to membrane; Biological process= erythrocyte differentiation
  misc_feature: Pfam annotation: Pfam_ID=Mtc; Match level="Score=529.9, E-value=2.4e -156, Copies=1"; Pfam description=Tricarboxylate carrier
  misc_feature (249)..(249): Xaa can be any naturally occurring amino acid
  misc_feature (258)..(258): Xaa can be any naturally occurring amino acid
  misc_feature (272)..(272): Xaa can be any naturally occurring amino acid
  misc_feature (281)..(281): Xaa can be any naturally occurring amino acid
  misc_feature (295)..(296): Xaa can be any naturally occurring amino acid
MASVPKGINIDEPRYDQKTYVGRAKHFFITTNPLNIFASSKSLDEAKSIVDRYRRNERIEGLTEDKLWRAKNLYDSAFHPDTGEKMFVLGRMSAQVPSNMLITGGMITFYRSIPAVVFWQWLNQSFNALVNYSNRSGDIVQTDQQILTSYLCATTGAVGTALGLNSLTKSMPSIIGRMVPFVAVAAANCINIPMMRAQELRQGTPVYDENNNKLGYSKRAAQSGIAQVVFSRVCMALPGMVCTPIIMNXVERKGFLRXYPKMNLPVSIGILXFLLTFATPXLACAVFKQKATHTXXKLEPELQ

SEQ ID NO: 21316 - protein, 582 aa, Diabrotica virgifera
  misc_feature: Coding regions on vcDNA: vcDNA=SeqID_1013; Strand=+; Position=25-1773
  misc_feature: Homolog annotation: Hit_ID=NP_651791.2; Match level="QueryCoverage =89%, HitCoverage=77%, E-value=8e-91, Identity=35%"; Hit description =CG15533-PA [Drosophila melanogaster] gb|AAF57044.1| CG15533-PA [Drosophila melanogaster]
  misc_feature: Gene Ontology Annotation: Molecular function=sphingomyelin phosphodiesterase activity; Cellular component=integral to membrane; Biological process=ceramide biosynthesis
  misc_feature: Pfam annotation: Pfam_ID=Metallophos; Match level="Score=64.3, E -value=3.3e-16, Copies=1"; Pfam description=Calcineurin-like phosphoesterase
MKTTWIFLGLFLICANVKIILGFDSTTGLYSSFITNQWPEEVIEKFREHKTLFAVLTGKYLKDDMLSCVACNLLFTGILLEKNYDMTSIQLSSEAEYFCEILGLESTNVCDGVIYPHVDVLSYIIDNKKEVNSQQICSLIMKCDQGNETFNWTIDIPDGTPAEKVPDGNTTFKVGHITDIHFDPLYTEGKVADCHEPLCCQNDQADATKGEDACGHFGTYKQADAPQVLLEEALDQLAQQKPEFVYFTGDLVSHRVWGTSPEFNGNIIKKAMGLFAEKLGNIPVYPILGNHEAHPVNLYAPLDTSEDEISSDWLYDVILDTWTEHDWLDKEAVKKTILAGGYYTVKTARGLRLIVLNNNVCSRENWWNLYNSEDPYGQLKWLADTLLEAEKNKEIVHILYHIQTSSCIGSWGRAYNQILKRFQNTIAAQFNGHTHRDQFFIHYDNDTNENNMSTPIGVTFNGGSLMPDEANPNYKILSIDANSFNVKDFETYTFDLDEANKNQKIDWIKLYSFKDSFHVDSLSPADLSDLVINKMKNDTVVDLYNRFFYRGSSKANQTYVGRDLRCQILLTVEGEADMCNHL

SEQ ID NO: 21317 - protein, 85 aa, Diabrotica virgifera
  misc_feature: Coding regions on vcDNA: vcDNA=SeqID_1014; Strand=-; Position=156-413
ANSHHNTSKYTKVRQKKSTTEISEEWNTSSKIELPMDTRFVIAYPEKNNQEYLWNNSHQCQIIQIVSISKLSKNSLIKINVESDT

SEQ ID NO: 21318 - protein, 227 aa, Diabrotica virgifera
  misc_feature: Coding regions on vcDNA: vcDNA=SeqID_1015; Strand=+; Position=226-906
  misc_feature: Homolog annotation: Hit_ID=NP_996089.1; Match level="QueryCoverage =98%, HitCoverage=23%, E-value=3e-80, Identity=64%"; Hit description =CG7255-PD, isoform D [Drosophila melanogaster] ref|NP_996088.1| CG7255-PE, isoform E [Drosophila
  misc_feature: Gene Ontology Annotation: Molecular function=basic amino acid transporter activity; Cellular component=integral to membrane; Biological process=transport
  misc_feature (225)..(225): Xaa can be any naturally occurring amino acid
MSTIWKVLTRKKEIDTESVEETRLSRVLGTFDLTALGVGSTLGVGIYVLAGKVALTAGPSVILSFLIAAIASVFAGLCYAEFGARTPKTGSAYVYTYVCVGEFVAFVIGWNLILEYVIGSASVARGLCLYLDTLLNNTLENTFKEIAPINVSFMSEYFDFMAFGISIVLAIALAFGLKESSLVNNIFTSLNIGIVLFVIIAGSLKADFKNWNIQPSNTTKRTNIXRG

SEQ ID NO: 21319 - protein, 133 aa, Diabrotica virgifera
  misc_feature: Coding regions on vcDNA: vcDNA=SeqID_1016; Strand=+; Position=3-402
  misc_feature: Homolog annotation: Hit_ID=XP_319656.1; Match level="QueryCoverage =92%, HitCoverage=57%, E-value=1e-46, Identity=69%"; Hit description =ENSANGP00000013993 [Anopheles gambiae]
  misc_feature: Gene Ontology Annotation: Molecular function=phosphatidylethanolamine binding; Cellular component=cytoplasm; Biological process=biological _process unknown
  misc_feature: Pfam annotation: Pfam_ID=PBP; Match level="Score=82.0, E-value=1.6e -21, Copies=1"; Pfam description=Phosphatidylethanolamine-binding prote
  misc_feature (88)..(88): Xaa can be any naturally occurring amino acid
SYYLRRPVVARLYSTLSKSMEKHGVVPDVIDVAPEQQVEVSYPSGVKVDFGNELTPTQVKDIPAVKWPADKDSLYTLCMTDPDAPSRXEPNFREWHHWLVGNIPGGEVSKGEVLSEYVGSGPPRNTGLHRDVF

SEQ ID NO: 21320 - protein, 161 aa, Diabrotica virgifera
  misc_feature: Coding regions on vcDNA: vcDNA=SeqID_1017; Strand=+; Position=99-584
  misc_feature: Homolog annotation: Hit_ID=S36442; Match level="QueryCoverage=68%, HitCoverage=74%, E-value=8e-20, Identity=48%"; Hit description =reverse transcriptase-like protein - bovine (fragment)
  misc_feature: Gene Ontology Annotation: Molecular function=molecular_function unknown; Cellular component=cellular_component unknown; Biological process=biological_process unknown
  misc_feature (99)..(99): Xaa can be any naturally occurring amino acid
MYICVYIYIYIYMYIYILKQLDIDQKDIRCIEALYWNQTAVVKVDNETTQAQKILRGVRQGCIISPLLFNLYSESIFQEALEICESGIKVNGTWVNTIXYADDSVLIADNIEDLQNLLNKIEEHSENMGLSINIKKTKFLIIATEYNYLMLRRELGRNFKF

SEQ ID NO: 21321 - protein, 369 aa, Diabrotica virgifera
  misc_feature: Coding regions on vcDNA: vcDNA=SeqID_1018; Strand=+; Position=198-1305
  misc_feature: Homolog annotation: Hit_ID=XP_395357.1; Match level="QueryCoverage =97%, HitCoverage=93%, E-value=1e-149, Identity=72%"; Hit description= similar to TIA-1 homologue [Apis mellifera]
  misc_feature: Gene Ontology Annotation: Molecular function=antimicrobial peptide activity; Cellular component=lysosome; Biological process=induction of apoptosis
  misc_feature: Pfam annotation: Pfam_ID=RRM_1; Match level="Score=237.6, E-value =2.3e-68, Copies=3"; Pfam description=RNA recognition motif. (a.k.a. RRM, R
  misc_feature (227)..(227): Xaa can be any naturally occurring amino acid
MSDESHPKTLYVGNLDVSVSEDLLCTLFSQIGLVKGCKIIREPGNDPYAFIEFTNHQSASTALAAMNKRLFLDKEMKVNWATSPGNQPKQDTSNHHHIFVGDLSPEIETETLREAFAPFGEISNCRIVRDPQTLKSKGYAFVSFVKKAEAENAIQAMNGQWLGSRSIRTNWSTRKPPPPRTEKPAQRQKQPQFEEIYNQTSPTNTTVYCGGFASGLTDDLVHRTFSXPFGTIQDIRVFKDKGYAFIKFLTKESATHAIENIHNSDINGATVKCFWGKENGGFGPDPSMQSGAVPQSSAPPYSYGYGSYWYPQGYTAGGGYMQGYQSYQQYQQYPGGQQYCVMPQQGQWSGQPGQQPNVPVMYGQKYPSQ

SEQ ID NO: 21322 - protein, 303 aa, Diabrotica virgifera
  misc_feature: Coding regions on vcDNA: vcDNA=SeqID_1019; Strand=+; Position=1-907
  misc_feature: Homolog annotation: Hit_ID=NP_082319.1; Match level="QueryCoverage =98%, HitCoverage=59%, E-value=1e-59, Identity=43%"; Hit description =DNA segment, Chr 1, Brigham & Women's Genetics 0212 expressed [Mus musculus] gb|AAH49091.1| DNA
  misc_feature (289)..(289): Xaa can be any naturally occurring amino acid
  misc_feature (296)..(296): Xaa can be any naturally occurring amino acid
PTRPVLLGILENHNVRNFTLEALSNEVHKKFESSHFFKVGSCIVTLLQNNLLTDPEQRLAAITLLYELYRGEPIGNTPFANVFIHLLNPPEQQSSVGAPKLEYPGQLPRITAPEKHFIVQLLADKPKDALLKKTAAQIVNSDVPSQVNADFSAIQLTLAEKQSELPQTCKTGIPVVLSLPEKNYNSYTVDTTKDDTIIKKIVTSDNAPVNKVYKPEFVTLAPPLLNCKDEPVWLNPTTPKEHTVAYDITMCVPDTVGYEARQLMNKAYKSALSNSQQQQLLGELEDDPXLVYHMGXTPRKLPD

SEQ ID NO: 21323 - protein, 87 aa, Diabrotica virgifera
  misc_feature: Coding regions on vcDNA: vcDNA=SeqID_1020; Strand=+; Position=2-265
AHASDNIMAKLTFVLLALVAIVVLSTTEVNSLVQEPGTLKASKALGFKLSDDDTCTCAKCSDSCIAVDKDHNVGGICHLGDCLCVYH

SEQ ID NO: 21324 - protein, 290 aa, Diabrotica virgifera
  misc_feature: Coding regions on vcDNA: vcDNA=SeqID_1021; Strand=+; Position=75-947
  misc_feature: Homolog annotation: Hit_ID=NP_610276.1; Match level="QueryCoverage =91%, HitCoverage=46%, E-value=4e-47, Identity=33%"; Hit description =CG11123-PA [Drosophila melanogaster] gb|AAF59259.1| CG11123-PA [Drosophila melanogaster]
  misc_feature: Pfam annotation: Pfam_ID=PUF; Match level="Score=34.6, E-value=3e-07, Copies=3"; Pfam description=Pumilio-family RNA binding repeat
METHSSESSQKRNNRKRKKSFLKNARKYAKKGHFGRGSQLDSDTYHYFVKILETYKEGFDTDEDKQVFANNVFAQTEDQEVNCSCNQVGCRVVEMLLPFANDDILKKFMVAFSEDMRPLISDRFASHVLECLVSESCKRTLNNKVPEESRTEYQKFAIKVSKFLLNNLEDYIWDTYGNHVIRSCLTHLIQMPVDKKNETVVKVEVPDEFSEIVKECGQRIISWPQFKEMCMSDLTSGFLQVLMKCLKRVDSKMLKLYLKKLTTEVFINSEQTEESTKYYHLHLHNLLSCL

SEQ ID NO: 21325 - protein, 119 aa, Diabrotica virgifera
  misc_feature: Coding regions on vcDNA: vcDNA=SeqID_1022; Strand=+; Position=8-367
  misc_feature: Homolog annotation: Hit_ID=CAH04344.1; Match level="QueryCoverage =100%, HitCoverage=100%, E-value=4e-60, Identity=96%"; Hit description=S25e ribosomal protein [Platystomos albinus]
  misc_feature: Gene Ontology Annotation: Molecular function=structural constituent of ribosome; Cellular component=cytosolic small ribosomal subunit (sensu Eukarya); Biological process=protein biosynthesis
  misc_feature: Pfam annotation: Pfam_ID=Ribosomal_S25; Match level="Score=236.1, E -value=6.6e-68, Copies=1"; Pfam description=S25 ribosomal protein
MPPKKDSKSSAKQPQKTQKKKEGSGGGKAKKKKWSKGKVRDKLNNQVLFDKATYDKLYKEVPSYKLITPSVVSERLKVRGSLARRALIELQQKGLIKQVVQHRAQLIYTRTTKGDDPAA

SEQ ID NO: 21326 - protein, 135 aa, Diabrotica virgifera
  misc_feature: Coding regions on vcDNA: vcDNA=SeqID_1023; Strand=-; Position=295-702
MTSDSESTVSLSSDASDSFLTVSTSSSVFTSSFSSLSSSTFGIYNSSSDLRILNPPLSLSDEVSSKSSESDKLSDNISLSSASRSSWISSVLSELSDSDLRRLCLSFLFIVSIHFSVWTNMFFGFLRASNLLCRS

SEQ ID NO: 21327 - protein, 103 aa, Diabrotica virgifera
  misc_feature: Coding regions on vcDNA: vcDNA=SeqID_1024; Strand=-; Position=595-906
  misc_feature: Homolog annotation: Hit_ID=ZP_00357698.1; Match level="QueryCoverage =34%, HitCoverage=21%, E-value=3e-10, Identity=78%"; Hit description =hypothetical protein Chlo02002738 [Chloroflexus aurantiacus]
FIFFFSFFFFFFFFFFFFFFSFFFFFFFFFLINIFIENIINGHLGKVISAWSSRHGHLGMVISAWSSRHGHLGMVIRHGVENLPSNCPCLLTDAISGSTIESC

SEQ ID NO: 21328 - protein, 59 aa, Diabrotica virgifera
  misc_feature: Coding regions on vcDNA: vcDNA=SeqID_1025; Strand=+; Position=50-229
SWVNVSNILFLDFFINYFYSSSHSLVLVQNVGAISLLFNHYLVVLIPYRPNTQFKSDVS

SEQ ID NO: 21329 - protein, 554 aa, Diabrotica virgifera
  misc_feature: Coding regions on vcDNA: vcDNA=SeqID_1026; Strand=+; Position=53-1714
  misc_feature: Homolog annotation: Hit_ID=NP_732694.2; Match level="QueryCoverage =100%, HitCoverage=89%, E-value=0.0, Identity=65%"; Hit description =CG6375-PB, isoform B [Drosophila melanogaster] ref|NP_524446.3| CG6375-PA, isoform A [Drosophila
  misc_feature: Gene Ontology Annotation: Molecular function=molecular_function unknown; Cellular component=nuclear membrane; Biological process =nucleobase, nucleoside, nucleotide and nucleic acid metabolism
  misc_feature: Pfam annotation: Pfam_ID=DEAD; Match level="Score=234.9, E-value=1.5e- 67, Copies=1"; Pfam description=DEAD/DEAH box helicase
MSIQEKVLMKKIKKREKQKLKFVQKKESEKSKEVLETDLPEKAKVGNGLKRLQSNDEGPSKKKKKKNKKKKEKIVEEEDTDEEQPEEDEIESDIEDQEIDNGEEDTDEKSDLGNKLPGSSATLEILSKSTFDSLTDKVCENTLKAIADMGFTTMTEIQAKSIPPLLEGRDLVGAAKTGSGKTLAFLIPAVELIYKLKFMPRNGTGIIIISPTRELSMQTFGVLKELMKYHHHTYGLVMGGTARQTEAQKLSKGINILVATPGRLLDHLQNTPDFLYKNLQCLVIDEADRILEVGFEEEMKQIINLLPKRRQTMLFSATQNKKTDALTSLALKKEPVHIDVDDSKLEATVSGLEQGYVVCPSDKRLLVLFTFLKKNRKKKVMVFFSSCMSVKYHHELFNYIDLPVMCIHGKQKQTKRTTTFFQFCNAETGTLLCTDVAARGLDIPAVDWIVQYDPPDDPKEYIHRVGRTARGEGSSGHALLILRPEELGFLRYLKQAKVPLNEFEFSWSKIADIQAQLENLIGKNYFLNMSAKEAFKAYVRAYDSHHLKTIFDVS

SEQ ID NO: 21330 - protein, 429 aa, Diabrotica virgifera
  misc_feature: Coding regions on vcDNA: vcDNA=SeqID_1027; Strand=+; Position=98-1387
  misc_feature: Homolog annotation: Hit_ID=S47891; Match level="QueryCoverage=93%, HitCoverage=84%, E-value=6e-62, Identity=35%"; Hit description =exuperantia protein - fruit fly (Drosophila virilis)
MMVQKESANSGDERESSVPVVPENPAKGIPTGKYKLVGWGIDTTGRRLIDEIIQIAAFTPESQFSQYVMPFGDLNPTYSRRHGIRVVNTIRYRRLKDVNTQEFLKTKSEISALQDFLKWLETVKGNDVDGIILIYYELRKASPGMLLESLRRHNMIERFQKVVKGFANGFNIAQAKCGNTTKSFNLHIMSKVLLNRGAEHFNSAVDRARASFDIAAHLAQGEREELKGEAASKDCTGTESHLMEVVCPYVNPIDAEEEEIALFKVLLERQNTFRPVFGALLRASRTERQHASHLRRLLAENNINYDKLKIAYDSDAKDGLEKVIKSEVANAKDKDLEELLDILDHFFDPEKKAIQPKPKPSPQRYPYGRRPKFVRNKNNSQSKNPKTNSTANDNPTASDDSSPRSESEQPAQDGPEVTSPKEEKPVEAQ

SEQ ID NO: 21331 - protein, 369 aa, Diabrotica virgifera
  misc_feature: Coding regions on vcDNA: vcDNA=SeqID_1028; Strand=+; Position=167-1273
  misc_feature: Homolog annotation: Hit_ID=S47891; Match level="QueryCoverage=80%, HitCoverage=66%, E-value=1e-50, Identity=37%"; Hit description =exuperantia protein - fruit fly (Drosophila virilis)
MMVQKESANSGDERESSVPVVPENPAKGIPTGKYKLVGWGIDTTGRRLIDEIIQIAAFTPESQFSQYVMPFGDLNPTYSRRHGIRVVNTIRYRRLKDVNTQEFLKTKSEISALQDFLKWLETVKGNDVDGIILIYYELRKASPGMLLESLRRHNMIERFQKVVKGFANGFNIAQAKCGNTTKSFNLHIMSKVLLNRGAEHFNSAVDRARASFDIAAHLAQGEREELKGEAASKDCTGTESHLMEVVCPYVNPIDAEEEEIALFKVLLERQNTFRPVFGALLRASRTERQHASHLRRLLAENNINYDKLKIAYDSDAQDGLEKVLKVREQIKRMKIWKVLKNILDRFLYFFFFFPEKQKKISHPNTPKPP

SEQ ID NO: 21332 - protein, 184 aa, Diabrotica virgifera
  misc_feature: Coding regions on vcDNA: vcDNA=SeqID_1029; Strand=+; Position=127-681
  misc_feature: Homolog annotation: Hit_ID=XP_312781.1; Match level="QueryCoverage =100%, HitCoverage=91%, E-value=4e-56, Identity=57%"; Hit description= ENSANGP00000020445 [Anopheles gambiae]
  misc_feature: Gene Ontology Annotation: Molecular function=GTPase activity; Cellular component=rhabdomere; Biological process=signal transduction
  misc_feature: Pfam annotation: Pfam_ID=Ras; Match level="Score=207.1, E-value=3.5e -59, Copies=1"; Pfam description=Ras family
MTTVKITVVGDGIVGKTCLLSTYTTGHFPAEYVPTVFEHYGQKLVVDDVEYDMTLWDTAGQEDYERLRPLSYPHTNCFLVCFSVDKNLASYDNVILKWVPEVRHFSPNVPILLVATKKDLRTDPSLACYTPEEGKKLKRRVKAQGYMECSALMNEGLEEVFIEAIRVFKKSKNKKPVARHCTVL

SEQ ID NO: 21333 - protein, 317 aa, Diabrotica virgifera
  misc_feature: Coding regions on vcDNA: vcDNA=SeqID_1030; Strand=+; Position=17-966
  misc_feature: Homolog annotation: Hit_ID=XP_394363.1; Match level="QueryCoverage =99%, HitCoverage=15%, E-value=1e-117, Identity=69%"; Hit description= similar to CG12532-PA [Apis mellifera]
  misc_feature: Gene Ontology Annotation: Molecular function=protein tyrosine/serine/threonine phosphatase activity; Cellular component =integral to membrane; Biological process=protein amino acid dephosphorylation
  misc_feature: Pfam annotation: Pfam_ID=Myotub-related; Match level="Score=72.8, E -value=9.6e-19, Copies=1"; Pfam description=Myotubularin-related
  misc_feature (293)..(293): Xaa can be any naturally occurring amino acid
TPTDAKTLERLQERSYVRDWQRLGICNNGGSANNKVAEQFRITSVNYLYMVCRSYPALLVVPASVTDESIRRFCRCYRQGRIPSITWRHPRTKALLLRGAGHHGKSVMGMLKSHPTPAASTETTSSFEQEKYLSAIVCATPTFSHRSWGMSDSSLSIDSLLLAADDPLACATMTPEVARRSNAFNKTIGTLGAFPRSSGGKGPKNFGRWGSLKDRRQPSQASLAPGQSGKVNLRHSADVEAGVDGVHTLQKAALYILGEKAQMKGIKIESAPKTEFIPVEYYDIRHTKTAFKXLMRACIPSSPNAEPEHSFHRFIEK

SEQ ID NO: 21334 - protein, 341 aa, Diabrotica virgifera
  misc_feature: Coding regions on vcDNA: vcDNA=SeqID_1031; Strand=+; Position=20-1042
  misc_feature: Homolog annotation: Hit_ID=XP_312273.1; Match level="QueryCoverage =99%, HitCoverage=76%, E-value=7e-74, Identity=40%"; Hit description =ENSANGP00000021082 [Anopheles gambiae]
MMSDQRLDLLLFGASGFTGNKCIPYLYTITKENGRNLTWGISGRSEEKLRKVLETNGQKLGADLSNIPIIVTDVKDQESVKQMAKKARVVINCVGPYKYLGKPVVEACIAAGTHHVDVTAEPEFVDILSTDCHEAAKEKGVYVVTTCGMDCIPTDLGLSYLEEKFDGVLNSLTAYLEAWQEDKSSRLAVGYGTWASLVHGMKHGTQFRRLKERMFPGRKPAPFQPELRVNYFPHHAKVIDGWSLVYPAVDKQVMRKSQTYLYEHENKRPVQVETLINIKSTLHLIGISIGFFIWMCFAQCGCGRYLLLNYPRLFTTGLFSKYKWPEDKIVKQAMFQITWYG

SEQ ID NO: 21335 - protein, 100 aa, Diabrotica virgifera
  misc_feature: Coding regions on vcDNA: vcDNA=SeqID_1032; Strand=-; Position=873-1175
GFGKKNLNKEKANFQAGFLGIDQVVDVLQNLSLVKLGRTFAKRIADHKRPLTNSNPGFLHPHFTFLDNNHSFNDQCQILHIQNKGLKLLEVRDFCIPNKH

SEQ ID NO: 21336 - protein, 248 aa, Diabrotica virgifera
  misc_feature: Coding regions on vcDNA: vcDNA=SeqID_1033; Strand=+; Position=34-780
  misc_feature: Homolog annotation: Hit_ID=EAL30258.1; Match level="QueryCoverage =45%, HitCoverage=47%, E-value=6e-39, Identity=67%"; Hit description =GA19603-PA [Drosophila pseudoobscura]
  misc_feature: Gene Ontology Annotation: Cellular component=integral to membrane; Biological process=cell adhesion
  misc_feature: Pfam annotation: Pfam_ID=Ninjurin; Match level="Score=174.8, E-value =1.9e-49, Copies=1"; Pfam description=Ninjurin
MSVAYTALDQGRGASQPSDDHSANSAPMAKAEVDDIDGTTTDAINGRNNVDPVSHTTVPDISITDTNELKLNTEDHIDGLHLGDDLNNHEIDGVHHLRDFRIGTPHSSMARTGLNFDTELGSIAGETIPDINVYQHKKTLAQGMMDLALFSANANQLRYVLDSYSRHPYFWGSCICIILSLGLQVAIGIGLIWNALYDVKDEKEICVANKINNFTVIGIFLVVVVNVFISAFGVADPLPATVVAATGV

SEQ ID NO: 21337 - protein, 356 aa, Diabrotica virgifera
  misc_feature: Coding regions on vcDNA: vcDNA=SeqID_1034; Strand=+; Position=20-1087
MNFLGALCILHLIAFGSAGVISPVSEIIEGPSSKTTVVGPDGSVITAVAQGAKIVANGETAVVAGPDTAALLKSADEPAVLESNIQPIALVKSPIAVPVVASKSGILEHGQLVAHENNILVNHHIASVAAHSSPILNATPSLVSGHLQPVVVAPVVKSQPIIAHQAAIIASKTTESEHSQSIVHPPTLQKTTYVESTVPIHVPLVETNDAIVRAEPIIAGHVSPLVSAHLAPALHYNLEPVAKVAPLVHEKAALFHHLEPAIVPAIPLVETKAAVIAKEVLPVASVVGTKTTITGQEQSIIHPGTVLKSQPIVAVKSLPVLTDHIHSIPVVAQHVPVPVIGTTTLSENAQTVVSHS

SEQ ID NO: 21338 - protein, 309 aa, Diabrotica virgifera
  misc_feature: Coding regions on vcDNA: vcDNA=SeqID_1035; Strand=+; Position=143-1070
  misc_feature: Homolog annotation: Hit_ID=XP_308390.1; Match level="QueryCoverage =92%, HitCoverage=66%, E-value=4e-47, Identity=33%"; Hit description =ENSANGP00000009437 [Anopheles gambiae]
  misc_feature: Gene Ontology Annotation: Cellular component=membrane; Biological process=signal transduction
  misc_feature: Pfam annotation: Pfam_ID=Sugar_tr; Match level="Score=-95.4, E-value =0.00049, Copies=1"; Pfam description=Sugar (and other) transporter
  misc_feature (237)..(237): Xaa can be any naturally occurring amino acid
  misc_feature (306)..(306): Xaa can be any naturally occurring amino acid
MANKIEGSIFSGTLTQLLASVSGSLFAISDGMTYGWTAPMLPYLVSKESHIKTTKSEVEWLETILMVGSFCGLPTTIYLVDKIGRRKSLLLAAATSLIGWIVIALANNMIYLYITRFIFGIIGNMSFVSMPMYIAEIAESKIRGFLASIVYLQMLVGFVIVYSVGPYLPFYTTPIVAGVVLVSELLIFWWMPESPYYLLFKNKSEEARQSLQYFRPGRDVALELREITKAIDRQKNXKGRFQDIILVKSNRKAMLIMTVFNAGQHIVAISVILMNLHDILNSAGSIYMDSAHAGILFSVIMLISAXTAS

SEQ ID NO: 21339 - protein, 137 aa, Diabrotica virgifera
  misc_feature: Coding regions on vcDNA: vcDNA=SeqID_1036; Strand=-; Position=73-486
LNKKNYKIQILLPLRTDDPVTKEKRSCGSTVRLASVPKTSVNNLCTPRSHPRPAFPMYENIIWTQERTRADAWADAWSASRWYGRDNFRVPLWYAVYRRVSAIACGLQNNTIISSQKGLYTIMKGRKLFVGSIHMHR

SEQ ID NO: 21340 - protein, 142 aa, Diabrotica virgifera
  misc_feature: Coding regions on vcDNA: vcDNA=SeqID_1037; Strand=+; Position=364-792
  misc_feature: Homolog annotation: Hit_ID=EAL38601.1; Match level="QueryCoverage =97%, HitCoverage=98%, E-value=4e-15, Identity=31%"; Hit description =ENSANGP00000026529 [Anopheles gambiae str. PEST] ref|XP_551404.1| ENSANGP00000026529 [Anopheles gambiae st
MPKKNMIAKICPTCKQQVPVACKSCPCGHFFYNARRIAREFAIEADYRRRTARVRREKPNYYDALEYEKHIKKMKQRLSECDNDEEEDNRKDNGKSKKKKMKKEDEEEDEVLTKITPELQQHCQFILEQLNFKLSMVTWKPT

SEQ ID NO: 21341 - protein, 80 aa, Diabrotica virgifera
  misc_feature: Coding regions on vcDNA: vcDNA=SeqID_1038; Strand=-; Position=728-970
  misc_feature (36)..(36): Xaa can be any naturally occurring amino acid
VNPSIFGRFFHLQTHPFAALKFTLSKFSAISSTFSXKTGPLIGPMTALCSIFHSDNDCWASESFILCFHFWVDLELLVIR

SEQ ID NO: 21342 - protein, 56 aa, Diabrotica virgifera
  misc_feature: Coding regions on vcDNA: vcDNA=SeqID_1039; Strand=-; Position=300-470
KLGHSLYIKMPLFLLKSGFKIFGNILDSDTFLSKVFQLIVKTVTRHLETRQFISEY

SEQ ID NO: 21343 - protein, 80 aa, Diabrotica virgifera
  misc_feature: Coding regions on vcDNA: vcDNA=SeqID_1040; Strand=-; Position=278-520
PFSISLQHDTAASLFQFNQRVQQAPLPVSKLISLSSGGTYVGLQAGQDPPRIVGPKLMIVKAKTGVCMIILFLVLSFILL

SEQ ID NO: 21344 - protein, 229 aa, Diabrotica virgifera
  misc_feature: Coding regions on vcDNA: vcDNA=SeqID_1041; Strand=+; Position=2-691
  misc_feature: Homolog annotation: Hit_ID=XP_311545.1; Match level="QueryCoverage =89%, HitCoverage=93%, E-value=2e-45, Identity=45%"; Hit description =ENSANGP00000010247 [Anopheles gambiae]
  misc_feature: Gene Ontology Annotation: Molecular function=glutathione peroxidase activity; Cellular component=cellular_component unknown; Biological process=glutathione conjugation reaction
  misc_feature: Pfam annotation: Pfam_ID=GST_N; Match level="Score=73.5, E-value=5.7e- 19, Copies=1"; Pfam description=Glutathione S-transferase, N-terminal
VVKVVVKLKIKMAHTYKVRYFNFTARGEPIRMLLSYGEIPFEDERIAREDWPKIKPTTPLGQLPVLEIDGKQIPHSISICRYLASIVKLDGKDAKENLRIDVAVETLLDLQKLAFEYVFETDAAKKDEKNKKVKESVPLFLGKLEEHAKQNGGYTALDRLSWADIIFICIYEGLMNILGKNTFDSYPSLQKIKKNVLDVKSIRNWIKNRPETPSTMGPLKFEYDLKQEV

SEQ ID NO: 21345 - protein, 264 aa, Diabrotica virgifera
  misc_feature: Coding regions on vcDNA: vcDNA=SeqID_1042; Strand=+; Position=205-994
  misc_feature: Homolog annotation: Hit_ID=NP_476594.1; Match level="QueryCoverage =100%, HitCoverage=81%, E-value=1e-124, Identity=76%"; Hit description=CG9078-PA [Drosophila melanogaster] gb|AAF52318.1| CG9078-PA [Drosophila melanogaster]
  misc_feature: Gene Ontology Annotation: Cellular component=membrane; Biological process=meiosis
  misc_feature: Pfam annotation: Pfam_ID=FA_desaturase; Match level="Score=84.9, E -value=2.1e-22, Copies=1"; Pfam description=Fatty acid desaturase
  misc_feature (254)..(254): Xaa can be any naturally occurring amino acid
MGQHVSRTDFEWVYTEEPHASRRKQILEKYPQIKKLFGYDPNFKWVVTSMVLTQFVLLYLLKDRSWPVLILVAYCLGGVINHSLMLAIHEISHNLAFGHARPLHNKLFGFFANLPIGLPITISFKKYHLEHHRYQGDEQKDTDIPTYIEAKLFCTTFGKFIWVILQPFFYSFRPLVVYPKPPTLLEFVNLVIQLAFDALVVYFFGGRMLGYLLIGSVMAMGLHPVAGHFISEHYMFKKGYETYSYYGPFDWITXFNVGYHNEHH

SEQ ID NO: 21346 - protein, 109 aa, Diabrotica virgifera
  misc_feature: Coding regions on vcDNA: vcDNA=SeqID_1043; Strand=+; Position=1-330
  misc_feature: Homolog annotation: Hit_ID=XP_310466.1; Match level="QueryCoverage =92%, HitCoverage=11%, E-value=1e-31, Identity=63%"; Hit description =ENSANGP00000019196 [Anopheles gambiae]
  misc_feature: Gene Ontology Annotation: Molecular function=molecular_function unknown; Cellular component=integral to membrane
FPRPQHNAQATFNLGYMHEQGLGMVRDMHLAKRYYDRAAELSPDAKVPVALALIKLNVLFSFESIEEGPLHHLLDFNATVGSNWDLYLITTLTVMLAAIVYFRRPQVAV

SEQ ID NO: 21347 - protein, 310 aa, Diabrotica virgifera
  misc_feature: Coding regions on vcDNA: vcDNA=SeqID_1044; Strand=+; Position=202-1131
  misc_feature: Homolog annotation: Hit_ID=XP_321144.1; Match level="QueryCoverage =95%, HitCoverage=61%, E-value=1e-100, Identity=55%"; Hit description= ENSANGP00000020140 [Anopheles gambiae]
  misc_feature: Gene Ontology Annotation: Molecular function=protein disulfide isomerase activity; Cellular component=endoplasmic reticulum; Biological process=protein folding
  misc_feature: Pfam annotation: Pfam_ID=Thioredoxin; Match level="Score=304.2, E -value=2e-88, Copies=2"; Pfam description=Thioredoxin
  misc_feature (237)..(237): Xaa can be any naturally occurring amino acid
  misc_feature (257)..(257): Xaa can be any naturally occurring amino acid
MIQILFLGLFFQSSLALYPSSGSVVELTPSNFDKLVIKGDEVWVVEFFAPWCGHCKNLVPEYTKAANALKGIVKVGAVDVDQHKEIGGQYGIRGFPTIKIFGADKRKPEDFNGGRTAKDIVEGALKAAKAKAKANLGLGGGSQSDDSDNSHVVELTDSNFEKLVLKSDDMWLVEFFAPWCGHCKNLAPHWAKAAAELKGQVKLGALDATVHPARASLYGVQGYPTIKFFGPRAKNSXHKYDGGRTSSDIVTWALNKXYKRTFQHPEVTQLLNDKPFKKLWGDKPPCGVNVLPHTLFFKSECSYSYIKMLN

SEQ ID NO: 21348 - protein, 301 aa, Diabrotica virgifera
  misc_feature: Coding regions on vcDNA: vcDNA=SeqID_1045; Strand=+; Position=247-1150
  misc_feature: Homolog annotation: Hit_ID=NP_477331.1; Match level="QueryCoverage =98%, HitCoverage=76%, E-value=2e-52, Identity=37%"; Hit description =CG8823-PA [Drosophila melanogaster] gb|AAF54935.1| CG8823-PA [Drosophila melanogaster]
  misc_feature: Gene Ontology Annotation: Molecular function=lipase activity; Cellular component=extracellular; Biological process=digestion
  misc_feature: Pfam annotation: Pfam_ID=Abhydro_lipase; Match level="Score=59.5, E -value=9.4e-15, Copies=1"; Pfam description=ab-hydrolase associated lipase region
  misc_feature (287)..(287): Xaa can be any naturally occurring amino acid
MNTTVILLILGISTVVAYDIAQNVRSFGYTFDKFEVTTEDGYILEIHRISESPNGIKNKKRPPVLVMHGLLGCSADFIHIGPGKALPLRLSDEGYDVWLGNNRGNTYSQKHSSTTIKNASFWDFSFHEIGISDTPAVIDFILDKTGEKTLSYVAHSTGVAQFLIATSMKPEYQNKVKIAAALAPVVYLDHSTNFLLKMVTKDDYAQILAAEESAKATVILDHNSIIWDLGLGAICGMFKELCADLIFLLTGFDTDQLDRSSIIPFFSSFPAGISVKELNHVLQWKNXGLFSQYDYGMIKNK

SEQ ID NO: 21349 - protein, 189 aa, Diabrotica virgifera
  misc_feature: Coding regions on vcDNA: vcDNA=SeqID_1046; Strand=+; Position=103-674
  misc_feature: Homolog annotation: Hit_ID=XP_321844.1; Match level="QueryCoverage =100%, HitCoverage=39%, E-value=4e-68, Identity=69%"; Hit description= ENSANGP00000020325 [Anopheles gambiae]
  misc_feature: Pfam annotation: Pfam_ID=Paf1; Match level="Score=-106.6, E-value =1.2e-05, Copies=1"; Pfam description=Paf1
  misc_feature (111)..(111): Xaa can be any naturally occurring amino acid
  misc_feature (149)..(149): Xaa can be any naturally occurring amino acid
  misc_feature (159)..(159): Xaa can be any naturally occurring amino acid
  misc_feature (177)..(177): Xaa can be any naturally occurring amino acid
MAPTIQQNNQNGTANGVEKRPVKTVEKRSDLICKVKYCNTLPDIPFDLKFIAYPFEPIRFIQYNPTSLERNYKYEVLTEHDLGVSIDLINKDIYAIEPGATLDPADEKLLXEDILTPQDSKRSRHHAKSVSWLRITEYISTEQSRFPPXTMDNVESTAXIGLKNSLNTGKVYMERTXQIKALEKTFIDS

SEQ ID NO: 21350 - protein, 183 aa, Diabrotica virgifera
  misc_feature: Coding regions on vcDNA: vcDNA=SeqID_1047; Strand=+; Position=79-630
  misc_feature: Homolog annotation: Hit_ID=XP_320031.1; Match level="QueryCoverage =51%, HitCoverage=21%, E-value=1e-09, Identity=32%"; Hit description =ENSANGP00000010505 [Anopheles gambiae]
  misc_feature: Pfam annotation: Pfam_ID=RnaseH; Match level="Score=47.5, E-value =3.9e-11, Copies=1"; Pfam description=RNase H
MILNNLIPNYNIDFNTMEQIQVYFLRDPTVHKCSKIVVWYIQMQSKNIEGVGCAYWDSSNKISKTFKLNSIMSIYTAELIAIIEALKYLSNINHSKFIIYSDSKSSLSKISAINPKSKVNYIELFIINKIKELQQQGKSVKLAWVKSHCGITGNEMVDELFVGGFFHILYFICLISYEWSSNH

SEQ ID NO: 21351 - protein, 154 aa, Diabrotica virgifera
  misc_feature: Coding regions on vcDNA: vcDNA=SeqID_1048; Strand=+; Position=65-529
  misc_feature: Homolog annotation: Hit_ID=XP_416409.1; Match level="QueryCoverage =85%, HitCoverage=88%, E-value=2e-25, Identity=46%"; Hit description =PREDICTED: similar to glutathione S-transferase [Gallus gallus]
  misc_feature: Gene Ontology Annotation: Molecular function=glutathione transferase activity; Cellular component=microsome; Biological process =glutathione metabolism
  misc_feature: Pfam annotation: Pfam_ID=MAPEG; Match level="Score=98.0, E-value=2.5e- 26, Copies=1"; Pfam description=MAPEG family
MESSSGISFDKHVLRWYFVCCCFLILKMSFMSIFTAVKRVIHKAFANPEDSKQMKVDPQVNENVERVRRAHLNDLENIPLFFVAGLIYTFANPGAAGAKAIFVIYVVTRYLHTFVYTVVPLPQPARALSWSTGYIINIYMAMYSLIHFLKSSSV

SEQ ID NO: 21352 - protein, 425 aa, Diabrotica virgifera
  misc_feature: Coding regions on vcDNA: vcDNA=SeqID_1049; Strand=+; Position=139-1503
  misc_feature: Homolog annotation: Hit_ID=CAH93116.1; Match level="QueryCoverage =89%, HitCoverage=41%, E-value=1e-66, Identity=38%"; Hit description =hypothetical protein [Pongo pygmaeus]
  misc_feature: Gene Ontology Annotation: Molecular function=endopeptidase inhibitor activity; Cellular component=extracellular space
  misc_feature: Pfam annotation: Pfam_ID=VWA; Match level="Score=7.1, E-value =0.00046, Copies=1"; Pfam description=von Willebrand factor type A domain
MKYKILCFCLLALLNIKLGQCATGDVSFIIFSDNENRGHLIEKRDAEEKPPIIYEMNVNSNVSNRFATTVIESRVKNAHTTAREAVFSVILPEQAFISEFVMIIGGKSYKAYVKGKEEAKNIYDKAVSSGQSAAHVAVSARDSHRFTVSVNVEPEAKATFLLTYEELLERRNNQYELVLNINPGQLVKDLSVKVNISESRPLVFVKTPALRSGNEVSKNENKLSPSANIEKISPTNTIVTFQPDVEKQKVYGKEFGRCTLTGQFIVQYEIERDPSGGEILLKDGYFIHFFAPKDIESLPKNVYFILDTSGSMGGIKIQQLRNAMNSILDEIKPEDTLNIVEFNSETFENDMPGPLPASQPNIAKAKKLISNMAATGGTYMIGGLETALYLIKSEMERSVSTDNTRQPIVIFLTDGQPNGGLYSPR

SEQ ID NO: 21353 - protein, 117 aa, Diabrotica virgifera
  misc_feature: Coding regions on vcDNA: vcDNA=SeqID_1050; Strand=+; Position=143-496
IKKMGLKSLLFIICLGICIGLSVAEKLNSSDQQYLDDLFKDIPDGDRKRVLYHHLFLGYLKKNPQLNPTDYNLDDKDAEKLYDIFITKFKTNSLMSDPICFSNGECIDPSDSGLYPS

SEQ ID NO: 21354 - protein, 169 aa, Diabrotica virgifera
  misc_feature: Coding regions on vcDNA: vcDNA=SeqID_1051; Strand=+; Position=136-645
  misc_feature: Homolog annotation: Hit_ID=AAV34826.1; Match level="QueryCoverage =98%, HitCoverage=100%, E-value=2e-54, Identity=64%"; Hit description= ribosomal protein L14 [Bombyx mori]
  misc_feature: Gene Ontology Annotation: Molecular function=structural constituent of ribosome; Cellular component=cytosolic large ribosomal subunit (sensu Eukarya); Biological process=protein biosynthesis
  misc_feature: Pfam annotation: Pfam_ID=Ribosomal_L14e; Match level="Score=116.8, E -value=5.4e-32, Copies=1"; Pfam description=Ribosomal protein L14
MPFQRFVETGRVAVVSEGPHKGKLVSIVDVIDQTRVLVDGPNSNVPRGQLRLNELHLTKFRIRYPFSAPTRVVRKAWTDAKIDEKWNESVWAKKVAAKEKRSQLTDLDRFKLRRARSRRNHIRTATFLALRKAASRNGFLYGKKKMAKGGDKPKPSKKAKKEKPAPKKK

SEQ ID NO: 21355 - protein, 307 aa, Diabrotica virgifera
  misc_feature: Coding regions on vcDNA: vcDNA=SeqID_1052; Strand=+; Position=203-1126
  misc_feature: Homolog annotation: Hit_ID=EAL29491.1; Match level="QueryCoverage =100%, HitCoverage=100%, E-value=1e-126, Identity=71%"; Hit description=GA18418-PA [Drosophila pseudoobscura]
  misc_feature: Gene Ontology Annotation: Molecular function=molecular_function unknown; Cellular component=mitochondrial electron transport chain; Biological process=biological_process unknown
  misc_feature: Pfam annotation: Pfam_ID=Cytochrom_C1; Match level="Score=460.9, E -value=1.4e-135, Copies=1"; Pfam description=Cytochrome C1 family
  misc_feature (303)..(305): Xaa can be any naturally occurring amino acid
MAATIGRICGAGLLKPTNLSSVGQLSSYSTTKEWTRGRKALLGSLGLIAGGTGALLFALDQSVKASDLELHPPKNVWSHSGTFNSLDHASVRRGYEVYKQVCAACHSMRFIAYRNLIGVSHTEAEAKAEAEEQMIEDGPDDTGNFFKRPGKLSDYFPSPYPNEEAARAANNGSYPPDLSYIVSARHGGEDYIFALLTGYCDAPAGVVLRDGQYFNPYFPGGAISMAQALYNETIEYSDGTPATASQLAKDVAVFLKWTSEPEHDDRKKMLIKVIGIFSLLIGITYYAKKLKFSSLKSRKIEFXXXSK

SEQ ID NO: 21356 - protein, 290 aa, Diabrotica virgifera
  misc_feature: Coding regions on vcDNA: vcDNA=SeqID_1053; Strand=+; Position=240-1112
  misc_feature: Homolog annotation: Hit_ID=NP_652626.1; Match level="QueryCoverage =94%, HitCoverage=50%, E-value=8e-30, Identity=32%"; Hit description =CG18578-PA [Drosophila melanogaster] gb|AAF54591.1| CG18578-PA [Drosophila melanogaster]
MGSKVAAIFSFVLVFCSVNYVSSLKVLGLFPYGAPSHYFLGNELLKGIAEAGHDVTMITVFEEKNPPKNGKFRQLVLKEVLNVQYELFANMSNLNDEDSYAAKNPLGMMKIFNMVGLTVTEATLSHPTVQALIKSGEKFDVMILTQYAVEATKALATHFGAHLVLYNDNAATCWVNHFVGNSGLPSLNPELIFDYPQLMSFKQRLANTLYTIATYVNHNLVQYPAHAELIKKYVSKDMDLTKIQYDVALVLSNSHPSLNNPAPSVPCMKEIAGYHVQEPKHCLLILKILG

SEQ ID NO: 21357 - protein, 314 aa, Diabrotica virgifera
  misc_feature: Coding regions on vcDNA: vcDNA=SeqID_1054; Strand=+; Position=1-945
  misc_feature: Homolog annotation: Hit_ID=AAA98076.1; Match level="QueryCoverage =98%, HitCoverage=99%, E-value=2e-30, Identity=30%"; Hit description =nuclear protein
  misc_feature: Gene Ontology Annotation: Molecular function=protein tyrosine kinase activity; Cellular component=chromosome; Biological process=mRNA splicing
  misc_feature (294)..(294): Xaa can be any naturally occurring amino acid
  misc_feature (299)..(299): Xaa can be any naturally occurring amino acid
KDRKNKSEKMSSSKTNRSITPKSPKQSSRSQKNVKDNKYEKFNKYERKRSPERRRKSRSRSNGRRGRSRSIENRRSSRSIEKHRSSRSTERSKWSLPTAKKKSSSVDQRKRSRSKSQESKYKSKRPGGKQQRSRSRSKRSRHNDRSRSRSLSISTKRKLKHDNVKRSRSKSTSVSSTRKSRSPSVDKERKRKSSTDFNKKKRRDRSASVDKRKILRSKTPDKERKKSRSDSREKVRKRPKSESEDEELAEIRRRKQRYEEEYAEIARKLRLAEEEEKRRRERSLSKDRKRRNRXNSREXRRSLDRRSKRLIGVK

SEQ ID NO: 21358 - protein, 52 aa, Diabrotica virgifera
  misc_feature: Coding regions on vcDNA: vcDNA=SeqID_1055; Strand=+; Position=105-263
YDKQHNIYNNNLVTSNPHSHAFRPGDTVFQFNAARLNSDTQSLVHRYYRPLR

SEQ ID NO: 21359 - protein, 293 aa, Diabrotica virgifera
  misc_feature: Coding regions on vcDNA: vcDNA=SeqID_1056; Strand=+; Position=10-891
  misc_feature: Homolog annotation: Hit_ID=AAM13396.1; Match level="QueryCoverage =91%, HitCoverage=51%, E-value=9e-35, Identity=31%"; Hit description =nicotinic acetylcholine receptor Dalpha6 subunit variant type V [Drosophila melanogaster]
  misc_feature: Gene Ontology Annotation: Molecular function=acetylcholine receptor activity; Cellular component=nicotinic acetylcholine-gated receptor -channel complex; Biological process=synaptic transmission
  misc_feature: Pfam annotation: Pfam_ID=Neur_chan_LBD; Match level="Score=144.1, E -value=3.2e-40, Copies=1"; Pfam description=Neurotransmitter-gated ion-channel lig
  misc_feature (287)..(287): Xaa can be any naturally occurring amino acid
MLMFLATDAPDLTCPPSNSGTTYVKLKDAVLCNYDSSVRPVVNHQNSTSVSFKLILKFFDFDILSSTFKVDAWLSLFWRDQHLTWKPSDHDNIKNIYLYTYQIWTPDLSVYNLANQGEDPELISTIRCMVNYNGVVLCVPPIHMDVLCVPNLSKYPFDKQDCKLRIGSWMHKGEEIDIVAEKNVVNVDDLIPNGEWEILSHSTVKHKGVYACCPNNTYPSVDINFTIRRLAGSHAASMVIPVIVCVILTLMVLTLSPVNKERLIMSYVNILCHFTSVQYVACQLPLXEIICPL

SEQ ID NO: 21360 - protein, 380 aa, Diabrotica virgifera
  misc_feature: Coding regions on vcDNA: vcDNA=SeqID_1057; Strand=+; Position=3-1145
  misc_feature: Homolog annotation: Hit_ID=NP_611192.1; Match level="QueryCoverage =92%, HitCoverage=89%, E-value=3e-56, Identity=33%"; Hit description =CG15918-PA [Drosophila melanogaster] gb|AAF57892.1| CG15918-PA [Drosophila melanogaster]
  misc_feature: Gene Ontology Annotation: Biological process=regulation of protein activity, epigenetic
  misc_feature: Pfam annotation: Pfam_ID=Polysacc_deac_1; Match level="Score=-2.7, E -value=0.00072, Copies=1"; Pfam description=Polysaccharide deacetylase
PDASATFQCLILVLVATLAFDSAIANDVAKPCESDSCTIGNNCRCSSQVSPLGGDLTEYPQLISLTFDEAVTQHIYDNSWITLLGNIYNPDDKPISGTFFVPHEYTSYQRVNDLYNFGFEIGVHSITKDFRQNYWRYATLDTLTKEFKGQKQIISTYANIPAEAIIGVRTPQLQLAGNTSIEAYIASELAYDSSWPSLPSRRLFPYTLDYQSTEQCLLGAECPNEAFPGYWILPINDLTSPNGTECNSLATCGIEGSVDEIAKYLDDQIEGIRSKSRTPINLMINSYWFEQTDTSFDGLRKFLENTVAREAKDTFFVSQKQVLDFIKNPVKISDFKTADAPDGASCEPYTCRLKKGTEDRNMDACVPCPDEYPWINNVNV

SEQ ID NO: 21361 - protein, 234 aa, Diabrotica virgifera
  misc_feature: Coding regions on vcDNA: vcDNA=SeqID_1058; Strand=+; Position=22-723
  misc_feature: Homolog annotation: Hit_ID=CAE70527.1; Match level="QueryCoverage =89%, HitCoverage=53%, E-value=4e-10, Identity=25%"; Hit description =Hypothetical protein CBG17156 [Caenorhabditis briggsae]
HTFCLNICRKPNLLKMTKPKSNKRNFGDKGKFSQKRKQGIGKRNQKFKNNKKNKGGPNVHKNFPKKQVQDVKPDVEKNEIKNDVVQAGSFIGNPDKNPKKDPFFIIKQKVNSSDNHEKEKIIKELENKINAIESRGQLTNTATRKLRQLKKYKKLAEGGQLNSPPEKTKHGKTKTEKRRERRVAAAATKKETVALNKTKVTKSVRKKSAEPESTAEKSDDEVEGAEEDLLRAHQ

SEQ ID NO: 21362 - protein, 74 aa, Diabrotica virgifera
  misc_feature: Coding regions on vcDNA: vcDNA=SeqID_1059; Strand=+; Position=9-233
MAKLTLVLLAAVFVAVLATQEVSAGAVKGAEAPRAAGLGADCECNACSKECISESSDYIGGICYQGQCVCASLG

SEQ ID NO: 21363 - protein, 176 aa, Diabrotica virgifera
  misc_feature: Coding regions on vcDNA: vcDNA=SeqID_1060; Strand=+; Position=3-533
  misc_feature: Homolog annotation: Hit_ID=EAL31157.1; Match level="QueryCoverage =86%, HitCoverage=97%, E-value=6e-60, Identity=74%"; Hit description =GA20712-PA [Drosophila pseudoobscura]
  misc_feature: Gene Ontology Annotation: Molecular function=molecular_function unknown; Cellular component=cellular_component unknown; Biological process=biological_process unknown
  misc_feature: Pfam annotation: Pfam_ID=DUF59; Match level="Score=95.9, E-value=1.1e- 25, Copies=1"; Pfam description=Domain of unknown function DUF59
NLSKAKNKLRFKYFSITNKFCQLENQNPNVYKTTDDRTATLDEEDDTVVDEFDQREIFDLIRDINDPEHPLSLEQLHVVQENLISIDNGKNSILINFTPTIPHCSMATLIGLSIRVKLLRCLPSRFKVRVEVTPGTHNAEHQVNKQLADKERVAAALENSHLIKVINQCIASRNRG

SEQ ID NO: 21364 - protein, 36 aa, Diabrotica virgifera
  misc_feature: Coding regions on vcDNA: vcDNA=SeqID_1061; Strand=-; Position=286-396
NWIGHLARTQDGRRTRPIMEWRPINYKRSRGRSPTR

SEQ ID NO: 21365 - protein, 237 aa, Diabrotica virgifera
  misc_feature: Coding regions on vcDNA: vcDNA=SeqID_1062; Strand=+; Position=9-722
  misc_feature: Homolog annotation: Hit_ID=XP_396287.1; Match level="QueryCoverage =65%, HitCoverage=52%, E-value=4e-16, Identity=31%"; Hit description =similar to ENSANGP00000009926 [Apis mellifera]
  misc_feature: Gene Ontology Annotation: Biological process=defasciculation of motor neuron
  misc_feature: Pfam annotation: Pfam_ID=ig; Match level="Score=29.4, E-value=1.1e -05, Copies=1"; Pfam description=Immunoglobulin domain
MLQYACFICVTLLASIHCISCLEASVEVEVPISVKVGNSATLVCNLKPKNEKDHLSNVRWCKENEEFYRFSPDDTPQKTTSNIPGIVVNVEESSDKKVVLSNLQKELTGNYTCEASWTTPSTVTAKDSKEMYVMDELKGDILLEGTSPLRSTDKLFGVCVSPASQVTPKFTWLLNGEQVSSEESQPATKNNKDPNRFIAYLKWTNGVSFVDGKANLTCVVEVDGVYNAQKTVILKSF

SEQ ID NO: 21366 - protein, 436 aa, Diabrotica virgifera
  misc_feature: Coding regions on vcDNA: vcDNA=SeqID_1063; Strand=+; Position=75-1382
  misc_feature: Homolog annotation: Hit_ID=XP_394565.1; Match level="QueryCoverage =85%, HitCoverage=80%, E-value=9e-51, Identity=34%"; Hit description =similar to KIAA0117 protein [Apis mellifera]
  misc_feature: Gene Ontology Annotation: Molecular function=RNA binding; Cellular component=nucleolus; Biological process=nucleobase, nucleoside, nucleotide and nucleic acid metabolism
  misc_feature: Pfam annotation: Pfam_ID=RRM_1; Match level="Score=136.0, E-value=9e -38, Copies=2"; Pfam description=RNA recognition motif. (a.k.a. RRM, R
MEYTIGSLADLISGKNTPNKPKVVKVAVKQEIKSEEEDAPKSIKKEKKKLKPSVTVLKQEVVSSSDPVKKNQKKKKRKISNSQDDDNIPEKLVVKKKKRKSSTSQDEEQITEGSSIKKQKHKKRKTSLSTVSIEDTESLVEKTSSKTRKNKSNLNGSSLADSDDEENLDEKVSSEQNGQEKETAKKKVKVEHDPEEQERTIFVGNVPIKIKKKKIKQFFKKYGTIETLRIRGIPVADPKIPKKVAAIKNEFHPDRNSVYCYIRFTTKEEAQKALQANGSVFEEHHLRVHNCSTTEKPDESKAIFIGNLSFNAEEEQLWKLFEPCGPISSVRIIRDSYTGMGKGFAYVNFQDSDAVQLALEMENVKLGDRELRIKLSSVNTAKKNKKKDNKRNATRRKMGKERKSGQAQDTEADGKLSRKTKDAWYLITRVFQVPRL

SEQ ID NO: 21367 - protein, 395 aa, Diabrotica virgifera
  misc_feature: Coding regions on vcDNA: vcDNA=SeqID_1064; Strand=+; Position=156-1340
  misc_feature: Homolog annotation: Hit_ID=XP_393721.1; Match level="QueryCoverage =57%, HitCoverage=21%, E-value=2e-26, Identity=32%"; Hit description =similar to ENSANGP00000022416 [Apis mellifera]
MCEIQCDVLAEFSLKNIEDTFKITCITSRSFIRTKFSSKQFVSSEQSASEEDNQFDEELSKIYEDLSIQNITAKSENDQEGASCYCSASHTDNLSTDEHESLREIHNPPPPKGIQQSDSGTDLTEQLIHDVDSDWQKFWSLNGEKLIWESWIDKYSQYINPEYLPYAQKKVGENYNLLVENVADDTFVYNPKKFTFNEKELQNFSSELQQACLKPIDKCQEPSKKESNSKNHMLLRTLSGSDEKISGEISEGWNPLSPSSVDEETEAERLLTSRCCSRTSSSLRTIDSITNVTRMTVSSIDLSNSTPSSDSFSSVSSVNSSVSSEESEEDYQHQWNHLWKKHYEDQYLEHYNKFIQSVIGIVTVDPKDLRTDKTLPFRYKNFNKMSTESKSVETD

SEQ ID NO: 21368 - protein, 159 aa, Diabrotica virgifera
  misc_feature: Coding regions on vcDNA: vcDNA=SeqID_1065; Strand=+; Position=13-492
  misc_feature: Homolog annotation: Hit_ID=XP_392323.1; Match level="QueryCoverage =79%, HitCoverage=14%, E-value=4e-51, Identity=80%"; Hit description =similar to ENSANGP00000009134 [Apis mellifera]
  misc_feature: Gene Ontology Annotation: Molecular function=molecular_function unknown; Cellular component=septate junction; Biological process =dorsal closure
  misc_feature: Pfam annotation: Pfam_ID=4_1_CTD; Match level="Score=135.0, E-value =1.8e-37, Copies=1"; Pfam description=4.1 protein C-terminal domain (CTD)
MSHPPEHIPDIDNQTPATVKSPKEKKEKEKDNIPEGIVQTESIVYRGDPTIIHSTTNVPVVATEARKVNLTSDDGSYSATGEIVSSQTISSKTRTVETITYKTERDGVVETRVEQKITIQSDGDPIDHDKALAEAIQEATAMNPDMTVEKIEIQQQTTQ

SEQ ID NO: 21369 - protein, 159 aa, Diabrotica virgifera
  misc_feature: Coding regions on vcDNA: vcDNA=SeqID_1066; Strand=+; Position=523-1002
  misc_feature: Homolog annotation: Hit_ID=AAV34832.1; Match level="QueryCoverage =100%, HitCoverage=100%, E-value=1e-69, Identity=79%"; Hit description=ribosomal protein L21 [Bombyx mori]
  misc_feature: Gene Ontology Annotation: Molecular function=structural constituent of ribosome; Cellular component=cytosolic large ribosomal subunit (sensu Eukarya); Biological process=protein biosynthesis
  misc_feature: Pfam annotation: Pfam_ID=Ribosomal_L21e; Match level="Score=212.4, E -value=8.8e-61, Copies=1"; Pfam description=Ribosomal protein L21e
MTNSKGYRRGTRDLFARKFKKRGVIPLSTYLRVYKVGDIVDIKGNGAVQKGMPHKVYHGKTGRVFNVTAHALGVIVNKRVRGRIIPKRINLRIEHVNHSKCRQDFLQRVKSNEKLRKEAKEKNVKVELRRQPAQPRPAHIVSGKVPAQVLAPIPYEFIA

SEQ ID NO: 21370 - protein, 159 aa, Diabrotica virgifera; identical to SEQ ID NO: 21369
  misc_feature: Coding regions on vcDNA: vcDNA=SeqID_1067; Strand=+; Position=77-556
  misc_feature: Homolog annotation: Hit_ID=AAV34832.1; Match level="QueryCoverage =100%, HitCoverage=100%, E-value=1e-69, Identity=79%"; Hit description=ribosomal protein L21 [Bombyx mori]
  misc_feature: Gene Ontology Annotation: Molecular function=structural constituent of ribosome; Cellular component=cytosolic large ribosomal subunit (sensu Eukarya); Biological process=protein biosynthesis
  misc_feature: Pfam annotation: Pfam_ID=Ribosomal_L21e; Match level="Score=212.4, E -value=8.8e-61, Copies=1"; Pfam description=Ribosomal protein L21e

SEQ ID NO: 21371 - protein, 627 aa, Diabrotica virgifera
  misc_feature: Coding regions on vcDNA: vcDNA=SeqID_1068; Strand=-; Position=57-1940
  misc_feature: Homolog annotation: Hit_ID=XP_418617.1; Match level="QueryCoverage =83%, HitCoverage=78%, E-value=6e-23, Identity=23%"; Hit description =PREDICTED: similar to Macrophage mannose receptor precursor (MMR) (CD206 antigen) [Gallus gallus]
  misc_feature: Gene Ontology Annotation: Molecular function=receptor activity; Cellular component=integral to plasma membrane; Biological process =pinocytosis
  misc_feature: Pfam annotation: Pfam_ID=Lectin_C; Match level="Score=200.3, E-value =4e-57, Copies=3"; Pfam description=Lectin C-type domain
YNIEKNNLLTPIFVKMLSRGVLLLIFAVAVYAQGAPAQKGWLKGWASVPNVPLVKHGNKSYFLGVNYKANFQEALQFCDVLYMKLLTIESQEENDAIKKMILDNKASGTEYWTSAANFLDNRNFVWMSTGKTVEYTRWNNGEPSYNGEKCVQLLENNNEILWNDRDCNTQLNFICQRENHEAVPAAASVVASPAAVAKPSYSPNINMLNFNGKNYYFSRDFTGRFTQAAFYCRMLHMSLVTIESEEENKAIEKYVRDNNLGSRWWTAGTRLLDDTWTWFTNGQPIEYTRWDKNQPDNVNEKCINLQHTNENGLFWNDLTCTDQLPFICEKVTNEHLGRVKRDVDEEEVDPDADEFVNAIYAAIVDEDNEEKIQTSTAATNEGEDEELEPASDEDWQAAIEETPPGFLTYTYNAGKKYHIETEMLGTQKQAQVFCEYHGLQLLAIENEQETESTKKVLEDVGEDGPFWISGRRPLSDWRWLRINRPIIYQKLEPNETLFVDDRTCMTILLSGIWRLEKCGKVRPFICENQESAVPGGTVPADDVVGTVGKVKDETEVTPPAAPVYKKNCLVKPIVNVYINNNLVSSGVSVAPGADEGHKNQGTYSVNINNSLKPCAQKIKKLKSKLYK

SEQ ID NO: 21372 - protein, 99 aa, Diabrotica virgifera
  misc_feature: Coding regions on vcDNA: vcDNA=SeqID_1069; Strand=-; Position=282-581
EFSIGSLQHAVIFQSIRGEVPNAYTECYSVRNSIYGMLNIRRPKKTLSLESVKRRLIKTLVNVLSNKNKTIIIVFGTLSGAKLIYGMSNIRRLKRTTFY

SEQ ID NO: 21373 - protein, 380 aa, Diabrotica virgifera
  misc_feature: Coding regions on vcDNA: vcDNA=SeqID_1070; Strand=+; Position=17-1159
  misc_feature: Pfam annotation: Pfam_ID=LEA_4; Match level="Score=24.3, E-value =0.00038, Copies=1"; Pfam description=Late embryogenesis abundant protein
MKNKMKILILSCLVATCLAKPGLFGDDGALKKAAERLHEANQKFAADTSNAFQNARENIKNNNERIASQTAEALEKAKEDLKNTGENISRKTNAAVEQAKENLRKAGEDIHNAGEKFAENTDKALQKAGQDIHETGERIKDKAVKIAKGEEPIVDVKVNSKVKVLDNEVGVQGQLTIGGHRTGFHGSANANILGQKANIHADVLNAHRNPNDTHHQHQNAINKLKELINKAKNQNAEVNGQQFIENQYPNGGQNVYYLPQEQNYPQYPAVYQPNVVNSVQNGQQNYQQYPGIYQPNVINDVQNVANGGGSPVYIPAGNVQDLTDYNRYGSPGSPAVYAGNEGRYVRGAEFWQLEDDYENNPKYRVAVEDGDYSGLIDVRY

SEQ ID NO: 21374 - protein, 75 aa, Diabrotica virgifera
  misc_feature: Coding regions on vcDNA: vcDNA=SeqID_1071; Strand=-; Position=1280 -1507
FAILSTISSSAACCKLLFLYYTLPKFHKHWYSPYYSSTSFKVSSSVNFIFTIYTKHNSSQNDSAPMYSPTYSILP

SEQ ID NO: 21375 - protein, 382 aa, Diabrotica virgifera
  misc_feature: Coding regions on vcDNA: vcDNA=SeqID_1072; Strand=+; Position=153-1298
  misc_feature: Homolog annotation: Hit_ID=AAT38512.1; Match level="QueryCoverage =96%, HitCoverage=73%, E-value=5e-79, Identity=40%"; Hit description =pheromone-degrading enzyme [Phyllopertha diversa]
  misc_feature: Gene Ontology Annotation: Molecular function=monooxygenase activity; Cellular component=extracellular space; Biological process =leukotriene metabolism
  misc_feature: Pfam annotation: Pfam_ID=p450; Match level="Score=77.0, E-value=5.2e -20, Copies=1"; Pfam description=Cytochrome P450
  misc_feature (375)..(375): Xaa can be any naturally occurring amino acid
MAVVLALFVGAIVAAISYWWMGIYRIRSKLHWIPEIPRLPLIGNALELKKTTEILGKFEDYLSKHNGLCTIELATYKFIVTSDPTFLEFLLGKTDILNKSDEYQFLGNWLGKGLLTAAAPKWKRSRKMLTPSFHFSILDVFVDTFDSNAAILVDLLDKETNKDSFDIFPYVKNCTMDVICETSMGVSIHAQKNPKSDYVRAVAELCRLLILRTYSPLKTFDFFYRLTSDYKLEMEQVKILHSHTMQVITSRKEELKKKHKDDQKEETDDVGIKKRKAFLDLLLETTIDGRPLTDTEIREEVDTFLFAGHDTTAAAISFCLYCLSVNKDVQDKIAREQKQIFGENKNRNETIRDIQEMKYLELALKESLRMYPPVXLCGRKPT

SEQ ID NO: 21376 - protein, 305 aa, Diabrotica virgifera
  misc_feature: Coding regions on vcDNA: vcDNA=SeqID_1073; Strand=+; Position=74-987
  misc_feature: Homolog annotation: Hit_ID=XP_392229.1; Match level="QueryCoverage =82%, HitCoverage=30%, E-value=3e-84, Identity=63%"; Hit description =similar to CG4276-PA [Apis mellifera]
  misc_feature (278)..(278): Xaa can be any naturally occurring amino acid
  misc_feature (282)..(282): Xaa can be any naturally occurring amino acid
  misc_feature (285)..(285): Xaa can be any naturally occurring amino acid
MKSCYNMIIDKLSLGKRTEDPVIMAYRNGYSGDDRELDREDRMTEGVGKPVHVIEHLATFTVNKETGIIYPADGMRRLLQLEKSNGIWSQKMQLCLDNNWVLIMDYETGSVMERFPASSIQEPSAFMSQDPMDMYNNILVFIVTNSNQSHPTEMHIFQCQSISAQDLVEDLKELRMGKAPTRSRKSSIPPPSHKPPQNVISPSRDVTRDYYGSDSELTANNDDSSSTTSEKYERDVTILNHCFDDIEKFIARLQHAAAAARELERRRKTRKTKKRDMXDGMXTMXTKHPRKGVVEIFRKLISFTF

SEQ ID NO: 21377 - protein, 366 aa, Diabrotica virgifera
  misc_feature: Coding regions on vcDNA: vcDNA=SeqID_1074; Strand=+; Position=317-1417
  misc_feature: Homolog annotation: Hit_ID=XP_395844.1; Match level="QueryCoverage =99%, HitCoverage=60%, E-value=4e-64, Identity=41%"; Hit description =similar to CG6613-PA [Apis mellifera]
  misc_feature: Pfam annotation: Pfam_ID=RUN; Match level="Score=108.7, E-value=1.5e -29, Copies=1"; Pfam description=RUN domain
MNKLLKSVRLTNNKDDLIKKSITRQLSDSCKEIHYAGVEENKSPNFSEFSTTEAATTLCTAIEAIFLHGLRDTLIHKFKKALADVDEQSEPSFWAPLLIISHRQIIEQITNLSQITTEVGQCRVWIRLALNDCLLSSYLMSIRQDSSSLKSYYKVNAYVRDGELLDVAQRLIEGVEAFKSFTLPFNSSLLNTWPLPSLILSGIWSPTLKSCPVAPCDDVAQSISITESMKTQSNFENSSDTASICSVMSYNSQSSGLRQIVSLSEDEVLKIILAKDKDQTSNSQSYDDLRSVSGSDHDRNSDSNNINYTVGNSLSKRTGWSFDETQLPESTEPQETNDESEEKLVKEEPKSMETSFNALIESYNMP

SEQ ID NO: 21378 - protein, 148 aa, Diabrotica virgifera
  misc_feature: Coding regions on vcDNA: vcDNA=SeqID_1075; Strand=+; Position=2-448
EGGTPAWTGAGFLSFDFKMKLILFGIVVLLYFIYCTEEGSALNCYQCQAKVGNGSDCESGKSDSNTTCQSSPDSNETLACFSIVVNGFFIRGCDKTTLCNDEPPPGYDIKWCKSCTTDLCNTHTSSSSIITPALFTPIIIFTAVLSYF

SEQ ID NO: 21379 - protein, 371 aa, Diabrotica virgifera
  misc_feature: Coding regions on vcDNA: vcDNA=SeqID_1076; Strand=+; Position=63-1175
  misc_feature: Homolog annotation: Hit_ID=XP_318845.1; Match level="QueryCoverage =64%, HitCoverage=78%, E-value=2e-32, Identity=42%"; Hit description =ENSANGP00000014460 [Anopheles gambiae]
  misc_feature: Gene Ontology Annotation: Molecular function=structural constituent of muscle; Cellular component=sarcomere; Biological process=striated muscle contraction
MDTIWALKLKIKLKVFNTLQIYIMKVLVCALFLSVLVYGEETKKSDKRGVPEGNVVSLDSLGSGINLRSLGSPLSLSPYVGSPSLGLPLNLRSVSGYSPSIYGSPLSAHSVGHSVGSPSLGLPLNLRSLSGYSPSIYGSPLSAHSVGVQGLDLRSLASVLNVGPSTHTVNTITKHFPFAVPQPYAVPVDRQVPVPVPHPVPVAVDRPYEVKVPQPYPVTVDKHVPYTVERPVPVEVKVPVRVEVPVPVKVGVPQPYTVEVPKPVAVPVPSPVVVKEHVPVPSPVVVKEQVPVPSPVVVKEQVPVPSPVVVNEHVPVTQPIYVKKGNVPPPYLFEKHVPGESPGSFFNIKRGAPSNPHIIFFKKKKLCFFFF

SEQ ID NO: 21380 - protein, 445 aa, Diabrotica virgifera
  misc_feature: Coding regions on vcDNA: vcDNA=SeqID_1077; Strand=+; Position=140-1478
  misc_feature: Homolog annotation: Hit_ID=XP_316417.1; Match level="QueryCoverage =95%, HitCoverage=90%, E-value=1e-162, Identity=67%"; Hit description= ENSANGP00000021015 [Anopheles gambiae]
  misc_feature: Gene Ontology Annotation: Molecular function=dolichyl-diphospho -oligosaccharide-protein glycosyltransferase activity; Cellular component=endoplasmic reticulum; Biological process=protein modification
  misc_feature: Pfam annotation: Pfam_ID=DDOST_48kD; Match level="Score=769.3, E -value=2.1e-228, Copies=1"; Pfam description=Dolichyl -diphosphooligosaccharide-pro
  misc_feature (425)..(425): Xaa can be any naturally occurring amino acid
MVDRCEKYSFSKMNLFLILFSAIVVCNAQGPTLVLLDNQVIKETHSIFFRSLQERGYTLTFKIADDSSLLLSKYGEYLYKNLIIFAPSVEEFGGNLNVETITQFVDDGGNVLVTGSSTTGDVLRELASEFGFEVDEDGAFVIDHLNYDVTDEGQHTKLVVSSENLIDAPVIVGPKRGVAPLLYQGTGILVDSENPLVLPLLTADSTAYSFNPNQQIKEYPHAVGRDAVLIAGLQARNNARVVFCGSLAFFSDEFFTSSPSKAQVQESSPKSGNEDVATAVSQWVFKEHGQLRVRSVKHHKAGQKEAPQDYTIMDNVVYTIEIDILEKGQWKPFTANDIQLEFVRIDPFVRTTLERKPSGQYEARFRIPDVYGVYQFKVDYDRVGYTRLFSTTQVSVRPLQHTQYERFITSAYPYYTGAFSMMVGXFVFSFVFLHLKDDEKKSKSE

SEQ ID NO: 21381 - protein, 260 aa, Diabrotica virgifera
  misc_feature: Coding regions on vcDNA: vcDNA=SeqID_1078; Strand=+; Position=2-781
AANLTNKSSFFLKRYATNRTSKYIPSEPSTSGYNSLERNKFNESENIQPLQSTGSLNRFGTLRKAASLNKTEPTIVQNSDTSRFSTPPRVIKPRSQQEVQNIANRNSAAKESTSFNRFSTPNRSIKTKSPVETESFGSRTLEAQEYSTTKGKSPNKFLKSREAENLNKSLERGSTGNSNKSSKSSKNSSSSSKSVGAIKTKQSAESKELLSRPRTFSETANSPSAEPKKKLTNSNSFRSFLKPSALTKEKVPEPPVRPER

SEQ ID NO: 21382 - protein, 149 aa, Diabrotica virgifera
  misc_feature: Coding regions on vcDNA: vcDNA=SeqID_1079; Strand=+; Position=122-571
  misc_feature: Homolog annotation: Hit_ID=AAK92162.1; Match level="QueryCoverage =100%, HitCoverage=100%, E-value=1e-68, Identity=87%"; Hit description=ribosomal protein L26 [Spodoptera frugiperda]
  misc_feature: Gene Ontology Annotation: Molecular function=structural constituent of ribosome; Cellular component=cytosolic ribosome (sensu Eukarya); Biological process=protein biosynthesis
  misc_feature: Pfam annotation: Pfam_ID=KOW; Match level="Score=34.2, E-value=3.8e -07, Copies=1"; Pfam description=KOW motif
MKFNKLVTASRSKNRKRHFTAPSHIRRTLMSAPLSKELRQKYNVSTMPIRKDDEVQVVRGHYKGQQVGKVVQVYRKKFVIYIERIQREKANGASVYVGIHPSKVVIVKLKMDKDRKKIIDRRAKGRLAALGKDKGKYTEESAASAVETS

SEQ ID NO: 21383 - protein, 234 aa, Diabrotica virgifera
  misc_feature: Coding regions on vcDNA: vcDNA=SeqID_1080; Strand=+; Position=117-818
  misc_feature: Homolog annotation: Hit_ID=XP_396089.1; Match level="QueryCoverage =78%, HitCoverage=15%, E-value=3e-57, Identity=54%"; Hit description =similar to CG5020-PB [Apis mellifera]
  misc_feature: Gene Ontology Annotation: Molecular function=actin binding; Cellular component=cell cortex; Biological process=cellularization
  misc_feature: Pfam annotation: Pfam_ID=CAP_GLY; Match level="Score=165.2, E-value =1.5e-46, Copies=2"; Pfam description=CAP-Gly domain
MNYDSSDESIRIITGGVRRHRITDGSTASSLDALWDLHPNALYEAGLSRHKDSSTILTEDTDSFIIGQKVWVSGTKPGHIAFIGETQFAPGEWAGIALEEPIGKNDGSVNGIRYFQCEPKKGVFSRLTRLTKEPLEGVSYATTPSPENVIRNSISPTGSTHGLLKSPVSVCGSNLSLISSASHVIDFKIGDRVIIKSSQGSKVGTVRYMGITEFAAGEWVGVELDDPKGKNDGS

SEQ ID NO: 21384 - protein, 233 aa, Diabrotica virgifera
  misc_feature: Coding regions on vcDNA: vcDNA=SeqID_1081; Strand=+; Position=101-803
  misc_feature: Homolog annotation: Hit_ID=XP_396089.1; Match level="QueryCoverage =89%, HitCoverage=15%, E-value=4e-68, Identity=55%"; Hit description =similar to CG5020-PB [Apis mellifera]
  misc_feature: Gene Ontology Annotation: Molecular function=actin binding; Cellular component=cell cortex; Biological process=cellularization
  misc_feature: Pfam annotation: Pfam_ID=CAP_GLY; Match level="Score=241.9, E-value =1.2e-69, Copies=2"; Pfam description=CAP-Gly domain
  misc_feature (192)..(192): Xaa can be any naturally occurring amino acid
MNYDSSDESIRIITGGVRRHRITDSSTILTEDTDSFIIGQKVWVSGTKPGHIAFIGETQFAPGEWAGIALEEPIGKNDGSVNGIRYFQCEPKKGVFSRLTRLTKEPLEGVSYATTPSPENVIRNSISPTGSTHGLLKSPVSVCGSNLSLISSASHVIDFKIGDRVIIKSSQGSKVGTVRYMGITEFAAGEWXVELDDPRGKNDGSVNGKRYFECRPNFGLFAPITKVSKSPSK

SEQ ID NO: 21385 - protein, 210 aa, Diabrotica virgifera
  misc_feature: Coding regions on vcDNA: vcDNA=SeqID_1082; Strand=+; Position=66-698
  misc_feature: Homolog annotation: Hit_ID=EAA10684.3; Match level="QueryCoverage =99%, HitCoverage=98%, E-value=9e-92, Identity=84%"; Hit description =ENSANGP00000020935 [Anopheles gambiae str. PEST] ref|XP_557384.1| ENSANGP00000020935 [Anopheles gambiae st
  misc_feature: Gene Ontology Annotation: Molecular function=actin binding; Cellular component=troponin complex; Biological process=muscle development
  misc_feature: Pfam annotation: Pfam_ID=Troponin; Match level="Score=140.5, E-value =3.9e-39, Copies=1"; Pfam description=Troponin
MADDERKKLEEEKKRKQAEIERKRAEVRARMEEASKAKKAKKGFMTPERKKKLRLLLRKKAAEELKKEQERKAAERRRIIEERCGKPKLVDDANEAELQTVCRGYHEKIAKLEGDKYDLEVIERIKAQEISELNSQVNDLRGKFVKPTLKKVSKYENKFAKLQKKAAEFNFRNQLKVVKKKEFTLEEEDKEKKPDWSKKGDEKKVQEAEA

SEQ ID NO: 21386 - protein, 198 aa, Diabrotica virgifera
  misc_feature: Coding regions on vcDNA: vcDNA=SeqID_1083; Strand=+; Position=56-653
  misc_feature: Homolog annotation: Hit_ID=XP_315307.1; Match level="QueryCoverage =99%, HitCoverage=100%, E-value=5e-87, Identity=83%"; Hit description= ENSANGP00000020935 [Anopheles gambiae] gb|EAA44287.2| ENSANGP00000024659 [Anopheles gambiae
  misc_feature: Gene Ontology Annotation: Molecular function=actin binding; Cellular component=troponin complex; Biological process=muscle development
  misc_feature: Pfam annotation: Pfam_ID=Troponin; Match level="Score=129.1, E-value =1.1e-35, Copies=1"; Pfam description=Troponin
  misc_feature (83)..(83): Xaa can be any naturally occurring amino acid
MADDEEKKRKQAEIERKRAEVRARMEEASKAKKAKKGFMTPERKKKLRLLLRKKAAEELKKEQERKAAERRRIIEERCGKPKXVDDANEGSLKQVCEGYHRRIVDLENKKFDLEKEVEFRDFQISELNSQVNDLRGKFVKPTLKKVSKYENKFAKLQKKAAEFNFRNQLKVVKKKEFTLEEEDKETKKADKAEWQTKK

SEQ ID NO: 21387 - protein, 143 aa, Diabrotica virgifera
  misc_feature: Coding regions on vcDNA: vcDNA=SeqID_1084; Strand=+; Position=109-540
  misc_feature: Homolog annotation: Hit_ID=CAH04342.1; Match level="QueryCoverage =100%, HitCoverage=100%, E-value=5e-79, Identity=100%"; Hit description=S23e ribosomal protein [Carabus granulatus]
  misc_feature: Gene Ontology Annotation: Cellular component=cytosolic ribosome (sensu Eukarya); Biological process=protein biosynthesis
  misc_feature: Pfam annotation: Pfam_ID=Ribosomal_S12; Match level="Score=258.7, E -value=1e-74, Copies=1"; Pfam description=Ribosomal protein S12
MGKPRGLRTARKHVNHRREQRWADKDYKKAHLGTRWKANPFGGASHAKGIVLEKVGVEAKQPNSAIRKCVRVQLIKNGKKITAFVPRDGCLNHIEENDEVLVAGFGRKGHAVGDIPGVRFKVVKVANVSLLALYKEKKERPRS

SEQ ID NO: 21388 - protein, 204 aa, Diabrotica virgifera
  misc_feature: Coding regions on vcDNA: vcDNA=SeqID_1085; Strand=+; Position=69-683
  misc_feature: Homolog annotation: Hit_ID=XP_315307.1; Match level="QueryCoverage =99%, HitCoverage=100%, E-value=8e-85, Identity=80%"; Hit description= ENSANGP00000020935 [Anopheles gambiae] gb|EAA44287.2| ENSANGP00000024659 [Anopheles gambiae
  misc_feature: Gene Ontology Annotation: Molecular function=actin binding; Cellular component=troponin complex; Biological process=muscle development
  misc_feature: Pfam annotation: Pfam_ID=Troponin; Match level="Score=126.6, E-value =5.9e-35, Copies=1"; Pfam description=Troponin
MADDERKKLEEEKKRKQAEIERKRAEVRARMEEASKAKKAKKGFMTPERKKKLRLLLRKKAAEELKKEQERKAAERRRIIEERCGKPKLVDDANEGSLKQVCEGYHRRIVDLENKKFDLEKEVEFRDFQISELNSQVNDLRGKFVKPTLKKVSKYENKFAKLQKKAAEFNFRNQLKVVKKKEFTLEEEDKETKKADKAEWQTKK

SEQ ID NO: 21389 - protein, 204 aa, Diabrotica virgifera
  misc_feature: Coding regions on vcDNA: vcDNA=SeqID_1086; Strand=+; Position=678-1292
  misc_feature: Homolog annotation: Hit_ID=EAA10684.3; Match level="QueryCoverage =99%, HitCoverage=98%, E-value=4e-90, Identity=83%"; Hit description =ENSANGP00000020935 [Anopheles gambiae str. PEST] ref|XP_557384.1| ENSANGP00000020935 [Anopheles gambiae st
  misc_feature: Gene Ontology Annotation: Molecular function=actin binding; Cellular component=troponin complex; Biological process=muscle development
  misc_feature: Pfam annotation: Pfam_ID=Troponin; Match level="Score=126.6, E-value =5.9e-35, Copies=1"; Pfam description=Troponin
MADDEEKKRKQAEIERKRAEVRARMEEASKAKKAKKGFMTPERKKKLRLLLRKKAAEELKKEQERKAAERRRIIEERCGKPKLVDDANEGSLKQVCEGYHRRIVDLENKKFDLEKEVEFRDFQISELNSQVNDLRGKFVKPTLKKVSKYENKFAKLQKKAAEFNFRNQLKVVKKKEFTLEEEDKEKKPDWSKKGDEKKVQEAEA

SEQ ID NO: 21390 - protein, 210 aa, Diabrotica virgifera
  misc_feature: Coding regions on vcDNA: vcDNA=SeqID_1087; Strand=+; Position=508-1140
  misc_feature: Homolog annotation: Hit_ID=EAA10684.3; Match level="QueryCoverage =99%, HitCoverage=98%, E-value=4e-88, Identity=80%"; Hit description =ENSANGP00000020935 [Anopheles gambiae str. PEST] ref|XP_557384.1| ENSANGP00000020935 [Anopheles gambiae st
  misc_feature: Gene Ontology Annotation: Molecular function=actin binding; Cellular component=troponin complex; Biological process=muscle development
  misc_feature: Pfam annotation: Pfam_ID=Troponin; Match level="Score=126.6, E-value =5.9e-35, Copies=1"; Pfam description=Troponin
MADDERKKLEEEKKRKQAEIERKRAEVRARMEEASKAKKAKKGFMTPERKKKLRLLLRKKAAEELKKEQERKAAERRRIIEERCGKPKLVDDANEGSLKQVCEGYHRRIVDLENKKFDLEKEVEFRDFQISELNSQVNDLRGKFVKPTLKKVSKYENKFAKLQKKAAEFNFRNQLKVVKKKEFTLEEEDKEKKPDWSKKGDEKKVQEAEA

SEQ ID NO: 21391 - protein, 81 aa, Diabrotica virgifera
  misc_feature: Coding regions on vcDNA: vcDNA=SeqID_1088; Strand=+; Position=501-746
  misc_feature: Homolog annotation: Hit_ID=XP_315306.1; Match level="QueryCoverage =97%, HitCoverage=30%, E-value=3e-35, Identity=92%"; Hit description =ENSANGP00000024316 [Anopheles gambiae]
  misc_feature: Gene Ontology Annotation: Molecular function=actin binding; Cellular component=troponin complex; Biological process=muscle development
ISELNSQVNDLRGKFVKPTLKKVSKYENKFAKLQKKAAEFNFRNQLKVVKKKEFTLEEEDKEKKPDWSKKGDEKKVQEAEA

SEQ ID NO: 21392 - protein, 159 aa, Diabrotica virgifera
  misc_feature: Coding regions on vcDNA: vcDNA=SeqID_1089; Strand=+; Position=40-519
  misc_feature: Homolog annotation: Hit_ID=CAH04342.1; Match level="QueryCoverage =89%, HitCoverage=100%, E-value=4e-78, Identity=99%"; Hit description= S23e ribosomal protein [Carabus granulatus]
  misc_feature: Gene Ontology Annotation: Cellular component=cytosolic ribosome (sensu Eukarya); Biological process=protein biosynthesis
  misc_feature: Pfam annotation: Pfam_ID=Ribosomal_S12; Match level="Score=258.0, E -value=1.6e-74, Copies=1"; Pfam description=Ribosomal protein S12
MGKPRGLRTARKHVNHRREQRWADKDYKKAHLGTRWKANPFGGASHAKGIVLEKVGVEAKQPNSAIRKCVRVQLIKNGKKITAFVPRDGCLNHIEENDEVLVAGFGRKGHAVGDIPGVRFKVVKVANVSLLALYKEKKERPPSINLLFLINKILLKFNF

SEQ ID NO: 21393 - protein, 122 aa, Diabrotica virgifera
  misc_feature: Coding regions on vcDNA: vcDNA=SeqID_1090; Strand=+; Position=50-418
  misc_feature: Homolog annotation: Hit_ID=NP_476969.1; Match level="QueryCoverage =100%, HitCoverage=98%, E-value=6e-61, Identity=90%"; Hit description= CG8210-PA [Drosophila melanogaster] gb|AAF58115.1| CG8210-PA [Drosophila melanogaster]
  misc_feature: Gene Ontology Annotation: Molecular function=hydrogen-transporting ATPase activity, rotational mechanism; Cellular component=hydrogen -transporting ATPase V1 domain; Biological process=hydrogen transport
  misc_feature: Pfam annotation: Pfam_ID=ATP-synt_F; Match level="Score=195.3, E -value=1.2e-55, Copies=1"; Pfam description=ATP synthase (F/14-kDa) subunit
MALHAAIKGKLISVIGDEDTCVGFLLGGVGEMNKNRHPNFLVVDKNTAVSEIEDCFKRFLKRDDIDIILINQNIAEIIRHVIDSHNSPIPAVLEIPSKDHPYDASKDSILRRARGMFNPDEL

SEQ ID NO: 21394 - protein, 432 aa, Diabrotica virgifera
  misc_feature: Coding regions on vcDNA: vcDNA=SeqID_1091; Strand=+; Position=119-1417
  misc_feature: Homolog annotation: Hit_ID=XP_395028.1; Match level="QueryCoverage =87%, HitCoverage=97%, E-value=1e-174, Identity=79%"; Hit description= similar to ENSANGP00000009978 [Apis mellifera]
  misc_feature: Gene Ontology Annotation: Biological process=regulation of protein activity, epigenetic
MQLKEYLYKCGIEDDSDDDELGAMKDLTINDYINTSVNTKQQNDLESQQRLAVLSFEQVNRLNEVMDEVVFIHGRGNFPTLEIRLKDLVNVVREKLEADTSAGGAGMKVKDIRLNGGAASHVLATESQPYNDLDLIFGVELSSMRNFDRVKSAVLSSLYEMLPEGVNRKRISTCSLKEAYVSKMVKVNQNIGGDRWSLISLGNSRGRGVELKFVDCMRRQFEFSVDSFQIILDSLLLFYKCSELPISENFYPTVVGESVYGDFQEALYHLQKKLISTRHPEEIRGGGLLKYCNLLVKNYKPARPDYIKSLQRYMCSRFFIDFPDISQQRGKLENYLWNHFVEPDEEALRHQYLMLLHDVVEESTVCLMGHERRQTLQLIKNLAWQVLYQDQQRMMTQQPPPLVYANGIVYAPIIQTNCYCTCNTTWMPQCCS

SEQ ID NO: 21395 - protein, 63 aa, Diabrotica virgifera
  misc_feature: Coding regions on vcDNA: vcDNA=SeqID_1092; Strand=-; Position=257-448
KNVHFSQKNNLHIFYTSLYVCSINLNVYDVFQETADFSKLFYTQVITAPISIQLERFECTSTS

SEQ ID NO: 21396 - protein, 143 aa, Diabrotica virgifera
  misc_feature: Coding regions on vcDNA: vcDNA=SeqID_1093; Strand=-; Position=106-537
  misc_feature: Homolog annotation: Hit_ID=AAC60281.1; Match level="QueryCoverage =93%, HitCoverage=13%, E-value=6e-19, Identity=40%"; Hit description =unknown [Gallus gallus]
  misc_feature (23)..(23): Xaa can be any naturally occurring amino acid
  misc_feature (84)..(84): Xaa can be any naturally occurring amino acid
MFYVSDLLKRLIPAWSPHLPRDXNLLEGVQRRATKLPFNYARLSYETRLRKLKLSPLTHRRERDELISTYIILKGDFGEHRIFXYQQDARLRGHLYKLKKEPFKTTVRQNFLVNRVFDQWNSLSDDIVGAISLNSFKNRFDEN

SEQ ID NO: 21397 - protein, 360 aa, Diabrotica virgifera
  misc_feature: Coding regions on vcDNA: vcDNA=SeqID_1094; Strand=+; Position=1-1083
  misc_feature: Homolog annotation: Hit_ID=AAT38514.1; Match level="QueryCoverage =98%, HitCoverage=70%, E-value=1e-68, Identity=36%"; Hit description =antennae-rich cytochrome P450 [Phyllopertha diversa]
  misc_feature: Gene Ontology Annotation: Molecular function=cytochrome P450 activity; Cellular component=extracellular space; Biological process= steroid metabolism
  misc_feature: Pfam annotation: Pfam_ID=p450; Match level="Score=80.9, E-value=3.4e -21, Copies=1"; Pfam description=Cytochrome P450
VLTQNFLFFQTMPKWKENRTKFTPCFSPSKLKGMFPFISDIGEELDRYIADSPEIIDVSDLSGKYFIEVIARCMFGIKANSLKSKDAGFIKMYKGMFSFTYRNLLSQSAHFFFGELAEIFQLNFLEKSITDYLSDALYTVIKERKAHDGKAQDLIDIIIDMSKMEGKENLSQEEIEQLIANAMSFLVAGGETSTSTASNVFYEFAINQDIQEKARKEVLRCMEEDGGITYEAMLKTDYLEMCFYEAMRKYPAVPHFCRKSATDYKIRNTDLVLPKGTRIYIPLLPLHMNEKYFPEPQKYDPERFRNFDWSKDGKLVYIPFGAGPRRCLGDRFGLMMFKVAFMQFLSKYRIERAEDTPDEL

SEQ ID NO: 21398 - protein, 155 aa, Diabrotica virgifera
  misc_feature: Coding regions on vcDNA: vcDNA=SeqID_1095; Strand=+; Position=220-687
  misc_feature: Homolog annotation: Hit_ID=EAL31477.1; Match level="QueryCoverage =86%, HitCoverage=75%, E-value=3e-33, Identity=54%"; Hit description =GA14506-PA [Drosophila pseudoobscura]
  misc_feature: Gene Ontology Annotation: Molecular function=glutathione transferase activity; Cellular component=microsome; Biological process =glutathione metabolism
  misc_feature: Pfam annotation: Pfam_ID=MAPEG; Match level="Score=122.6, E-value =9.2e-34, Copies=1"; Pfam description=MAPEG family
MAQAVNSNSSSPLSLDNEVLRSLLFYCSILVLKMMLMSFLTASKRFKHKAYANPEDAKLENLKPQVNENVERVRRAHLNDVENIPLFFVIALIYTLTNPAVYFAKTLFFAYTLARIGHTVVYAVVPIPQPARVLCWIVGYGITGYMGVVSLLTFK

SEQ ID NO: 21399 - protein, 306 aa, Diabrotica virgifera
  misc_feature: Coding regions on vcDNA: vcDNA=SeqID_1096; Strand=+; Position=61-978
  misc_feature: Homolog annotation: Hit_ID=XP_393246.1; Match level="QueryCoverage =99%, HitCoverage=28%, E-value=9e-83, Identity=49%"; Hit description =similar to CG15279-PA [Apis mellifera]
  misc_feature: Gene Ontology Annotation: Molecular function=neurotransmitter:sodium symporter activity; Cellular component=integral to membrane; Biological process=sodium ion transport
  misc_feature: Pfam annotation: Pfam_ID=SNF; Match level="Score=-137.3, E-value=2.4e- 13, Copies=1"; Pfam description=Sodium:neurotransmitter symporter fam
MGKNKKEYTFDNPVFIISPEDVDHKSNGKIPDVEENDKSPQRSQWGNDTQFLMSCVAMSVGLGNVWRFPFIARSNGGGAFLIPYLIVLTVVGRPMYYMEMVLGQFCSRGPGQMYSKMSPVLKGIGIGQVFGATCVASYYCILMAITLLYLVNSFTINFPWATCWESWEEYLNERNFTCVDKDTVNFSSNNTISSAEMYFRREVLKEKDDISDGLGAPDWKLSLFLLVSWFATFLVSIKGVKSSGKASYFLAIFPYIVMLVLLIRASTLPGAAEGMKYFVDADFFRLKDAEVWYAAVTQWFFSLNGG

SEQ ID NO: 21400 - protein, 290 aa, Diabrotica virgifera
  misc_feature: Coding regions on vcDNA: vcDNA=SeqID_1097; Strand=-; Position=58-930
  misc_feature: Homolog annotation: Hit_ID=XP_393860.1; Match level="QueryCoverage =98%, HitCoverage=35%, E-value=4e-40, Identity=32%"; Hit description =similar to neutral endopeptidase 24.11 [Apis mellifera]
  misc_feature: Gene Ontology Annotation: Molecular function=metallopeptidase activity; Cellular component=integral to plasma membrane; Biological process=neuropeptide signaling pathway
  misc_feature: Pfam annotation: Pfam_ID=Peptidase_M13; Match level="Score=104.1, E -value=3.5e-28, Copies=1"; Pfam description=Peptidase family M13
DESRENGIKRLQNITAAIGWLDEAFNVTKIEELIGFDKVKHLPDDNATAIDLARVALKVTLDRVFRFINTNDVLSHFRVPEMSVNAYYLRILNILILPASILQEYIFDGNRPTYMNFGALGTIIGHEITHGFSLYYNLEGNEEDLWTNATIDKRTEITQCVDDEYNIFEIAHGKNKTNHTSGEENLADFNAVNIAYSAYQNWVQYNGRESTLPGINYTPNQLFWIMSSTYMCFQPLLSEKDTFVGKSAHHGIPEFRVVGGIRHSPYFASDFGCPVGSNMNPKEKCKIFGA

SEQ ID NO: 21401 - protein, 266 aa, Diabrotica virgifera
  misc_feature: Coding regions on vcDNA: vcDNA=SeqID_1098; Strand=+; Position=50-850
  misc_feature: Homolog annotation: Hit_ID=CAI11968.1; Match level="QueryCoverage =75%, HitCoverage=47%, E-value=1e-24, Identity=35%"; Hit description =novel protein similar to mouse thymidylate kinase family LPS -inducible member (Tyki) [Danio rerio]
  misc_feature: Pfam annotation: Pfam_ID=Thymidylate_kin; Match level="Score=-17.9, E- value=0.0013, Copies=1"; Pfam description=Thymidylate kinase
MLLCVSLILCVLNNCFCSSVYGDDAFSNELEYTDLAPPYFYNDLRSILKFFEDPQYRFTPGVRELLSIYHQQKVKTDRLNITGQVKKHPLFVIEGLAGSGKTTIGQLLASKLNGVQVHSPSNSIYSLKPLFQGDHFKESAFNAMCHYITALEVKVFLKSSPVIMDRFWHSSASYWISYAIQAKPNKYTMPPKGNKIYTWPEDLLKPDQVFLLDVDETVRMERIFGRSEIKNITDAEVVLHNLTEFRNNILTAYKNMQNPRSYCNKL

SEQ ID NO: 21402 - protein, 346 aa, Diabrotica virgifera
  misc_feature: Coding regions on vcDNA: vcDNA=SeqID_1099; Strand=+; Position=2-1042
  misc_feature: Homolog annotation: Hit_ID=AAM50097.1; Match level="QueryCoverage =97%, HitCoverage=52%, E-value=1e-113, Identity=58%"; Hit description= AT03044p [Drosophila melanogaster]
INVDAVRFFLVDCRPIEHYNAGHLPTAFHLDCNLMLSEPSAFATAVQGLLSAQRQALLHKSHAGGEHLCFLGSGRNEEDQYTHMVVASFLQKHTQYVSLLMGGYIAVHNYFSDNVDDFLQDHNPKSCIVCAPTYASKMLQSSQKPSQSNDLFGKISAAMKSKSAEVKGRLIDYIVNPNGSPVPERHVSSTDKIGKRYRDVAPVFSIDDDHDNVANEYVGPEDKQEMVQIQAYLKQSDVIEHFPCQEVKLNGFMYKSHLIVTRTELIVLREIPNIKGAAEVIVKRPLSAIVKITARKRHPELITFKYGVPDGENLKISDMDRFLIPNADKATKVVSDQILNQLKAKE

SEQ ID NO: 21403 - protein, 322 aa, Diabrotica virgifera
  misc_feature: Coding regions on vcDNA: vcDNA=SeqID_1100; Strand=+; Position=2-971
  misc_feature: Homolog annotation: Hit_ID=AAM50097.1; Match level="QueryCoverage =98%, HitCoverage=47%, E-value=1e-103, Identity=57%"; Hit description= AT03044p [Drosophila melanogaster]
  misc_feature (279)..(279): Xaa can be any naturally occurring amino acid
PRVRSLFAAACNLEVVINMWDFYFQQSDPFFIFFLSLIMVVNARDQIISMNDENRDKIIASLNNMPCGLEADDVSDFCTLAQYYALKTPVSFRNDLMQSIYSGKGDSVAIVSQALCLPVTVHELVENTTHETINVDAVRFFLVDCRPIEHYNAGHLPTAFHLDCNLMLSEPSAFATAVQGLLSAQRQALLHKSHAGGEHLCFLGSGRNEEDQYTHMVVASFLQKHTQYVSLLMGGYIAVHNYFSDNVDDFLQDHNPKSCIVCAPTYASKMLQSSQKPSXPTNCWEKISAGMKSKSGEGKGRVKNFWLTPWVTQGPKRIGANN

SEQ ID NO: 21404 - protein, 317 aa, Diabrotica virgifera
  misc_feature: Coding regions on vcDNA: vcDNA=SeqID_1101; Strand=+; Position=45-997
  misc_feature: Homolog annotation: Hit_ID=XP_314621.1; Match level="QueryCoverage =92%, HitCoverage=96%, E-value=1e-100, Identity=62%"; Hit description= ENSANGP00000024584 [Anopheles gambiae] ref|XP_314619.1| ENSANGP00000022519 [Anopheles gambiae]
  misc_feature: Gene Ontology Annotation: Molecular function=methenyltetrahydrofolate cyclohydrolase activity; Cellular component=extracellular space; Biological process=nucleobase, nucleoside, nucleotide and nucleic acid
  misc_feature: Pfam annotation: Pfam_ID=THF_DHG_CYH_C; Match level="Score=283.6, E -value=3.2e-82, Copies=1"; Pfam description=Tetrahydrofolate dehydrogenase/cycloh
  misc_feature (266)..(266): Xaa can be any naturally occurring amino acid
  misc_feature (282)..(282): Xaa can be any naturally occurring amino acid
  misc_feature (294)..(294): Xaa can be any naturally occurring amino acid
  misc_feature (298)..(298): Xaa can be any naturally occurring amino acid
MRWRNTFCSQIIDGKKVAEEIQKELKRDIDTWVSEGHRAPSLTAILVGEDPASNKYVRNKMTAAKKVGITSKTLKLSKDLTEQELIDKIKELNEDPSVDGILVQLPVPEHISERKVCNAVDPKKDVDGFHITNMGRLALNLDTLVPCTALGVIELIKRSHIDTFGKNVVVCGRSKNVGLPIALLLHSDARNECPGHEATVTLCHRHTPPEELEFFVKRADIVISATGVVNLIKPDMIKPGACIIDVGITRIPTEDGKDKIVGDVDXEGCSDVAGYITPVPGXGVGPMTVAMLMXNTFXAAQLMVEGAAKGVKANGHI

SEQ ID NO: 21405 - protein, 207 aa, Diabrotica virgifera
  misc_feature: Coding regions on vcDNA: vcDNA=SeqID_1102; Strand=+; Position=205-828
  misc_feature: Homolog annotation: Hit_ID=EAL39065.1; Match level="QueryCoverage =97%, HitCoverage=64%, E-value=1e-48, Identity=48%"; Hit description =ENSANGP00000029046 [Anopheles gambiae str. PEST] ref|XP_553121.1| ENSANGP00000029046 [Anopheles gambiae st
  misc_feature: Gene Ontology Annotation: Molecular function=bile acid transporter activity; Cellular component=cytoplasm; Biological process =xenobiotic metabolism
  misc_feature: Pfam annotation: Pfam_ID=Aldo_ket_red; Match level="Score=126.6, E -value=6.2e-35, Copies=1"; Pfam description=Aldo/keto reductase family
  misc_feature (193)..(193): Xaa can be any naturally occurring amino acid
MSLKNVKYTLNNGANLHAVGFGTWLLKGNGVSKAMDMALEAGYRLFDTAAMYDNEKEIGDALKELLPKHNLKREDVFITTKLYPSDQGEKAFDAIKESLRKLDSQYIDLYLIHWPGTYGVSSRSKQNAILRDQSWQQMVKAVNMGLIKNIGVSNYTVKHLQELLNNNHGIKPVVNQVEWHPYCHQKELYDFCXVERIQLQAYQSLGR

SEQ ID NO: 21406 - protein, 258 aa, Diabrotica virgifera
  misc_feature: Coding regions on vcDNA: vcDNA=SeqID_1103; Strand=+; Position=297-1070
  misc_feature: Homolog annotation: Hit_ID=XP_321043.1; Match level="QueryCoverage =87%, HitCoverage=30%, E-value=8e-92, Identity=66%"; Hit description =ENSANGP00000011245 [Anopheles gambiae]
  misc_feature: Gene Ontology Annotation: Molecular function=mRNA binding; Cellular component=mitochondrion; Biological process=RNA splicing
  misc_feature: Pfam annotation: Pfam_ID=tRNA-synt_1; Match level="Score=-182.0, E -value=8.3e-07, Copies=1"; Pfam description=tRNA synthetases class I (I, L, M and
  misc_feature (115)..(115): Xaa can be any naturally occurring amino acid
  misc_feature (237)..(237): Xaa can be any naturally occurring amino acid
  misc_feature (240)..(240): Xaa can be any naturally occurring amino acid
  misc_feature (249)..(249): Xaa can be any naturally occurring amino acid
  misc_feature (252)..(252): Xaa can be any naturally occurring amino acid
MFTIKKCFLPHKTLQRIVSYRCLSGLNLWDQEISSEIKHEIEKHWKDKLKFKSFEDSSSNKEKYYVLSMFPYPSGALHMGHVRVYTISDTVARYQRLNGKNVLHPIGWDAFGLPXENAAIDHKIAPDVWTKQNIAHMKEQLERLNCSFEWNREFKTCDPNYYKWTQDLFLKLYDEGLVYQKEALVNWDPVDQTVLADEQVDENGNSWRSGAKVEKRVLKQWYVRTTRFAKNLLDGLXDPXLQDWRDIIXLQXHWIGDW

SEQ ID NO: 21407 - protein, 165 aa, Diabrotica virgifera
  misc_feature: Coding regions on vcDNA: vcDNA=SeqID_1104; Strand=-; Position=890-1387
ANQLCPEYISSVVWKSLRNQHLTGGNLKKELRGSRCGYQRLDSQNETEGSQPDTTKGSDGSQANCSLEAKTNRICSRTSGSDYQRSQALFSDKSRIYLHGNDKRRRVYRRPGKTIFSMLYTRNYVMWRRFLYVLGRHFHGWENRDGFRAWWRTFNGGLLHQRHFG

SEQ ID NO: 21408 - protein, 111 aa, Diabrotica virgifera
  misc_feature: Coding regions on vcDNA: vcDNA=SeqID_1105; Strand=-; Position=774-1109
  misc_feature: Homolog annotation: Hit_ID=AAM50290.1; Match level="QueryCoverage =95%, HitCoverage=16%, E-value=5e-09, Identity=37%"; Hit description =RE43020p [Drosophila melanogaster]
GEARKKKKKKKRKFLAIFLAVVAKLGLLVKLLQAGLLLKLALTTVAILGVSVAKLIFLVKHGKQKTIYYENSHHDHHYEHDDIYEQDDHHHGWGRSANAMAYSKQIPKSSY

SEQ ID NO: 21409 - protein, 147 aa, Diabrotica virgifera
  misc_feature: Coding regions on vcDNA: vcDNA=SeqID_1106; Strand=+; Position=23-466
  misc_feature: Homolog annotation: Hit_ID=XP_393102.1; Match level="QueryCoverage =100%, HitCoverage=100%, E-value=1e-55, Identity=72%"; Hit description=similar to ribosomal protein L35A [Apis mellifera]
  misc_feature: Gene Ontology Annotation: Molecular function=structural constituent of ribosome; Cellular component=cytosolic ribosome (sensu Eukarya); Biological process=protein biosynthesis
  misc_feature: Pfam annotation: Pfam_ID=Ribosomal_L35Ae; Match level="Score=187.9, E- value=2e-53, Copies=1"; Pfam description=Ribosomal protein L35Ae
MADAAAKKPKAEKKAPKEGATPSDKPSVKRRPFKRHGRLYAKAIFTGYKRGLRNQHENTALLSVEGTRSKDESWFYVGKKCVYVYKAKNRTCVPGRPKSVKSKVRAIWGKVTRPHGTRGAVRAKFNRNLPAKAMGHRIRIMLYPSKI

SEQ ID NO: 21410 - protein, 241 aa, Diabrotica virgifera
  misc_feature: Coding regions on vcDNA: vcDNA=SeqID_1107; Strand=+; Position=199-922
  misc_feature: Homolog annotation: Hit_ID=XP_312915.1; Match level="QueryCoverage =96%, HitCoverage=70%, E-value=8e-86, Identity=64%"; Hit description =ENSANGP00000014770 [Anopheles gambiae]
  misc_feature: Gene Ontology Annotation: Molecular function=transporter activity; Cellular component=mitochondrial inner membrane; Biological process =transport
  misc_feature: Pfam annotation: Pfam_ID=Mito_carr; Match level="Score=139.5, E-value= 7.7e-39, Copies=2"; Pfam description=Mitochondrial carrier protein
  misc_feature (114)..(114): Xaa can be any naturally occurring amino acid
  misc_feature (231)..(231): Xaa can be any naturally occurring amino acid
MEFYLGSDDASDNNKIIRTIEWDMMDKTKFFPLSMLSSFSVRCALYPLTLIKTRLQIQKHNDLYTGMFDAYGKIYKYEGFGGLYRGFWVSSVQIVSGVFYISTYEGVRHILHQXNVHSSLRALVAGGCASLVGQTIIVPFDVLSQHLMMMGVNSRGGEQDFNHLGMKTKPNQSKFSITIDVAKHIFRMDGIAGFYRGYFAGLSAYVPNSALWWGFYHIYQDQLYILMPSWXSHLLLQSISG

SEQ ID NO: 21411 - protein, 184 aa, Diabrotica virgifera
  misc_feature: Coding regions on vcDNA: vcDNA=SeqID_1108; Strand=+; Position=748-1303
  misc_feature: Homolog annotation: Hit_ID=EAA06221.3; Match level="QueryCoverage =67%, HitCoverage=16%, E-value=1e-27, Identity=52%"; Hit description =ENSANGP00000004709 [Anopheles gambiae str. PEST] ref|XP_566345.1| ENSANGP00000004709 [Anopheles gambiae st
  misc_feature: Gene Ontology Annotation: Molecular function=transcription factor activity; Cellular component=nucleus; Biological process=regulation of transcription
  misc_feature: Pfam annotation: Pfam_ID=HLH; Match level="Score=58.5, E-value=1.9e -14, Copies=1"; Pfam description=Helix-loop-helix DNA-binding domain
  misc_feature (64)..(64): Xaa can be any naturally occurring amino acid
MYTAVSNTTSQPLQTLLSTNRILTTGIPSVLDGESKVAINRVQPIKEPKVKEVKRSAHNAIRKXYRTSINDKIVELKNIVVGEDAKLNKSAILRRTIDYIRFLQNSNSRLKQENIGSKNGRQSKHTQRSFRLLGDKYRPEDTPPRSDHSLSPEHSLPSSPEYCATIKDESEDEAIGTVRQGMAG

SEQ ID NO: 21412 - protein, 259 aa, Diabrotica virgifera
  misc_feature: Coding regions on vcDNA: vcDNA=SeqID_1109; Strand=+; Position=104-880
  misc_feature: Homolog annotation: Hit_ID=CAG31361.1; Match level="QueryCoverage =94%, HitCoverage=52%, E-value=1e-57, Identity=44%"; Hit description =hypothetical protein [Gallus gallus]
  misc_feature (244)..(244): Xaa can be any naturally occurring amino acid
MVTQNIAGLKNFFVFNSTLGNKEGEELKKILYYYPVIDNVDVQIKNVGLVEGIIQFTETFKPSTPVKSLRTTKTRHLYFQPEKDYWIVMTLQINRPSKEKDISHDAEELEDDVDDSVYEAILKQSYYVYRLFWNTFESSKDITSLKTSLDVFYRTYLQSIKLANADILNVFSGIQYLPLDKQTFLKVQCFVNSLESTYGIIQHSSFLYNDYLIWSGVEPSDMQIIYQYLIGTLLPCHVEAEFTXRSIPRNAPSPFAALR

SEQ ID NO: 21413 - protein, 333 aa, Diabrotica virgifera
  misc_feature: Coding regions on vcDNA: vcDNA=SeqID_1110; Strand=+; Position=19-1017
  misc_feature: Homolog annotation: Hit_ID=EAA00819.2; Match level="QueryCoverage =95%, HitCoverage=75%, E-value=2e-34, Identity=29%"; Hit description =ENSANGP00000011548 [Anopheles gambiae str. PEST] ref|XP_551263.1| ENSANGP00000011548 [Anopheles gambiae st
  misc_feature: Gene Ontology Annotation: Molecular function=molecular_function unknown
  misc_feature: Pfam annotation: Pfam_ID=DUF227; Match level="Score=80.4, E-value =4.7e-21, Copies=1"; Pfam description=Domain of unknown function (DUF227)
  misc_feature (294)..(294): Xaa can be any naturally occurring amino acid
  misc_feature (305)..(305): Xaa can be any naturally occurring amino acid
  misc_feature (314)..(314): Xaa can be any naturally occurring amino acid
MNIPEEHRALIDRIASENGFTDYEIITSSGSSKGDNFLGVLTAITIKDKEKSLDLILKSSHTNKGFREAAPIKEIYNREIFLYERVFKEFKKFQEEHNIEDPFDSVPKCYSSFTEEGLECLVMENLKTQQYELWDKKVPMNPGHIKAVLIEYAKFHAVSFAMKQKNPALFKELAEENGGNPFEEKYTKDKDKEEKFKSFLTTTLSNGYKVLKDDPVLTEKLKKYEEIVGPELMSKLKGPEHKLVITHGDCWCNNFMFKYQDPYNKTKPEGLRILDWQISSFGSPCADLSYFFLXNSPNEVLDDIXTYLKVYHDXLASHYVILIWILKDCFPSL

SEQ ID NO: 21414 - protein, 286 aa, Diabrotica virgifera
  misc_feature: Coding regions on vcDNA: vcDNA=SeqID_1111; Strand=+; Position=120-975
  misc_feature: Homolog annotation: Hit_ID=NP_727943.1; Match level="QueryCoverage =97%, HitCoverage=67%, E-value=2e-72, Identity=44%"; Hit description =CG3525-PC, isoform C [Drosophila melanogaster] ref|NP_727942.1| CG3525-PB, isoform B [Drosophila
  misc_feature: Gene Ontology Annotation: Molecular function=ethanolamine kinase activity; Cellular component=cytoplasm; Biological process =phosphatidylethanolamine biosynthesis
  misc_feature: Pfam annotation: Pfam_ID=Choline_kinase; Match level="Score=230.3, E -value=3.6e-66, Copies=1"; Pfam description=Choline/ethanolamine kinase
  misc_feature (254)..(254): Xaa can be any naturally occurring amino acid
  misc_feature (273)..(273): Xaa can be any naturally occurring amino acid
MNFKTPEVPPHVNVEISENDIQNGALQILKVIRPNWEESSITFKLLTDGITNKLVGCKPEGADDEEIVLVRIYGNKTDLIIDRKAETRNIILLHKAGLAPNLYATFKNGLAYRYLPGCTLTSKSVREPTIYTLVAKQLALLHKVNPNNGPSKTFLWDKIRKFLDLIPDTFSDPEKHIRYMKNVTPKSKIEQEMYEMKEVIESLGSPIVFAHNDLLLGNVIYNKEKNKVTFIDYEYAALNYQSVDIANHFAEFCXGIDEIDYSLYRNKKIQQNXIRYTLTKYMDEKH

SEQ ID NO: 21415 - protein, 366 aa, Diabrotica virgifera
  misc_feature: Coding regions on vcDNA: vcDNA=SeqID_1112; Strand=+; Position=17-1117
  misc_feature: Homolog annotation: Hit_ID=NP_998455.1; Match level="QueryCoverage =96%, HitCoverage=73%, E-value=5e-96, Identity=49%"; Hit description =zgc:85806 [Danio rerio] gb|AAH68391.1| Zgc:85806 [Danio rerio]
  misc_feature: Gene Ontology Annotation: Molecular function=protein binding; Cellular component=cytoplasm; Biological process=protein folding
  misc_feature: Pfam annotation: Pfam_ID=TPR_1; Match level="Score=137.8, E-value =2.5e-38, Copies=7"; Pfam description=Tetratricopeptide repeat
MDSDENEEILSKSPEEMAELKKENGNQLYKTKQYRSALPLYSEAINLCPNVAPYYGNRAACYMMLYRFTEALEDVRKSVQLDPEFVKGYIRMLKCAIAMGDTTTADFAIKKLQDLKVDQQTFANELKSVQQLKQYESDGTKAYDKKDYRLVVFCMDRCLDNAPTCYRYKIAKAECLTYLGRYQEAQEIANSILNIDKGNADAIYVRGMCLFYDDNLDSAFQHFQQVLRLAPDHTKAMNIYKRARLLKKMKEDGNEAYKTGKFQEAYNLYTEALQVDPFNKKTNAKLYFNRATVLARLTKTREAIEDCTAALQLDDTYLKALMRRAKCYMDLVELEYAVENNEKILKKKKKKKKKKNPSPIPMNNQK

SEQ ID NO: 21416 - protein, 241 aa, Diabrotica virgifera
  misc_feature: Coding regions on vcDNA: vcDNA=SeqID_1113; Strand=+; Position=158-880
  misc_feature: Homolog annotation: Hit_ID=XP_319061.1; Match level="QueryCoverage =97%, HitCoverage=51%, E-value=1e-129, Identity=94%"; Hit description= ENSANGP00000013182 [Anopheles gambiae]
  misc_feature: Gene Ontology Annotation: Molecular function=protein kinase activity; Cellular component=DNA-directed RNA polymerase II, holoenzyme; Biological process=regulation of cell cycle
  misc_feature: Pfam annotation: Pfam_ID=Pkinase; Match level="Score=136.3, E-value =7e-38, Copies=1"; Pfam description=Protein kinase domain
MTCLMMDYEFKMKTQNERVKVEDLFDYEGCKVGRGTYGHVYKGRRKDGSDSKDYALKQIEGTGLSMSACREIALLRELKHANVINLIRVFLSHNDRKVWLLFDFAEHDLWHIIKFHRAAKANKKPVMVPKGMVKSLLYQILDGIHYLHSNWVLHRDLKPANILVMGEGPERGRVKIADMGFARLFNAPLKPLADLDPVVVTFWYRAPELLLGARHYTKAIDIWAIGCIFAELLTSEPIFIV

SEQ ID NO: 21417 - protein, 297 aa, Diabrotica virgifera
  misc_feature: Coding regions on vcDNA: vcDNA=SeqID_1114; Strand=+; Position=204-1094
  misc_feature: Homolog annotation: Hit_ID=XP_311452.1; Match level="QueryCoverage =97%, HitCoverage=50%, E-value=1e-112, Identity=66%"; Hit description= ENSANGP00000018551 [Anopheles gambiae]
  misc_feature: Gene Ontology Annotation: Molecular function=glucose-6-phosphate 1 -dehydrogenase activity; Cellular component=cytoplasm; Biological process=pentose-phosphate shunt
  misc_feature: Pfam annotation: Pfam_ID=G6PD_N; Match level="Score=345.5, E-value =7.3e-101, Copies=1"; Pfam description=Glucose-6-phosphate dehydrogenase, NA
  misc_feature (265)..(265): Xaa can be any naturally occurring amino acid
  misc_feature (270)..(270): Xaa can be any naturally occurring amino acid
  misc_feature (290)..(290): Xaa can be any naturally occurring amino acid
MENGKLQSKSAELCLSLYRDSLKSKDMDHDGTHFDGQYPHVFVILGASGDLAKKKIYPTLWWLYRDNVLPVNTIFYGYARSKITLSEVRQKCSPWMDVKPEEKEKYEEFWKLNHYMSGQYTSRTDFELLNKEVEKFEKGPVANRLFYLALPPSVYEDVTVHIKNNCMGQKGWTRIIIEKPFGRDLETSNKLSSHLSQLFTEQQLYRIDHYLGKEMVQNLMTLRFGNRIFNPTWNSDHIASIQINCKEPFGTEGQRKGIFDEFGIXIGDVXMQNHILQILALVAMKKPASXSPDDIRK

SEQ ID NO: 21418 - protein, 416 aa, Diabrotica virgifera
  misc_feature: Coding regions on vcDNA: vcDNA=SeqID_1115; Strand=+; Position=212-1460
  misc_feature: Homolog annotation: Hit_ID=XP_311452.1; Match level="QueryCoverage =95%, HitCoverage=70%, E-value=1e-168, Identity=70%"; Hit description= ENSANGP00000018551 [Anopheles gambiae]
  misc_feature: Gene Ontology Annotation: Molecular function=glucose-6-phosphate 1 -dehydrogenase activity; Cellular component=cytoplasm; Biological process=pentose-phosphate shunt
  misc_feature: Pfam annotation: Pfam_ID=G6PD_N; Match level="Score=345.9, E-value =5.7e-101, Copies=1"; Pfam description=Glucose-6-phosphate dehydrogenase, NA
  misc_feature (399)..(399): Xaa can be any naturally occurring amino acid
MFRRQPMSEFEESKSAELCLSLYRDSLKSKDMDHDGTHFDGQYPHVFVILGASGDLAKKKIYPTLWWLYRDNVLPVNTIFYGYARSKITLSEVRQKCSPWMDVKPEEKEKYEDFWKLNHYMSGQYTSRTDFELLNKEVEKFEKGPVANRLFYLALPPSVYEDVTVHIKNNCMGQKGWTRIIIEKPFGRDLETSNKLSSHLSQLFTEQQLYRIDHYLGKEMVQNLMTLRFGNRIFNPTWNSDHIASIQINCKEPFGTEGRGGYFDEFGIIRDVMQNHILQILALVAMEKPASVQPDDIRNEKVKVLKSIAPIKLKDVVLGQYVGNPDGQGNAKLGYLDDPSVPKDSVTPTYALAVVHINNERWDGVPFILKWWKALNERKAEVRIQFKNVPGDIFDGKPXKRNELVIRGPPWRSPCM

SEQ ID NO: 21419 - protein, 81 aa, Diabrotica virgifera
  misc_feature: Coding regions on vcDNA: vcDNA=SeqID_1116; Strand=-; Position=131-376
HSTVKITSRLVLCFICIDNQSMINSASLQRIYLLLHVNLLVINNSFVFTSFFFLLRRHLSKVRNPNSNYSFGNYCTKNFCG

SEQ ID NO: 21420 - protein, 373 aa, Diabrotica virgifera
  misc_feature: Coding regions on vcDNA: vcDNA=SeqID_1117; Strand=+; Position=34-1155
  misc_feature: Homolog annotation: Hit_ID=XP_321867.1; Match level="QueryCoverage =88%, HitCoverage=63%, E-value=3e-53, Identity=34%"; Hit description =ENSANGP00000020284 [Anopheles gambiae]
  misc_feature: Gene Ontology Annotation: Molecular function=G-protein activated inward rectifier potassium channel activity; Cellular component =voltage-gated potassium channel complex; Biological process =potassium ion transport
  misc_feature: Pfam annotation: Pfam_ID=IRK; Match level="Score=169.4, E-value=7.7e -48, Copies=1"; Pfam description=Inward rectifier potassium channel
MYEELQYDSVRDQYTEVSFDEFSEDSDEHQSHVQGNPLLILKRQKKRKTRKTTFSNLARLIKKSGRLNTFLKQRTNKNIYYIRDFGNTLLGIRWRWVLITLFLVNVGCFLVFGMLWWVIAIGSGDFSPNVTDPCIVNTNTSEGYFLLSAETITTIGYGYRYPTEQCSFGWFMLVSQVMLSVAIQGTLVSVVYVKITKPITTSSTSLFSKKAVICMRDGKLRFIFRINDFTKKIWCGTNISLYFMDKEFIYPNTEFEIIQMEVEPHGLLIFPLEIEHVINETSPLWTFRPLDILESRFEVIAVAEGSSNITGQVSQNRTSYSNSDILWGHRFMPCVDYDEEEERYIVDYKKFKQLIPFDTPLCSAKMLRDIQQI

SEQ ID NO: 21421 - protein, 122 aa, Diabrotica virgifera
  misc_feature: Coding regions on vcDNA: vcDNA=SeqID_1118; Strand=+; Position=830-1195
  misc_feature (81)..(81): Xaa can be any naturally occurring amino acid
  misc_feature (83)..(83): Xaa can be any naturally occurring amino acid
  misc_feature (86)..(86): Xaa can be any naturally occurring amino acid
  misc_feature (88)..(89): Xaa can be any naturally occurring amino acid
  misc_feature (97)..(97): Xaa can be any naturally occurring amino acid
  misc_feature (100)..(100): Xaa can be any naturally occurring amino acid
  misc_feature (102)..(102): Xaa can be any naturally occurring amino acid
ISDSIQTISIFIIPRFLLSARYLVQVDINRPLVPDRNWNLFGHNEFVLLDLITISSQHESASTATKLTTLHKNTTFETGLXAXDLXTXXISFACFLXHPXIXTLSSLHRLLASQHLILYHYF

SEQ ID NO: 21422 - protein, 300 aa, Diabrotica virgifera
  misc_feature: Coding regions on vcDNA: vcDNA=SeqID_1119; Strand=+; Position=12-914
  misc_feature: Homolog annotation: Hit_ID=XP_320368.1; Match level="QueryCoverage =92%, HitCoverage=75%, E-value=1e-25, Identity=26%"; Hit description =ENSANGP00000013987 [Anopheles gambiae]
  misc_feature: Pfam annotation: Pfam_ID=CRAL_TRIO; Match level="Score=-6.4, E-value =0.00012, Copies=1"; Pfam description=CRAL/TRIO domain
MDKNTQDDVTSKHREEILKYLGKTEEDLAASVELMKSWFKTQPHLPEVPSTKKLEFYIVNNTFNLESAKTRIDQFYTLRSTLTVIFDTSNPKSPEQKAAIDSAQIVPLPKLHDDLYGVILFKMRENIPVNFDPHWWLGALVNAHEVKIHEGLMLNYIVVYDLEHMTLSHLLKISPIFAVNSSKLSENGLGERLKEMHFINCPPFFQIIMNILRAVMRADFFTRLHIHHTVDTFRERFPSELLPKDYGGNEKCMDELEAAWIKKCEEYQEHFDRLDTLRVDESLRPNPDVPDLIELGFDRF

SEQ ID NO: 21423 - protein, 272 aa, Diabrotica virgifera
  misc_feature: Coding regions on vcDNA: vcDNA=SeqID_1120; Strand=+; Position=439-1254
  misc_feature: Homolog annotation: Hit_ID=XP_320789.1; Match level="QueryCoverage =98%, HitCoverage=25%, E-value=1e-102, Identity=69%"; Hit description= ENSANGP00000014167 [Anopheles gambiae]
  misc_feature: Gene Ontology Annotation: Molecular function=motor activity; Cellular component=myosin I; Biological process=transport
  misc_feature: Pfam annotation: Pfam_ID=Myosin_head; Match level="Score=-95.1, E -value=2.1e-12, Copies=1"; Pfam description=Myosin head (motor domain)
KMEHHLYDRDRVGVQDAVLLEDYTNQDVFVDNLQKRFKEDVIYTYIGPVLISVNPYRELNIYDSKTVQEYRNKHFFEVPPHVFAITNNAYTSLKEENREQCILISGESGSGKTEASKKVLNFIAAVTDQKGEVEKVKDKLLFSNPILEAFGNAKTNRNDNSSRFGKYMDIQFNFEGNPVGGNILNYLLEKSRVINQAPGERNFHIFYQLLAGASEEELDKLHLKRSLSSYYYLSNGHNGTTTINDQKDFSEVKRALTTLEFTEKDSQICFPV

SEQ ID NO: 21424 - protein, 212 aa, Diabrotica virgifera
  misc_feature: Coding regions on vcDNA: vcDNA=SeqID_1121; Strand=+; Position=317-955
KIYTIMPKHRDVPSLQSLCLKSIGTLVVHVAPLILSKISIYKEPQKVISSLQTSLTWLNDHLSSHVPFYLYDQMAVEVLLAVKVFIEATKKTYFPHTSIATFLTEMNVAVSLTEVVLNCHLKSIDFSQWPKIMRYILYKNLHNLTGLENLNLGSCSGGWRTSEFDRCLLESIAKMKHLKSLCLCFDSTDVIVQTVGDNCHRSNVSISLLQAP

SEQ ID NO: 21425 - protein, 663 aa, Diabrotica virgifera
  misc_feature: Coding regions on vcDNA: vcDNA=SeqID_1122; Strand=+; Position=1-1990
  misc_feature: Homolog annotation: Hit_ID=CAA77038.1; Match level="QueryCoverage =99%, HitCoverage=52%, E-value=0.0, Identity=65%"; Hit description =maleless protein [Sciara ocellaris]
  misc_feature: Gene Ontology Annotation: Molecular function=chromatin binding; Cellular component=dosage compensation complex (sensu Drosophila); Biological process=dosage compensation, by hyperactivation of X chromosome
  misc_feature: Pfam annotation: Pfam_ID=HA2; Match level="Score=84.3, E-value=3.2e -22, Copies=1"; Pfam description=Helicase associated domain (HA2)
  misc_feature (68)..(68): Xaa can be any naturally occurring amino acid
IDTTLFSKYFNNCPVIEIPGRAFPVKQYFLEDAIELTKFVPPTDTRKRKNKGGKDDDEEESTGVEEPXDENLNKVVGGNYSDLTRNVMSRLNEKEVSFELLEALLDYIKTQSIPGAVLVFLPGWNLIFAMMKHLQNHPVYGGSQYSILPLHSQIPREDQKRVFQPVPDHVTKVILATNIAETSITINDVVFVIDSCKAKMKMFTSHNNMTSYATVWASRTNLEQRKGRAGRVRPGICFHLCSKARFDKLDEHMTPEMFRTPLHELALSIKLLRLGSIGHFLSKAIEPPPLDAVIEAEVLLREMKCLDQNDELTPLGRIIAKLPIEPRLGKMMVLGCVFMCGGPLATMAANSSTFPEIFTLDMGQRRLSYHQRALSGDRHSDHVAMLTAFELWDQARQGGEEAELRFCDFKGISMPTMRVTWEAKHQLQQILNNVGFPEETMALFPMETVGPDPRLDVVMSLMCYGLYPNVCFHKDKRKVLTTESKAALIHKTSVNCSNQDQGFPYPFFVFGEKIRTRAVSCKQMTMVTPLHLLLFGSRKVEWVDNVVRLDNWINLDMDPEVASMIVALRPALESLVIRTSQSPEAILEMGETDVKVVSTIKEICRLHAGSFELERAKGSLLQSNRPPRGHTLGGFIGPSPKFFKGGFNSQGGGGGFRGGFRGD

SEQ ID NO: 21426 - protein, 173 aa, Diabrotica virgifera
  misc_feature: Coding regions on vcDNA: vcDNA=SeqID_1123; Strand=+; Position=168-689
  misc_feature: Homolog annotation: Hit_ID=EAL29130.1; Match level="QueryCoverage =92%, HitCoverage=82%, E-value=2e-65, Identity=72%"; Hit description =GA19846-PA [Drosophila pseudoobscura]
  misc_feature: Gene Ontology Annotation: Molecular function=molecular_function unknown; Cellular component=nucleolus; Biological process=ribosomal large subunit biogenesis
  misc_feature: Pfam annotation: Pfam_ID=Ribosomal_L24e; Match level="Score=118.6, E -value=1.5e-32, Copies=1"; Pfam description=Ribosomal protein L24e
MRIETCYFCSSRIYPGHGIQFVRNDCKIFKFCRSKCHAAFKKKKNPRKVKWTKAYRKTVGKELTIDPSFEFEKRRNIPLKYNRETWSKAVEAMKTVEKIKQKRQGAYIMQRLRKGREIEQERDIKEVQRDLSLIRSPAVGLKERKQEESMAQDHRESDEEMEGIIEDGGEVTL

SEQ ID NO: 21427 - protein, 49 aa, Diabrotica virgifera
  misc_feature: Coding regions on vcDNA: vcDNA=SeqID_1124; Strand=+; Position=2-151
  misc_feature: Homolog annotation: Hit_ID=XP_311327.1; Match level="QueryCoverage =91%, HitCoverage=4%, E-value=1e-17, Identity=86%"; Hit description =ENSANGP00000021314 [Anopheles gambiae]
  misc_feature: Gene Ontology Annotation: Molecular function=protein binding; Cellular component=ubiquitin ligase complex; Biological process =negative regulation of BMP signaling pathway
GHPRGTPDNYPRAHTCFNRLDLPPYESYTHLKDKLIKAIEGSQGFAGVD

SEQ ID NO: 21428 - protein, 251 aa, Diabrotica virgifera
  misc_feature: Coding regions on vcDNA: vcDNA=SeqID_1125; Strand=+; Position=182-937
  misc_feature: Homolog annotation: Hit_ID=XP_317058.1; Match level="QueryCoverage =82%, HitCoverage=72%, E-value=5e-40, Identity=40%"; Hit description =ENSANGP00000019732 [Anopheles gambiae]
  misc_feature: Pfam annotation: Pfam_ID=Arm; Match level="Score=30.7, E-value=4.4e -06, Copies=2"; Pfam description=Armadillo/beta-catenin-like repeat
MPVVNTSMALLPVAEASNAEPTENQPRQPMSLQGLLRFSMEATRAEDAPSNSEFAPMDEERKKFLEEALNSMSVDVVQIMQRQIAFLKGVESVDPSECNTNYLEAIETILEYVDNIDIANDFHKIGGFTTIYPCMKSKDSKIRAAGCELLAVLCQNNPYCQTVVLDNEFIPKLLHMIENDNDGQVVTKAIYALGGIVRDNPEGLTQLIHYNGLTMLLNCLKSNHENVIIKSAFLLGTLCRATPNLKENLHH

SEQ ID NO: 21429 - protein, 623 aa, Diabrotica virgifera
  misc_feature: Coding regions on vcDNA: vcDNA=SeqID_1126; Strand=+; Position=337-2208
  misc_feature: Homolog annotation: Hit_ID=XP_396698.1; Match level="QueryCoverage =100%, HitCoverage=98%, E-value=0.0, Identity=83%"; Hit description =similar to CG9281-PB [Apis mellifera]
  misc_feature: Gene Ontology Annotation: Molecular function=ATP-binding cassette (ABC) transporter activity; Cellular component=cellular_component unknown; Biological process=biological_process unknown
  misc_feature: Pfam annotation: Pfam_ID=ABC_tran; Match level="Score=274.8, E-value =1.4e-79, Copies=2"; Pfam description=ABC transporter
MPSDAKKREQQRKKDAAKARQAGKKNEKQKGEEQNDTLKTNGLSNGATNGSSELSAEEALCAKLEADARLNAEARACTGSLAVHPKSRDVKIDTFSITFHGCEMLQDALLELNCGRRYGLLGLNGSGKSTILAVLGNREVPIPDHIDIFHLTREMPASDKTALECVMEVDEERVRLEKLAEELVACEDDESQEQLMDIYERLDDMAADTAEARAANILHGLGFTREMQNKKTKDFSGGWRMRIALARALYVKPHLLLLDEPTNHLDLDACVWLEEELRNYKRILVLISHSQDFLNGVCTNIIHINKKRLKYYTGNYDAFVKTRMELLENQMKQYNWEQDQINHMKNYIARFGHGSAKLARQAQSKEKTLAKMVAQGLTEKVTSDKIVTFYFPSCGTIPPPVIMVQNVSFRYNDSTPLIYKNLEFGIDLDTRLALVGPNGAGKSTLLKLLYGDLTPTEGMIRKNSHLRIARYHQHLHELLDLDLSPLEYMMKEFPDIKEKEEMRKIIGRYGLTGRQQVCPIRQLSDGQRCRVVFAWLAWQVPHMLLLDEPTNHLDMETIDALADAINEFEGGMVLVSHDFRLISQVAEEIWVCEKGTVTKWQGDILSYKDHLKTKILKDAAKRK

SEQ ID NO: 21430 - protein, 213 aa, Diabrotica virgifera
  misc_feature: Coding regions on vcDNA: vcDNA=SeqID_1127; Strand=+; Position=448-1086
  misc_feature: Homolog annotation: Hit_ID=XP_396698.1; Match level="QueryCoverage =96%, HitCoverage=31%, E-value=2e-72, Identity=71%"; Hit description =similar to CG9281-PB [Apis mellifera]
  misc_feature: Gene Ontology Annotation: Molecular function=ATP-binding cassette (ABC) transporter activity; Cellular component=cellular_component unknown; Biological process=biological_process unknown
  misc_feature: Pfam annotation: Pfam_ID=ABC_tran; Match level="Score=-24.5, E-value =0.00038, Copies=1"; Pfam description=ABC transporter
  misc_feature (153)..(153): Xaa can be any naturally occurring amino acid
  misc_feature (159)..(159): Xaa can be any naturally occurring amino acid
  misc_feature (174)..(174): Xaa can be any naturally occurring amino acid
VRRYGLVYINLSGITLTLAVLGNREVPIPDHIDIFHLTREMPASDKTALECVMEVDEERVRLEKLAEELVACEDDESQEQLMDIYERLDDMAADTAEARAANILHGLGFTREMQNKKTKDFSGGWRMRIALASALYVKPHLLLINEPTNILYXNACVWXLENELKILKKKIRVXKSLSLNFSNGIWANPNKHLNKKKAPIFYPGNFSPLFFIN

SEQ ID NO: 21431 - protein, 76 aa, Diabrotica virgifera
  misc_feature: Coding regions on vcDNA: vcDNA=SeqID_1128; Strand=-; Position=627-857
VGLFASNMNFYEIKKYSKTILGRICSVFFTKIRKPNIYIVSNKYTKTPITALRKNIKNIFSRVDLHLNYSQILYTI

SEQ ID NO: 21432 - protein, 188 aa, Diabrotica virgifera
  misc_feature: Coding regions on vcDNA: vcDNA=SeqID_1129; Strand=+; Position=208-774
  misc_feature: Homolog annotation: Hit_ID=EAA01312.2; Match level="QueryCoverage =100%, HitCoverage=100%, E-value=2e-83, Identity=79%"; Hit description=ENSANGP00000020389 [Anopheles gambiae str. PEST] ref|XP _551530.1| ENSANGP00000020389 [Anopheles gambiae
  misc_feature: Gene Ontology Annotation: Molecular function=actin binding; Cellular component=cytoskeleton; Biological process=muscle contraction
  misc_feature: Pfam annotation: Pfam_ID=CH; Match level="Score=92.2, E-value=1.3e -24, Copies=1"; Pfam description=Calponin homology (CH) domain
MANNRAAKSGFAAEAQRKVNAKYSEDLAKESLEWIVTITGDELNTAGDMDNFYEVLKDGTVLCKLVNNIQPGIVKKINTSTMAFKCMENINAFLEAAKQLGVPPQETFQTVDLWERQNLNSVVICLQSLGRKADKYGKQSIGPKEAEKNERMFSEEKLRAGQTIIGLQMGSNKGATQSGINFGNTRHM

SEQ ID NO: 21433 - protein, 189 aa, Diabrotica virgifera
  misc_feature: Coding regions on vcDNA: vcDNA=SeqID_1130; Strand=+; Position=103-672
  misc_feature: Homolog annotation: Hit_ID=EAA01312.2; Match level="QueryCoverage =97%, HitCoverage=97%, E-value=1e-80, Identity=78%"; Hit description =ENSANGP00000020389 [Anopheles gambiae str. PEST] ref|XP_551530.1| ENSANGP00000020389 [Anopheles gambiae st
  misc_feature: Gene Ontology Annotation: Molecular function=actin binding; Cellular component=cytoskeleton; Biological process=muscle contraction
  misc_feature: Pfam annotation: Pfam_ID=CH; Match level="Score=92.2, E-value=1.3e -24, Copies=1"; Pfam description=Calponin homology (CH) domain
MSLETRAAKSGLAAETQKRVNAKYSEDLAKESLEWIVTITGDELNTAGDMDNFYEVLKDGTVLCKLVNNIQPGIVKKINTSTMAFKCMENINAFLEAAKQLGVPPQETFQTVDLWERQNLNSVVICLQSLGRKADKYGKQSIGPKEAEKNERMFSEEKLRAGQTIIGLQMGSNKGATQSGINFGNTRHM

SEQ ID NO: 21434 - protein, 190 aa, Diabrotica virgifera
  misc_feature: Coding regions on vcDNA: vcDNA=SeqID_1131; Strand=+; Position=2-574
  misc_feature: Homolog annotation: Hit_ID=EAA04742.3; Match level="QueryCoverage =96%, HitCoverage=6%, E-value=3e-13, Identity=30%"; Hit description =ENSANGP00000009384 [Anopheles gambiae str. PEST] ref|XP_564690.1| ENSANGP00000009384 [Anopheles gambiae str
QHLQQYLETEDSTTLSLSEHEKVQADQTLTQRDWRRQKQTLERKVHEEDSTLLKLDERTTETSQQDTAIKDWRKRRDRGDEKIKEDLKEETQTLETEEKVPQEPVPWNQQEITLKKTPRQRKEVQKETLEEVTLKPFRKSSATSQTVEETTTVTTQRKPDKVHTEESSLLKLTAAESIEETKKQETKGWR

SEQ ID NO: 21435 - protein, 493 aa, Diabrotica virgifera
  misc_feature: Coding regions on vcDNA: vcDNA=SeqID_1132; Strand=+; Position=6-1484
  misc_feature: Homolog annotation: Hit_ID=NP_728180.1; Match level="QueryCoverage =95%, HitCoverage=92%, E-value=1e-177, Identity=65%"; Hit description= CG6335-PA, isoform A [Drosophila melanogaster] gb|AAF48856.1| CG6335 -PA, isoform A [Drosophila
  misc_feature: Gene Ontology Annotation: Molecular function=ATP binding; Cellular component=cytoplasm; Biological process=protein biosynthesis
  misc_feature: Pfam annotation: Pfam_ID=tRNA-synt_2b; Match level="Score=114.6, E -value=2.5e-31, Copies=1"; Pfam description=tRNA synthetase class II core domain
  misc_feature (453)..(453): Xaa can be any naturally occurring amino acid
  misc_feature (460)..(460): Xaa can be any naturally occurring amino acid
MWHRLFRCRNLSPVLALSKMSTNQLLDVKIKEQADLVRNLKASKEPKEKIAQEVEKLLALKAQLQIDDGITSNNQKFVLKTPKGTRDFAPEQMSLRLEVMDKITSVFKKHGAVTIDTPVFELKEVLTGKYGEDSKLIYDLKDQGGEILALRYDLTVPFARYLAMNKVTNIKRYHIAKVYRRDNPSITKGRYREFYQCDFDIAGSYDPMIPDAECVKIMYEILTLLEMSPFVIKLNHRKLLDGMLEVCGVPTDSIRTICSSIDKLDKSPWEEVRKEMVEEKNLSPEVADKIGEYVRLNGKADLVEKLQQNEVLSKNKSAQEGLEAMKLLLNYCDLYNTSDKILFDLSLARGLDYYTGVIYEAVLLKDDTVGGDISVGSVAGGGRYDNLVGMFNQKGKDVPCVGASIGVERLFTIIEARQANSTTKCRKTDIDAYVASAQKNLLEERMKLCSELXDKGFKVXHSYKKNPKLLAQLQHCEENGIPFAIVLGESEIK

SEQ ID NO: 21436 - protein, 453 aa, Diabrotica virgifera
  misc_feature: Coding regions on vcDNA: vcDNA=SeqID_1133; Strand=+; Position=152-1511
  misc_feature: Homolog annotation: Hit_ID=XP_220770.2; Match level="QueryCoverage =98%, HitCoverage=91%, E-value=1e-166, Identity=61%"; Hit description= similar to Notchless gene homolog; similar to hypothetical protein similar to
  misc_feature: Gene Ontology Annotation: Molecular function=molecular_function unknown; Cellular component=cellular_component unknown; Biological process=biological_process unknown
  misc_feature: Pfam annotation: Pfam_ID=WD40; Match level="Score=259.2, E-value=7.3e- 75, Copies=7"; Pfam description=WD domain, G-beta repeat
  misc_feature (180)..(180): Xaa can be any naturally occurring amino acid
  misc_feature (204)..(204): Xaa can be any naturally occurring amino acid
  misc_feature (396)..(396): Xaa can be any naturally occurring amino acid
  misc_feature (422)..(422): Xaa can be any naturally occurring amino acid
  misc_feature (434)..(434): Xaa can be any naturally occurring amino acid
  misc_feature (440)..(440): Xaa can be any naturally occurring amino acid
MENEGEAVTEQKRLLCCFKSENGEVAGDMMDLPIDCSLQQLTLICNALLKQEEPVPYLFYVNENEITHTLEKALNIRELNTEGVVDIIYQQQAVFRVRPVTRCTSSIPGHAEAVISVSFSPDGKHLASGSGDTTVRFWDVDTQSPLYTCEGHKNWTLGIAWSSDSTKLASACKDGKIIIXDPFTGKQIGKTLTGHKQWITSLSXEPYHKNPECRYLASSSKDGDVRIWDTVLSNTFFCISGHTKSVTMVKWGGAGLIYSASQDRTVKVWRAKDGVLCRTLEGHAHWVNTLALNTDYILRIGAFDPVKDSNKDTLMPDKKKSQDFALKRYYEVTESIGERLVSGSDDFTLFLWNPDKDKKPLARLTGHQQLVNDVKFSPDGRILASASFDKSIKLWXGKTGKFICTLRGHVQAVYMVSFSADXRLMVSGSADSTXKLWNLXNRKLEVDLPGHAD

SEQ ID NO: 21437 - protein, 213 aa, Diabrotica virgifera
  misc_feature: Coding regions on vcDNA: vcDNA=SeqID_1134; Strand=+; Position=371-1012
  misc_feature: Homolog annotation: Hit_ID=XP_319886.1; Match level="QueryCoverage =100%, HitCoverage=64%, E-value=7e-61, Identity=39%"; Hit description= ENSANGP00000010634 [Anopheles gambiae]
  misc_feature: Gene Ontology Annotation: Molecular function=lipid transporter activity; Cellular component=mitochondrial inner membrane; Biological process=transport
  misc_feature: Pfam annotation: Pfam_ID=Mito_carr; Match level="Score=168.5, E-value= 1.4e-47, Copies=2"; Pfam description=Mitochondrial carrier protein
MSLDFIAGCVGGVAGVFVGHPLDTVKVNLQTQCAVNPQYRGTVHCIKSLMAKEGIKGIYRGVTSPALGVATLNAVVFGVYANVQKYSTNPESLSSHAVAGAAAGFFTSVISSPMELVKSRMQVAGAQAGKSPLDCLLRIYKQRKLLGVFQGYGITLIRDVPAFTTYFVSYEYLARTEEGQVPSSATILFAGGMAGVISWIIPYPLDVLKSKIQ

SEQ ID NO: 21438 - protein, 281 aa, Diabrotica virgifera
  misc_feature: Coding regions on vcDNA: vcDNA=SeqID_1135; Strand=+; Position=96-938
  misc_feature: Homolog annotation: Hit_ID=XP_392002.1; Match level="QueryCoverage =99%, HitCoverage=44%, E-value=9e-53, Identity=37%"; Hit description =similar to ENSANGP00000024998 [Apis mellifera]
  misc_feature (276)..(276): Xaa can be any naturally occurring amino acid
MLLILLLLVALCAAVYYYVFVPLTFWRKNEVKQKGLFASFLDTFVFLKKKSVADLVTTWYGEFPNTRYSGIYQFGNPVLILRDPDLIKQIWIKDFEHFTDRRTYIPEDLDPLFGKSIFSLKGERWKNMRSIVSPTFTSSKMKYMFVLIKECCDNFTNYFLKQGSHIQEVQFKDASGRFCTDVIASIAFGINLDSLDQKDNEFYAMVSRVSNLNKFSKLIRFMGFLLAPKLYRFLGLKLSDKEETSFFVNLVNDSIQQREEKGIVRPDTIQLLVETXKNEKP

SEQ ID NO: 21439 - protein, 204 aa, Diabrotica virgifera
  misc_feature: Coding regions on vcDNA: vcDNA=SeqID_1136; Strand=+; Position=302-913
  misc_feature: Homolog annotation: Hit_ID=XP_307863.1; Match level="QueryCoverage =97%, HitCoverage=50%, E-value=1e-101, Identity=86%"; Hit description= ENSANGP00000018620 [Anopheles gambiae] gb|EAA03629.2| ENSANGP00000018620 [Anopheles gambiae
  misc_feature: Gene Ontology Annotation: Molecular function=methionine adenosyltransferase activity; Cellular component=cytoplasm; Biological process=amino acid metabolism
  misc_feature: Pfam annotation: Pfam_ID=S-AdoMet_synt_N; Match level="Score=227.5, E- value=2.5e-65, Copies=1"; Pfam description=S-adenosylmethionine synthetase, N-te
MPETTSTNGYSNGHSGYEMADGAEFLFTSESVGEGHPDKMCDQISDAILDAHLEQDPNAKVACETVAKTGMILLAGEITSKAVVDYQKVVRQTVKHIGYDDSSKGFDHKTCNVLLALDQQSPDIAAGVHINKNEEEIGAGDQGLMFGYATDETEECMPLTVVLAHRLNHKIADLRRSGEFWWARPDSKTQVTAEYTFQRGACIP

SEQ ID NO: 21440 - protein, 116 aa, Diabrotica virgifera
  misc_feature: Coding regions on vcDNA: vcDNA=SeqID_1137; Strand=-; Position=266-616
  misc_feature: Homolog annotation: Hit_ID=AAT92174.1; Match level="QueryCoverage =96%, HitCoverage=100%, E-value=1e-52, Identity=87%"; Hit description= ribosomal protein L30 [Ixodes pacificus]
  misc_feature: Gene Ontology Annotation: Cellular component=cytosolic ribosome (sensu Eukarya); Biological process=protein biosynthesis
  misc_feature: Pfam annotation: Pfam_ID=Ribosomal_L7Ae; Match level="Score=114.7, E -value=2.3e-31, Copies=1"; Pfam description=Ribosomal protein L7Ae/L30e/S12e/Gadd
MVAQKKQKKAIESINSRLALVMKSGKYCLGYKQTLKTLRQGKSKLIIISNNTPPLRKSEIEYYAMLAKTGVHHYSGNNVELGTACGKYFRVCAMSITDPGDSDIIRSMPASEGGEK

SEQ ID NO: 21441 - protein, 280 aa, Diabrotica virgifera
  misc_feature: Coding regions on vcDNA: vcDNA=SeqID_1138; Strand=+; Position=414-1354
  misc_feature: Homolog annotation: Hit_ID=XP_307863.1; Match level="QueryCoverage =92%, HitCoverage=63%, E-value=1e-124, Identity=82%"; Hit description= ENSANGP00000018620 [Anopheles gambiae] gb|EAA03629.2| ENSANGP00000018620 [Anopheles gambiae
  misc_feature: Gene Ontology Annotation: Molecular function=methionine adenosyltransferase activity; Cellular component=cytoplasm; Biological process=amino acid metabolism
  misc_feature: Pfam annotation: Pfam_ID=S-AdoMet_synt_M; Match level="Score=300.5, E- value=2.7e-87, Copies=1"; Pfam description=S-adenosylmethionine synthetase, cent
MPETTSTNGYSNGHSGYEMADGAEFLFTSESVGEGHPDKMCDQISDAILDAHLEQDPNAKVACETVAKTGMILLAGEITSKAVVDYQKVVRQTVKHIGYDDSSKGFDWRTLNLLTCNVLLALDQQSPDIAAGVHINKNEEEIGAGDQGLMFGYATDETEECMPLTVVLAHRLNHKIADLRRSGEFWWARPDSKTQVTAEYTFQRGACIPQRVHTVVVSLQHSDKISLEKLRTEIKEKVIKEVIPGPYLDDQTVIHINPCGLFIISFLFSGRDPPKGRQGA

SEQ ID NO: 21442 - protein, 238 aa, Diabrotica virgifera
  misc_feature: Coding regions on vcDNA: vcDNA=SeqID_1139; Strand=+; Position=309-1024
  misc_feature: Homolog annotation: Hit_ID=XP_307863.1; Match level="QueryCoverage =89%, HitCoverage=53%, E-value=1e-100, Identity=82%"; Hit description= ENSANGP00000018620 [Anopheles gambiae] gb|EAA03629.2| ENSANGP00000018620 [Anopheles gambiae
  misc_feature: Gene Ontology Annotation: Molecular function=methionine adenosyltransferase activity; Cellular component=cytoplasm; Biological process=amino acid metabolism
  misc_feature: Pfam annotation: Pfam_ID=S-AdoMet_synt_N; Match level="Score=218.7, E- value=1.1e-62, Copies=1"; Pfam description=S-adenosylmethionine synthetase, N-te
  misc_feature (187)..(187): Xaa can be any naturally occurring amino acid
MPETTSTNGYSNGHSGYEMADGAEFLFTSESVGEGHPDKMCDQISDAILDAHLEQDPNAKVACETVAKTGMILLAGEITSKAVVDYQKVVRQTVKHIGYDDSSKGFDWRTLNLLVALEEQSPNIAEGVHGNRDELEIGAGDQGLMFGYATDETEECMPLTVVLAHRLNHKIADLRRSGEFWWARPDXKTQVTAEYTFQRGACIPQRVHTVASLQKNYKYFYNKNFNFLALLNSKIINI

SEQ ID NO: 21443 - protein, 403 aa, Diabrotica virgifera
  misc_feature: Coding regions on vcDNA: vcDNA=SeqID_1140; Strand=+; Position=317-1525
  misc_feature: Homolog annotation: Hit_ID=XP_307863.1; Match level="QueryCoverage =97%, HitCoverage=98%, E-value=0.0, Identity=82%"; Hit description =ENSANGP00000018620 [Anopheles gambiae] gb|EAA03629.2| ENSANGP00000018620 [Anopheles gambiae
  misc_feature: Gene Ontology Annotation: Molecular function=methionine adenosyltransferase activity; Cellular component=cytoplasm; Biological process=amino acid metabolism
  misc_feature: Pfam annotation: Pfam_ID=S-AdoMet_synt_M; Match level="Score=307.0, E- value=3e-89, Copies=1"; Pfam description=S-adenosylmethionine synthetase, cent
  misc_feature (345)..(345): Xaa can be any naturally occurring amino acid
  misc_feature (366)..(366): Xaa can be any naturally occurring amino acid
  misc_feature (374)..(374): Xaa can be any naturally occurring amino acid
MPETTSTNGYSNGHSGYEMADGAEFLFTSESVGEGHPDKMCDQISDAILDAHLEQDPNAKVACETVAKTGMILLAGEITSKAVVDYQKVVRQTVKHIGYDDSSKGFDWRTLNLLVALEEQSPNIAEGVHGNRDELEIGAGDQGLMFGYATDETEECMPLTVVLAHRLNHKIADLRRSGEFWWARPDSKTQVTAEYTFQRGACIPQRVHTVVVSLQHSDKISLEELRTEIKEKVIKEVIPAKYLDDQTVIHINPCGLFIIGGPQSDAGLTGRKIIVDTYGGWGAHGGGAFSGKDFTKVDRSAAYAARWVAKSLVKAGLCRRCLVQVSYAIGLAEPLSITVFDYGTXKLTQNFLLDIFNKNPPLRHGXNVKELNLXTPFYQKTSTYGHFGRDGFTWEQPKTLQLN

SEQ ID NO: 21444 - protein, 403 aa, Diabrotica virgifera
  misc_feature: Coding regions on vcDNA: vcDNA=SeqID_1141; Strand=+; Position=330-1541
  misc_feature: Homolog annotation: Hit_ID=XP_307863.1; Match level="QueryCoverage =97%, HitCoverage=98%, E-value=0.0, Identity=86%"; Hit description =ENSANGP00000018620 [Anopheles gambiae] gb|EAA03629.2| ENSANGP00000018620 [Anopheles gambiae
  misc_feature: Gene Ontology Annotation: Molecular function=methionine adenosyltransferase activity; Cellular component=cytoplasm; Biological process=amino acid metabolism
  misc_feature: Pfam annotation: Pfam_ID=S-AdoMet_synt_C; Match level="Score=317.6, E- value=1.9e-92, Copies=1"; Pfam description=S-adenosylmethionine synthetase, C-te
MPETTSTNGYSNGHSGYEMADGAEFLFTSESVGEGHPDKMCDQISDAILDAHLEQDPNAKVACETVAKTGMILLAGEITSKAVVDYQKVVRQTVKHIGYDDSSKGFDHKTCNVLLALDQQSPDIAAGVHINKNEEEIGAGDQGLMFGYATDETEECMPLTVVLAHRLNHKIADLRRSGEFWWARPDSKTQVTAEYTFQRGACIPQRVHTVVVSLQHSDKISLEELRTEIKEKVIKEVIPAKYLDDQTVIHINPCGLFIIGGPQSDAGLTGRKIIVDTYGGWGAHGGGAFSGKDFTKVDRSAAYAARWVAKSLVKAGLCRRCLVQVSYAIGLAEPLSITVFDYGTSKLTQKELLDIVNKNFDLRPGKIVKELNLRQPIYQKTSTYGHFGRDGFTWEQPKTLQLN

SEQ ID NO: 21445 - protein, 346 aa, Diabrotica virgifera
  misc_feature: Coding regions on vcDNA: vcDNA=SeqID_1142; Strand=+; Position=32-1072
  misc_feature: Homolog annotation: Hit_ID=XP_308390.1; Match level="QueryCoverage =87%, HitCoverage=69%, E-value=5e-43, Identity=33%"; Hit description =ENSANGP00000009437 [Anopheles gambiae]
  misc_feature: Gene Ontology Annotation: Molecular function=glucose transporter activity; Cellular component=plasma membrane; Biological process =glucose transport
  misc_feature: Pfam annotation: Pfam_ID=Sugar_tr; Match level="Score=-49.3, E-value =1.5e-05, Copies=1"; Pfam description=Sugar (and other) transporter
QESKPLSYYCLTYKPTYIIFIIFEFVKFLKNYLFLGTLNAISDGMQYGWTAPVLPILLGPDSPVPITEWEGEMLETFLWVGSLSCLPLTMYLVDKIGRKNSILLAAVLTLTVWVITALAPSVEYLYVARFLAGTASNTAYVSTPMYIAEIAEQKIRGFLSSLIYLMMLLGIFLIYAVAPYIPYYAHCTLGAILACLELGIFPFMPESPYFLVFKGKHEEAKKSLEWLRPEGADVETELNEINAAIERQKTEKDKIWDLFIVPSYRKGIIIMFVLNGAQHFSSISVLLMNLHIILEAAGSTYIDPATAGILFAFILLLAATVASVSVDNMAEDSLNFVSYLVYVFLY

SEQ ID NO: 21446 - protein, 55 aa, Diabrotica virgifera
  misc_feature: Coding regions on vcDNA: vcDNA=SeqID_1143; Strand=-; Position=1588 -1755
  misc_feature: Homolog annotation: Hit_ID=ZP_00357698.1; Match level="QueryCoverage =96%, HitCoverage=37%, E-value=3e-14, Identity=66%"; Hit description =hypothetical protein Chlo02002738 [Chloroflexus aurantiacus]
CYPSPFFCIFVILFFFFFLLLFFFFFFFFFFFFFFFFFFFFFFFFFFFSAMIYIS

SEQ ID NO: 21447 - protein, 445 aa, Diabrotica virgifera
  misc_feature: Coding regions on vcDNA: vcDNA=SeqID_1144; Strand=+; Position=50-1383
  misc_feature: Homolog annotation: Hit_ID=CAH64510.1; Match level="QueryCoverage =99%, HitCoverage=83%, E-value=1e-106, Identity=46%"; Hit description= putative esterase [Tribolium castaneum]
  misc_feature: Gene Ontology Annotation: Molecular function=carboxylesterase activity; Cellular component=synaptic junction
  misc_feature: Pfam annotation: Pfam_ID=COesterase; Match level="Score=350.9, E -value=1.8e-102, Copies=1"; Pfam description=Carboxylesterase
  misc_feature (71)..(71): Xaa can be any naturally occurring amino acid
  misc_feature (388)..(388): Xaa can be any naturally occurring amino acid
  misc_feature (414)..(415): Xaa can be any naturally occurring amino acid
  misc_feature (422)..(422): Xaa can be any naturally occurring amino acid
  misc_feature (424)..(424): Xaa can be any naturally occurring amino acid
  misc_feature (429)..(429): Xaa can be any naturally occurring amino acid
  misc_feature (431)..(431): Xaa can be any naturally occurring amino acid
MDSPIVEVTEGQLRGCLRKDHAGQEIFAFLGVPYAQPPINSLRFKAPEPVKHWGGIKDANKEGDPCYSRNXFYREYLGSEDCLYLNVFTRELPNVSKKLKPVMVWIHGGGYISDSSCVDIFGPDFLITEDIVFVSMNYRLGLLGFLALDDTTLEVPGNAGLKDQNLALQWIKRNIEHFNGDPNNITLFGNSAGASSVHFHILSDKSAGLFHKAILQSGTVFNPWNWGRNDINEILLKAGKVVQSEQEALEILNDMPYKELYKIQEKLHDSICANLYRPVGPVIEKPNKSAFITRSPIEIFRSGNYYKVPMIFGTNKTEGMFVEYNELIFPRFKPPTMSIENAIPWDLQLQEGSAKYNEVKKKLQDYYSAPTRHNDKYLPFSTSLYFLXIVAAVENHVKTSDVPVYFYKFVFEGXXSCVKIAXGXSHLPXTXHADEVALCVKNKFL

SEQ ID NO: 21448 - protein, 229 aa, Diabrotica virgifera
  misc_feature: Coding regions on vcDNA: vcDNA=SeqID_1145; Strand=-; Position=380-1069
  misc_feature: Homolog annotation: Hit_ID=ZP_00357698.1; Match level="QueryCoverage =33%, HitCoverage=36%, E-value=2e-19, Identity=64%"; Hit description =hypothetical protein Chlo02002738 [Chloroflexus aurantiacus]
KKILIVLCGRGGAGGVFIFFFLIIFYVGGAGGGGGGGAHFSFFFLKIKTGEGGCVCVFLLTYPPFSFFPRSVFFQKHKRNFFFLSWPGGKIKNPFFIKFFFINFFLGGGGPLKKKKRGGPPKTTQKEAPFFGGEKKKKTWGGGGVFFGGGHTLFFFLGGEKKKWVGKFFFFFFFFFFFFFFFFFFFFFFFFFFFFFFFFFFFFFFFFFFFFFFFFFFFYYKQNLIISFS

SEQ ID NO: 21449 - protein, 382 aa, Diabrotica virgifera
  misc_feature: Coding regions on vcDNA: vcDNA=SeqID_1146; Strand=+; Position=1-1146
VAFSSNPQNALQTELSSYPGVPGYDDDLPESELFLNSVSLEEREEFYPIIKFLSDFHVTPEQIEELLQPENRDKLGLLIEVLLTKAKQKDIQDQLREELEREKEIDDVGVDEQDFNNGDEGVWGPPIDFPESRIYYDENDEDHENSESGSGYPVNSEFFRERQLRNDNVYEELNNMVDDRPGVYSEGGVVWSEPVNMKENVPQHRLLKNNLNQILQKYKAFKRPERLDVKKPGPPFDSLTEINENKGKIEPRTKPKDILLPSMMKKEPRGAHPYPDMEPPQQRRDADLEYVYVTLKNILTSWSQGNNIIQNIFEHLEIRSQSFCGWEELLAWIPGSPSKVPTKISRGIKNGYLKVGKIVGGEWKGQTGNKQLGVEKIFIGGG

SEQ ID NO: 21450 - protein, 108 aa, Diabrotica virgifera
  misc_feature: Coding regions on vcDNA: vcDNA=SeqID_1147; Strand=+; Position=275-601
TVETTGPYLPCILFVNDLPDHITHDHIVMYADDSSVIVSAHTYVELQNRVSRVIRLFQTWCTQNLLQLNIDKTSYIHFRCKRNMPVVSIPEIVNVPNIKFLGVFLDQL

SEQ ID NO: 21451 - protein, 117 aa, Diabrotica virgifera
  misc_feature: Coding regions on vcDNA: vcDNA=SeqID_1148; Strand=+; Position=45-398
  misc_feature: Homolog annotation: Hit_ID=AAL62471.1; Match level="QueryCoverage =100%, HitCoverage=97%, E-value=7e-52, Identity=87%"; Hit description= ribosomal protein L34 [Spodoptera frugiperda]
  misc_feature: Gene Ontology Annotation: Molecular function=structural constituent of ribosome; Cellular component=cytosolic large ribosomal subunit (sensu Eukarya); Biological process=protein biosynthesis
  misc_feature: Pfam annotation: Pfam_ID=Ribosomal_L34e; Match level="Score=208.2, E -value=1.7e-59, Copies=1"; Pfam description=Ribosomal protein L34e
MVQRLVFRRRLSYNTKSNRRRIVRTPGGKLVYQYLKKPKKIPRCGQCKDKLRGILPARPQERSRLCRRKKTVKRAYGGVLCHKCVKEKIVRAFLIEEQKIVVKVLKAQQAVVKPSKK

SEQ ID NO: 21452 - protein, 265 aa, Diabrotica virgifera
  misc_feature: Coding regions on vcDNA: vcDNA=SeqID_1149; Strand=+; Position=95-889
  misc_feature: Homolog annotation: Hit_ID=XP_309617.1; Match level="QueryCoverage =91%, HitCoverage=58%, E-value=4e-55, Identity=44%"; Hit description =ENSANGP00000010140 [Anopheles gambiae]
  misc_feature: Gene Ontology Annotation: Molecular function=molecular_function unknown; Cellular component=cellular_component unknown; Biological process=biological_process unknown
  misc_feature: Pfam annotation: Pfam_ID=Str_synth; Match level="Score=11.0, E-value =1.8e-11, Copies=1"; Pfam description=Strictosidine synthase
FISFLFLLFENNASIIIAIWHFYPLTMGFIGGILKFLVNRLLELSIVVVIILFIPNLPPYSQFTKSVKLPPPHPLKGSLSLNQKLNNVEIKYQGRLSGPESFSEYDGELYTGLNSGDIVKLTGNHISPIAKTGKPCKAQYEERICGRPLGLKFHKGLLYVADAYYGILSININNGKKKVLVSPDQIIDGKQSKWFNGIAVAKNGDIFWTDSSSTFHLENGLFELLSDPSGRLVHYDAKTKMNTVLIDQIHAANGVALSDDEDFVL

SEQ ID NO: 21453 - protein, 275 aa, Diabrotica virgifera
  misc_feature: Coding regions on vcDNA: vcDNA=SeqID_1150; Strand=+; Position=268-1091
  misc_feature: Homolog annotation: Hit_ID=EAL38532.1; Match level="QueryCoverage =97%, HitCoverage=20%, E-value=6e-78, Identity=51%"; Hit description =ENSANGP00000026123 [Anopheles gambiae str. PEST] ref|XP_551022.1| ENSANGP00000026123 [Anopheles gambiae st
  misc_feature: Gene Ontology Annotation: Molecular function=15-hydroxyprostaglandin dehydrogenase (NAD+) activity; Cellular component=cellular_component unknown; Biological process=biological_process unknown
  misc_feature (253)..(253): Xaa can be any naturally occurring amino acid
  misc_feature (265)..(265): Xaa can be any naturally occurring amino acid
MEMTKEKYNPNPRETANILSALFFGYTYDVFKKGLSKTLEVDDLYNPLKSDRSKVLGDNLQRNWDKQLEKSKKSNSKPSLLKAIVMSFWLEYAKLGIYTITTDLVLRLIQPLILGNLLDYFKPEAQVSKNEALTYAGILVAINILNILMSNQYMLEVFHSGMRIRASCCAVIYRKSLKLSKTALGETASGKLVNLLSNDVSRFDLVSLFIHQLWIAPVLSLIVMGILYQRTGYAGVVGVVAVFVIVPFQTYTXKISGIYRKQTAXQTDERVRLMD

SEQ ID NO: 21454 - protein, 74 aa, Diabrotica virgifera
  misc_feature: Coding regions on vcDNA: vcDNA=SeqID_1151; Strand=+; Position=412-636
IRYKSIVIKSHTSPSILTICVHTLLLHHLHNTMNHAFIYLLRRITIPTSNISRYSLSDIYERIYDIIGRPFFFF

SEQ ID NO: 21455 - protein, 419 aa, Diabrotica virgifera
  misc_feature: Coding regions on vcDNA: vcDNA=SeqID_1152; Strand=+; Position=2-1261
  misc_feature: Homolog annotation: Hit_ID=AAB53258.1; Match level="QueryCoverage =94%, HitCoverage=16%, E-value=1e-103, Identity=46%"; Hit description= p270 [Bombyx mori] pir||T18201 fatty-acid synthase homolog p270 - silkworm
  misc_feature: Gene Ontology Annotation: Cellular component=mitochondrion; Biological process=polar body extrusion after meiotic divisions
  misc_feature: Pfam annotation: Pfam_ID=ADH_zinc_N; Match level="Score=156.8, E -value=4.8e-44, Copies=1"; Pfam description=Zinc-binding dehydrogenase
  misc_feature (355)..(355): Xaa can be any naturally occurring amino acid
  misc_feature (388)..(388): Xaa can be any naturally occurring amino acid
GFFNCLKREPETNYMRSLFMFDSDQPFDKDSAFYKSQLSKQMAVNIWKDNQWGTYRHLVLKNLDNVESEHCYANITVRGDLSSLRWIESTYKYDMVLPTEKSLVYIHYASLNFRDVMTASGRINADVITQDRIEQEFVQGFEFSGYTAEGKRVMGLVTHGALATLMLADDYLLFEVPDNMSLQDAASMTCVYSSVIYGLVTRANMKRGSSILIHSGTGGVGQSAIRLALDFRCNIFVTVGTKEKREYLLKTFPQIKPHQIGNSRDISFETMVKKYTGGRGVDVVLNSLAEEKLQASIRCLAPGGSFVEIGKFDLANNNEINLLLMQKECSFHGVMLDQIFTETPKTKKEVARFFXENVGEGKFIVPLPITCFRYDQLEEAFRHMATGXHMGKSMIKYETWSNASPSPEKLEEYQYFATP

SEQ ID NO: 21456 - protein, 193 aa, Diabrotica virgifera
  misc_feature: Coding regions on vcDNA: vcDNA=SeqID_1153; Strand=+; Position=124-705
  misc_feature: Homolog annotation: Hit_ID=NP_996265.1; Match level="QueryCoverage =100%, HitCoverage=100%, E-value=1e-93, Identity=84%"; Hit description=CG7073-PE, isoform E [Drosophila melanogaster] ref|NP _732719.1| CG7073-PD, isoform D [Drosophila
  misc_feature: Gene Ontology Annotation: Molecular function=ATP binding; Cellular component=nuclear membrane; Biological process=small GTPase mediated signal transduction
  misc_feature: Pfam annotation: Pfam_ID=Arf; Match level="Score=326.8, E-value=3.3e -95, Copies=1"; Pfam description=ADP-ribosylation factor family
MFLWDWFTGMLGYLGLWKKSGKLLFLGLDNAGKTTLLHMLKDDRLAQHLPTLHPTSEELSIGNMRFTTFDLGGHEQARRVWRDYFPAVDAIVFLVDANDSSRFVESQEQLNALLSDETLSNCPILILGNKIDLPGAASEDELRTRFGLFGQTTGKGKVARNDLPGRPLELFMCSILKRQGNGEGFRCLAQYID

SEQ ID NO: 21457 - protein, 249 aa, Diabrotica virgifera
  misc_feature: Coding regions on vcDNA: vcDNA=SeqID_1154; Strand=+; Position=126-875
  misc_feature: Homolog annotation: Hit_ID=Q9NHW7; Match level="QueryCoverage=95%, HitCoverage=95%, E-value=6e-70, Identity=52%"; Hit description =Aquaporin AQPAe.a gb|AAF64037.1| aquaporin [Aedes aegypti]
  misc_feature: Gene Ontology Annotation: Molecular function=water transporter activity; Cellular component=integral to plasma membrane; Biological process=transport
  misc_feature: Pfam annotation: Pfam_ID=MIP; Match level="Score=272.5, E-value=7e -79, Copies=1"; Pfam description=Major intrinsic protein
MGRTGDESDDGILGVSEFTKNKNIWKALLAECLGTFLLVFIGCGSCINMIEGDGGAIIKISFAFGLTIATVVQAIAHVSGGHINPAVTFSFVCTGDVKIVKGLCYLVVQCIGAIGGSGLLKLVVPDSKVGGFGLTDTHDSLSDVQGMVMEAALTFMFLLVIQGVCDAYRKDLKGSGPLAIGLAAVACHLTGIPYTGSSINPARSFGPAVIMNHWHHHWIYWVGPLLGGGLAGVIYKILFKVRKDESYDL

SEQ ID NO: 21458 - protein, 457 aa, Diabrotica virgifera
  misc_feature: Coding regions on vcDNA: vcDNA=SeqID_1155; Strand=+; Position=131-1504
  misc_feature: Homolog annotation: Hit_ID=XP_393283.1; Match level="QueryCoverage =86%, HitCoverage=98%, E-value=1e-119, Identity=52%"; Hit description= similar to GM06507p [Apis mellifera]
  misc_feature: Gene Ontology Annotation: Molecular function=peroxidase activity; Cellular component=extracellular space; Biological process=protein targeting
  misc_feature: Pfam annotation: Pfam_ID=Peptidase_C1; Match level="Score=232.5, E -value=7.9e-67, Copies=1"; Pfam description=Papain family cysteine protease
MIRHYILGCVLASSLILLVSSFRGDDFADLPGPYCENIGCCNNRLDSCSVPILGTLCYCDEFCNSSRVDDCCPDYWSHCRGITFPTTERTRPTPPQPPENITGCQWGDRTLFLNQKVKDNCNECTCARQSELLCERNVCLVDQNIIETVNRNPDEFGWTAQNYSEFWGRTLDDGVQFRLGTLPPQRFVMTMNPVKRIYDPNSLPRDFDSNSVWRGLITGIQDQGWCGSSWAISTAAVASDRYGIVSKGKEAVTLSAQNLVSCDTQGQQSCTGGHLDRAWSFTKAYGLVDEDCFPYVARNERCTIKRRGTLEAAGCRQQRFAERRGRYTVGPAYRLGNETDIMYEITRSGPVQATMKVYHDLFTYSGGIYKHSDLAVNHKQGYHSVRIVGWGEEYNYRGVQKYWKVANSWGANWGEDGYFRIVRGTNECEIESFVIASWPHVSRKILLSNELGTNSVY

SEQ ID NO: 21459 - protein, 294 aa, Diabrotica virgifera
  misc_feature: Coding regions on vcDNA: vcDNA=SeqID_1156; Strand=+; Position=95-980
  misc_feature: Homolog annotation: Hit_ID=CAC14874.1; Match level="QueryCoverage =96%, HitCoverage=65%, E-value=2e-59, Identity=42%"; Hit description =zinc/iron regulated transporter-related protein 3, DZIP3 protein [Drosophila melanogaster]
  misc_feature: Gene Ontology Annotation: Molecular function=zinc ion transporter activity; Cellular component=integral to plasma membrane; Biological process=zinc ion transport
  misc_feature: Pfam annotation: Pfam_ID=Zip; Match level="Score=115.8, E-value=1e -31, Copies=1"; Pfam description=ZIP Zinc transporter
  misc_feature (259)..(259): Xaa can be any naturally occurring amino acid
MPPRVLLHSHHDHLEHQDSEGNATLAKATAMCVLFTASFIIGNIPIKLNQWLNWSSDAKSNSYVKLLLGLGGGVLLCTTFIHLLPEVSEHFEELDLTPNIEIHYAEVLMCIGFFIMYLVEECVHVYLEYKEKPPDMKIPLEPVDVDLGLALKRSISIRRGEIPDIKKIRQELAVEAEHHGRHSHSHGHSHTPVHGGGSTVAIIRGLLVVLALSVHELFEGLAVGLESSPSTVWYMFGAVAAHKLVIAFCIGVELVTSGXKTYLVIVYVFMFAVVSRAGIGMGILAPEMTAPQLH

SEQ ID NO: 21460 - protein, 392 aa, Diabrotica virgifera
  misc_feature: Coding regions on vcDNA: vcDNA=SeqID_1157; Strand=+; Position=3-1182
  misc_feature: Homolog annotation: Hit_ID=XP_311385.1; Match level="QueryCoverage =93%, HitCoverage=67%, E-value=9e-65, Identity=37%"; Hit description =ENSANGP00000000531 [Anopheles gambiae]
  misc_feature: Gene Ontology Annotation: Molecular function=ATP dependent RNA helicase activity; Cellular component=nucleolus; Biological process =nucleobase, nucleoside, nucleotide and nucleic acid metabolism
  misc_feature: Pfam annotation: Pfam_ID=Helicase_C; Match level="Score=104.2, E -value=3.3e-28, Copies=1"; Pfam description=Helicase conserved C -terminal domain
  misc_feature (272)..(272): Xaa can be any naturally occurring amino acid
TFQWIVVGNLCGGENRNTEKTRLRKGVHILIATPGRLLDHMLHTNAFKTNNVRCLILDEADRLLDMGFKKDIVRMVEELDNAKTNAEYNPLALLKKKSFTDNEDDDVIETTETENTSQKMPLGDPSSKVRQTVLLSATLNKGIAELADFTMKDHVYIDALDEFTTQNPEMMVIPNTVQQKFIVTHVKHRLFTLSALILSQAKTNSKVFVFMGTSMVDYHYELFTRYLIKMPRHRGQLANNQVMVLEEDEDSDDEEIVADVEIFKLHGNMDHXARKQVFTSFRAAKKGVLLCTDVVARGIDVPAADCIVQYNGPQSIEDYLHRAGRTGRAGKSGTSYIFLTHEEQDFVTEMEKHRVYLQKQDTERILESLSDIMEEPDFKKAATALQKRFESA

SEQ ID NO: 21461 - protein, 76 aa, Diabrotica virgifera
  misc_feature: Coding regions on vcDNA: vcDNA=SeqID_1158; Strand=+; Position=192-419
  misc_feature: Homolog annotation: Hit_ID=XP_395455.1; Match level="QueryCoverage =94%, HitCoverage=19%, E-value=1e-26, Identity=83%"; Hit description =similar to eukaryotic translation initiation factor 4A, isoform 1 [Apis mellifera]
  misc_feature: Gene Ontology Annotation: Molecular function=translation initiation factor activity; Cellular component=eukaryotic translation initiation factor 4 complex; Biological process=regulation of translational initiation
  misc_feature: Pfam annotation: Pfam_ID=Helicase_C; Match level="Score=60.2, E-value= 6e-15, Copies=1"; Pfam description=Helicase conserved C-terminal domain
TRYIQFKAENSHKRDFTVSAMHGDMEQRERDVIMRQFRTGSSRVLITTDLLARGIDVQQVSLVINYDLPSNREITF

SEQ ID NO: 21462 - protein, 418 aa, Diabrotica virgifera
  misc_feature: Coding regions on vcDNA: vcDNA=SeqID_1159; Strand=+; Position=20-1278
  misc_feature: Homolog annotation: Hit_ID=AAH12547.1; Match level="QueryCoverage =96%, HitCoverage=99%, E-value=1e-143, Identity=65%"; Hit description= Eukaryotic translation initiation factor 4A, isoform 2 [Homo sapiens] gb|AAH48105.1| Eukaryotic translati
  misc_feature: Gene Ontology Annotation: Molecular function=translation initiation factor activity; Cellular component=eukaryotic translation initiation factor 4 complex; Biological process=regulation of translational initiation
  misc_feature: Pfam annotation: Pfam_ID=Helicase_C; Match level="Score=125.8, E -value=1.1e-34, Copies=1"; Pfam description=Helicase conserved C -terminal domain
  misc_feature (80)..(80): Xaa can be any naturally occurring amino acid
  misc_feature (113)..(113): Xaa can be any naturally occurring amino acid
  misc_feature (132)..(132): Xaa can be any naturally occurring amino acid
  misc_feature (163)..(163): Xaa can be any naturally occurring amino acid
  misc_feature (214)..(214): Xaa can be any naturally occurring amino acid
MSMPDRREEWDKNGPANEDSQPQGYDGPPGMEPDGIIESNWEEVVDNFDDMNLKEELLRGIYAYGFELPSAIQQRVIIPXVLEIYGIDLYHTSSVKIDFFLISIINNFHILKXDIIYFYILLFLFFINFLLXINLNNLNLVMMMILVLKSCIFSKIYRSNRDXDKIFFHMPGRVYDMITRRYIRPTHIKMFVLDEADEMLSRGFKDQIHDVLKXLNTDVQVILLSATMPNDVLDVTKSFMRSPVRILVKKEELTLEGIKQFYVYVEKEDWKLETLCDLYDTLSITQAVIFCNTRRKVDWLTENMHKRDFTVSAMHGDMEQRERDVIMRQFRTGSSRVLITTDLLARGIDVQQVSLVINYDLPSNRENYIHRIGRGGRFGRKGVAINFVTDDDKRTLKDIEQFYNTKIDEMPMNVADLI

SEQ ID NO: 21463 - protein, 237 aa, Diabrotica virgifera
  misc_feature: Coding regions on vcDNA: vcDNA=SeqID_1160; Strand=+; Position=3-716
  misc_feature: Homolog annotation: Hit_ID=AAF64266.1; Match level="QueryCoverage =97%, HitCoverage=74%, E-value=1e-111, Identity=83%"; Hit description= BM-010 [Homo sapiens]
  misc_feature: Gene Ontology Annotation: Molecular function=translation initiation factor activity; Cellular component=eukaryotic translation initiation factor 4 complex; Biological process=regulation of translational initiation
  misc_feature: Pfam annotation: Pfam_ID=Helicase_C; Match level="Score=125.8, E -value=1.1e-34, Copies=1"; Pfam description=Helicase conserved C -terminal domain
AQASAHIKMFVLDEADEMLSRGFKDQIHDVFKMLNTDVQVILLSATMPNDVLDVTKSFMRSPVRILVKKEELTLEGIKQFYVYVEKEDWKLETLCDLYDTLSITQAVIFCNTRRKVDWLTENMHKRDFTVSAMHGDMEQRERDVIMRQFRTGSSRVLITTDLLARGIDVQQVSLVINYDLPSNRENYIHRIGRGGRFGRKGVAINFVTDDDKRTLKDIEQFYNTKIDEMPMNVADLI

SEQ ID NO: 21464 - protein, 408 aa, Diabrotica virgifera
  misc_feature: Coding regions on vcDNA: vcDNA=SeqID_1161; Strand=+; Position=331-1557
  misc_feature: Homolog annotation: Hit_ID=AAH12547.1; Match level="QueryCoverage =92%, HitCoverage=92%, E-value=1e-172, Identity=78%"; Hit description= Eukaryotic translation initiation factor 4A, isoform 2 [Homo sapiens] gb|AAH48105.1| Eukaryotic translati
  misc_feature: Gene Ontology Annotation: Molecular function=translation initiation factor activity; Cellular component=eukaryotic translation initiation factor 4 complex; Biological process=regulation of translational initiation
  misc_feature: Pfam annotation: Pfam_ID=DEAD; Match level="Score=210.5, E-value=3.3e- 60, Copies=1"; Pfam description=DEAD/DEAH box helicase
MSMPDRREEWDKNGPANEDSQPQGYDGPPGMEPDGIIESNWEEVVDNFDDMNLKEELLRGIYAYGFEKPSAIQQRAIIPCVKGHDVIAQAQSGTGKTATFSISILQQIDTSVRECQALILAPTRELAQQIQKVVIALGDFMSAQCHACIGGTNVREDIRKLETGVHVVVGTPGRVYDMITRRALRPTHIKMFVLDEADEMLSRGFKDQIHDVFKMLNTDVQVILLSATMPNDVLDVTKSFMRSPVRILVKKEELTLEGIKQFYVYVEKEDWKLETLCDLYDTLSITQAVIFCNTRRKVDWLTENMHKRDFTVSAMHGDMEQRERDVIMRQFRTGSSRVLITTDLLARGIDVQQVSLVINYDLPSNRENYIHRIGRVGRFGRKVVAIKIVTDALTLKFLQILKSHILYI

SEQ ID NO: 21465 - protein, 219 aa, Diabrotica virgifera
  misc_feature: Coding regions on vcDNA: vcDNA=SeqID_1162; Strand=+; Position=117-776
  misc_feature: Homolog annotation: Hit_ID=AAH79981.1; Match level="QueryCoverage =97%, HitCoverage=45%, E-value=6e-49, Identity=43%"; Hit description =MGC81123 protein [Xenopus laevis]
  misc_feature: Gene Ontology Annotation: Cellular component=membrane
MERSGGILSGLSALVGTTEPALKLLLTLLAGYPLALIHRKYLYNKERSLHHLFFITSGFLLGYWNYGGAIFHSVLAAFFTYCTLSILKGTSLSVAIVFLFNIGYLLIGYFYTSTESYDITWTMPQCIITLRLIGVAFDLYDGHQPVETLSSDSKKLALVQKPSILEIFGHSFFPSGFLIGPQFSMKRYLEFIDGHYNTRDGPPDSVVAAIKRGLLELHI

SEQ ID NO: 21466 - protein, 190 aa, Diabrotica virgifera
  misc_feature: Coding regions on vcDNA: vcDNA=SeqID_1163; Strand=+; Position=31-603
  misc_feature: Homolog annotation: Hit_ID=CAB88804.1; Match level="QueryCoverage =90%, HitCoverage=87%, E-value=2e-15, Identity=35%"; Hit description =glycine-rich protein [Triticum aestivum]
  misc_feature: Gene Ontology Annotation: Molecular function=structural molecule activity; Cellular component=intermediate filament; Biological process=epidermal differentiation
MYKYLLFVSLIGLSTCFPGIIDSGHGLSSWNGGGADWQKALASVGIGASLGHSPGLDDGHGQGSPDGSIGGDFHHGVSVVSTGGGNKGAVFDLTNQGDAGHHGAFGGSFVASSKYSAGGHGGDGGSSGGFGGHGGYGVSEGTGFAGHYSDVLGASQPVAGYDGGHLGGGHEALTALQGSIGGGEGLGGYH

SEQ ID NO: 21467 - protein, 303 aa, Diabrotica virgifera
  misc_feature: Coding regions on vcDNA: vcDNA=SeqID_1164; Strand=+; Position=17-928
  misc_feature: Homolog annotation: Hit_ID=XP_315007.1; Match level="QueryCoverage =66%, HitCoverage=65%, E-value=1e-45, Identity=46%"; Hit description =ENSANGP00000021318 [Anopheles gambiae]
  misc_feature: Gene Ontology Annotation: Molecular function=receptor binding; Cellular component=microfibril; Biological process=opsinization
  misc_feature: Pfam annotation: Pfam_ID=Fibrinogen_C; Match level="Score=219.5, E -value=6.4e-63, Copies=1"; Pfam description=Fibrinogen beta and gamma chains, C-te
MYSLVIVITVLVLCSNLKIALSETQELLELTPESRPAIRRRWYPQPEEITITYRPNALDGCRNLVGTSKPSLCSVDSSTPYYYPRSCSDILQSGGNRSGIYVIKPRGSKEPFEVLCDMEIQGGGWTTVQRRFNGREDFYQPWRAYKFGFGTLNGEFWLGLHNIYQMTGSEQYELLIELTDKEGITGYARYASFAIAGEKDGYNLTKLGAYSGNVGDALSGQLNAKFSTLDVDLDGQAGDCAKTFEGGWWYKDNICYVCCLNGKVPTVIFTDQQKWNGINWDGFRGKEYNLSGSRMLIRPVSSI

SEQ ID NO: 21468 - protein, 300 aa, Diabrotica virgifera
  misc_feature: Coding regions on vcDNA: vcDNA=SeqID_1165; Strand=+; Position=46-948
  misc_feature: Homolog annotation: Hit_ID=NP_649626.1; Match level="QueryCoverage =97%, HitCoverage=97%, E-value=1e-69, Identity=50%"; Hit description =CG1153-PA [Drosophila melanogaster] gb|AAF51902.1| CG1153-PA [Drosophila melanogaster]
  misc_feature: Pfam annotation: Pfam_ID=DUF1676; Match level="Score=85.6, E-value =1.3e-22, Copies=1"; Pfam description=Protein of unknown function (DUF1676)
MAFFKLAGLFLCIVASISALPTAHDEARGNSVQTEHDLLDAVYNDCLKKDSMSCLKYKVFNFVDKMIGNRETITVMDGVQFVKTPGGEQDGAPRAISSDDTIESVIFNRITSFLGSHTLKIDLKGSEVVNAVQSTARSLNDYAESLEEEENMIEGASESRKRKGGGKKGKGQMGALMGLMGLKAAILGKLALASIALIAGKALLIGKIALVLSAIIGLKKLLGNGGGGKHVTYEVVPHASHSSAHVSTHETAYAGGSGHGGGYGGDIGGGGYGGGGSGGWGRSLDAQSLAYRGHPQAKQA

SEQ ID NO: 21469 - protein, 154 aa, Diabrotica virgifera
  misc_feature: Coding regions on vcDNA: vcDNA=SeqID_1166; Strand=+; Position=98-562
REETKSITVVKDPTRCKFAVENKPIEHLNQFKYLGVGLSNYHDPVRGLRLQINKAAVRSGCLRDIVWNNPYMRTDSKVMTYGLESPIISKVKDGFACFRFRGTHNRRTAVSTISGFINSASVHSSESKNSSTINLRGISNTIEIPIGTRSSDIS

SEQ ID NO: 21470 - protein, 299 aa, Diabrotica virgifera
  misc_feature: Coding regions on vcDNA: vcDNA=SeqID_1167; Strand=+; Position=53-952
  misc_feature: Homolog annotation: Hit_ID=AAT38514.1; Match level="QueryCoverage =86%, HitCoverage=52%, E-value=2e-43, Identity=34%"; Hit description =antennae-rich cytochrome P450 [Phyllopertha diversa]
  misc_feature: Gene Ontology Annotation: Cellular component=membrane; Biological process=electron transport
MSFLNSSWLFSLATFCIGIIFLGYKYFTREFNYWKKRGVYTPKPIPFFGNLYDVATLKLTLYEYVQKIYDETEEPYFGMFIFDKPVLLIKSPKLIKDILIKDFNVFCDRTMANVTHHNLISKFIYQQKYQTWKSTKTKMSSVFSSGMMKTFFTNLELINKQFTEYLENISGPVDAKYIAGHFGTEMIARCFFATDPRCFEREPSKFRHFVHRIFQYSLRNKFIQTGYFFKPNLVKFFKLHFIEDSVVQYFEQTFLEAMECRKGYSGKPVSMVDVVNDLKKHAMEIFLIRTYLYQMPSFY

SEQ ID NO: 21471 - protein, 151 aa, Diabrotica virgifera
  misc_feature: Coding regions on vcDNA: vcDNA=SeqID_1168; Strand=+; Position=177-632
  misc_feature: Homolog annotation: Hit_ID=XP_392901.1; Match level="QueryCoverage =100%, HitCoverage=100%, E-value=1e-81, Identity=97%"; Hit description=similar to ENSANGP00000010475 [Apis mellifera]
  misc_feature: Gene Ontology Annotation: Molecular function=ubiquitin conjugating enzyme activity; Cellular component=nucleus; Biological process =flight behavior
  misc_feature: Pfam annotation: Pfam_ID=UQ_con; Match level="Score=251.9, E-value =1.1e-72, Copies=1"; Pfam description=Ubiquitin-conjugating enzyme
MAALPRRIIKETQRLMAEPVPGISAVPDDSNARYFHVIVTGPEDSPFEGGLFKLELFLPEDYPMSAPKVRFITKIYHPNIDRLGRICLDILKDKWSPALQIRTVLLSIQALLSAPNPDDPLANDVAELWKINESEAIRNAKEWTRRYAMDN

SEQ ID NO: 21472 - protein, 93 aa, Diabrotica virgifera
  misc_feature: Coding regions on vcDNA: vcDNA=SeqID_1169; Strand=+; Position=469-750
LTCSSYRRTRLLDYKCSNFSLTVRDFSLTGRNLLPDIHYFAVIDPDKGLIEVDKTHEDTISLHELHDLETEILIWWQIFLNQTIVNSIRVQYS

SEQ ID NO: 21473 - protein, 148 aa, Diabrotica virgifera
  misc_feature: Coding regions on vcDNA: vcDNA=SeqID_1170; Strand=-; Position=74-520
KHYHKIDLFCSYLRRESIIQFRIFQLYSKRIKVFYLLNFFNFSSVKYETTARGDDFNKKSLLTKFPRVRGAVIKTFGIYQGLRGRPRGGASCTMSINRPCTRSLAKHLYIQLETRCPHQSSRHHQVPIHCRNSPRINPQNIRGHHHHH

SEQ ID NO: 21474 - protein, 443 aa, Diabrotica virgifera
  misc_feature: Coding regions on vcDNA: vcDNA=SeqID_1171; Strand=+; Position=102-1432
  misc_feature: Homolog annotation: Hit_ID=XP_395869.1; Match level="QueryCoverage =97%, HitCoverage=95%, E-value=1e-148, Identity=61%"; Hit description= similar to ENSANGP00000020170 [Apis mellifera]
  misc_feature: Gene Ontology Annotation: Molecular function=calcium/calmodulin -dependent protein kinase activity; Biological process=positive regulation of growth rate
  misc_feature: Pfam annotation: Pfam_ID=MFAP1_C; Match level="Score=485.1, E-value =7.2e-143, Copies=1"; Pfam description=Micro-fibrillar-associated protein 1
  misc_feature (366)..(366): Xaa can be any naturally occurring amino acid
  misc_feature (389)..(389): Xaa can be any naturally occurring amino acid
  misc_feature (397)..(397): Xaa can be any naturally occurring amino acid
  misc_feature (405)..(405): Xaa can be any naturally occurring amino acid
  misc_feature (426)..(426): Xaa can be any naturally occurring amino acid
MMNPQSTYAIQSTAGAVPIRNEKGELSMQKVKVHRYISGKRPDYAQEAHSDSDSAEEDFLEKRTQLVTVPSPEPIRTEEDDLNDPRLRRLKIAETNTEVRPERRRHVLEPEVLESSEEEEEEIHLAEHKHTLEAAPDDDESEVELSDSEIEKRRESLKKKMLTKQEDEFMLKEEEKVDSSSDEESSEYEEYSESEEETGPRLKPVFVRKKERVTIIEKEKEAQKQKKVEEDAQRNAEERRRQTLKMVEDTIRKEQQKDKTTNEPSIDDVCTDDENDEVEYEAWKLRELKRIKRDREEREAIEKEKLEIDKLRNLTEEERRVQLRLVPKNVTNKAVKGKYKFLQKYYHRGAFYLDKEDDVYKRDFAXGTLEDHFDKTILPKVMQVKNFGXGRTKYTHXLVDQDTTXFDSPMVWKKYTHIKFPSQQGXVGLKPMVEKPSLKKKEN

SEQ ID NO: 21475 - protein, 156 aa, Diabrotica virgifera
  misc_feature: Coding regions on vcDNA: vcDNA=SeqID_1172; Strand=+; Position=122-592
  misc_feature: Homolog annotation: Hit_ID=NP_523910.1; Match level="QueryCoverage =91%, HitCoverage=91%, E-value=4e-34, Identity=50%"; Hit description =CG14981-PA, isoform A [Drosophila melanogaster] gb|AAF47809.1| CG14981-PA, isoform A [Drosophila
  misc_feature: Gene Ontology Annotation: Molecular function=receptor activity; Cellular component=mitochondrion; Biological process=mitochondrial translocation
  misc_feature: Pfam annotation: Pfam_ID=Tom22; Match level="Score=-31.4, E-value =0.0045, Copies=1"; Pfam description=Mitochondrial import receptor subunit
MAPAEENERDSGMESQEGSQSQEPEENVTNTSQSISGEKKRPEIEDSYDDEPDETFCERLWGLTEMFPESIRNFTWSTVVNTKEGIKFAYSFSRSATWVVFSTSIILFAPIIFEVERAQMEEMQKNQQKQILLGPNSAISGGVPPPIMPPMPQQKS

SEQ ID NO: 21476 - protein, 290 aa, Diabrotica virgifera
  misc_feature: Coding regions on vcDNA: vcDNA=SeqID_1173; Strand=-; Position=386-1259
  misc_feature: Homolog annotation: Hit_ID=CAA10770.1; Match level="QueryCoverage =95%, HitCoverage=80%, E-value=2e-42, Identity=33%"; Hit description =reverse transcriptase-like [Bos taurus]
  misc_feature (220)..(220): Xaa can be any naturally occurring amino acid
ETFLKEKTDNKDLRIILNLYWNQKANIKIETEISKAIEIRRGVRQGCILSPLLFNLYSESICQEALLQANEGKIINGEVVNNIRYADDTVLVARRVEELQRLLTNINIACNNYGININIKKTKYMVFSKNMTQPAHISINGFQIQKVSSYKYLGTLINETGDQNNEIKRRIEIARATFIKMRKLFCNRDISIPLRLRMLRGYVFNTLRYGVEAWTLKTEXIKNIESFEMWCYRRMLKISWVERITNLEVIQRIGRDPEILSTIKRRKLEYLGHLMRGHKNALLQNIMQGK

SEQ ID NO: 21477 - protein, 155 aa, Diabrotica virgifera
  misc_feature: Coding regions on vcDNA: vcDNA=SeqID_1174; Strand=+; Position=1-468
  misc_feature: Homolog annotation: Hit_ID=XP_313593.1; Match level="QueryCoverage =98%, HitCoverage=79%, E-value=6e-59, Identity=69%"; Hit description =ENSANGP00000014025 [Anopheles gambiae]
  misc_feature: Gene Ontology Annotation: Molecular function=protein binding; Cellular component=nucleus; Biological process=regulation of mitosis
  misc_feature: Pfam annotation: Pfam_ID=Rotamase; Match level="Score=173.2, E-value =5.5e-49, Copies=1"; Pfam description=PPIC-type PPIASE domain
QLPAGWEKRLSRSTGQHYYLNIYTKESQWDAPDKPAEPVSSSGPEQVQCSHLLVKHKDSRRPSSWREENITRTKDEALDIVKSYREQIAQGKNSFAELASKYSDCSSAKRGGDLGPFGKGAMQKPFEDAAFALKVGELSEPVFTDSGVHIILRTV

SEQ ID NO: 21478 - protein, 158 aa, Diabrotica virgifera
  misc_feature: Coding regions on vcDNA: vcDNA=SeqID_1175; Strand=+; Position=1-477
  misc_feature: Homolog annotation: Hit_ID=XP_313593.1; Match level="QueryCoverage =97%, HitCoverage=80%, E-value=2e-59, Identity=69%"; Hit description =ENSANGP00000014025 [Anopheles gambiae]
  misc_feature: Gene Ontology Annotation: Molecular function=protein binding; Cellular component=nucleus; Biological process=regulation of mitosis
  misc_feature: Pfam annotation: Pfam_ID=Rotamase; Match level="Score=173.2, E-value =5.5e-49, Copies=1"; Pfam description=PPIC-type PPIASE domain
ADEQLPAGWEKRLSRSTGQHYYLNIYTKESQWDAPDKPAEPVSSSGPEQVQCSHLLVKHKDSRRPSSWREENITRTKDEALDIVKSYREQIAQGKNSFAELASKYSDCSSAKRGGDLGPFGKGAMQKPFEDAAFALKVGELSEPVFTDSGVHIILRTV

SEQ ID NO: 21479 - protein, 204 aa, Diabrotica virgifera
  misc_feature: Coding regions on vcDNA: vcDNA=SeqID_1176; Strand=+; Position=179-790
  misc_feature: Homolog annotation: Hit_ID=XP_312914.1; Match level="QueryCoverage =95%, HitCoverage=49%, E-value=6e-79, Identity=79%"; Hit description =ENSANGP00000014724 [Anopheles gambiae]
  misc_feature: Pfam annotation: Pfam_ID=Peptidase_A22B; Match level="Score=-62.0, E -value=1.7e-06, Copies=1"; Pfam description=Signal peptide peptidase
  misc_feature (177)..(177): Xaa can be any naturally occurring amino acid
  misc_feature (195)..(195): Xaa can be any naturally occurring amino acid
MADTQSQTVEYQWAYSIMDSSRVSTFLISMLLIVYGSFRSLNMEQEARERANGTTNSLLNPPQSVPAENGVQTLDTMQALCLPLGASVSLLVMFFFFDSMQMLFAICTAVIATVALAFLLLPMCQYIMGPCSDGKKISFGMCGRFTAAELFSLSLSVFIVCIWVLTGHWLLMDAMGXMGLCVAFIAFVRLPSLKXKSTLLLTGL

SEQ ID NO: 21480 - protein, 288 aa, Diabrotica virgifera
  misc_feature: Coding regions on vcDNA: vcDNA=SeqID_1177; Strand=+; Position=122-984
  misc_feature: Homolog annotation: Hit_ID=EAA11696.3; Match level="QueryCoverage =84%, HitCoverage=62%, E-value=2e-79, Identity=57%"; Hit description =ENSANGP00000021848 [Anopheles gambiae str. PEST] ref|XP_556296.1| ENSANGP00000021848 [Anopheles gambiae st
  misc_feature: Pfam annotation: Pfam_ID=Acyl_transf_1; Match level="Score=-154.2, E -value=0.097, Copies=1"; Pfam description=Acyl transferase domain
  misc_feature (235)..(235): Xaa can be any naturally occurring amino acid
  misc_feature (275)..(275): Xaa can be any naturally occurring amino acid
MIRRFNINFLKRNELDNIKLNLRHIFTGIQVFCDSKNKKESPLKRLLDDSSTFQDVSKEYKQQWATLPYPQGTKIRKQGEFYKKEKKDPRDASIIIFPGQGAQFVGMAKDLMRFPMAKDLFELANYILGYDLLKLCLQGPKDKLDQTKYCQPAVMVASLAAIEQLKEERPNAIANCMATAGFSLGEITALVFAGALGFERALQLVKIRGEAMQLAGEAYKGGMATVMYGPDSKLXQACIKAKQWAVDKGDPVPECKIANYLFPHFKVLPGSESAXRFLEKNLKGINYV

SEQ ID NO: 21481 - protein, 98 aa, Diabrotica virgifera
  misc_feature: Coding regions on vcDNA: vcDNA=SeqID_1178; Strand=-; Position=1276 -1573
  misc_feature: Homolog annotation: Hit_ID=AAK61417.1; Match level="QueryCoverage =77%, HitCoverage=21%, E-value=1e-26, Identity=69%"; Hit description =transposase [Ceratitis rosa]
  misc_feature (33)..(33): Xaa can be any naturally occurring amino acid
  misc_feature (54)..(54): Xaa can be any naturally occurring amino acid
REFLLPKLDDMDVDDMWFQKNGAICHTARETIXLIHETFPGRVISGCGNQNWPXRSCNLTPLDFFLWGYLKSKVYTNKLTADLIEAYNHPCIEEGMRI

SEQ ID NO: 21482 - protein, 99 aa, Diabrotica virgifera
  misc_feature: Coding regions on vcDNA: vcDNA=SeqID_1179; Strand=+; Position=184-483
NSINKHKFHEISYTHYKQYEHFIVYVTVQVDSQLELTPTSWSQLQLKRAVKVDFKNLNQLLLVGVDSSWIDSVNVDYTRISSAFLMSVRFFVLTVSTTY

SEQ ID NO: 21483 - protein, 52 aa, Diabrotica virgifera
  misc_feature: Coding regions on vcDNA: vcDNA=SeqID_1180; Strand=-; Position=163-321
HPVFSTGTACGYSTLVYRHTTRCSSDGFRNWKKDTFIEVSFFFHDLVLNIVS

SEQ ID NO: 21484 - protein, 506 aa, Diabrotica virgifera
  misc_feature: Coding regions on vcDNA: vcDNA=SeqID_1181; Strand=+; Position=9-1526
  misc_feature: Homolog annotation: Hit_ID=XP_316957.1; Match level="QueryCoverage =66%, HitCoverage=52%, E-value=1e-54, Identity=33%"; Hit description =ENSANGP00000019358 [Anopheles gambiae]
  misc_feature: Gene Ontology Annotation: Molecular function=sphingomyelin phosphodiesterase activity; Cellular component=integral to membrane; Biological process=ceramide biosynthesis
  misc_feature: Pfam annotation: Pfam_ID=Metallophos; Match level="Score=32.6, E -value=1.2e-06, Copies=1"; Pfam description=Calcineurin-like phosphoesterase
  misc_feature (460)..(460): Xaa can be any naturally occurring amino acid
  misc_feature (480)..(480): Xaa can be any naturally occurring amino acid
  misc_feature (497)..(497): Xaa can be any naturally occurring amino acid
  misc_feature (501)..(501): Xaa can be any naturally occurring amino acid
MVSMLTTCLVLGLASPGLCGIFDYPSQWSPDEVLNDITNATAIILQPNPIFNVIIPQLSALFNLSTENLADWTEILANRFGIHAGYTPLDQSLITTVLNNILSTPTTQPPSAEDLNNFFQKASTVLKDSSICGACQFLELIFQLHQDFVIPVLIGICDLYMGLSTYTVSTFCPQIVDLNLPSLTYIRANSKIMDNQLVCSVLLQTKECYFPIPPLTWVGAVNSGPKIYPQPVSSNQQPIYIIHLSDVHVSFNYETGGVSDCGYPVCCLEGLGNSQLKSGKAGQWGDYNCDSAPNVLDSALDFIKTIYPSIDALYYTGDVVDHAVWNTTVEQNVNSLDFVFGKVKAAFPGVVALPSLGNHEAQPMNVFPPRETAIANAGLDQQWLYNHVAYLWGSWVDAPAVDMIKQHGYYSYELYPKLKVIVLNNNFCYSYNWWLFYNTTYMQTELNWLQTELLASEAKXQYVHIVGHNTLGNYECISPXEDTYLKDVRRFSHIIKXQFVXHTHTD

SEQ ID NO: 21485 - protein, 273 aa, Diabrotica virgifera
  misc_feature: Coding regions on vcDNA: vcDNA=SeqID_1182; Strand=+; Position=72-892
  misc_feature: Homolog annotation: Hit_ID=AAK73352.1; Match level="QueryCoverage =98%, HitCoverage=93%, E-value=2e-89, Identity=55%"; Hit description =CRALBP isoform 2 [Aedes aegypti] gb|AAL85591.1| cellular retinaldehyde-binding protein [Aedes aegypti] gb|
  misc_feature: Gene Ontology Annotation: Molecular function=binding; Cellular component=soluble fraction; Biological process=vitamin A metabolism
  misc_feature: Pfam annotation: Pfam_ID=CRAL_TRIO; Match level="Score=66.7, E-value =6.3e-17, Copies=1"; Pfam description=CRAL/TRIO domain
  misc_feature (264)..(264): Xaa can be any naturally occurring amino acid
MASPFSLNQGPLDEETQALAKEELRETPEMMKTGIEKLREYLNNDESLNFKDTDEYLTIFLRPCKWDPKGAYDLMKRIAEFKEKHKGLLENLLPDEEKPAFTEHNVVNILTNLDHKGRRVLLVFAGETWDPSKVTSDQIFRMFYLIHEMAVLEPKTQVRGVVVIMDYDGMGMKQVRGLGPAFSLLLLTFIQDAMPLRLKEVHMVKEPFVFNMVWQLFKPFLKPKLKGRIFFHGKKMSSLHKYMAPSHLPKNYDGELPAIDYSGXDWYPVIEDT

SEQ ID NO: 21486 - protein, 67 aa, Diabrotica virgifera
  misc_feature: Coding regions on vcDNA: vcDNA=SeqID_1183; Strand=+; Position=263-463
ILNLIHKEYSVLYRILFNVSHNRLIFLHYIYYHDFLIPVTDRSSLNDFNMGTELCKVKKLLFSSPRR

SEQ ID NO: 21487 - protein, 413 aa, Diabrotica virgifera
  misc_feature: Coding regions on vcDNA: vcDNA=SeqID_1184; Strand=+; Position=106-1342
  misc_feature: Homolog annotation: Hit_ID=XP_414047.1; Match level="QueryCoverage =98%, HitCoverage=31%, E-value=0.0, Identity=86%"; Hit description =PREDICTED: similar to KIAA0017 protein [Gallus gallus]
  misc_feature: Gene Ontology Annotation: Molecular function=U2 snRNA binding; Cellular component=snRNP U2; Biological process=hermaphrodite genital morphogenesis
  misc_feature (361)..(361): Xaa can be any naturally occurring amino acid
  misc_feature (370)..(371): Xaa can be any naturally occurring amino acid
  misc_feature (379)..(379): Xaa can be any naturally occurring amino acid
MFLYNLTLQRGTTISHAIHGNFSGSKIQEIVISRGKILELLRPDPNTGKVHTLLTIEIFGIIRSLMPFRLTGGTKDYVIVGSDSGRLVILEYNQQKNVFEKVHQETFGKSGGRRIVPGQYLATDLRGRAVMIGAIEKQKLAYILNRDAQARLTISSPLEAHKSNTLVYHMVGVDVGYDNPIFACLEIDYEEADSDPTGEAAQKTQQTLTFYEIDLVVNHVVRKYSEPLEEHANFLVTVPGGDDGPSGVLICSENYLTYKNLGEQHDIRCPIPRRRNDLDDPERGMIFVCSATHKTKSMFFFLAQTEQGDIFKITLETDDDMVTEIKLKYFDTVPVATAMCVLKTGFLFVASEFGNHYLYQXAHLGDDDDXXEFSSAMPXLEEGDTFFFAPRPLRNLVLVDELESLSPFSHQSR

SEQ ID NO: 21488 - protein, 244 aa, Diabrotica virgifera
  misc_feature: Coding regions on vcDNA: vcDNA=SeqID_1185; Strand=+; Position=17-751
  misc_feature: Homolog annotation: Hit_ID=AAN05630.1; Match level="QueryCoverage =84%, HitCoverage=93%, E-value=1e-25, Identity=31%"; Hit description =diapause-associated transcript-2 [Leptinotarsa decemlineata]
MNTRTFLFLVVFLIVAQSAFCAPKDKKHKSKGKYKTWVDQNQVELEGAKNRVIKYIQKNDPDTTRAINELLEPVKDKCPQVDKVPKLLDDVYGCVKNTTVGSGTVCSTIQKTIEKCYGPLIDLVGSCLPKESNELPLLAQKIIIGGLKQVCTFTVEEFLELFAPCQSETNWADVSSCNDVRAAVEEFEKKLPSTQIICSLLPKLKTCANDVHSSSCKNPITLRSFTRVEESVLKESEPVCRGKN

SEQ ID NO: 21489 - protein, 499 aa, Diabrotica virgifera
  misc_feature: Coding regions on vcDNA: vcDNA=SeqID_1186; Strand=+; Position=2-1499
  misc_feature: Homolog annotation: Hit_ID=XP_392673.1; Match level="QueryCoverage =94%, HitCoverage=89%, E-value=1e-136, Identity=66%"; Hit description= similar to schwannomin [Apis mellifera]
  misc_feature: Gene Ontology Annotation: Molecular function=protein binding; Cellular component=plasma membrane; Biological process=negative regulation of cell proliferation
  misc_feature: Pfam annotation: Pfam_ID=ERM; Match level="Score=393.5, E-value=2.7e -115, Copies=1"; Pfam description=Ezrin/radixin/moesin family
  misc_feature (366)..(366): Xaa can be any naturally occurring amino acid
  misc_feature (416)..(416): Xaa can be any naturally occurring amino acid
  misc_feature (430)..(430): Xaa can be any naturally occurring amino acid
  misc_feature (455)..(455): Xaa can be any naturally occurring amino acid
SWLKLDKKVQDQSIQKNHQTASFMFLAKFYPEEVAEELVQEVTQHLFFLQVKQAILSMDVYCPPEASVLLASYAVQAKNKKETELWLGVTALGLNIYEKENKLQPKTTFTWSEIRHISFDDKKFIIKPVDKNAPNFVFFSQKVRMNKLILDLCMGNHDLFMRRRKPDSMELQQMKAAAKEEKQRRQVQRNRLAREKQLREEAERERASMEQRLLQYQEEIRLANEALRKSEESADLLAEKSRVAEEEARLLSQKAAEAEQEIIRLRLTAMRKDEEKVSLERKTREAEMLTARLVEESEKRAAEANRLKDELLKARAAEKQAKEKLLDFLNRTTTYNGSNTVSPISVSNFSSVTTLYQPPVKSWLRXDLSMIETEISTSPDLNLNITGYDLISKADADQLSLEIEKERIEYLEKSKXSQNQIRELRTKTRXLKAGTKNCFQLLTTKRQIREKKYSXLKKKKFGSQKRKRFFLRKKKRPFCFFIKKKKFFFFNKKFFGKKM

SEQ ID NO: 21490 - protein, 213 aa, Diabrotica virgifera
  misc_feature: Coding regions on vcDNA: vcDNA=SeqID_1187; Strand=+; Position=64-705
  misc_feature: Homolog annotation: Hit_ID=NP_728691.1; Match level="QueryCoverage =98%, HitCoverage=78%, E-value=1e-60, Identity=50%"; Hit description =CG12026-PB, isoform B [Drosophila melanogaster] ref|NP_647674.1| CG12026-PA, isoform A [Drosophila
  misc_feature: Pfam annotation: Pfam_ID=PMP22_Claudin; Match level="Score=-48.7, E -value=0.019, Copies=1"; Pfam description=PMP-22/EMP/MP20/Claudin family
MGSKIEYVDSSQIYATSYVRNSKAVGVLWGIFTICYAIIAIVSFITAEWIGTTSGETPGRIGLYSICYIGENAEQCKENFWDTFMDLAHALQASMVFVGLAVLTAVLTIFVMLFFCFCRSTTVYHISAWLQLISAACMIAGCAVYPAGWNSDNIRKVCGTSTDKYMLGDCHIRWTYILAAIGCLDAVILSTLAFLLALRHIKLQADPDYSYVT

SEQ ID NO: 21491 - protein, 281 aa, Diabrotica virgifera
  misc_feature: Coding regions on vcDNA: vcDNA=SeqID_1188; Strand=+; Position=141-983
  misc_feature: Homolog annotation: Hit_ID=XP_312050.1; Match level="QueryCoverage =98%, HitCoverage=53%, E-value=5e-55, Identity=44%"; Hit description =ENSANGP00000016967 [Anopheles gambiae] gb|EAA07732.1| ENSANGP00000016967 [Anopheles gambiae
  misc_feature (155)..(155): Xaa can be any naturally occurring amino acid
  misc_feature (220)..(220): Xaa can be any naturally occurring amino acid
  misc_feature (246)..(246): Xaa can be any naturally occurring amino acid
  misc_feature (257)..(257): Xaa can be any naturally occurring amino acid
  misc_feature (263)..(263): Xaa can be any naturally occurring amino acid
  misc_feature (266)..(266): Xaa can be any naturally occurring amino acid
MISLIVLAALAATIGYLYIKFKLTYWKRIGLEQIEPVHLIYGNAKDFITRNSSFGDCHTKLYNNFKSRGLKHGGIYVLLRPTYMPLDLDIIKNILQKDFNNFVNHGFYVNEEVDPLTGHLFALEDDKWRRLRTKLTPTFTSGKMKMMFSTMGCMXEGLRDILKSYAKLQDAVDMKEVASRFTTDVIGSVAFGIDCNSLKNPDSEFRQFGRKIFTQTTWTXLRSVLATTIPRNFLKMIKFKQRNPEXFEISFMGVVKXTVNYRXEKXNLYRKDFMHLLLQLK

SEQ ID NO: 21492 - protein, 332 aa, Diabrotica virgifera
  misc_feature: Coding regions on vcDNA: vcDNA=SeqID_1189; Strand=+; Position=68-1066
  misc_feature: Homolog annotation: Hit_ID=1K9O; Match level="QueryCoverage=91%, HitCoverage=82%, E-value=1e-52, Identity=40%"; Hit description=Chain I, Crystal Structure Of Michaelis Serpin-Trypsin Complex
  misc_feature: Gene Ontology Annotation: Molecular function=serine protease inhibitor activity; Cellular component=cytoplasm; Biological process= regulation of proteolysis and peptidolysis
  misc_feature: Pfam annotation: Pfam_ID=Serpin; Match level="Score=175.2, E-value =1.4e-49, Copies=1"; Pfam description=Serpin (serine protease inhibitor)
MRCSVLVVLIIASIFGCNADNLNSVVQGNDEFTANTYKELVKTVGKENIILSGLSAEIVLSLLANGAKGETQKQLLIGLGLPNNITDVNKAFTEITSRLKVNTPDLKLLSANKIYPAKGFPIEKAFQDVAVNDYNSGVQNLDYNKPAEAAGTINGWVEDQTNHKIQNLIDPQMLDASTVLVLVNALYYTGKWDHPFEKYNSADRLFHSSPTESKKIPTMYTEAFAKYAYNDKLKAKFLELGFQGANVTMTFVLPDEINGLAAAEQNLKEYLAPQPLESARVAITLPKFKINTKIDFKPILKKLGITQMFEDSADLTGIAKAPLKVDFCLQKR

SEQ ID NO: 21493 - protein, 289 aa, Diabrotica virgifera
  misc_feature: Coding regions on vcDNA: vcDNA=SeqID_1190; Strand=+; Position=62-931
  misc_feature: Homolog annotation: Hit_ID=P81225; Match level="QueryCoverage=60%, HitCoverage=95%, E-value=3e-36, Identity=54%"; Hit description =Cuticle protein 21 (LM-ACP 21)
  misc_feature: Gene Ontology Annotation: Molecular function=structural constituent of eye lens
  misc_feature: Pfam annotation: Pfam_ID=Chitin_bind_4; Match level="Score=111.3, E -value=2.4e-30, Copies=1"; Pfam description=Insect cuticle protein
MALKIITFAAFIVVARAGVLNEAFPPQLAYAASPVAKVAYSEAPAVSYSSLSAPFAYPAPPAIAKVAAPVQFGASPYAGLSFAPSAPFPSPALAPALPYQQPQVYSYASPPVAPVSYAAPSLKLAAPLAYAAPIAKTVIAEPSAPAHYDFGYAVNDPNTGDSKSQQESRRGDVVQGSYSVVDADGTKRTVDYTADDHNGFNAVVRKEPAAVAVKAVAPVVAKVSAPVAYAQPAPISYAQPAPVAYAQPAPVAYSHSAPVALPQQFIRSSPLWSSFLNAYHIHCWSKCFY

SEQ ID NO: 21494 - protein, 283 aa, Diabrotica virgifera
  misc_feature: Coding regions on vcDNA: vcDNA=SeqID_1191; Strand=+; Position=39-887
  misc_feature: Homolog annotation: Hit_ID=NP_651272.1; Match level="QueryCoverage =98%, HitCoverage=60%, E-value=9e-31, Identity=36%"; Hit description =CG13625-PA [Drosophila melanogaster] gb|AAF56315.1| CG13625-PA [Drosophila melanogaster]
NFENKMSTINQKEYLKKYLKIGAKTGEKKKKKKSEKTAGTRMKIIDDDVDTLLSQEIQDDIDAANEDAPQIVAVIDERPHSLIVDEKTNNTLWKPIGQASNNSEFQNFKIGSIKLNKNRDDSEKHRLLGTKSFSSSKRNDNLPSTSTSNNYNKLKDKHAVSKGNGNFPIKESTYSYNEKNYSPPRRDQDYSPQRKRDIDQSPKRREEDYSPPRKRKQSHSPVRKKDQDSSPRRKVNKDSDYSSPRRDDKDYSPPRKRNKSYSPRRKKDQDCSPPRKDNKDSEK

SEQ ID NO: 21495 - protein, 212 aa, Diabrotica virgifera
  misc_feature: Coding regions on vcDNA: vcDNA=SeqID_1192; Strand=+; Position=441-1077
  misc_feature: Homolog annotation: Hit_ID=XP_393529.1; Match level="QueryCoverage =92%, HitCoverage=51%, E-value=3e-73, Identity=65%"; Hit description =similar to ENSANGP00000020224 [Apis mellifera]
  misc_feature: Gene Ontology Annotation: Molecular function=ornithine decarboxylase activity; Cellular component=cellular_component unknown; Biological process=arginine metabolism
  misc_feature: Pfam annotation: Pfam_ID=Orn_Arg_deC_N; Match level="Score=115.2, E -value=1.6e-31, Copies=1"; Pfam description=Pyridoxal-dependent decarboxylase, py
  misc_feature (164)..(164): Xaa can be any naturally occurring amino acid
MKIPSVEERIHVLDDQSNVWTVIREIVSNNNQEDAFYVLDVGDIVRKHQEWREKLPRVTPHYAVKCNDSLTVLETLNALGTNFDCASKGEINKVLSMGVEPERIIFANPAKPSSHIRHAAATGVNTMTFDSDTELHKVKNLFPEAKLVIRIRCDATDVQCQLGXKFGCDPITEAPELLRIARSLDLFVFGVSFRGGTFPPKVPGNGGAPATF

SEQ ID NO: 21496 - protein, 458 aa, Diabrotica virgifera
  misc_feature: Coding regions on vcDNA: vcDNA=SeqID_1193; Strand=+; Position=619-1995
  misc_feature: Homolog annotation: Hit_ID=XP_393529.1; Match level="QueryCoverage =87%, HitCoverage=99%, E-value=1e-148, Identity=63%"; Hit description= similar to ENSANGP00000020224 [Apis mellifera]
  misc_feature: Gene Ontology Annotation: Molecular function=enzyme inhibitor activity; Cellular component=cellular_component unknown; Biological process=arginine metabolism
  misc_feature: Pfam annotation: Pfam_ID=Orn_Arg_deC_N; Match level="Score=338.5, E -value=9.5e-99, Copies=1"; Pfam description=Pyridoxal-dependent decarboxylase, py
MKIPSVEERIHVLDDQSNVWTVIREIVSNNNQEDAFYVLDVGDIVRKHQEWREKLPRVTPHYAVKCNDSLTVLETLNALGTNFDCASKGEINKVLSMGVEPERIIFANPAKPSSHIRHAAATGVNTMTFDSDTELHKVKNLFPEAKLVIRIRCDATDVQCQLGNKFGCDPITEAPELLRIARSLDLDVVGVSFHVGSGCREPPVFRRAISAARDIFDFAETLGYNFSLLDIGGGYPGGKGTSIHQIAEIVNLALDNYFPDPSVHVIAEPGRFYVSSAYTLVCNIHSIRNVNQVNDEGGNNMHRMYYINDGVYGSFNCILYDHQVVVPQPLEERVGAKYYDSSVWGPTCDGLDQVIEHAMLPEMKVGDWLVFEDMGAYTLPVASPFNGFPIPKVHIVMDESISVLMEDMFELTDRHFEMLTIPNNLKNKNDSSSKYELPDFPIAIGNSILDYVDVVAME

SEQ ID NO: 21497 - protein, 224 aa, Diabrotica virgifera
  misc_feature: Coding regions on vcDNA: vcDNA=SeqID_1194; Strand=+; Position=178-847
  misc_feature: Homolog annotation: Hit_ID=XP_392408.1; Match level="QueryCoverage =100%, HitCoverage=11%, E-value=1e-109, Identity=81%"; Hit description=similar to ENSANGP00000017306 [Apis mellifera]
  misc_feature: Gene Ontology Annotation: Molecular function=transcription factor activity; Cellular component=nucleus; Biological process=regulation of transcription, DNA-dependent
  misc_feature: Pfam annotation: Pfam_ID=CAF1; Match level="Score=310.4, E-value=2.8e- 90, Copies=1"; Pfam description=CAF1 family ribonuclease
  misc_feature (194)..(194): Xaa can be any naturally occurring amino acid
  misc_feature (214)..(214): Xaa can be any naturally occurring amino acid
  misc_feature (216)..(216): Xaa can be any naturally occurring amino acid
MPAATLGSIPHPNNEDCGIRDVWAHNLEDEFRTIRQIVQKYQYVAMDTEFPGVVARPIGEFRSSADYQYQMLRCNVDLLRIIQLGLTFLDDNGKTPGGAYTTWQFNFKFNLQEDMYAQDSIDLLQNSGIQFKKHEDEGIEPLEFAELLMSSGIVLVENIKWLSFHSGYDFGYLIKLLTDNNLPQDETEFFDLLXLYFPTIYDVKYLMKSCKNLXKXGLQEVAEQ

SEQ ID NO: 21498 - protein, 284 aa, Diabrotica virgifera
  misc_feature: Coding regions on vcDNA: vcDNA=SeqID_1195; Strand=+; Position=2-856
THASAKYISIYSMETKMVILRNIILFSCFLGLLAKESPKNNRPSKLGNRINDEFNPDNISVSVSTDYISDINLSALSYTNSPDEYLELYFKVAQTVNISGLPTQEGLNLEITKRESPYDKTPFTNRNYTSVQSTGSESVSITLNVYESLNRNVDFSDLTISSTIEYNVTILTETIISWNDETNFNTATLLNEDTRISLQDDAMINLASHEGQDLSQCDNQRCSSTTFNSKVMDGFDLNDGIEVFRITTVSPKLFSERKTVDKNNTYHMVNSVLISYFIQIGKVF

SEQ ID NO: 21499 - protein, 317 aa, Diabrotica virgifera
  misc_feature: Coding regions on vcDNA: vcDNA=SeqID_1196; Strand=+; Position=204-1153
  misc_feature: Homolog annotation: Hit_ID=EAA01878.2; Match level="QueryCoverage =54%, HitCoverage=67%, E-value=6e-31, Identity=35%"; Hit description =ENSANGP00000013819 [Anopheles gambiae str. PEST] ref|XP_561532.1| ENSANGP00000013819 [Anopheles gambiae st
  misc_feature: Pfam annotation: Pfam_ID=F-box; Match level="Score=36.4, E-value=8.7e- 08, Copies=1"; Pfam description=F-box domain
  misc_feature (287)..(287): Xaa can be any naturally occurring amino acid
MNLCPESIEILSIRPVVCPLVRLGQKTSAASTEKSSENQHFAAKDTSLQPLYIDTYRQSTSPSYQYKQPPVNPSQKLDYLQNYYDEDCYTDQRNNNLSYSNKNTLQLSSFSQEQNYWEYNKINNTDTENQNVFGNHETQQSNCLLDNFTRLGKSSPSLDQGYHTLVTHNPSLITPNFWDTNLYKGKKYQTKNNSFDKLPDELVVKIFSYLTSVDISFCAQVCRRFDILACTPSLWRVIVIEDDNISGDKAIKGVLKQLCAQGKTGACPTVERIHITNAARYRIRDCXLLARRRPELTHLQLRGCSTLSNSAVFEIAT

SEQ ID NO: 21500 - protein, 152 aa, Diabrotica virgifera
  misc_feature: Coding regions on vcDNA: vcDNA=SeqID_1197; Strand=+; Position=17-474
  misc_feature: Homolog annotation: Hit_ID=Q7M4F4; Match level="QueryCoverage=71%, HitCoverage=65%, E-value=6e-27, Identity=53%"; Hit description =Endocuticle structural glycoprotein SgAbd-1 pir||S78091 endocuticular protein SgAbd-1 -
  misc_feature: Pfam annotation: Pfam_ID=Chitin_bind_4; Match level="Score=93.0, E -value=7.6e-25, Copies=1"; Pfam description=Insect cuticle protein
  misc_feature (70)..(70): Xaa can be any naturally occurring amino acid
MISLALFLTICGCAFGQYREKVLVRPNIAITPGQVIRIISQTQEGPNLDGSYAWSYETENGIAGREVDDXKAQDIEEVQGEIKYTAPDGSPIQLTYTADENGFVPQGAHLPTAPPVPEAILRSLEWNAAHPEEDDYLRGANTIEGSVRYRRP

SEQ ID NO: 21501 - protein, 245 aa, Diabrotica virgifera
  misc_feature: Coding regions on vcDNA: vcDNA=SeqID_1198; Strand=+; Position=143-877
  misc_feature: Homolog annotation: Hit_ID=NP_611376.1; Match level="QueryCoverage =95%, HitCoverage=47%, E-value=2e-46, Identity=41%"; Hit description =CG15096-PA, isoform A [Drosophila melanogaster] gb|AAF57633.1| CG15096-PA, isoform A [Drosophila
  misc_feature: Gene Ontology Annotation: Molecular function=inorganic phosphate transporter activity; Cellular component=integral to membrane; Biological process=phosphate transport
  misc_feature: Pfam annotation: Pfam_ID=MFS_1; Match level="Score=-13.6, E-value =0.012, Copies=1"; Pfam description=Major Facilitator Superfamily
  misc_feature (187)..(187): Xaa can be any naturally occurring amino acid
MDKMTPKKTAEVRRVDKGPAFGVRHIQVIFMFFLYLLMYGTRYSFSVALVAMTQRTTPNPEIQVYNWTNTGILLSTFFWGYVIPQTPIGILGTKFGTKYFLLAAVFMNSMASLWIPTMAEKIGIEGVAVCRVIQGFAQGLVIPSVHGLLGKWAPTNERSSLYGITVVGSILGTIAGLSSTGFICASXAGWPLSFYILPSLGIFWMVLYYFYGAGCPADHSSITEAEKTYIENSLHSQNMRDVIPY

SEQ ID NO: 21502 - protein, 301 aa, Diabrotica virgifera
  misc_feature: Coding regions on vcDNA: vcDNA=SeqID_1199; Strand=+; Position=261-1162
  misc_feature: Homolog annotation: Hit_ID=EAL26822.1; Match level="QueryCoverage =62%, HitCoverage=41%, E-value=4e-64, Identity=57%"; Hit description =GA22005-PA [Drosophila pseudoobscura]
  misc_feature: Gene Ontology Annotation: Molecular function=stearoyl-CoA desaturase activity; Cellular component=integral to membrane; Biological process=lipid metabolism
  misc_feature: Pfam annotation: Pfam_ID=FA_desaturase; Match level="Score=15.4, E -value=1.3e-07, Copies=1"; Pfam description=Fatty acid desaturase
  misc_feature (251)..(251): Xaa can be any naturally occurring amino acid
  misc_feature (265)..(265): Xaa can be any naturally occurring amino acid
  misc_feature (290)..(290): Xaa can be any naturally occurring amino acid
MIATLTQLSDESQPLVRDPVSKTILTLPKCNGNELPIASTSNISKEELEKPKETEELEELDELEEVGDTNEISDISDISDEEENVENNNNVENIKDDAGENNKNQKPLPNYEKYKFLFWEFETPIIWVSVFFIFLWHALSVYMVCTFPLMDEIPLVLYATVIGGISGFGVTGGAHRYFTHRAYKARLPLKIILLICYSVAGQNTLYDWVRDHRVHHRFSETDADPHNAKRGFFFSHVGWLMMRKHPEVIRXGRMINLKDITEDPXVAFHVKYWFWCKLFLCFIIPSSIPXLLWGESWYHRI

SEQ ID NO: 21503 - protein, 78 aa, Diabrotica virgifera
  misc_feature: Coding regions on vcDNA: vcDNA=SeqID_1200; Strand=+; Position=94-330
  misc_feature: Homolog annotation: Hit_ID=AAV90734.1; Match level="QueryCoverage =98%, HitCoverage=93%, E-value=2e-20, Identity=66%"; Hit description =mitochondrial ATP synthase e chain [Aedes albopictus]
  misc_feature: Pfam annotation: Pfam_ID=ATP-synt_E; Match level="Score=92.1, E-value= 1.4e-24, Copies=1"; Pfam description=ATP synthase E chain
MSALPAPVRVSPLIKFGRWSFLALGVAYGAFHQNRLSKKEAGIREVENKIKAERDAKLAIEKKAAADKEIKELEALAR

SEQ ID NO: 21504 - protein, 427 aa, Diabrotica virgifera
  misc_feature: Coding regions on vcDNA: vcDNA=SeqID_1201; Strand=+; Position=4-1286
  misc_feature: Homolog annotation: Hit_ID=AAC24982.2; Match level="QueryCoverage =87%, HitCoverage=37%, E-value=2e-46, Identity=30%"; Hit description =reverse transcriptase [synthetic construct]
  misc_feature: Gene Ontology Annotation: Molecular function=molecular_function unknown; Cellular component=cellular_component unknown; Biological process=biological_process unknown
  misc_feature: Pfam annotation: Pfam_ID=RVT_1; Match level="Score=119.1, E-value =1.1e-32, Copies=1"; Pfam description=Reverse transcriptase (RNA -dependent
  misc_feature (30)..(30): Xaa can be any naturally occurring amino acid
  misc_feature (219)..(219): Xaa can be any naturally occurring amino acid
  misc_feature (232)..(232): Xaa can be any naturally occurring amino acid
MLTSAFVCLLKKVNAKECSDYRIISLIIPXKILLKIIHARIHSKLELDIRDTQYGFRNGMGTREALFSFNVLTQRCLDVNRPLYVCFIDYNKAFDKVKHDRLMEILKTKNLDERDLRLITHLYYNQRAIVRIEKDTSEEMEIKRGVSQGCILSPLLFNAYSEEVMRETLEAETVGIRVNGVLVNNIRYADDTVIVADSLQDLQRLMSKIVRCSREYGLXYQKTKFMKISKKXYNNNEILIVEGQQIERVKKYTYLGTLITENNDFTAEIKVRIEKARSNFIKMKKVLCSKDLTLALKVRLTKCYVYSVLYDGVESWTLHVETMRRLNAFEMWTYRRIMRVYWVDRVTNNEVLRRIGKEKEVEPTIKERKLQYLGYVMRGEKYGILRLIMQGKIDGRRSIRRNRISWLKNLREWFGCSLKQLFRATAS

SEQ ID NO: 21505 - protein, 58 aa, Diabrotica virgifera
  misc_feature: Coding regions on vcDNA: vcDNA=SeqID_1202; Strand=-; Position=435-611
GGGSNNLENHFHIFLMPQQRDNRVYHIYIINSKYNSIIKKKDFSSSYFAIIIFSFQFY

SEQ ID NO: 21506 - protein, 130 aa, Diabrotica virgifera
  misc_feature: Coding regions on vcDNA: vcDNA=SeqID_1203; Strand=+; Position=185-577
  misc_feature: Homolog annotation: Hit_ID=AAV84214.1; Match level="QueryCoverage =97%, HitCoverage=83%, E-value=6e-45, Identity=67%"; Hit description =cytochrome B5 [Culicoides sonorensis]
  misc_feature: Gene Ontology Annotation: Molecular function=electron transporter activity; Cellular component=mitochondrion; Biological process=cell cycle
  misc_feature: Pfam annotation: Pfam_ID=Cyt-b5; Match level="Score=86.5, E-value =7.2e-23, Copies=1"; Pfam description=Cytochrome b5-like Heme/Steroid bindin
MTTLYSLADVKKHNDNKSTWIVIHNNVYDVTPFLNEHPGGEEVLLEQAGKEASEAFEDVGHSSDARELMVKYKVGEVVEEERTAVKAKNVDWGVSSNNESSSSQNSFKSWLIPIALGVLATILYRAYFQS

SEQ ID NO: 21507 - protein, 212 aa, Diabrotica virgifera
  misc_feature: Coding regions on vcDNA: vcDNA=SeqID_1204; Strand=+; Position=117-755
  misc_feature: Homolog annotation: Hit_ID=CAH04317.1; Match level="QueryCoverage =100%, HitCoverage=100%, E-value=1e-112, Identity=96%"; Hit description=S5e ribosomal protein [Timarcha balearica]
  misc_feature: Gene Ontology Annotation: Molecular function=structural constituent of ribosome; Cellular component=cytosolic ribosome (sensu Eukarya); Biological process=protein biosynthesis
  misc_feature: Pfam annotation: Pfam_ID=Ribosomal_S7; Match level="Score=266.2, E -value=5.8e-77, Copies=1"; Pfam description=Ribosomal protein S7p/S5e
MEDDWAVDNQSGGVVAPKIAELPEIKLFARWNCDDVQVSDMSLQDYIAVKEKNAKYLPHSAGRYAAKRFRKAQCPIVERLTNSLMMHGRNNGKKLMAVRIVKHAFEIIHLLTGENPLQILVSAIINSGPREDSTRIGRAGTVRRQAVDVSPLRRVNQAIWLLCTGAREAAFRNIKTIAECLADELINAAKGSSNSYAIKKKDELERVAKSNR

SEQ ID NO: 21508 - protein, 276 aa, Diabrotica virgifera
  misc_feature: Coding regions on vcDNA: vcDNA=SeqID_1205; Strand=+; Position=80-907
  misc_feature: Homolog annotation: Hit_ID=AAH23567.2; Match level="QueryCoverage =75%, HitCoverage=45%, E-value=9e-15, Identity=28%"; Hit description =Cytokine receptor-like factor 3 [Homo sapiens]
MIQCKHANIYLSRLKWLNSELDHAMKQILNTFEETEANVSKTFCNFKEAFIEALNKREKILLDKAKKVAELTEKPGAVLVEWKVVVDNEEKVTDIEEFRLQKALGNVHEDKHLVVNFHDAYKGLDCQRLQKDLKVNEQYSFRVCCKFEGTTEWSPWSLPQVGSTSLKPFSWQFSQDYELTNEFKVAKPKKDDVDMLYSEGAQFSAGYAIDFMFLEGHPSDAVVGLVCEGLDELPKNVKRCKEGTFAINRNEKTSVDGVQESTVMAEFHRGSKGTFT

SEQ ID NO: 21509 - protein, 240 aa, Diabrotica virgifera
  misc_feature: Coding regions on vcDNA: vcDNA=SeqID_1206; Strand=+; Position=257-977
  misc_feature: Homolog annotation: Hit_ID=EAL28352.1; Match level="QueryCoverage =96%, HitCoverage=49%, E-value=9e-79, Identity=60%"; Hit description =GA19110-PA [Drosophila pseudoobscura]
  misc_feature: Gene Ontology Annotation: Cellular component=mitochondrion
  misc_feature: Pfam annotation: Pfam_ID=MFS_1; Match level="Score=-25.3, E-value =0.032, Copies=1"; Pfam description=Major Facilitator Superfamily
  misc_feature (174)..(174): Xaa can be any naturally occurring amino acid
  misc_feature (182)..(182): Xaa can be any naturally occurring amino acid
  misc_feature (188)..(188): Xaa can be any naturally occurring amino acid
  misc_feature (202)..(202): Xaa can be any naturally occurring amino acid
  misc_feature (204)..(204): Xaa can be any naturally occurring amino acid
  misc_feature (210)..(210): Xaa can be any naturally occurring amino acid
  misc_feature (216)..(216): Xaa can be any naturally occurring amino acid
MSQNKKEKVHKMVYVIFISLLLDLFAFTMILPLLPSLLDHYKINDSKGLYNWLSSQIHEFQILVGAPEEYNSVLFGGFLGSLFSFLQFLAAPICGGLSDIIGRKTIMVICLVGISLSYILWALSKNLVIFILARFLGGISKGNVSLSMAIITDVSSINTRGKGMALIGIAFSLXFIVGPLIXAGFAVXAKKRSGEWFICPAXFXVLLSLXDLISLXQLFKETLPKEKRAKDVKVTLTNML

SEQ ID NO: 21510 - protein, 209 aa, Diabrotica virgifera
  misc_feature: Coding regions on vcDNA: vcDNA=SeqID_1207; Strand=+; Position=105-734
  misc_feature: Homolog annotation: Hit_ID=BAC87874.1; Match level="QueryCoverage =97%, HitCoverage=86%, E-value=6e-29, Identity=34%"; Hit description =arylalkylamine N-acetyltransferase [Periplaneta americana]
  misc_feature: Gene Ontology Annotation: Molecular function=arylalkylamine N -acetyltransferase activity; Biological process=catecholamine metabolism
  misc_feature: Pfam annotation: Pfam_ID=Acetyltransf_1; Match level="Score=15.1, E -value=0.015, Copies=1"; Pfam description=Acetyltransferase (GNAT) family
MTSPLEKSYKIRDATKADRDAIVEFLRISFFRDEPLNAFLELVTEENPTCETLEEFTVGHIPNGINLVAIHNDQIVGLILSTPLEKVQEEQYDCKNEKYNKLVRLLDYAAKHADPFVIYPSSTKGISVQVISVRKDFTGRGLAVELLQKTCDLAQQQGYDFVEIACTSLYSAKLSEKNSLKYTDYKENGEIVFKPESPHTTLNVYLKKL

SEQ ID NO: 21511 - protein, 468 aa, Diabrotica virgifera
  misc_feature: Coding regions on vcDNA: vcDNA=SeqID_1208; Strand=+; Position=3-1406
  misc_feature: Homolog annotation: Hit_ID=AAL28926.1; Match level="QueryCoverage =99%, HitCoverage=67%, E-value=1e-156, Identity=59%"; Hit description= LD30157p [Drosophila melanogaster]
  misc_feature: Gene Ontology Annotation: Molecular function=small GTPase regulatory/interacting protein activity; Cellular component=nucleus; Biological process=EGF receptor signaling pathway
HASAQQLIPIAVEICQHLATTFNQVLDTDEGSDEKAITAMGLLNTIETLLTVMDEQPEVMRLLEPTVLQVIANVLQNEVQEFYEEVLALIYDLTSKQISPDMWKVFELLYRVFMKNGIDHFTDMMPALHNYITIDTNAFLSDEQRLLAIYNMCKQILTEDSGEDPESHAAKLLEVVLLQCRKKIDTAAPMLIELAAARLLREVKTSELRTMCLQVLIAALYYDPQLLFSVLSKMPDFTNHFIKQWLHDTDCFLGIHDRKLCVLGLCTLISMPNKPPVLIEVAPKVVPSLILLFEGLKRAYAAKAAEAAEEEESESSDGELEDILSSDEDEIDDQGQEYLENLSKRATTALTQQGMNVTATINDINDASEDDDSNFEPNEETVLETYTTPLDEEDCDVDEYQAFKQVMTALQGQDPEWYNALTNNLNETQLKSLSEVCVLAEQRAAARESKRIEQQGGYIFTQQAVPTS

SEQ ID NO: 21512 - protein, 66 aa, Diabrotica virgifera
  misc_feature: Coding regions on vcDNA: vcDNA=SeqID_1209; Strand=-; Position=807-1007
NIKYIVVNTNLCLNIAHSKVKRLTIKLVSLFKDYSNCHMTFDYVTKYVLETLPGYKIVFNSTQSPK

SEQ ID NO: 21513 - protein, 99 aa, Diabrotica virgifera
  misc_feature: Coding regions on vcDNA: vcDNA=SeqID_1210; Strand=+; Position=376-675
  misc_feature (41)..(41): Xaa can be any naturally occurring amino acid
PKNKKIKGGNITGLTKPNGGGTIMETYGWKIKFGKWKFNFXLKGNKKGFNNTINNWISNFTGNNKKGPNPFSSWVTGSKSGPNPGSSLRTSSNLRTSRG

SEQ ID NO: 21514 - protein, 313 aa, Diabrotica virgifera
  misc_feature: Coding regions on vcDNA: vcDNA=SeqID_1211; Strand=+; Position=15-956
  misc_feature: Homolog annotation: Hit_ID=XP_318747.1; Match level="QueryCoverage =76%, HitCoverage=35%, E-value=1e-18, Identity=27%"; Hit description =ENSANGP00000016535 [Anopheles gambiae]
  misc_feature: Gene Ontology Annotation: Molecular function=insulin-like growth factor binding; Cellular component=soluble fraction; Biological process=signal transduction
  misc_feature: Pfam annotation: Pfam_ID=LRR_1; Match level="Score=58.5, E-value=1.9e- 14, Copies=7"; Pfam description=Leucine Rich Repeat
MIVNKILVLLFLPFCFGKSVEVTFKDVTFKGFSVFTEKFKKKIPSGNKLADFLPPKTVYDAIEMKEQHIPLLTKGSLADLDQLDELVIEYCGVEEVESGAISNVPNLRKLSLKGNAIKSIAKDVFSHLGISTLDLSLNQISTIHPQAFDNMPDLLNIQLADNFITQWNPEWLKNTPLLTRISLQNNSIEKLPAHAFKNMVGDKKYGKIDLTINLVFSHNKISEIDPEAFEDLTRINNLWLDNNVLESFDENLLSGIKVNDLRLNKNNIKCLDGNLDKILKAETNHIDSNPFDCNCLEKIKDGQLKEDVDFHFC

SEQ ID NO: 21515 - protein, 203 aa, Diabrotica virgifera
  misc_feature: Coding regions on vcDNA: vcDNA=SeqID_1212; Strand=+; Position=537-1145
  misc_feature (165)..(165): Xaa can be any naturally occurring amino acid
MEVEKKLNEDTGEKSDKIISTKVPNSEKDEKKSELTSNTAEGTEPPVKKVNESDKNKPNENNAVPKPSPKKTKEDINKLKLLVADDDDDDDVPGDFFDDFLKEDFMAGLDIVDDDDWDEEKSKKMHESRLTNKTQKEKPVEIKTPQNKNDIVKKRELRRDPEKTXRAIEKDKASKILSEKVKLSQTGLVPPRMEMKMDIPEMK

SEQ ID NO: 21516 - protein, 230 aa, Diabrotica virgifera
  misc_feature: Coding regions on vcDNA: vcDNA=SeqID_1213; Strand=+; Position=119-812
  misc_feature: Homolog annotation: Hit_ID=NP_731021.1; Match level="QueryCoverage =85%, HitCoverage=40%, E-value=1e-43, Identity=45%"; Hit description =CG1213-PC, isoform C [Drosophila melanogaster] ref|NP_731020.1| CG1213-PB, isoform B [Drosophila
  misc_feature: Gene Ontology Annotation: Molecular function=fructose transporter activity; Cellular component=plasma membrane; Biological process =hexose transport
  misc_feature (213)..(213): Xaa can be any naturally occurring amino acid
MENKEDRGYKKVPVHEEGVVEAAYAAERDSVYVTTTLPGPTSRNFLYIAASAANIASFVCGTAFGWTSPEIPKLNNLTTTPLADVLTPSQEGWVGSFLPLAAAIGPIGGGIMADMIGRKKSLLVATLPFLLAFLLNVMASTVFYFYVSRFLCGLGVGMIFTVLPMYIGEISDDEVRGSLGSFMQLFIVIGLLFSYALGPYLPVKTFNIILLFXPVIFIVLFFLVIPDSPY

SEQ ID NO: 21517 - protein, 286 aa, Diabrotica virgifera
  misc_feature: Coding regions on vcDNA: vcDNA=SeqID_1214; Strand=+; Position=131-992
  misc_feature: Homolog annotation: Hit_ID=XP_315471.1; Match level="QueryCoverage =98%, HitCoverage=64%, E-value=4e-93, Identity=34%"; Hit description =ENSANGP00000021202 [Anopheles gambiae]
  misc_feature: Gene Ontology Annotation: Cellular component=nucleoplasm; Biological process=mitosis
  misc_feature: Pfam annotation: Pfam_ID=KH_1; Match level="Score=120.7, E-value=3.5e- 33, Copies=3"; Pfam description=KH domain
  misc_feature (238)..(238): Xaa can be any naturally occurring amino acid
MQQPVMEGGAAYEPSVRSYDDLFPALPESTPQQQTNSSIGQWTNNKMRVGSTTITQVFRVPYEERKLDVQKFGEGESNHICGNIMKETGAHIEISHAKDQSLTFLVTGKQNEVLEARRKILTHFQTQANRQISIPKEHHRWILGKKGDRLKELEKTTATKISVPAMNDPSDILTITGTKEGIEKAEHEIRVTSDQQSKKASERLNIPRHFHPFITGPFNQNLNNMMTETGAKINVPPXSANKDEIFIAGEKEGVMAAKNKIEDLYQSIEKKLKTVGGGGAPSHTDT

SEQ ID NO: 21518 - protein, 106 aa, Diabrotica virgifera
  misc_feature: Coding regions on vcDNA: vcDNA=SeqID_1215; Strand=+; Position=311-628
  misc_feature: Homolog annotation: Hit_ID=CAG32123.1; Match level="QueryCoverage =95%, HitCoverage=14%, E-value=7e-23, Identity=50%"; Hit description =hypothetical protein [Gallus gallus]
  misc_feature: Gene Ontology Annotation: Cellular component=nucleus
MLHVFHVDSGRMMTFDMSLALESVDNLKRYVQEEFKIPAEKQVLLISGGECLDPKKRVCSYSAGTDTNPIFLFSKSIIESPIPPPPTGDYGSESDVDLKVQEHCDM

SEQ ID NO: 21519 - protein, 370 aa, Diabrotica virgifera
  misc_feature: Coding regions on vcDNA: vcDNA=SeqID_1216; Strand=+; Position=80-1191
  misc_feature: Homolog annotation: Hit_ID=XP_308743.1; Match level="QueryCoverage =90%, HitCoverage=63%, E-value=7e-57, Identity=39%"; Hit description =ENSANGP00000015016 [Anopheles gambiae]
  misc_feature: Pfam annotation: Pfam_ID=UDPGT; Match level="Score=-178.3, E-value =0.1, Copies=1"; Pfam description=UDP-glucoronosyl and UDP-glucosyl tra
  misc_feature (335)..(335): Xaa can be any naturally occurring amino acid
SLKYFLKMKKKYVLLIPILICMLCLQTTQAAKILGVFILSAKSHYSLGNALLRGLADAGHDVTMISPYEDIVPTKSGSYRSVVLTGFAERYEAIMKHVNPFEKAYTNDFTHFLKFQKIVYPGLERTLSHPNVQKLINSDETFDVVIVEQFATEAFKALAHHFKAHLVLFSSIGADSKLNYVVGNPTMVSYVPQVDTDFSREMTFCQRLYNTLLYIFEAVVTHYHWLPLQQEGLVKKYFPNSPSIFELNYNVSLILVNSHESLQPSIPLVPNIIPIGGFHVKKPKPLPKDLQQYLDDATEGVIFVSFGSSVKAVNLPKDKKEILITSFGKFKSESXLWKWEDEFRFTTKCKDPENGFHKWNLSSSSQCQTN

SEQ ID NO: 21520 - protein, 249 aa, Diabrotica virgifera
  misc_feature: Coding regions on vcDNA: vcDNA=SeqID_1217; Strand=+; Position=3-752
  misc_feature: Homolog annotation: Hit_ID=EAL27057.1; Match level="QueryCoverage =97%, HitCoverage=61%, E-value=2e-70, Identity=57%"; Hit description =GA18617-PA [Drosophila pseudoobscura]
  misc_feature: Gene Ontology Annotation: Molecular function=3-hydroxyisobutyryl-CoA hydrolase activity; Cellular component=cellular_component unknown; Biological process=embryogenesis and morphogenesis
IPYIAFIDRERPLAGVGLSVHGRYRVATERSLFAMPETQIGFFPDVGGSHFLPRLTGKLGWYLALTGQRLKGSDILKAGIATHLCDSKDLPQLEEALLNNCTTDADIQNTLIKFSKKDVPPFSLEQVLDKIDDYFSAPTMEEIVAKLEKDDSKWAQETLALLRKMSPTSLKVSLKMLELGQHYNLDDCLHMEYNMCLTFLKNNDFYEGVRALLIDKDQKPNWKPKTLEEVTTKIVDEYFYDLPKLKIKM

SEQ ID NO: 21521 - protein, 305 aa, Diabrotica virgifera
  misc_feature: Coding regions on vcDNA: vcDNA=SeqID_1218; Strand=+; Position=190-1107
  misc_feature: Homolog annotation: Hit_ID=EAL27057.1; Match level="QueryCoverage =94%, HitCoverage=72%, E-value=4e-87, Identity=57%"; Hit description =GA18617-PA [Drosophila pseudoobscura]
  misc_feature: Gene Ontology Annotation: Molecular function=3-hydroxyisobutyryl-CoA hydrolase activity; Cellular component=cellular_component unknown; Biological process=embryogenesis and morphogenesis
  misc_feature: Pfam annotation: Pfam_ID=ECH; Match level="Score=79.2, E-value=1.1e -20, Copies=1"; Pfam description=Enoyl-CoA hydratase/isomerase family
MIKPPGSLIKSFKCLLTSINRNMSSQTSEVIVKDVNNKGVLVLNRPKALNALNLSMIETIKPVLKDWESKKSLVLIKSTGEKSFCAGGDVRAVAEAGLRGEKTLGQIFFKTEYSTNALIGSYKIPYIAFIDGIVMGGGVGLSVHGRYRVATERSLFAMPETQIGFFPDVGGSHFLPRLTGKLGWYLALTGQRLKGSDILKAGIATHLCDSKDLPQLEEALLNNCTTDADIQNTLIKFSKKDVPPFSLEQVLDKIDDYFSAPTMEEIVAKLEKDDSKWAQETLALLRKMSPTSLKVSLKMWILGKT

SEQ ID NO: 21522 - protein, 400 aa, Diabrotica virgifera
  misc_feature: Coding regions on vcDNA: vcDNA=SeqID_1219; Strand=+; Position=1-1203
  misc_feature: Homolog annotation: Hit_ID=XP_393860.1; Match level="QueryCoverage =100%, HitCoverage=49%, E-value=1e-179, Identity=72%"; Hit description=similar to neutral endopeptidase 24.11 [Apis mellifera]
  misc_feature: Gene Ontology Annotation: Molecular function=zinc ion binding; Cellular component=endoplasmic reticulum; Biological process =reproduction
  misc_feature: Pfam annotation: Pfam_ID=Peptidase_M13; Match level="Score=271.2, E -value=1.8e-78, Copies=1"; Pfam description=Peptidase family M13
YLKAFETLVSKTPKRVQANYVMWRAASNSVSYLTERLRKRQLDYTAVITGKTEREPRWKECIDITSVSLSIASGALYVRKYFNEQARQNAIDMVKDIRAEFQDILKVVDWMDEETRENALEKAKSMTSHIAYPDELLDDEKLKEFYDGLEMDRNQYFKSILNLTLFGTRFSFKRLRQPVNKTDWITHGRPAIVNAFYSSIENSIQFPAGILQGVFFNADRPRYMNYGAIGFVIGHEITHGFDDQGRQFDKVGNLVDWWQETTKKRFVEKAQCIIDQYANYTVPELNLNLNGINTQGENIADNGGIKEAYLAYNSWVGRHGTEPKLPGLKYTPNQLFWISAANSWCSKYRPESLKLRVLTGYHSPAPFRIIGPMSNSEYFNKDFKCPEGSNMNRVKKCSVW

SEQ ID NO: 21523 - protein, 119 aa, Diabrotica virgifera
  misc_feature: Coding regions on vcDNA: vcDNA=SeqID_1220; Strand=+; Position=3-362
  misc_feature: Homolog annotation: Hit_ID=AAL41023.1; Match level="QueryCoverage =99%, HitCoverage=20%, E-value=9e-25, Identity=45%"; Hit description =juvenile hormone esterase [Tenebrio molitor]
  misc_feature: Gene Ontology Annotation: Molecular function=carboxylesterase activity; Cellular component=synaptic junction; Biological process =biological_process unknown
FGKPPVGELRFREPQPAEPWSGILDANQNTKACYQVNDFLNISSIQTEDCLFLNVYTPKYPSTTNSYPVLFFLYGGGFMGGASTFTAAGPHYLIEGEVIVVTSSYRVGPFSYFLSIVDK

SEQ ID NO: 21524 - protein, 404 aa, Diabrotica virgifera
  misc_feature: Coding regions on vcDNA: vcDNA=SeqID_1221; Strand=+; Position=4-1218
  misc_feature: Homolog annotation: Hit_ID=XP_312564.1; Match level="QueryCoverage =88%, HitCoverage=61%, E-value=9e-61, Identity=41%"; Hit description =ENSANGP00000014256 [Anopheles gambiae]
  misc_feature: Gene Ontology Annotation: Molecular function=carboxylesterase activity
  misc_feature: Pfam annotation: Pfam_ID=COesterase; Match level="Score=269.0, E -value=8.1e-78, Copies=1"; Pfam description=Carboxylesterase
MVIIKYLFSLFLTYHLVKGDDVIVTIPNGQLRGRLEYSLRKNVTFYAFQQIPFGKPPVGELRFREPQPAEPWSGILDANQNTKACYQVNDFLNISSIQTEDCLFLNVYTPKYPSTTNSYPVLFFLYGGGFMGGASTFTAAGPHYLIEGEVIVVTASYRVGPFGFLSTGDAASPGNYGLKDQTLALKWVRDNIKYFGGDPDKVTIHGASAGGASVTFHLASPQSRGLFRAGISHSGSLLMPWAYQDGAKEIAYRLAQAIDGNFDPTATTEELVQFLRSATADQVNMAAKTFQESIGNEQIVQGFFFGPVIEQPSETAFITEPMYSTIEGGRMSKVPLFIGINSEEALDRITYSYFPGSVQAYDADVKQLVNRNMHIQDDATKETIGNELDAFILMDVCKTIWLLL

SEQ ID NO: 21525 - protein, 289 aa, Diabrotica virgifera
  misc_feature: Coding regions on vcDNA: vcDNA=SeqID_1222; Strand=+; Position=98-967
  misc_feature: Homolog annotation: Hit_ID=EAL24565.1; Match level="QueryCoverage =94%, HitCoverage=54%, E-value=7e-21, Identity=25%"; Hit description =CG40500-PA.3 [Drosophila melanogaster]
  misc_feature: Gene Ontology Annotation: Molecular function=extracellular matrix structural constituent; Cellular component=extracellular space; Biological process=regulation of cell growth
  misc_feature: Pfam annotation: Pfam_ID=LRR_1; Match level="Score=60.2, E-value=5.9e- 15, Copies=8"; Pfam description=Leucine Rich Repeat
MFFQSVVFLFCVYTVYPCSDITFNNVNVTLKGAKDIKEITGCFEPTEDLIKVSYIQIINQNIPVIKRNAINSLPKLIDVILEENNITDIEPGAFRNLSMLYLLKIRNNNIRMIREGVFADLPLTELNLMNNSIEIIHPNAFDNMPNLIVLSLNENKITSLSNNWFKSSPKVGNINLERNYISVIPNKILQNIHGEHIVRNITILTNIMLNDNTIHKIEDGAFNGPETLGWLFLHRNEIGEISENSLGSLKTIEWVRLDHNKLKCVPDKLVEISPKIVYYLQSNPYLKCV

SEQ ID NO: 21526 - protein, 107 aa, Diabrotica virgifera
  misc_feature: Coding regions on vcDNA: vcDNA=SeqID_1223; Strand=+; Position=259-582
NMSESEFEEIERAWEEGCSAISPEKSKIRYQNSYQSFKKWSEGKNLRIGEKTLLAYFVQRHMQLKAPGCLWAEYLMIKSTLFLYNGIDISKYSTLIAYLKRKNIGYY

SEQ ID NO: 21527 - protein, 203 aa, Diabrotica virgifera
  misc_feature: Coding regions on vcDNA: vcDNA=SeqID_1224; Strand=+; Position=547-1156
  misc_feature: Homolog annotation: Hit_ID=XP_392336.1; Match level="QueryCoverage =92%, HitCoverage=53%, E-value=2e-58, Identity=59%"; Hit description =similar to CG7530-PA [Apis mellifera]
  misc_feature: Gene Ontology Annotation: Molecular function=molecular_function unknown; Cellular component=membrane; Biological process=signal transduction
  misc_feature: Pfam annotation: Pfam_ID=HlyIII; Match level="Score=-36.2, E-value =0.00085, Copies=1"; Pfam description=Haemolysin-III related
  misc_feature (187)..(187): Xaa can be any naturally occurring amino acid
MTMKHVTNTKNGIHDHTQSLLEDLPTSEEKEESKKIVDDSDSDDEYDEIYYQKARQLLPYEEAPEYLRHNPYILTGYRRNLKTNLCISSVFWWTNETINIWSHIFGLFLFVALTVYDFMILHVQATLSDKIIVSFLLGCFMTCMAFSALYHTFSCRSEKDCEKYLSYDLFGIALSLLAIYTSGIYYXFWCDTDWQLFYTITVT

SEQ ID NO: 21528 - protein, 253 aa, Diabrotica virgifera
  misc_feature: Coding regions on vcDNA: vcDNA=SeqID_1225; Strand=+; Position=174-935
  misc_feature: Homolog annotation: Hit_ID=XP_392336.1; Match level="QueryCoverage =90%, HitCoverage=65%, E-value=8e-71, Identity=57%"; Hit description =similar to CG7530-PA [Apis mellifera]
  misc_feature: Gene Ontology Annotation: Molecular function=molecular_function unknown; Cellular component=membrane; Biological process=lipid metabolism
  misc_feature: Pfam annotation: Pfam_ID=HlyIII; Match level="Score=46.1, E-value=1e -10, Copies=1"; Pfam description=Haemolysin-III related
MNTLFLEYYPLKFTDIFQNGIHDHTQSLLEDLPTSEEKEESKKIVDDSDSDDEYDEIYYQKARQLLPYEEAPEYLRHNPYILTGYRRNLKTNLCISSVFWWTNETINIWSHIFGLFLFVALTVYDFMILHVQATLSDKIIVSLFLGCFMTCMAFSALYHTFSCRSEKDCEKYLSYDLFGIALSLLAIYTSGIYYAFWCDTDWQLFYTITVTVIFAVAMTLHIPEFNVDPNGQTIVFVALGLYGVIPTIHLDIK

SEQ ID NO: 21529 - protein, 79 aa, Diabrotica virgifera
  misc_feature: Coding regions on vcDNA: vcDNA=SeqID_1226; Strand=+; Position=907-1143
  misc_feature (75)..(75): Xaa can be any naturally occurring amino acid
LMCSIVCNYISQVCILDDRQNSHFCVSLIRNNLIIYLLRVFIKTLISIIILSTYDLRRLLKCFSVYEIYICICDXNRYM

SEQ ID NO: 21530 - protein, 204 aa, Diabrotica virgifera
  misc_feature: Coding regions on vcDNA: vcDNA=SeqID_1227; Strand=+; Position=328-936
  misc_feature: Homolog annotation: Hit_ID=XP_392336.1; Match level="QueryCoverage =70%, HitCoverage=40%, E-value=1e-37, Identity=55%"; Hit description =similar to CG7530-PA [Apis mellifera]
  misc_feature: Gene Ontology Annotation: Molecular function=molecular_function unknown; Cellular component=membrane; Biological process=signal transduction
  misc_feature (178)..(178): Xaa can be any naturally occurring amino acid
  misc_feature (199)..(199): Xaa can be any naturally occurring amino acid
MTSKLRLWIAPYSELSLEGDGAFCKPCGKSNMTVTLAAKHEVAIDDNDNETCCTNTKNGIHDHTQSLLEDLPTSEEKEESKKIVDDSDSDDEYDEIYYQKARQLLPYEEAPEYLRHNPYILTGYRRNLKTNLCISSVFWWTNETINIWSHIFGLFLFVALTVYDFMILHVQATLSDKXIVSLFLGCFMTCMAFSALYHXTFSCR

SEQ ID NO: 21531 - protein, 185 aa, Diabrotica virgifera
  misc_feature: Coding regions on vcDNA: vcDNA=SeqID_1228; Strand=+; Position=2-559
  misc_feature: Homolog annotation: Hit_ID=XP_308641.1; Match level="QueryCoverage =92%, HitCoverage=99%, E-value=4e-74, Identity=77%"; Hit description =ENSANGP00000011253 [Anopheles gambiae]
  misc_feature: Gene Ontology Annotation: Molecular function=ATP binding; Cellular component=nucleus; Biological process=negative regulation of cell proliferation
  misc_feature: Pfam annotation: Pfam_ID=NDK; Match level="Score=365.7, E-value=6.1e -107, Copies=1"; Pfam description=Nucleoside diphosphate kinase
PTRPPFFFLSDRRVVCMICTLLAIFYYFLRAMAANQERTFIMIKPDGVQRGLVGKIIKRFEQKGFRLVAMKFMWPSEELLKKHYADLAGKPFFAGLVKYMSSGPVVPMVWEGLGVVKTGRVLLGATNPADSAPGTIRGDLCIQVGRNICHGSDAVESANKEIDLWFTEKELVPWTPAAKTWVYED

SEQ ID NO: 21532 - protein, 354 aa, Diabrotica virgifera
  misc_feature: Coding regions on vcDNA: vcDNA=SeqID_1229; Strand=+; Position=40-1104
  misc_feature: Homolog annotation: Hit_ID=XP_319555.1; Match level="QueryCoverage =88%, HitCoverage=73%, E-value=2e-69, Identity=40%"; Hit description =ENSANGP00000017837 [Anopheles gambiae]
FDADVKSHSMAERLDLLLFGATGVTGLHAIRYLHKFSKEKKLTWGVSGRSETKLKAVLKNEGLRMGEDLSIIPIVLADTKDQKSLNEMAKKAKVLLNCCGPYRLLGFPVVEACIKAGTHHLDVSGEPSYIDSLPEKYDAAAKEKGIYIVSACGVDCVPTDLGSAYLQQKFDGVLNSVVAYVELWTEGKSSGSVGGYGTWQSLVYEFQTMGSLSKLKAKLIPPSDSAFKPTLPVKIRPFYSEVTKGWVMPFAGHDRKIMQETQKYFYEKESQRPINGQVLMSVTSIFTLIYINIVLLTLFALAQFSFTRNWLIENPQIFSFGYVKKKKTFRKKKKKPFLKKPKTRGPAFYSNILF

SEQ ID NO: 21533 - protein, 395 aa, Diabrotica virgifera
  misc_feature: Coding regions on vcDNA: vcDNA=SeqID_1230; Strand=+; Position=641-1828
  misc_feature: Homolog annotation: Hit_ID=XP_312273.1; Match level="QueryCoverage =91%, HitCoverage=84%, E-value=3e-80, Identity=39%"; Hit description =ENSANGP00000021082 [Anopheles gambiae]
FHLQTLRLNQRCQLRSVHSIRHQIFAEDLSKIPIVLADTKDQKSLNEMAKKAKVLLNCCGPYRLLGFPVVEACIKAGTHHLDVSGEPSYIDSLPEKYDAAAKEKGIYIVSACGVDCVPTDLGSAYLQQKFDGVLNSVVAYVELWTEGKSSGSVGGYGTWQSLVYEFQTMGSLSKLKAKLIPPSDSAFKPTLPVKIRPFYSEVTKGWVMPFAGHDRKIMQETQKYFYEKESQRPINGQVLMSVTSIFTLIYINIVLLTLFALAQFSFTRNWLIEYPQIFSFGYVKKEEHPSEEVKAGGRYRLTLYGEGWKEKLANVNDQYAMPPNRSILAQLQFENFYTFTVLGLMCAGIAILNEKDKLPKSGGVYSAGAAFGKTSLMKMLIENGTSFEIKSVKDI

SEQ ID NO: 21534 - protein, 180 aa, Diabrotica virgifera
  misc_feature: Coding regions on vcDNA: vcDNA=SeqID_1231; Strand=+; Position=137-679
  misc_feature: Homolog annotation: Hit_ID=AAQ09911.1; Match level="QueryCoverage =90%, HitCoverage=92%, E-value=6e-36, Identity=42%"; Hit description =CG13011 [Drosophila yakuba]
  misc_feature: Pfam annotation: Pfam_ID=MARVEL; Match level="Score=34.6, E-value=3e -07, Copies=1"; Pfam description=Membrane-associating domain
MARGPTIVAVHSAASQGGINCCFCRCCTCLQLQVLKSPEGIIKLAEILLGFFCQSLALNFGAGYASTIGSSYQSFLSTASWCLLTSFLLLFSYVCSQKSLNLLRSSLFETLFNGVAALSYFGSCSYLGWAVNTFLQPMYVITPFFQVYPAMSAAYMMGTILGCIYAYDGYKSYQYFKGFR

SEQ ID NO: 21535 - protein, 272 aa, Diabrotica virgifera
  misc_feature: Coding regions on vcDNA: vcDNA=SeqID_1232; Strand=+; Position=35-853
  misc_feature: Homolog annotation: Hit_ID=AAC63079.1; Match level="QueryCoverage =94%, HitCoverage=51%, E-value=1e-37, Identity=33%"; Hit description =putative juvenile hormone esterase [Leptinotarsa decemlineata]
MTRRVIGCYGVRSGETRIVREKTSGSLFPTKFDNYIVYNVGNTPVTAEGIFSTKLRWHKAVTSYVLQPGESRVLEMSGVLFFGIGIRLINESNSRAIVHCADETGYVILEEGTAQKPKIDIDRVEITNNRYCVGKLSYIGDDFSKIINIFWPKHEANIWSKFQDLVNDELDRTVREQVNSVLNNELRIIKDHLDDLNKNIENSADLYKNTSDLIFGLEKEFTFADYKNHEMSFYCLPYYSALVTLQVLYYQFGIVNQKKINLSGRIYHENKK

SEQ ID NO: 21536 - protein, 174 aa, Diabrotica virgifera
  misc_feature: Coding regions on vcDNA: vcDNA=SeqID_1233; Strand=-; Position=74-598
NCLLGLHATAPGRNFTKYTKICHPEKKYTYPPPTHLTKYTRPQNRCCHLNLLTNYYAVILSVVVSLLVVIVSSKYVERISELYLRKYLKLHDEYVLEIESCSDNADLNVCGRTNLNRNNTEIDYSVQCNKWIENFSENTKHSGFKLHHMYWNRVYFPRCVDSGYGHLQFWMTYV

SEQ ID NO: 21537 - protein, 268 aa, Diabrotica virgifera
  misc_feature: Coding regions on vcDNA: vcDNA=SeqID_1234; Strand=+; Position=68-872
  misc_feature: Homolog annotation: Hit_ID=EAL42176.1; Match level="QueryCoverage =87%, HitCoverage=57%, E-value=4e-96, Identity=69%"; Hit description =ENSANGP00000026362 [Anopheles gambiae str. PEST] ref|XP_560906.1| ENSANGP00000026362 [Anopheles gambiae st
  misc_feature: Pfam annotation: Pfam_ID=CoA_transf_3; Match level="Score=131.0, E -value=2.9e-36, Copies=1"; Pfam description=CoA-transferase family III
  misc_feature (244)..(244): Xaa can be any naturally occurring amino acid
MYCPTFRVLSCTKQITNQLRKKSIQISSNSDESPLDGIRILDLTRIVAGPFCTMVLSDLGAEVIKVERPKTGDECRKWGPPFANNTQEPCYFLSVNRNKKSMCVDLKHPEGKSILYDLAKKSDVLVENYVPGKLDELKLGYEDFRKVAPHLIYCSITGYGPDGPYKNRPGYDVIAASMGGLIHATGTISGEPVKVGVAMTDVTTGLYAHGAIMAALIKRSRTGRGQKNDCNLLSTQISTLINIXANYLNAGKEATKWGTAHESIVPYK

SEQ ID NO: 21538 - protein, 325 aa, Diabrotica virgifera
  misc_feature: Coding regions on vcDNA: vcDNA=SeqID_1235; Strand=-; Position=78-1056
  misc_feature: Homolog annotation: Hit_ID=BAB17302.1; Match level="QueryCoverage =60%, HitCoverage=24%, E-value=1e-24, Identity=35%"; Hit description =inter-alpha-trypsin inhibitor heavy chain3 [Oryctolagus cuniculus]
  misc_feature: Gene Ontology Annotation: Molecular function=copper ion binding; Cellular component=extracellular space
  misc_feature (25)..(25): Xaa can be any naturally occurring amino acid
LENSGFSRHIYDASDAALQLHDFYXSSPLMTNINFKYDTEAKELTRIHYPIYFRGNEIAIAGKYTGNKLTAEVNGLGRRGPIRLLPKIEEPVTSLERLWAYLTIKQTLEKREVAENKDELTKKALELALKYSFVTEVTSLVVVKPNATNAVDTEEASQNRGGRFGGPVRAYNKMARRPAIGHSYLASASFSPSLHMDYAPRLASSYSSHHARVPTPIATSTRPDVKPKIEDSLPWLASAMNSNRTITLPDGVFELGDNNLVNYPHGVCPKTPQGVEGECVLIKDCPTVLPYLTDLAAYTKYFCPVESKYAGVCCPKVLKRPARGL

SEQ ID NO: 21539 - protein, 307 aa, Diabrotica virgifera
  misc_feature: Coding regions on vcDNA: vcDNA=SeqID_1236; Strand=+; Position=115-1035
  misc_feature: Homolog annotation: Hit_ID=XP_320780.1; Match level="QueryCoverage =97%, HitCoverage=94%, E-value=1e-63, Identity=42%"; Hit description =ENSANGP00000014129 [Anopheles gambiae]
  misc_feature: Gene Ontology Annotation: Biological process=nucleotide metabolism
  misc_feature: Pfam annotation: Pfam_ID=IU_nuc_hydro; Match level="Score=124.8, E -value=2.1e-34, Copies=1"; Pfam description=Inosine-uridine preferring nucleoside
MKMRRVILDVDVGTDDYMALLHLMHAENRGEIKIEGIVCTSGNTDLDHVVINTVRLLELIGRTDIPVFKGAKRELILLNNIERYHGEDGLGDLYYDTDPDLSIVSKTPAAVAIHDIVDAHPNAVSLICVGPLTNLALSLKLYDDLASKIKDVWIMGGNYTAVGNVSRCAEFNFHVDPEAAYIALENLICPIYVLPWETCLLPKIPLEWRFEALGNATPELTLLTKAEEIIYKRHNREHWIPCDTFLTFAFTNPEEHILKSSIHHASVELHGDLTRGQVVLDHLKMKSPNVIIYRDIDTQLFIKEMLK

SEQ ID NO: 21540 - protein, 173 aa, Diabrotica virgifera
  misc_feature: Coding regions on vcDNA: vcDNA=SeqID_1237; Strand=-; Position=437-959
  misc_feature: Homolog annotation: Hit_ID=XP_312124.1; Match level="QueryCoverage =84%, HitCoverage=62%, E-value=5e-24, Identity=35%"; Hit description =ENSANGP00000023417 [Anopheles gambiae]
  misc_feature (99)..(99): Xaa can be any naturally occurring amino acid
NNGKRQARTKCDGQHLKFQRVQRFKYLGAVITADNDVTEEIKDRIQSGNRCLFALDKLIKSKNLTGSSKIKIYKSIVRPVLTYGCETWTMTKANEEKLXVLNEKIFGPHHDITILQEIKSQRLRWAGHVHKLHNERLVRLVWEEIPTRKRPLGRPRMRWRDSILRSPKNEHSI

SEQ ID NO: 21541 - protein, 108 aa, Diabrotica virgifera
  misc_feature: Coding regions on vcDNA: vcDNA=SeqID_1238; Strand=+; Position=402-728
GQMGLFIFRRSAWMLSLHRILGRPSGLLPVGISSHTSLTICNIAKSEYHLMTKYVSQKTGIESFCSVYFTFSSSLPSSPSIFSSSITEPYFVTEEYLSMIWSMILIQH

SEQ ID NO: 21542 - protein, 77 aa, Diabrotica virgifera
  misc_feature: Coding regions on vcDNA: vcDNA=SeqID_1239; Strand=-; Position=1-231
AKITESVFIIRLILKQPEQKSFYCTKAPKIIFSRHSTKLFNQDVALVGSCGGRCVLALGGVLKSSFLGVFGRPSPPK

SEQ ID NO: 21543 - protein, 399 aa, Diabrotica virgifera
  misc_feature: Coding regions on vcDNA: vcDNA=SeqID_1240; Strand=+; Position=34-1230
  misc_feature: Homolog annotation: Hit_ID=EAA11902.3; Match level="QueryCoverage =83%, HitCoverage=66%, E-value=1e-120, Identity=61%"; Hit description= ENSANGP00000018572 [Anopheles gambiae str. PEST] ref|XP_556430.1| ENSANGP00000018572 [Anopheles gambiae s
  misc_feature: Gene Ontology Annotation: Molecular function=electron transporter activity; Cellular component=mitochondrion; Biological process =ecdysone biosynthesis
  misc_feature: Pfam annotation: Pfam_ID=p450; Match level="Score=-199.5, E-value =0.047, Copies=1"; Pfam description=Cytochrome P450
MMSKNIVTMSREISRRLSLTALQFQRTYATDRPYSTALGVVSDEMQDKDIYEYKIEKVDPIPKDYKEIPGPKELPFIGNSWRFAPIIGHYKIHELDKVMWSLHKQYGKIAKVSGLIGHPDLLFIFDGDEIKNGFKKEEAMPHRPSMPSLHYYKQKLQKDFFNGNEGIIGVHGPKWETFRKQVQQFLLPPITAKKYIEPLDEISTDFINRMENMLDTNRELPDHFLSEIYKWALESVARVSLNRRLGCLEPNLPQDSESQKIINAINTFFWNVAEVELKLPIWRVYKNNSFKKYIGALEDFRTLCLKYITHSIEEIRSKSYDNVKEQDISILEQILLKTGNAKLAAVLALDLFLVGVDTTSIAVASTMYQLSQNPDKQQKLFKELNRGLPSLEPKMKYLH

SEQ ID NO: 21544 - protein, 156 aa, Diabrotica virgifera
  misc_feature: Coding regions on vcDNA: vcDNA=SeqID_1241; Strand=+; Position=2-472
  misc_feature: Homolog annotation: Hit_ID=AAK59928.1; Match level="QueryCoverage =96%, HitCoverage=100%, E-value=1e-73, Identity=88%"; Hit description= ribosomal protein S11 [Heliothis virescens]
  misc_feature: Gene Ontology Annotation: Biological process=reproduction
  misc_feature: Pfam annotation: Pfam_ID=Ribosomal_S17; Match level="Score=146.0, E -value=8.7e-41, Copies=1"; Pfam description=Ribosomal protein S17
GRPVKMADQTEKAFQKQPTVFLNRKSGGKKNLRHSRSVGLGFKTPREAIEGSYIDKKCPFTGNVSIRGRILTGVVQKMKMQRTIVIRRDYLHYIRKYNRFEKRHRNMSVHLSPCFRDVEIGDVVTIGECRPLSKTVRFNVLKVTKGSSSKKSFRKF

SEQ ID NO: 21545 - protein, 54 aa, Diabrotica virgifera
  misc_feature: Coding regions on vcDNA: vcDNA=SeqID_1242; Strand=-; Position=402-566
PKSGLGPLGRDIIPYCWIVQKHGILRSLIFFSNVVCLSCGKYNGTVYAKRPGNF

SEQ ID NO: 21546 - protein, 280 aa, Diabrotica virgifera
  misc_feature: Coding regions on vcDNA: vcDNA=SeqID_1243; Strand=+; Position=116-955
  misc_feature: Homolog annotation: Hit_ID=CAF93504.1; Match level="QueryCoverage =99%, HitCoverage=60%, E-value=1e-103, Identity=65%"; Hit description= unnamed protein product [Tetraodon nigroviridis]
  misc_feature: Gene Ontology Annotation: Molecular function=proteasome endopeptidase activity; Cellular component=proteasome regulatory particle (sensu Eukarya); Biological process=proteolysis and peptidolysis
  misc_feature (274)..(274): Xaa can be any naturally occurring amino acid
MENIATDSGKIVKMEVDYSATCDDKIPECQKLAKSGKLHDALDQLLALEKQTRTGADMISTGRVLVAICQICKDAKNWSALNEHIVLLTKRRSQLKQAVAKMVQECCSYVDETPDKETKVKLIDTLRQVTEGKIYVEVERARLTHKLAKIREDDGDIQQAADIIQELQVETYGSMEKREKVELILEQMRLCVAKQDYIRTQIISKKINTKFFDEDGSSDLKLKYYRLMMEVDEHEGSYLATCKHYRAVLNTPSIMADAEERQAAAQARVLYIIXGSHDNE

SEQ ID NO: 21547 - protein, 56 aa, Diabrotica virgifera
  misc_feature: Coding regions on vcDNA: vcDNA=SeqID_1244; Strand=+; Position=209-379
  misc_feature: Homolog annotation: Hit_ID=CAH04315.1; Match level="QueryCoverage =78%, HitCoverage=16%, E-value=7e-14, Identity=84%"; Hit description =S3Ae ribosomal protein [Biphyllus lunatus]
TLIQHRGRNLYYRFELSKLLELHGDGGKGGAGDSTGEAGSKVDRPEGYEPPVQESV

SEQ ID NO: 21548 - protein, 284 aa, Diabrotica virgifera
  misc_feature: Coding regions on vcDNA: vcDNA=SeqID_1245; Strand=+; Position=11-865
  misc_feature: Homolog annotation: Hit_ID=CAH04315.1; Match level="QueryCoverage =94%, HitCoverage=100%, E-value=1e-141, Identity=94%"; Hit description=S3Ae ribosomal protein [Biphyllus lunatus]
  misc_feature: Gene Ontology Annotation: Molecular function=structural constituent of ribosome; Cellular component=cytosolic small ribosomal subunit (sensu Eukarya); Biological process=protein biosynthesis
  misc_feature: Pfam annotation: Pfam_ID=Ribosomal_S3Ae; Match level="Score=495.9, E -value=4.1e-146, Copies=1"; Pfam description=Ribosomal S3Ae family
MRTRGRMCGFSSTTAIMAVGKNKGLSKGGKKGVKKKVVDPFTRKDWYDVKAPSMFATRQVGKTLVNRTQGTKIASEGLKFRVFEVSLADLQNDNDAERSFRKFRLIAEDVQGRNVLTNFHGMDLTTDKLRSMVKKWQTLIEASADVKTSDGYLLRVFCIGFTNKDQLSQRKTCYAQHTQVRAIRKKMVDIITRDIQGSDIKEVVNKLLPDSIAKDIEKACQGIYPLHDVYIRKVKVLKKPRFELSKLLELHGDGGKGGAGDSTGEAGSKVDRPEGYEPPVQESV

SEQ ID NO: 21549 - protein, 363 aa, Diabrotica virgifera
  misc_feature: Coding regions on vcDNA: vcDNA=SeqID_1246; Strand=+; Position=47-1138
  misc_feature: Homolog annotation: Hit_ID=XP_307732.1; Match level="QueryCoverage =80%, HitCoverage=90%, E-value=6e-61, Identity=35%"; Hit description =ENSANGP00000016355 [Anopheles gambiae]
  misc_feature: Gene Ontology Annotation: Molecular function=chitinase activity; Cellular component=extracellular space; Biological process=response to bacteria
  misc_feature: Pfam annotation: Pfam_ID=Glyco_hydro_18; Match level="Score=292.7, E -value=6.1e-85, Copies=1"; Pfam description=Glycosyl hydrolases family 18
MKAVLLVLACVLVSAYSQCDEKPDVEVVCYWGSWSVYRKENGKFATKDIDVKSCTTVIYAFAGINLDQKTTSLDTYKDLDLKGFANFTALKQDNPCLTTMLAIGGWNEGSRKYSVMANSKQLREDFADSVIAFLAYYGFDGVDIDWEYPTTRGGIKEDGENFISLLQALKSRFEKYELKLSIAVSIDVDLINTAYVVPKLADLVDNVNVMAYDYVTSESNVTGLSSPLSKIKDTISHWLKAGLPSKKLYLGIPAYAKTFILANESNADIGAKVTGQGDPGEFTQEAGLLAYYEVKSLMNDPREVATTVDDTNSFFFALFWFTLVFNFENPPENPAPPKKLIFFQWESTTFGGEIFCFWAPFEQ

SEQ ID NO: 21550 - protein, 209 aa, Diabrotica virgifera
  misc_feature: Coding regions on vcDNA: vcDNA=SeqID_1247; Strand=+; Position=83-712
  misc_feature: Homolog annotation: Hit_ID=XP_393312.1; Match level="QueryCoverage =94%, HitCoverage=94%, E-value=3e-72, Identity=71%"; Hit description =similar to ENSANGP00000020090 [Apis mellifera]
  misc_feature: Gene Ontology Annotation: Molecular function=defense/immunity protein activity; Cellular component=extracellular matrix; Biological process= cell-matrix adhesion
  misc_feature: Pfam annotation: Pfam_ID=Hairy_orange; Match level="Score=75.6, E -value=1.3e-19, Copies=1"; Pfam description=Hairy Orange
MSYEMITPTSVEESQPISRTYQYRKVMKPMLERKRRARINRCLDELKELMVTALQSEGENVSKLEKADILELTVRHLHKLRKQQRLSTNPVIDADRFRAGYTHCANEVSRCLASTPGVDIQLGTKLMTHLGHRLNEMDKVSPLVIQVSSQYTPPGSPNLETEVPHHYTMPLTPASSSSSRCSPSPNQPMDCSTAGLLKVAKQEAMWRPW

SEQ ID NO: 21551 - protein, 206 aa, Diabrotica virgifera
  misc_feature: Coding regions on vcDNA: vcDNA=SeqID_1248; Strand=+; Position=157-777
  misc_feature: Homolog annotation: Hit_ID=XP_309138.1; Match level="QueryCoverage =88%, HitCoverage=62%, E-value=5e-79, Identity=75%"; Hit description =ENSANGP00000018750 [Anopheles gambiae]
  misc_feature: Gene Ontology Annotation: Molecular function=transporter activity; Cellular component=membrane; Biological process=intracellular protein transport
  misc_feature: Pfam annotation: Pfam_ID=EMP24_GP25L; Match level="Score=73.0, E -value=8.4e-19, Copies=1"; Pfam description=emp24/gp25L/p24 family
MRYWVFIVSLGLFQFALGTELTFELPDSAKECFHEEIKKNTSCTLEYQVVTGGNYDVDVALEDPKGNILYKQVKMQFDSHTFVSQDHGIYKVCFSNEFSTFSHKLVYMDFQVGEEQPLPGIGEHATVLTQMESSAQEIHKSLNTILDYQTHHRLREAQGRKRAEELNERVLWWSIMETLAVITIAFGQVFVLKNFFTEKKPYTQFK

SEQ ID NO: 21552 - protein, 273 aa, Diabrotica virgifera
  misc_feature: Coding regions on vcDNA: vcDNA=SeqID_1249; Strand=+; Position=61-882
MRLILVLSVLSALVAISFATVSEIIGGTLIGSLIVHKVAKDLGIGNIITIEGDARAKLGNNEIAVEAAAGVGGDVVGYHANVEGDVLGQEVKVHGDIYDGDKVMDKYRTVSIDDQGRQYVLVRKWVGTTPVLVRQYIDTLDVNGKPVPTNPMVRRVGMIIEIRRPDGTIELHRPDGKIIILRSGAIIYVKRPDGTVELRRPDGTILEIRRPGTFIEVKQPDGTIVVYKLELVVPETKPVPIDTSMVPVHVPLIKPTLLETSRYPARYPARYPA

SEQ ID NO: 21553 - protein, 208 aa, Diabrotica virgifera
  misc_feature: Coding regions on vcDNA: vcDNA=SeqID_1250; Strand=+; Position=20-646
  misc_feature: Homolog annotation: Hit_ID=NP_727758.1; Match level="QueryCoverage =100%, HitCoverage=95%, E-value=1e-20, Identity=36%"; Hit description= CG32603-PA [Drosophila melanogaster] gb|AAN09580.1| CG32603-PA [Drosophila melanogaster]
  misc_feature: Gene Ontology Annotation: Molecular function=calcium ion binding
MAFKVLVFAALVAYVNAGIFGEAPVAAPVVSAYSAAPVVAAAPVVAAPAAVSRSYIQTYSSHSAPLAVAAPVVAKSVAPVVSAYSAPLALPAAAPVISSYSAPVVAKSVGPVAYSAHAPVVSAYSSPLVAQSVSPVAYAAPAPVLSAYSSPVVAKSVAPLSYAAPAPVLSAYSAPVVASSFAPAPLAYAAHGSPLVSAYSSGPLVQPW

SEQ ID NO: 21554 - protein, 243 aa, Diabrotica virgifera
  misc_feature: Coding regions on vcDNA: vcDNA=SeqID_1251; Strand=+; Position=150-881
  misc_feature: Homolog annotation: Hit_ID=XP_393883.1; Match level="QueryCoverage =97%, HitCoverage=97%, E-value=7e-90, Identity=69%"; Hit description =similar to CG1591-PA [Apis mellifera]
  misc_feature: Gene Ontology Annotation: Cellular component=nucleus
  misc_feature: Pfam annotation: Pfam_ID=PA28_beta; Match level="Score=322.4, E-value= 6.6e-94, Copies=1"; Pfam description=Proteasome activator pa28 beta subuni
MAESVKVQEYKEEVKKQAESLVLKGFPETIVKLNSILETSHFKNRSFNDVHQDLNIPIPEPIILNSHSELPVAKKAKLDPSLIQDGTKVMILPTGAVSTNKNIVELIEQVKPHIRKLVEDSNLIKMWISFMIPKIEDGNNFGVSIQEDTLAEVQSVESEAAAFFDQISRYYVSRGKLISKVAKYPHIEDYRKSVQELDEKEYLSLWLVMSEIRNRYCALHDIVLKNLDKIKKPRPSNATESLY

SEQ ID NO: 21555 - protein, 334 aa, Diabrotica virgifera
  misc_feature: Coding regions on vcDNA: vcDNA=SeqID_1252; Strand=+; Position=47-1048
  misc_feature: Homolog annotation: Hit_ID=NP_511166.2; Match level="QueryCoverage =87%, HitCoverage=82%, E-value=5e-99, Identity=57%"; Hit description =CG8288-PA [Drosophila melanogaster] gb|AAF48508.2| CG8288-PA [Drosophila melanogaster]
  misc_feature: Gene Ontology Annotation: Molecular function=RNA binding; Cellular component=mitochondrial large ribosomal subunit; Biological process =protein biosynthesis
  misc_feature: Pfam annotation: Pfam_ID=Ribosomal_L3; Match level="Score=122.1, E -value=1.3e-33, Copies=1"; Pfam description=Ribosomal protein L3
  misc_feature (322)..(322): Xaa can be any naturally occurring amino acid
MALVLSNIATKSNLKVIEEKLFALSICNSNQTRCMAKLNPPPRLRNPTWFTKKMIFTRDEEITKENEKFVQEVIQDKYSNITPKGEVATNIEWTPELQRTGVIARKIGVYPLWLKNGKPIQTTLLQVLDNHVIKKIAPDEYDSPRKRVLEVRNKKACLLLGAEGVDPSKFTKEYCGLFKESGVIPKQVLARFFVSPDAVLPLGTLISAMHFQVGNAIDVRGKTIDRGFQGVMKRHGFKGMPASHGVTKTHRRGGNIGGGGEKGRVWPGTKMPGHMGNRFRIAKGLKILRINTRHNVLWVTGQAIPGETNSICFIYDSKLPLXKPEKALPFPTYL

SEQ ID NO: 21556 - protein, 235 aa, Diabrotica virgifera
  misc_feature: Coding regions on vcDNA: vcDNA=SeqID_1253; Strand=+; Position=234-938
  misc_feature: Homolog annotation: Hit_ID=NP_611231.1; Match level="QueryCoverage =80%, HitCoverage=75%, E-value=7e-47, Identity=50%"; Hit description =CG14480-PA [Drosophila melanogaster] gb|AAF57835.1| CG14480-PA [Drosophila melanogaster]
  misc_feature: Gene Ontology Annotation: Molecular function=molecular_function unknown; Cellular component=cellular_component unknown; Biological process=N-linked glycosylation
MSSGFITESEVIEIRKRRQEEWEKVRKADDPKERPEEPYDNRSLYEKLQEQKQKKDLEYEEAHKLKNMIKGLDDDEIEFLDLVDRTKTEADRKKELEEEQELRDYRNRVSILQEKSIDERLQAEIVVNKTKREKQPNSQQKLLKGVVIKKPENQKRKIDEVDNSEETNVKKQKNPENQKKKIDEVDNSDETNVKKQKKPENQKRKIDEIDNSEETNVKEQAIIDVDDKSTKNTQT

SEQ ID NO: 21557 - protein, 198 aa, Diabrotica virgifera
  misc_feature: Coding regions on vcDNA: vcDNA=SeqID_1254; Strand=+; Position=83-679
  misc_feature: Homolog annotation: Hit_ID=XP_319394.1; Match level="QueryCoverage =82%, HitCoverage=79%, E-value=3e-57, Identity=67%"; Hit description =ENSANGP00000012211 [Anopheles gambiae]
  misc_feature: Gene Ontology Annotation: Cellular component=integral to membrane
  misc_feature: Pfam annotation: Pfam_ID=Tim17; Match level="Score=89.4, E-value=9.3e- 24, Copies=1"; Pfam description=Tim17/Tim22/Tim23 family
MSSLNDSNDVYSSNYSSRSGLHGKVSPFSSPYLNYDPGYLPQAQPEFIFLDGASKQRGRFELAFGQIGGSCMIGAALGGASGFYNGLKATTLAGQTGKLRRTQLINYIMKKGSATANTFGSVAVIYSAFGVILSWARGGTDDDLNTIVAATATGCLYKSTAGLRKCGLGGAIGLGVSTAYALWVNRDKLSELRQFNPA

SEQ ID NO: 21558 - protein, 158 aa, Diabrotica virgifera
  misc_feature: Coding regions on vcDNA: vcDNA=SeqID_1255; Strand=+; Position=87-563
  misc_feature: Homolog annotation: Hit_ID=XP_317327.1; Match level="QueryCoverage =86%, HitCoverage=36%, E-value=2e-48, Identity=65%"; Hit description =ENSANGP00000010537 [Anopheles gambiae]
  misc_feature: Gene Ontology Annotation: Molecular function=binding; Cellular component=soluble fraction; Biological process=vitamin A metabolism
  misc_feature: Pfam annotation: Pfam_ID=CRAL_TRIO; Match level="Score=75.3, E-value =1.7e-19, Copies=1"; Pfam description=CRAL/TRIO domain
RRLFTDFNWDCSYSLQTIFRAFLLVLEHLIEHVHNQSNGFVVIVDWTEFTFRQSTYLKPSVLKLMIEGLQDCFPARFKGIHFIAQPWYVETALALIKPFLNEKVKERIFVHGNNLSTLHEHVHKDVLPAELGGEEPSYDHRTFLDMLQERLKQNHDTS

SEQ ID NO: 21559 - protein, 1521 aa, Diabrotica virgifera
  misc_feature: Coding regions on vcDNA: vcDNA=SeqID_1256; Strand=+; Position=66-4631
  misc_feature: Homolog annotation: Hit_ID=AAM50562.1; Match level="QueryCoverage =99%, HitCoverage=99%, E-value=0.0, Identity=99%"; Hit description =AT20865p [Drosophila melanogaster]
  misc_feature: Pfam annotation: Pfam_ID=ubiquitin; Match level="Score=3079.6, E -value=0, Copies=20"; Pfam description=Ubiquitin family
MQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKTKIQDKEGIPPDQQRLIFAGKQLEDGRTLSDYNIQKESTLHLVLRLRGGMQIFVKTLTGKTITLESDPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGN

SEQ ID NO: 21560 - protein, 147 aa, Diabrotica virgifera
  misc_feature: Coding regions on vcDNA: vcDNA=SeqID_1257; Strand=+; Position=147-590
  misc_feature: Homolog annotation: Hit_ID=XP_307421.1; Match level="QueryCoverage =100%, HitCoverage=96%, E-value=5e-61, Identity=77%"; Hit description= ENSANGP00000012938 [Anopheles gambiae] gb|EAA03029.1| ENSANGP00000012938 [Anopheles gambiae
  misc_feature: Gene Ontology Annotation: Molecular function=actin filament severing activity; Cellular component=actin cortical patch (sensu Saccharomyces); Biological process=actin filament organization
  misc_feature: Pfam annotation: Pfam_ID=Cofilin_ADF; Match level="Score=175.3, E -value=1.3e-49, Copies=1"; Pfam description=Cofilin/tropomyosin-type actin-bindin
MASGVTVADACKKVHEEIKRDKKHRFAIFYIKDGKQIDVEHIGERNAEYDDFLTKLQEGGANECRYGLFDFEYMHQCQGTSESTKKQKLFLMSWCPETASVKKKMVYASSFEYLKKALVIQKSIQATDLAEASITAVEEKLRSTDRQ

SEQ ID NO: 21561 - protein, 169 aa, Diabrotica virgifera
  misc_feature: Coding regions on vcDNA: vcDNA=SeqID_1258; Strand=+; Position=76-585
  misc_feature: Homolog annotation: Hit_ID=XP_307933.1; Match level="QueryCoverage =97%, HitCoverage=91%, E-value=7e-89, Identity=92%"; Hit description =ENSANGP00000021824 [Anopheles gambiae]
  misc_feature: Gene Ontology Annotation: Molecular function=ubiquitin conjugating enzyme activity; Cellular component=nucleoplasm; Biological process =establishment and/or maintenance of chromatin architecture
  misc_feature: Pfam annotation: Pfam_ID=UQ_con; Match level="Score=291.2, E-value =1.7e-84, Copies=1"; Pfam description=Ubiquitin-conjugating enzyme
MSEPQSALLLRKQLAELNKNPVEGFSAGLIDDNDIYRWEVLIIGPPDTLYEGGFFRCHLYFPKEYPLRPPKMKFVTEIWHPNIDKNGDVCISILHEPGDDKFGYEKASERWLPVHTVETILISVISMLADPNDESPANVDAAKEWRESYSEFKRKVARCVRKSQEQEEC

SEQ ID NO: 21562 - protein, 408 aa, Diabrotica virgifera
  misc_feature: Coding regions on vcDNA: vcDNA=SeqID_1259; Strand=+; Position=2-1225
  misc_feature: Homolog annotation: Hit_ID=XP_314896.1; Match level="QueryCoverage =100%, HitCoverage=29%, E-value=8e-80, Identity=37%"; Hit description= ENSANGP00000012396 [Anopheles gambiae]
  misc_feature (362)..(362): Xaa can be any naturally occurring amino acid
  misc_feature (371)..(372): Xaa can be any naturally occurring amino acid
  misc_feature (377)..(378): Xaa can be any naturally occurring amino acid
  misc_feature (390)..(390): Xaa can be any naturally occurring amino acid
IYALAVNGHKQHVPAILGKVRKAIGYNQDAVNITLRLINKGEEEAGFEVLKSMPRVTREDGSPAPTGYFFIKQLVKADRPLNVILKYCDIMEKEHMYDRGFLLAAEMSLQLGNEKLAYPMLEELQKRGITVRQHFFWPLFISKANDNKAVIDILQKMHDFNVFPNNETIREYVIPNLKGNSSQILALLRDGNISVGTAASSLVVFLLLRNEIKEAAAIATTIQAYYNPDMTRRPLTNSFYKTNDLKSYIAILRTVFDNVDRKRNTQKNEDDDEEATEGVNKAELVGNFVLDLTSKSRAFVEKIESVLNALCEQGLSISTPTAEKIEDKLGEKMTDQISQLLERLSSGELTPVPVQRQPPSYXPSHQMNIPXXERLIXXLTAKKSETKRLXRQLFTLYYRAKDLEKTEK

SEQ ID NO: 21563 - protein, 166 aa, Diabrotica virgifera
  misc_feature: Coding regions on vcDNA: vcDNA=SeqID_1260; Strand=+; Position=5-505
  misc_feature: Homolog annotation: Hit_ID=NP_728587.1; Match level="QueryCoverage =75%, HitCoverage=66%, E-value=2e-10, Identity=32%"; Hit description =CG9134-PC, isoform C [Drosophila melanogaster] ref|NP_728586.1| CG9134-PA, isoform A [Drosophila
  misc_feature: Pfam annotation: Pfam_ID=Lectin_C; Match level="Score=78.3, E-value =2.1e-20, Copies=1"; Pfam description=Lectin C-type domain
MLNILLLIISCVLITHATADTCCAANPKNIYYLGDKQVNWANAVLACQLVGMRLVSIQSQAKNEEISAFVRTSGVKNIGIDNAIWTSGNRRQDKVHWLWLAQEALVYTSWDLVFHEPNNATGDEECVSIITNNGTVTTWNDIACNRLFYPLCEKQICCSGCNCGCS

SEQ ID NO: 21564 - protein, 170 aa, Diabrotica virgifera
  misc_feature: Coding regions on vcDNA: vcDNA=SeqID_1261; Strand=+; Position=29-541
  misc_feature: Homolog annotation: Hit_ID=XP_308577.1; Match level="QueryCoverage =93%, HitCoverage=98%, E-value=5e-32, Identity=41%"; Hit description =ENSANGP00000007514 [Anopheles gambiae]
MSQTKEIKSYSYFDSPDGHDVLDKFLCVMKPASLTAFGIGTIDVVAWSHPKGYLPTLGRYAYMGFPIVGASAAFVLVTNASASFRKKDDVWNWFIGGFSAGSVVGAWKRHAMIGFNCGMFFGILAVCRKIMADNNWEVTPSVAPVASQNAWNYDFTLTKERPGNWTTGRE

SEQ ID NO: 21565 - protein, 54 aa, Diabrotica virgifera
  misc_feature: Coding regions on vcDNA: vcDNA=SeqID_1262; Strand=+; Position=2-166
YLVSIPLFLFLSIIIMLLIDTKKIFDKKFQLYIIFVHICLIVQVKKLSIVILYR

SEQ ID NO: 21566 - protein, 62 aa, Diabrotica virgifera
  misc_feature: Coding regions on vcDNA: vcDNA=SeqID_1263; Strand=+; Position=666-854
VSTLGRHRRLFFKQGLRQAGKTSKALQKRSLCFLKVLISYFFMNSYSSFLLISRYVHVGSKI

SEQ ID NO: 21567 - protein, 548 aa, Diabrotica virgifera
  misc_feature: Coding regions on vcDNA: vcDNA=SeqID_1264; Strand=+; Position=3-1646
  misc_feature: Homolog annotation: Hit_ID=XP_318614.1; Match level="QueryCoverage =100%, HitCoverage=57%, E-value=0.0, Identity=59%"; Hit description =ENSANGP00000021005 [Anopheles gambiae]
  misc_feature: Gene Ontology Annotation: Molecular function=electron transporter activity; Cellular component=mitochondrion; Biological process =aldehyde metabolism
  misc_feature: Pfam annotation: Pfam_ID=Aldedh; Match level="Score=13.3, E-value =8.8e-18, Copies=1"; Pfam description=Aldehyde dehydrogenase family
HRGASSINWTLICGDKKAGLSIFWADDGLDTGPILLQEECDVQENDTVDTIYKRFLYPVGVSAVARAVDMVADGNAPKVVQSEKGATYDPMLNKPELQKIDWNKTALELHNFIRGMDSVPGASCLMKLPDSADYQEALLFGSSLWKTAIPIGKEILIEGTKPGIIHEEGLLLTGSDGDYVNVKRVKINGRMKNASVLDQITKQVEIELTPEEKVLIESVRAVWEAILNIDIEDDTDFFASGAGSMDVVRLVEEVKELFKTELENEDVFMAPVFSEFCVNVVQKSRGGKGEIKVEYRAIEMEANKMKLRFPCQLFINGEFMDAEGGKTTQTVNPATEEVICDVQCASKNDVDKAVAAAKNAFENGEWSKISARERGLMLFKLADLMQEYKEELATIESIDSGAVYTLALKTHVGMSIETWRYFAGWADKIEGSTLPVSHARPNRNLSFTKKEPIGVCGLVTPWNYPLMMLSWKMAACLAAGNTVVIKPAQVCPLTALKFAELSVKAGIPPRVINVVTGSGSVAGQAIADHPHVRKLGFTGSTEIGQVIM

SEQ ID NO: 21568 - protein, 240 aa, Diabrotica virgifera
  misc_feature: Coding regions on vcDNA: vcDNA=SeqID_1265; Strand=+; Position=260-978
  misc_feature: Homolog annotation: Hit_ID=XP_312429.1; Match level="QueryCoverage =99%, HitCoverage=39%, E-value=1e-121, Identity=86%"; Hit description= ENSANGP00000021922 [Anopheles gambiae]
  misc_feature: Gene Ontology Annotation: Molecular function=actin binding; Cellular component=actin cytoskeleton; Biological process=hearing
  misc_feature: Pfam annotation: Pfam_ID=WD40; Match level="Score=89.1, E-value=1.2e -23, Copies=3"; Pfam description=WD domain, G-beta repeat
  misc_feature (232)..(232): Xaa can be any naturally occurring amino acid
MSYTPKSIYAALPRTQRGQPLVLGGDPKGKNFLYTNGNSVIIRNIENPSISDVYTEHSCQVNVAKYSPSGFYIASGDQSGKIRIWDTVNKEHILKNEFHPIGGPIKDIAWSPDNQRMIVVGEGRERFGHVFMSETGTSVGEISGQSKPINSCDFRPARPFRLITGSEDNTIAIFEGPPFKFKMTKQEHSRFVQAVRYSPSGNLFASAGFDGKVFLYDGTSSDLLGEVGSASXHSGGVYGV

SEQ ID NO: 21569 - protein, 129 aa, Diabrotica virgifera
  misc_feature: Coding regions on vcDNA: vcDNA=SeqID_1266; Strand=-; Position=121-510
NIYISTEKNGNIHRAVDHVSKEIKIQVIGQSSQNTVLPLNNSIFPTFSHKIYSVITICKYKTFSFFLNGTPRISVLRPVANITTLPLVQGCMYLACFALQIFKKTIDFTFLRILHLKNPLQKKIITISL

SEQ ID NO: 21570 - protein, 273 aa, Diabrotica virgifera
  misc_feature: Coding regions on vcDNA: vcDNA=SeqID_1267; Strand=+; Position=20-841
  misc_feature: Homolog annotation: Hit_ID=XP_396021.1; Match level="QueryCoverage =68%, HitCoverage=91%, E-value=5e-26, Identity=34%"; Hit description =similar to CG13096-PA [Apis mellifera]
MVKVKKPSKPESKQIKKVVTKVKNGKTVSKKPKDGKLKDSLKSVLEEKFNINVEDVENAVAGVIKLHLNNPKIKNQLFDEDKFAVNMKLNCHKIPRGYPKILRVPLKYSLLTPEDDVCLIVSEIKGIGNREHEKHVDHYEKLLAEKNVTNIKKIMTVHELNTEHETFEQKIRLADLYDAFLVCGKVSGKVVHKCGKIFYKKRKVPTSVNLKATKLKEHIDRNLSKSFLHLHLGDTYNVQLGHSKMTVAQIIYFTSAYLASEFPGGCILHVCTR

SEQ ID NO: 21571 - protein, 258 aa, Diabrotica virgifera
  misc_feature: Coding regions on vcDNA: vcDNA=SeqID_1268; Strand=+; Position=810-1583
  misc_feature: Homolog annotation: Hit_ID=AAL10507.1; Match level="QueryCoverage =90%, HitCoverage=20%, E-value=8e-28, Identity=39%"; Hit description =maebl [Plasmodium knowlesi]
  misc_feature: Gene Ontology Annotation: Molecular function=cytoskeletal protein binding; Cellular component=cell-cell adherens junction; Biological process=protein biosynthesis
LFFSPHIYLYEDPLKNDIQLLSYYINKFKQEKAITASSEPAKVPLNPARATRKFTAKRLEDDEEAAKEMQKLREARAARLAFINEEEKIERSSVAVDDAVKAKKKKEDERLAEEKALAEEQARREAQTKKEEAARKAELARQDELAAQAAAEKAAELERQAEQARKQELAKQAEIEKARKAEEERLRQEEQRRQEEEAKAEETRKQQERLEELARQAEEEKQAELARQAEELAELARQEAELAEQAKREAELAELARQ

SEQ ID NO: 21572 - protein, 438 aa, Diabrotica virgifera
  misc_feature: Coding regions on vcDNA: vcDNA=SeqID_1269; Strand=+; Position=64-1380
MVYESDFYTTRRPYRATPSVSSYTISGVPSRQVRVLPGLGKVHVTYTYDRIVPYVGHKRLTVVTAPPRVWGTRPSVLQREFDRIENKIRPWTGYSATNRYLNSNSAVRTYYVNYPITGSDYYDYYYSLNSPSTYYSPRLYRWYSSWPREYRTYWPMYRTYLSRYLRNYYQNLDWPSYYWSTYLPYTKNLDYEFSDIENKIDNLRKTIYLDYPYPIKAVDYTYYPQSYKSYTPLSLYYDYYWPLSSLNRYSSYWPYYPYHRYLYYKYTLPSDRYYHLKGIFDDETRLIRAQTASLLKRIHDPVPRVQRYSWPAVAAKYDNGLPARLHNDNYIHRLLVTSPNSKTEYTTYYTEPVKKYIGAGHLAAVSYAGDRVYSRRPHIYLYEDPLKNDIQLLSYYINKFKQEKAITASSEPAKAAKVEKAQSPEKEQEKPEITEITE

SEQ ID NO: 21573 - protein, 243 aa, Diabrotica virgifera
  misc_feature: Coding regions on vcDNA: vcDNA=SeqID_1270; Strand=+; Position=89-892
  misc_feature: Homolog annotation: Hit_ID=NP_650015.3; Match level="QueryCoverage =100%, HitCoverage=41%, E-value=4e-10, Identity=30%"; Hit description= CG6544-PA, isoform A [Drosophila melanogaster] gb|AAF54549.3| CG6544 -PA, isoform A [Drosophila
MVYESDFYTTRRPYRATPSVSSYTISGVPSRQVRVLPGLGKVHVTYTYDRIVPYVGHKRLTNKIRPWTGYSATNRYLNSNSAVRTYYVNYPITGSDYYDYYYSLNSPSTYYSPRLYRWYSSWPREYRTYWPMYRTYLSRYLRNYYQNLDWPSYYWSTYLPYTKNLDYEFSDIENKIDNLRTQIFDDETRLIRAQTASLLKRIHDPVPRVQRYSWPAVAAKYDNGLPGRLHYDNYIHRLLVTSP

SEQ ID NO: 21574 - protein, 126 aa, Diabrotica virgifera
  misc_feature: Coding regions on vcDNA: vcDNA=SeqID_1271; Strand=+; Position=75-455
  misc_feature: Homolog annotation: Hit_ID=NP_731505.1; Match level="QueryCoverage =100%, HitCoverage=100%, E-value=3e-21, Identity=51%"; Hit description=CG6544-PC, isoform C [Drosophila melanogaster] gb|AAF54551.1| CG6544-PC, isoform C [Drosophila
MVYESDFYTTRRPYRATPSVSSYTISTPRHYVVTDYPERTRKSAEQVYSYSYSSDSSNRSGYGDPRSRSYTSTESVSRSSTGGPGGYNYTSERTSRSRGDGPGGYSSSYSSTSSGPGTYRHYSYRV

SEQ ID NO: 21575 - protein, 449 aa, Diabrotica virgifera
  misc_feature: Coding regions on vcDNA: vcDNA=SeqID_1272; Strand=+; Position=112-1460
  misc_feature: Homolog annotation: Hit_ID=XP_309165.1; Match level="QueryCoverage =94%, HitCoverage=57%, E-value=1e-132, Identity=55%"; Hit description= ENSANGP00000018598 [Anopheles gambiae]
  misc_feature: Gene Ontology Annotation: Molecular function=ceramidase activity; Cellular component=membrane fraction
  misc_feature: Pfam annotation: Pfam_ID=Ceramidase_alk; Match level="Score=285.8, E -value=7e-83, Copies=1"; Pfam description=Neutral/alkaline non -lysosomal cerami
  misc_feature (417)..(417): Xaa can be any naturally occurring amino acid
MLSIKILLCMLLAHQSAVEAVYNVGVGRADCTGPSAEITFMGYAKSGQKGCGIHLRQFSRAFVIKDENTLVAFVTIDTCMMNHPLKQAVIDKLDLKYPNVFTLKNTILSGTHSHSTPGGFLKDVMLDIPSSGYCKETFNALVAGIVKSIDKAYNNQVEARIFYSTTTVTNTNRNRSPAAYLYNPESERKKYETDVDKELVQIKFVSTKDNVAIGAINWFPVHPTSMNNTNCLVHSDNVGYASLLLESSVNTDSLPGQGDFVGAFASTNLGDTSPNLKDPICVNTGEPCDFVHSSCAGGNKYCISFGPGEDMFESTKIIANNLFQNGKKLLDGATTDATEITGTIQYIHKFSHMPSQTTTYQLENGTQINVRGCLPAMGYGFAAGTTDGPGEFDFEQATNTSNPFWNVVRDFIFPPTXDDVVCHFPKPILIMSGKLLSHTNETGNSSTQL

SEQ ID NO: 21576 - protein, 312 aa, Diabrotica virgifera
  misc_feature: Coding regions on vcDNA: vcDNA=SeqID_1273; Strand=+; Position=54-992
  misc_feature: Homolog annotation: Hit_ID=CAE47497.1; Match level="QueryCoverage =100%, HitCoverage=100%, E-value=1e-143, Identity=79%"; Hit description=cathepsin L-like proteinase [Diabrotica virgifera virgifera]
  misc_feature: Gene Ontology Annotation: Molecular function=cysteine-type peptidase activity; Cellular component=extracellular space; Biological process= proteolysis and peptidolysis
  misc_feature: Pfam annotation: Pfam_ID=Peptidase_C1; Match level="Score=344.1, E -value=1.9e-100, Copies=1"; Pfam description=Papain family cysteine protease
MKLFILAALIVATSANLGAFEKWTSFKATHNKSYSLVEDKLRFAVFQENLKKIEEHNAKYENGEETYYLAVNQFADWSSAEFKALLNSQIINRPELSFIETYEADPNVELASSVDWRNKAVLGVKNQGSCGSCWAFSATGALEGQLAIHKNQKVPLSEQELVDCDSSNSGCNGGLMTNAFAYVKSHGLASEKQYAYTGRDGSCKRGSRTLSTISGYVNLAKTEAALASALSSVGPVSIAVDADTWQLYGGGIFNNKNCGTSLNHGVLAVGYTNDVFIVKNSWGTSWGELGYIRISRGHNLCGLNQMNSYPKL

SEQ ID NO: 21577 - protein, 365 aa, Diabrotica virgifera
  misc_feature: Coding regions on vcDNA: vcDNA=SeqID_1274; Strand=+; Position=29-1126
  misc_feature: Homolog annotation: Hit_ID=P80683; Match level="QueryCoverage=28%, HitCoverage=77%, E-value=3e-28, Identity=62%"; Hit description =Larval cuticle protein A3A (TM-A3A) (TM-LCP A3A)
  misc_feature: Gene Ontology Annotation: Molecular function=structural constituent of eye lens
  misc_feature: Pfam annotation: Pfam_ID=Chitin_bind_4; Match level="Score=94.5, E -value=2.7e-25, Copies=1"; Pfam description=Insect cuticle protein
MAYKIFLFSCLIAAGSAGSVQLQTSAPAVGPSPQIHITATPAVQYSAQVPHQGAVIIQQAPSLLQNAALILSQAAPILQAPQLIHQTPQLVHQAPQLVHPAPQLVQQAAPYIQQAAPYIQQSAPIYQQPAPVLQQHNSFLQYAVRIAVPTAQYAQNSPPPQPAIQYAPREVQISQKQIQQESPVPILQYSAQLQAPTPFQISRNPVQIIAKAVPQFTPSVQYAEQDTGSVEDSDIVDQYDEPAPEALAPIVAAPEAPAPVHYAPVVKAAKVAKVKKPDHFDHNPEYSYGYDIEDGQTGDSKRQNEQRQGDVVQGSYSVVDPDGHRRTVEYTADPIHGFSAVVRREPVNIKSSRPVRRSRKYKTRE

SEQ ID NO: 21578 - protein, 308 aa, Diabrotica virgifera
  misc_feature: Coding regions on vcDNA: vcDNA=SeqID_1275; Strand=+; Position=40-961
  misc_feature: Homolog annotation: Hit_ID=EAL28992.1; Match level="QueryCoverage =96%, HitCoverage=43%, E-value=9e-80, Identity=48%"; Hit description =GA16009-PA [Drosophila pseudoobscura]
  misc_feature: Gene Ontology Annotation: Molecular function=glucose transporter activity; Cellular component=integral to plasma membrane; Biological process=glucose transport
  misc_feature: Pfam annotation: Pfam_ID=Sugar_tr; Match level="Score=-144.7, E-value= 0.021, Copies=1"; Pfam description=Sugar (and other) transporter
  misc_feature (270)..(270): Xaa can be any naturally occurring amino acid
  misc_feature (289)..(289): Xaa can be any naturally occurring amino acid
  misc_feature (294)..(294): Xaa can be any naturally occurring amino acid
MNSNANPKYSVWRQSLPQIIAVFIKNTLLFIHGTSLGFPTILVPGISGNDRSETILFGQDEISWISSINLIFIPMGCLISGSITQAIGRKRAMQIINIPFIISWLLFHFSTKSWIIFLAASILGFSGGLLEAPVLTYVAEVTQPHLRGILSCTGTMSVTLGMLSQFILGSFMQWRTVTLVNCSFPVISFLLLMIVPETPVWLLSKNRIEEAKKSIAWLRGWTNIEDIQDEFQELHKQICNEKQPDSFKEAISQKLKNLKLFSKRIFIYPXLPISFVFFLGHFNGYGPFXVYALXIFQQMKVSIDPYYY

SEQ ID NO: 21579 - protein, 97 aa, Diabrotica virgifera
  misc_feature: Coding regions on vcDNA: vcDNA=SeqID_1276; Strand=+; Position=121-414
KRCNALLIVISVCRISFESNVHFCNKENHILLFLFFYQSSSVDHLFDEKKNSFVRLKYREYKEPPTCTIIKTYLESFILIFLIIAHKNLKKFPCDVF

SEQ ID NO: 21580 - protein, 307 aa, Diabrotica virgifera
  misc_feature: Coding regions on vcDNA: vcDNA=SeqID_1277; Strand=+; Position=14-934
  misc_feature: Homolog annotation: Hit_ID=XP_321349.1; Match level="QueryCoverage =85%, HitCoverage=65%, E-value=4e-85, Identity=59%"; Hit description =ENSANGP00000008492 [Anopheles gambiae]
  misc_feature: Gene Ontology Annotation: Molecular function=URM1 activating enzyme activity; Cellular component=cellular_component unknown; Biological process=coenzymes and prosthetic group metabolism
  misc_feature: Pfam annotation: Pfam_ID=ThiF; Match level="Score=206.2, E-value=6.3e- 59, Copies=1"; Pfam description=ThiF family
  misc_feature (242)..(242): Xaa can be any naturally occurring amino acid
  misc_feature (261)..(261): Xaa can be any naturally occurring amino acid
  misc_feature (267)..(267): Xaa can be any naturally occurring amino acid
  misc_feature (272)..(272): Xaa can be any naturally occurring amino acid
  misc_feature (290)..(290): Xaa can be any naturally occurring amino acid
  misc_feature (292)..(292): Xaa can be any naturally occurring amino acid
MEHCSSVESLKIEIKELQEKLKQKQKLLEELLKKDNDTIAESKTISTNEIIRYSRQMIMPDITIDGQKALKNSKVLIVGVGGLGCPAALYLATAGVGKITLVDYDEVELSNLHRQVLHSEDDIGVPKVMSAYNKLKRINSDIKIIPIREHANSKTIENLLHNNKYDVAIDGTDNVATRYLLNDICVLHNIPLVSGSALQMEGQLTVYHYKDGPCYRCLFPVPPPAHTVTNCGDGGVLGPVPXTIGVLQALETIKIINTSAXVLSGRXLYLDXSTSTFRNVKMRPRNPKCXCXGDEPTITTLIDYEQF

SEQ ID NO: 21581 - protein, 135 aa, Diabrotica virgifera
  misc_feature: Coding regions on vcDNA: vcDNA=SeqID_1278; Strand=+; Position=67-474
  misc_feature: Homolog annotation: Hit_ID=AAK92163.1; Match level="QueryCoverage =100%, HitCoverage=100%, E-value=2e-59, Identity=81%"; Hit description=ribosomal protein L27 [Spodoptera frugiperda]
  misc_feature: Gene Ontology Annotation: Molecular function=structural constituent of ribosome; Cellular component=cytosolic large ribosomal subunit (sensu Eukarya); Biological process=protein biosynthesis
  misc_feature: Pfam annotation: Pfam_ID=Ribosomal_L27e; Match level="Score=145.6, E -value=1.1e-40, Copies=1"; Pfam description=Ribosomal L27e protein family
MGKIMKSGKVVLVLGGRYAGRKAVVVKTYDEGTSDKQYGHALVAGIDRYPRKIHKRMGKGKMHKRSKIKPFIKVLNYNHLMPTRYSVDLASDLKVVPKDLKDAMKRKKARFQTRVKFEERYKQGKNKWFFQKLRF

SEQ ID NO: 21582 - protein, 379 aa, Diabrotica virgifera
  misc_feature: Coding regions on vcDNA: vcDNA=SeqID_1279; Strand=+; Position=2-1138
  misc_feature: Homolog annotation: Hit_ID=XP_316320.1; Match level="QueryCoverage =99%, HitCoverage=64%, E-value=0.0, Identity=57%"; Hit description =ENSANGP00000022607 [Anopheles gambiae]
  misc_feature: Gene Ontology Annotation: Molecular function=protein binding; Cellular component=nucleus; Biological process=response to nutrients
  misc_feature: Pfam annotation: Pfam_ID=TPR_1; Match level="Score=75.3, E-value=1.6e- 19, Copies=2"; Pfam description=Tetratricopeptide repeat
LNEALMHYKEAIRIQPTFADAYSNMGNTLKEMQDVSGALQCYTRAIQINPAFADAHSNLASIHKDSGNIPEAVRSYRTALKLKPDFPDAYCNLAHCLQIVCDWTDYDSRMKKLVNIVADQLEKNRLPSVHPHHSMLYPLSHDFRKAIAARHANLCLEKINVLHKFPYKFSPDLKSRLRIGYVSSDFGNHPTSHLMQSIPGMHDKSKVEIFCYALSQDDGTTFRSKISREAEHFIDLSSLSCNGKAADRIYSDNIHVLVNMNGYTKGARNEIFALRPAPIQVMWLGYPGTSGASFMDYLITDEITSPIEVADQYSEKLAYMPYTYFVGDHKQMFPHLKERLIVSDRTGQNLADNGIIINPSDMFCPASYSDVKEDQEDHK

SEQ ID NO: 21583 - protein, 248 aa, Diabrotica virgifera
  misc_feature: Coding regions on vcDNA: vcDNA=SeqID_1280; Strand=+; Position=208-954
  misc_feature: Homolog annotation: Hit_ID=EAA12546.2; Match level="QueryCoverage =95%, HitCoverage=91%, E-value=2e-30, Identity=34%"; Hit description =ENSANGP00000011117 [Anopheles gambiae str. PEST] ref|XP_554920.1| ENSANGP00000011117 [Anopheles gambiae st
  misc_feature: Pfam annotation: Pfam_ID=PID; Match level="Score=41.4, E-value=2.6e -09, Copies=1"; Pfam description=Phosphotyrosine interaction domain (P
MAFFKSMWKPNSKHEKLSEELFSKITKEPKQENVPENDANTFKLKYIGCTTVEKVTGDNVSSEAVKTIIKNAKKLKGKTLANVTLHISEKGVIVTDAEGNDVLKISIYSISNCSTDSSHRQLFSFISSDTNQVNTCHAFLCPKRKVAQNVTLAVASAFSTAYLDWSQHTMSSEGMKNTVQSKENEKNNLNQINKSEVIIEEKLIDFDSEPTTEDDLFTLESQLLFNKNDWVSFDDDGFADPSKLKFFQ

SEQ ID NO: 21584 - protein, 267 aa, Diabrotica virgifera
  misc_feature: Coding regions on vcDNA: vcDNA=SeqID_1281; Strand=+; Position=95-898
VSVKSIFSITYLQIKTCIERVIKYWTMDLRAVINNVRNFFSSLQFHPTGSERNRKRSALDSIDSCMSPKIRRVQSINLDRENYYMSPKPLRRPSVYKTPSIKKIESVVLDDDEDDINISSKKINGNTLSGNARTGKFTSTPYGNSFSKKSVNGTDSKDVLFVKELKPSSDEDVTFVREQKSSSLKRADALRKGLNYLRPYSGSISKPKIVQNERQLKEKYNSTFGLLNGTSSFNMNSSIRLNEKKLYREILDSTQFFTPRSSFDTLS

SEQ ID NO: 21585 - protein, 261 aa, Diabrotica virgifera
  misc_feature: Coding regions on vcDNA: vcDNA=SeqID_1282; Strand=+; Position=136-918
  misc_feature: Homolog annotation: Hit_ID=NP_727075.1; Match level="QueryCoverage =97%, HitCoverage=63%, E-value=1e-104, Identity=62%"; Hit description= CG3576-PA, isoform A [Drosophila melanogaster] ref|NP_652526.1| CG3576-PB, isoform B [Drosophila
  misc_feature: Gene Ontology Annotation: Molecular function=molecular_function unknown; Cellular component=membrane; Biological process =intracellular protein transport
  misc_feature: Pfam annotation: Pfam_ID=LAG1; Match level="Score=22.1, E-value=2.2e -09, Copies=1"; Pfam description=Longevity-assurance protein (LAG1)
MAYYYRTFMETFWCEHVWLPPNTTWKDIAPDADPNVRHADPKHLFYPLPMAFVLLFLRYILEKYWFAPVGVSLGIKNNRPKKTPDNPVLEKAYTQSKKWKHKQVQGLAKQLDISERQVERWLRLRKAQNKPSTLVKFCENSWRCLYYTLSFIYGLTILWDKPWLWNINECWTGFPHQDVTNDIWWYYMISMSFYWSLSVSQFFDVKRKDFWQMFIHHIATIVLMCLSWIVNVFRIGSLVLVVHDCADILLEAAKMAKYSGY

SEQ ID NO: 21586 - protein, 296 aa, Diabrotica virgifera
  misc_feature: Coding regions on vcDNA: vcDNA=SeqID_1283; Strand=+; Position=231-1121
  misc_feature: Homolog annotation: Hit_ID=XP_311426.1; Match level="QueryCoverage =95%, HitCoverage=95%, E-value=4e-90, Identity=56%"; Hit description =ENSANGP00000018490 [Anopheles gambiae] gb|EAA07072.2| ENSANGP00000018490 [Anopheles gambiae
  misc_feature: Gene Ontology Annotation: Molecular function=oxidoreductase activity; Cellular component=integral to membrane; Biological process=lipid metabolism
  misc_feature: Pfam annotation: Pfam_ID=Steroid_dh; Match level="Score=76.0, E-value= 9.8e-20, Copies=1"; Pfam description=3-oxo-5-alpha-steroid 4 -dehydrogenase
MVQVEVYTVKNKKLGDITASNNTTVGDIKKEIAKVTKLPADRQSLRSEAKGKDIRNDATIPNLESLRKVFVKDLGPQIGWNTVFLLEYAGPLFIYAAVSFRPWILYGDTASNATFTTTAKLALGCWSIHYLKRILETLFVHRFSHGTMPIRNLFKNCGYYWGFCLYVAYHINHPLFTPPPVLFQAVGLAMFAVCESGNLATHLLLRNLRPAGSTVRKIPRPDGCPLNLLFDFVSCPNYSYEVGSWIGFTILTSCIPAGIFTGAGSYQMTRWALGKHKIYKKEFSNYPKQRESYPSP

SEQ ID NO: 21587 - protein, 98 aa, Diabrotica virgifera
  misc_feature: Coding regions on vcDNA: vcDNA=SeqID_1284; Strand=+; Position=1-297
  misc_feature: Homolog annotation: Hit_ID=NP_650672.1; Match level="QueryCoverage =89%, HitCoverage=26%, E-value=3e-14, Identity=37%"; Hit description =CG7780-PA [Drosophila melanogaster] gb|AAF55486.1| CG7780-PA [Drosophila melanogaster]
  misc_feature: Gene Ontology Annotation: Molecular function=deoxyribonuclease II activity
SNCSRVYKVNNIQKINMSVVNVSFNTTSDHSKWAVTSNSSSSWSCVGDINRAQHQLERGGGTVCLQNQKLSTNFHKLISAVEECPRKESFDIPTVINV

SEQ ID NO: 21588 - protein, 361 aa, Diabrotica virgifera
  misc_feature: Coding regions on vcDNA: vcDNA=SeqID_1285; Strand=+; Position=67-1152
  misc_feature: Homolog annotation: Hit_ID=XP_396933.1; Match level="QueryCoverage =95%, HitCoverage=98%, E-value=4e-69, Identity=38%"; Hit description =similar to ENSANGP00000002045 [Apis mellifera]
  misc_feature: Gene Ontology Annotation: Molecular function=deoxyribonuclease II activity
  misc_feature: Pfam annotation: Pfam_ID=DNase_II; Match level="Score=411.6, E-value =9.4e-121, Copies=1"; Pfam description=Deoxyribonuclease II
MSSQILFFLCLYFIAGRTNALSCKDENNRDVDWFVAYKIPIQSGRGDIIKAGLGHIYLTSTNSSTWTFSKRSIGDNSSLIGNTLHDFYYNRTKLSYILYNDEPPNHPISAAKGHTKGVVISNTAGGYWLIHSVPKFPEVGNSYSFPSTGVKYGQTFLCVTMNLTNINAVGLQLQYNQPHIYLQQVLSDIKTRVPDLASAAQNVTVKSAPFYRVAQIYSKKKVAFTSFAKHRKFNQELYEDLVAPYLKQDLVVETWPNGAGRLHSNCSRVYKVNNIQKINMSVVNVSFNTTSDHSKWAVTSNSSSSWSCVGDINRAQHQLERGGGTVCLQNQKLSTNFHKLISAVEECPRKESFDIPTVINV

SEQ ID NO: 21589 - protein, 291 aa, Diabrotica virgifera
  misc_feature: Coding regions on vcDNA: vcDNA=SeqID_1286; Strand=+; Position=87-962
  misc_feature: Homolog annotation: Hit_ID=XP_307685.1; Match level="QueryCoverage =98%, HitCoverage=83%, E-value=1e-101, Identity=54%"; Hit description= ENSANGP00000017097 [Anopheles gambiae]
  misc_feature: Gene Ontology Annotation: Molecular function=enoyl-CoA hydratase activity; Cellular component=mitochondrion; Biological process=growth
  misc_feature: Pfam annotation: Pfam_ID=3HCDH_N; Match level="Score=304.7, E-value =1.4e-88, Copies=1"; Pfam description=3-hydroxyacyl-CoA dehydrogenase, NAD
MAAIGNVLSRGFSTTTARNVIQNVTVIGGGLMGSGIAQVAAQSGQNVTLVDVSSDVLKKSESSIQNSLGRVAKKLHKDNPAEGKKLVDDILSRIQYSTEPQKGVQNADLVVEAIVENMDIKHKLFKSLDEAAPEKTLFASNTSSLSIAEIASVTKRLDRFGGLHFFNPVPMMKLLEVIRISETSDQTYNAMMAWGKSIGKVCITCKDTPGFVVNRLLVPYVAEAVRMLERGDASAQDIDTAMKLGAGYPMGPLELADYTGLDTGVFVLEGWHKKFPENPLFNPVKAPKENS

SEQ ID NO: 21590 - protein, 70 aa, Diabrotica virgifera
  misc_feature: Coding regions on vcDNA: vcDNA=SeqID_1287; Strand=+; Position=388-600
  misc_feature: Homolog annotation: Hit_ID=XP_307575.1; Match level="QueryCoverage =98%, HitCoverage=98%, E-value=1e-14, Identity=47%"; Hit description =ENSANGP00000015489 [Anopheles gambiae] ref|XP_307389.1| ENSANGP00000012903 [Anopheles gambiae]
MGNVVYSIIWLLILIIVSFLIAGICAGLYIIVHPLSVCLEPLAGFAEILLSGVQFPHYCAEKMMSGAPLG

SEQ ID NO: 21591 - protein, 236 aa, Diabrotica virgifera
  misc_feature: Coding regions on vcDNA: vcDNA=SeqID_1288; Strand=+; Position=266-973
  misc_feature: Homolog annotation: Hit_ID=EAA59641.1; Match level="QueryCoverage =95%, HitCoverage=29%, E-value=5e-24, Identity=33%"; Hit description =hypothetical protein AN8019.2 [Aspergillus nidulans FGSC A4] ref|XP _412156.1| hypothetical protein AN8019.
  misc_feature: Gene Ontology Annotation: Molecular function=structural constituent of cytoskeleton; Cellular component=plasma membrane; Biological process=protein targeting
  misc_feature: Pfam annotation: Pfam_ID=Ank; Match level="Score=142.9, E-value=7.2e -40, Copies=5"; Pfam description=Ankyrin repeat
MIVTGAKARSLLRAIQNGTIDKIKLAYENEINIECYGSCRSVLNWATHFGKVSIVRKLLKNKKLIKNTDLDTSLHIAALEGYTTLVKLLLKHGADIEFENDDGETPLLLAIKSNDGYNLKDVDSLVNILIENEADVNASDNGLNTSLHMACQMGLCSIAELLLDAGADINLQNGTGWTPLFCAAYYDRLFIVKLLLHRGADVTITDDESGDTALHMCVKCDKVAVTELLLSNGADV

SEQ ID NO: 21592 - protein, 256 aa, Diabrotica virgifera
  misc_feature: Coding regions on vcDNA: vcDNA=SeqID_1289; Strand=+; Position=181-951
MAIDWEKIVTELSAVFQDEQETFARVLFYLGEEEKVYKDADKLGPQMKILMSSMKVASLFSQYAKRLAEDTKRADSDEKFKRVMGLIWAQMMDANKQTDDKDKTPDVSIIAKLEHLSLEASPGMVRALSIIPYESQKRFLVMLKDIVPTTVLSNVEYVVETVNKVGGAVVTVALASIQLAYEAIVNIRRWWNGEISGKRCCKNIIDSLATIGGSVGGGFAGVAVGALGRSLGMIIRGFGGGLLGGKLAQTSFPMDD

SEQ ID NO: 21593 - protein, 402 aa, Diabrotica virgifera
  misc_feature: Coding regions on vcDNA: vcDNA=SeqID_1290; Strand=+; Position=155-1363
  misc_feature: Homolog annotation: Hit_ID=CAH64510.1; Match level="QueryCoverage =91%, HitCoverage=68%, E-value=1e-87, Identity=46%"; Hit description =putative esterase [Tribolium castaneum]
  misc_feature: Gene Ontology Annotation: Molecular function=carboxylesterase activity; Cellular component=synaptic junction
  misc_feature: Pfam annotation: Pfam_ID=COesterase; Match level="Score=206.3, E -value=6e-59, Copies=1"; Pfam description=Carboxylesterase
  misc_feature (299)..(299): Xaa can be any naturally occurring amino acid
  misc_feature (314)..(314): Xaa can be any naturally occurring amino acid
MDQSIVQTTEGKLRGCIRHTFDGEEFYGFLGIPYIKPALGDLRFKAPQPPEPWTGIRDATKVGSPVFHKETFTKSFLGGEDGVNLNVYTKKPIPQGSKLNPVMVYIHGGGYVEGRNGPDMFGPEYLLTEDVVLVVINYRLGILGFLSLEDPSLKIYGNAGLKDQVAALKWVKRNIKNFGGDPDNVTIFGQSAGAAAVEYLVASPAAKGLFHRAIFQSGSVGSFWASGQRFSKGLLQFLEKGNLSDTQALEYFKSLSVRELYDIMTKYTKSIPSRTLGLLGPIEEIPNDTAFITKHPLAXIISGDYNKVPIMDGXTLQMEVICLSSELMEDQGKAFVDNFDIEFILNAMIGIEKGSETSKKYVQRIQEIYKMPNGEINKYLVLSDLFCTGGVGWCKHHAATSR

SEQ ID NO: 21594 - protein, 264 aa, Diabrotica virgifera
  misc_feature: Coding regions on vcDNA: vcDNA=SeqID_1291; Strand=+; Position=65-859
  misc_feature: Homolog annotation: Hit_ID=EAL27943.1; Match level="QueryCoverage =81%, HitCoverage=77%, E-value=9e-44, Identity=43%"; Hit description =GA19277-PA [Drosophila pseudoobscura]
  misc_feature: Gene Ontology Annotation: Biological process=protein modification
MNLNMCNLNNTMDNNSLEVTGVNLKNKIEAILGWPVDSFYLTLNGRIVQSDTIVQRASIDSLRIIPRIFGGKGGFGSMLRAIGAQIEKTTNREACRDLSGRRLRDINEEQRLKNWINQQAEREKEAKERKKKKLEKMCEQPKYEFNDSEYDKERSALPEMVEDAVLQGLQATSSTSDTSMKRKGDKKEVIKKKKAKLWVDDELDEDLSSEYDSSGNESSNESKNGELNIEKSAQATRSDNSLEDVPNSLTPDKASEQKEKVQEA

SEQ ID NO: 21595 - protein, 174 aa, Diabrotica virgifera
  misc_feature: Coding regions on vcDNA: vcDNA=SeqID_1292; Strand=+; Position=344-868
  misc_feature (163)..(163): Xaa can be any naturally occurring amino acid
MGYNYLLAEEALAKNHVSILDVQKRGWTTLHELAYEYSSEPLPLNKYLWEMVVVKATDQWKVQNGFKKGQVIVYIRLHHAISDGLSGMNLLCSLIGNSDTFDNFLKTMSKNIKTKNSVLQFLQNLYFFFIIPGLMVVEIYKITKDKTLWRNKSCNGKNRFAIXVEDGVVEKWLL

SEQ ID NO: 21596 - protein, 264 aa, Diabrotica virgifera
  misc_feature: Coding regions on vcDNA: vcDNA=SeqID_1293; Strand=+; Position=51-842
  misc_feature: Homolog annotation: Hit_ID=XP_392321.1; Match level="QueryCoverage =100%, HitCoverage=34%, E-value=5e-60, Identity=45%"; Hit description= similar to ENSANGP00000022613 [Apis mellifera]
MMRNETRILSDKDQEVSFSSYVQMDDLLDKLKLLNYESEFLSGLKIKPIHKYYFIVTKNPGEQFYLFSLLAAWLIRKNGKPFENPQEFDDPNETIDRIINEVKQNGMTVDFSPNKLKQGVGEYVVAILDYLTNIALTKNNIILKRPKPPEEKEEEAEVLDDESEINLDRIEEEMIAAYSDDSDEENIFRLDELKPTKKEIQVTELKSNVDEETWKLEVERVLPMLKVTVKNDSRDWRSHLEQMKQHQSTIDNTFGTAKGQLEKL

SEQ ID NO: 21597 - protein, 243 aa, Diabrotica virgifera
  misc_feature: Coding regions on vcDNA: vcDNA=SeqID_1294; Strand=+; Position=204-932
  misc_feature: Homolog annotation: Hit_ID=XP_395866.1; Match level="QueryCoverage =93%, HitCoverage=32%, E-value=6e-73, Identity=59%"; Hit description =similar to ENSANGP00000012494 [Apis mellifera]
  misc_feature: Gene Ontology Annotation: Molecular function=protein transporter activity; Cellular component=mitochondrial matrix; Biological process=mitochondrial translocation
  misc_feature (222)..(222): Xaa can be any naturally occurring amino acid
  misc_feature (231)..(231): Xaa can be any naturally occurring amino acid
MYGLQRISYRIYIRNGFRHYSQQPAKRNSFIGRLFENFKDEMAKNKEMKESLKKFREEAQKLEQSDALKAARQKFESVEKEASKGSEVFKESLGSVKERLKGVIDEASKSDLAKKAGKFTEEVGKTTHKISETAQEISKTGAFQSISQATKAVKQEIDNTSIEGRVYVSPKILRKRTETSAVVHQKYYEPNTDATGVELHKDSKFYESWQNFKDNNPYVHKXMDWKFKYDXSENPVIRASRAL

SEQ ID NO: 21598 - protein, 450 aa, Diabrotica virgifera
  misc_feature: Coding regions on vcDNA: vcDNA=SeqID_1295; Strand=+; Position=226-1579
  misc_feature: Homolog annotation: Hit_ID=XP_396745.1; Match level="QueryCoverage =91%, HitCoverage=75%, E-value=4e-58, Identity=31%"; Hit description =similar to CG8108-PB [Apis mellifera]
  misc_feature: Pfam annotation: Pfam_ID=AKAP95; Match level="Score=-226.9, E-value =0.063, Copies=1"; Pfam description=A-kinase anchoring protein 95 (AKAP95
  misc_feature (366)..(366): Xaa can be any naturally occurring amino acid
MPRGRFPSSPRGGYRGSSRGSSRGLSSWNGSSRSGGYPSSRSYPPAMESRNPYEPKYSTSERYREEYKPYRAEYSTSIMVRERRSPERKRLRVEAPSSRHESYYGSSRHEAPYERRPSEHHSSLSRREEFRRPSGPPPKRGSYRGRISSRGSSSIRARPRTLVPRSYAIGRRIPHISEYARRLKIARIRRAIARRHAIEEAEAENGDEDIKAEIEAEEAQITEESKDNEERKEQSKAFIKLQCPHCHMRALTYKKYELHLGSRTHSLAMRRVAFKQKAILNQMRRAQRNTQNELEKGAADLDSVTTYCPLCKLNFKQKKAVHQLSESHVNMKKFLMPTCKVCTLAFKSPMSYEKHLCTVDHIKRKXEEGVDDTDIENFTTIDSVGDEENAEGGESVGLEKIRKIEAYYCDLCKMYLQRAEESEMAPILARHCKQRVHVQRYKVVTTRRRS

SEQ ID NO: 21599 - protein, 148 aa, Diabrotica virgifera
  misc_feature: Coding regions on vcDNA: vcDNA=SeqID_1296; Strand=+; Position=2-448
  misc_feature: Homolog annotation: Hit_ID=XP_313621.1; Match level="QueryCoverage =95%, HitCoverage=32%, E-value=2e-30, Identity=46%"; Hit description =ENSANGP00000024261 [Anopheles gambiae]
  misc_feature (52)..(52): Xaa can be any naturally occurring amino acid
KTIIRPIVSYGCETWVVTQKSANALDVFERKVLRRILGQIGENNNWRIRYNXEIYEQYSEPTLAQHTKLQRLRWAGHVVRIHENRIPRKVLNARMQGRRPVGRPKKRWEDEVDEDARNFLGTRSWKRTAVNRNDWRSLLKEAKARFGL

SEQ ID NO: 21600 - protein, 108 aa, Diabrotica virgifera
  misc_feature: Coding regions on vcDNA: vcDNA=SeqID_1297; Strand=+; Position=171-497
  misc_feature: Homolog annotation: Hit_ID=P12831; Match level="QueryCoverage=99%, HitCoverage=100%, E-value=2e-56, Identity=95%"; Hit description =Cytochrome c pir||B25506 cytochrome c - Boettcherisca peregrina prf||1211285B cytochrome c
  misc_feature: Gene Ontology Annotation: Molecular function=electron transporter activity; Cellular component=mitochondrion; Biological process =electron transport
  misc_feature: Pfam annotation: Pfam_ID=Cytochrom_C; Match level="Score=127.6, E -value=3e-35, Copies=1"; Pfam description=Cytochrome c
MGVPAGDVEKGKKIFKQRCEQCHTVESGGKHKVGPNLHGLFGRKTGQAPGFAYTDANKAKGITWGEDTLFEYLENPKKYIPGTKMVFAGLKKPNERGDLIAYLKSATK

SEQ ID NO: 21601 - protein, 224 aa, Diabrotica virgifera
  misc_feature: Coding regions on vcDNA: vcDNA=SeqID_1298; Strand=+; Position=71-744
  misc_feature: Homolog annotation: Hit_ID=BAA19760.1; Match level="QueryCoverage =95%, HitCoverage=92%, E-value=8e-82, Identity=67%"; Hit description =proteasome subunit Y [Xenopus laevis]
  misc_feature: Gene Ontology Annotation: Molecular function=endopeptidase activity; Cellular component=26S proteasome; Biological process=proteolysis and peptidolysis
  misc_feature: Pfam annotation: Pfam_ID=Proteasome; Match level="Score=218.5, E -value=1.3e-62, Copies=1"; Pfam description=Proteasome A-type and B -type
  misc_feature (200)..(200): Xaa can be any naturally occurring amino acid
MPLMTEYGAMTGPNDWRDAAHSTGTSIMAAEFDGGVVIGADSRTTTGAYIANRVADKLTKVTDHIYCCRSGSAADTQAIADIVAYHLNFHGMELGEEPKVQVGAAIFQELCYNYRDSLMAGILVAGWDKKKGGQVYSIPIGGMCVRQEVSIGGSGSSNVYGYVDANFKPNMSKEECVKFVTNTLALAMSRDGSSGGVVRXGIITEAGIERRVVLGNELPKFYEG

SEQ ID NO: 21602 - protein, 255 aa, Diabrotica virgifera
  misc_feature: Coding regions on vcDNA: vcDNA=SeqID_1299; Strand=+; Position=87-854
  misc_feature: Homolog annotation: Hit_ID=NP_572988.1; Match level="QueryCoverage =80%, HitCoverage=35%, E-value=8e-39, Identity=43%"; Hit description =CG9009-PA [Drosophila melanogaster] gb|AAF48408.2| CG9009-PA [Drosophila melanogaster]
MSVKVFKNILNNKKNILSATKYVSVYTRKLGTSDGQSKILTCGTTVDIPNVSIPEFVYPSLDKFHKYTAMVCATTGRSYTFGEVKKKSKTLSRALRHIFKLKKGDVVAIFSPNKAEYAIAIFGILDAGLTVTTLNPIYTPAEVARQLQDSSAKVIITQTPSIPTVKASLDLLKTTIPIVAIKSTQNESLPSGIIDFDELLNTNLDVPDVDVLPSDLAILPYSSGTTGLPKVELTHSNIVSNLCQMHDDSLRGTNR

SEQ ID NO: 21603 - protein, 207 aa, Diabrotica virgifera
  misc_feature: Coding regions on vcDNA: vcDNA=SeqID_1300; Strand=+; Position=723-1346
  misc_feature: Homolog annotation: Hit_ID=XP_397406.1; Match level="QueryCoverage =66%, HitCoverage=40%, E-value=1e-17, Identity=32%"; Hit description =similar to beta-tubulin cofactor C [Apis mellifera]
  misc_feature: Gene Ontology Annotation: Molecular function=co-chaperonin activity; Cellular component=microtubule; Biological process=beta-tubulin folding
EAYLSFNQGRTRERIWKEVNPSNPLYPISNMNSTITFENTNEKANKLNLLTKREVERQLNLQKRKDNKDSLVAGNEKLEFFETLFAEKRSYIENMIDLSKSVPVNELPDHFNEILKEIVTLQKYVAASSIFIRNYDMQKCQNILQELTVRTKQVEDELLPKKKFSFKNKVKQKAQNSEIKSKSIDDVDFKPKIEPVKNVTGFFKKRE

SEQ ID NO: 21604 - protein, 279 aa, Diabrotica virgifera
  misc_feature: Coding regions on vcDNA: vcDNA=SeqID_1301; Strand=+; Position=83-922
  misc_feature: Homolog annotation: Hit_ID=XP_392843.1; Match level="QueryCoverage =99%, HitCoverage=99%, E-value=1e-135, Identity=87%"; Hit description= similar to ENSANGP00000015322 [Apis mellifera]
  misc_feature: Gene Ontology Annotation: Molecular function=structural constituent of ribosome; Cellular component=cytosolic small ribosomal subunit (sensu Eukarya); Biological process=protein biosynthesis
  misc_feature: Pfam annotation: Pfam_ID=Ribosomal_S5; Match level="Score=137.1, E -value=4e-38, Copies=1"; Pfam description=Ribosomal protein S5, N -terminal doma
MADAAPAGGRGGFRGGFGGGGRGGGRGGPRGRGRGRGRGRGRGKEDQKEWVPVTKLGRLVKDGKIRSLEEIYLFSLPIKEFEIIDHFIGSDLNDEVLKIMPVQKQTRAGQRTRFKAFVAIGDSKGHIGLGVKCSKEVATAIRGAIILAKLSVVPVRRGYWGNKIGQPHTVPCKVTGKCGSVTVRLIPAPRGTGIVSAPVPKKLLQMAGIEDCYTSARGSTGTLGNFAKATYAAIAKTYAYLTPDLWKDMALAKTPYQEFADYLAKNHRPVTGPARAETA

SEQ ID NO: 21605 - protein, 121 aa, Diabrotica virgifera
  misc_feature: Coding regions on vcDNA: vcDNA=SeqID_1302; Strand=+; Position=388-753
IEMSDFKTKTERPQVSRINPESHTDLSVCPKDSGGGDKKLTKREIRKPFSFYVATYNARTLLSEEKFFEMEDAIKEIKWDVIRVCEIRHRGENLKTLKSGHLFYSIGSETKSVGGGRFLHP

SEQ ID NO: 21606 - protein, 210 aa, Diabrotica virgifera
  misc_feature: Coding regions on vcDNA: vcDNA=SeqID_1303; Strand=-; Position=194-826
  misc_feature: Homolog annotation: Hit_ID=EAL27662.1; Match level="QueryCoverage =96%, HitCoverage=27%, E-value=3e-75, Identity=66%"; Hit description =GA10087-PA [Drosophila pseudoobscura]
  misc_feature: Gene Ontology Annotation: Molecular function=electron transporter activity; Cellular component=cytosol; Biological process=pyruvate metabolism
  misc_feature: Pfam annotation: Pfam_ID=malic; Match level="Score=161.3, E-value =2.1e-45, Copies=1"; Pfam description=Malic enzyme, N-terminal domain
MERDRVGNWGNGEHLVPGGVSGLERLTTPALNKGLAFTFEERQQLGIHGLLPPVVKSQEQQIEHCKKCLDRLDDNLNKYMYLIGLLDRNEKLFYSFVRKYVTDIMPLVYTPVVGLACQNFGLVYRRPRGMYVTIYDKGNVYEIMKNWPETDVRAIVVTDGERILGLGDQGACGMGIPVGKLSLYTALAGIKPHQCLPITIDVGSGRHVPY

SEQ ID NO: 21607 - protein, 205 aa, Diabrotica virgifera
  misc_feature: Coding regions on vcDNA: vcDNA=SeqID_1304; Strand=-; Position=599-1216
  misc_feature: Homolog annotation: Hit_ID=XP_310951.1; Match level="QueryCoverage =90%, HitCoverage=27%, E-value=3e-55, Identity=52%"; Hit description =ENSANGP00000019421 [Anopheles gambiae]
  misc_feature: Gene Ontology Annotation: Molecular function=electron transporter activity; Cellular component=cytosol; Biological process=pyruvate metabolism
  misc_feature: Pfam annotation: Pfam_ID=malic; Match level="Score=-10.8, E-value =2.1e-07, Copies=1"; Pfam description=Malic enzyme, N-terminal domain
MLSSWSWFNKDDQTEQNIKTSPNTKTETFTSPLPINKSNLTMERDRVGNWGNGEHLVPGGVSGLERLTTPALNKGLAFTFEERQQLGIHGLLPPVVKSQEQQIEHCKKCLDRLDDNLNKYMYLIGLLDRNEKLFYSFVRKYVTDIMPLVYTPVVGLACQNFGLVYRRPRGMYVTIYDKGNVYEIMKNWPETDVRAIVVTDGERIF

SEQ ID NO: 21608 - protein, 388 aa, Diabrotica virgifera
  misc_feature: Coding regions on vcDNA: vcDNA=SeqID_1305; Strand=-; Position=158-1324
  misc_feature: Homolog annotation: Hit_ID=XP_313043.1; Match level="QueryCoverage =98%, HitCoverage=44%, E-value=1e-112, Identity=70%"; Hit description= ENSANGP00000011712 [Anopheles gambiae]
  misc_feature: Gene Ontology Annotation: Molecular function=electron transporter activity; Cellular component=cytosol; Biological process=pyruvate metabolism
  misc_feature: Pfam annotation: Pfam_ID=malic; Match level="Score=408.7, E-value =6.9e-120, Copies=1"; Pfam description=Malic enzyme, N-terminal domain
MEAVLRRWGQNTLIQFEHFGNSNAFRLLEKYRNEYCTFNDDIQGTASVPVTGRLASLRITNTRLSDHVIRTRDKSVRSSFCCSTSPLPINKSNLTMERDRVGNWGNGEHLVPGGVSGLERLTTPALNKGLAFTFEERQQLGIHGLLPPVVKSQEQQIEHCKKCLDRLDDNLNKYMYLIGLLDRNEKLFYSFVRKYVTDIMPLVYTPVVGLACQNFGLVYRRPRGMYVTIYDKGNVYEIMKNWPETDVRAIVVTDGERILGLGDQGACGMGIPVGKLSLYTALAGIKPHQCLPITIDVGTNNETHLKDPLYIGLRQKRVTGQEYDELLDEFMEAVVRRWGQNTLIQFEDFGNSNAFRLLEKYRNEYCTFHDDIQGTARVAVALGLFGFF

SEQ ID NO: 21609 - protein, 171 aa, Diabrotica virgifera
  misc_feature: Coding regions on vcDNA: vcDNA=SeqID_1306; Strand=+; Position=43-558
  misc_feature: Homolog annotation: Hit_ID=CAH87320.1; Match level="QueryCoverage =85%, HitCoverage=88%, E-value=2e-11, Identity=37%"; Hit description =hypothetical protein PC405573.00.0 [Plasmodium chabaudi]
FFSPPPPPPPPPKKKKKKNVLFFCCFLFFFFFLIKKKPPPPPPPPPGEKKNYFFFFFFLPAEEKNKKKKNVAPPPPPPQKKKKENFFFFFFFLKKKKKKKKKGVVVFFFGGGGGGGGPPHKKKKKKRGGGVLPPPPVVFLKKKKNPPGGVFFPAPPLFPPNIYKKKKIPLF

SEQ ID NO: 21610 - protein, 259 aa, Diabrotica virgifera
  misc_feature: Coding regions on vcDNA: vcDNA=SeqID_1307; Strand=-; Position=75-855
  misc_feature: Homolog annotation: Hit_ID=XP_313043.1; Match level="QueryCoverage =61%, HitCoverage=23%, E-value=7e-67, Identity=74%"; Hit description =ENSANGP00000011712 [Anopheles gambiae]
  misc_feature: Gene Ontology Annotation: Molecular function=electron transporter activity; Cellular component=cytosol; Biological process=pyruvate metabolism
  misc_feature: Pfam annotation: Pfam_ID=malic; Match level="Score=266.8, E-value =3.7e-77, Copies=1"; Pfam description=Malic enzyme, N-terminal domain
  misc_feature (148)..(148): Xaa can be any naturally occurring amino acid
NKFRNTSHFREACQNFGLVYRRPRGMYVTIYDKGNVYEIMKNWPETDVRAIVVTDGERILGLGDQGACGMGIPVGKLSLYTALAGIKPHQCLPITIDVGTNNETHLKDPLYIGLRQKRVTGQEYDELLDEIMGTGVRRWGQNTLIQFXDFGNSNAFKLVEKYRNENCTFQRPTFRDPLMEPEPGLFGFFEGSQKPKLFRIWGIVFPREQGKSRIWGIPLNLGPPGQRGKKERVLNGKGGPPGKKKNMGVGEKPSKKFYK

SEQ ID NO: 21611 - protein, 171 aa, Diabrotica virgifera
  misc_feature: Coding regions on vcDNA: vcDNA=SeqID_1308; Strand=+; Position=360-875
  misc_feature: Homolog annotation: Hit_ID=XP_310263.1; Match level="QueryCoverage =88%, HitCoverage=59%, E-value=1e-43, Identity=52%"; Hit description =ENSANGP00000015213 [Anopheles gambiae]
MSTQKGNTGRTRPQKHKNRSAFKNNLHDTNHRTKMINSIQVSDVCARCKDIIEWKIKYKKYKPLTQPKTCNKCGLKTVKKAYHVMCSDCGKKLGVCTKCCEKREVFVAEPTEKQQVQLDNELKALLQSLPERKRRTFIRYMNKKDKDKEEHRKHQIQSTLLQVSVYFGDYR

SEQ ID NO: 21612 - protein, 180 aa, Diabrotica virgifera
  misc_feature: Coding regions on vcDNA: vcDNA=SeqID_1309; Strand=+; Position=53-595
  misc_feature: Homolog annotation: Hit_ID=EAL33178.1; Match level="QueryCoverage =96%, HitCoverage=95%, E-value=1e-51, Identity=54%"; Hit description =GA10478-PA [Drosophila pseudoobscura]
  misc_feature: Gene Ontology Annotation: Molecular function=cytochrome c oxidase activity; Cellular component=integral to membrane; Biological process=positive regulation of growth rate
  misc_feature: Pfam annotation: Pfam_ID=COX4; Match level="Score=250.4, E-value=3.1e- 72, Copies=1"; Pfam description=Cytochrome c oxidase subunit IV
MASTLFALTARAIRNVPKTTGQAAAMSSYARTLIGKREIVGFGYNGEPNYADRADFPMPAIRWREPSADTNALREKEKGDWKNLSMEEKKALYRASFCQTFAEFKAPTGEWKSVVGLGLVLVSGAFWIFYFFKGFVYSPLPITFDKEHREAQLRRMIDLQVNPVQGLASKWDYEKDDWKK

SEQ ID NO: 21613 - protein, 284 aa, Diabrotica virgifera
  misc_feature: Coding regions on vcDNA: vcDNA=SeqID_1310; Strand=+; Position=95-949
  misc_feature: Homolog annotation: Hit_ID=XP_309465.1; Match level="QueryCoverage =71%, HitCoverage=81%, E-value=1e-19, Identity=29%"; Hit description =ENSANGP00000022079 [Anopheles gambiae]
MKLLAVYLICLKLVFSLELDSQCDNRGTLVYEDMHCKPITKEGHKCPVEFKCDLEAKGNTCRFRNRDIPFGSYLSDNDTYSACSVGCSCQEDNSFECAELDCPEYENPSPTSNDCYLKYKLGECCSVGRICARKDHPVECKTDGAIHMEGEEFYPQGTCLSCVCGKGFAGKYTPEFCQRRSCLVQVHNRDKIKDNCAPFYLYDNDNTALLSPFHGVCPSTNITRVAANPKAEKDTGLTCKFGTDTYKLGERMETVFKSFDNDRRVPCECKLPPFLTCRQKIIYL

SEQ ID NO: 21614 - protein, 277 aa, Diabrotica virgifera
  misc_feature: Coding regions on vcDNA: vcDNA=SeqID_1311; Strand=+; Position=66-898
  misc_feature: Homolog annotation: Hit_ID=XP_311498.1; Match level="QueryCoverage =97%, HitCoverage=88%, E-value=7e-92, Identity=60%"; Hit description =ENSANGP00000025078 [Anopheles gambiae]
  misc_feature: Pfam annotation: Pfam_ID=Ribosomal_L2_C; Match level="Score=118.5, E -value=1.6e-32, Copies=1"; Pfam description=Ribosomal Proteins L2, C -terminal dom
  misc_feature (254)..(254): Xaa can be any naturally occurring amino acid
MNSLTRTLYKLNPVLDNLHISPIISSVRYKAKIVPLPAIGGGSGNCFRRIVHYPEEYTVKPLDVTNLGGRDPKTGRMVVKGIGGGIKHKYHWIDWKRIGPNEEGKVQTEKVIKIIKDGCRTANVALVAYGDKLKYILATVNMKPGDIIKTSCYIPRIPVRANEGDAYPLGAIPIGTQIHNVEMYPGKGGMLVHAAGTYATVLRKAPNNFVIIMMPSKKEFSLPAQCMCTVGRLSNVEHGSTPIGSAGKNRELGXRPRSGLWQRKRGCHGRKIRRPPQ

SEQ ID NO: 21615 - protein, 411 aa, Diabrotica virgifera
  misc_feature: Coding regions on vcDNA: vcDNA=SeqID_1312; Strand=+; Position=114-1349
  misc_feature: Homolog annotation: Hit_ID=NP_725571.1; Match level="QueryCoverage =96%, HitCoverage=95%, E-value=1e-132, Identity=53%"; Hit description= CG7997-PB, isoform B [Drosophila melanogaster] ref|NP_611119.1| CG7997-PA, isoform A [Drosophila
  misc_feature: Gene Ontology Annotation: Molecular function=alpha-N -acetylgalactosaminidase activity; Cellular component=lysosome; Biological process=carbohydrate metabolism
  misc_feature: Pfam annotation: Pfam_ID=Melibiase; Match level="Score=-148.4, E -value=1.8e-07, Copies=1"; Pfam description=Melibiase
MVSRLVLALVGLISTVNGLDNGLARTPPMGWMDWQRFRCLTNCTLYPDECISEKLFRDMADRMAADGYLAAGYEYIMIDDCWSSKERDSKGRLVPDPDRFPSGIKNLSDYIHSKGLKFGIYADYGTLTCAGYPGSKEYLKIDADRFAEWEVDYLKFDGCNSDWIFIDKGYIEMGKHLNATGRPIVYSCSWPAYQEPNKMQSNYTALAETCNLWRNWDDIDDSWESVTSIIEWFSDNQDRIGPFSAPGHWNDPDMLVIGNFGLSFEQSKGQMSVWSVMAAPLIMSVDLRTIEPKFRAILLNKDAIAVNQDPLGEMGRLVLKKNNIYIWTKKLTPKADGRQPHAIAVLSQRTDGYKYRMEFTLKDLNITDPNGFLIKDIFDEDKSVASIADDEPFVLRMAPTGGTLLVATPKK

SEQ ID NO: 21616 - protein, 272 aa, Diabrotica virgifera
  misc_feature: Coding regions on vcDNA: vcDNA=SeqID_1313; Strand=+; Position=1-819
  misc_feature: Homolog annotation: Hit_ID=XP_312307.1; Match level="QueryCoverage =77%, HitCoverage=72%, E-value=4e-53, Identity=43%"; Hit description =ENSANGP00000010622 [Anopheles gambiae] gb|EAA07735.1| ENSANGP00000010622 [Anopheles gambiae
  misc_feature: Pfam annotation: Pfam_ID=Lectin_C; Match level="Score=4.8, E-value =0.00019, Copies=1"; Pfam description=Lectin C-type domain
EDRLTNITPPAESKVIPGKIVNSPYTPLKPVKIINNNLQHNSHIQQPTAPPRVKPTITGQRQVSETDLYLLGAIEKLVYKVDFMEKRLRRVEEMLYYSMAGNRIDTEPPCRTNYTKVGHDCYHFNSATGRELDWKAASKYCKKIGGFLAEMESIEDNQDLVTFIQATQHLRGRDFWVGGLNPGLLWIWSNSARPVAAPGSHTNKDNPSSAIQGEGRCLRLAYNTALRSYSYKGTDCSIRYNFICELPENTSSNEIKRLGRSRNILSEELSKN

SEQ ID NO: 21617 - protein, 264 aa, Diabrotica virgifera
  misc_feature: Coding regions on vcDNA: vcDNA=SeqID_1314; Strand=+; Position=30-824
  misc_feature: Homolog annotation: Hit_ID=EAA05578.2; Match level="QueryCoverage =89%, HitCoverage=43%, E-value=2e-64, Identity=48%"; Hit description =ENSANGP00000012528 [Anopheles gambiae str. PEST] ref|XP_563947.1| ENSANGP00000012528 [Anopheles gambiae st
  misc_feature: Gene Ontology Annotation: Molecular function=calcium, potassium:sodium antiporter activity; Cellular component=integral to plasma membrane; Biological process=calcium ion homeostasis
  misc_feature: Pfam annotation: Pfam_ID=Na_Ca_ex; Match level="Score=110.4, E-value =4.4e-30, Copies=1"; Pfam description=Sodium/calcium exchanger protein
TPNVLIKNHIFLLTSMLEKAVLGANCTPPAIDEFPQDLFTRTQLQNGAVIVHILVTVYLFAAIAIICDGYFVPAVEKICHILKIPPDIGGATFMATATASPELFVNIVGTFVTEGDIGLGTILGSTVFNILGVTACCGLTLAFTGSKSQLEWWSLTRDSVIYGISVCLLVWFLNNEQIEWYEALTLVLVYVLYIIFLIFDQQIQKYVKGKWCSNSLSDDSLQSKSVESLATSQETISKISNKISNIDSIENVKESTSVEMEQYY

SEQ ID NO: 21618 - protein, 473 aa, Diabrotica virgifera
  misc_feature: Coding regions on vcDNA: vcDNA=SeqID_1315; Strand=+; Position=38-1457
  misc_feature: Homolog annotation: Hit_ID=XP_391915.1; Match level="QueryCoverage =98%, HitCoverage=87%, E-value=0.0, Identity=83%"; Hit description =similar to ENSANGP00000015354 [Apis mellifera]
  misc_feature: Gene Ontology Annotation: Biological process=regulation of protein activity, epigenetic
  misc_feature: Pfam annotation: Pfam_ID=CBM_14; Match level="Score=48.7, E-value =1.7e-11, Copies=1"; Pfam description=Chitin binding Peritrophin-A domain
  misc_feature (414)..(414): Xaa can be any naturally occurring amino acid
MAYFATTIFLVALVASSGLAQQQAKDDEPKKEESFEAEICKDKDAGEWFRLVGGEGDTCRDVIQCTSSGLQAIRCPAGLYFDIEKQTCDWKDSVKNCKLKNKERRVKPMLFTDKPVCNEGELACGDGQCIERGLFCNGEKDCQDGSDETTCDIDSDPNSAPPCDPAVCVLPDCFCSEDGTGIPNDLPAKDVPQMITVTFDDAINNNNIGLYKNIFNGERKNPNGCHIKATFFVSHKYTNYSAVQEMHRKGHEIAVHSISHNDDENFWSNASVNDWVKEMGGMRVITEKFANITDNSVVGVRAPYLRVGGNNQFTMMEEEAFLYDSTITAPLNNPPLWPYTMYFRMPHRCHGNLQNCPTRSHAVWEMVLNELDRREDPENDEYLPGCAMVDSCSNILTGDQFYNFLNYNFDRHYXENRAPLGLYFHAAWLKNHPEFLDAFLYWIDEILSDHTDVYFVTVTQVIHWMPNPRSVAD

SEQ ID NO: 21619 - protein, 56 aa, Diabrotica virgifera
  misc_feature: Coding regions on vcDNA: vcDNA=SeqID_1316; Strand=-; Position=657-827
LNLAFNIIIQQNLSIKQDTCEKETLYTSNTCSLLIILLIVRLGTFPYIIKREVHRE

SEQ ID NO: 21620 - protein, 183 aa, Diabrotica virgifera
  misc_feature: Coding regions on vcDNA: vcDNA=SeqID_1317; Strand=+; Position=340-888
  misc_feature: Homolog annotation: Hit_ID=XP_396299.1; Match level="QueryCoverage =73%, HitCoverage=39%, E-value=2e-31, Identity=49%"; Hit description =similar to ENSANGP00000017738 [Apis mellifera]
  misc_feature: Gene Ontology Annotation: Molecular function=UDP-galactose beta-N -acetylglucosamine beta-13-galactosyltransferase activity; Cellular component=Golgi membrane; Biological process=protein amino acid glycosylation
MIKISATLKLSIIGLIIFTMIFLRFQGSLLQRNTYSLTTKLLLNGKTFLLSTGDYNRLLNISFNFSMINQVCQESAPVLVLIVVHSAPSNFKKRQTIRDTWGQVEETKQIVFMIGDPSSPEQQKKLEEENTLFGDIVQGNFIDNYRNLTLQHVMVLKYFVYHCPAAKYLLKTDDDVFINWPSM

SEQ ID NO: 21621 - protein, 150 aa, Diabrotica virgifera
  misc_feature: Coding regions on vcDNA: vcDNA=SeqID_1318; Strand=+; Position=104-556
  misc_feature: Homolog annotation: Hit_ID=EAA12081.3; Match level="QueryCoverage =98%, HitCoverage=100%, E-value=4e-41, Identity=55%"; Hit description= ENSANGP00000013101 [Anopheles gambiae str. PEST] ref|XP_555896.1| ENSANGP00000013101 [Anopheles gambiae s
  misc_feature: Gene Ontology Annotation: Molecular function=molecular_function unknown; Cellular component=cellular_component unknown; Biological process=biological_process unknown
  misc_feature: Pfam annotation: Pfam_ID=CHCH; Match level="Score=48.2, E-value=2.3e -11, Copies=1"; Pfam description=CHCH domain
MPRRGRAAPARAPARSNLPIRTPAPTPPAPVYAAPPAPVPAPSQGPGLFGQMAATAGGVAVGSAIGHTVGHAVTGLFSGGGSSEAPVQQPPQQVALQQQYAGTGAAGEQGPCSWEIKQFLQCSSTQSDLSLCQGFNEALQQCKVRNNIAV

SEQ ID NO: 21622 - protein, 313 aa, Diabrotica virgifera
  misc_feature: Coding regions on vcDNA: vcDNA=SeqID_1319; Strand=+; Position=187-1123
  misc_feature: Homolog annotation: Hit_ID=XP_314832.1; Match level="QueryCoverage =94%, HitCoverage=54%, E-value=4e-43, Identity=33%"; Hit description =ENSANGP00000011073 [Anopheles gambiae]
  misc_feature: Gene Ontology Annotation: Molecular function=permease activity; Cellular component=cellular_component unknown; Biological process =biological_process unknown
  misc_feature: Pfam annotation: Pfam_ID=Sugar_tr; Match level="Score=-103.8, E-value= 0.00093, Copies=1"; Pfam description=Sugar (and other) transporter
  misc_feature (287)..(287): Xaa can be any naturally occurring amino acid
  misc_feature (297)..(297): Xaa can be any naturally occurring amino acid
MAIEIKDQFTKESCHRSILKQFILGILANFSSVGPSMSLGFSAVALPVLRGHLNTIELSWFASIASLATPFGCFFAGPFADRYGRRMALFFVNIVCLLGWITIAVFCYAKPSHFWILLLGRVLTGLSTGLCSSPATVYMAEISSPDLRGIFTTWASVSFSLGVLVVYFLGFLFQSNLGAICLITAVFPCVGILFSIFLIPESPTWLVGRYRTEEARSSLCRIFNTGLTPDVQAELDHLIKCKGVSNMKSEKPMYRKILSKLEYLMQPHCLRPMILVLTYFFFPTFSXGIFVIIFYAXRYRNNAGITFDPYITI

SEQ ID NO: 21623 - protein, 228 aa, Diabrotica virgifera
  misc_feature: Coding regions on vcDNA: vcDNA=SeqID_1320; Strand=+; Position=2-688
  misc_feature: Homolog annotation: Hit_ID=NP_620470.1; Match level="QueryCoverage =97%, HitCoverage=40%, E-value=6e-98, Identity=70%"; Hit description =CG8947-PA [Drosophila melanogaster] gb|AAF49777.1| CG8947-PA [Drosophila melanogaster]
  misc_feature: Gene Ontology Annotation: Molecular function=cathepsin K activity; Cellular component=lysosome; Biological process=proteolysis and peptidolysis
  misc_feature: Pfam annotation: Pfam_ID=Peptidase_C1; Match level="Score=333.8, E -value=2.6e-97, Copies=1"; Pfam description=Papain family cysteine protease
YTDADTDDLPDQYDWRLFGAVSPVKDQAICGSCWSFGTVGTLEGSLFLKNGGRLVQLSQQALVDCSWGFGNNGCDGGEDWRAYQWIQKHGGIPIDSHYGGYKGEDGFCAADEVEKTAKITGWVNVTENDENALRLALVKQGPISVSIDASQKSFSFYSHGVYYEENCGNREEDLDHSVLAVGYGSINGENYWLIKNSWSTYWGNDGYILMSSRNNNCGVMTAATYVTM

SEQ ID NO: 21624 - protein, 548 aa, Diabrotica virgifera
  misc_feature: Coding regions on vcDNA: vcDNA=SeqID_1321; Strand=+; Position=68-1715
  misc_feature: Homolog annotation: Hit_ID=BAA86911.1; Match level="QueryCoverage =86%, HitCoverage=87%, E-value=1e-156, Identity=54%"; Hit description= homologue of Sarcophaga 26,29kDa proteinase [Periplaneta americana]
  misc_feature: Gene Ontology Annotation: Molecular function=cathepsin K activity; Cellular component=extracellular space; Biological process =proteolysis and peptidolysis
  misc_feature: Pfam annotation: Pfam_ID=Peptidase_C1; Match level="Score=150.3, E -value=4.5e-42, Copies=1"; Pfam description=Papain family cysteine protease
  misc_feature (469)..(469): Xaa can be any naturally occurring amino acid
MISKFTLVFLVCIVAPAIGDPPVPEWSDTYSVEGTIHLPYAEIVEPFHAWYDGKSKNSRIDYYNGTAKTYQLGGNGNGVQLKVVPFTTEEVLNQITCFQINGTEDDPVTPQSILPDLEGFEYQGIQEYGDRELEVWFLKTVQLEKENEYTLWVVRDEHGKAIPVKYDMRGYNSLLGSHYDHYYLLYTSKSYRTHKIDPSVFEVETNSECRSFPGPGNQHVHIMNPMAEYIRPEKSEHVDSSFGDFINNHNKNYADTKEHVFRKEVFRQNVRFIESVNRQNKGYSLAINHLADKTDKEIKYLNGRLSSGGNNGGQPFPYTDADTDDLPDQYDWRLFGAVSPVKDQAICGSCWSFGTVGTLEGSLFLKNGGRLVQLSQQALVDCSWGFGNNGCDGGEDWRAYQWIQKHGGIPIDSHYGGYKGEDGFCAADEVEKTAKITGWVNVTENDENALRLALVKQGPISVSIDASKXFQFYSHGVYYKNPFFKKKKKKKTFFFFLAWCNLVLFLKNIVHFQYNAISVGFRIWPITYILKKFHMLGSILCCTRLNHE

SEQ ID NO: 21625 - protein, 64 aa, Diabrotica virgifera
  misc_feature: Coding regions on vcDNA: vcDNA=SeqID_1322; Strand=-; Position=772-966
RKFELKHCLLYCDKSYQYRSINSFFYNHIFAFILKKLQICLTILLFFKKILSHIVFIFTCAYVH

SEQ ID NO: 21626 - protein, 200 aa, Diabrotica virgifera
  misc_feature: Coding regions on vcDNA: vcDNA=SeqID_1323; Strand=+; Position=134-734
  misc_feature: Homolog annotation: Hit_ID=XP_315241.1; Match level="QueryCoverage =99%, HitCoverage=99%, E-value=6e-88, Identity=73%"; Hit description =ENSANGP00000020929 [Anopheles gambiae] gb|EAA10578.1| ENSANGP00000020929 [Anopheles gambiae
  misc_feature: Gene Ontology Annotation: Molecular function=small monomeric GTPase activity; Cellular component=membrane fraction; Biological process =gastrulation
  misc_feature: Pfam annotation: Pfam_ID=Arf; Match level="Score=147.0, E-value=4.3e -41, Copies=1"; Pfam description=ADP-ribosylation factor family
  misc_feature (29)..(29): Xaa can be any naturally occurring amino acid
MFTLVYGFYKHMVQKDEYCVLILGLDNAXTYLEAAKTKLTKNYKAIHPTKITTTVGLNIGKVDVGGIRLNFWDLGGQNELQSLWDKYYEESHAVIYIVDSSDRERMDESKDIFDKMIASEYLKGIPLLVLANKQDIPECMGVREVKPIFNKNAHLIGKRDCMVMPVSALTGEGVDEGIRWLVDCIKRNSYLRPPRNQEEL

SEQ ID NO: 21627 - protein, 59 aa, Diabrotica virgifera
  misc_feature: Coding regions on vcDNA: vcDNA=SeqID_1324; Strand=+; Position=2-181
  misc_feature: Homolog annotation: Hit_ID=AAP44496.1; Match level="QueryCoverage =79%, HitCoverage=7%, E-value=1e-10, Identity=60%"; Hit description =Na-K-Cl cotransporter [Aedes aegypti]
ENGNTSRDLRNKDINWSRYGLGTEAARVRGNTSGFVDLSNDYGAGGHQASGANELFAEE

SEQ ID NO: 21628 - protein, 203 aa, Diabrotica virgifera
  misc_feature: Coding regions on vcDNA: vcDNA=SeqID_1325; Strand=+; Position=184-795
  misc_feature: Homolog annotation: Hit_ID=XP_321671.1; Match level="QueryCoverage =83%, HitCoverage=78%, E-value=1e-36, Identity=40%"; Hit description =ENSANGP00000011708 [Anopheles gambiae]
DNLKLQKQTMWKFSRKSYSNAIGITTDQWKGVTVKFNNKIKGTLLEKWIKYWKLLAGDYRDVALNLKSEMRQKPLKSAVYLSGLSFLAYCGTHNPDLRNFRAKYIDSANQLALVNSSVANPNSVNHLKYIEKCFNANLIRFINLGVLSIVWVDEFSEDCDNYESNCSYLQVPYTRFGERILDIGFLNTWWVISRKMLDYDINY

SEQ ID NO: 21629 - protein, 359 aa, Diabrotica virgifera
  misc_feature: Coding regions on vcDNA: vcDNA=SeqID_1326; Strand=+; Position=661-1737
  misc_feature: Homolog annotation: Hit_ID=EAL26405.1; Match level="QueryCoverage =77%, HitCoverage=86%, E-value=1e-21, Identity=32%"; Hit description =GA14087-PA [Drosophila pseudoobscura]
  misc_feature (326)..(326): Xaa can be any naturally occurring amino acid
MSERVNYKRLCVRSDKDGFTYPKTIAKERGELSTVISIAICLILFLVDLIHNENSFCVFAIQYTTGVVLTIVLQLIYRFILMCEEMRHLISRYDRNVWILFKDVLHFPIPVYMTFFFGVIYLVYNYSSTAFELWNSSVTLPRIVSMYLNMYLLGKLLKLDSGPLNDSLWIAEDNGLDYGSGMAYSFFFGYLNLVLPKTGREDKHLKEIMEDYEGSNGITFAVHKLFILIPKSMKCFVSLKNEYSPSVDESRSLEQKVMTVAGVQNRVYKNAVYKISPKKNDYIYVSAEYATPLKTFKDVFDNRGQHSENFHKHKKDIILQFYLTLXRVLEQKGLNQFCELYYEDSIKMVVLPITMKSFM

SEQ ID NO: 21630 - protein, 194 aa, Diabrotica virgifera
  misc_feature: Coding regions on vcDNA: vcDNA=SeqID_1327; Strand=+; Position=5-589
  misc_feature: Homolog annotation: Hit_ID=NP_728587.1; Match level="QueryCoverage =64%, HitCoverage=70%, E-value=5e-25, Identity=42%"; Hit description =CG9134-PC, isoform C [Drosophila melanogaster] ref|NP_728586.1| CG9134-PA, isoform A [Drosophila
  misc_feature: Pfam annotation: Pfam_ID=Lectin_C; Match level="Score=89.0, E-value =1.2e-23, Copies=1"; Pfam description=Lectin C-type domain
MADAWVLKALVLCISCVAFSAAVYLDGWGGGTANRNPQSATWEKIFESNTRSSVLPLFRHDNKLYYMGVHFRARWQNAFQFCESLHMKLLTIHSNEENNRIHKYIRDASKGTEYWIGGTRLVDGSSWVWMPYGTQIDYTKWSNGQPSDINEKCLQLWITDNQLTWNDRDCNAEFYFICERYVDSNDSGPPGASL

SEQ ID NO: 21631 - protein, 76 aa, Diabrotica virgifera
  misc_feature: Coding regions on vcDNA: vcDNA=SeqID_1328; Strand=+; Position=2-232
  misc_feature: Homolog annotation: Hit_ID=EAL32170.1; Match level="QueryCoverage =94%, HitCoverage=14%, E-value=6e-17, Identity=57%"; Hit description =GA17499-PA [Drosophila pseudoobscura]
  misc_feature: Gene Ontology Annotation: Molecular function=ethanolamine kinase activity; Cellular component=cytoplasm; Biological process =phosphatidylethanolamine biosynthesis
VYLTEYNGREPSSKEIEKMYVQINKSTLITHIFWGVWSLVQAEHSSISFDYMGYAAIRLNEYFSKKDLFLSLELPS

SEQ ID NO: 21632 - protein, 235 aa, Diabrotica virgifera
  misc_feature: Coding regions on vcDNA: vcDNA=SeqID_1329; Strand=+; Position=1-705
  misc_feature: Homolog annotation: Hit_ID=XP_392097.1; Match level="QueryCoverage =100%, HitCoverage=70%, E-value=4e-76, Identity=42%"; Hit description= similar to ENSANGP00000016783 [Apis mellifera]
  misc_feature: Gene Ontology Annotation: Molecular function=structural constituent of bone; Cellular component=collagen type III; Biological process =histogenesis and organogenesis
  misc_feature: Pfam annotation: Pfam_ID=Collagen; Match level="Score=143.5, E-value =4.7e-40, Copies=3"; Pfam description=Collagen triple helix repeat (20 copi
PKGDKGEKGFTGRDGTKGDKGDQGFTGPSGPIGPTGPPGPVGRRGLPGQRGDKGEKGPMGFPGDRGRDGSPGLPGLSGGKGTKGEAGIPSVGPSGPPGPIGEPGEKGLPGFPGKPGPRGNDGFPGLMGEKGDVGSPGLNGLTGPAGQKGEPGPIGPPGIDGREGSPGYPGAKGELGPRGQPGRAGLQGFPGLKGEAGFPGGTGQKGFKGTIRMARTPWKPGMDGLPGKIGEKGER

SEQ ID NO: 21633 - protein, 281 aa, Diabrotica virgifera
  misc_feature: Coding regions on vcDNA: vcDNA=SeqID_1330; Strand=+; Position=166-1007
  misc_feature: Homolog annotation: Hit_ID=XP_317621.1; Match level="QueryCoverage =99%, HitCoverage=78%, E-value=3e-95, Identity=60%"; Hit description =ENSANGP00000009965 [Anopheles gambiae]
  misc_feature: Gene Ontology Annotation: Biological process=protein-mitochondrial targeting
  misc_feature: Pfam annotation: Pfam_ID=Porin_3; Match level="Score=240.4, E-value =3.2e-69, Copies=1"; Pfam description=Eukaryotic porin
  misc_feature (231)..(231): Xaa can be any naturally occurring amino acid
  misc_feature (246)..(246): Xaa can be any naturally occurring amino acid
  misc_feature (270)..(270): Xaa can be any naturally occurring amino acid
MGNVHAYSSNPPPPPPPSTTFPRKKDTDPAASPPEVIENPGPLEEIHSKCKNVFPTCFEGARVMLTRGLSNHFQISHTINMSSVTPSGYRFGATYVGTKQISPTEAYPILLGDIDPSGNLNATIIHQIQPNLQTKFGAQVQNSKFQVGQLTMNYKGSDYTASCTVANPDVINSSGIVVLHYLQAVTAKLALGTELAYQKGPSIPGGEIALLSAAAKYSTDNAQISGTLGVXGVHLCYYQRASKQLXQIGVEIEAKHRMQEAVASVGYQVXLPKSEVVFKGH

SEQ ID NO: 21634 - protein, 68 aa, Diabrotica virgifera
  misc_feature: Coding regions on vcDNA: vcDNA=SeqID_1331; Strand=+; Position=104-309
  misc_feature: Homolog annotation: Hit_ID=AAQ21381.1; Match level="QueryCoverage =98%, HitCoverage=44%, E-value=2e-20, Identity=73%"; Hit description =vacuolar H+ ATP synthase 16 kDa proteolipid subunit [Apis mellifera]
  misc_feature: Gene Ontology Annotation: Molecular function=hydrogen-transporting two-sector ATPase activity; Cellular component=integral to membrane; Biological process=proton transport
  misc_feature: Pfam annotation: Pfam_ID=ATP-synt_C; Match level="Score=9.5, E-value =0.0015, Copies=1"; Pfam description=ATP synthase subunit C
  misc_feature (48)..(48): Xaa can be any naturally occurring amino acid
MADDKHPVYGPFFGVMGAAAAIIFSSLGAAYGTAKSGTGIAAMPDMRXELIMKCIIPLCRRIAVYGLA

SEQ ID NO: 21635 - protein, 112 aa, Diabrotica virgifera
  misc_feature: Coding regions on vcDNA: vcDNA=SeqID_1332; Strand=+; Position=417-755
LAEGFIDPRTPVEMNSLPRIHPALNSNWFNTFRCQKPDNAPLLLNRRILQCERHDVLTRTVASIGRLSYKSLYSLLRMRAPGNAPIESEGYICLPGCLTTLSHNGIGNYVCG

SEQ ID NO: 21636 - protein, 185 aa, Diabrotica virgifera
  misc_feature: Coding regions on vcDNA: vcDNA=SeqID_1333; Strand=+; Position=2-559
  misc_feature: Homolog annotation: Hit_ID=AAV84268.1; Match level="QueryCoverage =73%, HitCoverage=87%, E-value=5e-60, Identity=88%"; Hit description =vacuolar atpase 16kDa subunit [Culicoides sonorensis]
  misc_feature: Gene Ontology Annotation: Molecular function=hydrogen-transporting two-sector ATPase activity; Cellular component=integral to membrane; Biological process=proton transport
  misc_feature: Pfam annotation: Pfam_ID=ATP-synt_C; Match level="Score=120.5, E -value=4.2e-33, Copies=2"; Pfam description=ATP synthase subunit C
MTLGIIHFMISSGLMTDIAFYRFLILHGPYDEPPGYEPVSLHACPLTPAIIFYSLGAAYGTVKSGTGIAAMSVMRPQLIMKCIIPVDMAGIIAIYGLVIAVLISGNIQDSSTYSLYSGFVHLGAGLSVGFSGLAAGFAIGIVGDAGVRGTAQQPRLFVGMILILIFAEVLGLYGLIVAIYLYTRA

SEQ ID NO: 21637 - protein, 157 aa, Diabrotica virgifera
  misc_feature: Coding regions on vcDNA: vcDNA=SeqID_1334; Strand=+; Position=906-1379
  misc_feature: Homolog annotation: Hit_ID=AAQ21381.1; Match level="QueryCoverage =98%, HitCoverage=99%, E-value=4e-62, Identity=78%"; Hit description =vacuolar H+ ATP synthase 16 kDa proteolipid subunit [Apis mellifera]
  misc_feature: Gene Ontology Annotation: Molecular function=hydrogen-transporting two-sector ATPase activity; Cellular component=vacuolar membrane; Biological process=hydrogen transport
  misc_feature: Pfam annotation: Pfam_ID=ATP-synt_C; Match level="Score=120.1, E -value=5.5e-33, Copies=2"; Pfam description=ATP synthase subunit C
  misc_feature (101)..(101): Xaa can be any naturally occurring amino acid
  misc_feature (104)..(104): Xaa can be any naturally occurring amino acid
MADDKHPVYGPFFGVMGAAAAIIFSSLGAAYGTAKSGTGIAAMSVMRPELIMKCIIPVVMADIIAIYGLVIAVLISGNIQDSSTYSLYSGFVHLGAGLSVXFHXLALGVAIAIAGDAGVRGTGQQPKLFVRMILILIFAKVLRLYGLIVAIYLYTIA

SEQ ID NO: 21638 - protein, 391 aa, Diabrotica virgifera
  misc_feature: Coding regions on vcDNA: vcDNA=SeqID_1335; Strand=+; Position=70-1242
  misc_feature: Homolog annotation: Hit_ID=XP_309798.1; Match level="QueryCoverage =98%, HitCoverage=64%, E-value=1e-119, Identity=55%"; Hit description= ENSANGP00000012386 [Anopheles gambiae]
  misc_feature: Gene Ontology Annotation: Molecular function=signal recognition particle binding; Cellular component=integral to membrane; Biological process=cotranslational membrane targeting
  misc_feature: Pfam annotation: Pfam_ID=SRP-alpha_N; Match level="Score=182.2, E -value=1.1e-51, Copies=1"; Pfam description=Signal recognition particle, alpha su
TITALGKMLDLFTIFSKGGIVLWCFQSTNQIFTPSVNALIKNVILQERSGVKTFDHDGLILQYKLDNEFDLVFVVAYQKILQLSYVDKFLNDIHLEFRDKYKNELTEKLYFQDFSFVDTYNSTLKSAENWSKVQLKQPKQMRTFEESFKSKKTVSSMIERKGEEKPQKPIKKKEVNFSTEEKTIAPPSPQSQKNGLIDEETLAMNRAKFAKKMQKKKPEAKKSPKSPPAEKAGKKPRVWDLSGSNKDVDLLERTTDRPEDARSNYTPDADMVGQMKGVIKDLEVESSDEEYEDEEEVETVQQSKPAPKGGMFSIFRGLVGSKNLTKSDMEPVLEKMKDHLIAKNVAADISEKLCDSVATKLEGKVLGTFDSVATTVKNTLNESLVQIFKSK

SEQ ID NO: 21639 - protein, 179 aa, Diabrotica virgifera
  misc_feature: Coding regions on vcDNA: vcDNA=SeqID_1336; Strand=+; Position=1-540
  misc_feature: Homolog annotation: Hit_ID=XP_392094.1; Match level="QueryCoverage =100%, HitCoverage=31%, E-value=3e-59, Identity=65%"; Hit description= similar to ENSANGP00000014306 [Apis mellifera]
  misc_feature: Gene Ontology Annotation: Molecular function=molecular_function unknown; Cellular component=mitochondrial inner membrane; Biological process=biological_process unknown
PGLSWKEQIRPLEPEITAVQKAAADHDGLVNAVIEGIPKEARERGVYPEDALRERFLKVEQVARTVALIPEEGAALPVHLLSYLQSLILIKAASPIPQSELNNEIIDVSTLNTNDILQRARYWLDRGDFTQTLRYMNLLKGAARCVAKEWMDETRIYLETQQAANTLMAYASSSGLAYL

SEQ ID NO: 21640 - protein, 373 aa, Diabrotica virgifera
  misc_feature: Coding regions on vcDNA: vcDNA=SeqID_1337; Strand=+; Position=18-1135
  misc_feature: Homolog annotation: Hit_ID=XP_310873.1; Match level="QueryCoverage =97%, HitCoverage=50%, E-value=5e-81, Identity=43%"; Hit description =ENSANGP00000012412 [Anopheles gambiae]
  misc_feature (334)..(334): Xaa can be any naturally occurring amino acid
MIFAQNWSRALLKRNILNSCRYQHGYIILVPEIGEDVDGKDSASKQTSNLPEFNNVTIENCRAAIAKQSLEFEEGVKSIEKEIESNPKGDIFQQIFKPLEVVGGPLDVTWGVSKTLYLGNSTLMPTSSYMAIHERARKARASKYNSKSIYSAVKTALNIKTERSSEESRILQKFATEGRLNGLELDSTKKVILSEYLNKLNKEKTLFRQKTEVSTKRFTQTISDPEIIKDIPKSVLKLLAIDPNNADNGPWKLNLQPYSYMPVMEYCSERDIRWNLWQALVSRGSKMGDSELSTSLHIEEIRMLRRDVAGILGFETFADMSLQTKMVKNTAEIXNILLSLLESAKSAQDAEVKQLYDFAVENEFEDDKLELWD

SEQ ID NO: 21641 - protein, 298 aa, Diabrotica virgifera
  misc_feature: Coding regions on vcDNA: vcDNA=SeqID_1338; Strand=+; Position=39-935
  misc_feature: Homolog annotation: Hit_ID=EAL26180.1; Match level="QueryCoverage =96%, HitCoverage=98%, E-value=1e-100, Identity=63%"; Hit description= GA19673-PA [Drosophila pseudoobscura]
  misc_feature: Gene Ontology Annotation: Molecular function=enoyl-CoA hydratase activity; Cellular component=mitochondrion; Biological process =energy pathways
  misc_feature: Pfam annotation: Pfam_ID=ECH; Match level="Score=293.9, E-value=2.6e -85, Copies=1"; Pfam description=Enoyl-CoA hydratase/isomerase family
MSAATVSRIVAAKVFGNNSFKYGQVAKNVRLFSVAATKENYEFIKVSKTGEKQNVGLIQLNRPKALNALCNGLISEVSEALNSFDTDKSVGAVVITGNEKAFAAGADIKEMVSNTFAKCVTEDFIGAWQLIANMKKPLLAAVNGYALGGGCELAMMCDIIYAGDKAKFGQPEILLGVIPGAGGTQRLTRTVGKSKAMEIVLSGNQVTAQDAEKMGLVSKVVPAAELLTETVKLAEKIAGNSQIANIIAKESVNTALETTLKEGLHFEKRMFHALFATKDQKEGMAAFIEKRKANFTHE

SEQ ID NO: 21642 - protein, 111 aa, Diabrotica virgifera
  misc_feature: Coding regions on vcDNA: vcDNA=SeqID_1339; Strand=+; Position=99-434
  misc_feature: Homolog annotation: Hit_ID=XP_309492.1; Match level="QueryCoverage =99%, HitCoverage=57%, E-value=7e-20, Identity=40%"; Hit description =ENSANGP00000022042 [Anopheles gambiae]
  misc_feature: Gene Ontology Annotation: Biological process=mitosis
MTDQPLPPPVMWAQRSSIVFLTINLEDVKNPEIKFNKDSIYFKGTGGVEKKDYEVTIPLYKEIDPEQSKSFNKGRCIEIIVTKANTDGPYWPTLTSFKKKHHRIKCDSNKY

SEQ ID NO: 21643 - protein, 281 aa, Diabrotica virgifera
  misc_feature: Coding regions on vcDNA: vcDNA=SeqID_1340; Strand=+; Position=27-869
  misc_feature: Homolog annotation: Hit_ID=NP_511055.1; Match level="QueryCoverage =96%, HitCoverage=60%, E-value=6e-52, Identity=41%"; Hit description =CG4317-PA [Drosophila melanogaster] gb|AAF46121.1| CG4317-PA [Drosophila melanogaster]
  misc_feature: Gene Ontology Annotation: Molecular function=phosphohistidine phosphatase activity; Cellular component=endoplasmic reticulum; Biological process=polyphosphate metabolism
MYSWPLSANMRAVMYHSVLLLICFLVSFSIECTNYGYPFENHLAQMTPYRIVSNKSFDRIEYRGCTPKKIWMMVRHGTRNPKYSVIEQMLARLPEIRKLLVESTSLPNDHVKNRDLDLLRKWKLTLDVDDKNKLTHEGEEEMLVLAERMQSRFPELFDEVYSNTSYKFKYTHSQRTLRSAYFFAAGLFGKATAKDVWFPAPLRKDPILRFYKLCDKWNVEVKKNPAALREVTIFENGPEMAKLVKEVNKNLAFEEHEVNKDDVLLMYQMCAFETAWNKKRN

SEQ ID NO: 21644 - protein, 261 aa, Diabrotica virgifera
  misc_feature: Coding regions on vcDNA: vcDNA=SeqID_1341; Strand=+; Position=149-934
  misc_feature: Homolog annotation: Hit_ID=XP_391949.1; Match level="QueryCoverage =97%, HitCoverage=17%, E-value=3e-74, Identity=58%"; Hit description =similar to ENSANGP00000005493 [Apis mellifera]
  misc_feature: Gene Ontology Annotation: Molecular function=interleukin-5 receptor binding; Cellular component=interleukin-5 receptor complex; Biological process=regulation of synapse
  misc_feature: Pfam annotation: Pfam_ID=PDZ; Match level="Score=38.8, E-value=1.7e -08, Copies=1"; Pfam description=PDZ domain (Also known as DHR or GLGF
MSLYPSLEDMKMDQMANAQYSHIQRSIAAPQATAPGAPPPYTYPGFDSMPVLPALGADNKQLYPSLGEFMGLELSEAVIAENMPEYSQVVLYQQSVVPQTTSTGLIAPISGQSVGLQRAQVTHGVRQLILCKDKDNKVGVRVKSINKGVFVCVVVENSPAAMAGLRFGDQILQINDENVAGYTMEKVHAMFKKSPVNGINVVVRDRPFERTITLHKDSVGCIGFQYKNGKIITIVKDSSAARNVVLIEHQLWYVDMPSPST

SEQ ID NO: 21645 - protein, 374 aa, Diabrotica virgifera
  misc_feature: Coding regions on vcDNA: vcDNA=SeqID_1342; Strand=+; Position=17-1138
  misc_feature: Homolog annotation: Hit_ID=CAC82442.1; Match level="QueryCoverage =95%, HitCoverage=72%, E-value=3e-49, Identity=41%"; Hit description =putative non-ribosomal nucleolar protein [Chironomus tentans]
  misc_feature: Gene Ontology Annotation: Molecular function=microtubule binding; Cellular component=Cajal body; Biological process=nucleolus organization and biogenesis
MAENINSVLNALIFDFLTKKNIKLAPQFQKELKPASLVKGSPVLAEIVSHYLKSGPKAKQLKVNAEDSDESSSEEEETPKTKPIVNGNVKSNKKDSSSEDSSDEEEQPKTVKPSIKPIQKKPESSGDSSSDEEEVKKPSVKPLQKQAQIPVKAAVTKDSSEDSSEDSSDEPEKAPAKPVQKKAPPVPKQATKNVQKKESSSEDSSEEEVASKPVPTKQPQNKPQKEESSDESSSEEEAPKKPAPKKPAPKPSVVTKKAESSSEDSSDEDEPVKKPVAKATATKVIPPKIQKKQESSSEDSSPEEEEAPKKTVNPTPVKAKPAQTGVKRKAESSSSEESSDEEPPAKKPAVAPAKKPAAVITQKKSVPKKESSSD

SEQ ID NO: 21646 - protein, 526 aa, Diabrotica virgifera
  misc_feature: Coding regions on vcDNA: vcDNA=SeqID_1343; Strand=+; Position=2-1582
  misc_feature: Homolog annotation: Hit_ID=AAF68853.2; Match level="QueryCoverage =98%, HitCoverage=94%, E-value=3e-76, Identity=39%"; Hit description =Nopp140-like nucleolar protein [Drosophila melanogaster]
  misc_feature: Gene Ontology Annotation: Molecular function=microtubule binding; Cellular component=Cajal body; Biological process=nucleolus organization and biogenesis
APAKPVQKKAPPVPKQATTVKPSIKPIQKKPESSDDSSSDEEEVKKPSVKPLQKQAQIPVKAAVTKDSSEDSSEDSSDEPEKAPAKPVQKKAPPVPKQATKNVQKKESSSEDSSEEEVASKPVPTKQPQNKPQKEESSDESSSEEEAPKKPAPKKPAPKPSVVTKKAESSSEDSSDEDEPVKKPVAKATATKVIPPKIQKKQESSSEDSSSEEEEAPKKTVNPTPVKAKPAQTGVKRKAESSSSEESSDEEPPAKKPAVAPAKKPAAVITQKKSVPKKESSSDDSSSEEETPAVKKLTPAPQNKSTAKKEESSSEDSSEEETKKPAPKPQPVTKKATSNKKESSSDDDSDDEDDEDEKPALKKAAVTSTLKKPAKKESSDDDDDDEEEETNTSKQQEDENEESELKIKKPKYDNFVKAGQNKSFDGNDKGDRNSFGGRGGRGRGGRGGFRGGFNNRNSDGDGGERNSWGGGNNRGGGFRGGRGGNRGRGDGGFRNSFGNDRGGGRGGFRKSFGDNDKGGRKWEVRG

SEQ ID NO: 21647 - protein, 488 aa, Diabrotica virgifera
  misc_feature: Coding regions on vcDNA: vcDNA=SeqID_1344; Strand=+; Position=5-1471
  misc_feature: Homolog annotation: Hit_ID=NP_730694.2; Match level="QueryCoverage =98%, HitCoverage=99%, E-value=1e-56, Identity=37%"; Hit description =CG7421-PA, isoform A [Drosophila melanogaster] gb|AAF51788.3| CG7421- PA, isoform A [Drosophila
  misc_feature: Gene Ontology Annotation: Molecular function=RNA polymerase II transcription factor activity; Cellular component=Cajal body; Biological process=embryogenesis and morphogenesis
MAENINSVLNALIFDFLTKKNIKLAPQFQKELKPASLVKGSPVLAEIVSHYLKSGPKAKQLKVNAEDSDESSSEEEETPKTKPIVNGNVKSNKKDSSSEDSSDEEEQPKTVKPSIKPIQKKPESSGDSSSDEEEVKKPSVKPLQKQAQIPVKAAVTKDSSEDSSEDSSDEPEKAPAKPVQKKAPPVPKQATKNVQKKESSSDDSSSEEETPAVKKLTPAPQNKSTAKKEESSSEDRSEEETKKPAPKPQPVTKKATSNKKESSSDDDSDDEDDEDEKPALKKAAVTSTLKKPAKKESSDDDDDDEEEETNTSKQQEDENEESELKIKKPKYDNFVKAGQNKSFDGNDKGDRNSFGGRGGRGRGGRGGFRGGFNNRNSDGDGGERNSWGGGNNRGGGFRGGRGGNRGRGDGGFRNSFGNDRGGGRGGFRKSFGDNDRGGRGGRFGDRGGRGGGFRGDRNGRGGGFNNSFNERDSFGAKSAENKKITFDD

SEQ ID NO: 21648 - protein, 274 aa, Diabrotica virgifera
  misc_feature: Coding regions on vcDNA: vcDNA=SeqID_1345; Strand=+; Position=14-838
  misc_feature: Homolog annotation: Hit_ID=XP_309679.1; Match level="QueryCoverage =87%, HitCoverage=57%, E-value=7e-38, Identity=37%"; Hit description =ENSANGP00000003904 [Anopheles gambiae]
MKYHSCIFIIFLIFLKVTCSEKDNKGDEFVATEEWQTIKEGQKVPSGLHYRINVQTGLKEAKLIGKDHDDTNKETSVLEVPSEKTQDHPTIDELKEVMKKIKNDDVKPGGKVKSDFRTYEQLKEELGSLNLTSKVDAEILQDLFKQHQKEITKEKINVRSVLNILEDFDYLGHQFDTGLEFVRQNGFRDVIYKNLNSTHEQIKQNTLKLFGSLVQNNARVQIHALETGSIPILLRFLSSDQTELTTSNALFALSCLVRRFPLAQKRFLKMVEYL

SEQ ID NO: 21649 - protein, 164 aa, Diabrotica virgifera
  misc_feature: Coding regions on vcDNA: vcDNA=SeqID_1346; Strand=+; Position=51-545
  misc_feature: Homolog annotation: Hit_ID=XP_318684.1; Match level="QueryCoverage =95%, HitCoverage=90%, E-value=2e-16, Identity=31%"; Hit description =ENSANGP00000010274 [Anopheles gambiae]
MFVTHHFSIDEVNNLLSESFVRIFGNVVEHFPAAAIGILKCRPFNNSNALIQAICDFLDGLKAHEKEKIFQLYPDILDSALCTSPMIYDKEPSFVNIEEKRKLQELNSRYKDKFGYPFITTISDHNHLYSEIQSRMENNKDDELQRTLREVKAIVYLRVQDIVS

SEQ ID NO: 21650 - protein, 274 aa, Diabrotica virgifera
  misc_feature: Coding regions on vcDNA: vcDNA=SeqID_1347; Strand=+; Position=92-917
  misc_feature: Homolog annotation: Hit_ID=XP_317791.1; Match level="QueryCoverage =97%, HitCoverage=62%, E-value=1e-110, Identity=74%"; Hit description= ENSANGP00000018102 [Anopheles gambiae]
  misc_feature: Gene Ontology Annotation: Molecular function=citrate transporter activity; Cellular component=mitochondrial inner membrane; Biological process=mitochondrial citrate transport
  misc_feature: Pfam annotation: Pfam_ID=Mito_carr; Match level="Score=207.0, E-value= 3.8e-59, Copies=2"; Pfam description=Mitochondrial carrier protein
  misc_feature (268)..(268): Xaa can be any naturally occurring amino acid
MSPSPPTPFTYPFKRPWLKDYGAAAPVGGGSIGLKGIIAGGITGGIEICITFPTEYVKTQLQLDEKGDKKKYNGIADCVKKTVKSHGFFGLYRGLSVLLYGSIPKSAVRFGAFESFKNKMQRPDGTLSISGRLLCGMGAGVCEAILAVTPMETVKVKFINDQRSQTPRFKGFLHGVKMIVREEGIGGVYKGVTATIIKQGSNQAIRFFVMETLKDAYKGGDRDKKIPKIVVGAMGAFAGACSVYGNNPIDVVKTRMQGLKAKKYKNTXDCAVKL

SEQ ID NO: 21651 - protein, 165 aa, Diabrotica virgifera
  misc_feature: Coding regions on vcDNA: vcDNA=SeqID_1348; Strand=+; Position=3-500
  misc_feature: Homolog annotation: Hit_ID=AAB64306.1; Match level="QueryCoverage =100%, HitCoverage=13%, E-value=7e-68, Identity=76%"; Hit description= pyruvate carboxylase [Aedes aegypti] pir||T43735 pyruvate carboxylase (EC 6.4.1.1) [validated] - yellow f
  misc_feature: Gene Ontology Annotation: Molecular function=pyruvate carboxylase activity; Cellular component=cytosol; Biological process =gluconeogenesis
  misc_feature: Pfam annotation: Pfam_ID=Biotin_lipoyl; Match level="Score=78.5, E -value=1.7e-20, Copies=1"; Pfam description=Biotin-requiring enzyme
QVTNEYLAFNEKFGPVDKLQTRMFLVGPKVGEEFEVTIERGKTLGIKTLAVAEDLTENGEREVFFELNGTLRSVLIRDKSAGEELHLHPKAEKTNKKQVGAPMPGTVIDIRIKAGDKVEKGTPLVILSAMKMETVVQSPVAGVVKTIDAAMGMKLEAEDLIITLE

SEQ ID NO: 21652 - protein, 257 aa, Diabrotica virgifera
  misc_feature: Coding regions on vcDNA: vcDNA=SeqID_1349; Strand=+; Position=174-943
  misc_feature: Homolog annotation: Hit_ID=XP_394716.1; Match level="QueryCoverage =82%, HitCoverage=89%, E-value=9e-43, Identity=42%"; Hit description =similar to CG31475-PA [Apis mellifera]
  misc_feature: Pfam annotation: Pfam_ID=efhand; Match level="Score=21.7, E-value =0.0022, Copies=1"; Pfam description=EF hand
  misc_feature (240)..(240): Xaa can be any naturally occurring amino acid
MNVAQKIKYLECLRWSYTVPILCYLAFFVMIWMLAVPLKHNIKIVKDLKVNVEDSFEIRIKNSNFNTDKRGEEELIDKNEYLVDFNKDGTRTLLEVFEKADKDKNNKLDSRELAMWIRQKIVEHISTAISSNLELFSLIDISPQNGVITWREYHTYFLKKRGFSDKFIGDHDEKRHRGLERSLKGTYLSERIMRDKAAWTEAAKSNPNTLTIDEFLSFTHPESSVTNQLMLVDELFDKFXRDGDELLTEDGVAGLQL

SEQ ID NO: 21653 - protein, 401 aa, Diabrotica virgifera
  misc_feature: Coding regions on vcDNA: vcDNA=SeqID_1350; Strand=+; Position=2-1204
  misc_feature: Homolog annotation: Hit_ID=EAA45649.2; Match level="QueryCoverage =97%, HitCoverage=79%, E-value=1e-72, Identity=35%"; Hit description =ENSANGP00000024832 [Anopheles gambiae str. PEST] ref|XP_560701.1| ENSANGP00000024832 [Anopheles gambiae st
  misc_feature: Gene Ontology Annotation: Cellular component=membrane; Biological process=electron transport
  misc_feature: Pfam annotation: Pfam_ID=p450; Match level="Score=47.9, E-value=1.5e -13, Copies=1"; Pfam description=Cytochrome P450
  misc_feature (387)..(387): Xaa can be any naturally occurring amino acid
SLLTNNNVIDVIVLLATIVLLGIAYVRYCYGYWKRKGVVQLRPQFPLGNYGNNLPRGISIGAVTKKFYDEFRRKGLKFGGVYLGLDPYLVIVDPIYAKDILTKDFQYFTDRALYFSKKSPITVHILSQEGTEWREARAKFTNIFTSAKMRFFFETLKKCSEDLQSTLKEYVDQDKDVDIFETVACYTTDIIGDVVYGIQAQSFSKEGAIFRQMGRELFNVFSKFFQFKILMTICYPKIAKMLGIVNIQGHIGEFFMKFLKEAMDVRVANKATRSDFLQLLIEMKNSGVDLTDDEMASQAFLFFTAGFETSSMSSSLTLFELSQHQDVQDKIREEINAVLKKHDDKISYDVLKEMKLLDQAFNETARKYPVLSTITRVCTKDYKLEDXRFVIKKGTPVLLPL

SEQ ID NO: 21654 - protein, 213 aa, Diabrotica virgifera
  misc_feature: Coding regions on vcDNA: vcDNA=SeqID_1351; Strand=+; Position=75-716
  misc_feature: Homolog annotation: Hit_ID=AAF65467.1; Match level="QueryCoverage =98%, HitCoverage=98%, E-value=7e-68, Identity=60%"; Hit description =death-associated small cytoplasmic leucine-rich protein SCLP [Manduca sexta]
  misc_feature: Gene Ontology Annotation: Molecular function=receptor signaling protein activity; Cellular component=axon; Biological process =morphogenesis of embryonic epithelium
  misc_feature: Pfam annotation: Pfam_ID=LRR_1; Match level="Score=49.3, E-value=1.1e- 11, Copies=5"; Pfam description=Leucine Rich Repeat
MRPPTQYPQDIAQESEAESEPDPRMGAMMICTRLAGRAVIRVIGRCNDAKENENLDLSDCQLMQVPDAVYHLMRHTELKTCDLSDNVITKIPPKFAAKFNQITELNLSHNQVSKLPDECVSLGALERLDISHNTFIELPDCIFKIPKLRHLNASNNSIVDLDVDCLKDAPSLESVDLTNNPLAPRIYEQLSRLSDLRILLTPREKEDWEDLTI

SEQ ID NO: 21655 - protein, 213 aa, Diabrotica virgifera
  misc_feature: Coding regions on vcDNA: vcDNA=SeqID_1352; Strand=+; Position=201-842
  misc_feature: Homolog annotation: Hit_ID=XP_316297.1; Match level="QueryCoverage =100%, HitCoverage=82%, E-value=2e-56, Identity=55%"; Hit description= ENSANGP00000020614 [Anopheles gambiae]
  misc_feature: Gene Ontology Annotation: Molecular function=molecular_function unknown; Cellular component=endosome; Biological process=locomotion
  misc_feature: Pfam annotation: Pfam_ID=SNF7; Match level="Score=158.0, E-value=2e -44, Copies=1"; Pfam description=SNF7
MGIFFSKKKPPSRVTEHDKAVLQLKQQRDKLRQYQKRIELSLGKDKDIAKKLLNNGQRDRAKLLLKKKRYQEQLLSKLDVQLDNLDKMASDIEFAQLETQVVSGLKAGNEALKQINDSLKIEDIERILDETREGIDKQNEINELLSGQLTDEDEAAVEEELAGMIEQEMPSVPSEEPKVEVNEEESEDEEEVADKEKPKQKEKRKEERVAVMA

SEQ ID NO: 21656 - protein, 88 aa, Diabrotica virgifera
  misc_feature: Coding regions on vcDNA: vcDNA=SeqID_1353; Strand=-; Position=97-363
ESWFFNIFITDKMGVGTLNSSSLFFKNAVQVRYNFPNSFGRYFGKKHLIVNRMKYEDRHERQPNESQMKDRQMIAMKKIQKSYRGILK

SEQ ID NO: 21657 - protein, 199 aa, Diabrotica virgifera
  misc_feature: Coding regions on vcDNA: vcDNA=SeqID_1354; Strand=+; Position=18-617
  misc_feature: Homolog annotation: Hit_ID=XP_397538.1; Match level="QueryCoverage =44%, HitCoverage=65%, E-value=5e-11, Identity=48%"; Hit description =hypothetical protein XP_397538 [Apis mellifera]
MNALTTFIAICCLSVTAKARPGIGSTKLEGIPDLQTFGGISYPKYDILHLGEYSKGFVPGDTIHESKHETITVPKPYPVKIPVPHPYPVHISKPYPVVETKYVKVPYAVPHEIVKHVPVPVEVPKPYPVSVHEHGDSHGAGSSPVYGVQNGGEHYGTSEQVSNYETQEPNIEEGGLSGHQENSLTDGNPGWVPVEHHEE

SEQ ID NO: 21658 - protein, 267 aa, Diabrotica virgifera
  misc_feature: Coding regions on vcDNA: vcDNA=SeqID_1355; Strand=+; Position=74-877
  misc_feature: Homolog annotation: Hit_ID=XP_312380.1; Match level="QueryCoverage =93%, HitCoverage=75%, E-value=2e-37, Identity=34%"; Hit description =ENSANGP00000012173 [Anopheles gambiae]
  misc_feature: Gene Ontology Annotation: Molecular function=tocopherol binding; Cellular component=cytosol; Biological process=transport
  misc_feature: Pfam annotation: Pfam_ID=CRAL_TRIO; Match level="Score=-11.8, E-value= 0.00032, Copies=1"; Pfam description=CRAL/TRIO domain
MLTTSDLLLTDRRKIREEWKKSDFQIGADIDIIKRWCKTQKHLPELPCDNTIEYFLTNCKFSIEKTKQNLDMYYSIPNLLPEMYEKKHPCLDKMKNVEKVAYMIPMPRLTENLHRITVVKFRDSDPDLFVPVDYSAFLFRNIFEIKNREDLTMGEIIIIDYKYFKFGHVIKISPLFAKNCAFILEKVWSNRLRELHFINAPVFIDKIMALLKAFFSKKLQERVHIHSDLEDLFKLVPRELLPSDYGGNEPSLDEFQRVWSQKFEDNK

SEQ ID NO: 21659 - protein, 301 aa, Diabrotica virgifera
  misc_feature: Coding regions on vcDNA: vcDNA=SeqID_1356; Strand=+; Position=40-945
  misc_feature: Homolog annotation: Hit_ID=XP_391912.1; Match level="QueryCoverage =91%, HitCoverage=75%, E-value=2e-53, Identity=36%"; Hit description =similar to CG10026-PA [Apis mellifera]
  misc_feature: Gene Ontology Annotation: Molecular function=binding; Cellular component=soluble fraction; Biological process=vitamin A metabolism
  misc_feature: Pfam annotation: Pfam_ID=CRAL_TRIO; Match level="Score=62.8, E-value =9.6e-16, Copies=1"; Pfam description=CRAL/TRIO domain
  misc_feature (292)..(292): Xaa can be any naturally occurring amino acid
MSHPSLESPQKKETTFKGTFDLEEPSQELLQWAKENINEDPDTRDLLISELKDMIYERGECTPTRTDDEFLLRFLRARHFILKKAHRLYVNYHNFIQEAPEYFKNVNLQKLTEIKKTKMFNCPLSRDQSGRRMLIYNIGEWVPSDFSPTELIQFVIFLIQISMLEQKTQINGVVALFDLSGLSLEMVWYMSPTLAKHMVNIAMTSMPCRVEGVHFLYSSWMFDTAFSMVKGLVSPTVTDRIYFHSDLETLYSHIDPKYLPNSLGGAQEDYSLESLVHDILETHGETVKTELXKLGYPGGVL

SEQ ID NO: 21660 - protein, 252 aa, Diabrotica virgifera
  misc_feature: Coding regions on vcDNA: vcDNA=SeqID_1357; Strand=+; Position=2-760
SCRHERHEPERHRTKMAKIVLFFCAIILASAAALPTQSADGGVVDIIKKVVHKLEDIMEKVFTEGPNFIDTFPDKYDDRLTKVLDVTRAVLTKIAQALKVVIDKVAEQSNDAGKKLVSCVEQHEADLVNIRVALVEGAGKCVKDSVVALVNTGAPLLKDLTEIHKQARDAAEEIDNCEGDNAAGLLCVFQVAMDILKVDLQIPDAVKGDIQPVIDAGKALHTAGKKCIHDQVPAFYANTGKLLGEIATCAAA

SEQ ID NO: 21661 - protein, 240 aa, Diabrotica virgifera
  misc_feature: Coding regions on vcDNA: vcDNA=SeqID_1358; Strand=+; Position=136-858
  misc_feature: Homolog annotation: Hit_ID=XP_321943.1; Match level="QueryCoverage =74%, HitCoverage=65%, E-value=1e-55, Identity=55%"; Hit description =ENSANGP00000013948 [Anopheles gambiae]
  misc_feature: Gene Ontology Annotation: Molecular function=peptidoglycan recognition activity; Biological process=anti-Gram-positive bacterial polypeptide induction
  misc_feature: Pfam annotation: Pfam_ID=Amidase_2; Match level="Score=191.8, E-value= 1.4e-54, Copies=1"; Pfam description=N-acetylmuramoyl-L-alanine amidase
MSRLNIFSFLKMLQALCCVLGVTSASSDPVIVSREEWGARAPKNIENMANPVPYVVIHHSYLPPACYNLTDCFKAMRWMQDLHQDTNGWADIGYNFGVGGDGRAYEGRGWSRVGAHAPYYNSKSIGICIIGDWTVELPPENQLATVHELIQKGVREGYIQKDYKLVGHRQVRQGTECPGDRLFKEIHKWQNFCEQPDEIAVRTNNTWFLKKTVHDNSRDKEDKDEDNNDNGINRLEKRTV

SEQ ID NO: 21662 - protein, 425 aa, Diabrotica virgifera
  misc_feature: Coding regions on vcDNA: vcDNA=SeqID_1359; Strand=+; Position=175-1453
  misc_feature: Homolog annotation: Hit_ID=XP_317666.1; Match level="QueryCoverage =92%, HitCoverage=79%, E-value=1e-153, Identity=68%"; Hit description= ENSANGP00000018515 [Anopheles gambiae]
  misc_feature: Gene Ontology Annotation: Molecular function=ATPase activity; Cellular component=plasma membrane; Biological process=protein kinase C activation
  misc_feature: Pfam annotation: Pfam_ID=Arfaptin; Match level="Score=331.2, E-value =1.5e-96, Copies=1"; Pfam description=Arfaptin-like domain
  misc_feature (220)..(220): Xaa can be any naturally occurring amino acid
MYQYFYTEMYPTAYYYPTFYHEDRMGMTVTSGSVTIRKDDNNLIGISIGGGSPLCPCLYIVQIFDNTAAAKDGTLQSGDELVSVNGQSVKGKTKVEVAKMIQAAKDEVIINYNKLHADPGQGKSLDIIMKKMKHRLVENMSSSTADALGLSRAILCNDTLVKKMQELQDTEVMYRGLVDHCKRMLQAHMELQQAVKAMGDIFSGIAVREPQPRASEAFRXFGEQHRSIEKMGLEMVKKVKPVLSDVGTYLYKAIPDTRLTVKKYADTKFEYLAYCLKVKEMDDEECSYAALQEPLYRVETGNYEYRLILRCRQLARSRFAKLRADVLVKMELLDNKHVQSLGGHLVKVIKGLTELHTRTVELLNGPALFPVEVDLTTNAFQYKSTTPVAQYNDDDKEVEEGEEILDIERDDFIANFSVPSASNET

SEQ ID NO: 21663 - protein, 59 aa, Diabrotica virgifera
  misc_feature: Coding regions on vcDNA: vcDNA=SeqID_1360; Strand=+; Position=618-797
RLYFKCTHFFRILRKLISIFEKFKRRIKDYFITEGRKSLRMNKKFFNDIFETKNHTKFS

SEQ ID NO: 21664 - protein, 457 aa, Diabrotica virgifera
  misc_feature: Coding regions on vcDNA: vcDNA=SeqID_1361; Strand=+; Position=3-1374
  misc_feature: Homolog annotation: Hit_ID=AAH75251.1; Match level="QueryCoverage =99%, HitCoverage=37%, E-value=0.0, Identity=74%"; Hit description =Copa-prov protein [Xenopus laevis]
  misc_feature: Gene Ontology Annotation: Molecular function=transporter activity; Cellular component=secretory vesicle; Biological process=ER to Golgi transport
  misc_feature: Pfam annotation: Pfam_ID=Coatomer_WDAD; Match level="Score=677.6, E -value=7.9e-201, Copies=1"; Pfam description=Coatomer WD associated region
  misc_feature (255)..(255): Xaa can be any naturally occurring amino acid
IMASHPNLNLFAAGHDGGMVIFKLERERPAYTVHGNLLYYVKERYLRKLDFTTSKDVPVIQIRGGGKIPVYKMSFNPAENAVLLSTRTSNLDNSTYDLYVIPKEQERDDQVPEAESKRSSGLTALWVARNRFAVLDRTHQLIIKNLKNEVTKKVQTPTCDEVFYAGTGMLLLRDSEHVTLFDVQQKRTLAQVKINKCRYVVWSSDMSHLALLSKHNVTICNRKLDVLCCLHENTRVKSGAWDDTGVFIYTTSNHXKYTLKNGDQGIIITLDLPIYITRVRGNQIFCLDRECKPRVLTVDSMEYKFKLALINHKYEEVLYMVRNSKLVGQSMISYLQQKGYPEVALHFVKDDKTRFTLALECENIEIALDAAKSLNDKACWDQLAHAALWQGNHQVCEMCYQRTKSFEKLSFLYLITGNLDKLRRMMKIADITKAISSQYHAALLLADTEERVKLLKA

SEQ ID NO: 21665 - protein, 273 aa, Diabrotica virgifera
  misc_feature: Coding regions on vcDNA: vcDNA=SeqID_1362; Strand=+; Position=70-887
  misc_feature: Homolog annotation: Hit_ID=AAC50931.1; Match level="QueryCoverage =100%, HitCoverage=47%, E-value=2e-82, Identity=58%"; Hit description= vacuolar protein sorting homolog h-vps45 pir||JC5722 vacuolar protein sorting protein 45 - human
  misc_feature: Gene Ontology Annotation: Molecular function=chaperone activity; Cellular component=cytoplasmic vesicle; Biological process =intracellular protein transport
  misc_feature: Pfam annotation: Pfam_ID=Sec1; Match level="Score=-167.1, E-value =5.4e-05, Copies=1"; Pfam description=Sec1 family
  misc_feature (230)..(230): Xaa can be any naturally occurring amino acid
  misc_feature (246)..(246): Xaa can be any naturally occurring amino acid
MNVISAIKAYIVKMTSESEPGMKVLLMDKDTTSVISMVYGQSEIQQKEVFLLERIDSPSFANSTGLRYLKCLAFLRLTQQNISALCAELRNPKYGAYYVYFSNIIAKADIKILAEHDEHEVVKEVQELYMDYLAVNPHLFSLGLNAALTSLSWNPSALQISVQGIISVLLSLKKCPVIRYQANSNVCKDLGSRIDEVINKESSLFAFNQINSSLLLILDRRDDPITPLLXQWTYQAMVHELLTIYXHRVNLSIVPGRAKELSEVVLSVEQDTF

SEQ ID NO: 21666 - protein, 35 aa, Diabrotica virgifera
  misc_feature: Coding regions on vcDNA: vcDNA=SeqID_1363; Strand=-; Position=93-200
KLFYIFGPFVLKYINKLKIETNLAHTGLNSDHVKF

SEQ ID NO: 21667 - protein, 88 aa, Diabrotica virgifera
  misc_feature: Coding regions on vcDNA: vcDNA=SeqID_1364; Strand=+; Position=554-820
VPLLEISNFSRTTAVYYGFRSLYITTSTLHNPGRMFFDNKIHNPPIDQLLVILILQNFSKQQSPKQNCKYFRSSSDRPAIIVKRYERY

SEQ ID NO: 21668 - protein, 225 aa, Diabrotica virgifera
  misc_feature: Coding regions on vcDNA: vcDNA=SeqID_1365; Strand=+; Position=221-898
  misc_feature: Homolog annotation: Hit_ID=AAP93585.1; Match level="QueryCoverage =74%, HitCoverage=100%, E-value=3e-67, Identity=69%"; Hit description= putative thioredoxin perxidase [Apis mellifera ligustica]
  misc_feature: Gene Ontology Annotation: Molecular function=electron transporter activity; Cellular component=mitochondrion; Biological process =phospholipid metabolism
  misc_feature: Pfam annotation: Pfam_ID=GSHPx; Match level="Score=224.3, E-value =2.4e-64, Copies=1"; Pfam description=Glutathione peroxidase
MFITRPCSTGIGIPGIGVTLLLAPLLVIVAIVKASAKLEEQFCSSDSLDGCSQSTNTMSSPDNYKNANSIYEFTANDIKGEPVSLEKYRGHVCIIVNVASQCGYTKNNYAELVELYDEYAESKGLRILAFPCNQFAGQEPGSNAEICQFMQNKNVKFDMFEKVNVNGNDAHPLWSYLKHKQGGVLGDFIKWNFTKFIIDKNGQPVERHGPNTNPKDMVKYLEKYW

SEQ ID NO: 21669 - protein, 89 aa, Diabrotica virgifera
  misc_feature: Coding regions on vcDNA: vcDNA=SeqID_1366; Strand=+; Position=3-272
FASGGFLFGIICPSFLGNWSWMTVKKMLPSEDILHGPIKSIECVKAFLQWIVTFFLLVSSAMVTHKIFSLYIVRPLVFLRYAVNDCRNP

SEQ ID NO: 21670 - protein, 386 aa, Diabrotica virgifera
  misc_feature: Coding regions on vcDNA: vcDNA=SeqID_1367; Strand=+; Position=143-1303
  misc_feature: Homolog annotation: Hit_ID=XP_319655.1; Match level="QueryCoverage =97%, HitCoverage=97%, E-value=1e-169, Identity=71%"; Hit description= ENSANGP00000013885 [Anopheles gambiae]
  misc_feature: Gene Ontology Annotation: Molecular function=actin binding; Cellular component=Arp2/3 protein complex; Biological process=actin cytoskeleton organization and biogenesis
  misc_feature: Pfam annotation: Pfam_ID=WD40; Match level="Score=104.5, E-value=2.7e- 28, Copies=5"; Pfam description=WD domain, G-beta repeat
PESTNNLYNFTMTEQHRFGNIIQPITCHAWNKNRTQISLSPNNHEVHIYQRSAAEWKLLDTLNQHDLRVMGIDWAPNTNRIVTCAADRNAYVWTQDKDNKWKPTLVLLRINRAATCVKWSPDENKFAVGSGARLISVCYFESENDWWVSKHIKKPIRSTVTCLDWHPNNVLLAAGSSDFKVRVFSAYIKDIEKTPEPTAWGSKMPLGQLMAEFVNSNVGGGWVHSLSFSPDGNKICWVSHDSSINVADASKGNAVHKLRTEFLPFLSCTWIGNKSVVAAGHSCIPIVYGLKDNGQLAFTAKLDASQKKESGGLSAMRMFHSLDKQARSETSDTNLDSIHQNAITCVCIYTGKKEKALKISTSGADGQLVIWDLNSLERSIQNLRIE

SEQ ID NO: 21671 - protein, 251 aa, Diabrotica virgifera
  misc_feature: Coding regions on vcDNA: vcDNA=SeqID_1368; Strand=+; Position=263-1011
  misc_feature: Homolog annotation: Hit_ID=XP_395160.1; Match level="QueryCoverage =100%, HitCoverage=80%, E-value=1e-107, Identity=71%"; Hit description=similar to ENSANGP00000016884 [Apis mellifera]
  misc_feature: Gene Ontology Annotation: Molecular function=G-protein coupled photoreceptor activity; Cellular component=cellular_component unknown; Biological process=fatty acid biosynthesis
  misc_feature: Pfam annotation: Pfam_ID=ELO; Match level="Score=-79.4, E-value=5.9e -07, Copies=1"; Pfam description=GNS1/SUR4 family
  misc_feature (200)..(200): Xaa can be any naturally occurring amino acid
  misc_feature (209)..(209): Xaa can be any naturally occurring amino acid
  misc_feature (226)..(226): Xaa can be any naturally occurring amino acid
  misc_feature (235)..(235): Xaa can be any naturally occurring amino acid
  misc_feature (239)..(239): Xaa can be any naturally occurring amino acid
MATVISSNQSMVSQAYDYYVWTLSLSDSRTKGWLLVDSPVPTLLFICLYFFIVWIGPKMMENRRPYKLSWLLVPYNLYMAGLNFYIASRLFTASFRLKYNYFCEPCRQKYTADEMQIADAVWWYYFSKLLEFCDTLFFILRKKNNQLSFLHVYHHSTMFAFWWIGIKWVPSGSTFLPAMVNSGIHVLMYAYYGLSVFGPXVAQYLWWKXYLTILQLIQFTCALILXANGIRMGCXFPLXWMHYTLIGYMIS

SEQ ID NO: 21672 - protein, 261 aa, Diabrotica virgifera
  misc_feature: Coding regions on vcDNA: vcDNA=SeqID_1369; Strand=+; Position=190-1041
  misc_feature: Homolog annotation: Hit_ID=AAT74547.1; Match level="QueryCoverage =89%, HitCoverage=57%, E-value=4e-09, Identity=27%"; Hit description =omega gliadin [Aegilops tauschii]
MVQYFLLLLATACLTSAYPKENPAEINNQQYQQRPVFVLLDQTLQDQLYAQQIQNEVRVKAPLQEIQQPRIQELQQPRIQEQPQLEQQQIYTPGGFQYGDPQLQYPGYNQQAFPRIQPSILLYGAGGQGQPILINPGNPPGNFLVPQQPGVVYRNNPQNPIPTNPANIPPFQAKPSESKPEKLETFTEDNFVPFPKPAGGTDASGEAERRQPPQQFPNNNNLKPGQRFFILYGQPLYQNYPLNYPEIPNFGFQQIEQPFQQ

SEQ ID NO: 21673 - protein, 401 aa, Diabrotica virgifera
  misc_feature: Coding regions on vcDNA: vcDNA=SeqID_1370; Strand=+; Position=13-1215
  misc_feature: Homolog annotation: Hit_ID=EAL31574.1; Match level="QueryCoverage =98%, HitCoverage=40%, E-value=1e-156, Identity=65%"; Hit description= GA17701-PA [Drosophila pseudoobscura]
  misc_feature: Gene Ontology Annotation: Molecular function=carbohydrate binding; Cellular component=integral to endoplasmic reticulum membrane; Biological process=ER-associated protein catabolism
  misc_feature: Pfam annotation: Pfam_ID=Glyco_hydro_47; Match level="Score=415.3, E -value=7.1e-122, Copies=1"; Pfam description=Glycosyl hydrolase family 47
MLRCKIISSVILFLIIIQHSVAIRTYTKDDILKLREEVKEMFYHAYNSYLKFAYPYDELRPISCDGVDTYGSYSLTLIDALDTLAIMGNYSEFQRVVDILSEKKDFDANINVSVFETNIRIIGGLLSAHLLSHKAGAKLEPGWPCNGPLLRLAEDVAKRLIVAFDTKTGMPYGTVNLHSGVPKGETTVTCTAGVGTFIVEFGTLSRLTGDPLYEEVALNALYSLFNHKSHLGLFGNHVDTDTGRWTAQDAGIGSGVDSYFEYLVKGSILLQRPELMEMFYEAKKSIDKYMKKDDWYMWVSMTKGQVTLPVFQSLESYWPGVLSLIGETSSAMKTLHNYHQVWQQYGFTPEFYYIPQNEAGSNKESYPLRPELIESIMYLYRASGDPFLLQAGEDILRSIQH

SEQ ID NO: 21674 - protein, 230 aa, Diabrotica virgifera
  misc_feature: Coding regions on vcDNA: vcDNA=SeqID_1371; Strand=+; Position=18-710
  misc_feature: Homolog annotation: Hit_ID=NP_649677.1; Match level="QueryCoverage =93%, HitCoverage=97%, E-value=2e-24, Identity=36%"; Hit description =CG2342-PA [Drosophila melanogaster] gb|AAF54096.1| CG2342-PA [Drosophila melanogaster]
  misc_feature: Gene Ontology Annotation: Molecular function=structural constituent of eye lens
  misc_feature: Pfam annotation: Pfam_ID=Chitin_bind_4; Match level="Score=96.3, E -value=7.7e-26, Copies=1"; Pfam description=Insect cuticle protein
MFTKIIISIASLCLVQAAVQPVVQRTPPVVAAVPAENPEYSFAYDVQDTLTGDSKRQTENRNGDVVTGEYSLNDPDGTRRIVQYRADPINGFVAVVRKEPLLAPLVQPAVGVVQQPSVDSVAIEAADLEPIVAAEPQRYVARQRQVRPNNEDFESRREPLDPKRAQPKNTKPAKLELADEQPQSFPVAPAAPVPVAQFAPNVFSAPYVSAPVVSFPRYSAPFTYSTVTVF

SEQ ID NO: 21675 - protein, 129 aa, Diabrotica virgifera
  misc_feature: Coding regions on vcDNA: vcDNA=SeqID_1372; Strand=-; Position=381-770
NMYRMLAVKLSIKVRCIVIYYTECKKKTCHKLHHIFWDQKEFDERKLPYSNVARARTPPSLSQMYLLKFPYVFVKRRARIFRVTADSDVDKISTNKEPEELCNSDLSQNKTSLLYFVGHSKQKMFLQAL

SEQ ID NO: 21676 - protein, 178 aa, Diabrotica virgifera
  misc_feature: Coding regions on vcDNA: vcDNA=SeqID_1373; Strand=+; Position=94-630
  misc_feature: Homolog annotation: Hit_ID=XP_319028.1; Match level="QueryCoverage =100%, HitCoverage=94%, E-value=4e-77, Identity=70%"; Hit description= ENSANGP00000013345 [Anopheles gambiae]
  misc_feature: Gene Ontology Annotation: Molecular function=structural constituent of ribosome; Cellular component=mitochondrial large ribosomal subunit; Biological process=protein biosynthesis
  misc_feature: Pfam annotation: Pfam_ID=Ribosomal_L13; Match level="Score=20.1, E -value=3.8e-08, Copies=1"; Pfam description=Ribosomal protein L13
MSALKRVQQWATFARIWHIYDAAWQNPFHSAELLRKYLMGIHKPIYHPMNDCGDHVIVINSADIALPGDEWKKRVYFHHTGYPGGASWTLAWELHKKDPTLVLKKAVYNSMDGNLQRRYTMERLHLFPNADVPTNLLANVSNQIKQLRPKPKRLDTYPDEEVKQFPKIIDLPKDYILR

SEQ ID NO: 21677 - protein, 269 aa, Diabrotica virgifera
  misc_feature: Coding regions on vcDNA: vcDNA=SeqID_1374; Strand=+; Position=211-1020
  misc_feature: Homolog annotation: Hit_ID=NP_599132.2; Match level="QueryCoverage =87%, HitCoverage=53%, E-value=7e-67, Identity=58%"; Hit description =CG4214-PA, isoform A [Drosophila melanogaster] ref|NP_523582.4| CG4214-PB, isoform B [Drosophila
  misc_feature: Gene Ontology Annotation: Molecular function=t-SNARE activity; Cellular component=integral to membrane; Biological process=synaptic vesicle docking
  misc_feature: Pfam annotation: Pfam_ID=Syntaxin; Match level="Score=60.3, E-value =5.6e-15, Copies=1"; Pfam description=Syntaxin
  misc_feature (238)..(238): Xaa can be any naturally occurring amino acid
  misc_feature (242)..(242): Xaa can be any naturally occurring amino acid
MLPRRRRAGSETEPQVIVGNDNYWTNPQPKTNQSHTVYPNNVTSDYYLEEDYIEDYTEPELVMTARDRTSEFVNTIQTLQGRNIARAVAARDPKKSRVIQSHSEFMLIAKNVGRHIASTYAKLEKLTLLAKRKSLFDDKTSEIQELTYIIKGDLSNLNQQIAQLQDVSRKQKQGSSGKHLQSHTSSIVLALQKLASMSTDFKQVLEVRTENLRHQKNRRDQFSQGGLPPPTVASSSAXGSLXVSETDQVSINMESAALIPKGRPKSKPL

SEQ ID NO: 21678 - protein, 91 aa, Diabrotica virgifera
  misc_feature: Coding regions on vcDNA: vcDNA=SeqID_1375; Strand=+; Position=61-336
  misc_feature: Homolog annotation: Hit_ID=XP_314269.1; Match level="QueryCoverage =94%, HitCoverage=65%, E-value=5e-24, Identity=56%"; Hit description =ENSANGP00000018740 [Anopheles gambiae]
  misc_feature: Gene Ontology Annotation: Biological process=growth
  misc_feature: Pfam annotation: Pfam_ID=L51_S25_CI-B8; Match level="Score=86.4, E -value=7.3e-23, Copies=1"; Pfam description=Mitochondrial ribosomal protein L51 /
MAVRFGSALKELRIHLCQTGAASKGVREFMEKHYVQVKSSNPKFPILVRECSGVEPRLWARYDLGKEKCISLKDLSPENVLNRVQAVPKGP

SEQ ID NO: 21679 - protein, 273 aa, Diabrotica virgifera
  misc_feature: Coding regions on vcDNA: vcDNA=SeqID_1376; Strand=+; Position=75-893
  misc_feature: Homolog annotation: Hit_ID=NP_998242.1; Match level="QueryCoverage =90%, HitCoverage=35%, E-value=6e-24, Identity=27%"; Hit description =ubiquitin-like, containing PHD and RING finger domains, 1 [Danio rerio] gb|AAH58055.1|
  misc_feature: Pfam annotation: Pfam_ID=ubiquitin; Match level="Score=45.7, E-value =1.3e-10, Copies=1"; Pfam description=Ubiquitin family
MHIKIRKDGDANQEWVISVSKVDKVSVIEKLVAEKTGVKPKQQTLLFQGKTLESKVCILDYQIQNNNVVQLFVRDINNSESKEITNGISTEDPDKKLIEAESRYYAVGDFIDVLLEDDGTWYEAFILKIYFKKESSEILTQEDENKLIFRIKSADHIIPGFETDAGFNDIRPRSYFIYEPEDLTPEMIVLANYNLEEKTTRGHWYDFKVQEASKLNVSGTALVGKDKTPVEDCNLIFVDRIMRIEQPVLLTEVSAEEKLSRYSKKTRDLPFHC

SEQ ID NO: 21680 - protein, 192 aa, Diabrotica virgifera
  misc_feature: Coding regions on vcDNA: vcDNA=SeqID_1377; Strand=+; Position=269-847
  misc_feature: Homolog annotation: Hit_ID=NP_788369.1; Match level="QueryCoverage =92%, HitCoverage=87%, E-value=4e-35, Identity=42%"; Hit description =CG33038-PB, isoform B [Drosophila melanogaster] gb|AAF58056.2| CG33038-PB, isoform B [Drosophila
  misc_feature: Gene Ontology Annotation: Molecular function=hydrogen ion transporter activity; Biological process=proton transport
MLSFYRFLKCLPSKTSHQNRTLFYWINLQFNSLDIERKKKLGPDRTCAEWILRNGGSVKFVSFKDYLSDYNELPLEGTLLRIKEVDASNTSIMHSGFEHFNGCEHIDLLKLHKCAYVDDKALEQLHYLKDSLCKLQVTCCPNVTDKGILSLGVLKKLAKLNICDLTSVKSLEDTVQKLETSLPHCEISWVTG

SEQ ID NO: 21681 - protein, 140 aa, Diabrotica virgifera
  misc_feature: Coding regions on vcDNA: vcDNA=SeqID_1378; Strand=+; Position=5-427
  misc_feature: Homolog annotation: Hit_ID=AAV34834.1; Match level="QueryCoverage =100%, HitCoverage=100%, E-value=1e-71, Identity=97%"; Hit description=ribosomal protein L23 [Bombyx mori] gb|AAK83857.1| ribosomal protein L17/23 [Spodoptera frugiperda] dbj|
  misc_feature: Gene Ontology Annotation: Cellular component=cytosolic ribosome (sensu Eukarya); Biological process=protein biosynthesis
  misc_feature: Pfam annotation: Pfam_ID=Ribosomal_L14; Match level="Score=207.0, E -value=3.8e-59, Copies=1"; Pfam description=Ribosomal protein L14p/L23e
MSKRGRGGSAGAKFRISLALPVGAVINCADNTGAKNLYVIAVQGIGGRLNRLPAAGSGDMIVATVKKGKPELRKKVMPAVVIRQRKPFRRKDGVFIYFEDNAGVIVNNKGEMKGSAITGPVAKECADLWPTIASNASSIA

SEQ ID NO: 21682 - protein, 509 aa, Diabrotica virgifera
  misc_feature: Coding regions on vcDNA: vcDNA=SeqID_1379; Strand=+; Position=5-1534
  misc_feature: Homolog annotation: Hit_ID=AAG26008.1; Match level="QueryCoverage =94%, HitCoverage=96%, E-value=1e-145, Identity=51%"; Hit description= beta-glucosidase precursor [Tenebrio molitor]
  misc_feature: Gene Ontology Annotation: Cellular component=endoplasmic reticulum; Biological process=aging
  misc_feature: Pfam annotation: Pfam_ID=Glyco_hydro_1; Match level="Score=696.3, E -value=1.9e-206, Copies=1"; Pfam description=Glycosyl hydrolase family 1
FPRGTPQRPGLVLDFRHRVWVLCVLVISATCGEELNNKTFPGYFIFGTATASYQVEGAWNEDGKGQNIWDNFTHEDPSRIFGNANGDVACDSYHKYKEDVALLKDLGVDHYRFSISWSRVLPTGYSNEVNEAGVNYYKNLIKELNDNDIFPLVTMFHWDTPQPLEDIGGWTNDTIIDRFVDYAQFLFETFGDDVQMWLTFNEPKQTCNGGYGNGILAPGIQSPGVGEYLCTHNVIKAHAAVWHLYDEKYRRRQNGHLGITLDCFFGEPDSDSQEDKDAAERMLQFNYGWYANAIVNGNYPKVMRNVIARRSAAQGLSKSRLPDFTSKEIQFIKGSFDFLGLNYYTVNMVKARGSEVPVVSSWEKDMEVDIYLKEEWPKSSSSWLRIVPWGMRKMLNWMKKTYGDDTEIFITENGVSDDGSSLDDQIRIDYYQQHISGVRDALDDGVNVIGYTAWSLMDNFEWIRGYSECFGLYQVNFTDADRPRTPKRSVEFLKKVMTTRCVTDVCEDY

SEQ ID NO: 21683 - protein, 310 aa, Diabrotica virgifera
  misc_feature: Coding regions on vcDNA: vcDNA=SeqID_1380; Strand=+; Position=2-931
  misc_feature: Homolog annotation: Hit_ID=EAL30415.1; Match level="QueryCoverage =93%, HitCoverage=65%, E-value=5e-30, Identity=31%"; Hit description =GA17708-PA [Drosophila pseudoobscura]
  misc_feature: Pfam annotation: Pfam_ID=Endonuclease_NS; Match level="Score=64.6, E -value=2.7e-16, Copies=1"; Pfam description=DNA/RNA non-specific endonuclease
  misc_feature (285)..(285): Xaa can be any naturally occurring amino acid
  misc_feature (298)..(298): Xaa can be any naturally occurring amino acid
  misc_feature (303)..(303): Xaa can be any naturally occurring amino acid
NSVIIILVGYLLSVGTCATTGCEINPFGSKTPLVVKYGTSSLIEPTPGYTTLSFTRNAAVEFACPGTQIIKNGTSLGDIVTATCKTGDVFNINGHAVHWSYLSCNNVINPTVREITRATDTNDPNNKCVDNVKKLQIIQIGFALSSDRFNEAMTVCFDSTTKLAIYTYFVLSKSINYRARNVANPSFSQDDIFYRMGRSVNAMYQSIQTTYNTLVGLEATSTQYVNTSIFPNRGHLAAKADFVYEPHQRASYRYVNAAPQWNTFNGGNWEPVETDVRNMPQQKRXLKSWTGVYGIPAXPLSTXELVDLYI

SEQ ID NO: 21684 - protein, 279 aa, Diabrotica virgifera
  misc_feature: Coding regions on vcDNA: vcDNA=SeqID_1381; Strand=+; Position=117-956
  misc_feature: Homolog annotation: Hit_ID=NP_009197.1; Match level="QueryCoverage =99%, HitCoverage=76%, E-value=9e-95, Identity=61%"; Hit description =XPA binding protein 1 [Homo sapiens] gb|AAH07451.1| XPA binding protein 1 [Homo sapiens]
  misc_feature: Gene Ontology Annotation: Molecular function=molecular_function unknown; Cellular component=cellular_component unknown; Biological process=biological_process unknown
  misc_feature: Pfam annotation: Pfam_ID=ATP_bind_1; Match level="Score=335.9, E -value=6.1e-98, Copies=1"; Pfam description=Conserved hypothetical ATP binding pr
MASTSTSEVNAGNSNKPVCLIVLGMAGSGKSSLVTRLASSDKKPYAVNLDPACSNLNYFANIDIRDTVNYKEVMKQYNLGPNGAIVTSLNLFSTKIPEVIDFIKKSQNELCILDTPGQIEVFTWSVSGSIITDTLASSFPTVILYVVDCVRSTSPVTFMSNMLYACSILYKTRLPFIIVMNKIDIVDHSYAKDWMTNFEVFQEALESDESYISNLTRSMALALDEFYQNLKVCGVSAATGQGIEDLYKLVDKAAEEYENEYRVEWEKLKAESDAKKAEQ

SEQ ID NO: 21685 - protein, 208 aa, Diabrotica virgifera
  misc_feature: Coding regions on vcDNA: vcDNA=SeqID_1382; Strand=+; Position=34-660
  misc_feature: Homolog annotation: Hit_ID=EAL29833.1; Match level="QueryCoverage =62%, HitCoverage=72%, E-value=6e-38, Identity=58%"; Hit description =GA20083-PA [Drosophila pseudoobscura]
  misc_feature: Gene Ontology Annotation: Molecular function=structural constituent of eye lens
  misc_feature: Pfam annotation: Pfam_ID=Chitin_bind_4; Match level="Score=104.5, E -value=2.7e-28, Copies=1"; Pfam description=Insect cuticle protein
MGFGQKILVPLVLIEMSLLVTSRIIYDHQQEDNHEGQQVQYTNYYGHEESATTAHFQQPVQFPEEHSQGLHKEEHIDYYAPAKYSFKYGVNDYHTGDIKSQHESRDGDTVKGQYTLVEPDGSIRTVDYTADKHSGFNAVVRKSGPTKHIEGRHLEHQPEEEQHIPQHHLAEDHVLPQYQLEHQQALEEDVEEGHLEAEDASQYEEEEH

SEQ ID NO: 21686 - protein, 229 aa, Diabrotica virgifera
  misc_feature: Coding regions on vcDNA: vcDNA=SeqID_1383; Strand=+; Position=143-829
  misc_feature: Homolog annotation: Hit_ID=XP_394010.1; Match level="QueryCoverage =95%, HitCoverage=64%, E-value=3e-33, Identity=41%"; Hit description =similar to ENSANGP00000012504 [Apis mellifera]
  misc_feature: Gene Ontology Annotation: Molecular function=triacylglycerol lipase activity; Cellular component=extracellular; Biological process =triacylglycerol metabolism
  misc_feature: Pfam annotation: Pfam_ID=Lipase; Match level="Score=-82.1, E-value =6.5e-07, Copies=1"; Pfam description=Lipase
MLIQGILNVTLCALYALPGPPQIHFQGDTIQLYSINRILCPEIDPVRDTIFELYTRLNPEVPQILSTGDTESLKKSNINYSRPTVIFFHGFLESSKSDNAVQMRNAYLHIGDYNVILVNNERLLAGLDYLTAALNCEPIGKFSAKFVDFLVGQGLRLSSLHIIGISLGAQIAGMTGKNMKTGKAKRVTGLDPAGPLFQVFPKSLKIGVGDGEFVDILHTNAFYTGELRL

SEQ ID NO: 21687 - protein, 297 aa, Diabrotica virgifera
  misc_feature: Coding regions on vcDNA: vcDNA=SeqID_1384; Strand=+; Position=36-926
  misc_feature: Homolog annotation: Hit_ID=EAL39065.1; Match level="QueryCoverage =92%, HitCoverage=86%, E-value=4e-58, Identity=43%"; Hit description =ENSANGP00000029046 [Anopheles gambiae str. PEST] ref|XP_553121.1| ENSANGP00000029046 [Anopheles gambiae st
  misc_feature: Gene Ontology Annotation: Molecular function=oxidoreductase activity; Cellular component=cellular_component unknown; Biological process =arabinose metabolism
  misc_feature: Pfam annotation: Pfam_ID=Aldo_ket_red; Match level="Score=271.1, E -value=1.8e-78, Copies=1"; Pfam description=Aldo/keto reductase family
  misc_feature (270)..(271): Xaa can be any naturally occurring amino acid
MTYKLKVNFFAALFWAAVFFANNQPSCAVLSKDLKAILPSGDQMPLIGFGTSKILGTELVKNTLDDALAAGYRLFDTAAVYGNEEDIGKALKELLPKHNLTRKDIWITSKLAARAETLGKNAYAALEKSVKTINCDYLDLYLIHFPGIPSPEKKNYSALRDESWQQLVKGVKNGLTRNIGVSNYNVHHLTELVNNDHGVKVAVDQVEWNPRFHQDDLINFCKQNGILLQAYFSIGGTGNTDLINNVEVKKIAEKLGKHPAQVLLRWAVQXXCAVIPKSLSRKTMDSNLDLNFEIPQA

SEQ ID NO: 21688 - protein, 261 aa, Diabrotica virgifera
  misc_feature: Coding regions on vcDNA: vcDNA=SeqID_1385; Strand=+; Position=91-873
  misc_feature: Homolog annotation: Hit_ID=XP_315647.1; Match level="QueryCoverage =99%, HitCoverage=79%, E-value=6e-97, Identity=53%"; Hit description =ENSANGP00000022537 [Anopheles gambiae]
  misc_feature: Gene Ontology Annotation: Molecular function=signal transducer activity; Cellular component=nucleus; Biological process=mRNA splicing
  misc_feature: Pfam annotation: Pfam_ID=WD40; Match level="Score=111.8, E-value=1.7e- 30, Copies=3"; Pfam description=WD domain, G-beta repeat
MTEDVQRHSVHTLVFRSLKRSHDMFLANQGILPSIDDTAEKIRRLVKARDSYGMVFDDVKRMQAMKNLRDAEAGPNPPPPGTAETPDGQPADSAVVPYTDNSLVLKSQQNTNQNQLSNQLKRAPTMPKPKWHAPWKLYRVIAGHLGWVKCVAVEPGNEWFATGAADRIIKIWDLATGQVKVSLTGHVSTVRGLAISPRHPYLFNCGEDRQVKCWDLEYNKVVRHYHGHLSAVYSLSLHPTIDVLLTAGRDSTAREWDMRTK

SEQ ID NO: 21689 - protein, 243 aa, Diabrotica virgifera
  misc_feature: Coding regions on vcDNA: vcDNA=SeqID_1386; Strand=+; Position=193-924
  misc_feature: Homolog annotation: Hit_ID=NP_608889.1; Match level="QueryCoverage =97%, HitCoverage=94%, E-value=7e-74, Identity=57%"; Hit description =CG3792-PA [Drosophila melanogaster] gb|AAF52190.2| CG3792-PA [Drosophila melanogaster]
  misc_feature: Pfam annotation: Pfam_ID=PQ-loop; Match level="Score=86.1, E-value =9.2e-23, Copies=1"; Pfam description=PQ loop repeat
  misc_feature (195)..(195): Xaa can be any naturally occurring amino acid
MNSTLFDVFRTAALLVLTPKCFDNYFLEFNYLDGPCFFATLSKGLGFGIILGSLTVKVPQILKILNNKSGEGINILSVTLDLSAITIYMAYSFVKGFPFSAWGDASFLAIQTVLIGYLVLYYQGAITKAITYLLVYVTVCYVMMFGMTPLEFLWSLQTFNIFLVVVGKLMQAYTNLQNGHTGQLSAATLIMLLAXSLARIFTSMQETGDSVVILTYIASSLSNAVLVVQLLYYWNVDPKKKVE

SEQ ID NO: 21690 - protein, 322 aa, Diabrotica virgifera
  misc_feature: Coding regions on vcDNA: vcDNA=SeqID_1387; Strand=+; Position=79-1048
  misc_feature: Homolog annotation: Hit_ID=AAO66431.1; Match level="QueryCoverage =100%, HitCoverage=100%, E-value=2e-79, Identity=48%"; Hit description=luciferin-regenerating enzyme [Photinus pyralis]
  misc_feature: Gene Ontology Annotation: Cellular component=nucleus
  misc_feature: Pfam annotation: Pfam_ID=SMP-30; Match level="Score=329.7, E-value =4.2e-96, Copies=1"; Pfam description=Senescence marker protein-30 (SMP-30)
  misc_feature (299)..(299): Xaa can be any naturally occurring amino acid
MNPKLERVKEISTTELGEGPHWDAETQSLYLVDIFGQAIHRYVPATRQHTKVVLERSKVPSDAAYKRKNLVSLVLPVKGQKDRFVVGLDRELLAVTWDGVSDKVTNIEKIVEVQTENELVNNRFNDGKCDPSGRIWAGTMGEEPTNGNVAPGRGSLFSIQNGKAVKHLGQLGISNGLAWNEQLKKMYYIDSFKRCIEEYDFDIQNGTISNGKSIFSLEKNNVVGFPDGMTIDVDGNLWVAVFGGYKVIKIDPRKPETLLATIPIPAKEVTSVTFGGPNLDELYVTSANFTIKWGSASSXKHGGTYKVTGLNTKGYAGVAAVL

SEQ ID NO: 21691 - protein, 269 aa, Diabrotica virgifera
  misc_feature: Coding regions on vcDNA: vcDNA=SeqID_1388; Strand=+; Position=57-866
  misc_feature: Homolog annotation: Hit_ID=XP_312904.1; Match level="QueryCoverage =95%, HitCoverage=87%, E-value=1e-104, Identity=67%"; Hit description= ENSANGP00000023016 [Anopheles gambiae]
  misc_feature: Gene Ontology Annotation: Molecular function=molecular_function unknown; Cellular component=cellular_component unknown; Biological process=biological_process unknown
MANLFKFFNKLPPNFRSVSTTTTKNDAWLSKIFVRKIEPTKESHSRMLSDKEIIYSLQTHNYRPDSKVAYLQNVKNKVDYIKAQDSLSKEVELVGSWTVNVGDQDQALHLWKFTGGFDMIDRYNDFTGKNQEFQRLNEEQGKLVRSRHLQYLLAFSYWPQILMRQPKNIYEIRSYALKPGTMIEWGNNWARAINYRQNNDEAFAGFFSQIGRLYNVHHIWCYSSLNGRKETRESAWRSPGWDECVAYTVPLIREMHCRIMVPTEFSPTL

SEQ ID NO: 21692 - protein, 56 aa, Diabrotica virgifera
  misc_feature: Coding regions on vcDNA: vcDNA=SeqID_1389; Strand=+; Position=250-420
RPWELSYKIAVSSAYLSFLIRFYIDFHSKVFILQSLFKNLYPSRYYITAGIECIPV

SEQ ID NO: 21693 - protein, 292 aa, Diabrotica virgifera
  misc_feature: Coding regions on vcDNA: vcDNA=SeqID_1390; Strand=+; Position=1-877
  misc_feature: Homolog annotation: Hit_ID=NP_995991.1; Match level="QueryCoverage =99%, HitCoverage=53%, E-value=5e-91, Identity=52%"; Hit description =CG12006-PB, isoform B [Drosophila melanogaster] gb|AAS64961.1| CG12006-PB, isoform B [Drosophila
  misc_feature: Gene Ontology Annotation: Molecular function=molecular_function unknown; Cellular component=endoplasmic reticulum membrane; Biological process=lipid metabolism
  misc_feature: Pfam annotation: Pfam_ID=Glyco_transf_22; Match level="Score=220.0, E- value=4.6e-63, Copies=1"; Pfam description=Alg9-like mannosyltransferase family
  misc_feature (80)..(80): Xaa can be any naturally occurring amino acid
DEYWQTLEVAHNLVYEYGYLTWEWSKGIRSYIPPLVVSGLYKFLNLLGLDSAELLIYAPRVLQAFLSSYSDLCFYKWSGXKKWAVFAMASSWFWFYTGSRTLINTLECSLTTIALSKFPWPGKGIEESSTFIWITALLFTIRPTSAIVWLPLCLYHLKITKESFLNITFTKYFPIGFIILSLSTLIDSLCHGSLLIPPYGFLKFNLLENLSSFYGEQPWHWYLSSGLPGILGIQVLPFLLATVVVLKNRKVHPNELVMLGTIVFAVAVYSYLPHKEFRFLLPLLPLVFYISS

SEQ ID NO: 21694 - protein, 137 aa, Diabrotica virgifera
  misc_feature: Coding regions on vcDNA: vcDNA=SeqID_1391; Strand=+; Position=3-416
VIGPVRLVLLLQSILAYRYAKREALRGRYESLREPLVAWDNRDARLDKRNADNRAWIYDDERLDKRNADNRAWIYDDERLDKRNADYRGFGYDDELLSEREAFVPKKRVSWNIKKRSMEKSSLVPSGFWVDHDERVA

SEQ ID NO: 21695 - protein, 77 aa, Diabrotica virgifera
  misc_feature: Coding regions on vcDNA: vcDNA=SeqID_1392; Strand=+; Position=499-732
ITNSEQNYAISPCADCRLQILSFSVTYLPFRKACHVTFRWMPLLHKISNYKNKIFYVKRSYINRLLANLVYITYIFH

SEQ ID NO: 21696 - protein, 53 aa, Diabrotica virgifera
  misc_feature: Coding regions on vcDNA: vcDNA=SeqID_1393; Strand=-; Position=347-508
IKIRIKNFHILKYVIIYFYILLFLFFINFLLKYKFKLFKFSNDDNISIKKLYI

SEQ ID NO: 21697 - protein, 63 aa, Diabrotica virgifera
  misc_feature: Coding regions on vcDNA: vcDNA=SeqID_1394; Strand=+; Position=108-299
  misc_feature: Homolog annotation: Hit_ID=NP_732133.1; Match level="QueryCoverage =95%, HitCoverage=100%, E-value=2e-15, Identity=66%"; Hit description= CG17931-PA, isoform A [Drosophila melanogaster] gb|AAF55305.1| CG17931-PA, isoform A [Drosophila
  misc_feature: Pfam annotation: Pfam_ID=4F5; Match level="Score=72.6, E-value=1.1e -18, Copies=1"; Pfam description=4F5 protein family
MTRGNQRELARAKNQKKQQEQAKNKRSDGLTLEQRKFRDAELMREKQKKKQDDESQGSGQACK

SEQ ID NO: 21698 - protein, 231 aa, Diabrotica virgifera
  misc_feature: Coding regions on vcDNA: vcDNA=SeqID_1395; Strand=+; Position=78-773
MLIKSIILLLSVCWCAYSAIASPVSKKEEKRTEANVLYDQRQEGEWNVRAHLDNFLIMIVPTQTVATAASPSLLDFLSKSLPKGSHIKRIKNFKKHPVSELPQESQALETQHFIESKTAPYHVDLTKPSADIKPTPSDDVVLANSPSLKVIKPEGKLKRSTRFARTYIISIPSETEYISRKYAEPKSALRKHKKTIKEKSKAELKLLGSELEQCGPGMVRDSYGVCTTLKH

SEQ ID NO: 21699 - protein, 287 aa, Diabrotica virgifera
  misc_feature: Coding regions on vcDNA: vcDNA=SeqID_1396; Strand=+; Position=257-1115
  misc_feature: Homolog annotation: Hit_ID=XP_313758.1; Match level="QueryCoverage =100%, HitCoverage=81%, E-value=1e-122, Identity=71%"; Hit description=ENSANGP00000017072 [Anopheles gambiae]
  misc_feature: Gene Ontology Annotation: Molecular function=zinc ion transporter activity; Cellular component=cytoplasmic vesicle; Biological process= zinc ion transport
  misc_feature: Pfam annotation: Pfam_ID=Cation_efflux; Match level="Score=126.2, E -value=7.9e-35, Copies=1"; Pfam description=Cation efflux family
  misc_feature (234)..(234): Xaa can be any naturally occurring amino acid
  misc_feature (278)..(278): Xaa can be any naturally occurring amino acid
MLPLSHKDKAYPRGFGSRIKEKVNGWIRLIFSDRNSRNLFLFLILNLSFAFVELIYGVWSNSLGLISDAFHMFFDCTGLLAGLAASVITKWKANDRYSYGYVRAEIIAGFVNGLFLLFISFFLMSEAVERAIEPPEVKHERLFVVSVLGLLVNLVGIYAFQHGHGHSHGGSHGHSHGRSNHGHSHSVNNHHHSHDIEFDSGNSQIMKGVFLHILADTLGSVGVIISAVLMSLFXWMIADPICSMFIAILIALSVLALIKDSVMILMQRQPAALDMSYXACYQKVVSL

SEQ ID NO: 21700 - protein, 141 aa, Diabrotica virgifera
  misc_feature: Coding regions on vcDNA: vcDNA=SeqID_1397; Strand=+; Position=372-794
  misc_feature: Homolog annotation: Hit_ID=EAL24790.1; Match level="QueryCoverage =95%, HitCoverage=12%, E-value=2e-29, Identity=54%"; Hit description =GA20489-PA [Drosophila pseudoobscura]
  misc_feature (46)..(46): Xaa can be any naturally occurring amino acid
NVQIQITSPSRSRSRSPSTSQSRSRSRSKSRSRSRSRSRSARSGSXAKEASGPEDVVEEEEPDGDSLRSYEYDSEEDESDDGGRAQKRKNNKDRYGGFIIDEAEVDDELEDEDECEDGAQYIGIVPIEVDEIAPTAREIEG

SEQ ID NO: 21701 - protein, 125 aa, Diabrotica virgifera
  misc_feature: Coding regions on vcDNA: vcDNA=SeqID_1398; Strand=-; Position=661-1038
  misc_feature: Homolog annotation: Hit_ID=ZP_00357698.1; Match level="QueryCoverage =50%, HitCoverage=33%, E-value=1e-17, Identity=68%"; Hit description =hypothetical protein Chlo02002738 [Chloroflexus aurantiacus]
FSPRGKRGIFSKGINWGTPRVFPSPPFKNTGPGMEFWGPIKKVFPSPPPFLKLGPFKPAPPFFFFPFFFFFFFFFFFFFFFFFFFFFFWFFFFFFFFFFFFFFLTLFLTLLFMEVFNRNVHNNTV

SEQ ID NO: 21702 - protein, 236 aa, Diabrotica virgifera
  misc_feature: Coding regions on vcDNA: vcDNA=SeqID_1399; Strand=+; Position=166-873
  misc_feature: Homolog annotation: Hit_ID=XP_311386.1; Match level="QueryCoverage =93%, HitCoverage=44%, E-value=5e-71, Identity=58%"; Hit description =ENSANGP00000016782 [Anopheles gambiae]
  misc_feature: Gene Ontology Annotation: Molecular function=structural constituent of cytoskeleton; Cellular component=actin filament; Biological process=cytoskeleton organization and biogenesis
  misc_feature (223)..(223): Xaa can be any naturally occurring amino acid
MTLASTPTEVPVELVHSKSIIVIHPGSFNLRIGRASDLNPVTTLHAIARRRLPSGFIYKDSFLSERAETTPVQELEDARLAVSHTLQSCLQSDGRRRYATPPQQIAAFNRRSEPELLNNSGGEWVKPEGDIVIGNDILRLDPRQDFNVHFPYKRGDLNIHSEPGGSLTSVMADLETIWTYILETNFQISQKDLKYHRAVLVIPDVYNRTYLRELMYLLLSRMXFWSCVFLVQDHVA

SEQ ID NO: 21703 - protein, 270 aa, Diabrotica virgifera
  misc_feature: Coding regions on vcDNA: vcDNA=SeqID_1400; Strand=+; Position=105-917
  misc_feature: Homolog annotation: Hit_ID=NP_969717.1; Match level="QueryCoverage =80%, HitCoverage=36%, E-value=1e-22, Identity=34%"; Hit description =hypothetical protein Bd2932 [Bdellovibrio bacteriovorus HD100] emb|CAE80710.1| conserved
  misc_feature: Gene Ontology Annotation: Molecular function=molecular_function unknown; Cellular component=cellular_component unknown; Biological process=DNA repair
MKVYVLFIICAITLLQFAASDRASDMKARIDQLNRQNQQGSYGNQPTTNKYGQNGSYNNGYNNGQRYPNSNQIGQVNRNASRDLYPNLPQNNNGNPNWANPNYNPNGGSYGNNNNNNNNRYPATGYNNGQSNPNDPYNRNNGYNSNQNQPGSQGYNSGSNGYNSGTKYPYNQGQNGANQGYHNSGSPGYPITGSMGYPNTGSQGYPNTGSQGYQNTGSQGYHNTGSPGYSNTEVKVTPSLEAQVTPIQGTIKGIKGILTPTILVIRGARY

SEQ ID NO: 21704 - protein, 117 aa, Diabrotica virgifera
  misc_feature: Coding regions on vcDNA: vcDNA=SeqID_1401; Strand=+; Position=21-374
  misc_feature: Homolog annotation: Hit_ID=CAH04345.1; Match level="QueryCoverage =97%, HitCoverage=98%, E-value=2e-55, Identity=92%"; Hit description =S26e ribosomal protein [Cicindela campestris]
  misc_feature: Gene Ontology Annotation: Molecular function=structural constituent of ribosome; Cellular component=cytosolic ribosome (sensu Eukarya); Biological process=protein biosynthesis
  misc_feature: Pfam annotation: Pfam_ID=Ribosomal_S26e; Match level="Score=279.1, E -value=7.1e-81, Copies=1"; Pfam description=Ribosomal protein S26e
MTCKRRNGGRSKHGRGHVKPVRCTNCARCVPKDKAIKKFVIRNIVEAAAVRDITEASVYQAYVLPKLYAKLHYCVSCAIHSKVVRNRSKKDRRVRTPPQRNFPGRDNARVQQQQPRK

SEQ ID NO: 21705 - protein, 272 aa, Diabrotica virgifera
  misc_feature: Coding regions on vcDNA: vcDNA=SeqID_1402; Strand=+; Position=145-961
  misc_feature: Homolog annotation: Hit_ID=NP_524246.1; Match level="QueryCoverage =99%, HitCoverage=48%, E-value=4e-95, Identity=63%"; Hit description =CG10281-PA [Drosophila melanogaster] gb|AAF54125.1| CG10281-PA [Drosophila melanogaster]
  misc_feature: Gene Ontology Annotation: Molecular function=general RNA polymerase II transcription factor activity; Cellular component=transcription factor TFIIF complex; Biological process=transcription initiation from Pol II promoter
  misc_feature: Pfam annotation: Pfam_ID=TFIIF_alpha; Match level="Score=26.5, E -value=6.1e-09, Copies=1"; Pfam description=Transcription initiation factor IIF,
  misc_feature (247)..(247): Xaa can be any naturally occurring amino acid
MQSAKASTTPGQSPTVNVQEFSIRVPKNVQKRYHVMRFNGTLDVDFEKWTKVSMERENNMKEFKGVDEEVPKFGAGSEFGREAKEEARRKKLGIVARKYKAEDQPWILKSYGSTVKKFKGIREGGVSNNTAYYVFTHAEDGAIEAFPLQEWYKFQPIQRYKALSAEEAEMEFSKRNKHLNYFSLMLRKRLKGEEETELDEGEEKSKKSTSKKEKELKISEMDEWMDSSDDESSAEEEKEDSEEQIKXKAKKVVPKKKQKRDTDAEAFEDSDD

SEQ ID NO: 21706 - protein, 200 aa, Diabrotica virgifera
  misc_feature: Coding regions on vcDNA: vcDNA=SeqID_1403; Strand=+; Position=80-682
  misc_feature: Homolog annotation: Hit_ID=XP_318076.1; Match level="QueryCoverage =99%, HitCoverage=90%, E-value=6e-72, Identity=65%"; Hit description =ENSANGP00000017729 [Anopheles gambiae]
  misc_feature: Gene Ontology Annotation: Molecular function=transporter activity; Cellular component=ER-Golgi transport vesicle membrane; Biological process=ER to Golgi transport
  misc_feature: Pfam annotation: Pfam_ID=EMP24_GP25L; Match level="Score=77.2, E -value=4.3e-20, Copies=1"; Pfam description=emp24/gp25L/p24 family
MYLFGFLISLVCLGINQSLAYFITVDAHAEECFFDKVEAGTKMGLTFEIAEGGFLDIDVRIIDPNGQNLYQGERETAGKYTFAAHTSGIYTYCFSNKMSTMTPKVVMFNMAVGESPKAEQQEGENANKLEEMIRELTNSLSGVKQEQEYMQVRDRIHRSINESTNSRVVMWSFFEAVILVAMTVGQVYYLKRFFEVRRVV

SEQ ID NO: 21707 - protein, 144 aa, Diabrotica virgifera
  misc_feature: Coding regions on vcDNA: vcDNA=SeqID_1404; Strand=+; Position=59-493
  misc_feature: Homolog annotation: Hit_ID=XP_392173.1; Match level="QueryCoverage =95%, HitCoverage=38%, E-value=9e-44, Identity=66%"; Hit description =similar to CG11342-PA [Apis mellifera]
  misc_feature: Pfam annotation: Pfam_ID=Myb_DNA-binding; Match level="Score=20.8, E -value=0.0043, Copies=1"; Pfam description=Myb-like DNA-binding domain
VQPARFGEIFSAAGLAFNILGDLTMQLHPIAESPTGKWTDEEIEMLRQVVKQFSDGLNQISDHIKRRTVSQIRTALKKKAFEDAGLPVRQVNQAVPPVQLQQQPMIKSEVTLNMLNAAESEVDVEGLHEDVKLEFDGGNDEVSS

SEQ ID NO: 21708 - protein, 235 aa, Diabrotica virgifera
  misc_feature: Coding regions on vcDNA: vcDNA=SeqID_1405; Strand=+; Position=34-741
  misc_feature: Homolog annotation: Hit_ID=AAN05630.1; Match level="QueryCoverage =99%, HitCoverage=99%, E-value=4e-63, Identity=47%"; Hit description =diapause-associated transcript-2 [Leptinotarsa decemlineata]
MNKYMILAVLLVGAVLVQGKSVQKEDKKEDSSEENVRELAEILNKKFNTTLLLDMIKMAEQTKAKCPDLEEKLDEVSEKIEKCVDDVELGSETFCSLINKNLVKCTKPAIDLIASCLPEESKDLPVMLEKMLAAVVKQACSSTVEEVLELMNPCALEKDFASYPACKEIKTVIDEHKNKLPSKSLICSTMPKVRNCAKAHIEGNCQNTITRQAALKFHDAIDAALKDDCDALNKA

SEQ ID NO: 21709 - protein, 356 aa, Diabrotica virgifera
  misc_feature: Coding regions on vcDNA: vcDNA=SeqID_1406; Strand=+; Position=3-1074
  misc_feature: Homolog annotation: Hit_ID=XP_312568.1; Match level="QueryCoverage =90%, HitCoverage=70%, E-value=3e-39, Identity=30%"; Hit description =ENSANGP00000014917 [Anopheles gambiae]
  misc_feature: Gene Ontology Annotation: Molecular function=protein tyrosine phosphatase activity; Cellular component=extracellular; Biological process=regulation of cell cycle
  misc_feature: Pfam annotation: Pfam_ID=Acid_phosphat_A; Match level="Score=-24.3, E- value=1.6e-06, Copies=1"; Pfam description=Histidine acid phosphatase
  misc_feature (247)..(247): Xaa can be any naturally occurring amino acid
  misc_feature (287)..(287): Xaa can be any naturally occurring amino acid
RIPVKFFPTSKYLDGEYWGNLGAGQLTNEGKRQLFALGQYTRRRYPNFLPLKYNASSFHAYTTDVDRTHMSAQSNIYSLFPATDEQVWRRNLNWQPIPIHPISRDEFWGDSACPNFYILRTEALNDKLSQSIDEEYAGVYKYISKYSGLDIKSYFQIHTVFDNFKIQEDVGLPLPDWSKAVYPEPITSIAGWLFEVFSRTTQMKRLIKGRFLNKVVEYFEKMADDPKSSEKYQFYSGHDSNIASLLXSFGSFNPPYPPDFASTAHIELHFESWRHVVKVFSKDRGQXKQISVNGCSLSCPPSKFKEVLSDILIDKETYDEECSNIKDTSGLKKLLLADSNTHKITTEEVRETSFIT

SEQ ID NO: 21710 - protein, 231 aa, Diabrotica virgifera
  misc_feature: Coding regions on vcDNA: vcDNA=SeqID_1407; Strand=+; Position=162-857
  misc_feature: Homolog annotation: Hit_ID=AAN05630.1; Match level="QueryCoverage =99%, HitCoverage=99%, E-value=1e-63, Identity=48%"; Hit description =diapause-associated transcript-2 [Leptinotarsa decemlineata]
MNKYMILAVLLVGAVLVQGKKEDSSSSSEENVREVAELLNKKFNTTLLLDVIKMAEKAKAKCPDLEEKLDDISGKIEKCVDEIELGSETFCSLVKNNLARCSKPAIDLIASCLPEESKDLPVLAQKIIVAVVKQACSSTVEEILELLNPCALEKDFASFPACREIKTVIDEHRNKLPSKSLICSTLPKIRNCAKAHIEASCQNTVTRQAALKFHDAIDAALKDDCDALNKA

SEQ ID NO: 21711 - protein, 196 aa, Diabrotica virgifera
  misc_feature: Coding regions on vcDNA: vcDNA=SeqID_1408; Strand=+; Position=833-1421
  misc_feature: Homolog annotation: Hit_ID=AAN05630.1; Match level="QueryCoverage =97%, HitCoverage=82%, E-value=2e-34, Identity=40%"; Hit description =diapause-associated transcript-2 [Leptinotarsa decemlineata]
  misc_feature (94)..(94): Xaa can be any naturally occurring amino acid
  misc_feature (101)..(101): Xaa can be any naturally occurring amino acid
  misc_feature (114)..(114): Xaa can be any naturally occurring amino acid
  misc_feature (143)..(143): Xaa can be any naturally occurring amino acid
  misc_feature (173)..(173): Xaa can be any naturally occurring amino acid
MNKYMILAVLLVGAVLVQGKKEDSSSSSEENVREVAELLNKKFNTTLLLDVIKMAEKAKAKCPDLEEKLDDISGKIEKCVDEIELGSETFCSLXRTTWLDXSKPGIDLIASRFXPREPKDLLLLEREIIAAEVKQACSSTVEXIVELWKPWAREKDLASFPDCREIEKRYATXYRNKLPSISLICSTLPKIQELRQ

SEQ ID NO: 21712 - protein, 163 aa, Diabrotica virgifera
  misc_feature: Coding regions on vcDNA: vcDNA=SeqID_1409; Strand=+; Position=3-494
  misc_feature: Homolog annotation: Hit_ID=NP_708517.1; Match level="QueryCoverage =98%, HitCoverage=33%, E-value=6e-93, Identity=100%"; Hit description= putative flavodoxin [Shigella flexneri 2a str. 301] gb|AAN44224.1| putative flavodoxin
  misc_feature: Pfam annotation: Pfam_ID=Lactamase_B; Match level="Score=35.8, E -value=1.3e-07, Copies=1"; Pfam description=Metallo-beta-lactamase superfamily
KFSREFVQNLRNEIDLADIDYIVINHAEEDHAGALTELMAQIPDTPIYCTANAIDSINGHHHHPEWNFNVVKTGDTLDIGNGKQLIFVETPMLHWPDSMMTYLTGDAVLFSNDAFGQHYCDEHLFNDEVDQTELFEQCQRYYANILTPFSRLVTPKITEILAS

SEQ ID NO: 21713 - protein, 297 aa, Diabrotica virgifera
  misc_feature: Coding regions on vcDNA: vcDNA=SeqID_1410; Strand=+; Position=392-1282
  misc_feature: Homolog annotation: Hit_ID=XP_315429.1; Match level="QueryCoverage =87%, HitCoverage=64%, E-value=1e-100, Identity=65%"; Hit description= ENSANGP00000014070 [Anopheles gambiae]
  misc_feature: Gene Ontology Annotation: Molecular function=protein transporter activity; Cellular component=mitochondrial electron transport chain; Biological process=electron transport
  misc_feature: Pfam annotation: Pfam_ID=60KD_IMP; Match level="Score=34.6, E-value =1.7e-13, Copies=1"; Pfam description=60Kd inner membrane protein
TTAGVALVGSTNPTVTDIPTLDSNINTASSATEVKVEPIVEAIPEPPVVPDVVESTGEVLNQLNALGEPTFASLGLGGYSPVGIVQNCFEYLHVTMGMEWWAAIAIGTLVIRICLFPLVIMAQRNAAKMNNYLPQMQVLQLKMTEARQTGNQMDAARYSQELMMFMKEKGLNPFKNMIVPLAQMPIFISFFMGLRQMTNVPVDSLSTGGLFWFTDLTLPDQYFLLPIITSATLYATIELGTDTAKLSSQNMQLMKYVLRGLPLIVLPFTVNFPGAILCYWASSNLISLVQVGFLRVP

SEQ ID NO: 21714 - protein, 66 aa, Diabrotica virgifera
  misc_feature: Coding regions on vcDNA: vcDNA=SeqID_1411; Strand=-; Position=261-461
YFLIELILIISSSQHAIKWFISLKTGVHFLGGYNFYYHYTNTIHFIFKLFLHQYSVKTLGYRFKNH

SEQ ID NO: 21715 - protein, 225 aa, Diabrotica virgifera
  misc_feature: Coding regions on vcDNA: vcDNA=SeqID_1412; Strand=+; Position=69-746
  misc_feature: Homolog annotation: Hit_ID=XP_396972.1; Match level="QueryCoverage =98%, HitCoverage=51%, E-value=4e-47, Identity=45%"; Hit description =similar to CG4202-PA [Apis mellifera]
  misc_feature: Gene Ontology Annotation: Cellular component=nucleus
  misc_feature: Pfam annotation: Pfam_ID=Sas10_Utp3; Match level="Score=-147.1, E -value=0.014, Copies=1"; Pfam description=Sas10/Utp3 family
MRIDNDEDYSASDSDDDYTENERILLNKVRNRGKKFSDDEQEVFGVGGDESEDNEDDDGDGSDLALSDVEGQEDDNLPDTRAWGKDKRKFYQTDYVDGDYGGFQGKDAQLAELEEEEARNLQKQLAQHLDDDDFGLDIFAKKADEDDKQNEEIIKTDISKLSKRQKLQIMQKESPEFFNLVQDFQNKMAVVTSHLHPVLKKAEAGDIPQCKAVDFVQFKYELILK

SEQ ID NO: 21716 - protein, 211 aa, Diabrotica virgifera
  misc_feature: Coding regions on vcDNA: vcDNA=SeqID_1413; Strand=+; Position=235-870
  misc_feature: Homolog annotation: Hit_ID=NP_004695.1; Match level="QueryCoverage =85%, HitCoverage=37%, E-value=7e-28, Identity=38%"; Hit description =RNA, U3 small nucleolar interacting protein 2 [Homo sapiens] gb|AAH10048.1| RNA, U3 small
  misc_feature: Gene Ontology Annotation: Biological process=RNA processing
  misc_feature: Pfam annotation: Pfam_ID=WD40; Match level="Score=40.9, E-value=3.8e -09, Copies=2"; Pfam description=WD domain, G-beta repeat
HETAQEKKLRLAKIYLEEIEKEEKATREDKEVDEAVLSKRLKEDYLKETGKLQLQVANKYTQIDEENRLTLKCTEQHKSLTCLCISSDDQYVYAGSKDGVVVKYSLSDNKRIGVILFVKNSEGETVGHSSEILSLAISSDSKYLAVGTKSSDVYIWDPNTFKFIKKFQGHPVYRGLLSLNRGYRTCKLSTFLPRLMSGYYWCFLFHDKLGK

SEQ ID NO: 21717 - protein, 172 aa, Diabrotica virgifera
  misc_feature: Coding regions on vcDNA: vcDNA=SeqID_1414; Strand=+; Position=112-630
  misc_feature: Homolog annotation: Hit_ID=XP_393875.1; Match level="QueryCoverage =97%, HitCoverage=95%, E-value=1e-46, Identity=53%"; Hit description =similar to modifier 1 [Apis mellifera]
  misc_feature: Gene Ontology Annotation: Molecular function=chromatin binding; Cellular component=nucleus; Biological process=cell organization and biogenesis
  misc_feature: Pfam annotation: Pfam_ID=Chromo_shadow; Match level="Score=125.0, E -value=1.8e-34, Copies=1"; Pfam description=Chromo shadow domain
MSKRNSPVPEEEPPAPEEYVVEKILDSRINDHGIKEYFLKWIGYEEKDNTWEPEGNLDCPGLIEAFEKEKARKDKENERKRRPSTLTEQRSVKKKTDDKKSLGFDRGLEPEKIIGATDSPGQLMFLIKWNGTDEADLVPAKQANIRCPQVVIKFYEERLKWHAPSLEDSKGE

SEQ ID NO: 21718 - protein, 120 aa, Diabrotica virgifera
  misc_feature: Coding regions on vcDNA: vcDNA=SeqID_1415; Strand=+; Position=1-363
SGRVGSSEVILNIFIIIYPIVIMRSLIVATIVLFAVYQAVDGLIACHETFCDNQKCTENLVCKDSEVLVPKGTICGCCDDCYRKLNEGDACRSRFFGGGPFRGKCVDGLVCNAEGKCAKV

SEQ ID NO: 21719 - protein, 409 aa, Diabrotica virgifera
  misc_feature: Coding regions on vcDNA: vcDNA=SeqID_1416; Strand=+; Position=12-1237
  misc_feature: Homolog annotation: Hit_ID=XP_315551.1; Match level="QueryCoverage =97%, HitCoverage=32%, E-value=0.0, Identity=80%"; Hit description =ENSANGP00000017759 [Anopheles gambiae] gb|EAA11859.1| ENSANGP00000017759 [Anopheles gambiae
  misc_feature: Gene Ontology Annotation: Molecular function=U2 snRNA binding; Cellular component=snRNP U2; Biological process=hermaphrodite genital morphogenesis
  misc_feature (376)..(376): Xaa can be any naturally occurring amino acid
  misc_feature (382)..(382): Xaa can be any naturally occurring amino acid
  misc_feature (395)..(395): Xaa can be any naturally occurring amino acid
RSDVCSDDFDAYIIVSFVNATLVLSIGETVEEVTDSGFLGTAPTLCCSALSDDALVQVYPDGIRHICADKRVNEWKAGKKSIVKCAVNQRQVVIALSGGELVYFEMDHTGQLDEFKERKRMNSDVLCMALANVPPGEQRSWFLAVGLADGTVRIISLDPSDRLAPRAMQPLPVCAESLCIVEMGCTERDPDNAAAASTTSTLYLNIGLQNGTLLRTVLDPVTGDLTDTRTRYLGSRPVKLFRIRMQQSEAVLAMSSRSWLSYYYQNRFYLTPLSYESLEYASGFSSEQCPEGIVAISTNTLRILALEKLGAVFNQVSFPLEYTPRKFLIHPESSNLMILETEHNAYTEETKKQRRLQMAEEMREAAGEDEQELAQXMAEAFXNEDLPESIFSAPXAGHGMWASTLRGYG

SEQ ID NO: 21720 - protein, 308 aa, Diabrotica virgifera
  misc_feature: Coding regions on vcDNA: vcDNA=SeqID_1417; Strand=+; Position=176-1099
  misc_feature: Homolog annotation: Hit_ID=CAC12696.1; Match level="QueryCoverage =85%, HitCoverage=58%, E-value=4e-23, Identity=31%"; Hit description =prophenoloxidase activating factor [Tenebrio molitor]
  misc_feature: Pfam annotation: Pfam_ID=Trypsin; Match level="Score=-14.8, E-value =0.0044, Copies=1"; Pfam description=Trypsin
  misc_feature (293)..(293): Xaa can be any naturally occurring amino acid
MSVYILLINVLLLNHFLIVKVQGGFRSKREDIETENTVIEVFHDCKCVNYYQCDANNRVITNGENLIDVRMGGNVNKPGNTTRIQCKGGTFEGELICCKVINGTESSTEKVIPDTDHDNTTVDPTHQTQCGNCGTQRTKINVRIIVDEDSEEEINPLDGEFPWITPIYRKNKQGKWYFYASGTLIHPKVILTANHLFNRKHANNFKVILTGNIELTNVGNNVNNERNVAEIVNHPKYYAGALYNDGALLILDKPFESTNTNSINTLCLPPDNLNINSLGRCLVAGWGNGSEEXSTRILKKVDFTNCPH

SEQ ID NO: 21721 - protein, 92 aa, Diabrotica virgifera
  misc_feature: Coding regions on vcDNA: vcDNA=SeqID_1418; Strand=+; Position=800-1078
RGITVYQINCFRAAISKIQIADLSQRWHLKKIAPYYQGQLNIVYMGLATVDCNDELHCCLKILMFCFSLQKFRHATRNSCRTILKIVFFSGF

SEQ ID NO: 21722 - protein, 269 aa, Diabrotica virgifera
  misc_feature: Coding regions on vcDNA: vcDNA=SeqID_1419; Strand=+; Position=139-944
  misc_feature: Homolog annotation: Hit_ID=AAL29468.1; Match level="QueryCoverage =98%, HitCoverage=68%, E-value=2e-77, Identity=50%"; Hit description =3-hydroxykynurenine transaminase [Aedes aegypti]
  misc_feature: Gene Ontology Annotation: Molecular function=alanine-glyoxylate aminotransferase activity; Cellular component=extracellular space; Biological process=glyoxylate cycle
  misc_feature: Pfam annotation: Pfam_ID=Aminotran_5; Match level="Score=-51.6, E -value=2.6e-05, Copies=1"; Pfam description=Aminotransferase class-V
  misc_feature (231)..(231): Xaa can be any naturally occurring amino acid
  misc_feature (233)..(233): Xaa can be any naturally occurring amino acid
  misc_feature (235)..(235): Xaa can be any naturally occurring amino acid
  misc_feature (243)..(243): Xaa can be any naturally occurring amino acid
  misc_feature (249)..(249): Xaa can be any naturally occurring amino acid
MEIPAPETLKKPLVVPNKLLMGAGPANLSPRVLHAMSHGVLGHMHEETFKIMDEIKEGIKYVFQTKNETSLAISASGHTGMEAILCNILEPGDRVLIAVNGLWGLRAADMAERYGAVPIKMSTLPGDNFSFTEIEHNLKKYLPKLLFIVQGETSTGVHQPIEGLGDLCHKYNCLLGVDAVASVGGVPFYMDKWGVDAVYAGVQKAIGAPPGLTIISISNRALMHIYARNTXNXIXYWDMKVLXQQWNCXHNVRPYHPYTQSSLLCSLRE

SEQ ID NO: 21723 - protein, 70 aa, Diabrotica virgifera
  misc_feature: Coding regions on vcDNA: vcDNA=SeqID_1420; Strand=-; Position=3-212
IQKNTNYNHTRAHGRNKINVGIRQGDGLSQCLINLIMDEVIGSVNKMNQGYTMGNRTVRILCYADDAIII

SEQ ID NO: 21724 - protein, 264 aa, Diabrotica virgifera
  misc_feature: Coding regions on vcDNA: vcDNA=SeqID_1421; Strand=+; Position=59-853
  misc_feature: Homolog annotation: Hit_ID=CAA76928.1; Match level="QueryCoverage =92%, HitCoverage=86%, E-value=2e-47, Identity=43%"; Hit description =chymotrypsin [Phaedon cochleariae]
  misc_feature: Gene Ontology Annotation: Molecular function=serine-type peptidase activity; Cellular component=extracellular space; Biological process= biological_process unknown
  misc_feature: Pfam annotation: Pfam_ID=Trypsin; Match level="Score=205.0, E-value =1.5e-58, Copies=1"; Pfam description=Trypsin
MYNYYCVYVALVSSCLYLSNAGTPPLEYSEKSNNLGIIDGQEVIPHSMPYMAAIRSEINYTTVLCGGSLISDSLVLTAARCVYGASEVTVTLGAHNLTINEESQVTMTSTSFVIHEDYKHSGVLHDIAVIELPKAVTLNDYIATIKLPDFADISNSYEEQAASVAGWGRVNDAEQLNSDVLLYQNFTIIPNIMCELSYLFQIQSNQLCTSGVSGKNICLGDNGSPLVLNGVQIGIASYGTVFGCSLGFPGVFTRVTSYLGWLML

SEQ ID NO: 21725 - protein, 309 aa, Diabrotica virgifera
  misc_feature: Coding regions on vcDNA: vcDNA=SeqID_1422; Strand=+; Position=4-928
  misc_feature: Homolog annotation: Hit_ID=NP_649277.1; Match level="QueryCoverage =89%, HitCoverage=64%, E-value=2e-91, Identity=62%"; Hit description =CG10585-PA [Drosophila melanogaster] gb|AAF51668.1| CG10585-PA [Drosophila melanogaster]
  misc_feature: Gene Ontology Annotation: Molecular function=trans -hexaprenyltranstransferase activity; Cellular component =mitochondrion; Biological process=ubiquinone metabolism
  misc_feature (302)..(302): Xaa can be any naturally occurring amino acid
MSLSKLSAILVQKNYIIRPSLVCVSRLEKSTSANVQHTKKPNWNRAVSEAEKIVGYPNSFLSLRWLLSDEIANVALQLRKLVGSNHPLLKTAKGLFFNGKNNMQAWGLIVLLVSKAAGHSADIPEMEEDKSAGVLHSQRALAEVTEMIRTSHLVHKGLVNLQPPVKFDAPGDMISGNKIALLSGDFLLSNSCVELANLKNQELVELMSSAVRDLAEAEFVEPRDIQNAPLPARPKRSARGYEQFVDSTMEPLVVSEALGNARAEWTLRHVLNAGSLLGKSLSGTLKVAGHSYELQQKGIYLXKHLALAW

SEQ ID NO: 21726 - protein, 62 aa, Diabrotica virgifera
  misc_feature: Coding regions on vcDNA: vcDNA=SeqID_1423; Strand=-; Position=791-979
YITYCPGELIVKLACSGITKVSYRREAEIHSPEYTYVYYFSHNISLIIKFQIIISTLTFIII

SEQ ID NO: 21727 - protein, 116 aa, Diabrotica virgifera
  misc_feature: Coding regions on vcDNA: vcDNA=SeqID_1424; Strand=+; Position=53-403
  misc_feature: Homolog annotation: Hit_ID=AAM09303.2; Match level="QueryCoverage =87%, HitCoverage=64%, E-value=1e-13, Identity=36%"; Hit description =similar to Plasmodium lophurae. Histidine-rich glycoprotein precursor [Dictyostelium discoideum] gb|AAM443
  misc_feature: Gene Ontology Annotation: Biological process=neuron differentiation
GVIRKPTLYIKKEKMPHHHDHHHHHHHHHNRGIIGEIIHDVLHPNHHHHHPPPPPPIIPVPVPVPTNYGPPPPYYGPPMPPPPQTWYGPYGLPPCGHSGYSHGCHHCHHHHRRHYC

SEQ ID NO: 21728 - protein, 111 aa, Diabrotica virgifera
  misc_feature: Coding regions on vcDNA: vcDNA=SeqID_1425; Strand=+; Position=90-425
  misc_feature: Homolog annotation: Hit_ID=XP_321619.1; Match level="QueryCoverage =92%, HitCoverage=81%, E-value=3e-30, Identity=65%"; Hit description =ENSANGP00000011747 [Anopheles gambiae]
  misc_feature: Gene Ontology Annotation: Molecular function=ATP binding; Cellular component=mitochondrion; Biological process=protein folding
  misc_feature: Pfam annotation: Pfam_ID=Cpn10; Match level="Score=145.7, E-value=1e -40, Copies=1"; Pfam description=Chaperonin 10 Kd subunit
LYNKFLTITKMSGAAKRLIPLFDRILIKKFEAVSKTKGGIVLPEKAQDKVLQGTVVAVGQGARLQDGSFAAPTIKVGDKVLLPEYGGTKVNVEDNAEYQIFRESDIIAKVE

SEQ ID NO: 21729 - protein, 285 aa, Diabrotica virgifera
  misc_feature: Coding regions on vcDNA: vcDNA=SeqID_1426; Strand=+; Position=74-928
  misc_feature: Homolog annotation: Hit_ID=XP_391911.1; Match level="QueryCoverage =95%, HitCoverage=88%, E-value=1e-114, Identity=70%"; Hit description= similar to CG10237-PB [Apis mellifera]
  misc_feature: Gene Ontology Annotation: Molecular function=binding; Cellular component=soluble fraction; Biological process=vitamin A metabolism
  misc_feature: Pfam annotation: Pfam_ID=CRAL_TRIO; Match level="Score=62.6, E-value =1.1e-15, Copies=1"; Pfam description=CRAL/TRIO domain
MAAEIIFIKASPIVAATMLSDMDELPTIKLGDYTLQLELDELKPEVQEIAKKELRETPDVKKAGIVALRDLLREEKDLKVPLENDLWLTRYLRPCKYYPESACDLIKRYYKFKITHSGVYDGLMPSKEKNIFEQNILTVQPNRDQLGRRILIIELGKKWKTDKVSLDEVFKGCVLFLEAAMLEPESQVCGAVVIFDMDGLTLSQTTKFTPSFAKRIVDWLQDSVPLRIKNIHIVNQPYIFKIVFALFKPFLREKLRNRIIFHGTDRKSLHQYMSPECLPECYGGT

SEQ ID NO: 21730 - protein, 310 aa, Diabrotica virgifera
  misc_feature: Coding regions on vcDNA: vcDNA=SeqID_1427; Strand=+; Position=195-1127
  misc_feature: Homolog annotation: Hit_ID=XP_391911.1; Match level="QueryCoverage =98%, HitCoverage=100%, E-value=1e-129, Identity=69%"; Hit description=similar to CG10237-PB [Apis mellifera]
  misc_feature: Gene Ontology Annotation: Molecular function=binding; Cellular component=soluble fraction; Biological process=vitamin A metabolism
  misc_feature: Pfam annotation: Pfam_ID=CRAL_TRIO; Match level="Score=105.5, E-value= 1.3e-28, Copies=1"; Pfam description=CRAL/TRIO domain
MPIAATMLSDMDELPTIKLGDYTLQLELDELKPEVQEIAKKELRETPDVKKAGIVALRDLLREEKDLKVPLENDLWLTRYLRPCKYYPESACDLIKRYYKFKITHSGVYDGLMPSKEKNIFEQNILTVQPNRDQLGRRILIIELGKKWKTDKVSLDEVFKGCVLFLEAAMLEPESQVCGAVVIFDMDGLTLSQTTKFTPSFAKRIVDWLQDSVPLRIKNIHIVNQPYIFKIVFALFKPFLREKLRNRIIFHGTDRKSLHQYMSPECLPECYGGTLDLPRINGNQWYDLLVMCDKEYLAINSFGYKKKGEL

SEQ ID NO: 21731 - protein, 296 aa, Diabrotica virgifera
  misc_feature: Coding regions on vcDNA: vcDNA=SeqID_1428; Strand=+; Position=59-950
  misc_feature: Homolog annotation: Hit_ID=EAL34354.1; Match level="QueryCoverage =98%, HitCoverage=69%, E-value=6e-92, Identity=55%"; Hit description =GA21862-PA [Drosophila pseudoobscura]
  misc_feature: Gene Ontology Annotation: Molecular function=guanyl-nucleotide exchange factor activity; Cellular component=integral to membrane; Biological process=signal transduction
  misc_feature (266)..(266): Xaa can be any naturally occurring amino acid
MAMFRALGRNIPFLKEQFGALLGNTSTSVKFICGVVLLSYGLSFSDEAVRVISVTPGYLMPPSFWIWTTFTFCFMEIHFYEVLVDIVTVGLCGKLIEPLWGQMEIMTFFAVVNLGVAVLTTAFYFILYCCTFNTEFLFSVHIHGLAGYIAGVCVTVKQIMPDLVILKTPFGKISNRNVPLAVFFLSVIVKLIGLVDGTYPTMFFSGMIVSWVYLRFYQKHSNGTRGDLADYFTFASFFPNVIQPPIAVLSNVIHTGLVKIGYVERXRKFDMSNPTGVTVTVPIADQHDMERRRQLP

SEQ ID NO: 21732 - protein, 294 aa, Diabrotica virgifera
  misc_feature: Coding regions on vcDNA: vcDNA=SeqID_1429; Strand=+; Position=30-911
  misc_feature: Homolog annotation: Hit_ID=XP_312936.1; Match level="QueryCoverage =95%, HitCoverage=65%, E-value=1e-162, Identity=95%"; Hit description= ENSANGP00000014714 [Anopheles gambiae]
  misc_feature: Gene Ontology Annotation: Molecular function=H3/H4 histone acetyltransferase activity; Cellular component=nucleus; Biological process=negative regulation of transcription of homeotic gene (Polycomb group)
  misc_feature: Pfam annotation: Pfam_ID=WD40; Match level="Score=60.8, E-value=3.9e -15, Copies=2"; Pfam description=WD domain, G-beta repeat
  misc_feature (269)..(269): Xaa can be any naturally occurring amino acid
SVLISIKRNSSLKMGDKADAETFDDAVEERVINEEYKIWKKNTPFLYDLVMTHALEWPSLTAQWLPDVTRPEGKDHSIHRLILGTHTSDEQNHLLIASVQLPNEDAQFDASHYDNEKGEFGGFGSVSGKIEIEIKINHEGEVNRARYMPQNPCVIATKTPSSDVLVFDYTKHPSKPDPSGECHPDLRLRGHQKEGYGLSWNPNLNGYLLSASDDHTICLWDINATPKENRIIDAKTVFTGHTAVVEDVAWHLLHESLFGSVADDQKLMXWDTRCNNTSKPSHTVDAHTAEVNCL

SEQ ID NO: 21733 - protein, 312 aa, Diabrotica virgifera
  misc_feature: Coding regions on vcDNA: vcDNA=SeqID_1430; Strand=+; Position=176-1115
  misc_feature: Homolog annotation: Hit_ID=XP_392512.1; Match level="QueryCoverage =99%, HitCoverage=100%, E-value=1e-83, Identity=48%"; Hit description= similar to CG33250-PA [Apis mellifera]
  misc_feature: Gene Ontology Annotation: Biological process=DNA repair
  misc_feature: Pfam annotation: Pfam_ID=2OG-FeII_Oxy; Match level="Score=15.8, E -value=0.0072, Copies=1"; Pfam description=2OG-Fe(II) oxygenase superfamily
  misc_feature (41)..(41): Xaa can be any naturally occurring amino acid
MFKQSFKYYKSKNPPPNLDDVLNLNKSEELLAKSLIKYVDXILNTKEGSHYGLRKPSEWEAYEIISKRGLIFIKNPFLPSGQRYWIKKSLQEYSKKPNKLNIDPFNTLTNNADWWDVGQADKKILMSLRWATLGYHHNWDSKIYSEQNKSEFPIDLKDMTEYVSSKLGFLNFTAEAAIVNYYHLDSTLSGHTDHSEQNLEAPLFSFSFGQSAIFLLGGETLDEKPTAIFLHSGDIVIMSKDSRLCYHGVPKIMKTNNETWNEDSEYVLANEDFLVPKDILWRPFGSYLNHSRININARQVLDVGQLKLLNTE

SEQ ID NO: 21734 - protein, 151 aa, Diabrotica virgifera
  misc_feature: Coding regions on vcDNA: vcDNA=SeqID_1431; Strand=+; Position=159-614
  misc_feature: Homolog annotation: Hit_ID=CAH04330.1; Match level="QueryCoverage =100%, HitCoverage=100%, E-value=1e-77, Identity=97%"; Hit description=S14e ribosomal protein [Dascillus cervinus]
  misc_feature: Gene Ontology Annotation: Molecular function=structural constituent of ribosome; Cellular component=cytosolic ribosome (sensu Eukarya); Biological process=protein biosynthesis
  misc_feature: Pfam annotation: Pfam_ID=Ribosomal_S11; Match level="Score=240.8, E -value=2.4e-69, Copies=1"; Pfam description=Ribosomal protein S11
MAPRKGKQPKEEVQLSLGPQVREGEIVFGVAHIFASFNDTFVHVTDLSGRETISRVTGGMKVKADRDEASPYAAMLAAQDVAEKCKTLGITALHIKLRATGGNKTKTPGPGAQSALRALARSNMKIGRIEDVTPIPSDSTRRKGGRRGRRL

SEQ ID NO: 21735 - protein, 443 aa, Diabrotica virgifera
  misc_feature: Coding regions on vcDNA: vcDNA=SeqID_1432; Strand=+; Position=92-1423
MAKINTALAVLLFIVSVAWCQPTSVPVNQTSPPVQSTTSTTVPPSIPEKYEYIVKLLFGLENEKIPEFIVKAIYDANFATPADLIMLYDVGNISLAQTVEVLQKLKYDPSNVLSMKGLETILDDLNVKFKNFYNTIFLEKLNISGVQLRNFLQALNINTAEFSEAMTYGDEDPLVIFKKGNFSSANFQKALNTINETEEKFYSVCRQEIFQIVITQNSTSDVLSNLKKYHFDQREALQLWKIMNVTEENVESVPVFADLLTSLEDSLKDTTYLGVITSNTQVGINEAVYDDIKDKLKMAKLYAQSIYNNNNTVALVPEKSEFTDLVTFKVQNHNFTEHAQIATTKKDLTNCLFVTVNNGTVISTKVDVARYRDSEIKVELNLTQLIQGSPLICDKKVYGLAKEIDEGDIVFDTFNVDSDKSSVSTNVLSTCLAILCFVVYFKI

SEQ ID NO: 21736 - protein, 185 aa, Diabrotica virgifera
  misc_feature: Coding regions on vcDNA: vcDNA=SeqID_1433; Strand=+; Position=371-928
  misc_feature: Homolog annotation: Hit_ID=XP_392990.1; Match level="QueryCoverage =100%, HitCoverage=72%, E-value=1e-100, Identity=96%"; Hit description=similar to CG8385-PB [Apis mellifera]
  misc_feature: Gene Ontology Annotation: Molecular function=enzyme activator activity; Cellular component=membrane; Biological process=G-protein coupled receptor protein signaling pathway
  misc_feature: Pfam annotation: Pfam_ID=Arf; Match level="Score=427.9, E-value=1.2e -125, Copies=1"; Pfam description=ADP-ribosylation factor family
AITMGNVFANLFKGLFGKKEMRILMVGLDAAGKTTILYKLKLGEIVTTIPTIGFNVETVEYKNISFTVWDVGGQDKIRPLWRHYFQNTQGLIFVVDSNDRERITEAKDELMRMLAEDELRDAVLLIFANKQDLPNAMNAAEITDKLGLHSLRNRNWYIQATCATSGDGLYEGLDWLSNQLKNANR

SEQ ID NO: 21737 - protein, 439 aa, Diabrotica virgifera
  misc_feature: Coding regions on vcDNA: vcDNA=SeqID_1434; Strand=+; Position=253-1628
  misc_feature: Homolog annotation: Hit_ID=XP_392381.1; Match level="QueryCoverage =88%, HitCoverage=46%, E-value=5e-78, Identity=41%"; Hit description =similar to CG12163-PA [Apis mellifera]
  misc_feature: Gene Ontology Annotation: Molecular function=cysteine-type peptidase activity; Cellular component=extracellular space; Biological process= proteolysis and peptidolysis
  misc_feature: Pfam annotation: Pfam_ID=Cystatin; Match level="Score=76.4, E-value =7.6e-20, Copies=1"; Pfam description=Cystatin domain
  misc_feature (277)..(277): Xaa can be any naturally occurring amino acid
  misc_feature (338)..(338): Xaa can be any naturally occurring amino acid
  misc_feature (345)..(345): Xaa can be any naturally occurring amino acid
  misc_feature (350)..(350): Xaa can be any naturally occurring amino acid
  misc_feature (412)..(412): Xaa can be any naturally occurring amino acid
  misc_feature (427)..(427): Xaa can be any naturally occurring amino acid
  misc_feature (432)..(432): Xaa can be any naturally occurring amino acid
MLDVIFEKNRVYAECLVYMKLNDVDTAQSTVDKVKCVNQDGTPLSRHVRQVPGGISPISKDDPKVKRYLKDGLLHLDKESSHEFKFKVVEILEVSRQVVSGSLHRIKAKIALSDCKKESNIDASQCGVQANGQSTICDFKVWDQPWIEHGRETNITCHDDSLVKKQHHSFRLRRSLDDNDVETILSSVFEHFLAKYDKKYRNVVEHKYRFGVFKENLKLIHLLNKHEQGTAVYKITKFADMTSEEFSASHGYRSDLRSENDIPFHQAKIPEIDLPTXFDCGDQNVVTVVKDQGMCCRCWAFRTTDNVEGHDKLDDGRNDGLMDNAYWTIEILRGLELXEREYPYXRSGQXCHFNKTEAVARLTGALNISHDETDMAKRITQNAPITITINANAMQNYAEGVSHPFRVTLKSXNLDHGELIVGYDAHXYQLYXKRVPYWI

SEQ ID NO: 21738 - protein, 200 aa, Diabrotica virgifera
  misc_feature: Coding regions on vcDNA: vcDNA=SeqID_1435; Strand=+; Position=3-605
  misc_feature: Homolog annotation: Hit_ID=NP_055023.1; Match level="QueryCoverage =88%, HitCoverage=32%, E-value=2e-10, Identity=28%"; Hit description =dentin sialophosphoprotein preproprotein [Homo sapiens] sp|Q9NZW4|DSPP_HUMAN Dentin
  misc_feature: Gene Ontology Annotation: Cellular component=extracellular space
CTISQEFDVHETIDLPQESVVRQEEPDFLSDLESQIIPDTRSSKKSSVKSQQSKNDANPLYFGLNEISEDQPSKNEIPVYSGLNEISEDQQSKNAINPVYSGLNEIPEVGLKNRKVRAIEVVEINEVRRPSKSTDQQEQQEQQEQQVEQEVVDDEHSVLRRNKSDSDSSSSSDSSDSSDSSDSSDSSKSSDSSDSDSKAP

SEQ ID NO: 21739 - protein, 331 aa, Diabrotica virgifera
  misc_feature: Coding regions on vcDNA: vcDNA=SeqID_1436; Strand=+; Position=91-1083
  misc_feature: Homolog annotation: Hit_ID=AAV91004.1; Match level="QueryCoverage =99%, HitCoverage=86%, E-value=4e-33, Identity=31%"; Hit description =hemolymph proteinase 6 [Manduca sexta]
  misc_feature: Gene Ontology Annotation: Molecular function=serine-type endopeptidase activity; Cellular component=extracellular; Biological process=antifungal polypeptide induction
  misc_feature: Pfam annotation: Pfam_ID=Trypsin; Match level="Score=82.3, E-value =1.3e-21, Copies=1"; Pfam description=Trypsin
MENLVFVVLCAASIICGSRISYAYEDYDIGSKCHTSGLPGICKSVTECPQALDSLRKFHKHNFKRCLWDHMDEIICCPGNVVKGPTEIDPYPDGSTEVPTKRPNTDNKGQFPNKRRYQQACDAIETESRSNIIFHITDGEDALDKEFPHMVALGFEDSDLPPGELSWKCGASLISPNFLLTAAHCVSKEKPIRARMGVTKITDTHHQEIDVKRIRIHESYDPLGKHGDLAIVELTRNATLSDSVKPACLYWKHDDPLGLLVTGWGKTSVYNEDDRSVILQKAKLVPVSTTSCNNTYSTRSLGIQTIENTQICAFGNSSDACWGDSRGPLQS

SEQ ID NO: 21740 - protein, 270 aa, Diabrotica virgifera
  misc_feature: Coding regions on vcDNA: vcDNA=SeqID_1437; Strand=+; Position=212-1024
  misc_feature: Homolog annotation: Hit_ID=EAL39480.1; Match level="QueryCoverage =84%, HitCoverage=96%, E-value=1e-87, Identity=69%"; Hit description =ENSANGP00000028512 [Anopheles gambiae str. PEST] ref|XP_554756.1| ENSANGP00000028512 [Anopheles gambiae st
  misc_feature: Gene Ontology Annotation: Molecular function=ribose-5-phosphate isomerase activity; Cellular component=cellular_component unknown; Biological process=pentose-phosphate shunt
  misc_feature: Pfam annotation: Pfam_ID=Rib_5-P_isom_A; Match level="Score=311.2, E -value=1.6e-90, Copies=1"; Pfam description=Ribose 5-phosphate isomerase A (phosp
MIFKLFLNTVTSRLRPYSSMSSLKEAKRLAAYKAVDEHVKDGYIVGVGSGSTAVFAVDRLAERYHKENIKIKCVPTSFQSRQWLLQNELPLADLDVCPQLDVCIDGADEVDANMVLIKGGGGCLLQEKIVASCSKKLVVIADYTKDSEKLGQQYKKGIPIEVSPMAYVPIRSKIEKAFGGTAQLREAVMKAGPVVTDNGNFILDWKDFNQDYDWSSINSELLQIPGVVETGLFVDMAVMAYFGMQDGSVKVKHSPRKAANGSNGTNGFKL

SEQ ID NO: 21741 - protein, 325 aa, Diabrotica virgifera
  misc_feature: Coding regions on vcDNA: vcDNA=SeqID_1438; Strand=+; Position=3-980
  misc_feature: Homolog annotation: Hit_ID=CAG31113.1; Match level="QueryCoverage =97%, HitCoverage=60%, E-value=1e-122, Identity=69%"; Hit description= hypothetical protein [Gallus gallus]
  misc_feature: Gene Ontology Annotation: Molecular function=RNA binding; Cellular component=nucleolus; Biological process=rRNA processing
  misc_feature: Pfam annotation: Pfam_ID=Nop; Match level="Score=311.5, E-value=1.3e -90, Copies=1"; Pfam description=Putative snoRNA binding domain
NRLNNHIIYSIALLDQLDKDINTFSMRIREWYSYHFPELVKIVPENYTYAKVAQFIKNRKLLSEESLEALEELTMDSGKAQAILDASRSSMGMDISDIDLLNIEMFATRVVSLSDYRKRLAEYLRTKMSDVAPNLATLIGDQVGARLIAHAGSLTNLAKYPASTVQILGAEKALFRALKTRGNTPKYGLIFHSTFIGRAGTKNKGRISRYLANKCSIASRIDCFSEQPSQVFGEKLRQQVEDRLKFYESGDIPKKNIEVMKEAIEEYEQQVAQTQSGFGKKKEKKKEGNLKLGKGDRFEGSRKIETLPNPKKQEKKKKNYPPFDG

SEQ ID NO: 21742 - protein, 189 aa, Diabrotica virgifera
  misc_feature: Coding regions on vcDNA: vcDNA=SeqID_1439; Strand=-; Position=426-995
KKEKRLFNQDLCKALLAAKIPLKKLQNIYFRQFLQKYCNFNIPNEATLRKGNANELYDGVIEEIKVYLSDNTFYVIVDESTDACGRYMVHLIIGALKEDEPGKPYLIAAKQLEKTNNVTVSRFIQQTLSAFFLPTEIKSEHFLIFLSDAAPYMVKVGQNLKIFYPNMVHVTCLLHGINRVAEVLRVNLI

SEQ ID NO: 21743 - protein, 460 aa, Diabrotica virgifera
  misc_feature: Coding regions on vcDNA: vcDNA=SeqID_1440; Strand=+; Position=8-1387
  misc_feature: Homolog annotation: Hit_ID=NP_648781.1; Match level="QueryCoverage =98%, HitCoverage=61%, E-value=1e-65, Identity=37%"; Hit description =CG12301-PA [Drosophila melanogaster] gb|AAF49613.2| CG12301-PA [Drosophila melanogaster]
  misc_feature: Gene Ontology Annotation: Molecular function=snoRNA binding; Cellular component=nucleus; Biological process=G-protein coupled receptor protein signaling pathway
  misc_feature: Pfam annotation: Pfam_ID=Utp14; Match level="Score=-114.9, E-value =3.3e-07, Copies=1"; Pfam description=Utp14 protein
RVRFNLVKSLSTKNLVHVNELTSVLKGRKSLQLSNKIKSTSNISKTLPKPLEKPQAERIKRALNYEKAKLKLDRWEALVQANRSAAQLSFPLNSDEKVKVIEKRAISYPLSFRVKSDLQKNLENIDSQIEEYHIDTVEKKEDEDYPLTLEELKEKRKELAKLRAHQSFKEAKARRQNKIKSKKYHRILRKERIKQQLKEFEQLQKVNPEEALKKLEDIEKARAEERFSLRHKGTGQWARNKQVRAKYDKESRQELATQLLSRELTQKLKSVNSDSEDEGAVEDETSPTNQKVDESNPWVNGIKPTKEVADFVSGYRKYWNEVNKNNNKNEEEDKQAQTPNCSDTDESDIKNNNMIDQDDNKRVKKVKNKGENKIKRNEVSSSTSLLKNEKAKSKKKEKIKKENKTKEKTNMKEKPDKKESKKRKSLDMSEWEVSYNKSGNDDIEDMFDSLEAKMNKKISQ

SEQ ID NO: 21744 - protein, 59 aa, Diabrotica virgifera
  misc_feature: Coding regions on vcDNA: vcDNA=SeqID_1441; Strand=+; Position=3-182
HASEWRQNNACQDGDATKREICQRCAKQTKSPLAYPMCCNEEDEVHKWCYRYTTYGKVA

SEQ ID NO: 21745 - protein, 254 aa, Diabrotica virgifera
  misc_feature: Coding regions on vcDNA: vcDNA=SeqID_1442; Strand=+; Position=160-921
  misc_feature: Homolog annotation: Hit_ID=XP_313932.1; Match level="QueryCoverage =100%, HitCoverage=67%, E-value=1e-109, Identity=73%"; Hit description=ENSANGP00000021814 [Anopheles gambiae]
  misc_feature: Gene Ontology Annotation: Molecular function=serine-type peptidase activity; Cellular component=Golgi apparatus; Biological process=EGF receptor ligand processing
  misc_feature: Pfam annotation: Pfam_ID=Rhomboid; Match level="Score=127.6, E-value =3.1e-35, Copies=1"; Pfam description=Rhomboid family
MTGKRSRSFKCAVHHRDREVSSENDFHLLLVEPPLFRRMVTIVANEFLTDDRDRKYYADHYTCCPPPIFILTVTLAELGFYLYYYITTGELNPSGPVLVDSIFIYRPDKRIEIWRFLLYMLLHAGWLHLSFNLVVQLLVGLPLEMVHGSGRVALIYMSGVAAGSLGTSVFDNDVYLVGASGGVYALLAAHLANVLLNYNNMQCGILRLFGIFAIASCDVGYAIYSRYDAVGLPVFYVAHLTGALAGLTIGLLVL

SEQ ID NO: 21746 - protein, 300 aa, Diabrotica virgifera
  misc_feature: Coding regions on vcDNA: vcDNA=SeqID_1443; Strand=+; Position=56-955
  misc_feature: Homolog annotation: Hit_ID=XP_315113.1; Match level="QueryCoverage =99%, HitCoverage=55%, E-value=2e-95, Identity=52%"; Hit description =ENSANGP00000011459 [Anopheles gambiae]
  misc_feature: Gene Ontology Annotation: Molecular function=molecular_function unknown; Cellular component=cellular_component unknown; Biological process=biological_process unknown
  misc_feature: Pfam annotation: Pfam_ID=Kelch_2; Match level="Score=62.8, E-value =9.7e-16, Copies=4"; Pfam description=Kelch motif
MGKNKKDKKKGKGAEKTTAKTEKKLSNKMKKELQAKGEDDIESILLQIEKEEKKRLTVTEAIISPPSRRLNFTFMAHPEKEQLILYGGEFFNGQKTFVYGDLFFYNIPNNKWTVVKAPNGPPPRCGHQMIVSSANKGQLWVFGGEFTTPTQSQFYHYRDLWVFHLATKQWEKITAPNGPSARSGHRMVLIKKQIFVFGGFHDNLRDCKYFNDIYSFDIETYKWTKIEPLGTPPQSRSSCCMIGLNDGKILIYGGYSKEKVKKDLEKGHVYSDAFLLTPKKNDTAATVYKWSQVKIGGISF

SEQ ID NO: 21747 - protein, 67 aa, Diabrotica virgifera
  misc_feature: Coding regions on vcDNA: vcDNA=SeqID_1444; Strand=-; Position=136-339
PDKHCSLHLHKINTTFVSTCMSIISSMSVERIKTIGLFAEPSQCSNWTRQSPVSEKFATSTVNLYNT

SEQ ID NO: 21748 - protein, 419 aa, Diabrotica virgifera
  misc_feature: Coding regions on vcDNA: vcDNA=SeqID_1445; Strand=+; Position=25-1284
  misc_feature: Homolog annotation: Hit_ID=XP_321256.1; Match level="QueryCoverage =82%, HitCoverage=59%, E-value=1e-153, Identity=74%"; Hit description= ENSANGP00000018457 [Anopheles gambiae]
  misc_feature: Gene Ontology Annotation: Molecular function=glycyl-peptide N -tetradecanoyltransferase activity; Cellular component=cytoplasm; Biological process=N-terminal peptidyl-glycine N-myristoylation
  misc_feature: Pfam annotation: Pfam_ID=NMT; Match level="Score=414.5, E-value=1.3e -121, Copies=1"; Pfam description=Myristoyl-CoA:protein N -myristoyltran
MSEESEKNSLEKVSEVDGSTDGIILNKSAKKRNKNKKKKNENQEENSDQSNEVVQAENNLLSNLSNPINTISIKELKAAMEVFTLSQKPAKSSEEALKKTFQFWNTQPVPKMDEKITVNEAIEPDKEPADIRQEPYSLPDGFMWDTLNLDEPLVLKELYTLLNENYVEDDDCMFRFDYQPEFLKWALQPPGWKREWHCGVRVVKSGRLVGFISAIPATLNIYKKTQRMVEINFLCVHKKLRSKRVAPVLIREITRRVHLNGLFQAVYTAGIVLPKPVSTCTYWHRSLNPKKLIEVKFSHLSRNMTLQRTLKLYKLPDKPKTPGFRKMTAEDIPQAHKLLVEYLSRFDLAPYFNEEEFTHWFLPRTNIIDSFVVENNGEITDFVSYYTLASTVMHHPVHKNLKAAYSFYNVSKGTSLGAP

SEQ ID NO: 21749 - protein, 415 aa, Diabrotica virgifera
  misc_feature: Coding regions on vcDNA: vcDNA=SeqID_1446; Strand=+; Position=150-1397
  misc_feature: Homolog annotation: Hit_ID=XP_320378.1; Match level="QueryCoverage =88%, HitCoverage=50%, E-value=1e-126, Identity=58%"; Hit description= ENSANGP00000013980 [Anopheles gambiae]
  misc_feature: Gene Ontology Annotation: Molecular function=proton-dependent oligopeptide transporter activity; Cellular component=integral to plasma membrane; Biological process=oligopeptide transport
  misc_feature: Pfam annotation: Pfam_ID=PTR2; Match level="Score=263.5, E-value=3.7e- 76, Copies=1"; Pfam description=POT family
MTEKENKESNEDQYDNEIAEKKIPYPKSVFFIVSNEFCERFSYYGMRTILILYLTNILLFSESQSLVTYHSFSMAVYFFPIIGAIISDSFLGKFNTILYVSMIYASGSILLALTASDPIGLPKVGFSVLGLLLIAVGTGGIKPCVAAFGGDQFRLPQQEKDLERFFSLFYFSINAGSLISTFITPILRNDVHCFGNESCFPLAFAVPGILMIISVVIFGLGRPTYKIKKPEGNVIVQVTKCIVCGIKNKFKSKDKKEHWLDYAEEKYGEKLVNEVKATLHVLVLFLPLPIFWALYDQQGSGWTLMAVRMDGNIGFYTILPDQMQVVNPLLILAFIPLFTYYVYPLLGKCNLLKTSLQRMRCGGLLAAVAFAVSAFVTMAIGKKVPELPPAGKFTIKGGLTRETARRFLSPGGNRK

SEQ ID NO: 21750 - protein, 288 aa, Diabrotica virgifera
  misc_feature: Coding regions on vcDNA: vcDNA=SeqID_1447; Strand=+; Position=49-915
  misc_feature: Homolog annotation: Hit_ID=XP_391988.1; Match level="QueryCoverage =95%, HitCoverage=65%, E-value=2e-82, Identity=52%"; Hit description =similar to CG11255-PA [Apis mellifera]
  misc_feature: Gene Ontology Annotation: Molecular function=adenosine kinase activity; Cellular component=cellular_component unknown; Biological process=ribonucleoside monophosphate biosynthesis
MGENNIKENLLVGLGNPLLDISAVVNKQFLDKYELKENDAILADDRHRNLYEDITENYKVSYIAGGSVQNTLRVAQWLLGTPNVVTKFGCVGKDKYSKILHDKATESGVNVRYQYHESEPTGTCAVLITGQHRSLCAKLGSSGHFSVEHLRQPENRKLLENAQFFYVSGYFLSANREAQIEANKIALRNDRPFMLNLSAPIVCQIFAKDILETLPYVDVLFGNESEAESISKSLNLGSKNVEEIALKLSELPKENKRRKRLVVITQGVDPVVYAFEGQVKSFSVVKLP

SEQ ID NO: 21751 - protein, 118 aa, Diabrotica virgifera
  misc_feature: Coding regions on vcDNA: vcDNA=SeqID_1448; Strand=-; Position=314-669
  misc_feature: Homolog annotation: Hit_ID=AAQ88395.1; Match level="QueryCoverage =96%, HitCoverage=15%, E-value=3e-46, Identity=80%"; Hit description =SV2-like protein 2 [Ctenocephalides felis]
  misc_feature (80)..(80): Xaa can be any naturally occurring amino acid
VNGRKFFLVFSTVSSGLCSACMYFVYNKTHNLIVSAIFSSVISCGNAALDSLITEIFPTHLRATGIAVSMAARLGGIIGXIVIAQLLDLYCPAPTFIVTGLLIGGGLLLFLPNTTQLQ

SEQ ID NO: 21752 - protein, 184 aa, Diabrotica virgifera
  misc_feature: Coding regions on vcDNA: vcDNA=SeqID_1449; Strand=+; Position=285-839
  misc_feature: Homolog annotation: Hit_ID=AAV91469.1; Match level="QueryCoverage =94%, HitCoverage=97%, E-value=3e-74, Identity=77%"; Hit description =ribosomal protein 31 [Lonomia obliqua]
  misc_feature: Gene Ontology Annotation: Molecular function=structural constituent of ribosome; Cellular component=cytosolic ribosome (sensu Eukarya); Biological process=protein biosynthesis
  misc_feature: Pfam annotation: Pfam_ID=Ribosomal_L22; Match level="Score=221.5, E -value=1.6e-63, Copies=1"; Pfam description=Ribosomal protein L22p/L17e
MGRYAREPENAAKTCKAKGSNLRVHFKNTCETANAIKKMPLKRAVAYLKNVVIQKECIPFRRFNGGVGRCSQAKQFGTTQGRWPKKSAEFLLQLLRNAESNADYSGLDVDRLVIEHIQVNRAASLRRRTYRAHGRINPYMSSPCHIELWLTEGESTPEAPKKYSQKKSALNKVKKPKAPQAVSN

SEQ ID NO: 21753 - protein, 331 aa, Diabrotica virgifera
  misc_feature: Coding regions on vcDNA: vcDNA=SeqID_1450; Strand=+; Position=56-1051
  misc_feature: Homolog annotation: Hit_ID=XP_309800.1; Match level="QueryCoverage =89%, HitCoverage=48%, E-value=1e-114, Identity=68%"; Hit description= ENSANGP00000012563 [Anopheles gambiae]
  misc_feature: Gene Ontology Annotation: Cellular component=synaptic vesicle; Biological process=calcium ion homeostasis
TLSSFSGPVIWSYFAEFQPKSKRGSMLSFMAAFWTLGNLFVAGLAWLIIPADIGFKNQYFVYNSWRIFLLICSFPSFIVAALLCFLPESPKFLLTQGKSEEALAIFKYIYHVNTGNDPEDYPVKHLIYEQEELTLEQKAKIAKRGKYTNMIVDILDNSKQLFVSPILKFTVISITINFTFHIGYYGLMMWFPEMFNRFDEYAKIHDGAEAGVCEVVDYVVSSGSHSASVLCSDKISSSVFLESLITVSAALPSNIVAVLGMDKLGRKFFLVFSTVSSGLCSACMYFVYNKTHNLIVSAFSSYFMRRCTAYQNEHVIGKVLNKWLTSGTLNR

SEQ ID NO: 21754 - protein, 185 aa, Diabrotica virgifera
  misc_feature: Coding regions on vcDNA: vcDNA=SeqID_1451; Strand=+; Position=208-765
  misc_feature: Homolog annotation: Hit_ID=AAV91469.1; Match level="QueryCoverage =94%, HitCoverage=97%, E-value=9e-76, Identity=78%"; Hit description =ribosomal protein 31 [Lonomia obliqua]
  misc_feature: Gene Ontology Annotation: Molecular function=structural constituent of ribosome; Cellular component=cytosolic ribosome (sensu Eukarya); Biological process=protein biosynthesis
  misc_feature: Pfam annotation: Pfam_ID=Ribosomal_L22; Match level="Score=224.0, E -value=2.9e-64, Copies=1"; Pfam description=Ribosomal protein L22p/L17e
MGRYAREPENAAKSCKAKGSNLRVHFKNTCETANAIRKMPLKRAVAYLKNVIIQKECIPFRRFNGGVGRCAQAKQFGTTQGRWPKKSAEFLLQLLRNAESNADYSGLDVDRLVVEHIQVNRAACLRRRTYRAHGRINPYMSSPCHIELWLTEGESSQDAPKKASQKKKSTLDKVKRPKAPPAVTH

SEQ ID NO: 21755 - protein, 295 aa, Diabrotica virgifera
  misc_feature: Coding regions on vcDNA: vcDNA=SeqID_1452; Strand=+; Position=71-955
  misc_feature: Homolog annotation: Hit_ID=XP_391943.1; Match level="QueryCoverage =93%, HitCoverage=49%, E-value=5e-49, Identity=39%"; Hit description =similar to RE16761p [Apis mellifera]
  misc_feature: Gene Ontology Annotation: Molecular function=carboxylesterase activity; Cellular component=synaptic junction
  misc_feature: Pfam annotation: Pfam_ID=COesterase; Match level="Score=27.4, E-value= 2.9e-12, Copies=1"; Pfam description=Carboxylesterase
MSSGSPNYCSLVILLVVTVLCQTKCDEDGTIVELKQGKIRGHVLKSENGQDYYAFQEIPYAAPPVGKNRFQLPKEPEPWDNILDTKKNTKICYQTISRFDFLKIEEDCLYINVYSPQKPGSDDLLPVLLWIHGGGLVNESSTIEYYGPKYIMDHGVVVVTFNYRLGPFGFLGTDDGVIPQNLGLKDQRFAIEWVNQNIHLFGGNPEHVVLVGESAGSLSVGLHLMGDWEGGKELFHGVIMQSGTPISGICTTQHPTEQTFRLGKKVDPSFDSKSSEELLQVLQSASAHDILLGWN

SEQ ID NO: 21756 - protein, 556 aa, Diabrotica virgifera
  misc_feature: Coding regions on vcDNA: vcDNA=SeqID_1453; Strand=+; Position=398-2068
  misc_feature: Homolog annotation: Hit_ID=XP_393415.1; Match level="QueryCoverage =99%, HitCoverage=79%, E-value=0.0, Identity=72%"; Hit description =similar to ENSANGP00000012563 [Apis mellifera]
  misc_feature: Gene Ontology Annotation: Molecular function=organic cation transporter activity; Cellular component=synaptic vesicle; Biological process=calcium ion homeostasis
  misc_feature: Pfam annotation: Pfam_ID=MFS_1; Match level="Score=121.0, E-value=3e -33, Copies=1"; Pfam description=Major Facilitator Superfamily
MVEGESPRNQKQDSDVKIEHLANGCGSKDLELGNFTTTKELPSKLSSDVDKSSDKADFEKAIELTRYGKFHFLLLAVCGFVSTSEEMDVISMSFILPSAQCDLNLNTQTKGWLNSIIFIGMMAGAYVWGSVADSLGRKKVLIVSSFMNALCIVASSFCQTYELFMVFRFLNGAALGGSGPVIWSYFAEFQPKSKRGSMLSFMAAFWTLGNLFVAGLAWLIIPADIGFKNQYFVYNSWRIFLLICSFPSFIVAALLCFLPESPKFLLTQGKSEEALAIFKYIYHVNTGNDPEDYPVKHLIYEQEELTLEQKAKIAKRGKYTNMIVDILDNSKQLFVSPILKFTVISITINFTFHIGYYGLMMWFPEMFNRFDEYAKIHDGAEAGVCEVVDYVVSSGSHSASVLCSDKISSSVFLESLITVSAALPSNIVAVLGMDKLGRKFFLVFSTVSSGLCSACMYFVYNKTHNLIVSAIFSSVISCGNAALDSLITEIFPTHLRATGIAVSMVAARLGGIIGNIVIAQLLDLYCPAPTFIVTGLLIGGGLLCLFLPNTTQKPLQ

SEQ ID NO: 21757 - protein, 407 aa, Diabrotica virgifera
  misc_feature: Coding regions on vcDNA: vcDNA=SeqID_1454; Strand=+; Position=56-1279
  misc_feature: Homolog annotation: Hit_ID=XP_534640.1; Match level="QueryCoverage =93%, HitCoverage=31%, E-value=0.0, Identity=95%"; Hit description =PREDICTED: similar to UBC protein [Canis familiaris]
  misc_feature: Pfam annotation: Pfam_ID=ubiquitin; Match level="Score=730.8, E-value= 7.6e-217, Copies=5"; Pfam description=Ubiquitin family
MGVSKFLLLLGALFCAIVAIQANNYGMQIFVKTLTGKTITLEVEPSDTIENVKGKVQDKEGIPPDQQRLIFVGKQLEDSRTLSDYNIQKESTLHLVLRLRGGMQIFVKTLTGKTITLEVEPSDTVENVKAKIQDKEGIPPDQQRLIFAGKQLEDLRTLSDYNIQKESTLHLVLRLRGGMQIFVKTLTGKTITLEVEPSDTIENVKGKIQDKEGIPPDQQRLIFAGKQLEDLRTLSDYNIQKESTLHLVLRLRGGMQIFVKTLTGKTITLEVEPSDTVENVKAKIQDKEGIPPDQQRVIFAGKQLEDIRTLSVYNIQKESTLHLVLRLRGGMQIFVKTLTGKTTTLEVEPSDTIENVKGKIQDKEGIPPDQQRLIFAGKQLEDNRSLSDYNIQKESTLHLVLRLRGGK

SEQ ID NO: 21758 - protein, 452 aa, Diabrotica virgifera
  misc_feature: Coding regions on vcDNA: vcDNA=SeqID_1455; Strand=+; Position=122-1475
  misc_feature: Homolog annotation: Hit_ID=NP_066289.1; Match level="QueryCoverage =99%, HitCoverage=100%, E-value=0.0, Identity=97%"; Hit description =ubiquitin C [Homo sapiens] dbj|BAC56951.1| polyubiquitin C [Homo sapiens] gb|AAH39193.1|
  misc_feature: Pfam annotation: Pfam_ID=ubiquitin; Match level="Score=873.5, E-value= 8.6e-260, Copies=6"; Pfam description=Ubiquitin family
  misc_feature (393)..(393): Xaa can be any naturally occurring amino acid
  misc_feature (411)..(411): Xaa can be any naturally occurring amino acid
  misc_feature (420)..(420): Xaa can be any naturally occurring amino acid
  misc_feature (427)..(427): Xaa can be any naturally occurring amino acid
  misc_feature (439)..(439): Xaa can be any naturally occurring amino acid
  misc_feature (444)..(444): Xaa can be any naturally occurring amino acid
MQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTTTLEVEPSDTIENVKGKIQDKEGIPPDQQRLIFAGKQLEDSRTLSDYNIQKESTLHLVLRLRGGMQIFVKTLTGKTXTLEVEPSDTIENVKAKIXRQEGIPPDXQRLIFAXKQLEDSRTLSDXHIQKXSTLHLYFV

SEQ ID NO: 21759 - protein, 330 aa, Diabrotica virgifera
  misc_feature: Coding regions on vcDNA: vcDNA=SeqID_1456; Strand=+; Position=1-993
  misc_feature: Homolog annotation: Hit_ID=EAL34545.1; Match level="QueryCoverage =91%, HitCoverage=45%, E-value=1e-120, Identity=68%"; Hit description= GA20303-PA [Drosophila pseudoobscura]
  misc_feature: Gene Ontology Annotation: Molecular function=protein binding; Cellular component=actin filament; Biological process=nonselective vesicle transport
  misc_feature: Pfam annotation: Pfam_ID=Vps52; Match level="Score=203.4, E-value =4.5e-58, Copies=1"; Pfam description=Vps52 / Sac2 family
AMSKIRSYLLEQISKFRKPMTNYQIPQNNLLKNKGHYEFLLSNERNIAEEIANEYIDTMSKIYYSYFKSYEARIMKLQYEENITVDDLMGIEDTATRGMFNKSLKHKTTVFSIGNRGDVLAQQLEAPIIVPHAETKNRFPFEALFRSVEYALVDNACREYLFISEYFIVKNQSALDLFYKIMEKTLTLLTKNLKSYISSCYDSIAIFLCFHLVLRYKIMCHKRCVPALDQYWDILENILLPRFEYVVQLNIKSIRDCDVTKFNLELGPHYIARRYAEFSAAICSISENFYYELFSKLLARLKIYLSVPTFSSITYYSNFRVIHQHESSLA

SEQ ID NO: 21760 - protein, 149 aa, Diabrotica virgifera
  misc_feature: Coding regions on vcDNA: vcDNA=SeqID_1457; Strand=+; Position=182-632
  misc_feature: Homolog annotation: Hit_ID=NP_958475.1; Match level="QueryCoverage =67%, HitCoverage=30%, E-value=2e-16, Identity=41%"; Hit description =nucleosome assembly protein 1, like 1 [Danio rerio] gb|AAH44152.1| Nucleosome assembly protein
  misc_feature: Gene Ontology Annotation: Molecular function=chaperone activity; Cellular component=chromatin assembly complex; Biological process =nucleosome assembly
  misc_feature (132)..(132): Xaa can be any naturally occurring amino acid
MLRCLHSYLPQSCVVLVRFLKYLLRATTFCYMATENEQGDCPDDLESVEEEEVDGSKQLDFPNVYAALQSQRNAAMLALLPTSVKRRIKALKRIQLEATNIEAKFFKERPHLKCKYHKLYQPLYEKRNTIVXSPYEPTDEESPSSYEND

SEQ ID NO: 21761 - protein, 367 aa, Diabrotica virgifera
  misc_feature: Coding regions on vcDNA: vcDNA=SeqID_1458; Strand=+; Position=1250 -2353
  misc_feature: Homolog annotation: Hit_ID=AAH43903.1; Match level="QueryCoverage =99%, HitCoverage=97%, E-value=1e-113, Identity=52%"; Hit description= Nap1l1-prov protein [Xenopus laevis]
  misc_feature: Gene Ontology Annotation: Molecular function=chaperone activity; Cellular component=chromatin assembly complex; Biological process =nucleosome assembly
  misc_feature: Pfam annotation: Pfam_ID=NAP; Match level="Score=499.1, E-value=4.3e -147, Copies=1"; Pfam description=Nucleosome assembly protein (NAP)
MATENEQGDCPDDLESVEEEEVDGSKQLDFPNVYAALQSQRNAAMLALLPTSVKRRIKALKRIQLEATNIEAKFFKEVHNLECKYHKLYQPLYEKRNTIVSGQYEPTDEESQWSSDDESDLPEAIKEKIKLDDSKKETEPQDEKGVPDFWLTIFRNVGLLSEMVQPHDVPILKHLNDIKIICKEDPMKFILEFHFSTNEYFTNTVLTKEYDMKCAPEDDDPFSFEGPEIFKCAGCIINWNKGKNVTVKTVKKKQKHKSRGVIRTITKTVQNDSFFNFFSPPTIPDDAKEEDVDEDLRNLLTTDFEIGHYIRERIVPRAVLFFTGEACEDEDDFEEEEEEDDEEDDGDSDDKEVATKVNKDQQNCKQQ

SEQ ID NO: 21762 - protein, 103 aa, Diabrotica virgifera
  misc_feature: Coding regions on vcDNA: vcDNA=SeqID_1459; Strand=-; Position=407-718
RVSEISSWYTGLLTVKSIFITMKKYRKCVQMVTFPENGANQRYVARQLNVNHSTMQRTYQRYLETRFHQQRLDMGAKRETIVGELNTILLLFYCIGLQKYIFI

SEQ ID NO: 21763 - protein, 344 aa, Diabrotica virgifera
  misc_feature: Coding regions on vcDNA: vcDNA=SeqID_1460; Strand=+; Position=17-1051
  misc_feature: Homolog annotation: Hit_ID=XP_316461.1; Match level="QueryCoverage =96%, HitCoverage=88%, E-value=4e-93, Identity=48%"; Hit description =ENSANGP00000004185 [Anopheles gambiae]
  misc_feature: Gene Ontology Annotation: Cellular component=endoplasmic reticulum; Biological process=aging
  misc_feature: Pfam annotation: Pfam_ID=Glyco_hydro_1; Match level="Score=319.8, E -value=4.2e-93, Copies=1"; Pfam description=Glycosyl hydrolase family 1
MSVKYMLWAFLLVGITVCDTELNKKRFPKDFMFGVATSSYQIEGAWNEDGKGESTWDHFVHQTPSPIVNNYTGDVACDSYHKMKEDVALLKYLGVKHYRFSLSWSRILPTGYTNKINQAAIKYYKSLIRELTDNGIEPVVTILHCDTPQALEDMGGWTTDWIIDRYVEYAAVCFENFGADVKYWLTFNEAFYMCTLGYGTGTQAPGRKASGIGDYICGHNIIKAHAKAFHLYNDTYRPVQKGSVGISLVSIYAEPKSDSDEDKEAAERMIYFNFGWFASPIMFGSYPYQMEITINERSVVQGFAQSRLPSFTEEEKAYIAGTVDYFGVNYYSSVVAENLPDFKI

SEQ ID NO: 21764 - protein, 101 aa, Diabrotica virgifera
  misc_feature: Coding regions on vcDNA: vcDNA=SeqID_1461; Strand=+; Position=73-378
  misc_feature: Homolog annotation: Hit_ID=NP_611420.1; Match level="QueryCoverage =72%, HitCoverage=92%, E-value=6e-10, Identity=38%"; Hit description =CG10460-PA [Drosophila melanogaster] gb|AAF57567.1| CG10460-PA [Drosophila melanogaster]
MIFKVFLFALFVAVVMAEQTAEEAWPQYKKDFNRSYDAAEDAERFAIFKEKYNQIQEQNRQYAAGKSTWTAGVNDFTDRKPEELKHLHGLRVPEGNAAGLH

SEQ ID NO: 21765 - protein, 250 aa, Diabrotica virgifera
  misc_feature: Coding regions on vcDNA: vcDNA=SeqID_1462; Strand=+; Position=116-868
MSDEGGPNVKSLRDFRYQKKPLLTQDGLSLSSSPSSESRPRSRILPVSSDSDTETETTTKTIHPETATKTTEPANIAQPAPTTTTTTTDPVNTAEPPQNEIISEMKWSEVDTSVSTDSVANSSLAQKSDTVSNAAQQSVPQPVTPVQVANNSIVTMKFNGSYTPRTTKNPSVLEKEKQMKFLLEIFPNLDAMKIHNCLSKHSFNTDAAAAELSKFYNKPVDHAYTDWRQDHDKKIEEAKKYELPNTQLSI

SEQ ID NO: 21766 - protein, 285 aa, Diabrotica virgifera
  misc_feature: Coding regions on vcDNA: vcDNA=SeqID_1463; Strand=+; Position=75-931
  misc_feature: Homolog annotation: Hit_ID=EAL27179.1; Match level="QueryCoverage =85%, HitCoverage=69%, E-value=1e-75, Identity=48%"; Hit description =GA19234-PA [Drosophila pseudoobscura]
  misc_feature: Gene Ontology Annotation: Molecular function=stearoyl-CoA desaturase activity; Cellular component=mitochondrion; Biological process=lipid metabolism
  misc_feature: Pfam annotation: Pfam_ID=FA_desaturase; Match level="Score=212.0, E -value=1.1e-60, Copies=1"; Pfam description=Fatty acid desaturase
  misc_feature (254)..(254): Xaa can be any naturally occurring amino acid
  misc_feature (261)..(261): Xaa can be any naturally occurring amino acid
  misc_feature (264)..(264): Xaa can be any naturally occurring amino acid
  misc_feature (274)..(274): Xaa can be any naturally occurring amino acid
MAPLPDDSVQTTPLPRQFLREHPKAIYSDGKGRVKQDLVWLNIFKVIFYHTLAVYGIWKIVTLQSMWQTLLFNTIFYFFALIGVTGGAHRLWSHRAYKVTLPMKLLMMFICTAAYQDSIHNWARDHRLHHKYTDTDADPHNSRRGFFFCHIGWLMVKKHPDVISKGKTIDLSDIKGDRLIMLQNKYFFKIAPILGLVLPTLIPYYFWGETLSVSFLVTVVRLLLSLHATFSINSFAHLYGTKPYDRTINPTESXCLKAIAXGEXWHNYHHTFPXDYRAAEFQTTF

SEQ ID NO: 21767 - protein, 151 aa, Diabrotica virgifera
  misc_feature: Coding regions on vcDNA: vcDNA=SeqID_1464; Strand=-; Position=283-738
SFTIGFLSFTSKRLSFTGKSISFARITFPIRMRSSILIIRTSFTRNIRLPSPFIYISSTRWISAICSRIRIAVLPVICARTKRVVPSGLRHCFTFFVTRTIWSTALFCFTRYVTSITSSPFKACTARPSPRVTPSVERHFCLLLWLSYLHN

SEQ ID NO: 21768 - protein, 249 aa, Diabrotica virgifera
  misc_feature: Coding regions on vcDNA: vcDNA=SeqID_1465; Strand=+; Position=32-781
  misc_feature: Homolog annotation: Hit_ID=XP_308203.1; Match level="QueryCoverage =71%, HitCoverage=34%, E-value=5e-14, Identity=25%"; Hit description =ENSANGP00000020718 [Anopheles gambiae]
MSIGFVGDGHPSIRPNGRHASNTHIDKDSPIPITMDQSAMIAGFLMIGNTVGTPFCRKTFLGTKFSILIGILIMGAGWTLMWQSQNIFWLLGSRLLVGIGNGYCAGQVKMYISNICGEDLKQMFTKLINLYIFLGIILIYSFGPFIDFRYTSITCMLITLVVFCIILLLPTTPKELVKANKLKQARNIISKLKPGINLNTEVNKISDSLKIDNQEYFFTFDERQRSAYKFYKIHFADILSANLVVPLLR

SEQ ID NO: 21769 - protein, 280 aa, Diabrotica virgifera
  misc_feature: Coding regions on vcDNA: vcDNA=SeqID_1466; Strand=+; Position=104-942
  misc_feature: Homolog annotation: Hit_ID=XP_393678.1; Match level="QueryCoverage =86%, HitCoverage=80%, E-value=1e-103, Identity=76%"; Hit description= similar to COP9 signalosome subunit 6; COP9 (constitutive photomorphogenic), subunit 6
  misc_feature: Gene Ontology Annotation: Molecular function=endopeptidase activity; Cellular component=cytosol; Biological process=proteolysis and peptidolysis
  misc_feature: Pfam annotation: Pfam_ID=Mov34; Match level="Score=83.5, E-value=5.8e- 22, Copies=1"; Pfam description=Mov34/MPN/PAD-1 family
  misc_feature (258)..(258): Xaa can be any naturally occurring amino acid
MSEAKEAMEVEVETAPVAENSKSSMEVTTDTGKNVMAPGAVGSITCSLHPLVIMNVSEHWTRERAQEGAVQQVIGALIGKQKGRNIEVMNSFELVFTLIGGDIVIDKDYYNMKEEQFKQVFSDLDFIGWYTTGDAPSEMDIKVHKQICEINESPILLKLNPYDKNIEHLPVNLYESVIDLVNGEATMLFVSLTYTLATEEAERIGVDHVARMSATDSGESSLVAEHLTAQHSAIKMLHSRVRLVLEYMKAVQSGHCRXNHEVLRDAFSLCHRLPVIDGSR

SEQ ID NO: 21770 - protein, 99 aa, Diabrotica virgifera
  misc_feature: Coding regions on vcDNA: vcDNA=SeqID_1467; Strand=+; Position=1-300
  misc_feature: Homolog annotation: Hit_ID=NP_609453.1; Match level="QueryCoverage =93%, HitCoverage=100%, E-value=6e-29, Identity=65%"; Hit description= CG17127-PA [Drosophila melanogaster] gb|AAF53010.1| CG17127-PA [Drosophila melanogaster]
RTRGSTMKFFICLAFIGFVAAFPQKEGSAYTQEAIRQAQNTFLIPKDAQIQKVQEGIEIGAYESIPGNQKINLFEILGDQFPPEVVNNLQQQIDQVGRS

SEQ ID NO: 21771 - protein, 84 aa, Diabrotica virgifera
  misc_feature: Coding regions on vcDNA: vcDNA=SeqID_1468; Strand=+; Position=1-255
TEKATKIMHSIASLAQKEYRISFRQMRIYLSTILASIVGYGSSVWAHRLIKKKKKKKYKKKKNKRIKICSVPIKILLNFFVMQC

SEQ ID NO: 21772 - protein, 130 aa, Diabrotica virgifera
  misc_feature: Coding regions on vcDNA: vcDNA=SeqID_1469; Strand=+; Position=196-589
  misc_feature: Homolog annotation: Hit_ID=XP_395877.1; Match level="QueryCoverage =98%, HitCoverage=100%, E-value=2e-31, Identity=52%"; Hit description= similar to ENSANGP00000014819 [Apis mellifera]
  misc_feature: Pfam annotation: Pfam_ID=DUF953; Match level="Score=168.8, E-value =1.2e-47, Copies=1"; Pfam description=Eukaryotic protein of unknown function
  misc_feature (103)..(103): Xaa can be any naturally occurring amino acid
MVRSHHVEGYDNFVNFMKNFKAQGTVVCIYFGGSVDEATGESWCDDCVRAWPVISKVLEQLDDNVDFIHVEVGDRPTWKDPNSSFRKDPTTKLLVLPTLLKWXTPKRLEGSQCEKEFLVKMLLCDDDDED

SEQ ID NO: 21773 - protein, 83 aa, Diabrotica virgifera
  misc_feature: Coding regions on vcDNA: vcDNA=SeqID_1470; Strand=+; Position=456-707
ISASRHLAHWNGISTFISHFLSNGSFTLPRLYRWFLKRQCSITILVDDLISRLLRWIKLLEFFTNILDYFLVLICPCVVLHFF

SEQ ID NO: 21774 - protein, 455 aa, Diabrotica virgifera
  misc_feature: Coding regions on vcDNA: vcDNA=SeqID_1471; Strand=+; Position=153-1521
  misc_feature: Homolog annotation: Hit_ID=EAL26669.1; Match level="QueryCoverage =99%, HitCoverage=66%, E-value=1e-134, Identity=51%"; Hit description= GA13505-PA [Drosophila pseudoobscura]
  misc_feature: Gene Ontology Annotation: Molecular function=beta-glucuronidase activity; Cellular component=lysosome; Biological process =glycosaminoglycan catabolism
  misc_feature: Pfam annotation: Pfam_ID=Glyco_hydro_2_N; Match level="Score=174.4, E- value=2.5e-49, Copies=1"; Pfam description=Glycosyl hydrolases family 2, sugar b
  misc_feature (418)..(418): Xaa can be any naturally occurring amino acid
MMLIAVIFSIFVQLCSSEIHRGGILYPRNTETRQVISLDGLWNFIVPNVTNPFVGFENHWYRSSLKEVLNFDVQLMPVPASYNDITTDARIRDHVGLVWYDRFFFVPKSWEETERVWIRFGSVSYAAQVWINGELVMSHEIGHLPFASEITSFVKFGKENLITVACDNTLLPDTVPQGKVEELVSGRLDQTYTFDFFNYAGIDRPVFLYTTPKTYIDDIFISTVDVKENIALLEYNITVVGDNSLSSKICRVSLIDRSRKVAFSSQDNCGFYGVMKIENPNLWWPYLMDDDPGYLYNFQVDIFDQDLTPVDQYFLPVGIRTLTWTNSSFLINNKPLYLHGFGRHEDSDIRGKGLDLPLVIKDHNLIKWIGANAYRTSHYPYAEEIMDVADEIGIMIIDECPSVNTDIFTGSLLAKHKXPLTELIKRDKNRPAVILWSAANEPRTAAPAAKNYFRK

SEQ ID NO: 21775 - protein, 293 aa, Diabrotica virgifera
  misc_feature: Coding regions on vcDNA: vcDNA=SeqID_1472; Strand=+; Position=100-978
  misc_feature: Homolog annotation: Hit_ID=XP_310708.1; Match level="QueryCoverage =84%, HitCoverage=56%, E-value=2e-43, Identity=38%"; Hit description =ENSANGP00000022051 [Anopheles gambiae]
  misc_feature: Gene Ontology Annotation: Molecular function=molecular_function unknown; Cellular component=cellular_component unknown; Biological process=biological_process unknown
  misc_feature: Pfam annotation: Pfam_ID=ubiquitin; Match level="Score=13.8, E-value =0.0058, Copies=1"; Pfam description=Ubiquitin family
MSGASVCVLALNGRRQTVKCTPNTTILQILEEVCKKQNLKPEDYDLKHHNKILDTTSTFRFSGLPNNAQLELVSATKARLDTEVTLAVNLENGSRLIGNFNPSETLFNILTKMCPECLGDNRSPVVIYTRREMYGQELNSVTLKSLGLTGGRAMIRVIDKDPEDLKQQANVSSIIPSKPVEEKPYIRKYQPTEPNVDSINNQDNSDKTDGQPTNVEKVQKKQNVDLIQLAREKRKSNEFPPKLLEGHKDVPEKQSKVSNTQNKGYICEHKKWKWMSAPPNENVTEKMMIERRT

SEQ ID NO: 21776 - protein, 294 aa, Diabrotica virgifera
  misc_feature: Coding regions on vcDNA: vcDNA=SeqID_1473; Strand=+; Position=52-936
  misc_feature: Homolog annotation: Hit_ID=AAH41285.1; Match level="QueryCoverage =80%, HitCoverage=84%, E-value=2e-48, Identity=39%"; Hit description =MGC53558 protein [Xenopus laevis]
  misc_feature: Gene Ontology Annotation: Molecular function=protein binding; Cellular component=lateral plasma membrane; Biological process =establishment and/or maintenance of epithelial cell polarity
  misc_feature: Pfam annotation: Pfam_ID=LRR_1; Match level="Score=60.8, E-value=3.8e- 15, Copies=4"; Pfam description=Leucine Rich Repeat
MAPKVNVKERYNDGEVDLSMSDLSEVPVKEILSLKPVHSLDLSNNTLTVLPKNFTSLTHLTTLDLSKNDLKELPEDFGNLTKLRHLDLYRNQLQHLPLSFSKLKNLKWLDLKDNPLVPAVAKVAGLCINTKECQNCAKNIVAFFNKLENQVSADLEMRNKDRQKQLEFNQKKKQEEKNSKKKEKQKEKKSNVKVVEPTKQNQKVSSKGKSKKVKEEDSIFGSILSSILGWALLMLVLYVGFIFYKVYGSKNVLDSARDVFIDLHKLYDDAPNFWWYHQRNICKILYKIFTLDNI

SEQ ID NO: 21777 - protein, 290 aa, Diabrotica virgifera
  misc_feature: Coding regions on vcDNA: vcDNA=SeqID_1474; Strand=+; Position=105-974
  misc_feature: Homolog annotation: Hit_ID=NP_609401.2; Match level="QueryCoverage =96%, HitCoverage=89%, E-value=4e-80, Identity=55%"; Hit description =CG5188-PA [Drosophila melanogaster] gb|AAF52949.2| CG5188-PA [Drosophila melanogaster]
  misc_feature: Gene Ontology Annotation: Molecular function=methionyl aminopeptidase activity; Cellular component=cytosolic ribosome (sensu Eukarya); Biological process=proteolysis and peptidolysis
  misc_feature: Pfam annotation: Pfam_ID=Peptidase_M24; Match level="Score=176.9, E -value=4.4e-50, Copies=1"; Pfam description=metallopeptidase family M24
  misc_feature (289)..(289): Xaa can be any naturally occurring amino acid
MNSSKIYSVFTYRNLFWKRKKSYFGKYNVVSPGNVSPMLTVPEEIEKPSYSSSGKPGPSPDFAEIKNVHQIHKMMDSCKLAADILKKVENIIKVGIKTDEIDIFVFNSCLANNAYPSPLNYNNFPKSVCTSINNVACHGIPDDRPLEDGDIINVDITVYYNGYHGDCSKTFLVGNVDDEGKQLVEATKVCLNEAISICKPGTYFRDIGFCIQEKAEKLGFQIIPSFIGHGIGSYFHGPPDIYHMKNNYPGRMGSGMTFTIEPILTQGDQYIVILDDNWTAITEDNARTXQ

SEQ ID NO: 21778 - protein, 138 aa, Diabrotica virgifera
  misc_feature: Coding regions on vcDNA: vcDNA=SeqID_1475; Strand=+; Position=56-472
  misc_feature: Homolog annotation: Hit_ID=NP_609366.2; Match level="QueryCoverage =79%, HitCoverage=44%, E-value=1e-21, Identity=45%"; Hit description =CG4957-PA [Drosophila melanogaster] gb|AAF52894.2| CG4957-PA [Drosophila melanogaster]
  misc_feature: Gene Ontology Annotation: Molecular function=molecular_function unknown; Cellular component=cellular_component unknown; Biological process=biological_process unknown
  misc_feature: Pfam annotation: Pfam_ID=DUF28; Match level="Score=-113.4, E-value =0.00022, Copies=1"; Pfam description=Domain of unknown function DUF28
MLKQFLRPFSLSYESYNKHIVVQSKRFAGHSKWANIRHIKGAKDAERSRLFTKLGRQIKVAVQEGGSVDPKKNLQLNQVIEQTRRANMPAATVQSILKSCESSKSQDKSYMLEIKGPGSCFILCEVYTSHLTWFKDDT

SEQ ID NO: 21779 - protein, 322 aa, Diabrotica virgifera
  misc_feature: Coding regions on vcDNA: vcDNA=SeqID_1476; Strand=+; Position=94-1062
  misc_feature: Homolog annotation: Hit_ID=EAA14496.3; Match level="QueryCoverage =86%, HitCoverage=83%, E-value=6e-72, Identity=52%"; Hit description =ENSANGP00000021059 [Anopheles gambiae str. PEST] ref|XP_553403.1| ENSANGP00000021059 [Anopheles gambiae st
  misc_feature: Gene Ontology Annotation: Molecular function=glyoxylate reductase (NADP) activity; Cellular component=cellular_component unknown; Biological process=metabolism
  misc_feature: Pfam annotation: Pfam_ID=2-Hacid_dh_C; Match level="Score=122.7, E -value=9.1e-34, Copies=1"; Pfam description=D-isomer specific 2 -hydroxyacid dehyd
MTLAKMNFLRIGLLLFFVISFSSVLGKARQSKMNNFKVLVTNPTVPDSGITLLNDNGCNVTQLQTESRENILKNVRGMDALFWASGIKLDSEVLDAAGPQLKTIGLMSAGYNHVDVEELRKRGIRMGNTPKVLNDAVADIAILLTLAASRRLHEARLSIENGNWVTNDWAWMCGQDITNSTVGIIGLGHIGQTIARRLKGFDIQQLLYTGHKEKKEGIELGAKFGSLNTLLKDSDFVIMVVPLTTETPHMCNEEFFSKMKNTAVFFIVSKGEVVDQPTLINALKRHTIFAAGLDVMTPEPLPSNPALLTLPNVVSDDTSLHL

SEQ ID NO: 21780 - protein, 41 aa, Diabrotica virgifera
  misc_feature: Coding regions on vcDNA: vcDNA=SeqID_1477; Strand=+; Position=47-172
MAVFIDQELLTTANYFTWYSIFYRTSDFLFIHPVDLFTLYR

SEQ ID NO: 21781 - protein, 307 aa, Diabrotica virgifera
  misc_feature: Coding regions on vcDNA: vcDNA=SeqID_1478; Strand=+; Position=51-971
  misc_feature: Homolog annotation: Hit_ID=EAL41052.1; Match level="QueryCoverage =97%, HitCoverage=59%, E-value=6e-52, Identity=36%"; Hit description =ENSANGP00000029469 [Anopheles gambiae str. PEST] ref|XP_559120.1| ENSANGP00000029469 [Anopheles gambiae st
  misc_feature (253)..(253): Xaa can be any naturally occurring amino acid
  misc_feature (300)..(300): Xaa can be any naturally occurring amino acid
MHRENIKWEPIPYDPDFNGPLRKRSCTDILCLMIFLVFIGAWIGIGIYAYTNGNPSTLLVPRDTLGRRCGRDTDVLNKPYLLFHDITKCLDPSTPFTGCKTPQVCVSSCPSEFKYYLDRKTNDCGEYLFEGTDCPPYVLPSTSLQKRCIPNVAKIDENMLKQIGESLGNLKKAVNNIKLLYDFQEIGQNVIEDLIKCWWKIAIGVVIALVVCLFYIFILRWFAGPLVWLSIIGVVIGLGAGLYFSIVQYKHAXKRPRRQRQNAIRRRKGTARKTIKTNKDLWLTCVVILAIVLVVILLIXLVLRKRI

SEQ ID NO: 21782 - protein, 133 aa, Diabrotica virgifera
  misc_feature: Coding regions on vcDNA: vcDNA=SeqID_1479; Strand=-; Position=0-398
CQIIPIINIPKESKINNQNKCGIGHLIQSRTISGHQIHKRHIQRRTTRQIYGPIHTNTKPHNRSGLRTPTSGNTNLSNQIHKINEESDTYPESDYQWTPDLYRSISKEERSGKFMDQFLLILNKLNYWIPMVT

SEQ ID NO: 21783 - protein, 74 aa, Diabrotica virgifera
  misc_feature: Coding regions on vcDNA: vcDNA=SeqID_1480; Strand=+; Position=2-226
KEIFQRCVSVYLLRLVFPNRLHWFSYCELSIISFLPFVNISFCFTGFTVLINLCTHFYYKVTNTEPVKKRNYVC

SEQ ID NO: 21784 - protein, 92 aa, Diabrotica virgifera
  misc_feature: Coding regions on vcDNA: vcDNA=SeqID_1481; Strand=+; Position=71-349
  misc_feature: Homolog annotation: Hit_ID=XP_321047.1; Match level="QueryCoverage =98%, HitCoverage=75%, E-value=2e-14, Identity=38%"; Hit description =ENSANGP00000011351 [Anopheles gambiae] gb|EAA01460.1| ENSANGP00000011351 [Anopheles gambiae
MKFLRSTVCYIAILAILFTLCADEVEGRRKILMGRKSITRTYLRGNAVPAYVIIILVGIGQIILGGILYVALRKKIIAAPVTASYAVARQEP

SEQ ID NO: 21785 - protein, 551 aa, Diabrotica virgifera
  misc_feature: Coding regions on vcDNA: vcDNA=SeqID_1482; Strand=+; Position=61-1716
  misc_feature: Homolog annotation: Hit_ID=XP_312164.1; Match level="QueryCoverage =96%, HitCoverage=95%, E-value=0.0, Identity=79%"; Hit description =ENSANGP00000022161 [Anopheles gambiae]
  misc_feature: Gene Ontology Annotation: Molecular function=chaperone activity; Cellular component=cytoskeleton; Biological process=protein folding
  misc_feature: Pfam annotation: Pfam_ID=Cpn60_TCP1; Match level="Score=539.0, E -value=4.2e-159, Copies=1"; Pfam description=TCP-1/cpn60 chaperonin family
MFGGGRAPILVLSQNTKRESGRKVQLENINAGKQIADVIRTCLGPQAMLKMLMDPMGGIVMTNDGNAILREITVQHPAAKSMIEIARTQDEEVGDGTTSVIVLAGEMLVAAEQFLEQHIHPTIIIRQYRQALEDMIQLLEGPLSIPVDRNDKNALAQVVKGCIGTKFISKWSDLAVNIALDAVNTVLLEENGRTEVDIKRYAKVEKIPGGSIEESKILRGVMLNKDVTHPKMKRYIQNPRIILLDCALEYKKGESQTNVEISAETDFTKLLELEEEHVKRQCDEIIALKPDVVFTEKGVSDLAQHFLLKAGITAIRRVRKSDNNRIARACGATIVNRTEELQESDVGLGAGLFEIKKIGDEYFCFVVECKNPKACTILLRGASKDILNETERNLQDALQVARNIVLSPRLVPGGGAIEMAVAQRLMQKATHGPYRALAHALEIIPKTLTQNCGANTIRTLTALRAKHANHTDVNKPCLWGIDGETGELVEMDKKELWEPLAVKLQTYKTAIETAILLLRIDDIVSGSKKKGGNEPPTPSQMQQQEARGEAE

SEQ ID NO: 21786 - protein, 244 aa, Diabrotica virgifera
  misc_feature: Coding regions on vcDNA: vcDNA=SeqID_1483; Strand=+; Position=148-882
  misc_feature: Homolog annotation: Hit_ID=NP_610087.2; Match level="QueryCoverage =86%, HitCoverage=59%, E-value=6e-59, Identity=54%"; Hit description =CG9257-PA [Drosophila melanogaster] gb|AAF53959.1| CG9257-PA [Drosophila melanogaster]
MSNSIIYKLLVLSLVILLGVGGSNGQLIYAVNCGGEAHTDSFGIRYERDPLHGRIGIASDYGKRLLIGRVPPTDYILYQTERYHTNTFGYDIPVISDGDYVLVLKFCEVYFNAPDQKVFDVVLNGDHTIVADLDIFEKVGRGVAHDEYIPFNIIKGRLHVNGEESDIRGGRIRVEFIKGYKDNPKINAMYVIKGKLEDVPQLPSIPAEPSSTVEELKEESETIPKSRRPSGPKQPDHILPMIHP

SEQ ID NO: 21787 - protein, 350 aa, Diabrotica virgifera
  misc_feature: Coding regions on vcDNA: vcDNA=SeqID_1484; Strand=+; Position=3-1052
  misc_feature: Homolog annotation: Hit_ID=EAA10481.3; Match level="QueryCoverage =98%, HitCoverage=14%, E-value=1e-40, Identity=30%"; Hit description =ENSANGP00000010787 [Anopheles gambiae str. PEST] ref|XP_557638.1| ENSANGP00000010787 [Anopheles gambiae st
  misc_feature: Gene Ontology Annotation: Molecular function=extracellular matrix structural constituent; Cellular component=basal lamina; Biological process=cell surface receptor linked signal transduction
  misc_feature: Pfam annotation: Pfam_ID=Laminin_G_2; Match level="Score=102.9, E -value=8.2e-28, Copies=1"; Pfam description=Laminin G domain
PNRHNFDDVTEARFDGCIQNVTIMGQAIDLRNNIKARPVEPGCPDKWSSMVSFGQDQDHYVGWDKLPLTNEFNMSLKFRTIDDDGLILYISDPSQDNTISLSLHDGHLVLIDQKIELKSKGIFNDSKWHVVSVIHNDTYLRMDIDDQESQVTDATPPFIHAPVSSLYVGGLPRTIDPAQYSVAATTSFYGCVADLTVNGKVKNFANTTDRHAEILDKCVLDDSPEDIDHSIPDLKPLDNKGYYTTEAPPEITTNIEEGYATVRGDGGNDFRPINEVDIPRAPVTDVVTEVVPTEPTLPKRIGTLPPTTISPVTDGCALSPNPVQESVQVVGYRFGTHNGSRLECPTARGK

SEQ ID NO: 21788 - protein, 258 aa, Diabrotica virgifera
  misc_feature: Coding regions on vcDNA: vcDNA=SeqID_1485; Strand=+; Position=68-844
  misc_feature: Homolog annotation: Hit_ID=EAL28492.1; Match level="QueryCoverage =98%, HitCoverage=91%, E-value=6e-63, Identity=52%"; Hit description =GA15528-PA [Drosophila pseudoobscura]
  misc_feature: Gene Ontology Annotation: Molecular function=DNA binding; Cellular component=nucleus; Biological process=nucleobase, nucleoside, nucleotide and nucleic acid metabolism
  misc_feature: Pfam annotation: Pfam_ID=RRM_1; Match level="Score=88.6, E-value=1.6e- 23, Copies=1"; Pfam description=RNA recognition motif. (a.k.a. RRM, R
MNSNKFRTMEDEMSRFEAEISAAPILNAYGPAYIPGFGAIPPPPAPPMLIPHQVNKGVKRYDNLFLTPTSTQSAVVSAKPTLYAAPKASTQSMPQAAPTQSVDFIALQNEVEKKLKKLKNEKVSAELAISQGKASSALQSFGPEDYKRKSTKNRKLMRTAGGQTWEDSSLADWQDDDFRIFCGDLGNDVTDELLTRTFNKFPSFQRAKVIRDKRTNKSKGYGFVSFKDPADFTKAMKEMNGRYVGSRPYKAKKKYMAQ

SEQ ID NO: 21789 - protein, 143 aa, Diabrotica virgifera
  misc_feature: Coding regions on vcDNA: vcDNA=SeqID_1486; Strand=+; Position=88-519
  misc_feature: Homolog annotation: Hit_ID=XP_313849.1; Match level="QueryCoverage =81%, HitCoverage=76%, E-value=9e-17, Identity=38%"; Hit description =ENSANGP00000011648 [Anopheles gambiae]
  misc_feature: Pfam annotation: Pfam_ID=GILT; Match level="Score=88.8, E-value=1.4e -23, Copies=1"; Pfam description=Gamma interferon inducible lysosomal t
MYQNAYLRNGLIVLVILVCFGTNSNGLKVSVYYEALCPDSVRFIGRQLYPKWDQIKDYIDELEFVPFGKAIYVHHDADIVKQTSERYSFSCQHGRRECQGNKYQACALSQNKGKDVEVPLVYCIMKRIYPSSLNTAEQCARKY

SEQ ID NO: 21790 - protein, 191 aa, Diabrotica virgifera
  misc_feature: Coding regions on vcDNA: vcDNA=SeqID_1487; Strand=+; Position=48-623
  misc_feature: Homolog annotation: Hit_ID=NP_523419.1; Match level="QueryCoverage =98%, HitCoverage=93%, E-value=7e-93, Identity=90%"; Hit description =CG17060-PA [Drosophila melanogaster] gb|AAF50924.1| CG17060-PA [Drosophila melanogaster]
  misc_feature: Gene Ontology Annotation: Molecular function=RAB small monomeric GTPase activity; Cellular component=cellular_component unknown; Biological process=negative regulation of FGF receptor signaling pathway
  misc_feature: Pfam annotation: Pfam_ID=Ras; Match level="Score=344.9, E-value=1.2e -100, Copies=1"; Pfam description=Ras family
MAKKTYDLLFKLLLIGDSGVGKTCILFRFSDDAFTTTFISTIGIDFKIKTVELRGKKIKLQIWDTAGQERFHTITTSYYRGAMGIMLVYDITNEKSFENIVKWLRNIDEHANEDVEKMILGNKCDMTDKRVVSKERGETIAREHNIRFMETSAKANINIERAFSELAEAILVKTAGRDDPVDRVTVDIRPT

SEQ ID NO: 21791 - protein, 430 aa, Diabrotica virgifera
  misc_feature: Coding regions on vcDNA: vcDNA=SeqID_1488; Strand=+; Position=3-1292
  misc_feature: Homolog annotation: Hit_ID=XP_319522.1; Match level="QueryCoverage =71%, HitCoverage=41%, E-value=6e-66, Identity=44%"; Hit description =ENSANGP00000017788 [Anopheles gambiae]
  misc_feature: Gene Ontology Annotation: Molecular function=calcium ion binding; Cellular component=integral to plasma membrane; Biological process =signal transduction
  misc_feature (418)..(418): Xaa can be any naturally occurring amino acid
MKYCKIYISLLLLGACHLLTGDNEHSEDLEYFLYEDKDGNLKVERLLNSRPELLSSSGSDVKYFFFSKSNPGDEEGVEIHSNNTEKLKTTSFTTKRETIFIVHGWKDSHKADVNSHVREYILSDKLKATISALPDSIVKQTQAAIGEKEGKIDNRVRVEIIKEEEKKIKEEREEVREEKKKQKLEKDKELLVDKAPVISTEATPCLDDTALRITKKPEKVDEKEQRLQSKDFAIIETAIDTVSKEKKFIVEKEEIQELKSEMEDYKQDVEDLAKAVASQPKPEVKETKAAKRLFKSVNKMINKLDNVLVGLEKREKQLKKDLELEATDKKKEELLKIDDIIAVIHKIRDVPDQSKIEQIKNVLKRMDDDQDGSLKIEDVLKVIEIIGKENVNLSPKQIDELVDLIDKEEILEVEDKIXKALQKDKETKAK

SEQ ID NO: 21792 - protein, 334 aa, Diabrotica virgifera
  misc_feature: Coding regions on vcDNA: vcDNA=SeqID_1489; Strand=+; Position=19-1023
  misc_feature: Homolog annotation: Hit_ID=NP_651525.1; Match level="QueryCoverage =96%, HitCoverage=95%, E-value=2e-55, Identity=37%"; Hit description =CG6277-PA [Drosophila melanogaster] gb|AAF56653.2| CG6277-PA [Drosophila melanogaster]
  misc_feature: Gene Ontology Annotation: Molecular function=triacylglycerol lipase activity; Cellular component=extracellular; Biological process =triacylglycerol metabolism
  misc_feature: Pfam annotation: Pfam_ID=Lipase; Match level="Score=188.7, E-value =1.2e-53, Copies=1"; Pfam description=Lipase
MKYCKIYISLLLLGACHLLTGDNEHSEDLEYFLYEDKDGNLKVERLLNSRPELLSSSGSDVKYFFFSKSNPGDEEGVEIHSNNTEKLKTTSFTTKRETIFIVHGWKDSHKADVNSHVREYILRDHDVNIFVVDWSPIAGKGYLTAQGSMQKVGGYIADFARSLNKKYGLQLNKLKFVGHSLGAHICGCAGAALDGQVDRIVGLDPAGPLFREERTDNRIDASDAENVQIIHTNGGKMGYLAPCGDSDFYPNGGKSQPGCGFDLGGGCAHSRSYEIYAESLTSTGFVGQQCNSYEEYQKGKCTGPKASMGMFHIDKMASGSYYLKTHSKSPFHKG

SEQ ID NO: 21793 - protein, 289 aa, Diabrotica virgifera
  misc_feature: Coding regions on vcDNA: vcDNA=SeqID_1490; Strand=+; Position=40-909
  misc_feature: Homolog annotation: Hit_ID=EAL39065.1; Match level="QueryCoverage =98%, HitCoverage=91%, E-value=3e-80, Identity=51%"; Hit description =ENSANGP00000029046 [Anopheles gambiae str. PEST] ref|XP_553121.1| ENSANGP00000029046 [Anopheles gambiae st
  misc_feature: Gene Ontology Annotation: Molecular function=electron transporter activity; Cellular component=cellular_component unknown; Biological process=glucose metabolism
  misc_feature: Pfam annotation: Pfam_ID=Aldo_ket_red; Match level="Score=353.7, E -value=2.6e-103, Copies=1"; Pfam description=Aldo/keto reductase family
MAKDMNFKLLSGDLMPLVGFGTYQVRGDDLIKSVLDHALAAGYRLIDSAAVYGNEVSIGKALKELLPKHNLTRKDIFITTKLSPSNQGEQAYSALQRSLQNLDCEYLDLYLIHWPGAQGINSENKNNTVLRDESWQQMVKGVKNGLTKNIGVSNYNVKHMRELLNKNHGIKPAVNQVEWHPYYHQPELLDLLRKEGILLQAYSSLGGSNNPDLLNDKEINKIATKLGKSPAQVLLRWPLQQNIAIIPKARSKKHIDDNIDINFVIPEDDMKILNGLPQTKYAWDPDTIA

SEQ ID NO: 21794 - protein, 293 aa, Diabrotica virgifera
  misc_feature: Coding regions on vcDNA: vcDNA=SeqID_1491; Strand=+; Position=232-1113
  misc_feature: Homolog annotation: Hit_ID=AAM50785.1; Match level="QueryCoverage =97%, HitCoverage=89%, E-value=2e-79, Identity=51%"; Hit description =LD23788p [Drosophila melanogaster] dbj|BAC65097.1| glucuronyltransferase-P [Drosophila melanogaster]
  misc_feature: Gene Ontology Annotation: Molecular function =galactosylgalactosylxylosylprotein 3-beta-glucuronosyltransferase activity; Cellular component=integral to membrane; Biological process=carbohydrate
  misc_feature: Pfam annotation: Pfam_ID=Glyco_transf_43; Match level="Score=304.6, E- value=1.6e-88, Copies=1"; Pfam description=Glycosyltransferase family 43
MKKSRKIVILLSLCVVVMITQIYMITHNVKIETVNYYTKEETDLPELYVITPTFKKPEQIPELVRLSQTLLLIPKLTWLVVEDGYEKNDRVEAVLKRKIGLNYRYLLAPMPEKYRNSSYAKPKGVSNRNKGLGWIRKYAKNGVLYFADDDNTYDVKLFHEIRKTKTVSLFPVGLVTELGLSSPIVENCQFIDFYDGWIGGRKFPVDMAGFAVSVEFLLSRPNASMPYTAGYEEDGFLRSLAPFEAKEAQILASCCSEILVWHTRTVHTSPAKRNNLTTVYKNSNLPILQELIV

SEQ ID NO: 21795 - protein, 137 aa, Diabrotica virgifera
  misc_feature: Coding regions on vcDNA: vcDNA=SeqID_1492; Strand=+; Position=160-571
  misc_feature: Homolog annotation: Hit_ID=AAB92394.1; Match level="QueryCoverage =94%, HitCoverage=19%, E-value=3e-14, Identity=36%"; Hit description =putative reverse transcriptase [Drosophila subobscura]
  misc_feature (35)..(35): Xaa can be any naturally occurring amino acid
  misc_feature (37)..(37): Xaa can be any naturally occurring amino acid
  misc_feature (106)..(106): Xaa can be any naturally occurring amino acid
LPINQEHAYRAVNSTETSLHRLVKKVKNIIENKRXIXAFLDIKRIFHNTLIISITNALRPKGVDDICLNFMLRNRVENTTIHGVLSVLTRVNRGYPQDDILSPLLXNLAMDRLIGNLQANGHKTIGYSGDNMVIRDV

SEQ ID NO: 21796 - protein, 248 aa, Diabrotica virgifera
  misc_feature: Coding regions on vcDNA: vcDNA=SeqID_1493; Strand=+; Position=679-1425
  misc_feature: Homolog annotation: Hit_ID=AAL26582.1; Match level="QueryCoverage =98%, HitCoverage=98%, E-value=1e-114, Identity=85%"; Hit description= ribosomal protein S6 [Spodoptera frugiperda] sp|Q95V32|RS6_SPOFR 40S ribosomal protein S6
  misc_feature: Gene Ontology Annotation: Cellular component=cytosolic ribosome (sensu Eukarya); Biological process=protein biosynthesis
  misc_feature: Pfam annotation: Pfam_ID=Ribosomal_S6e; Match level="Score=310.6, E -value=2.4e-90, Copies=1"; Pfam description=Ribosomal protein S6e
MKLNVSYPATGCQKLFEVVDEHKIRIFYEKRMGQEVEADALGDEWKGYILKISGGNDKQGFPMKQGVLTNGRVRLLLSKGHSCYRPRRTGERKRKSVRGCIVDGNLSVLALVIVRKGEQEIPGLTDTTIPRRLGPKRASRIRKLFNLSKEDDVRQYVVKRPLAQKEGKKLRTKAPKIQRLITPVVLQRKRHRLALKKKRCLKRKEQEDAYAKLLAQRKKESKARREMLKRRRSASMRDSKSSTQSGQK

SEQ ID NO: 21797 - protein, 310 aa, Diabrotica virgifera
  misc_feature: Coding regions on vcDNA: vcDNA=SeqID_1494; Strand=+; Position=109-1039
  misc_feature: Homolog annotation: Hit_ID=XP_541574.1; Match level="QueryCoverage =99%, HitCoverage=81%, E-value=1e-44, Identity=42%"; Hit description =PREDICTED: similar to ZNF228 protein [Canis familiaris]
  misc_feature: Gene Ontology Annotation: Molecular function=DNA binding; Cellular component=nucleus; Biological process=regulation of transcription, DNA-dependent
  misc_feature: Pfam annotation: Pfam_ID=zf-C2H2; Match level="Score=114.6, E-value =2.4e-31, Copies=5"; Pfam description=Zinc finger, C2H2 type
  misc_feature (195)..(195): Xaa can be any naturally occurring amino acid
  misc_feature (210)..(210): Xaa can be any naturally occurring amino acid
  misc_feature (214)..(214): Xaa can be any naturally occurring amino acid
  misc_feature (237)..(237): Xaa can be any naturally occurring amino acid
  misc_feature (262)..(262): Xaa can be any naturally occurring amino acid
  misc_feature (284)..(284): Xaa can be any naturally occurring amino acid
MEVKQEISEETCKTEIDNHLDDALLDDFKCESEIKEESNYWQSTHDTYDSVDLKKCPINTEIEQHGNKLNLFEENQKTEKGHLQDEIKTEIMEKLIEDSSYEGNDMNRHNEGKTLNKNMQVVTEKRPYKCDTCFKQFSNVSHLKKHLRVHTGQKPYQCEICFNRFSDTSSLKRHFRLHTGAKLYKCEICFKQFSXKSSLKTHLRVHTGRXPYKXEICFKRFSVAGSLKSHLGTHTGXEKPYKVVRICFKRFSGGSNLKRTFXRLHTGDKDYKWKICFKQFSQAXNLKSHFGKHTLAEKPYRWEIWFKQFS

SEQ ID NO: 21798 - protein, 314 aa, Diabrotica virgifera
  misc_feature: Coding regions on vcDNA: vcDNA=SeqID_1495; Strand=+; Position=32-969
  misc_feature: Homolog annotation: Hit_ID=NP_724223.2; Match level="QueryCoverage =98%, HitCoverage=89%, E-value=1e-111, Identity=67%"; Hit description= CG31692-PB, isoform B [Drosophila melanogaster] gb|AAN11058.2| CG31692-PB, isoform B [Drosophila
  misc_feature: Gene Ontology Annotation: Molecular function=fructose-bisphosphatase activity; Cellular component=cytosol; Biological process =gluconeogenesis
  misc_feature: Pfam annotation: Pfam_ID=FBPase; Match level="Score=420.6, E-value =1.9e-123, Copies=1"; Pfam description=Fructose-1-6-bisphosphatase
  misc_feature (254)..(254): Xaa can be any naturally occurring amino acid
  misc_feature (260)..(260): Xaa can be any naturally occurring amino acid
  misc_feature (287)..(287): Xaa can be any naturally occurring amino acid
  misc_feature (297)..(297): Xaa can be any naturally occurring amino acid
MYVVNDGSRFVTERRMESNTITLTRFFLAEQQKFPEATGELTQLLTSIQTAVKVISSAVRRAGITKLFGTVGETNVQGEEVKKLDVLANELFINMLKSSYTVALLISEENETILEVETEHRGKYIVAFDPLDGSSNIDCLVSIGSIFAIYRKSDNTVPALDDTLMSGRNVVAAGYALYGSATMLVISSGSGVHGFMLDATIGEFVLTEHNMRIPKKGKIYSINEGYYHEWDDAIREYVDAKKDPSKGKAYGARXYVGSMXVADVHRTIKYGGIFLYPAPKSSPKGKXLKLMYEWVPXWPFLLAQAGGLATGGKN

SEQ ID NO: 21799 - protein, 337 aa, Diabrotica virgifera
  misc_feature: Coding regions on vcDNA: vcDNA=SeqID_1496; Strand=+; Position=3-1011
  misc_feature: Homolog annotation: Hit_ID=AAH88711.1; Match level="QueryCoverage =94%, HitCoverage=62%, E-value=4e-44, Identity=31%"; Hit description =Unknown (protein for IMAGE:7201876) [Xenopus laevis]
  misc_feature: Gene Ontology Annotation: Cellular component=26S proteasome
  misc_feature (279)..(279): Xaa can be any naturally occurring amino acid
  misc_feature (305)..(305): Xaa can be any naturally occurring amino acid
  misc_feature (324)..(324): Xaa can be any naturally occurring amino acid
MASREDWSAETQSKLLQEEQRVSVLNEIKDHLISIPQSEASKVANSFNIPLVFDCLNNSNTEEVDLACEVLSLFMNNLSIGESTNKYDVPLERALHHPYPGVKIMALNEIHRNVSKEEGLINVCRRISLLSSVIQCVGDSELAVAQEAAKIVSDVGISDLGLKVLVSGDIVKEIQEIMCINELTRLRVYEIVVNISKESEANLELLKSTGIVSQILEELNNNDVLLKMNIVELLTQLGLNIHGYNYLEQNGVLSKLFALIEDDEDQITVKFCEPGILKXFFGNMAHWKPTELLLKYPKIFDRLFXLIFESRDLTIVGITLDTLXGIIGGTTEGKMGF

SEQ ID NO: 21800 - protein, 258 aa, Diabrotica virgifera
  misc_feature: Coding regions on vcDNA: vcDNA=SeqID_1497; Strand=+; Position=25-801
  misc_feature: Homolog annotation: Hit_ID=XP_318578.1; Match level="QueryCoverage =89%, HitCoverage=87%, E-value=3e-89, Identity=67%"; Hit description =ENSANGP00000021064 [Anopheles gambiae]
  misc_feature: Gene Ontology Annotation: Molecular function=molecular_function unknown; Cellular component=cellular_component unknown; Biological process=proteolysis and peptidolysis
MTLVGDFEEKSEKNVNSQQNQAGTIPPDASQWGYDLYPSRKSHNDSASITDYLKGKGKENIDKIHCERNVYKCIKESPMVKLMMGALKASGCTVDIRRHISCEECAPTVSGGYDPIMNQVVICQNSATKVGAVNTVLTHEMIHMFDYCKNNVDFKNLEHLACTEIRAANLAHCSFLSALVAGDASLFYIKEAHQYCVRNKALSSVIAARNVSKEEAMVAIDKVFSKCYADLEPVGRRIRRNSADMYKAYEEGQYYGYG

SEQ ID NO: 21801 - protein, 272 aa, Diabrotica virgifera
  misc_feature: Coding regions on vcDNA: vcDNA=SeqID_1498; Strand=+; Position=130-946
  misc_feature: Homolog annotation: Hit_ID=EAA44266.2; Match level="QueryCoverage =95%, HitCoverage=67%, E-value=6e-40, Identity=34%"; Hit description =ENSANGP00000025399 [Anopheles gambiae str. PEST] ref|XP_557289.1| ENSANGP00000025399 [Anopheles gambiae st
  misc_feature: Gene Ontology Annotation: Molecular function=FK506 binding; Cellular component=integral to membrane; Biological process=biological _process unknown
  misc_feature: Pfam annotation: Pfam_ID=FKBP_C; Match level="Score=91.7, E-value =1.9e-24, Copies=1"; Pfam description=FKBP-type peptidyl-prolyl cis -trans i
  misc_feature (252)..(252): Xaa can be any naturally occurring amino acid
MSETFIEHEKSSQSVISSDSGKDILEESDVPDLEPISSSEDNISKNDEVENIPEEEKEKINEPEEPKPEWVDLLGSGAIMKKTIAEGKPDTRPQRSEKCIINYSCYLEDETLVDSADNFELNLGESDVIQGLDVSLGLMNIGEKCRLKITPRLAFGRKGLPSKIPGDSLVIYDVELVNVEPEDDVDMMPITLRKVKGNKKRERGNWWYTRGENNIAIQCYRRALDYLDEVEGGDQSKGEVSDSDLQSILEDXVSVCNNMAAAQSKWRCTVLP

SEQ ID NO: 21802 - protein, 236 aa, Diabrotica virgifera
  misc_feature: Coding regions on vcDNA: vcDNA=SeqID_1499; Strand=+; Position=279-985
  misc_feature: Homolog annotation: Hit_ID=NP_570027.1; Match level="QueryCoverage =73%, HitCoverage=40%, E-value=1e-49, Identity=52%"; Hit description =CG2713-PA [Drosophila melanogaster] gb|AAF45820.2| CG2713-PA [Drosophila melanogaster]
  misc_feature: Gene Ontology Annotation: Molecular function=molecular_function unknown; Cellular component=mitochondrial inner membrane pre -sequence translocase complex; Biological process=mitochondrial matrix protein import
  misc_feature (224)..(224): Xaa can be any naturally occurring amino acid
MMRLTRKSIQLFSNIARNHSDLLANHNKSGCALFKINIYSCNQCVFYCQSTKSTSKIEDTKPTFPLGSLLKENNDKAQEAAEEEERKKQRENSWRTMKLTLAFLGISFTCIGTYVIFTLGSPEKDSHGDPIKDDLADKPVVLQYIIRTYRELDYYRKLIKEPSREKLLPDPLEYPYLQPKYTLVLELTDVLVHPDWTYSTGWRFKKRPMVDYFLESLHGSYEIXIYTAEQGMTVFP

SEQ ID NO: 21803 - protein, 169 aa, Diabrotica virgifera
  misc_feature: Coding regions on vcDNA: vcDNA=SeqID_1500; Strand=+; Position=421-930
  misc_feature: Homolog annotation: Hit_ID=XP_393438.1; Match level="QueryCoverage =75%, HitCoverage=49%, E-value=3e-62, Identity=88%"; Hit description =similar to 40-kDa V-ATPase subunit [Apis mellifera]
  misc_feature: Gene Ontology Annotation: Molecular function=hydrogen-transporting ATPase activity, rotational mechanism; Cellular component=hydrogen -transporting ATPase V0 domain; Biological process=hydrogen transport
  misc_feature: Pfam annotation: Pfam_ID=vATP-synt_AC39; Match level="Score=-52.6, E -value=7.2e-07, Copies=1"; Pfam description=ATP synthase (C/AC39) subunit
DTLILNGFSFKINCYSLFIVLFADLLCIIITINSFGTELSKDDRAKLYPRCGRLNPDGLAALVRAEDYDQVKAVAEYYAEYSKLFEGAGNNPGDKTLEDKFFEYEVRLNINAFMQQFHFGVFYSYLKLKEQECRNIVWIAECVAQKHRAIVFLLFFLRICYVLLKHQHI

SEQ ID NO: 21804 - protein, 98 aa, Diabrotica virgifera
  misc_feature: Coding regions on vcDNA: vcDNA=SeqID_1501; Strand=+; Position=3-299
  misc_feature: Homolog annotation: Hit_ID=XP_393438.1; Match level="QueryCoverage =100%, HitCoverage=38%, E-value=3e-48, Identity=90%"; Hit description= similar to 40-kDa V-ATPase subunit [Apis mellifera]
  misc_feature: Gene Ontology Annotation: Molecular function=hydrogen-transporting ATPase activity, rotational mechanism; Cellular component=hydrogen -transporting ATPase V0 domain; Biological process=hydrogen transport
ALVRAEDYDQVKAVAEYYAEYSKLFEGAGNNPGDKTLEDKFFEYEVRLNINAFMQQFHFGVFYSYLKLKEQECRNIVWIAECVAQKHRAKIDNYIPIF

SEQ ID NO: 21805 - protein, 348 aa, Diabrotica virgifera
  misc_feature: Coding regions on vcDNA: vcDNA=SeqID_1502; Strand=+; Position=85-1131
  misc_feature: Homolog annotation: Hit_ID=CAA67343.1; Match level="QueryCoverage =100%, HitCoverage=100%, E-value=0.0, Identity=93%"; Hit description =40-kDa V-ATPase subunit [Manduca sexta] sp|Q25531|VA0D_MANSE Vacuolar ATP synthase subunit d (V-ATPase d
  misc_feature: Gene Ontology Annotation: Molecular function=hydrogen-transporting ATPase activity, rotational mechanism; Cellular component=hydrogen -transporting ATPase V0 domain; Biological process=hydrogen transport
  misc_feature: Pfam annotation: Pfam_ID=vATP-synt_AC39; Match level="Score=593.1, E -value=2.2e-175, Copies=1"; Pfam description=ATP synthase (C/AC39) subunit
MKGCVFNIDNGYLEGLCRGFKCGILKQSDYLNLVQCETLEDLKLHLQGTDYGTFLANEPSPLSVSVIDSRLREKLVIEFQHMRNQAVEPLSTFMDFITYSYMIDNIILLITGTLHQRPISELIPKCHPLGSFEQMEAIHVAATPAELYNAVLVDTPLAPFFVDCISEQDLDEMNIEIIRNTLYKAYLEAFYTFCKEIGGTTADSMCEILAFEADRRAIIITINSFGTELSKDDRAKLYPRCGRLNPDGLAALVRAEDYDQVKAVAEYYAEYSKLFEGAGNNPGDKTLEDKFFEYEVRLNINAFMQQFHFGVFYSYLKLKEQECRNIVWIAECVAQKHRAKIDNYIPIF

SEQ ID NO: 21806 - protein, 255 aa, Diabrotica virgifera
  misc_feature: Coding regions on vcDNA: vcDNA=SeqID_1503; Strand=+; Position=104-871
  misc_feature: Homolog annotation: Hit_ID=XP_319871.1; Match level="QueryCoverage =99%, HitCoverage=70%, E-value=9e-72, Identity=52%"; Hit description =ENSANGP00000010637 [Anopheles gambiae]
  misc_feature: Gene Ontology Annotation: Molecular function=Hsp70/Hsp90 organizing protein activity; Cellular component=cytoplasm; Biological process =protein folding
  misc_feature: Pfam annotation: Pfam_ID=TPR_1; Match level="Score=67.6, E-value=3.4e- 17, Copies=3"; Pfam description=Tetratricopeptide repeat
MSCPIGKDAVDKLKQFISLCKSNPDILHLPDLKFFKDYLESLGASLPETRNMPSDIKVEPKEATDTEEPVQEDVESDPESELEFDMTGCVEPDFIDDMNQKMGDPSKELSEEVTDQADEKRMEAMSQLSEGNIEKAIELFTEAIELNPTSALLFAKRGQAYLKLTKPNACIRDCTRALELNCDSAPAYKFRGRAYRLLGEWELAAKDFRQACNIDLDEQTDEWLKEVTPNAKRIEGHLLKKERKKKDKEEKEKIG

SEQ ID NO: 21807 - protein, 256 aa, Diabrotica virgifera
  misc_feature: Coding regions on vcDNA: vcDNA=SeqID_1504; Strand=+; Position=2-772
  misc_feature: Pfam annotation: Pfam_ID=DUF889; Match level="Score=36.0, E-value =4.3e-14, Copies=1"; Pfam description=Eukaryotic protein of unknown functio
DLVQIPNECVVEDVVGAIYGDIDFKFPTFPQLLADRSIICLRNDVCTEINNKMLRRLPGDIVTVYSVDNVDSDNPEDAENFSMEFLNRIKYGGLPDHELMLKVGAPVILLRNIDARSGLVNGTRLIIKQVSQNAIIADIAFGVNKGKTVFIPKFDIKCRVDTHSVNLKRRQFPVKLSFAITVNKAQGQTLEKVGICLTTPVYAHGQLYTALSRTKRMSALKVQIRTSEHQGTAKENHINRTLARNVVYESVMDRFQ

SEQ ID NO: 21808 - protein, 160 aa, Diabrotica virgifera
  misc_feature: Coding regions on vcDNA: vcDNA=SeqID_1505; Strand=+; Position=57-539
  misc_feature: Homolog annotation: Hit_ID=XP_395405.1; Match level="QueryCoverage =95%, HitCoverage=96%, E-value=7e-48, Identity=60%"; Hit description =similar to ENSANGP00000015014 [Apis mellifera]
  misc_feature: Gene Ontology Annotation: Molecular function=tubulin binding; Cellular component=cytoplasm; Biological process=tubulin folding
  misc_feature: Pfam annotation: Pfam_ID=Prefoldin; Match level="Score=87.1, E-value =4.5e-23, Copies=1"; Pfam description=Prefoldin subunit
MASISATEQKGMQQIDLTTLNVQQLSQLKHQLDNEVSLFQDSLASLKVAQGKYQTSGETLEKITAETEGQDILVPLTGSMYVPGKLHDTQNVIIDIGTRYYVEKDIEGAKDYFQRKVKFVTEQMEKVQWLGIEKSKIREAVIEIAEMKMSQQQQQQPQQS

SEQ ID NO: 21809 - protein, 211 aa, Diabrotica virgifera
  misc_feature: Coding regions on vcDNA: vcDNA=SeqID_1506; Strand=-; Position=300-935
ADAWGFNCKENCIFSISDSDDVEYYSSPTHNDFLCFCCFQWLTHENRINDNHLYVKHSIISTFLTRFCKWNCGKHFKYSEIVSHEIYCNKRNRSYNCPYTSCGIDNNSALALPDHLKIHDSIKVCASFFKLVKPPFARYVLLEDQVIGIKLTTSDKDGTQCEIIPYDNNIKSERKPHVLFLYNNKFTPLANLPLSSSPEMCTAKIVLVKND

SEQ ID NO: 21810 - protein, 382 aa, Diabrotica virgifera
  misc_feature: Coding regions on vcDNA: vcDNA=SeqID_1507; Strand=+; Position=2-1151
  misc_feature: Homolog annotation: Hit_ID=NP_727442.1; Match level="QueryCoverage =100%, HitCoverage=70%, E-value=1e-160, Identity=75%"; Hit description=CG1799-PC, isoform C [Drosophila melanogaster] ref|NP _727441.1| CG1799-PA, isoform A [Drosophila
  misc_feature: Gene Ontology Annotation: Molecular function=IMP dehydrogenase activity; Cellular component=cellular_component unknown; Biological process=GTP biosynthesis
  misc_feature: Pfam annotation: Pfam_ID=IMPDH; Match level="Score=442.9, E-value =3.7e-130, Copies=1"; Pfam description=IMP dehydrogenase / GMP reductase dom
  misc_feature (330)..(330): Xaa can be any naturally occurring amino acid
GFCGIPIKMHGKLGGKLVGIVTSRDIDFLDDINFESIKLEQIMTKLENLVTAQSGVTLTEANHILEKSKKGKLPIVNTNGSLIALMARTDLKKAKSYPIASKDENKQLIVGAALGTREDDKARLALLAQAGVDVVVLDSSQGNSSYQIDMIKFIKTTYPNLQVVAGNVVTKKQAKNLIDAGADGLRVGMGSGSICITQEVMAVGRPQATAVYKVSQYAKHFGVPVIADGGIQSIGHITKALALGASTVMMGSLLAGTSEAPGEYFFSDGVRLKKYRGMGSLEAMDRKDAMGSAMNRYFHNEVDKLKVAQGVSGSIVDKGSVLRFLPYLQXGIKHGCQDIGVKSLNDLRDSMYTGQLRFELRTHSAQAEGNVHSLFSYEKRLF

SEQ ID NO: 21811 - protein, 75 aa, Diabrotica virgifera
  misc_feature: Coding regions on vcDNA: vcDNA=SeqID_1508; Strand=-; Position=197-424
QIHRMRWRRFKIYIYNLLPMSITCLMALFQCVKKRVCIYISSLRLIRTFHNNVLIVMANKRIYLISIPLSVFKYV

SEQ ID NO: 21812 - protein, 107 aa, Diabrotica virgifera
  misc_feature: Coding regions on vcDNA: vcDNA=SeqID_1509; Strand=+; Position=651-971
  misc_feature (89)..(89): Xaa can be any naturally occurring amino acid
  misc_feature (97)..(97): Xaa can be any naturally occurring amino acid
NISSHHSNQLYFAFFLKASTIIVYCIVDRGTTINDLIAMLERKDAVWNRTADCSMRLMVGCVQPLFTASSTAKLNRKSTALVQLDCMSXPYGCERDXFVLKLQIVQR

SEQ ID NO: 21813 - protein, 316 aa, Diabrotica virgifera
  misc_feature: Coding regions on vcDNA: vcDNA=SeqID_1510; Strand=+; Position=73-1023
  misc_feature: Homolog annotation: Hit_ID=EAL26754.1; Match level="QueryCoverage =89%, HitCoverage=91%, E-value=1e-76, Identity=50%"; Hit description =GA20657-PA [Drosophila pseudoobscura]
  misc_feature: Gene Ontology Annotation: Molecular function=guanyl-nucleotide exchange factor activity; Cellular component=eukaryotic translation initiation factor 2B complex; Biological process=translational initiation
  misc_feature: Pfam annotation: Pfam_ID=IF-2B; Match level="Score=222.2, E-value =9.6e-64, Copies=1"; Pfam description=Initiation factor 2 subunit family
  misc_feature (240)..(240): Xaa can be any naturally occurring amino acid
MVNITTTNTNIREYFCKIIKDNEDVSVGVAAIRALMELIKHSKSETVQELEANLKDGIQEMKNSNYTVAGINSGCELFLRFITLASLDTSGFDECKRIMLDRGHLFIKKLDEARGKIVKLAANFIEDGSKVLTHSRSRVVLQTLRKAHKQNKKFEVFVTISEPDKSGLRMLEDLKSDGIPCTVILDSAIGYIMEQVNFIMVGAESVVESGGIVNKVGSYTMAVCAKEMKIPFYVLTESFXFSRLFPLSQQDLPEEYKYTSEIRAKSNLKEIHPLVDYTPPSYIYGLFTNLGYFNSLSPFRLVRGRKFNKNLVFGKN

SEQ ID NO: 21814 - protein, 322 aa, Diabrotica virgifera
  misc_feature: Coding regions on vcDNA: vcDNA=SeqID_1511; Strand=+; Position=45-1008
  misc_feature: Homolog annotation: Hit_ID=NP_608907.1; Match level="QueryCoverage =96%, HitCoverage=86%, E-value=3e-65, Identity=42%"; Hit description =CG5828-PA [Drosophila melanogaster] gb|AAF52219.1| CG5828-PA [Drosophila melanogaster]
  misc_feature (183)..(183): Xaa can be any naturally occurring amino acid
NELNVCPLLKNPERYNPDTLNLVENLQARNYWLPSLEQMVKKFVSKAQYLHPDDPKATEKAEVCYQDFHNLLEQLTSDPNILKPLSVRTLLEFNENNLRSKYFKDAWLVQKENESTNALSQFKSRIKQIDSIKDFHSRWFEIIQGVLAGNVFDWGAKIVIDILESNKGNFGFDEATKTIQKRXPWFSDKLDEFVDKLKVKPYKTCIIFVDNSGYDFVLGILPLAREFLSQGTKVVLTANSYPALNDVTFQELNIYCKKAADYCKIFERSLFNGKLVTVENGQKGPCLDLADLSAELCECMKSADLGIIEGMARAVHTNFYTK

SEQ ID NO: 21815 - protein, 343 aa, Diabrotica virgifera
  misc_feature: Coding regions on vcDNA: vcDNA=SeqID_1512; Strand=+; Position=376-1407
MSSTELVASQFFATDVNMDYKIPSIMTRDREETVATREISDVLDLLSNKLPTVKDYYSETDKAWSLSKQIDIKFEENVALPAHLAFGLYLNANFYTNQLKTVNKLTVFNFKMNYQSEDNKVYNTTVPIYSTKGNIDNAKLETTWITTNDIEGYSTVVINSLIDTAIAQKKLYPLNPKIRRAITDDGIYQLADEDVDMVPDVIKCLNVAAMRKPTLFSKTTYYDVNLIIANIIVTVFGNKKASHLALDIGMKRIKQVLKADNSKSFDADTVASQVRCFGYTDRIDIDDINDILRMAKSGKSFDGGLSNKAKTAGTKPIEEKGSVLSKNQRKKLNRQQRSINNNQ

SEQ ID NO: 21816 - protein, 164 aa, Diabrotica virgifera
  misc_feature: Coding regions on vcDNA: vcDNA=SeqID_1513; Strand=+; Position=230-724
  misc_feature: Homolog annotation: Hit_ID=AAL85585.1; Match level="QueryCoverage =73%, HitCoverage=44%, E-value=9e-14, Identity=34%"; Hit description =chymotrypsin-like protein [Aedes aegypti]
  misc_feature: Gene Ontology Annotation: Molecular function=serine-type endopeptidase activity; Biological process=cytoskeleton organization and biogenesis
  misc_feature: Pfam annotation: Pfam_ID=Trypsin; Match level="Score=-21.5, E-value =0.012, Copies=1"; Pfam description=Trypsin
PKVILTAGHCNKKEMFDDLQAHVGITNVDDTDHQFRHVVKIIVHPKFDEYASISSHDIAVMKLKTPLILDDRVKVAVLPKPNTDELSGNATVTGWGAIQTDPYKIYPNDLQKAIVPIVEYNDCMAKLKAEVGEDLPEYNQHCRLLLYPHTGGIRTPVMQTLEFL

SEQ ID NO: 21817 - protein, 418 aa, Diabrotica virgifera
  misc_feature: Coding regions on vcDNA: vcDNA=SeqID_1514; Strand=+; Position=3-1255
  misc_feature: Homolog annotation: Hit_ID=XP_396231.1; Match level="QueryCoverage =99%, HitCoverage=65%, E-value=1e-109, Identity=32%"; Hit description= similar to ENSANGP00000006638 [Apis mellifera]
  misc_feature: Gene Ontology Annotation: Cellular component=plasma membrane; Biological process=transmembrane receptor protein tyrosine kinase signaling pathway
  misc_feature (150)..(150): Xaa can be any naturally occurring amino acid
LIVFRHYNVTGARFKVNVTDGLHTTKDCIFHIKTEPGEMKLINNPLPIFPLQKKFLTSKHLITVVSDPYRKIEYDVVKAPSLGRLMMESEKPGIFQDISTFSQEDLNTSKVFYEHTHQFSDLYANDSFVFNVRTHLAPKLLNQLFRIDIXVSSGGLDAYMNIPKLYVDEGGTITIPLNMSGVVTFLESHAGLRSPIIHASALPPQHGQVYSQQNRNVTTFTQLQLESGQVYYEHDHSDTLGDNIYFSLYLIPGPITLCNVTVPIIVNPVNDQPFVLVTPAPSLVVVQGENRTITRHDLATEDADTPPEKLKYDVISGPSHGKLVLENISVTSFTQADIDNNKLYYVHNGTSLKDSFPFRIWDGKFRPQFNLFNVIVSPINISVKAGMVVNLLQGSYDIILSEQQFFINTNADKNRVEF

SEQ ID NO: 21818 - protein, 181 aa, Diabrotica virgifera
  misc_feature: Coding regions on vcDNA: vcDNA=SeqID_1515; Strand=+; Position=217-762
  misc_feature: Homolog annotation: Hit_ID=XP_397415.1; Match level="QueryCoverage =100%, HitCoverage=100%, E-value=1e-91, Identity=90%"; Hit description=similar to CG3204-PA [Apis mellifera]
  misc_feature: Gene Ontology Annotation: Molecular function=GTPase activity; Cellular component=membrane; Biological process=signal transduction
  misc_feature: Pfam annotation: Pfam_ID=Ras; Match level="Score=271.0, E-value=2e -78, Copies=1"; Pfam description=Ras family
MREFKVVVLGSGGVGKSALTVQFVSGCFMEKYDPTIEDFYRKEIEVDNSPCVLEILDTAGTEQFASMRDLYIKNGQGFVVVYSLTNHQTFQDIRPMKELITRVKGTERVPILLVANKVDLDHQREVDYAEGNVLSQQWGCPFIEASAKNRTNVNEVFAEIVREMNFSPEKEKPSYCWCTML

SEQ ID NO: 21819 - protein, 212 aa, Diabrotica virgifera
  misc_feature: Coding regions on vcDNA: vcDNA=SeqID_1516; Strand=+; Position=31-669
  misc_feature: Homolog annotation: Hit_ID=XP_319148.1; Match level="QueryCoverage =74%, HitCoverage=97%, E-value=4e-15, Identity=29%"; Hit description =ENSANGP00000022587 [Anopheles gambiae]
  misc_feature: Gene Ontology Annotation: Molecular function=ubiquitin conjugating enzyme activity; Biological process=regulation of exit from mitosis
  misc_feature: Pfam annotation: Pfam_ID=Cytochrom_B561; Match level="Score=42.6, E -value=1.2e-09, Copies=1"; Pfam description=Cytochrome b561
MTTSKERIFHVTEILFQQMIAVFVLLVLWQLFISNSPVNSKGTWHIILCVTGFALCMAEGVQIFRHESVVTFGNTREEKKLAHMIVMAFAFVCITIGISLKISQKEDSNRAHFTSTHGILGLITWIFSFITALGGVITMYFRHLLSPRVIKLCHILLGITTYALGVATLCYGLQYMYGTGRGWVALVVLLVVYATYSLIGPFKSIYNYLRND

SEQ ID NO: 21820 - protein, 266 aa, Diabrotica virgifera
  misc_feature: Coding regions on vcDNA: vcDNA=SeqID_1517; Strand=+; Position=276-1073
  misc_feature: Homolog annotation: Hit_ID=XP_395542.1; Match level="QueryCoverage =100%, HitCoverage=66%, E-value=6e-67, Identity=48%"; Hit description= similar to LD27255p [Apis mellifera]
  misc_feature: Pfam annotation: Pfam_ID=Vps36; Match level="Score=-1.2, E-value=3e -11, Copies=1"; Pfam description=Vacuolar protein sorting 36
  misc_feature (163)..(163): Xaa can be any naturally occurring amino acid
MNRIKYASPLLLDGEATVAVENNVRLYDGDQKTSFEGGELIITTHRILWGRQGQIARGQTCLALHLHLVVFLEEESPSAFSFSRSRKVVVHLTETNDYSNGPQLTSIYNFIKLSFREGYTNHVPSILNDLLQNRPWEPKISIVPSVQVTVQRPIVPTIKPRLXIVGIERSIQAKQKETDESITLAFQDLDKLMVMAKDMVNISRTISTKIKEKQGDITEDETIRFKSYLLSLGIDDPVTRDSYKSDNQYYQSLARQICNFIQKHVE

SEQ ID NO: 21821 - protein, 207 aa, Diabrotica virgifera
  misc_feature: Coding regions on vcDNA: vcDNA=SeqID_1518; Strand=+; Position=92-715
  misc_feature: Homolog annotation: Hit_ID=XP_314051.1; Match level="QueryCoverage =92%, HitCoverage=99%, E-value=1e-102, Identity=95%"; Hit description= ENSANGP00000015684 [Anopheles gambiae] gb|EAA44533.2| ENSANGP00000024640 [Anopheles gambiae
  misc_feature: Gene Ontology Annotation: Molecular function=ATP binding; Cellular component=cytosol; Biological process=cell-matrix adhesion
  misc_feature: Pfam annotation: Pfam_ID=Ras; Match level="Score=323.7, E-value=2.7e -94, Copies=1"; Pfam description=Ras family
MFCCCSDKEDYGKGPMAAIRKKLVIVGDGACGKTCLLIVFSKDQFPEVYVPTVFENYVADIEVDGKQVELALWDTAGQEDYDRLRPLSYPDTDVILMCFSVDSPDSLENIPEKWTPEVKHFCPNVPIILVGNKKDLRNDPTTINELKKMKQEPVKPQDGRSMAEKINAFAYLECSAKSKEGVREVFENATRAALQVKKKKKPRCVMF

SEQ ID NO: 21822 - protein, 192 aa, Diabrotica virgifera
  misc_feature: Coding regions on vcDNA: vcDNA=SeqID_1519; Strand=+; Position=260-838
  misc_feature: Homolog annotation: Hit_ID=XP_314051.1; Match level="QueryCoverage =99%, HitCoverage=99%, E-value=1e-102, Identity=95%"; Hit description= ENSANGP00000015684 [Anopheles gambiae] gb|EAA44533.2| ENSANGP00000024640 [Anopheles gambiae
  misc_feature: Gene Ontology Annotation: Molecular function=ATP binding; Cellular component=cytosol; Biological process=cell-matrix adhesion
  misc_feature: Pfam annotation: Pfam_ID=Ras; Match level="Score=323.7, E-value=2.7e -94, Copies=1"; Pfam description=Ras family
MAAIRKKLVIVGDGACGKTCLLIVFSKDQFPEVYVPTVFENYVADIEVDGKQVELALWDTAGQEDYDRLRPLSYPDTDVILMCFSVDSPDSLENIPEKWTPEVKHFCPNVPIILVGNKKDLRNDPTTINELKKMKQEPVKPQDGRSMAEKINAFAYLECSAKSKEGVREVFENATRAALQVKKKKKPRCVMF

SEQ ID NO: 21823 - protein, 257 aa, Diabrotica virgifera
  misc_feature: Coding regions on vcDNA: vcDNA=SeqID_1520; Strand=+; Position=106-879
  misc_feature: Homolog annotation: Hit_ID=XP_320012.1; Match level="QueryCoverage =92%, HitCoverage=26%, E-value=3e-47, Identity=39%"; Hit description =ENSANGP00000010518 [Anopheles gambiae]
  misc_feature: Gene Ontology Annotation: Molecular function=actin binding; Cellular component=actin cytoskeleton; Biological process=nurse cell/oocyte transport (sensu Insecta)
  misc_feature: Pfam annotation: Pfam_ID=Gelsolin; Match level="Score=42.3, E-value =1.4e-09, Copies=2"; Pfam description=Gelsolin repeat
MQVLELQHDDYDDSSVYDIGSIDTAFRKINKNSTNFLIWKVENMNIIAIPKDQYGTFYTSDSYVIYAASLYGQSCGVDMVSKETKGSIEHHVHFWLGSQTNPDRSGVAAYKTVEVDNYLNGHAVQHRETEGYESARFLSYFKNGIRILKPEIINDCQPVKLYRVRGKRIPVVKEMPSVSWEHFNSQDIFVIKTPKIIFVWSGRAADAVEKLHATTIVEDMKEKHKIANLAFVDDGYEKTLQDDIKKEFNKYLHWKNE

SEQ ID NO: 21824 - protein, 261 aa, Diabrotica virgifera
  misc_feature: Coding regions on vcDNA: vcDNA=SeqID_1521; Strand=+; Position=82-867
  misc_feature: Homolog annotation: Hit_ID=XP_396981.1; Match level="QueryCoverage =84%, HitCoverage=58%, E-value=3e-82, Identity=65%"; Hit description =similar to Insulin-degrading enzyme (Insulysin) (Insulinase) (Insulin protease) [Apis
  misc_feature: Gene Ontology Annotation: Molecular function=signal transducer activity; Cellular component=soluble fraction; Biological process =cell-cell signaling
  misc_feature: Pfam annotation: Pfam_ID=Peptidase_M16; Match level="Score=206.0, E -value=7.5e-59, Copies=1"; Pfam description=Insulinase (Peptidase family M16)
MYCLRHTVLFVQNFASKKIRPTFFLYSTAELLKDSKPKMGTSNFVLKRYDNITKSEEDHRLYRGLELSNHMKVLLVSDPKTDKSAAAMDVNVGFLSDPKEVYGLAHFCEHMLFLGTKKYPNENDYNKFLSEHGGSTNAATYLDHTVYFFDIVPNQLPQALDRFSQFFIAPLFTESATEREINAVNSEHEKNLPNDLWRLDQLNKHLANPDHPFNTFGTGNKDTLIKIPKENNIDVREKLLEFHNKWYSSNIMSLAILGKES

SEQ ID NO: 21825 - protein, 262 aa, Diabrotica virgifera
  misc_feature: Coding regions on vcDNA: vcDNA=SeqID_1522; Strand=+; Position=25-810
  misc_feature: Homolog annotation: Hit_ID=XP_309482.1; Match level="QueryCoverage =90%, HitCoverage=84%, E-value=2e-25, Identity=30%"; Hit description =ENSANGP00000022138 [Anopheles gambiae]
  misc_feature: Gene Ontology Annotation: Molecular function=molecular_function unknown; Cellular component=cellular_component unknown; Biological process=circadian rhythm
  misc_feature: Pfam annotation: Pfam_ID=DUF233; Match level="Score=100.6, E-value =4.1e-27, Copies=1"; Pfam description=Odorant binding protein
MWATLITVSIFGLIIGNVEAGPKHLPSYITACKRNDPELNKCCLEQARIALPHIVDGDKRYGIPSFKPMKLEKVSVNSGNLKIDLKDIELYGLPDADIQDLAVDLKKQTVKIVFKCPQIVILGKYVMDGKILVLPLNGAGDANVTIDNPVFTYTSDYKLVNKDGLDYAQLGDRNELSYDMTRVYFKFDNLFNGNEQLSKSTHEVANAEWRAIVEEMSPGIKAAVRSIAGLLVNSIAARVLMTGYFWLKIDFFICIEIYLVIS

SEQ ID NO: 21826 - protein, 289 aa, Diabrotica virgifera
  misc_feature: Coding regions on vcDNA: vcDNA=SeqID_1523; Strand=+; Position=52-918
  misc_feature: Homolog annotation: Hit_ID=EAL32572.1; Match level="QueryCoverage =85%, HitCoverage=41%, E-value=2e-60, Identity=47%"; Hit description =GA21853-PA [Drosophila pseudoobscura]
  misc_feature: Pfam annotation: Pfam_ID=GMC_oxred_N; Match level="Score=143.6, E -value=4.6e-40, Copies=1"; Pfam description=GMC oxidoreductase
MILKSVFWIFIPSLLVFVYSEGVVKQKTRKGKFLLPFYVQHRPIENRGLYGDPYLTESSFDFVIIGSGPSGAVLANRLSEVPEWNVLLIEVGGEADSFTDIPYMAEFFQFTDYNWGYSAEQQNTSCNGCPNKRMRLPSGRALGGSSINDFLLYSRGNPADFDKWQESGNPGWSYESVLKYFKKSENANLSAADPEYHQAGGPLTVSDIPYRTQSANAFVQAAQEAGYPFLDYNGKNQIGVSYLQTITKNGKRVSAEKAFLRPVRYRSNLKIIKNSRAIKILISPDTKQA

SEQ ID NO: 21827 - protein, 242 aa, Diabrotica virgifera
  misc_feature: Coding regions on vcDNA: vcDNA=SeqID_1524; Strand=+; Position=84-812
  misc_feature: Homolog annotation: Hit_ID=XP_314003.1; Match level="QueryCoverage =95%, HitCoverage=72%, E-value=4e-52, Identity=46%"; Hit description =ENSANGP00000009984 [Anopheles gambiae]
  misc_feature: Gene Ontology Annotation: Biological process=rhabdomere development
MSDQEEKITQFSSITGADEPRARFYLDSAAWQLEVAIARYYENDGEESDTVEEVPSMADSPRSPASVKKPKPKGKPSNFATINTINSSSEDEEEEGQAYYAGGSETSGQQVLGPPKKKDFVADMFKSVQEHGVEILEPSASTSSSRAFRGTGYKLGQDDNDSVAVPGVPEPMTSSEVTLRLWQNGFTVNDSELRPYTDPANKEFLDSIRQGEIPQELRRGASEVHLAMEDHRMDAFNKVNIN

SEQ ID NO: 21828 - protein, 465 aa, Diabrotica virgifera
  misc_feature: Coding regions on vcDNA: vcDNA=SeqID_1525; Strand=+; Position=189-1583
  misc_feature: Homolog annotation: Hit_ID=EAL31894.1; Match level="QueryCoverage =92%, HitCoverage=89%, E-value=1e-160, Identity=63%"; Hit description= GA18114-PA [Drosophila pseudoobscura]
  misc_feature: Gene Ontology Annotation: Molecular function=inorganic phosphate transporter activity; Cellular component=integral to membrane; Biological process=phosphate transport
  misc_feature: Pfam annotation: Pfam_ID=MFS_1; Match level="Score=180.8, E-value =2.9e-51, Copies=1"; Pfam description=Major Facilitator Superfamily
  misc_feature (147)..(148): Xaa can be any naturally occurring amino acid
  misc_feature (166)..(166): Xaa can be any naturally occurring amino acid
  misc_feature (172)..(172): Xaa can be any naturally occurring amino acid
  misc_feature (181)..(181): Xaa can be any naturally occurring amino acid
MYVPKENPESNGEESDTESVYEDEDETTRILPPEVEDTTNCMKARHILGILGFLGFANVYAMRVNLSVAIVAMVNTTQPVFTNNSYDHCPITDNSTNTNGTATPGEFDWDEKTQSIVLGSFFYGYVLTQVPGGRLAEIFGSKRVYGXXVLVTSIFTLLTPIAARMXLHYLLXVRVLEGMGXEGVTFPSMHAMLARWIPPLERSKFAAYVYAGTNFGTILSLPISGWLCSLKLDNGWPLSFYIFGVLGIVWYLFWVLLIYDTPMSHPRIDPQEKAFILASIGPQDDRDTSSIPWKHMLRCMPLWAILVTQCGQSWAFYTQLTELPTYMAQILHFDIQSDALLSAVPYFTSWIGGILFSIFADWLLSKGYLSLSTSYKVFNSVASVIPSIGLLGVAYVGCDKVAAQLLLALTATFGGAVYAGNQMNHIALSPQYAGTMYGITNSAANMCGFLAPYVIGLLIQGQETL

SEQ ID NO: 21829 - protein, 448 aa, Diabrotica virgifera
  misc_feature: Coding regions on vcDNA: vcDNA=SeqID_1526; Strand=+; Position=2-1345
  misc_feature: Homolog annotation: Hit_ID=XP_395067.1; Match level="QueryCoverage =97%, HitCoverage=78%, E-value=4e-76, Identity=31%"; Hit description =similar to hemolectin [Apis mellifera]
  misc_feature: Gene Ontology Annotation: Molecular function=protein binding; Cellular component=extracellular space; Biological process=cell adhesion
  misc_feature: Pfam annotation: Pfam_ID=VWC; Match level="Score=23.1, E-value =0.00085, Copies=1"; Pfam description=von Willebrand factor type C domain
  misc_feature (432)..(432): Xaa can be any naturally occurring amino acid
  misc_feature (440)..(440): Xaa can be any naturally occurring amino acid
  misc_feature (443)..(443): Xaa can be any naturally occurring amino acid
DQVPLVGQEHQFQVLVTNHPCPSAKGGSHKMCIGKITILYQGHKLHVLKDENRPRLKLIMDGEVIDDYSGVRHVVKVHRDSSGDMKILLPTIQVEVLVTYPTLASSVKAPSYIFEGKLEGICGNCNGKPKDDFTKPDKNTPKDDLDFELSWLYEGLPQNKEECGAEKEETCVPDPTQPDPCEQLLDINKFGKCANLLDPTSYLDWCQRDTCKGDPAESCTALEAYAKDCAKYGFCVNWRNDLCPAPVCDPGLFYSPCGPAHPETCETIIEGTKGGIKGGKRNIPTEGCFCPKGKVLLNETCVTPRECITCDNEGHHPGDEWKKDKCTKCKCQGTNLECEKQECVDPSTICEHGYTAVRVPTAEDECCDKYTCIPGPTFSPTCEPPQNLVCGKDQVTRLTTKADGCQSYICECKALEECEEIDLTSTEPLEPXYVKEIDTXSSXCPSST

SEQ ID NO: 21830 - protein, 324 aa, Diabrotica virgifera
  misc_feature: Coding regions on vcDNA: vcDNA=SeqID_1527; Strand=+; Position=1-971
  misc_feature: Homolog annotation: Hit_ID=XP_307419.1; Match level="QueryCoverage =100%, HitCoverage=42%, E-value=4e-72, Identity=44%"; Hit description= ENSANGP00000012923 [Anopheles gambiae]
  misc_feature: Gene Ontology Annotation: Molecular function=DNA binding; Cellular component=nucleus; Biological process=establishment and/or maintenance of chromatin architecture
  misc_feature (314)..(314): Xaa can be any naturally occurring amino acid
HGDRESGFIDDELFVELVHALVNYQEKDKGDKGEKKKEEKEKEKEKDKEKKEKVEETKDKKKDDMDFPTFVIFQSISSQFPDKGGPEELRDKYVELTERTDPNAPPECTPNIDGPNAASVPREQTLHSFHTLFCRRCFKYDCFLHRLQVCHPGPNLQKRRGPDLKPFTDPCGTDCYLLLDVVKETMAARAKQEEESEKEKEKEVKAKVPTKTAAETVTELKTNGVSNPSPRKICKQQSVDSGNEASSEDSNDSNKYKDNDNSDPVSTTTSFSLLGLMGANDHKEWTGSDESLFRGLHKVFLNNYCAIAQIMLTXTCQQVYHFAQ

SEQ ID NO: 21831 - protein, 174 aa, Diabrotica virgifera
  misc_feature: Coding regions on vcDNA: vcDNA=SeqID_1528; Strand=+; Position=145-669
  misc_feature: Homolog annotation: Hit_ID=AAR09709.1; Match level="QueryCoverage =96%, HitCoverage=94%, E-value=1e-57, Identity=61%"; Hit description =similar to Drosophila melanogaster ATPsyn-d [Drosophila yakuba]
  misc_feature: Pfam annotation: Pfam_ID=Mt_ATP-synt_D; Match level="Score=260.1, E -value=3.9e-75, Copies=1"; Pfam description=ATP synthase D chain, mitochondrial (
MAARRITKSAVNWAALSEKVPEHQRAQFLAFKTKSDSYLRRVLANPEQAPAIDWAYYKSKVPVAGMVDDFQKQYGALSIAFPADTVKPQLDALEKEIKSDIEKFKTESNARIAEYRKQLAHIASLIPYDQMTLEDYRDAYPEDAIDPINKPTFWPHTPEEQHDYVDKDAQPSHH

SEQ ID NO: 21832 - protein, 218 aa, Diabrotica virgifera
  misc_feature: Coding regions on vcDNA: vcDNA=SeqID_1529; Strand=+; Position=114-770
  misc_feature: Homolog annotation: Hit_ID=NP_659075.1; Match level="QueryCoverage =87%, HitCoverage=32%, E-value=2e-17, Identity=27%"; Hit description =RIKEN cDNA 4732497O03 [Mus musculus] emb|CAI24760.1| novel protein similar to human
MGEVVERRMESMSQEILEMRRLKLFSILETKDIIKKRRAFECKLNGVEKNLHHFKDYTDYELSLLKDIKLRRKKLKISENKNKIEISILKNIKSRYEIALQRFTNEMNLHLEYFKFCREYNFRQAAYLCVQNMIKAFAHVPDIWLVAAAFYVSSDTKQSLALIHKGITIHPSSQSLQLEAIQLELLRRQKNQWPSDIQGDTLDEVYYIKIEQYIDAIE

SEQ ID NO: 21833 - protein, 285 aa, Diabrotica virgifera
  misc_feature: Coding regions on vcDNA: vcDNA=SeqID_1530; Strand=+; Position=1-858
  misc_feature: Homolog annotation: Hit_ID=AAR06266.1; Match level="QueryCoverage =96%, HitCoverage=57%, E-value=2e-18, Identity=24%"; Hit description =peritrophic membrane chitin binding protein 2 [Trichoplusia ni]
  misc_feature: Pfam annotation: Pfam_ID=CBM_14; Match level="Score=105.5, E-value =1.3e-28, Copies=2"; Pfam description=Chitin binding Peritrophin-A domain
RTRGRTRGTNNNNDTTSTEATVTTEGTNADETTTEISTTESNAAVNGTETCLRNNVVCPVVDGYDSVYAALPDCSKFCLCLNGVPFEHQCSDGLLFNPRSNACDWPQRTSCSGDNNVTTSAVPAVSTEYLTEEETTVHSSSTSNGENNVTGSVVPAVSTEDLTEEETTAQSSSTSNGENNVTGSAVPAVSTEDLTEEDTTVQSSSTSEESRNELPVGSEECLQNNVVCPAVDGKFPVYAALPDCTKFCQCSNGAPYLYNCSGGLHFNPSLNVCDWPEDAGCERSI

SEQ ID NO: 21834 - protein, 71 aa, Diabrotica virgifera
  misc_feature: Coding regions on vcDNA: vcDNA=SeqID_1531; Strand=-; Position=393-608
KFHLRKQINTDYRFDKKCHFINMNQYYNIFFSNRWLPIFGLRSTKYPNNLRCQMTLQENINEKVMLRHLHT

SEQ ID NO: 21835 - protein, 121 aa, Diabrotica virgifera
  misc_feature: Coding regions on vcDNA: vcDNA=SeqID_1532; Strand=+; Position=43-408
NIVQKMKSIFIITFFACIGLAVTVAIPMNIKGPAPDLDDPNCVVCFSAGNFIQGFKNSGDSKEEAKQQRNFICNLFNTDELMQICMSTYEEDVEYIYGVTDLRTVTEMCIDMNKCKAKPNI

SEQ ID NO: 21836 - protein, 105 aa, Diabrotica virgifera
  misc_feature: Coding regions on vcDNA: vcDNA=SeqID_1533; Strand=+; Position=743-1060
DIISSICIFYLFNSFLVNTMAISNVTATISVSTSNNYINCEKAIKFINVFNGSSSKLHYFIVSVYLICTKCDPELPILPFIVISRLKEITLFLSDREHNTFSQMI

SEQ ID NO: 21837 - protein, 274 aa, Diabrotica virgifera
  misc_feature: Coding regions on vcDNA: vcDNA=SeqID_1534; Strand=+; Position=137-958
  misc_feature: Homolog annotation: Hit_ID=NP_524931.1; Match level="QueryCoverage =92%, HitCoverage=60%, E-value=1e-73, Identity=54%"; Hit description =CG10449-PA [Drosophila melanogaster] gb|AAF53744.1| CG10449-PA [Drosophila melanogaster]
  misc_feature: Gene Ontology Annotation: Molecular function=molecular_function unknown; Cellular component=cellular_component unknown; Biological process=nurse cell/oocyte transport (sensu Insecta)
  misc_feature: Pfam annotation: Pfam_ID=Zip; Match level="Score=47.2, E-value=4.7e -11, Copies=1"; Pfam description=ZIP Zinc transporter
MFSSKLFIIFILFLSVEICISHSHSHGDHHGHSHDEPASFKYSRAANEPDHHEHVHTHEHVHAHEHHGEVPHKSKNQLNTQELWIQAMGSTLLISAAPFFILFFVPLDNTESSQPLLKILLAFASGGLLGDAFLHLIPHATMAIEEQNPHSHSHSHSHEPGEEHSHDMSVGLWVLAGIVVFLVVEKSVRILKGPSHSHSHSAPAASNEKTATKKDSGDKKVAKTPKNEEEPAKEIKVAGYLNLAADFSHNFTDGLAIGSSYLAGNTGRIVTTIT

SEQ ID NO: 21838 - protein, 310 aa, Diabrotica virgifera
  misc_feature: Coding regions on vcDNA: vcDNA=SeqID_1535; Strand=+; Position=375-1302
  misc_feature: Homolog annotation: Hit_ID=XP_394220.1; Match level="QueryCoverage =100%, HitCoverage=49%, E-value=1e-132, Identity=71%"; Hit description=similar to CG9518-PA [Apis mellifera]
  misc_feature: Gene Ontology Annotation: Biological process=reproduction
  misc_feature: Pfam annotation: Pfam_ID=GMC_oxred_N; Match level="Score=302.9, E -value=5.1e-88, Copies=1"; Pfam description=GMC oxidoreductase
  misc_feature (282)..(282): Xaa can be any naturally occurring amino acid
  misc_feature (294)..(294): Xaa can be any naturally occurring amino acid
MVFETLLVSTALRTIGIVGSTLWLIPLILAGITYINYNKLDPETPIMDAQRLYRDYDFIVVGGGSAGAVVASRLSEISKWKVLLLEAGYDENEISDVPSLAAYLQLSKMDWTYKTEYTGRACLGMKNGQCNWPRGKVLGGSSVLNYMLYVRGNKNDYDYWEQLGNPGWNYENVLKYFKRSEDNRNPYLTKTPYHNKGGLLTVQESPWRTPLVVAFLEAGLEMGYPVRDINGADQAGFMIAQGTIRRGSRCSTAKAFLRPVKLRKNIHIALNAHVTRVLINPXTMRAFGVEFVRXGRKQIVTAKREIILSA

SEQ ID NO: 21839 - protein, 66 aa, Diabrotica virgifera
  misc_feature: Coding regions on vcDNA: vcDNA=SeqID_1536; Strand=-; Position=99-299
KKGIVIKYILGVYLHCVLKSVNKPIQHMIFWHIYHTSAAIHLGVMTQSMILSNENRGRALAHLKGH

SEQ ID NO: 21840 - protein, 409 aa, Diabrotica virgifera
  misc_feature: Coding regions on vcDNA: vcDNA=SeqID_1537; Strand=+; Position=1-1230
  misc_feature: Homolog annotation: Hit_ID=XP_327905.1; Match level="QueryCoverage =66%, HitCoverage=23%, E-value=5e-14, Identity=33%"; Hit description =predicted protein [Neurospora crassa] emb|CAE76137.1| hypothetical protein [Neurospora crassa]
PTRPERQRERERLKKEEEQRRRERTRRDDRGLDKPSGDRVERLLPPIEERVPPSRKGHSTERDRDRGRDVRGRDRSTDRPRKSPDRRGDMDKDRSYDRGYDNRSRPDPERDYIPGHRDKDYDSPYERGRPLDDRRYLDVDEHYGEGVRDDRMYGAPVDDRRSRRDMWDERGVDDRENIDHRSRYAPRDDHNLKNNRGGDWGDLQHGEYSNHDWDRNRRPVNSEWDARENWDIDQHKQTGAGQGEDDWRHYNRPVDSWTNDDRRRWPQEWRDRSRPRSATSHQVEPVNVPPSEDSNLESNRKKEIPPLLQPAPAAEEPGVKPESSEEETMKQSSPPPVKRAADEAVDSPGSAKKICVKQETVQPPLEDDLSEISDDADDILNMVEDVPDSPNKRRIQKLQKYRRLLPQLL

SEQ ID NO: 21841 - protein, 140 aa, Diabrotica virgifera
  misc_feature: Coding regions on vcDNA: vcDNA=SeqID_1538; Strand=+; Position=218-640
  misc_feature: Homolog annotation: Hit_ID=XP_308297.1; Match level="QueryCoverage =96%, HitCoverage=88%, E-value=1e-33, Identity=48%"; Hit description =ENSANGP00000010865 [Anopheles gambiae]
  misc_feature: Gene Ontology Annotation: Molecular function=zinc ion binding; Cellular component=nucleus; Biological process=signal transduction
  misc_feature: Pfam annotation: Pfam_ID=HIT; Match level="Score=65.8, E-value=1.2e -16, Copies=1"; Pfam description=HIT domain
MTTDPNCIFCKIIAGDAPADILFQNEELVVFRDIKPESKHHFLVVPKNHILNVNSLQTNEDRLLVERMLEIGKKILAEHNGDLDDVRIGFHCPPFNSINHLHLHVISPASEMGFIKRQVFRPNTWWFQSVDDTLLRLSKL

SEQ ID NO: 21842 - protein, 440 aa, Diabrotica virgifera
  misc_feature: Coding regions on vcDNA: vcDNA=SeqID_1539; Strand=+; Position=2-1321
  misc_feature: Homolog annotation: Hit_ID=EAA14209.2; Match level="QueryCoverage =88%, HitCoverage=87%, E-value=1e-108, Identity=48%"; Hit description= ENSANGP00000010188 [Anopheles gambiae str. PEST] ref|XP_553591.1| ENSANGP00000010188 [Anopheles gambiae s
  misc_feature: Pfam annotation: Pfam_ID=MFS_1; Match level="Score=51.3, E-value=2.9e- 12, Copies=1"; Pfam description=Major Facilitator Superfamily
  misc_feature (435)..(435): Xaa can be any naturally occurring amino acid
ELGASVISLRYQPEEDQEEEQEENLVANSKSLNVKENSSLRCLLPQILASLAAAAFHIGNGTAMAYSAVLISQLEEDGSDFKATKSENAFMASIIILIAPFASIVSGVLMDKFGRLNTIKLAIVPGVLGWVALALAPNMKIIIMGRILTGIAASWGTNPAIVYITEIAHPKLRMSLMQLSPTYVSLGMIVVYLAGMYTTWRMVAWICNIFIVLPVIVVFFIPESPMWLILKGRTKEAKKSLEWLNKKQPQPEGKNETFAEIQFKVLKKQHEEEEAKSKNKGSFKEILHEFMKPTGYKPLIIMCPLFFCQHFSGIYITMFYSITFIKEAGTDLNAYFVSALIGVVRFIMASTNVVLLKYLNRRTALISSCAGMAFFMYLSGQYTLWIKEEVTTAKWVPVVSLLMYVVCSVNGLMYLPFMVISELFPSEIRGSRYTXRYSMS

SEQ ID NO: 21843 - protein, 80 aa, Diabrotica virgifera
  misc_feature: Coding regions on vcDNA: vcDNA=SeqID_1540; Strand=+; Position=644-883
DHTMTRAEVNNTKIEIAPRETKIIIHMFYLFIYNRDSLTMTLPEIVIIIIIINNCYHKVCIIFAVMSIFIFSTEKVFQAH

SEQ ID NO: 21844 - protein, 181 aa, Diabrotica virgifera
  misc_feature: Coding regions on vcDNA: vcDNA=SeqID_1541; Strand=+; Position=212-756
  misc_feature: Homolog annotation: Hit_ID=CAE70927.1; Match level="QueryCoverage =100%, HitCoverage=99%, E-value=5e-77, Identity=79%"; Hit description= Hypothetical protein CBG17727 [Caenorhabditis briggsae]
  misc_feature: Gene Ontology Annotation: Molecular function=enzyme activator activity; Cellular component=membrane; Biological process =gametogenesis
  misc_feature: Pfam annotation: Pfam_ID=Arf; Match level="Score=364.8, E-value=1.2e -106, Copies=1"; Pfam description=ADP-ribosylation factor family
  misc_feature (132)..(132): Xaa can be any naturally occurring amino acid
  misc_feature (162)..(162): Xaa can be any naturally occurring amino acid
MGLTISAVFNRLFSKKPMRILMVGLDAAGKTTILYKLKLGEIVTTIPTIGFNVETVEYKNISFTVWDVGGQTRIRKLWRHYFANTDGLIFVVDSNDRDRIAEAEEELHNMLGEDDLRDCILLIFANKQDLPXNSMSTAELTDKLKLHTLKNRGGGYIQATCXAQGNGLYEGLDWLSNELAK

SEQ ID NO: 21845 - protein, 72 aa, Diabrotica virgifera
  misc_feature: Coding regions on vcDNA: vcDNA=SeqID_1542; Strand=+; Position=2-220
  misc_feature (9)..(9): Xaa can be any naturally occurring amino acid
LTRPTVDPXIDKIVINKELEELHNINFSQNKTFCCISWVLLSKKCSYKFFRRMHSFRDKRDGTFKKSKNCNL

SEQ ID NO: 21846 - protein, 239 aa, Diabrotica virgifera
  misc_feature: Coding regions on vcDNA: vcDNA=SeqID_1543; Strand=+; Position=429-1146
  misc_feature: Homolog annotation: Hit_ID=XP_393144.1; Match level="QueryCoverage =98%, HitCoverage=41%, E-value=3e-61, Identity=52%"; Hit description =similar to CG11128-PC [Apis mellifera]
  misc_feature: Gene Ontology Annotation: Molecular function=basic amino acid transporter activity; Cellular component=integral to membrane; Biological process=transport
  misc_feature (206)..(206): Xaa can be any naturally occurring amino acid
  misc_feature (209)..(209): Xaa can be any naturally occurring amino acid
MPNKLFAAITRKKTFTYNEETTSLARVLSLVDLVGLGAGSTLGLGVYVLAGSVAKTYAGPASSISFFIAAIISLFGGLCYAEFAARVPRTGYAYAYCYAGVGELVAFVVGWNLLLGAVLGAASVASGMSSYIDALFEKQIALTIGSWFSMDVPYLTHTPDILALAIIILLTILLSVGMKESSMFNNICTVLNLLTIFTVIVACAIXADXKNWTIAQRKHSNLSTKKQRGTGGILPIRGL

SEQ ID NO: 21847 - protein, 263 aa, Diabrotica virgifera
  misc_feature: Coding regions on vcDNA: vcDNA=SeqID_1544; Strand=+; Position=106-895
  misc_feature: Homolog annotation: Hit_ID=XP_393144.1; Match level="QueryCoverage =100%, HitCoverage=46%, E-value=4e-73, Identity=52%"; Hit description= similar to CG11128-PC [Apis mellifera]
  misc_feature: Gene Ontology Annotation: Molecular function=basic amino acid transporter activity; Cellular component=integral to membrane; Biological process=transport
  misc_feature (206)..(206): Xaa can be any naturally occurring amino acid
  misc_feature (236)..(236): Xaa can be any naturally occurring amino acid
  misc_feature (252)..(252): Xaa can be any naturally occurring amino acid
MPNKLFAAITRKKTFTYNEETTSLARVLSLVDLVGLGAGSTLGLGVYVLAGSVAKTYAGPASSISFFIAAIISLFGGLCYAEFAARVPRTGYAYAYCYAGVGELVAFVVGWNLLLGAVLGAASVASGMSSYIDALFEKQIALTIGSWFSMDVPYLTHTPDILALAIIILLTILLSVGMKESSMFNNICTVLNLLTIFTVIVACAIXADIKNWTIAKESIKPEYKEQAGTGGFFPYXVAGVIAGTPNCFFGFXGFDAPAACSDE

SEQ ID NO: 21848 - protein, 77 aa, Diabrotica virgifera
  misc_feature: Coding regions on vcDNA: vcDNA=SeqID_1545; Strand=+; Position=131-364
  misc_feature: Homolog annotation: Hit_ID=EAL30934.1; Match level="QueryCoverage =100%, HitCoverage=100%, E-value=3e-33, Identity=85%"; Hit description=GA14782-PA [Drosophila pseudoobscura]
MARGQQKLQSQAKAAEKAAKAKKQQGHSAGDQKKAAQKALVHVCAVCKAQMPDPKTYKQHFENKHPKNEVPAELKDI

SEQ ID NO: 21849 - protein, 156 aa, Diabrotica virgifera
  misc_feature: Coding regions on vcDNA: vcDNA=SeqID_1546; Strand=+; Position=59-529
  misc_feature: Homolog annotation: Hit_ID=XP_316036.1; Match level="QueryCoverage =58%, HitCoverage=85%, E-value=3e-18, Identity=47%"; Hit description =ENSANGP00000010714 [Anopheles gambiae] gb|EAA11745.1| ENSANGP00000010714 [Anopheles gambiae
  misc_feature: Pfam annotation: Pfam_ID=Chitin_bind_4; Match level="Score=77.9, E -value=2.7e-20, Copies=1"; Pfam description=Insect cuticle protein
MKVLIVVALIAVACAAAYPQYNQYHNSPFQAPARAAVHSVHPVHSVHPVQPVAQPQHHARSGAYDSSKDARVLRYDSETSVGNDGYRFAVETSDGHQREEQAVLENAGTKEESLSVSGRYFYPGLNGETFEVTYVADKDGYRASGPHLPQPVQALH

SEQ ID NO: 21850 - protein, 304 aa, Diabrotica virgifera
  misc_feature: Coding regions on vcDNA: vcDNA=SeqID_1547; Strand=+; Position=23-935
  misc_feature: Homolog annotation: Hit_ID=EAA07900.3; Match level="QueryCoverage =99%, HitCoverage=100%, E-value=1e-147, Identity=80%"; Hit description=ENSANGP00000018205 [Anopheles gambiae str. PEST] ref|XP _563078.1| ENSANGP00000018205 [Anopheles gambiae
  misc_feature: Gene Ontology Annotation: Molecular function=protein serine/threonine phosphatase activity; Cellular component=cytoplasm; Biological process=regulation of cell cycle
  misc_feature: Pfam annotation: Pfam_ID=Metallophos; Match level="Score=140.8, E -value=3.2e-39, Copies=1"; Pfam description=Calcineurin-like phosphoesterase
  misc_feature (259)..(259): Xaa can be any naturally occurring amino acid
  misc_feature (272)..(272): Xaa can be any naturally occurring amino acid
  misc_feature (276)..(276): Xaa can be any naturally occurring amino acid
  misc_feature (278)..(279): Xaa can be any naturally occurring amino acid
  misc_feature (293)..(293): Xaa can be any naturally occurring amino acid
MSSELDNWIEIAKQCKYLPENDLKKLCDIVCSILLEESNVQPVSTPVTVCGDIHGQFYDLEELFRKGGQVPDTNYVFLGDFVDRGYYSLETFTRLLTLKAKYPNKITLLRGNHESRQITQVYGFYDECMTKYGNVNAWKYCCGVFDLLTIAAIIDEKILCVHGGLSPEIKTLDQIRILERNQEIPHKGAFCDLVWSDPDYIDTWATSPRGAGFLFGAKVTNDFMRINALTLICRAHQLVHEGYKYMFEDQLVTVWSAPXYCYRCGNVASILXFTTXHXXECTLFKAVPDAERXIPSRNITPYFL

SEQ ID NO: 21851 - protein, 212 aa, Diabrotica virgifera
  misc_feature: Coding regions on vcDNA: vcDNA=SeqID_1548; Strand=+; Position=28-666
  misc_feature: Homolog annotation: Hit_ID=NP_649919.1; Match level="QueryCoverage =88%, HitCoverage=88%, E-value=3e-25, Identity=39%"; Hit description =CG9427-PA [Drosophila melanogaster] gb|AAF54414.1| CG9427-PA [Drosophila melanogaster]
  misc_feature: Pfam annotation: Pfam_ID=GILT; Match level="Score=93.9, E-value=4.1e -25, Copies=1"; Pfam description=Gamma interferon inducible lysosomal
MKGKVINLLVLFSCFWLSEQAQVKVSIYYETLCPDSIAFIKDQFHPTYKDLKDYIDVEFVPYGHASETNITGQWAFTCQHGPAECFGNAFHSCVLALNSDKSKTENFVYCSMSAEDPASLQIIEQCLNKAGLDWKTIKNCYFSNEYVKYLIQNGEKTRAAEDTSFIPTIVLNDKFSQQNQDDAISDFRKLICKTLNNGPNECKEDHINVILT

SEQ ID NO: 21852 - protein, 260 aa, Diabrotica virgifera
  misc_feature: Coding regions on vcDNA: vcDNA=SeqID_1549; Strand=+; Position=116-895
  misc_feature: Homolog annotation: Hit_ID=XP_395412.1; Match level="QueryCoverage =89%, HitCoverage=67%, E-value=3e-69, Identity=56%"; Hit description =similar to CG5976-PB [Apis mellifera]
  misc_feature: Gene Ontology Annotation: Molecular function=molecular_function unknown; Cellular component=cellular_component unknown; Biological process=biological_process unknown
  misc_feature: Pfam annotation: Pfam_ID=Peptidase_M28; Match level="Score=39.7, E -value=8.3e-09, Copies=1"; Pfam description=Peptidase family M28
MISTILKSLIVATVFFEGNCNQLKKIQMSHQSTQLSENAMRYLSKLSNVKYTNEVLDNILIPRVVGTSGHKKVFEYIKKELKNLDWNVEVDEFEDDTPMGRLTFKNIIATLNPNADRYLVLSCHYDSKYFEDIVFVGAIDSAVPCAMMLNLIKVMDKELKSVQSNSLSLKLIFFDGEEAFVEWGPRDSIYGARHLAQVYQNKIETSRVSGERINENQKIDMLILVDLIGHKATRFLSTSRETENWYLRLANIETRLRNLE

SEQ ID NO: 21853 - protein, 281 aa, Diabrotica virgifera
  misc_feature: Coding regions on vcDNA: vcDNA=SeqID_1550; Strand=+; Position=120-961
  misc_feature: Homolog annotation: Hit_ID=XP_320320.1; Match level="QueryCoverage =90%, HitCoverage=44%, E-value=2e-34, Identity=32%"; Hit description =ENSANGP00000016486 [Anopheles gambiae]
  misc_feature: Gene Ontology Annotation: Molecular function=acyltransferase activity; Cellular component=integral to membrane; Biological process=cholesterol metabolism
  misc_feature (242)..(242): Xaa can be any naturally occurring amino acid
NQEHLKTTIPKKVINQNFKQEEHVSNHEEETKEKKYSLPSKQFSIRESFILQLFEQNKTLNTIYNIFVANYVIFIFAYTLKEYMNHQRLPKALLIIPRSFGKMHLVALVWLGNNFATFSTYYFFLLWGKTRQKVIFQKLWDALWILLLITYYMMSFVVITKVVFALNLPFASAVIITMESVRFLMKVHAFVRHNAPKMLHNSNDKTTLLSFSRFIYFLYIPTIIYRDQYPRLKKIRWGFVFXRLFEIANIIIFLAYWYEYVITPYFQESCLKHGTWRCFYF

SEQ ID NO: 21854 - protein, 109 aa, Diabrotica virgifera
  misc_feature: Coding regions on vcDNA: vcDNA=SeqID_1551; Strand=+; Position=118-694
  misc_feature: Homolog annotation: Hit_ID=CAF93975.1; Match level="QueryCoverage =95%, HitCoverage=49%, E-value=3e-11, Identity=41%"; Hit description =unnamed protein product [Tetraodon nigroviridis]
MSSTGIYSGLNENSRNSSRVLRPPGGGHTDLFGDAANDSKPSRRDHGRNASSILEGTNSPTTSPTTPTKTVVAPPPVPQAKEPVPQQPKGRVPPGGGGGPPPPPPLGGG

SEQ ID NO: 21855 - protein, 289 aa, Diabrotica virgifera
  misc_feature: Coding regions on vcDNA: vcDNA=SeqID_1552; Strand=+; Position=84-953
  misc_feature: Homolog annotation: Hit_ID=AAD20975.2; Match level="QueryCoverage =95%, HitCoverage=32%, E-value=4e-88, Identity=58%"; Hit description =3-hydroxy-3-methylglutaryl coenzyme A reductase [Ips paraconfusus]
  misc_feature: Gene Ontology Annotation: Molecular function=hydroxymethylglutaryl -CoA reductase (NADPH) activity
MSKIFALYGELCATHPWEVIFTVITFTVCFLTLDKPQGTKAFPRTTSTCSTCTEDHFIAADVIVMTIIRCLAILYSYHQFRNLRKLGSKYILGFAGLFVVCSSFVFISAVLNILQIEVADLKDALFFFLLLIDLSKAVKLAQYALTASNQEEISKNIAMGVAVLGPTITLDTIVETLVIGVGTLSGVQRLEMLSYFACLSVIVNYIILLTFYPACLALMLDLSKVSDYYKQEQVTRILGDEKDKSNPAAQRVKMIMSLGLTIVHIHSRWSVTQTENLAIWGEPNWNSLE

SEQ ID NO: 21856 - protein, 175 aa, Diabrotica virgifera
  misc_feature: Coding regions on vcDNA: vcDNA=SeqID_1553; Strand=+; Position=52-579
  misc_feature: Homolog annotation: Hit_ID=XP_308839.1; Match level="QueryCoverage =97%, HitCoverage=87%, E-value=2e-66, Identity=69%"; Hit description =ENSANGP00000021738 [Anopheles gambiae]
  misc_feature: Pfam annotation: Pfam_ID=CHCH; Match level="Score=55.7, E-value=1.3e -13, Copies=2"; Pfam description=CHCH domain
MGITDDVHLPTEEELTVQEIPLSGPALKAGAFHVGKTCEWENNEFILCRDELKDPRKCINEGKAVTSCAMNFFRKIKATCADEFMQYVNCLDKSSPDQALVPCRKTQAVFDKCVKDNLGLDRPPYDYFNRVHVHKTERPRPPVEGKTVYEDATPGLPEDVPKPEAKYGSRYLFMW

SEQ ID NO: 21857 - protein, 411 aa, Diabrotica virgifera
  misc_feature: Coding regions on vcDNA: vcDNA=SeqID_1554; Strand=+; Position=3-1235
  misc_feature: Homolog annotation: Hit_ID=CAG01685.1; Match level="QueryCoverage =99%, HitCoverage=30%, E-value=1e-124, Identity=58%"; Hit description= unnamed protein product [Tetraodon nigroviridis]
  misc_feature: Gene Ontology Annotation: Molecular function=ATP binding; Cellular component=cytoplasm; Biological process='de novo' IMP biosynthesis
  misc_feature: Pfam annotation: Pfam_ID=AIRS_C; Match level="Score=54.8, E-value =2.5e-13, Copies=1"; Pfam description=AIR synthase related protein, C- termi
  misc_feature (388)..(388): Xaa can be any naturally occurring amino acid
PFNLELEHVLGKMPQKVFKLNRHKVASKPLEFPKALSIYQSLLRVLRLPSIGSKRYLTNKVDRCVTGLIAQQQCVGPLHTPLADVAVTALSHFGHEGIASSIGEQPIKGLVNTAAGARMTVVEALSNLVFAGITSLRDVKCSGNWMWAAKLPGEGAALYDACKAMCDLMSELGIAIDGGKDSLSMAARVGKDTVKAPGTLVVSTYAPCPDIRKVVTPDFKAPSMGKTGTILFVDLSRSDSRLGGSALAQAFGQLGEESPDLHSAEELVNAFNATQQLIKDDSILAGHDISDGGLIVCLLEMCFAGICGMEVDVQHRQGKPLNILFAEEVGWVLEVLDEDVAHCLNVFSNHNVPVFKIGKTVGYGIKSKFGIIANHACLESTILPLMKXWEETSYRLELHQTIKSCADSGFH

SEQ ID NO: 21858 - protein, 66 aa, Diabrotica virgifera
  misc_feature: Coding regions on vcDNA: vcDNA=SeqID_1555; Strand=-; Position=537-737
YKIEKKIPLAIGYLKGIRNKGKLRNKPNIKTQFKSNQFNAENNFELTIDKELKSRDALHAPYGSKN

SEQ ID NO: 21859 - protein, 149 aa, Diabrotica virgifera
  misc_feature: Coding regions on vcDNA: vcDNA=SeqID_1556; Strand=+; Position=74-523
  misc_feature: Homolog annotation: Hit_ID=EAL26207.1; Match level="QueryCoverage =83%, HitCoverage=71%, E-value=2e-26, Identity=50%"; Hit description =GA20768-PA [Drosophila pseudoobscura]
  misc_feature: Pfam annotation: Pfam_ID=zf-CCCH; Match level="Score=21.6, E-value =0.0016, Copies=1"; Pfam description=Zinc finger C-x8-C-x5-C-x3-H type (an
MSLVPDYGDSSNSDDSSSSTSDSENEIIPTKKSDVASKNKLPAPSFGGSNLTEESTKSSVFKNPFIEAENAKDAILQKHVKMVESKDNMVIINGKKICWNYRKGRCRFGHNCKYAHDSDVQKTQEQIEVEKVAAIKNSVVCENSQTGCI

SEQ ID NO: 21860 - protein, 186 aa, Diabrotica virgifera
  misc_feature: Coding regions on vcDNA: vcDNA=SeqID_1557; Strand=-; Position=143-703
  misc_feature: Homolog annotation: Hit_ID=NP_728587.1; Match level="QueryCoverage =69%, HitCoverage=72%, E-value=1e-16, Identity=37%"; Hit description =CG9134-PC, isoform C [Drosophila melanogaster] ref|NP_728586.1| CG9134-PA, isoform A [Drosophila
  misc_feature: Pfam annotation: Pfam_ID=Lectin_C; Match level="Score=20.0, E-value =8.2e-06, Copies=1"; Pfam description=Lectin C-type domain
MRKQLLGVLLTILFSVEINAQSYVITNDTGIAQSIAPSIPVERNGNTLYYFGYTYTGSWLGAMEHCKSLNMDLASIESQEENDFLYNRMKPFLGGGVEYWFWTSGTTLSSGRWIWMRTGRPIGWANWGEGYVGLGRCLEVRYNYASGLKWHDTLQNEGRHALCEAKITRTVADLIPKFCNRWDYTK

SEQ ID NO: 21861 - protein, 108 aa, Diabrotica virgifera
  misc_feature: Coding regions on vcDNA: vcDNA=SeqID_1558; Strand=+; Position=30-356
KSVLTMEELYLFLLTMLVTLSTHASPVPDDSRYLYYADIAPAILNRLFLVRRQAEPDIGYSDESLDDSPRKHYYRPYVRIRRVYRTHYQPRHPLSNYADSYDRFPTVA

SEQ ID NO: 21862 - protein, 237 aa, Diabrotica virgifera
  misc_feature: Coding regions on vcDNA: vcDNA=SeqID_1559; Strand=+; Position=222-935
  misc_feature: Homolog annotation: Hit_ID=XP_316595.1; Match level="QueryCoverage =97%, HitCoverage=82%, E-value=1e-62, Identity=52%"; Hit description =ENSANGP00000011437 [Anopheles gambiae]
  misc_feature: Gene Ontology Annotation: Molecular function=myo-inositol-1(or 4) -monophosphatase activity; Cellular component=cellular_component unknown; Biological process=signal transduction
  misc_feature: Pfam annotation: Pfam_ID=Inositol_P; Match level="Score=282.8, E -value=5.8e-82, Copies=1"; Pfam description=Inositol monophosphatase family
MSAEELDQYYETAVALAKRLGAIIKETALVRNKSTTSKLNRTDLVTETDKHIEKLLISTVNKEYPHHKIIGEESTFEGAECTLTDAPTWIVDPIDGTMNFVHSFPHSCISIALFVNKEPEIGIIYNPHLEQFFSARKGKGAFLNGEPINVSDTKTMADALVLTESFARENSVKEKVILENYKMLMRETHGPRSLGSAAMDMCMVACGAADAYYQYKLNIWDIAAGELIVKEAGGCGT

SEQ ID NO: 21863 - protein, 289 aa, Diabrotica virgifera
  misc_feature: Coding regions on vcDNA: vcDNA=SeqID_1560; Strand=+; Position=115-981
  misc_feature: Homolog annotation: Hit_ID=XP_394293.1; Match level="QueryCoverage =97%, HitCoverage=90%, E-value=8e-70, Identity=47%"; Hit description =similar to ENSANGP00000021771 [Apis mellifera]
  misc_feature: Gene Ontology Annotation: Cellular component=membrane; Biological process=intracellular protein transport
  misc_feature: Pfam annotation: Pfam_ID=Yip1; Match level="Score=186.9, E-value=4.2e- 53, Copies=1"; Pfam description=Yip1 domain
  misc_feature (281)..(281): Xaa can be any naturally occurring amino acid
MTNLQEVPTDELLSFQDFPSVHISGEDNRTIPISEAQINVNYVDGNISPSHNPPGPGDAPVTDGTNPTTEKAFWTLEYYQKYFDVDTSDVVERIMASITPKWDNRLKNHLRTKPDLYGPFWISVTLIFTIAIGGNIANYLQSSSSQYHWRYDFHLVSYSATTIFSYVTIIPLILWGLLKWSVHIQDVEGLDEELSPGILELICIYGYSLFIYIPVSALWSIQINILQWTLLAFGTFISGSVLLLTLMPALRFSQRKFLLMFFIIGFHLMVSAGFMLYCFHXPSGSVNNT

SEQ ID NO: 21864 - protein, 295 aa, Diabrotica virgifera
  misc_feature: Coding regions on vcDNA: vcDNA=SeqID_1561; Strand=+; Position=104-988
  misc_feature: Homolog annotation: Hit_ID=CAG09215.1; Match level="QueryCoverage =91%, HitCoverage=66%, E-value=2e-86, Identity=57%"; Hit description =unnamed protein product [Tetraodon nigroviridis]
  misc_feature: Gene Ontology Annotation: Molecular function=protein farnesyltransferase activity; Cellular component=cytoplasm; Biological process=C-terminal protein farnesylation
  misc_feature: Pfam annotation: Pfam_ID=Prenyltrans; Match level="Score=164.0, E -value=3.3e-46, Copies=4"; Pfam description=Prenyltransferase and squalene oxidas
MECNLRPLSQIKKETLNTEHCPTKTSSEQIDVEKTVLKKYEDLHTKLKVNRELPELLKDKHRNFLYDSITYLSSAYEVLDASRPWLCYWILHPLSLINIQLDARRKKVIAKFLAKCQSPNGGFGGGPGQIPHLATTYAAVNALVILGTEEALNVINRKKLQEFLWRVRQVDGSFQMHENGEVDIRGAYCALSIASLTGIMTPELFRNTAEWIVSCQTYEGGFSGCPGMEAHGGYAFCGLAALVILNKGHLVDERALLRWLVQKQMKVEGGFQGRTNKLVTPVFFLQGGAFPLYIL

SEQ ID NO: 21865 - protein, 431 aa, Diabrotica virgifera
  misc_feature: Coding regions on vcDNA: vcDNA=SeqID_1562; Strand=+; Position=93-1388
  misc_feature: Homolog annotation: Hit_ID=AAC05332.1; Match level="QueryCoverage =96%, HitCoverage=94%, E-value=0.0, Identity=78%"; Hit description =extra sex combs [Schistocerca americana]
  misc_feature: Gene Ontology Annotation: Molecular function=protein binding; Cellular component=nucleus; Biological process=negative regulation of transcription
  misc_feature: Pfam annotation: Pfam_ID=WD40; Match level="Score=83.5, E-value=5.5e -22, Copies=6"; Pfam description=WD domain, G-beta repeat
MKEKNMEKIKSTPKEDLSNHEEESGDEGDETSSVGSASTTDNTSRSATPTNKLRKGRRGKKRLSASIPKVLKPIYTFSCSIKEDHGQPLFGAQFNHHLKEGQPLVFAAVGSNRVTIYECPDGTGIKLLQCYADPDLDENYYTCAWSHDEDLGKPLLAVAGSRGVIRILNPITMSCIRHYIGHGHAINELKFHPKDPNLLLSISKDHSLRLWNIKSDVCIAIFGGVEGHRDEVLSADFDLNGNRIMSCGMDHSLKLWRLDKETMKDTIKNSYSWNASRNTRPFECLKENFPDFSTRDIHRNYVDCVKWFGDFLLSKSCENCIVCWKPGRLEDENLRKGETSSTIIHRFEYKECEIWFVRFAMDFWQKILALGNQTGKVFVWDLDVPDPAQAKCYTLHQARCTTAIRQTTLSRNSNVLICVCDDGTIWRWDRI

SEQ ID NO: 21866 - protein, 312 aa, Diabrotica virgifera
  misc_feature: Coding regions on vcDNA: vcDNA=SeqID_1563; Strand=+; Position=2-942
  misc_feature: Homolog annotation: Hit_ID=XP_321444.1; Match level="QueryCoverage =64%, HitCoverage=55%, E-value=7e-49, Identity=44%"; Hit description =ENSANGP00000022153 [Anopheles gambiae]
  misc_feature: Gene Ontology Annotation: Molecular function=lipid binding; Cellular component=cellular_component unknown; Biological process =triacylglycerol metabolism
  misc_feature: Pfam annotation: Pfam_ID=Abhydro_lipase; Match level="Score=110.1, E -value=5.6e-30, Copies=1"; Pfam description=ab-hydrolase associated lipase region
  misc_feature (147)..(147): Xaa can be any naturally occurring amino acid
  misc_feature (166)..(166): Xaa can be any naturally occurring amino acid
  misc_feature (224)..(224): Xaa can be any naturally occurring amino acid
  misc_feature (255)..(255): Xaa can be any naturally occurring amino acid
  misc_feature (293)..(293): Xaa can be any naturally occurring amino acid
  misc_feature (297)..(297): Xaa can be any naturally occurring amino acid
  misc_feature (306)..(306): Xaa can be any naturally occurring amino acid
NCDSVSNTYLQLVSVLCLILPFSKCEDSTCNLFQKYVLFKDECPTEETNEVQQNSCSYFQKYVLWRKECNEVPQADSTFTKCNRVQQKLLGQDYCTYIPDQYLDVPQIIARHGYPSETHIVETEDGYLLQVHRIPRPKLGASIGQPXFLQHGLLGSSADWIINGKXTLAFVLADKGYDVWLGNARGNVYSRSHISLPNDYSAFWNFSFHEMGTKDLPSVITYIXELQRSQVNFIYVGHSMGTTMFYVFASENARXSQNIKLWLGMGSAAYMTHITSPIRYFAHLRRILEVVTXIPWXFNQFLPNNXTGCVLF

SEQ ID NO: 21867 - protein, 261 aa, Diabrotica virgifera
  misc_feature: Coding regions on vcDNA: vcDNA=SeqID_1564; Strand=+; Position=9-794
  misc_feature: Homolog annotation: Hit_ID=XP_313005.1; Match level="QueryCoverage =88%, HitCoverage=92%, E-value=4e-52, Identity=44%"; Hit description =ENSANGP00000020427 [Anopheles gambiae]
  misc_feature: Pfam annotation: Pfam_ID=DUF1676; Match level="Score=101.8, E-value =1.7e-27, Copies=1"; Pfam description=Protein of unknown function (DUF1676)
MISKCIIVLALVAHAVLGRTTGTSAQNAVHEAAPKPEGNSYISDFRYMYKVYQECAATDVMSCLKLKLVAALDRAAKSYTELPLFEGIKFVKDPQAASAPAEVKTEAEIEANLPRSLDEKENALDSILTDRVSNFLGSHTLQIKLPSTSEMQEEGRGKKKKGNQGLLLLPLILGGTLIPLALGALALLAGKALIVSKLALVLAHFIGLKKLLSGHGGSDNQYVEVYSAGHSGWGRSNIRRKGPEYGGIRVCPENNHISYCI

SEQ ID NO: 21868 - protein, 195 aa, Diabrotica virgifera
  misc_feature: Coding regions on vcDNA: vcDNA=SeqID_1565; Strand=+; Position=539-1126
  misc_feature: Homolog annotation: Hit_ID=AAP93585.1; Match level="QueryCoverage =86%, HitCoverage=100%, E-value=5e-65, Identity=67%"; Hit description= putative thioredoxin perxidase [Apis mellifera ligustica]
  misc_feature: Gene Ontology Annotation: Molecular function=electron transporter activity; Cellular component=mitochondrion; Biological process =phospholipid metabolism
  misc_feature: Pfam annotation: Pfam_ID=GSHPx; Match level="Score=203.3, E-value =4.8e-58, Copies=1"; Pfam description=Glutathione peroxidase
MLILSYRTVCKAAVAFRSLALISNNPKMSNPENYKEASSIYDFSAKDIKGEVVSLEKYKGHVCIIVNVASQCGYTKNNYAELNDLFDEYGESKGLKILAFPCNQFANEEPGDNATICQFVQNKNVKFDVFQKINVNGDDSHPLWNYLKYKQGGTLGDFIKWNFTKFIVDKNGQPVERHGPSTNPKDLVKSLEKYW

SEQ ID NO: 21869 - protein, 195 aa, Diabrotica virgifera; identical to SEQ ID NO: 21868
  misc_feature: Coding regions on vcDNA: vcDNA=SeqID_1566; Strand=+; Position=209-796
  misc_feature: Homolog annotation: Hit_ID=AAP93585.1; Match level="QueryCoverage =86%, HitCoverage=100%, E-value=5e-65, Identity=67%"; Hit description= putative thioredoxin perxidase [Apis mellifera ligustica]
  misc_feature: Gene Ontology Annotation: Molecular function=electron transporter activity; Cellular component=mitochondrion; Biological process =phospholipid metabolism
  misc_feature: Pfam annotation: Pfam_ID=GSHPx; Match level="Score=203.3, E-value =4.8e-58, Copies=1"; Pfam description=Glutathione peroxidase

SEQ ID NO: 21870 - protein, 454 aa, Diabrotica virgifera
  misc_feature: Coding regions on vcDNA: vcDNA=SeqID_1567; Strand=+; Position=2-1362
  misc_feature: Homolog annotation: Hit_ID=XP_393117.1; Match level="QueryCoverage =96%, HitCoverage=29%, E-value=1e-107, Identity=38%"; Hit description= similar to ENSANGP00000021796 [Apis mellifera]
  misc_feature: Gene Ontology Annotation: Molecular function=serine-type peptidase activity; Cellular component=extracellular space; Biological process= cellular defense response
  misc_feature: Pfam annotation: Pfam_ID=SRCR; Match level="Score=199.0, E-value=9.3e- 57, Copies=2"; Pfam description=Scavenger receptor cysteine-rich doma
  misc_feature (299)..(299): Xaa can be any naturally occurring amino acid
DLGETDYVFTYDNGEPVELEPENVIEVKQRLIKKCSDDDFHCSVNSCISLTLLCDNNRDCADGKDEENCREYVERFSVAKNKRLVVVENQRIVNVSHATCSVLCIQNKKFTCRSFTYRRSDRNCFLSDKNIGLSGALQTHHSSDYYELKDGTIDCSDKTKYFECNNKKCLSKDYVCDGYNDCDNREDEKHCGAEKFGYKIKLAGSGQKNEGRVEITAFGSTGYICDDDFSIIDANVICRELGFPLGAAEVKGQSYFAKDLKERNTLYMIDDLNCVGNESSVIDCSFPGWGMHNCRDQEXAGVVCKTPQEKCGNDKWKCDSGNECIPFEFVCDDVEDCNDDSDESVQHCEAPTELRLVGGSYPGEGRVEIKHNGIWGTICDDDFNEDAAKVVCKSLGYKGKSFVKKDAHFGAGYGPIWLDQVSCRGNETELNTCTHWGWGEDHCEPSENVGVICS

SEQ ID NO: 21871 - protein, 246 aa, Diabrotica virgifera
  misc_feature: Coding regions on vcDNA: vcDNA=SeqID_1568; Strand=-; Position=516-1259
  misc_feature: Homolog annotation: Hit_ID=XP_317949.1; Match level="QueryCoverage =78%, HitCoverage=40%, E-value=4e-45, Identity=47%"; Hit description =ENSANGP00000020548 [Anopheles gambiae]
  misc_feature (171)..(171): Xaa can be any naturally occurring amino acid
  misc_feature (196)..(196): Xaa can be any naturally occurring amino acid
  misc_feature (207)..(207): Xaa can be any naturally occurring amino acid
  misc_feature (218)..(218): Xaa can be any naturally occurring amino acid
ICPKSICRRRGHYNKNCGNPNRANTNTRAGNVDADLIINDQKFEAVKEFISLGTSLNPNNNTSEEIRRRIIIANRCYHSLSKYLANKRLSQKTRIRLYRTLIVPVLTYGSEEWRLTKTDESSLSIFERKVIRKIFGAVCENGIWRRRYNFELQNIYKHTFGGKDITTIIKXNSLQWTGHVAWTHESNIIKKDYSSXPVGMRSRGRPXLRWMDGVTTRXEKIGVGNWKMQARDRTKWRRKLEKVEAL

SEQ ID NO: 21872 - protein, 274 aa, Diabrotica virgifera
  misc_feature: Coding regions on vcDNA: vcDNA=SeqID_1569; Strand=-; Position=235-1059
  misc_feature: Homolog annotation: Hit_ID=XP_317949.1; Match level="QueryCoverage =69%, HitCoverage=39%, E-value=4e-45, Identity=47%"; Hit description =ENSANGP00000020548 [Anopheles gambiae]
  misc_feature (238)..(238): Xaa can be any naturally occurring amino acid
MMSKGNFLRFETLEGWQLLVSFCTRDKFSICHSCYNNTYYNNKNCGNPNRANTNTRAGNVDADLIINDQKFEAVKEFISLGTSLNPNNNTSEEIRRRIIIANRCYHSLSKYLANKRLSQKTRIRLYRTLIVPVLTYGSEEWRLTKTDESSLSIFERKVIRKIFGAVCENGIWRRRYNFELQNIYKHTFGGKYIITIIKRNRLQWARHVARAPESNMIKKILTAQPVGMRRRSRPKLRXMDGVTQDAEKIGVGNWKMQARDRTEWCKKIEKVEAL

SEQ ID NO: 21873 - protein, 256 aa, Diabrotica virgifera
  misc_feature: Coding regions on vcDNA: vcDNA=SeqID_1570; Strand=+; Position=123-891
  misc_feature: Homolog annotation: Hit_ID=XP_308192.1; Match level="QueryCoverage =94%, HitCoverage=61%, E-value=1e-49, Identity=42%"; Hit description =ENSANGP00000021557 [Anopheles gambiae]
  misc_feature (71)..(71): Xaa can be any naturally occurring amino acid
  misc_feature (84)..(84): Xaa can be any naturally occurring amino acid
  misc_feature (147)..(147): Xaa can be any naturally occurring amino acid
  misc_feature (189)..(189): Xaa can be any naturally occurring amino acid
KKCKFFQTKIEFLGHVVDVNGIHPTQEKVDAIKSAPSPNSLTELKSYLGLLNYYGKFIPMLSSKLRPLSVXIDFTKNWTQECEXLTFQLSKELLTSESVLTRYNPNLPIYVTCDASGYGVGCVLSHKINNIEKPVMFGSSTLSVNEXNYSNLEREALAIIFAIKKFHKYLYGRKFVLITDHQPLQFIFXKKKGIPTSAASRITRWAVTLSGYQYDIQYRKGSSISNADGLSRLPCNNKAEISDFLYSFRLVNQIPP

SEQ ID NO: 21874 - protein, 244 aa, Diabrotica virgifera
  misc_feature: Coding regions on vcDNA: vcDNA=SeqID_1571; Strand=+; Position=88-824
  misc_feature: Homolog annotation: Hit_ID=NP_723144.1; Match level="QueryCoverage =98%, HitCoverage=99%, E-value=6e-46, Identity=40%"; Hit description =CG9107-PA, isoform A [Drosophila melanogaster] ref|NP_608981.1| CG9107-PB, isoform B [Drosophila
  misc_feature: Gene Ontology Annotation: Molecular function=molecular_function unknown; Cellular component=nucleolus; Biological process=rRNA processing
  misc_feature: Pfam annotation: Pfam_ID=RRM_1; Match level="Score=18.3, E-value =0.00071, Copies=1"; Pfam description=RNA recognition motif. (a.k.a. RRM, R
  misc_feature (224)..(224): Xaa can be any naturally occurring amino acid
  misc_feature (238)..(238): Xaa can be any naturally occurring amino acid
MSSDINTFTVLPLVLSTECTSSHDVFIKEHSIRAVSEDKPPGQTLFMLNVPPTATEAGLRNAFSSVGNIRRIIFENNTKEEGDGFKRAYIVFNKRDQLVRALQLKSLKPMSTDNEPIETGLNLWVKNYNNSICDRDVLRKKVEQFMADFDSQEKKDKTEENVDDEGWTVVTKGGRKPGLSRKESLANKLNEKVQKGAKKKELKNFYTFQIRESKKEQIALMRKXFEKDKEKVALMKQXRKFKPY

SEQ ID NO: 21875 - protein, 256 aa, Diabrotica virgifera
  misc_feature: Coding regions on vcDNA: vcDNA=SeqID_1572; Strand=+; Position=313-1083
  misc_feature: Homolog annotation: Hit_ID=AAH22251.1; Match level="QueryCoverage =98%, HitCoverage=93%, E-value=8e-33, Identity=34%"; Hit description =FLJ14007 protein [Homo sapiens]
  misc_feature: Gene Ontology Annotation: Molecular function=molecular_function unknown; Cellular component=cytoplasm; Biological process=biological_ process unknown
  misc_feature: Pfam annotation: Pfam_ID=zf-AN1; Match level="Score=8.4, E-value =0.0057, Copies=1"; Pfam description=AN1-like Zinc finger
MELPDIGKQCAHPQCKQLDFLPLNCKCGKTFCSDHFTIHAQECEVSKFLSEDELKKIENVYICSHPHCKERSIVALICERCKQHFCVQHRHLAECKEKDEETLNKEKEKYAAPVRIFNEAKAVVDKQVEKNLADAKKKPKNREMANKVQLMKIKNKATGLKTIPTVDRVYFSVSYCEKSCPVFVSSQWSLGRAIDAIAEEMKLQNNNNKANEKKLRLFTKEDSVSLSTDMSVTIKKLLGDKILIDGDTLRIKYVDS

SEQ ID NO: 21876 - protein, 288 aa, Diabrotica virgifera
  misc_feature: Coding regions on vcDNA: vcDNA=SeqID_1573; Strand=-; Position=77-943
  misc_feature: Homolog annotation: Hit_ID=XP_316292.1; Match level="QueryCoverage =96%, HitCoverage=53%, E-value=4e-64, Identity=43%"; Hit description =ENSANGP00000020582 [Anopheles gambiae]
  misc_feature: Gene Ontology Annotation: Molecular function=UDP-glycosyltransferase activity; Cellular component=microsome; Biological process=metabolism
  misc_feature: Pfam annotation: Pfam_ID=UDPGT; Match level="Score=-42.2, E-value =1.4e-08, Copies=1"; Pfam description=UDP-glucoronosyl and UDP -glucosyl tra
PAREILRKGFPGSPSLEELMTNVSLVLLNSHESTNQPVPVVPNMINVGGMHISPGKGLPKDLKVIMDNAKEGIVYFSMGSNIDPAKMKEEISTAIFDALGKLPYKVLIKWSKDVPGKSNNILIRQWFPQQDVLAHPNVKLFVTHGGLLSTLETIYYGVPVLALPIFGDQKINAAKAKAAGYGVSMSFSTITEERFSKALNEILNNKKYTENARLRSTLMHDRINKPLDTAVFWVEYIIRNKGAPHLRVAAVNMPFYEYFLLDVVVLLVLGFSIIITLVYLTCKKIYLF

SEQ ID NO: 21877 - protein, 186 aa, Diabrotica virgifera
  misc_feature: Coding regions on vcDNA: vcDNA=SeqID_1574; Strand=-; Position=291-851
  misc_feature: Homolog annotation: Hit_ID=XP_396587.1; Match level="QueryCoverage =96%, HitCoverage=92%, E-value=1e-73, Identity=72%"; Hit description =similar to ENSANGP00000008511 [Apis mellifera]
  misc_feature: Gene Ontology Annotation: Molecular function=structural constituent of cytoskeleton; Cellular component=Arp2/3 protein complex; Biological process=cell motility
  misc_feature: Pfam annotation: Pfam_ID=P21-Arc; Match level="Score=383.0, E-value =3.9e-112, Copies=1"; Pfam description=P21-ARC (ARP2/3 complex 21 kDa subunit
ITQRRTIKMPAYHSSFLEPSSIVGNIAILPIKTRFKGPGPVQSNEQEQDIIDESLFYFKANVFFRTYEIKSEADRLLIYITLYITECLKKLQKCSTKVQAQNEMRSLAISRFDIPGDPGFPLNSVYSKPANQNDGDVLKAYLTQLRQEVGMRVCDKVFGEDKKPSKWWLCFAKKKFMDKSLSGPGQ

SEQ ID NO: 21878 - protein, 523 aa, Diabrotica virgifera
  misc_feature: Coding regions on vcDNA: vcDNA=SeqID_1575; Strand=+; Position=162-1732
  misc_feature: Homolog annotation: Hit_ID=EAL40243.1; Match level="QueryCoverage =97%, HitCoverage=77%, E-value=1e-154, Identity=51%"; Hit description= ENSANGP00000027592 [Anopheles gambiae str. PEST] ref|XP_557736.1| ENSANGP00000027592 [Anopheles gambiae s
  misc_feature: Pfam annotation: Pfam_ID=AMP-binding; Match level="Score=200.7, E -value=2.9e-57, Copies=1"; Pfam description=AMP-binding enzyme
  misc_feature (22)..(22): Xaa can be any naturally occurring amino acid
MAQPTVYSEGPNQIIPSENYVXTDPSGSVRLRIPENGKAIETIKPISVPGLLEKTAREYPDKIALAQKVNGKWETVNFKQYLENVRTTAKAFLHLGLKPNHSVCILGFNSPEWFYSDLAAIFAGGIAVGVYTTNSAEACYFCAENSKANIIVVEDQKQLDKILEVRSRLPELKAIVQYSGEPTHPDVISWKRLMEIGAQQTDDALNNALKQVAINRCCTLVYTSGTVGNPKGVMLSHDNLTWDALVITERMGLSAGGEEVLISYLPLSHVAAQVVDIYITITVAAAVYFADKDALKGTLINTMQEVRPTKFLGVPRVYEKIFEKMMQIAAKSGALRKFISGWAKKQALQHHVDTMNGLQSNSWGYMFAKNVLFSKVKQALGLSRCTFFASAAAPLAPDVKRYFHSIDIPVMDCFGMSEASGGHCLGIEGATNFDTIGMTMPGMKTKLFNEENGQGELCMYGRHVFMGYLNEPGKTTEALDEEGWLHSGDLGRIDDKQLVYITGRYTELLVTAITHPRPRCHQT

SEQ ID NO: 21879 - protein, 299 aa, Diabrotica virgifera
  misc_feature: Coding regions on vcDNA: vcDNA=SeqID_1576; Strand=+; Position=572-1471
  misc_feature: Homolog annotation: Hit_ID=XP_314697.1; Match level="QueryCoverage =96%, HitCoverage=43%, E-value=1e-74, Identity=47%"; Hit description =ENSANGP00000013234 [Anopheles gambiae]
MAQPTVYSEGPNQIIPSENYVCTDPSGSVRLRIPENGKAIETIKPISVPGLLEKTAREYPDKIALAQKVNGKWETVNFKQYLENVRTTAKAFLHLGLKPNHSVCILGFNSPEWFYSDLAAIFAGGIAVGVYTTNSAEACYFCAENSKANIIVVEDQKQLDKILEVRSRLPELKAIVQYSGEPTHPDVISWKRLMEIGAQQTDDALNNALKQVAINRCCTLVYTSGTVGNPKGVMLSHDNLTWDALVITERMGLSAGGEEVLISYLPLSHVAAQVVDIYITITVAAAGYFPAQDAFRDSL

SEQ ID NO: 21880 - protein, 259 aa, Diabrotica virgifera
  misc_feature: Coding regions on vcDNA: vcDNA=SeqID_1577; Strand=+; Position=65-844
  misc_feature: Homolog annotation: Hit_ID=XP_393185.1; Match level="QueryCoverage =93%, HitCoverage=38%, E-value=1e-24, Identity=30%"; Hit description =similar to ENSANGP00000022165 [Apis mellifera]
  misc_feature: Gene Ontology Annotation: Molecular function=chaperone activity; Cellular component=nucleolus; Biological process=protein folding
KYILKMSEVDSVNTNNAVNEENSQEEKSSKTRKSKSKSPRLTTIERAREESEAITKGLGPEVEGRRRTRSAAKGVTATPPPPAKKERKSSSTTKSSRGRPKRTVEESSDSHDEKSETSVAESEEQAKSIDESKSEADTTETNSHDDKEESGNNNADASKCEDQAMSVDEKSEADGNETNSHDDKEESANNNADAKDEADADAEESTPAPAATENGAKEDSVDAPASEEEKKDEEEESKSTADEPESASTEQTEDEKPAE

SEQ ID NO: 21881 - protein, 400 aa, Diabrotica virgifera
  misc_feature: Coding regions on vcDNA: vcDNA=SeqID_1578; Strand=+; Position=592-1794
  misc_feature: Homolog annotation: Hit_ID=BAB79277.1; Match level="QueryCoverage =100%, HitCoverage=100%, E-value=0.0, Identity=73%"; Hit description =calreticulin [Galleria mellonella]
  misc_feature: Gene Ontology Annotation: Molecular function=calcium ion binding; Cellular component=extracellular space; Biological process=central nervous system development
  misc_feature: Pfam annotation: Pfam_ID=Calreticulin; Match level="Score=715.7, E -value=2.8e-212, Copies=1"; Pfam description=Calreticulin family
MKYLAVFVIFAYLYAAHASVYLEEKFSDDSWEKNWIYSKNPDKEFGKFVRTAGKFFNDEEEDKGLQTSEDARFYALSRKFKSFSTEGKDLVIQFTVKHEQNIDCGGGYVKVFDCSLKPEELHGETPYRLMFGPDICGPGTKKVHVILNYKDKNVLINKDIRCKDDIYTHAYTLIVRPDNTYEVQIDGEKVESGELESDWDLLPPKKIKDPEAKKPEDWDDRATIPDPDDSKPEDWDKPEHIPDPDATKPDDWDDEMDGEWEPPMIDNPEYKGEWKPKQIDNPAYKGAWVHPEIDNPEYTPDANLYKQKEICGIGFDLWQVKSGTIFDNVLVTDDVDYAKKALSGLKDKQEGEKKVKEEQDKAERESTSEDEKKEDDDDDDEDDDAEEHVPQVEEGDHDEL

SEQ ID NO: 21882 - protein, 257 aa, Diabrotica virgifera
  misc_feature: Coding regions on vcDNA: vcDNA=SeqID_1579; Strand=+; Position=101-874
  misc_feature: Homolog annotation: Hit_ID=EAL29884.1; Match level="QueryCoverage =87%, HitCoverage=68%, E-value=2e-28, Identity=33%"; Hit description =GA10999-PA [Drosophila pseudoobscura]
  misc_feature: Gene Ontology Annotation: Molecular function=phosphatidate phosphatase activity; Cellular component=integral to membrane; Biological process=biological_process unknown
  misc_feature: Pfam annotation: Pfam_ID=PAP2; Match level="Score=33.0, E-value=8.7e -07, Copies=1"; Pfam description=PAP2 superfamily
MGVILSTLGIQEPKLSLRPQKVVVGTIHGTQITLAYVLNTFVSIFAVLMIVLLEFGTIPAVQQGFYCGDPLISHKYTGDTITPVTLGLTAPLLVIVMVLVTELLAHQSIKQINLHAVAFYVSESSVGATLTLLVTSIGKVLVGEHRPHFLDTCEPDTAKNCSIGTFIETYTCTSTEFEPSFLVDSSLSFPSGHSSIAWFIGIFSAYVVHVRMTTVNSGYIMRPFLISVCLTWSMVCSLSRITDRRHHWWDVLAGSGL

SEQ ID NO: 21883 - protein, 95 aa, Diabrotica virgifera
  misc_feature: Coding regions on vcDNA: vcDNA=SeqID_1580; Strand=-; Position=573-860
IFTYIICNEIVHHHCFSFYATFFEGVIVLQLHILKRFIWVYFVLTRFVIIFIFFCISLMLPSEIRSFNVIVVAVEQNNLKMFNNIKRTVGTEELF

SEQ ID NO: 21884 - protein, 121 aa, Diabrotica virgifera
  misc_feature: Coding regions on vcDNA: vcDNA=SeqID_1581; Strand=+; Position=1-366
GGRIQGTEAEVGKFKEKEHEQSTLHYQQYTEELNTQLLTIQEQYQHIQQENDKLSAEVQNRVHHICDLERQLQNKQNEKVTFTSSNGTGLNVKEELEVTKELCVQLQVRLNYFSCKYFKYF

SEQ ID NO: 21885 - protein, 109 aa, Diabrotica virgifera
  misc_feature: Coding regions on vcDNA: vcDNA=SeqID_1582; Strand=-; Position=1279 -1608
KIHNSEKKRDHVTVKLINIYFLKKSIAPSCPLESRVSRYTTSVGGRYFSKLVNSNNEKNYNTPSLDHKIINFELCSFTDKRPDKSPPSAQAINKEFGLCSSSRIVNHTF

SEQ ID NO: 21886 - protein, 159 aa, Diabrotica virgifera
  misc_feature: Coding regions on vcDNA: vcDNA=SeqID_1583; Strand=-; Position=2-478
  misc_feature: Homolog annotation: Hit_ID=AAH86039.1; Match level="QueryCoverage =69%, HitCoverage=13%, E-value=8e-46, Identity=77%"; Hit description =Unknown (protein for MGC:98172) [Xenopus laevis] ref|NP_009057.1| valosin-containing protein [Homo sapiens
  misc_feature: Gene Ontology Annotation: Molecular function=protein binding; Cellular component=microsome; Biological process=microtubule cytoskeleton organization and biogenesis
RIWSLFKFKDSKSHVLREITLFHVALLPYLVLSFSITYFLFPQGGAAAPCRFIGEYGMRIRVLPIHDTAKGLTRNLFKVYLKPYFLEAYRPIHKDDVFVVRGGMRAVEFKVVETDPAPYCIVAPDTVIHCDGDPIKREEEEEALNAVGYDDIGGSRRQL

SEQ ID NO: 21887 - protein, 803 aa, Diabrotica virgifera
  misc_feature: Coding regions on vcDNA: vcDNA=SeqID_1584; Strand=-; Position=162-2573
  misc_feature: Homolog annotation: Hit_ID=XP_315645.1; Match level="QueryCoverage =100%, HitCoverage=98%, E-value=0.0, Identity=89%"; Hit description =ENSANGP00000021747 [Anopheles gambiae]
  misc_feature: Gene Ontology Annotation: Molecular function=protein binding; Cellular component=endoplasmic reticulum; Biological process =microtubule cytoskeleton organization and biogenesis
  misc_feature: Pfam annotation: Pfam_ID=AAA; Match level="Score=641.0, E-value=8.2e -190, Copies=2"; Pfam description=ATPase family associated with various
MAENKNPEDLATAILRKKDRPNRLLVEEAVNDDNSVVALSQAKMDELQLFRGDTVLLKGKRRKETVCIVLSDDTCSDEKIRMNRNVRNNLRVRLSDVVSIQACPDVKYGKRIHVLPIDDTVEGLTGNLFEVYLKPYFLEAYRPIHKDDVFVVRGGMRAVEFKVVETDPAPYCIVAPDTVIHCDGDPIKREEEEEALNAVGYDDIGGCRKQLAQIKEMVELPLRHPSLFKAIGVKPPRGILLYGPPGTGKTLIARAVANETGAFFFLINGPEIMSKLAGESESNLRKAFEEADKNSPAIIFIDELDAIAPKREKTHGEVERRIVSQLLTLMDGMKKSSHVIVMAATNRPNSIDPALRRFGRFDREIDIGIPDATGRLEVLRIHTKNMKLADDVDLEQIAAETHGHVGADLASLCSEAALQQIREKMDLIDLEDDQIDAEVLNSLAVTMENFRYAMTKSSPSALRETIVEVPNVTWDDIGGLANVKKELQELVQYPVEHPDKFLKFGMQPSRGVLFYGPPGCGKTLLAKAIANECQANFISVKGPELLTMWFGESEANVRDIFDKARSAAPCVLFFDELDSIAKSRGGNVGDAGGAADRVINQILTEMDGMGAKKNVFIIGATNRPDIIDPAILRPGRLDQLIYIPLPDEKSREAIFKANLRKSPVAKDVDLVYIAKVTHGFSGADLTEICQRACKLAIRQSIETEIRRERERALNPNVAMDLDDDDPVPEITRAHFEEAMRFARRSVSDNDIRKYEMFAQTLQQSRGFGTNFRFPTAAGGPAAPGGTGGDQANFQDDPEDDLYS

SEQ ID NO: 21888 - protein, 344 aa, Diabrotica virgifera
  misc_feature: Coding regions on vcDNA: vcDNA=SeqID_1585; Strand=+; Position=2368 -3402
  misc_feature: Homolog annotation: Hit_ID=EAA05259.3; Match level="QueryCoverage =88%, HitCoverage=53%, E-value=1e-45, Identity=37%"; Hit description =ENSANGP00000018463 [Anopheles gambiae str. PEST] ref|XP_564149.1| ENSANGP00000018463 [Anopheles gambiae st
  misc_feature: Gene Ontology Annotation: Molecular function=muscle motor activity; Cellular component=endoplasmic reticulum; Biological process=Golgi organization and biogenesis
MKLLYITTYEMEKTELEENYTKALNEKEMLMKELAAKNDSLNQLETMVEQLKGNQPDTAKLLATMESDKVAAARAVQQNMELKEQLESMAEVFAKMNNDKVELTEKLSIQQSASKDLLEKLQKTELHLQMLTDAIEIKDRELSHLREASELNEVLDHEEQHTDESHETCSHTLQNELKEATETIVKLTNELNNQRNQMSPSPQVSVGDDISYLLKQLEELKLKNQELETKLENHTIDDNYNNKLLTEEESESILQKEEAMKRLEEKFKRRMQDIADLTEEKQRLEHLVLQLQGETETIGEYVALYQHQRMILKQKVSEFIFFHKLFLMRYFILSCQDMSFILIV

SEQ ID NO: 21889 - protein, 525 aa, Diabrotica virgifera
  misc_feature: Coding regions on vcDNA: vcDNA=SeqID_1586; Strand=+; Position=3-1580
  misc_feature: Homolog annotation: Hit_ID=EAA05259.3; Match level="QueryCoverage =80%, HitCoverage=72%, E-value=6e-65, Identity=36%"; Hit description =ENSANGP00000018463 [Anopheles gambiae str. PEST] ref|XP_564149.1| ENSANGP00000018463 [Anopheles gambiae st
  misc_feature: Gene Ontology Annotation: Molecular function=actin binding; Cellular component=endoplasmic reticulum; Biological process=Golgi organization and biogenesis
IQHHGGRIQGTEAEVGKFKEKEHEQSTLHYQQYTEELNTQLLTIQEQYQHIQQENDKLSAEVQNRVHHICDLERQLQNKQNEKVTFTSSNGTGLNVKEELEVTKELCVQLQMEKTELEENYTKALNEKEMLMKELAAKNDSLNQLETMVEQLKGNQPDTAKLLATMESDKVAAARAVQQNMELKEQLESMAEVFAKMNNDKVELTEKLSIQQSASKDLLEKLQKTELHLQMLTDAIEIKDRELSHLREASELNEVLDHEEQHTDESHETCSHTLQNELKEATETIVKLTNELNNQRNQMSPSPQVSVGDDISYLLKQLEELKLKNQELETKLENHTIDDNYNNKLLTEEESESILQKEEAMKRLEEKFKRRMQDIADLTEEKQRLEHLVLQLQGETETIGEYVALYQHQRMILKQKAMEKDQQFKQLATDREQIKIKLEKLNHLVGELLKSKTLSSEILGQCERLHESENKEVETTEDFNKEESPHTETAEEILTLLSEIKSSNLVEPKESIHHCPFCSGQLITV

SEQ ID NO: 21890 - protein, 393 aa, Diabrotica virgifera
  misc_feature: Coding regions on vcDNA: vcDNA=SeqID_1587; Strand=+; Position=20-1198
  misc_feature: Homolog annotation: Hit_ID=XP_395987.1; Match level="QueryCoverage =39%, HitCoverage=30%, E-value=2e-16, Identity=30%"; Hit description =similar to ENSANGP00000018463 [Apis mellifera]
  misc_feature: Gene Ontology Annotation: Cellular component=Golgi apparatus
MADASKAQKLKLANSRKRFKELQELKKKKNATASVDNSEKDLREPTPVDSLVSSTHSSINAESELANVTNTQLPNYFMTTAQSDPATFFENLSTTNTNVGDVGNISDVVETPMFEQHVPFDNNYALFNQTNQQSYIKETQHIIRPNTDSLTIEDPELVQNEIFDHHRHNLIPDQIENSDAQTYEGSYNENNPVHNSFKQNVSDTNLSDFSTQVAHIIPESQSDSNLIIDLEQRNAELTSFLEQEKIQSQQQQLQINELQARIYHLELENATKDNNSVINKLEEDLKCHSQTIRLLVAEKSELSNAVAQQEVTFKNKNSECEELQARLKASRSRAFELEQELNTLKSERIHKETNNHDQNKVLENTLKDFNELRDSKEELDRISSKFREKLKSA

SEQ ID NO: 21891 - protein, 459 aa, Diabrotica virgifera
  misc_feature: Coding regions on vcDNA: vcDNA=SeqID_1588; Strand=+; Position=2-1380
  misc_feature: Homolog annotation: Hit_ID=EAA08109.2; Match level="QueryCoverage =99%, HitCoverage=52%, E-value=1e-173, Identity=64%"; Hit description= ENSANGP00000018217 [Anopheles gambiae str. PEST] ref|XP_563080.1| ENSANGP00000018217 [Anopheles gambiae s
  misc_feature: Gene Ontology Annotation: Molecular function=dynamine GTPase activity; Cellular component=coated pit; Biological process=synaptic transmission
  misc_feature: Pfam annotation: Pfam_ID=Dynamin_M; Match level="Score=404.6, E-value= 1.2e-118, Copies=1"; Pfam description=Dynamin central region
  misc_feature (77)..(77): Xaa can be any naturally occurring amino acid
KLLPLRRGYVGVINRSQRDIDGQKDIKLALEAERKYFLGHPSYTHIADKLGTPYLQKVLNEQLTNHIRNTLPSLRDXLQKQVIILEKELGDFKNFSPDDPSMKSKAMLQMIQQFALSFEKVLEGSRSDDVNTTELSGGARINCVFHERFPFEVVKMEFDESELRKEIAIAIANIHGIRIGLFTPDLAFDAIVKKQISRLKDPCLKCVDLVSTELLNVVHNCSEQMSRFPRLREIVERVITNHVRKREQECRDQLSVYINCQLSYMNTNHEDFIGFANAESQAKKTIPTHNNHLGNQVIRKGYMTLHNLSIIKGRSFWYVLSSDSLAWYRDETEKEIQYILPLNKLKLRDVETGFINRKPTFALFYPHGSNVYKDYKQLELSCNSVDDMDSWKASFLRAGVYPQKLLNNNEESDDESIDIQENVDPQLKRQVEVIRNLVENYMSIVTKAPKDLVPKILPL

SEQ ID NO: 21892 - protein, 374 aa, Diabrotica virgifera
  misc_feature: Coding regions on vcDNA: vcDNA=SeqID_1589; Strand=+; Position=203-1324
  misc_feature: Homolog annotation: Hit_ID=EAL31502.1; Match level="QueryCoverage =91%, HitCoverage=96%, E-value=1e-140, Identity=69%"; Hit description= GA15916-PA [Drosophila pseudoobscura]
  misc_feature: Gene Ontology Annotation: Molecular function=signal transducer activity; Cellular component=nucleus; Biological process=MAPKKK cascade
  misc_feature: Pfam annotation: Pfam_ID=Pkinase; Match level="Score=269.6, E-value =5.4e-78, Copies=1"; Pfam description=Protein kinase domain
  misc_feature (270)..(270): Xaa can be any naturally occurring amino acid
  misc_feature (341)..(341): Xaa can be any naturally occurring amino acid
MSNANRMSTGALPKSNPITEDYEISRTVLGLGINGKVVECYSKTTKEKYALKILPDSAKGWREADLHCKATGCRHVVEIIDVYENTYKRHAAVLMVMECMEGGELFQRIQDKAEGAFTEREAAQIMHDICIAVKYLHDRDIAHRDLKPENLLYSKPGPLGVLKLTDFGFAKETSSLVTLQTPCYTPYYVAPEVLGSQKYDKSCDIWALGVIMYILLCGYPPFYSDHGLSMSPGMKSRIRAGQFTFPDAEWKQISPDAKHLITGMLTVDPXKRFTIDQVMNNRWIAQYAAVPQTPLHTNRVLKETVELWPEVQEEMTRSLATMRVDYDQSSIKTLENSHNPXLLHKRRKKNAIYTPLVHFFTFIYSILYITSDLN

SEQ ID NO: 21893 - protein, 421 aa, Diabrotica virgifera
  misc_feature: Coding regions on vcDNA: vcDNA=SeqID_1590; Strand=+; Position=13-1275
  misc_feature: Homolog annotation: Hit_ID=XP_312564.1; Match level="QueryCoverage =79%, HitCoverage=55%, E-value=6e-49, Identity=34%"; Hit description =ENSANGP00000014256 [Anopheles gambiae]
  misc_feature: Gene Ontology Annotation: Molecular function=serine esterase activity; Cellular component=synaptic junction; Biological process =biological_process unknown
  misc_feature: Pfam annotation: Pfam_ID=COesterase; Match level="Score=184.2, E -value=2.8e-52, Copies=1"; Pfam description=Carboxylesterase
MERFVLCFIIFPIIFIGGSDSCKEKPIIKLSDGSIQGIRETSNSGKPYYAFREIPYAEPPIGELRFSEPISPKKWKGVKETVNITKICLTQLPPLIPYELQYYTDNKRENEDCLYLNVFTPQLPYKENITGFPVYVYIYGGFFIYGNPTGYDFQYLVDEGVVVVSFNYRMNSLGFLSTEDNVFPANLGLKDQLMVLKWVNKNIELFGGDPTKVTLGGHSAGAILTGYHLLSKKSKGLFRSAIVQSGTPLMSFGYIANPRKFAFMLGEKLSRDFHSSMNTSQDLLKLLRSLPGKEVAQVNLGNIEGFDYKLVEFRSTWAPTKEDPNYEHAFLTDDTMHENFKKGHFNQVPVMIGITDEEFKDYGNLTRAGLLVDSNYSLLIDPVVPLKKENILPMGNEIKNIYCNTNRFAQNATGMGQILSD

SEQ ID NO: 21894 - protein, 250 aa, Diabrotica virgifera
  misc_feature: Coding regions on vcDNA: vcDNA=SeqID_1591; Strand=+; Position=72-824
  misc_feature: Homolog annotation: Hit_ID=XP_312448.1; Match level="QueryCoverage =93%, HitCoverage=93%, E-value=1e-19, Identity=29%"; Hit description =ENSANGP00000022521 [Anopheles gambiae] gb|EAA44924.1| ENSANGP00000022521 [Anopheles gambiae
MINGSNSFFLFFSTVVFLCSSNADTCINHDPCLCRINENDKINISALSEDIKAPKYLSDTDGNLTYTFLGCKDEIFPTDDKTQQYKGTLILTNRTWDFNKTKNIYDVIGSSALARFSKDDDGYMLTYANGSEPQAIITLLCNSYKEPYLKITDLQKLSLVLSSPKLCIQTEEHGMSGGSVFLLIFFIVAGVYFVGGAALMYFIRGARGVEMIPNIDFWRNLPGLIKDGLIFLLSGCKPNFVTTAETYDRI

SEQ ID NO: 21895 - protein, 328 aa, Diabrotica virgifera
  misc_feature: Coding regions on vcDNA: vcDNA=SeqID_1592; Strand=+; Position=16-1002
  misc_feature: Homolog annotation: Hit_ID=BAA95789.1; Match level="QueryCoverage =95%, HitCoverage=86%, E-value=4e-17, Identity=23%"; Hit description =KED [Nicotiana tabacum]
  misc_feature: Gene Ontology Annotation: Molecular function=structural molecule activity; Cellular component=microtubule associated complex; Biological process=embryogenesis and morphogenesis
HTFCLNICRKPNLLKMTDVAPKTPNKRKSLGVKNNSTKKVKLENGQTPKQPGSAIKQKGQPSPKQQTKLDTPKQNKQTPKKNKTPKPQLKTPKQEVSVKKEQKQQTPKQQVVTSNNPSKKAKKVPKGTAQVEQKVKKEKTPQSSDQQKKSPNDKKKKRRPYFLLKSLAKSTDNAEKAKAIKDIDEKIKLIESRPELTKTANRKLHLLKKFKRIAQGLPPPAPPVKSESAQGKAKKKEAAAGKQNKQQKGKVQKVVKKEPEPEEDDSDDEEETVVSKAKIQKVVTKQEADSDDDDGSEEESGEEEGSGDEEESGDEEDNDDDESEEESD

SEQ ID NO: 21896 - protein, 288 aa, Diabrotica virgifera
  misc_feature: Coding regions on vcDNA: vcDNA=SeqID_1593; Strand=+; Position=103-969
  misc_feature: Homolog annotation: Hit_ID=XP_392911.1; Match level="QueryCoverage =96%, HitCoverage=40%, E-value=2e-83, Identity=56%"; Hit description =similar to CG11030-PA [Apis mellifera]
  misc_feature: Gene Ontology Annotation: Cellular component=nucleus; Biological process=rRNA processing
  misc_feature (268)..(268): Xaa can be any naturally occurring amino acid
MVQTSGVNMKYRDLPQVLILLNEMNVSAQHVAALVDSMIQKVRKGELTTDQGLSFLEMKYNMLLTYLINLTYVVLRKCCGEKIEGDPCIDRLIEIRTVLEKIKPIDQRLKYQIDKLVKTATTGKTADDPTHYKANPDNLLGNSDDSESVVSEVEKESRDRKSVYVPPKLTALYYTGDETSQQRAKTLQERSKKNVISSAIMQDLREEYLDTPLEVSQSSRAQQVLSKQQQERQEYEEKYMTRLSVSKSEKHKKHQLTTLGTLGDEITXFGRSQRNKGKKKFSSNKKGT

SEQ ID NO: 21897 - protein, 64 aa, Diabrotica virgifera
  misc_feature: Coding regions on vcDNA: vcDNA=SeqID_1594; Strand=-; Position=673-867
YDVRTNEGVFWTGCYNLNYLSILIVFRGQTKDKNNFFFFDIYFKLCPRVWCLLCKNHDIPVCYS

SEQ ID NO: 21898 - protein, 63 aa, Diabrotica virgifera
  misc_feature: Coding regions on vcDNA: vcDNA=SeqID_1595; Strand=+; Position=2-193
  misc_feature (25)..(25): Xaa can be any naturally occurring amino acid
GNDFVPMHDNAKPHSARITQQFLNXVNVPVMDWPALSPDANPIEHVWDMLGRSGGSSEEAREA

SEQ ID NO: 21899 - protein, 133 aa, Diabrotica virgifera
  misc_feature: Coding regions on vcDNA: vcDNA=SeqID_1596; Strand=+; Position=3-404
FPPPPYIIKKKIFFILKKKNKPPPSTFFFLYFFFFYIFFYFSQKYPKKKKKKKGPFFLKKKRAFYFFPPKKDFYFLKTGVPPPFNKLGPPRKFFKVFGVPPNPHQFTKTIVQFSPMGPTFHPKKKDQINRNQH

SEQ ID NO: 21900 - protein, 105 aa, Diabrotica virgifera
  misc_feature: Coding regions on vcDNA: vcDNA=SeqID_1597; Strand=-; Position=2704 -3021
IFSPKNFFFCLFFGKKKIFFFFELFLKNLKFKKFCGVGETVFKRGLPTFFFFYNIIFNFFLKNKISKNFPPSKTLKKKKKFLNFFGFLKLFKRIKKGRAPWGGCS

SEQ ID NO: 21901 - protein, 77 aa, Diabrotica virgifera
  misc_feature: Coding regions on vcDNA: vcDNA=SeqID_1598; Strand=-; Position=743-976
CRDFRTMLNAPWYVPNYVIEKDLNVPSIKTVITEYYKKYSKRLESHPNELASNLTDDHNDVRRLKRFKVVDLARRFK

SEQ ID NO: 21902 - protein, 597 aa, Diabrotica virgifera
  misc_feature: Coding regions on vcDNA: vcDNA=SeqID_1599; Strand=+; Position=106-1897
  misc_feature: Homolog annotation: Hit_ID=XP_392448.1; Match level="QueryCoverage =98%, HitCoverage=94%, E-value=1e-168, Identity=47%"; Hit description= similar to ENSANGP00000018261 [Apis mellifera]
  misc_feature: Gene Ontology Annotation: Molecular function=transporter activity; Cellular component=extracellular space; Biological process=transport
  misc_feature: Pfam annotation: Pfam_ID=AMP-binding; Match level="Score=231.6, E -value=1.5e-66, Copies=1"; Pfam description=AMP-binding enzyme
  misc_feature (592)..(592): Xaa can be any naturally occurring amino acid
MFANILGCQALLLLFVLLISCFFLTNGRYRYLYILYKTWRRDLRGLSKVFPAMYRIAKCEKNQETIPKLFTKIAKSRPHKVAFYFEDETWTFGQIEDYSNKMANYFISLGYEKGDTVALLLENRPEYAAIWIGLSKIGVVTALINTNLVSKPLQHCISVAKVRALIFGSDFASAVKEIYPESGEIKLYHFKTSPSAESRNGVLDIKECISNQSVASPQKHMDMSNTKDKLLYIYTSGTTGLPKAAKITHARFNFAVTGINYFLSLGENDNFYNPLPLYHATGGMLTVGQTLIFGVTMTLRRKFSASHFWTDCNKYNCTVANYIGETCRYILAAHKGKPTIAHGVKKMFGNGLKKDVWKDFVETFNIPELFEFYGSTEGNTNLINLDNTIGSVGFLPFYLGPIFSICLIKCDDETKEPLRDANGLCIRCKDNEPGILIGKIYKKISTHNFDGYVDQKETNKKILQDVFQKGDSYFNSGDMMVQDEFGYLYFRDRTGDTYRWKGENVATTEVELVVSDVIGPKDIVVYGVEVPKTDGKAGMIAVADEEKSLDRKALAERVKAHLPAYAIPIFLRVMDSLPMTGTFKVKKNELQXDGYDV

SEQ ID NO: 21903 - protein, 149 aa, Diabrotica virgifera
  misc_feature: Coding regions on vcDNA: vcDNA=SeqID_1600; Strand=+; Position=9-458
  misc_feature: Homolog annotation: Hit_ID=XP_321122.1; Match level="QueryCoverage =82%, HitCoverage=17%, E-value=2e-27, Identity=48%"; Hit description =ENSANGP00000018437 [Anopheles gambiae]
RVREEEDLDDLPLNALPTISFNKKSPSSKQESCNDSCLDESQKKTRKHKKRKGKLPKNYDALVAPDPERWLPKYERTGYRKKRDRRAKEVIKGSQGTASGQAEQYDFSKFVEDSSDTASTSVDPSPRPSSKSAQTHHKKSQQKKKGKRR

SEQ ID NO: 21904 - protein, 166 aa, Diabrotica virgifera
  misc_feature: Coding regions on vcDNA: vcDNA=SeqID_1601; Strand=+; Position=15-515
  misc_feature: Homolog annotation: Hit_ID=XP_311490.1; Match level="QueryCoverage =66%, HitCoverage=69%, E-value=5e-28, Identity=55%"; Hit description =ENSANGP00000013659 [Anopheles gambiae]
  misc_feature: Gene Ontology Annotation: Cellular component=integral to membrane; Biological process=cell adhesion
  misc_feature: Pfam annotation: Pfam_ID=Ninjurin; Match level="Score=119.2, E-value =1e-32, Copies=1"; Pfam description=Ninjurin
MGNMSQKDSKVNVAGQNHHTHRDGNVISEILRSTLDVNKYATKKTIAQGLLDIALLTANASQLKFILQVGEEHQFYLLMLILISTSIILQVIQAALCVILGGSYDINKEHHQDNANKTNNIIMVVNIVIMAVNVIINSFEMKSEYLINMFHAAKTSTTTIASTIKS

SEQ ID NO: 21905 - protein, 60 aa, Diabrotica virgifera
  misc_feature: Coding regions on vcDNA: vcDNA=SeqID_1602; Strand=-; Position=1004 -1186
KKHSVFALSLTKTEVPMAGSTKSTAQVFAREQRDIVLKSIDGVAHGIYLGVFDEILLGFI

SEQ ID NO: 21906 - protein, 302 aa, Diabrotica virgifera
  misc_feature: Coding regions on vcDNA: vcDNA=SeqID_1603; Strand=+; Position=76-984
TLKYLSKMVSVNWRYIYPITTIYLNLTVQVLSDLIFENRYRIAIGRVTILIQDLEGEQEHCNYNYNLTYIGDESCPFKMLQSTMSFNDIAQKTIIKNVTCITLRDDTRYYTLIKHSNSCNVLTLEIIQTENINVCLEKLSQQINNEYEKKNNVKYLGKQLKNIKIVGSGANTSPTSYILSVSKQTSTESDLTHTTITTWHWNKSELHALALLLSGTLILIIIILISLIYMIWKMCKPFKADQRKQYGYINIYREDSTTSDGYLTPKLVQPPQYEELIYSSPNLQANIDIRAMRDGYLKSRIV

SEQ ID NO: 21907 - protein, 146 aa, Diabrotica virgifera
  misc_feature: Coding regions on vcDNA: vcDNA=SeqID_1604; Strand=+; Position=54-494
  misc_feature: Homolog annotation: Hit_ID=XP_316431.1; Match level="QueryCoverage =95%, HitCoverage=96%, E-value=2e-39, Identity=47%"; Hit description =ENSANGP00000021011 [Anopheles gambiae]
MAAYYWVDCHARGALPSTALRGGVDIDGAEIFVGRSYHEGDWLPAKVIPSKDVAYVAYNGGEHAKDQFQVLCEQRFDWVPSGNGHVPFGAVEGGRTSDGEPLYIGRVYHLGSHTVGKVHPSHGTCYIPFDGKEIGYPHYEILVLRS

SEQ ID NO: 21908 - protein, 205 aa, Diabrotica virgifera
  misc_feature: Coding regions on vcDNA: vcDNA=SeqID_1605; Strand=+; Position=3-620
YLYRYHCVIFSSGGRPSLSTLTKLCTKMSIYEDKTQRDPYLIHREICIPNTLSTCKESVYQFAIISINKKLKYNISTSEVTQSTCTNGTYEINTYDKIIVLLIILYTSLVFISTYFDKYKRNRFRGYPDKFLLHFSLYRTWKNRTDISKNENYQKLLSMQGLRVYMMLIVMLLQLTLLYINIPVKNPNYHRDLLYTGVSQDWSKY

SEQ ID NO: 21909 - protein, 90 aa, Diabrotica virgifera
  misc_feature: Coding regions on vcDNA: vcDNA=SeqID_1606; Strand=-; Position=152-424
NQYEKLKTLALEHFKSFNNNGSQRLTRYYSRYFVSNAGISHGSQGINLPTYMYLHYTCYSILLVYLSLLLVYKHGRPMSSSGSRGADDDD

SEQ ID NO: 21910 - protein, 102 aa, Diabrotica virgifera
  misc_feature: Coding regions on vcDNA: vcDNA=SeqID_1607; Strand=+; Position=41-349
IVLYILSIISNILVFLILCILDIGAVLLQNSDFRIFLLVVKIRCYMLQCCYRCYVYFLWRYFWSHRIVFNNAIAFLPCVHFSWLFLSNVPSCVILRPKYLYS

SEQ ID NO: 21911 - protein, 125 aa, Diabrotica virgifera
  misc_feature: Coding regions on vcDNA: vcDNA=SeqID_1608; Strand=+; Position=75-449
  misc_feature: Homolog annotation: Hit_ID=XP_309978.1; Match level="QueryCoverage =96%, HitCoverage=24%, E-value=2e-41, Identity=63%"; Hit description =ENSANGP00000015951 [Anopheles gambiae]
  misc_feature: Pfam annotation: Pfam_ID=SBP56; Match level="Score=-272.7, E-value =0.0003, Copies=1"; Pfam description=56kDa selenium binding protein (SBP56)
MANGSGPGYATPLDAMKNGPKEKLMYVVCINPNEGEDKTDLLATVDVDPESPTYCQIIHRLRTGHKNDELHHSGWNVCSSCHSSTGCCNGLVRDKLILPALGSDRIYVVDVGKNPKAPEFHKIIE

SEQ ID NO: 21912 - protein, 350 aa, Diabrotica virgifera
  misc_feature: Coding regions on vcDNA: vcDNA=SeqID_1609; Strand=+; Position=215-1267
  misc_feature: Homolog annotation: Hit_ID=NP_648413.1; Match level="QueryCoverage =98%, HitCoverage=47%, E-value=1e-113, Identity=56%"; Hit description= CG6418-PB [Drosophila melanogaster] gb|AAF50131.1| CG6418-PB [Drosophila melanogaster]
  misc_feature: Gene Ontology Annotation: Molecular function=pre-mRNA splicing factor activity; Cellular component=spliceosome complex; Biological process =mRNA splicing
  misc_feature: Pfam annotation: Pfam_ID=DEAD; Match level="Score=28.2, E-value=8.4e -08, Copies=1"; Pfam description=DEAD/DEAH box helicase
MAFNYANIHSNQKRHNAVPPPSSGVSKQGYSTMNAISQNALSAAWGGSRKRVATEDEYFDDDEEETVPDLAYIPAPGSPTRLEMMQKKNVEDDEDDPLDAYMAGIEQQVHRESLQKSEPTQGIRNDLEEEDVEESYYRYMEENPNAGVPQTDDDHPEVEYDEDGNPIAPDKKKIIDPLPPIDHSTIEYQPFEKVFYEEHSDINELTDEQVKELRKVLDISVTGSNAPKPVSSFAHFGFEEKLMKAIIKAEYSTPTPIQAQAVPCALLGRDVLGIAQTGSGKTAAFLWPMMKHIAVQKPVEEGEGPIAMILAPTRELALQIYNDAKKFAKVYDLRVICAYGGGSKWEQVWH

SEQ ID NO: 21913 - protein, 256 aa, Diabrotica virgifera
  misc_feature: Coding regions on vcDNA: vcDNA=SeqID_1610; Strand=+; Position=3-773
  misc_feature: Homolog annotation: Hit_ID=XP_318571.1; Match level="QueryCoverage =93%, HitCoverage=38%, E-value=1e-100, Identity=68%"; Hit description= ENSANGP00000020921 [Anopheles gambiae]
  misc_feature: Gene Ontology Annotation: Molecular function=protein tyrosine/serine/threonine phosphatase activity; Cellular component =cellular_component unknown; Biological process=protein amino acid dephosphorylation
SRVRSGLESTYWFLHIKCILAGALRIVDKVESHKTSVLVHCSDGWDRTAQLTALAMLLLDPFYRTIKGFEILIEKEWMSFGHKFQQRVGHGDDHHSDADRSPIFLQFIDCVWQVTQQFPNAFEFNESFLITILDHLYSCRFGTFLFNSERERVVEKVKEHTISLWSYTNSHLNLYRNPLYWANPLQQVVLVPIASIRHIRLWKTYYCRWNPSMRTQDPVYQRIRELLLLKEQLERTVEDYRKEQQARVQRSSASPT

SEQ ID NO: 21914 - protein, 422 aa, Diabrotica virgifera
  misc_feature: Coding regions on vcDNA: vcDNA=SeqID_1611; Strand=+; Position=93-1361
  misc_feature: Homolog annotation: Hit_ID=XP_392412.1; Match level="QueryCoverage =100%, HitCoverage=100%, E-value=0.0, Identity=84%"; Hit description =similar to CG4173-PA [Apis mellifera]
  misc_feature: Gene Ontology Annotation: Molecular function=GTP binding; Cellular component=cellular_component unknown; Biological process=cytokinesis
  misc_feature: Pfam annotation: Pfam_ID=GTP_CDC; Match level="Score=407.7, E-value =1.5e-119, Copies=1"; Pfam description=Cell division protein
  misc_feature (246)..(246): Xaa can be any naturally occurring amino acid
  misc_feature (255)..(255): Xaa can be any naturally occurring amino acid
  misc_feature (383)..(383): Xaa can be any naturally occurring amino acid
MAPVDVDTVPVEPQIRNLNLSGHVGFDSLPDQLVSKSVQNGFIFNIMCIGETGLGKSTLMDSLFNTNFESSPSPHSLPTVKLKAHTYELQESNVRLKLTIVDTVGYGDQINKENSFKAIVDYIDAQFENYLQEELKIKRSLSTFHDTRIHACLYFICPTGHGLKSIDLVCMKQLDQKVNVIPIIAKADTISKTELQKFKSKIIAELQNNGVSIYEFPVDDESVSDINSTMNSHVPFAVIGSTDFIXSRNKMVRAXQYPWGTVQVENESHCDFVKLREMLIRTNMEDMREKTHCRHYELYRKKRLEQMGLSDVDEDNKPVSFQQTFEAKRSTHLQELQQKEDEMRQMFVVRVKEKESELKEAEKELHAKFDKLKKDHTEEKKKXEDSRKKLEDEIVEFNRRKSQYQQMGQSHHTLTLGKSKKK

SEQ ID NO: 21915 - protein, 208 aa, Diabrotica virgifera
  misc_feature: Coding regions on vcDNA: vcDNA=SeqID_1612; Strand=+; Position=253-879
  misc_feature: Homolog annotation: Hit_ID=XP_397158.1; Match level="QueryCoverage =93%, HitCoverage=86%, E-value=1e-42, Identity=46%"; Hit description =similar to TRANSCRIPTION FACTOR JUN-D [Apis mellifera]
  misc_feature: Gene Ontology Annotation: Molecular function=RNA polymerase II transcription factor activity; Cellular component=nuclear chromosome; Biological process=regulation of cell cycle
  misc_feature: Pfam annotation: Pfam_ID=Jun; Match level="Score=3.6, E-value=9.7e -08, Copies=1"; Pfam description=Jun-like transcription factor
  misc_feature (115)..(115): Xaa can be any naturally occurring amino acid
MSQDLNLSFKNMKKNLTLDLNQKKLTLPTTSGLLSSPDLNLLKVDTPELESMILANGMTNTPTPSLLFPRAVTAEQEKFAGGFVEALSHLHNSNSQQGSDSNSSTIYNDSFIPHXQEEPQTVPNMNQSPPMSPVDMEIPERMKLERKSPRVRGRVGKCRSRKLERISKLEDKVKLLKCENIELGSIVNQLKETVGLLKLEAVEFVHQN

SEQ ID NO: 21916 - protein, 58 aa, Diabrotica virgifera
  misc_feature: Coding regions on vcDNA: vcDNA=SeqID_1613; Strand=+; Position=3-178
  misc_feature: Homolog annotation: Hit_ID=XP_394434.1; Match level="QueryCoverage =94%, HitCoverage=5%, E-value=3e-14, Identity=67%"; Hit description =similar to CG1782-PA [Apis mellifera]
  misc_feature: Gene Ontology Annotation: Molecular function=ubiquitin activating enzyme activity; Biological process=DNA replication
  misc_feature (28)..(28): Xaa can be any naturally occurring amino acid
HASEAKAQERFGLSMSEVVRRVSKKKNXPSVKALVFELCCNDSTGEDVEVPYVKYNLC

SEQ ID NO: 21917 - protein, 472 aa, Diabrotica virgifera
  misc_feature: Coding regions on vcDNA: vcDNA=SeqID_1614; Strand=+; Position=91-1506
  misc_feature: Homolog annotation: Hit_ID=XP_310466.1; Match level="QueryCoverage =80%, HitCoverage=67%, E-value=1e-104, Identity=41%"; Hit description= ENSANGP00000019196 [Anopheles gambiae]
  misc_feature: Gene Ontology Annotation: Molecular function=molecular_function unknown; Cellular component=integral to membrane
MNKMQYKFLLLLFLMLICCEFSDETLQGPSEVSEKKSKDSKSENETPKKREFIASIEERDGATAIRIEPAPDLTNERERQKGDNIDSEISEAVDLFMLDQAKVIQKMVQHLDIVNSLQQNTAFDEPIEVPPIPTSSEEDILTDEELEAKKLFQTAQELLYKTKPDKEEIFQMFMEASNKGNPEAKGMLAWAKLFGVPMEQDIYVAKEMFSELAAMGKADGHAGLGVLYATGLAVNVSQPKALIHYTFGAIGGNHFAQMALAYRYWSGITVPASCEKALDYYRQVADKVSQGVSFGGGSAIQRIRLFDELENGFASGILDNDLIEYYQLLAEKGDVQAQVGLGQLHYQGGRGVELDYQKALHYFTQAANAGNALAMAYLGKIYLDGSDEIPANNDTAFKYFKKASDLNNPVGLSGLGLMYLYGKGVEKDYTKAHQYFLQDAEQGWGKRTSLLLIRAYEVIYFCTLSVAGLMGF

SEQ ID NO: 21918 - protein, 111 aa, Diabrotica virgifera
  misc_feature: Coding regions on vcDNA: vcDNA=SeqID_1615; Strand=+; Position=148-483
YQELGILSIYICLRLSSRLAPSLVWLLSIDTQTFSSKHHKCTPFGHFSANVELYHGFLFCSYSILAPQEAGELMISTAYPHMREKAKEIYVVSPARSFCGYPASFRIKAFI

SEQ ID NO: 21919 - protein, 266 aa, Diabrotica virgifera
  misc_feature: Coding regions on vcDNA: vcDNA=SeqID_1616; Strand=+; Position=148-950
  misc_feature: Homolog annotation: Hit_ID=NP_650619.1; Match level="QueryCoverage =83%, HitCoverage=81%, E-value=2e-78, Identity=51%"; Hit description =CG5851-PA [Drosophila melanogaster] gb|AAF55413.1| CG5851-PA [Drosophila melanogaster]
  misc_feature: Gene Ontology Annotation: Molecular function=protein phosphatase type 1 intrinsic regulator activity; Cellular component=nucleus; Biological process=biological_process unknown
  misc_feature: Pfam annotation: Pfam_ID=LRR_1; Match level="Score=97.9, E-value=2.7e- 26, Copies=10"; Pfam description=Leucine Rich Repeat
  misc_feature (206)..(206): Xaa can be any naturally occurring amino acid
  misc_feature (227)..(227): Xaa can be any naturally occurring amino acid
MPVPSQEETNNVNQPEGNQATTSNNAADGDHNEGNRGPTTNDITIIDPECLELDLNHGRVDKLQNFEPLTCIERLYLRWNLITKIENLDTLTTLIELELYDNQITKIENLGCLVNLEILDLSFNRIKAIEGLDNLVKLKKLFLSSNKIAKIDNLSNIPSLDLLELGDNKIREIENLDELTTLRQLYLGKNKITKIKNLDSLKNLTXLSLQSNRLTAIENLENLKELXELYLSENGIENIENLDANTKLETLDLAQNKIKSMDILHT

SEQ ID NO: 21920 - protein, 257 aa, Diabrotica virgifera
  misc_feature: Coding regions on vcDNA: vcDNA=SeqID_1617; Strand=+; Position=7-777
  misc_feature: Homolog annotation: Hit_ID=AAH41511.1; Match level="QueryCoverage =88%, HitCoverage=89%, E-value=1e-82, Identity=65%"; Hit description =Ethe1-prov protein [Xenopus laevis]
  misc_feature: Gene Ontology Annotation: Biological process=sulfur metabolism
  misc_feature: Pfam annotation: Pfam_ID=Lactamase_B; Match level="Score=113.0, E -value=7.6e-31, Copies=1"; Pfam description=Metallo-beta-lactamase superfamily
MVFKTGLRLFSRINRSTIRFNQARMMSGSHSNFIFRQLFDNVSSTYTYLLGDAVSKECIIIDPVLEHAKRDFQLTKDLNLNLIYAVNTHMHADHITGSGYLKCLTGCKSVISRASGAQADIFVDEGDFVRFGNHKIKVLSTPGHTNGCCSFYCQEQEIAFTGDALLIRGCGRTDFQEGDPSTLYHSVHNKIFSLPATTLLYPAHDYKGMTVTSVAEEKQFNPRLTKSLEEFVRIMNNLNFSYPKQIDKAVPANKVCG

SEQ ID NO: 21921 - protein, 75 aa, Diabrotica virgifera
  misc_feature: Coding regions on vcDNA: vcDNA=SeqID_1618; Strand=-; Position=1-225
AIIQRPLYMSILVNLNMTAPTKTHPCPSPSTAHSGKYSIWLIKSKSNHFSSFLSRKGNLTHSRTRFTCRHVFLWI

SEQ ID NO: 21922 - protein, 68 aa, Diabrotica virgifera
  misc_feature: Coding regions on vcDNA: vcDNA=SeqID_1619; Strand=-; Position=455-661
RFCNILPLKNVLLHQMPILQLFFMKSVIIPVLTIVSKFTRRHFLIFSQGTIFILVKLNIFNGLEDTII

SEQ ID NO: 21923 - protein, 283 aa, Diabrotica virgifera
  misc_feature: Coding regions on vcDNA: vcDNA=SeqID_1620; Strand=+; Position=102-950
  misc_feature: Homolog annotation: Hit_ID=XP_314112.1; Match level="QueryCoverage =97%, HitCoverage=62%, E-value=3e-73, Identity=49%"; Hit description =ENSANGP00000003742 [Anopheles gambiae]
  misc_feature: Gene Ontology Annotation: Molecular function=translation initiation factor activity; Cellular component=cytoplasm; Biological process =translational initiation
  misc_feature: Pfam annotation: Pfam_ID=NTP_transferase; Match level="Score=-24.0, E- value=5.6e-08, Copies=1"; Pfam description=Nucleotidyl transferase
MSFLQEFQVVVLAAGKGSRISEITTGKPKCLLPIGPKPLVWYPLYKLQSSGFHDVILVVLEHQKTEIQSTLEKSDLEIKIDYFTISDNEDLGTADSLRLIHDKLKSDVLVVSCDFISDVNLKGLLDQFRANNASVASLLIQPQSNEPIIVPGPKSKHKPERDLIGVDTQTNRIVFLASASDFENEISLPMSLLNKHTSIKMYSNLTDSHIYVLKNWVIKYLKSEDSFTSLKGELLPHIIKKQLGRPPKPVDTKESILNTKDSGDIFAYAKEDELKFTIKKLSF

SEQ ID NO: 21924 - protein, 303 aa, Diabrotica virgifera
  misc_feature: Coding regions on vcDNA: vcDNA=SeqID_1621; Strand=+; Position=2-913
  misc_feature: Homolog annotation: Hit_ID=XP_312606.1; Match level="QueryCoverage =67%, HitCoverage=46%, E-value=3e-49, Identity=46%"; Hit description =ENSANGP00000014953 [Anopheles gambiae]
  misc_feature: Gene Ontology Annotation: Molecular function=lipase activity; Cellular component=extracellular; Biological process=digestion
  misc_feature: Pfam annotation: Pfam_ID=Abhydro_lipase; Match level="Score=75.2, E -value=1.8e-19, Copies=1"; Pfam description=ab-hydrolase associated lipase region
LKTLLIIIIVVQVHCKSQTLDAIGNFVRQFRESLNVSDSKFNQDSDVGLDIYQFLRKYKYPVETHWVETEDGYVLRMQRLVGGKDGVYSDNSNKPAVLLMHGLLSSAMDFVNVGPNRSIALMLADAGYDVWLGNNRGTTWSTMHKTLDPDNDPEYYDYSFDTCGYYDLPAKIDYIIKQTGQKKIFYIGHSQGTSQFFAMAALRPEYNEKIALMTALAPVAYMTHMASPLLRLLAQYQEIFEFLLVDVLKFHNLLPYSWIYRVFAEISEREFEKMKPEDKDKFGIPLFLLCGFITDNSMRIFFI

SEQ ID NO: 21925 - protein, 118 aa, Diabrotica virgifera
  misc_feature: Coding regions on vcDNA: vcDNA=SeqID_1622; Strand=-; Position=2045 -2401
HYAFSCIISNIVSDIHFLVSFLVRTFVPCMTICKFLYRKLYKIRHVIGRNFVCHTVSRCMVVLRLQLILRILTILGPSLFFLACSKIRFFLSFASSSFLFRRFCAQDIHVLLMPFPTG

SEQ ID NO: 21926 - protein, 368 aa, Diabrotica virgifera
  misc_feature: Coding regions on vcDNA: vcDNA=SeqID_1623; Strand=+; Position=68-1171
  misc_feature: Homolog annotation: Hit_ID=XP_314946.1; Match level="QueryCoverage =91%, HitCoverage=98%, E-value=1e-122, Identity=64%"; Hit description= ENSANGP00000024633 [Anopheles gambiae] gb|EAA44397.1| ENSANGP00000024633 [Anopheles gambiae
  misc_feature: Gene Ontology Annotation: Molecular function=structural constituent of muscle; Cellular component=sarcomere; Biological process=striated muscle contraction
  misc_feature: Pfam annotation: Pfam_ID=GRP; Match level="Score=-8.0, E-value =0.00039, Copies=1"; Pfam description=Glycine rich protein family
MKALIVLSVCFCLTLAAESEKKEVTQESKKQEKRGLYGLGDHGGGFGLGGHDFGGGHDFGGGDYGGHQEHHEHVKTVVVEKKIPTPYEVVKHVPYTVEKKVPYEVKVPVPQPYEVYKKVPYPVKEIIKVPVIVPQPYEVIKKVPYEVKVPVPRPYEVKIHVPQPYTVERKVPVPVKVPVPQPYTVYKKVPYPVKVEVPVPQPYTVEKKVPYEVKVPVDRPYTVHVPKPYPVTVEKHVPYPVEKPVPYEVKIPIDKPYPVIVPKPVPYHVKVPVPQPYTVEKKVPVEVEKPVPVPVKVHVDKPYPVIKEVPVPVEKPVPYPVKVPVHVPVHIPHHHEEVGHGGGGDGGYGGYGGGDYGGQDFGGHGDYH

SEQ ID NO: 21927 - protein, 334 aa, Diabrotica virgifera
  misc_feature: Coding regions on vcDNA: vcDNA=SeqID_1624; Strand=-; Position=3-1004
  misc_feature: Homolog annotation: Hit_ID=S31175; Match level="QueryCoverage=99%, HitCoverage=37%, E-value=4e-37, Identity=33%"; Hit description =hypothetical protein 2 - midge (Chironomus thummi) transposon NLR1Cth
RDYRHANWTEFQNFITQNLPMLGELDTNDSIDTSATDIENLITEAITHAIPLKQITYTSPALPQYIIAKIQQKRRLLRQYKANRNPLIKTEYNRICARIKREISVLTARRWEDATSKLDYRDGGKFWQKFKVLTKQKLSQPSHLLVNNHIVNSPEGKAEAFRNSLQNNFQTPDNPYFDRIFKFNTEYIVNVTLNHYIPVYDPIMDPLTDRETESFCQIGKNSAPGPDGINRRCLKKLPESIIPLLTKIFNACLKNSHFPTPWKVANTIMLLKKGKPPTDVESYRPISLINTLGKVLELILKERLNNFLENHNIIPKFQYGFQSGKSTKHALIDF

SEQ ID NO: 21928 - protein, 82 aa, Diabrotica virgifera
  misc_feature: Coding regions on vcDNA: vcDNA=SeqID_1625; Strand=+; Position=903-1151
NTVSNRLNDVTNLTIEHLSEESIIFPTTFVQKENFKRKFMQKFNFPGCVGAIVCTHVAIIAPTEREHNYLNRKVIFLKMSKL

SEQ ID NO: 21929 - protein, 346 aa, Diabrotica virgifera
  misc_feature: Coding regions on vcDNA: vcDNA=SeqID_1626; Strand=+; Position=1-1041
  misc_feature: Homolog annotation: Hit_ID=NP_701073.1; Match level="QueryCoverage =85%, HitCoverage=12%, E-value=2e-13, Identity=24%"; Hit description =hypothetical protein PF11_0213 [Plasmodium falciparum 3D7] gb|AAN35797.1| hypothetical protein
LLASGKTGNKENDECKNNVIKALDGQKSSIKDISQDLKNLHGQVKQLPPKDVINKLQNSINNCQDASLKQALHKIEGILNKSHDESTKTLNVLTKFTNTFNKSLDNTNYAINSQKSSAKDILQNIKSIQNQLHKLPQIEELATSQRETNKKLEITMKNIDNVRDVSNMVVGTTNNILDNCSKTNNGLDSQKSLQEILNNVKNLQSQRQNIPQIDQLAAAQRAAVNKLDDAVKNIHGLTEVTATLMKNIANTNSALDVQKSNTQEILNNIKNVQNQLPQINELSAGQRTAINKLEDTLKNINGLTEITGTLMKSFANTNNALDLQKSSMQEVLSNIKNVQNHPSTNK

SEQ ID NO: 21930 - protein, 206 aa, Diabrotica virgifera
  misc_feature: Coding regions on vcDNA: vcDNA=SeqID_1627; Strand=+; Position=172-792
  misc_feature: Homolog annotation: Hit_ID=NP_649051.3; Match level="QueryCoverage =98%, HitCoverage=100%, E-value=7e-84, Identity=79%"; Hit description= CG4108-PA [Drosophila melanogaster] gb|AAF49241.2| CG4108-PA [Drosophila melanogaster]
  misc_feature: Gene Ontology Annotation: Biological process=locomotory behavior
  misc_feature: Pfam annotation: Pfam_ID=SNF7; Match level="Score=192.4, E-value=9e -55, Copies=1"; Pfam description=SNF7
MGNEMSSTAMEKHLFNLKFAVKELERNSKRCEKEEKQEKAKTKQAIQKGNMEVARIHAENAIRQKNQSVNYLRMSARVDAVASKIQSAVTTRKVTNSMAGVVKAMDVAMKSMNLEKISQVMDKFEQQFEDLGVQTDVLENTMGQTTTTLIPQNDVDSLMQQVADEAGLELNMELPEGPQSSAVSTSTVVHEQDELTQRLARLRQGE

SEQ ID NO: 21931 - protein, 275 aa, Diabrotica virgifera
  misc_feature: Coding regions on vcDNA: vcDNA=SeqID_1628; Strand=+; Position=117-941
  misc_feature: Homolog annotation: Hit_ID=EAL29213.1; Match level="QueryCoverage =96%, HitCoverage=55%, E-value=2e-66, Identity=46%"; Hit description =GA17544-PA [Drosophila pseudoobscura]
  misc_feature: Gene Ontology Annotation: Molecular function=orotidine-5'-phosphate decarboxylase activity; Cellular component=cytoplasm; Biological process=UMP biosynthesis
  misc_feature: Pfam annotation: Pfam_ID=Pribosyltran; Match level="Score=118.5, E -value=1.6e-32, Copies=1"; Pfam description=Phosphoribosyl transferase domain
MECYANKLKEFAKELYSINAIKFGEYKTKIGIMTPVYCDLRVIVSYPKLLVTLSDLMIQKVNNINNFNLLCGVPYTALPIATVLSTKTNIPMVMRRKEAKDYGTKKLIEGIFEPGQNCLIIEDVITSGSSILETVKDLKDAGLNCTDALILLNREQGGEAFLNNNGIKVHSLLGMMQLMEMLKEAGCVDEKMVEKVRSYLASTKVDKTALNHITENRLNVSFRSRALKAKNPVAQKLFQIMQTKQSTLCVAANLLHSTDLLNLAEKRGSKAYVPL

SEQ ID NO: 21932 - protein, 221 aa, Diabrotica virgifera
  misc_feature: Coding regions on vcDNA: vcDNA=SeqID_1629; Strand=+; Position=221-886
  misc_feature: Homolog annotation: Hit_ID=XP_396448.1; Match level="QueryCoverage =86%, HitCoverage=28%, E-value=5e-52, Identity=50%"; Hit description =similar to ENSANGP00000012328 [Apis mellifera]
  misc_feature: Gene Ontology Annotation: Molecular function=apoptotic protease activator activity; Cellular component=cytosol; Biological process =caspase activation
  misc_feature: Pfam annotation: Pfam_ID=WD40; Match level="Score=79.1, E-value=1.2e -20, Copies=3"; Pfam description=WD domain, G-beta repeat
MGPVRVQAKYSSNSANLFNLIEKRASGFVKDPLNIRDSVAFKLYSNFYQYDGNNVGYYSKSGLGGIFNLEFSLDGRLLVAACEGKQIILFDAANQKLMYKISDAHQNCVNCVKFLDDKQFATCSDDTSIKLWDIRNLKKCTKTLHGHSNWVKNIEWSQKEQMMVTSAFDGSIYAWNLKTPNDSNTMYDKVFLMNGLMRMKLTNDGSKMVISTTNGFMIIIS

SEQ ID NO: 21933 - protein, 127 aa, Diabrotica virgifera
  misc_feature: Coding regions on vcDNA: vcDNA=SeqID_1630; Strand=+; Position=98-478
  misc_feature: Homolog annotation: Hit_ID=CAE47500.1; Match level="QueryCoverage =100%, HitCoverage=38%, E-value=2e-53, Identity=77%"; Hit description= cathepsin L-like proteinase [Diabrotica virgifera virgifera]
  misc_feature: Gene Ontology Annotation: Molecular function=cathepsin S activity; Cellular component=lysosome; Biological process=proteolysis and peptidolysis
MKGFIFIFLAIAAVQALSDNEEWVQFKVKQGKSYRNYVEEQKRFTIFQENLRKIENHNEKYYHGLSTFKLGVTKFSDLTEKEFADMLGLSKTDKPTKPRMTHSLTPVKDLPSMFDWREKGAVTEVKN

SEQ ID NO: 21934 - protein, 310 aa, Diabrotica virgifera
  misc_feature: Coding regions on vcDNA: vcDNA=SeqID_1631; Strand=+; Position=2-934
  misc_feature: Homolog annotation: Hit_ID=XP_393328.1; Match level="QueryCoverage =95%, HitCoverage=98%, E-value=1e-103, Identity=60%"; Hit description= similar to epsilon subunit of coatomer protein complex isoform a; coatomer epsilon subunit;
  misc_feature: Gene Ontology Annotation: Biological process=nonselective vesicle transport
  misc_feature: Pfam annotation: Pfam_ID=Coatomer_E; Match level="Score=440.2, E -value=2.4e-129, Copies=1"; Pfam description=Coatomer epsilon subunit
IYKQKWHVPQQQDVDELFEIKNYFYIGNYQQCINEAQKLRKPSTPEVAVQRDFYTYRSYMAQNKFLVVLDEIHGASPPEIQPLKYLADYLAGKIKKDSVVAQVEQQVQANANNDTLILVAATIYVNEGNLDAAYKVLHATESLEAMAFIIDILLKLDRVDLARKKLKEMQDKDDDATLTQLAQAWINVSTGGDKLQDAYYIYQELVDKYGSTPLLLNGQAVTFIGQAKYEEAEAALQEALDKDANYPDTLVNMITLQRHMAKAPEIANRYLSQLKDANPDHPYIRDLKIKENDFHRICQQYSPSVSTIPA

SEQ ID NO: 21935 - protein, 300 aa, Diabrotica virgifera
  misc_feature: Coding regions on vcDNA: vcDNA=SeqID_1632; Strand=+; Position=67-966
  misc_feature: Homolog annotation: Hit_ID=XP_310347.1; Match level="QueryCoverage =94%, HitCoverage=88%, E-value=8e-81, Identity=46%"; Hit description =ENSANGP00000015300 [Anopheles gambiae]
  misc_feature: Gene Ontology Annotation: Molecular function=phospholipase inhibitor activity; Cellular component=nuclear membrane; Biological process =skeletal development
  misc_feature: Pfam annotation: Pfam_ID=Annexin; Match level="Score=296.8, E-value =3.4e-86, Copies=4"; Pfam description=Annexin
  misc_feature (281)..(281): Xaa can be any naturally occurring amino acid
MAPTVFPYENFRDDEDAQALKDAMDGLGTNENAIIEILARRTNEQRRQIEHTYKTMFGEDLIETLKGELGGDFEDVILALMKEPLDFQVEELHRAISGMGTDDDSLVEILVVHDNEEIQRLSERYQELYETSLEDAIRGDESGTLQRLLVSLSTGGRDDSGLVDKNSAIADAQALYDAGESSWGTEESVFNSILCLKNKRQLKLIFDEYETMIGHSIEDAIDNEFSGSTKNAYLALVTSIRDRPVYLATKLHDAMHGMGTDDKTLIRIIVSRSEIDLEDIXEAYEANTLRLCTDGCRMML

SEQ ID NO: 21936 - protein, 504 aa, Diabrotica virgifera
  misc_feature: Coding regions on vcDNA: vcDNA=SeqID_1633; Strand=+; Position=94-1605
  misc_feature: Homolog annotation: Hit_ID=NP_006775.1; Match level="QueryCoverage =99%, HitCoverage=74%, E-value=1e-128, Identity=39%"; Hit description= WD repeat-containing protein 3 [Homo sapiens] emb|CAI22739.1| WD repeat domain 3 [Homo sapiens]
  misc_feature: Gene Ontology Annotation: Molecular function=snoRNA binding; Cellular component=nucleus; Biological process=rRNA processing
  misc_feature: Pfam annotation: Pfam_ID=WD40; Match level="Score=136.5, E-value=6.4e- 38, Copies=5"; Pfam description=WD domain, G-beta repeat
MGLTKQYLRYVPSGNFNIIATQSCNVCFITLEGQVGRFVAVGACEHIIIWDLRLGEKAQILPGEKAVVTAITASPNKRHLAAGYSNGNIQIYDLKSSEIISIFSGHRSEITTLIYDRFGHKLASGSKDTDVIVWDTVAEVGLCRLTGHKGMVTQLQFMKGHPILISASKDSFVKFWDLETHHCFKTLTGHQTEVWTIALMKDDEYLVTGCGDAELRVYKLSFKDPDSENKNIEYLSSRLELTSLEESEYFTHPLQCHKVGALLRRGRGRVISMYSDITGQILGCHGTDMQIEFFQFLYEEDAQLRLKKRLKKEKKKNRCEENANTYQDKNLLSLRDEVKRFHPLKLSDKPKSFHLVLGSGGELRVAVNLTNNIVELYTIQSSVKDSDPKLLRSISNQGHRTEIRSVCFSSDNLAIASGSAESVKMWNRPSQTCLRTIRTEYILSTVFAPGDRHLLAGLKNGKFLIMDISTGDILEEIQAHATELWSVHLTPDLRGCVTGGGEIT

SEQ ID NO: 21937 - protein, 290 aa, Diabrotica virgifera
  misc_feature: Coding regions on vcDNA: vcDNA=SeqID_1634; Strand=+; Position=106-975
  misc_feature: Homolog annotation: Hit_ID=EAA10811.3; Match level="QueryCoverage =97%, HitCoverage=75%, E-value=2e-73, Identity=46%"; Hit description =ENSANGP00000010344 [Anopheles gambiae str. PEST] ref|XP_556460.1| ENSANGP00000010344 [Anopheles gambiae st
  misc_feature: Pfam annotation: Pfam_ID=DUF1625; Match level="Score=153.7, E-value =4.1e-43, Copies=1"; Pfam description=Protein of unknown function (DUF1625)
  misc_feature (244)..(244): Xaa can be any naturally occurring amino acid
  misc_feature (264)..(264): Xaa can be any naturally occurring amino acid
MNTLSEEFERSWVTSLIGIFLLCFGIWLLTWNEGRAVHHAHSLDETYNNAIILNLYEKPSEEHNGKVVHVTGSLQIEEPLTEVDYGIAIQAVKLKRRVQMYQWVEERTPRPDDDNNMETMGTMTNDYYYITEWRDKLVDSNGFYIRHGHENPKEIPLTSVTYVSPTVKLGHLQVGNEIKDKFDDFIEVTSDERPDRRDVKLHMGIYYHCDDIWNPEVGDIRVQFYYAGGSGEPVTIIAKQESGXLIPYETSKGHKIALLRPGNXNINQMFSGEHFDARLETWKIRGIRFF

SEQ ID NO: 21938 - protein, 171 aa, Diabrotica virgifera
  misc_feature: Coding regions on vcDNA: vcDNA=SeqID_1635; Strand=+; Position=350-862
VESSVSQQSQFATGGGVFYVPPRRIKLEMEEFGDLSSFVSPQRIISNAVDELNTPVFDKDAFDFDISSYQTNVQAHLMLKCDAAFFRENSSLNPLNNQEDVFINPENMHRNAVAFNNQQLYTDADIYSPTASENGTYIVKQSPDNSSMFDMDINSSVSVRSSSSRHSSYPS

SEQ ID NO: 21939 - protein, 456 aa, Diabrotica virgifera
  misc_feature: Coding regions on vcDNA: vcDNA=SeqID_1636; Strand=+; Position=425-1795
  misc_feature: Homolog annotation: Hit_ID=XP_310558.1; Match level="QueryCoverage =22%, HitCoverage=37%, E-value=4e-10, Identity=38%"; Hit description =ENSANGP00000017328 [Anopheles gambiae]
  misc_feature: Pfam annotation: Pfam_ID=bZIP_2; Match level="Score=47.3, E-value =4.5e-11, Copies=1"; Pfam description=Basic region leucine zipper
MTATEKRHSFESSAIDPVSFMYVDPYDVNPLSRSSDLPPATILADIPLKVESSVSQQSQFATGGGVFYVPPRRIKLEMEEFGDLSSFVSPQRIISNAVDELNTPVFDKDAFDFDISSYQTNVQAHLMLKCDAAFFRENSSLNPLNNQEDVFINPENMHRNAVAFNNQQLYTDADIYSPTASENGTYIVKQSPDNSSMFDMDINSSVSVRSSSSRHSSYPSSPVGSVVRPAATETPDDSEMSFQSSSSSKPRLSLDLGLVHQTNFLDVNTPSIIAEVVSLESTGFNILDLVKEDDIQFVNDVFPDASTSTPPSNVSQKVAVKQPRRRHRMADDDDDEDYVPPSMKTSRYPVAHDYSSDSEDEKPLKKKARGRPPKRTQSISSDCSKDSDVSKYRELRDKNNEASRKSRMKRKVKELEMDKEADELHNKNIKLKAQVEELEKMVNNFRDNLFKIMINK

SEQ ID NO: 21940 - protein, 275 aa, Diabrotica virgifera
  misc_feature: Coding regions on vcDNA: vcDNA=SeqID_1637; Strand=+; Position=86-908
  misc_feature: Homolog annotation: Hit_ID=XP_312962.1; Match level="QueryCoverage =87%, HitCoverage=51%, E-value=4e-83, Identity=64%"; Hit description =ENSANGP00000020335 [Anopheles gambiae]
  misc_feature: Pfam annotation: Pfam_ID=Ribosomal_S5; Match level="Score=-9.3, E -value=0.022, Copies=1"; Pfam description=Ribosomal protein S5, N -terminal doma
  misc_feature (206)..(206): Xaa can be any naturally occurring amino acid
  misc_feature (239)..(239): Xaa can be any naturally occurring amino acid
  misc_feature (250)..(250): Xaa can be any naturally occurring amino acid
MAGQLANVVKTFQKLTIASRCRIVGTIINPVKEHEPQILTQTSTRNTNFFNKLPAQDLWKGITSVSNAGKKRGRAKNVSKSKIKDLNRGQVIGVGKANIVWPGLSAPIIRGKELVEQHQLPEDPEREKKLIQIRDQMGTIKRPKLSPIERGWSGSKLPGRSIGPPDPVEEDNFEGFDTKVLELKTVFNMKGNFGRTRRQSALVVTXCHNICAGFALAKGFEGRAALRKAKNRSAQKLMXHIKLFRNHTVXHDFFTQFGTTKIYVSQKPERPRLVC

SEQ ID NO: 21941 - protein, 444 aa, Diabrotica virgifera
  misc_feature: Coding regions on vcDNA: vcDNA=SeqID_1638; Strand=+; Position=29-1363
  misc_feature: Homolog annotation: Hit_ID=XP_394704.1; Match level="QueryCoverage =99%, HitCoverage=97%, E-value=1e-163, Identity=62%"; Hit description= similar to ENSANGP00000003775 [Apis mellifera]
  misc_feature: Gene Ontology Annotation: Molecular function=zinc ion binding; Cellular component=nucleus; Biological process=signal transduction
  misc_feature: Pfam annotation: Pfam_ID=zf-ZPR1; Match level="Score=556.2, E-value =2.8e-164, Copies=2"; Pfam description=ZPR1 zinc-finger domain
MGATKPIFRDLNPDDPEPEATEIESLCMNCHEDGITRLLLTKIPFFKELVLMSFTCEHCGYQNNEIQSGAAVAKKGVRISLTVSTKRDLNRQVVKSDYTSVKLVELDFEIPPKSQKGEVTTVEGVINRSITGLEQDQPVRKIQHPEAAEQIEEFIKKLQELKEVKTPFTLILEDISGNSFIENPNAPRIDNSCTTTHFIRTKEQDHELGLFSQSEITAKEESGILHPIPEGEFTLEDLQGEVLQFPTNCPSCNSPCHTNMKMTNIPHFKEVVIMATTCDACGHKTNEVKSGGGIEPKGLKIEVDIKNKEDFSRDLLKSDTCSLGIPQLDLEVGPHALGGRFTTVEGLVLAIKDQLSDPKHSHIFGDSVDPKSRHEFEAFIDKFDDILSGKLFVTLVLDDPAGNSYIQTMRDDNEPDEGLRITHYERTFEQNEELGLNDINTENY

SEQ ID NO: 21942 - protein, 87 aa, Diabrotica virgifera
  misc_feature: Coding regions on vcDNA: vcDNA=SeqID_1639; Strand=+; Position=608-871
  misc_feature (29)..(29): Xaa can be any naturally occurring amino acid
ISGYTGYSLAVHSRHLLIPLSSSLSSPQXLCLVCFKVDVSKPLITQNQKRPELNNQAWTEKLDYYHNNKTVCIHKIIPKHKLFYVTV

SEQ ID NO: 21943 - protein, 316 aa, Diabrotica virgifera
  misc_feature: Coding regions on vcDNA: vcDNA=SeqID_1640; Strand=+; Position=56-1007
  misc_feature: Homolog annotation: Hit_ID=NP_648484.1; Match level="QueryCoverage =99%, HitCoverage=99%, E-value=1e-117, Identity=64%"; Hit description= CG6084-PA, isoform A [Drosophila melanogaster] gb|AAF50039.2| CG6084 -PA, isoform A [Drosophila
  misc_feature: Gene Ontology Annotation: Molecular function=electron transporter activity; Cellular component=cytoplasm; Biological process=glucose metabolism
  misc_feature: Pfam annotation: Pfam_ID=Aldo_ket_red; Match level="Score=479.6, E -value=3.3e-141, Copies=1"; Pfam description=Aldo/keto reductase family
  misc_feature (288)..(288): Xaa can be any naturally occurring amino acid
MAKVPNVKFNNGEVFPAYGLGTWKSKPGDVTQAVKDALDIGYRHIDCAHVYGNEPEVGAALKAKLADGTVKREDIYITSKLWNTFHRPDLVEPAVRTTLKNLGLEYLDLYLIHWPFALKEDGDLFPVNADGSTAYSTVDYVDTWKAMEALVKKGLVKSIGISNFNKRQTERILANCTIKPVTNQVEIHPYLNQQKLIDYLESKDIVVTAYSPLGSPDRPWAKPGDPQLLDDPKIKKIADKYNKTPAQVVLRYAVQRGLIVIPKSVTKSRIQQNFNIWDFISPTQTLLXHSFDCNGRICPYDDAVTHKDHPFVNDEY

SEQ ID NO: 21944 - protein, 287 aa, Diabrotica virgifera
  misc_feature: Coding regions on vcDNA: vcDNA=SeqID_1641; Strand=-; Position=16-879
  misc_feature: Homolog annotation: Hit_ID=XP_317786.1; Match level="QueryCoverage =91%, HitCoverage=71%, E-value=1e-90, Identity=54%"; Hit description =ENSANGP00000022197 [Anopheles gambiae]
  misc_feature: Gene Ontology Annotation: Molecular function=inorganic phosphate transporter activity; Cellular component=integral to membrane; Biological process=phosphate transport
YVLEAAGIIWHIFWQIFCYSDPVSHPFISKEEFSYLKSELESISVESHSIPWRSILTSVPVWALVIAQIGHDWGFYTMITDLPSYMSDVLKFNVKDNGIWNSVPYLVMWLCSMGSGWLCDWLISSKRMTVTKARKFFTTIASLGPGIFIMAASYSGCHRYFTVTMFTMAMGFLGAYYSSKKVNALDLAPNYAGILMALVNGIGAITGIIAPYLAGTLTENHTLKEWRTIFWITFFIFLITNIIFCIFGSGEEQVWNNFDNKNVKEIHSTGEDTAFFNFKRKEKNTNV

SEQ ID NO: 21945 - protein, 67 aa, Diabrotica virgifera
  misc_feature: Coding regions on vcDNA: vcDNA=SeqID_1642; Strand=+; Position=190-393
WRQSRTLKHSNFLRKSLYIEMDIILLYWIINPVFWSSGSFYKFLMLDCIEYLYEVNANVSHVLWIKT

SEQ ID NO: 21946 - protein, 261 aa, Diabrotica virgifera
  misc_feature: Coding regions on vcDNA: vcDNA=SeqID_1643; Strand=+; Position=30-813
  misc_feature: Homolog annotation: Hit_ID=NP_651999.1; Match level="QueryCoverage =100%, HitCoverage=84%, E-value=2e-88, Identity=66%"; Hit description= CG5812-PA [Drosophila melanogaster] gb|AAF56656.1| CG5812-PA [Drosophila melanogaster]
  misc_feature: Gene Ontology Annotation: Molecular function=molecular_function unknown; Cellular component=intermediate filament; Biological process=epidermal differentiation
  misc_feature: Pfam annotation: Pfam_ID=DUF243; Match level="Score=153.3, E-value =5.4e-43, Copies=1"; Pfam description=Domain of unknown function (DUF243)
  misc_feature (230)..(230): Xaa can be any naturally occurring amino acid
MRPFVLLSTLMALASARPEAGYSYSPPSGSYGAPSGGGGGFGGGIGGGHGGGGIGGGSGFGGGGFGGGGHGGGGIGGGGIGGGGIGGGGIGGGSGIGGGFGGGSGGGFGGGSGGGFGGGSGGGFGGGIGGGGDGGFGGGFGGGFGGGTTTIQKHIYVHVPPPEPEEFRPQRPISVGQAQKHYKIIFIKVPSAPAPTAPVIPLQPQNEEKTLVYVLVKKPEEGPEITIPTXAPTQPSKPEVYFIRYKTQRTAGGGTGFGGGS

SEQ ID NO: 21947 - protein, 346 aa, Diabrotica virgifera
  misc_feature: Coding regions on vcDNA: vcDNA=SeqID_1644; Strand=+; Position=192-1232
  misc_feature: Homolog annotation: Hit_ID=EAL29286.1; Match level="QueryCoverage =91%, HitCoverage=58%, E-value=1e-101, Identity=55%"; Hit description= GA10247-PA [Drosophila pseudoobscura]
  misc_feature: Gene Ontology Annotation: Molecular function=transcription factor activity; Cellular component=nucleus; Biological process=mitosis
  misc_feature: Pfam annotation: Pfam_ID=RRM_1; Match level="Score=101.0, E-value =3.1e-27, Copies=2"; Pfam description=RNA recognition motif. (a.k.a. RRM, R
MVVEYVQVAENEDEDPVELPSEDNGTLLLSTVTAQFPGASGLKYKVSAENKNFRGVRLSDGILHPPPDGEGWGETVFCCVYPKENKRKYSESVESPASKVKRVESKLKCTDLIVLGLPWKATEEDLKEYFEKYGEIVVAQVKRDRGGKSKGYGFIRFEKYESQVKVTGQRHMIEGRWCDVKIPSSKDGNSQLLPCKVFVGRLTEEISVENLRDYFSEYGSVTDVFIPKPFRAFGFITFADPEVAQALCGEDHIIKGVSVHVSTAAPKNESRRPFGNDRSGGGNFGNVWEGNGYSSRNGFGGGNQGSGGWNNQGGSRGGGNNMNDVNNLAPFMNPAFIAAALNLAAN

SEQ ID NO: 21948 - protein, 74 aa, Diabrotica virgifera
  misc_feature: Coding regions on vcDNA: vcDNA=SeqID_1645; Strand=+; Position=3-227
HASAHASALTSFSSRAQCQTHPHLAAACSEVLTPLGYIERFCAIFNKFFLIFRKFKHDIFAIMDGDKLDPTGQY

SEQ ID NO: 21949 - protein, 299 aa, Diabrotica virgifera
  misc_feature: Coding regions on vcDNA: vcDNA=SeqID_1646; Strand=+; Position=68-966
  misc_feature: Homolog annotation: Hit_ID=XP_396595.1; Match level="QueryCoverage =94%, HitCoverage=77%, E-value=6e-74, Identity=48%"; Hit description =similar to Actin-related protein 10 [Apis mellifera]
  misc_feature: Gene Ontology Annotation: Molecular function=protein binding; Cellular component=dynactin complex; Biological process=microtubule -based movement
  misc_feature: Pfam annotation: Pfam_ID=Actin; Match level="Score=-52.0, E-value =0.0017, Copies=1"; Pfam description=Actin
  misc_feature (258)..(258): Xaa can be any naturally occurring amino acid
  misc_feature (279)..(279): Xaa can be any naturally occurring amino acid
MPIYETLSSDKLTVVLDIGSAYTKFGFSGEFAPRTIIKSVARCKKTGQLRRIWDYESAEDLYDLLVEFLHVIYFRYALLSPKDKPVIIVESLLCPTLFRETLAKVLFSHYEISMMLSLPSHLVSLASIAVDTAVVVDIGYKEAVVIPVCHGLPMIQAWQALPIGSEAIHNKLRTLLSSNNTGIQNLSEETLEDIKVRCCFVTEKNRAEQLAQAKPDIVACPDVKYPIGGTESIVVTGKVRERTFEILYEEDNDHFCLXTMILDAILQVDLNLRQKLSEXIVLIWWNTMIPRFKAKLKKN

SEQ ID NO: 21950 - protein, 194 aa, Diabrotica virgifera
  misc_feature: Coding regions on vcDNA: vcDNA=SeqID_1647; Strand=+; Position=2-586
FGVRKKSHMEDNSLPSSTQLTGMSKLSSDNPLLSATKPIDNTPMLSCTKKEPQEPEYYPHITKVSDDGSGWYSKNNSVHVKKEKENEYDTELQDFVNLFKNKIVVGVLSGRSMRQPSSSDEVDCRAQTNGKNFKKFKKIKPLHPQITVIGNDFFNNSQFGNTTGIHDSRRRILYDSDDEQPSRKQRKTLKSFLI

SEQ ID NO: 21951 - protein, 339 aa, Diabrotica virgifera
  misc_feature: Coding regions on vcDNA: vcDNA=SeqID_1648; Strand=+; Position=127-1139
  misc_feature: Homolog annotation: Hit_ID=XP_316319.1; Match level="QueryCoverage =98%, HitCoverage=41%, E-value=1e-163, Identity=56%"; Hit description= ENSANGP00000020579 [Anopheles gambiae]
  misc_feature: Gene Ontology Annotation: Molecular function=protein binding; Cellular component=nucleus; Biological process=response to nutrients
  misc_feature: Pfam annotation: Pfam_ID=TPR_1; Match level="Score=221.6, E-value =1.6e-63, Copies=8"; Pfam description=Tetratricopeptide repeat
  misc_feature (264)..(265): Xaa can be any naturally occurring amino acid
  misc_feature (325)..(325): Xaa can be any naturally occurring amino acid
  misc_feature (328)..(328): Xaa can be any naturally occurring amino acid
MQEKLIVNVNQTVGSTFSTKMNDSIPMSSVGLLELAHREYQAGDYENAERHCMQLWRQDQTNTGVLLLLSSIHFQCRRLEKSAQFSSLAIKQNPLLAEAYSNLGNVYKERGQLSDALENYRHAVRLKPDFIDGYINLAAALVAAGDMEQAVQAYITALQYKPDLYCVRSDLGNLLKALGRLDEAKACYLKAIETRPDFAVAWSNLGCVFNAQGEIWLAIHHFEKAVGLDPNFLDAYINLGNVLKEARIFDRAVAAYLRALNLSXXNNAVVHGNLACVYYEQGLIDLAIDTYRRAIELQPNFPDAYCNLANALKEKGQVSEAEECXHTXALRLCPSHADS

SEQ ID NO: 21952 - protein, 66 aa, Diabrotica virgifera
  misc_feature: Coding regions on vcDNA: vcDNA=SeqID_1649; Strand=-; Position=253-453
TYSQTFHDMVNLPNEINPISGLECELNDSFLVTSEFQIINFAGFLMKFRRKLKQQKDNSMFYSIFY

SEQ ID NO: 21953 - protein, 268 aa, Diabrotica virgifera
  misc_feature: Coding regions on vcDNA: vcDNA=SeqID_1650; Strand=+; Position=1-807
  misc_feature: Homolog annotation: Hit_ID=NP_473398.1; Match level="QueryCoverage =81%, HitCoverage=79%, E-value=3e-70, Identity=57%"; Hit description =proline synthetase co-transcribed [Mus musculus] sp|Q9Z2Y8|POSC _MOUSE Proline synthetase
  misc_feature: Gene Ontology Annotation: Molecular function=molecular_function unknown; Cellular component=cytoplasm; Biological process=biological_ process unknown
  misc_feature: Pfam annotation: Pfam_ID=Ala_racemase_N; Match level="Score=32.7, E -value=1.9e-07, Copies=1"; Pfam description=Alanine racemase, N -terminal domain
  misc_feature (230)..(230): Xaa can be any naturally occurring amino acid
DHPVLCFFTLNKNNIIDPETVYSNRQVCHQHFGPIYFWKFVKDYKELQVIEPRLVAVSKTKPANLIVTAYEEGQRHFGENYVQELEEKANNPLILEKCKEIKWHLIGHLQSNKVNKVLGLPNLHLVETVDSQKLASTLNKSWPKFGPPESKLNIMIQVNTSGEDEKSGILPTQVSDVAQFVLKECTNLELKGLMTIGKYGYDPADGPNPDFLRLKQCRDDLCQSLGLDWXNIELSMGMSTDYEQAVEMGSTNVRVGSSIFGYRAPKHS

SEQ ID NO: 21954 - protein, 492 aa, Diabrotica virgifera
  misc_feature: Coding regions on vcDNA: vcDNA=SeqID_1651; Strand=+; Position=145-1620
  misc_feature: Homolog annotation: Hit_ID=AAT38758.1; Match level="QueryCoverage =98%, HitCoverage=37%, E-value=3e-59, Identity=32%"; Hit description =putative gag-pol polyprotein [Solanum demissum]
  misc_feature: Pfam annotation: Pfam_ID=rve; Match level="Score=81.7, E-value=2e-21, Copies=1"; Pfam description=Integrase core domain
MATKHELTRFPNMRQNSCSSMEEYSNNTLATVQKLADIGEAIEDKWISPAMRNGASEELESSIAAPNQQLSDKSTSEDVKNAPPGESERRRAKEEPPQTTALPLQNKTFKKKYNKHKATKKLACYECGDPNHKKSDCPKLCQGSTPNFHQKKKEENKDSSNKSAKNTTPLTRAMMTSVSPSSRTTDSGATSHMACDETALHNLNSSTTTSICAADNSEVKSKGIGEAVIQFEQGNNPTKTATNVSYVPNPSANLLSVGRMTEKGYAVVFDKDACTVYASSDFSVRGEVEFSCNKKDGLYGIHNLKQESMMVVKEGFLSDQELWHKRLGHLNRKGLRLLKNTAGGINFVDEPNQVCVTCLEGKQTVKPFPKRGKRAKDLLGIVHSDLQGPFEVLSWGGAAYCLIFVDDYSRKVFGYMLKYKSEVFSTFRLFKSMVENQTGKTIKCLRTDGGGEYTSREMENFLKENGIIHQLTVSYTPQQNGVAERTIRTITE

SEQ ID NO: 21955 - protein, 277 aa, Diabrotica virgifera
  misc_feature: Coding regions on vcDNA: vcDNA=SeqID_1652; Strand=+; Position=193-1023
  misc_feature: Homolog annotation: Hit_ID=NP_722628.1; Match level="QueryCoverage =79%, HitCoverage=48%, E-value=4e-20, Identity=28%"; Hit description =CG11907-PA, isoform A [Drosophila melanogaster] ref|NP_608519.2| CG11907-PB, isoform B [Drosophila
  misc_feature: Gene Ontology Annotation: Biological process=physiological processes
MTMQKDQKILCLQYTSPVFFVGFMNVMPMVFFSTANSYWMYKFRNVTQGDEITQGQDRTRLQVYFQPALMAGGTIPSVICTLLWTFYGHKIASMLRSLAALVLLGLVFAIFAIFTQINTDSWQTGFFALTVILLMMNSAGVATFQMSSVILIAKLPPSYMFCYLIGQNGTVLTTSLQLVAVAVTNNSITSGLIYFTAGTTLITISLMFVMIARRSHVFRYYEVENIKDKHAEHQFDMKKVIVQLWPVPGSIGNFVFTFSFVHPSITPVESEYAYEKT

SEQ ID NO: 21956 - protein, 328 aa, Diabrotica virgifera
  misc_feature: Coding regions on vcDNA: vcDNA=SeqID_1653; Strand=+; Position=126-1109
  misc_feature: Homolog annotation: Hit_ID=XP_310340.1; Match level="QueryCoverage =88%, HitCoverage=47%, E-value=2e-58, Identity=42%"; Hit description =ENSANGP00000015190 [Anopheles gambiae] gb|EAA06052.1| ENSANGP00000015190 [Anopheles gambiae
  misc_feature: Gene Ontology Annotation: Biological process=reproduction
  misc_feature: Pfam annotation: Pfam_ID=GMC_oxred_N; Match level="Score=179.6, E -value=6.6e-51, Copies=1"; Pfam description=GMC oxidoreductase
TIYIDVTFLNKLLVSFVKQNIPALLFGASGGEEDWQYRTEPSPLNCLGFKDEQCIWPRGKGLGGSSILNAMMYIKGNKRDYDTWEELGNTGWGWNTVKEYFKKLENMQTKGVSDQYGRDGYMTLNRYPSDQPIASALEEAFKEMKLPLLNEENPVNPLGALTAFQCIKDGIRFNTGRAFLGQVKSRSNLMTALHSFAQKVIIDRKSKSATGVQVEIGGKIINLKAKKEVIVSGGTINSPQLLMLSGLGPKHHLEKVNIDLIKDLPVGEHLEDHVLHLGFFVKFNPEIQSIENQLDTIYKYFAHQQGDLGTLMITNIMSFINTKNDSQY

SEQ ID NO: 21957 - protein, 268 aa, Diabrotica virgifera
  misc_feature: Coding regions on vcDNA: vcDNA=SeqID_1654; Strand=+; Position=133-934
  misc_feature: Homolog annotation: Hit_ID=XP_310335.1; Match level="QueryCoverage =97%, HitCoverage=48%, E-value=3e-51, Identity=39%"; Hit description =ENSANGP00000015052 [Anopheles gambiae]
  misc_feature: Gene Ontology Annotation: Biological process=reproduction
  misc_feature: Pfam annotation: Pfam_ID=GMC_oxred_N; Match level="Score=84.8, E -value=2.2e-22, Copies=1"; Pfam description=GMC oxidoreductase
  misc_feature (234)..(234): Xaa can be any naturally occurring amino acid
  misc_feature (241)..(241): Xaa can be any naturally occurring amino acid
MDIGSLLQDTCPGNLQGMSGYFFLTLLNSLLSSKCKLANPNDYTEDYAPRLKDGDEFDFIVVGSGSAGAVVANKLSENPNWKVLVLEAGGYPSSTSDMPALLFSASGQEDDWQYRTEHSPHSCLGFKDERCIWPRGKALGGSSILNAMLYIRGNKRDYDTWEKLGNTGWGWDTVKDHFKKLENMKVEGVSDQYGRDGYMTLNRYHSDQPIVDTLHEAFRELKYPQLQEENPETXLGTLIAXSCIKDGIRFNTGEAFLGQVKSRANLLT

SEQ ID NO: 21958 - protein, 567 aa, Diabrotica virgifera
  misc_feature: Coding regions on vcDNA: vcDNA=SeqID_1655; Strand=+; Position=130-1833
  misc_feature: Homolog annotation: Hit_ID=NP_996392.1; Match level="QueryCoverage =99%, HitCoverage=99%, E-value=0.0, Identity=82%"; Hit description =CG10701-PE, isoform E [Drosophila melanogaster] ref|NP_996391.1| CG10701-PF, isoform F [Drosophila
  misc_feature: Gene Ontology Annotation: Molecular function=structural constituent of cytoskeleton; Cellular component=plasma membrane; Biological process=establishment and/or maintenance of epithelial cell polarity
  misc_feature: Pfam annotation: Pfam_ID=ERM; Match level="Score=673.9, E-value=1.1e -199, Copies=1"; Pfam description=Ezrin/radixin/moesin family
MPKQMNVRVTTMDAELEFAIHQTTTGKQLFDQVIKTVGLREVWFFGLQYTDSKGDLTWVKLYKKVLSQDLKKENPFQFKFRAKFYPEDVAEELIQDITLRLFYLQVKNSILSDEIYCPPETSVLLASYAVQARHGDYDKSTHTPGFLANDRLLPQRVMDQHKMSKDEWENSIMTWWKEHRGMLREDAMMEYLKIAQDLEMYGVNYFEIRNKKQTELYLGVDALGLNIYEKDDQLTPKIGFPWSEIRNISFNDRKFIIKPIDKKAPDFVFFAPRVRINKRILALCMGNHELYMRRRKPDTIDVQQMKAQAREEKMAKQQQKEKLQSEIAARERAEKKQQEYEDRIKAMQEEMERSQANYMEAQEMIRRLEEQLKQLQAAKEEMEKRQNELQSMMERLEESKNMEAAERQKLEEEIRAKQEEVLRIQQEVEAKDSETKRLQEEVENARRKEEELKQLQLAQAAKGHLEENDHNEDDEMVNGDVSKDLSTDENIVDPIEDRRTLAERNERLQDQLLALKKDLAQSRDETKETAMDKIHRENVRQGRDKYKTLREIRKGNTKRRVDQFENM

SEQ ID NO: 21959 - protein, 293 aa, Diabrotica virgifera
  misc_feature: Coding regions on vcDNA: vcDNA=SeqID_1656; Strand=+; Position=253-1134
  misc_feature: Homolog annotation: Hit_ID=XP_311397.1; Match level="QueryCoverage =94%, HitCoverage=89%, E-value=4e-54, Identity=37%"; Hit description =ENSANGP00000016730 [Anopheles gambiae]
  misc_feature: Pfam annotation: Pfam_ID=UMPH-1; Match level="Score=144.7, E-value =2.1e-40, Copies=1"; Pfam description=Pyrimidine 5'-nucleotidase (UMPH-1)
MIDYIKKLKLNDSNKVLIKDPDEINRKIEKLIEGGYTKLQVISDYDKTITKQHVNGKTQFHAFDLFKQCPSISQEIRDFLTALTNKYAVIDKDPNLSHAERSKHMDEWWNKTIEAYKGLKISQEEIEKTCLEFGPPLRDNVKELFEVLKQGNVPVLLLSGGIGDCLEPSLRISGINGSNIELVANYIKRDNEGRIQDYKAPPIHTVNKNEYIKNTQHYKKHTNRPNVLLMGDHLGDAQMVNSLEHVGTVIKIGFSYNEAEVVLPTWLNTFDIVLKDDQSMNVPKAIVELLQKE

SEQ ID NO: 21960 - protein, 243 aa, Diabrotica virgifera
  misc_feature: Coding regions on vcDNA: vcDNA=SeqID_1657; Strand=+; Position=96-827
  misc_feature: Homolog annotation: Hit_ID=NP_651455.1; Match level="QueryCoverage =100%, HitCoverage=100%, E-value=1e-101, Identity=75%"; Hit description=CG14542-PA [Drosophila melanogaster] gb|AAF56559.1| CG14542-PA [Drosophila melanogaster]
  misc_feature: Gene Ontology Annotation: Molecular function=molecular_function unknown; Cellular component=endosome; Biological process=locomotory behavior
  misc_feature: Pfam annotation: Pfam_ID=SNF7; Match level="Score=212.7, E-value=7.3e- 61, Copies=1"; Pfam description=SNF7
MEWLFGKKVTPEEMLRKNQRALNKAMRDLDREKQKMEQQEKKVINDIKKLAKEGQMDAVKIMAKDLVRTRRYVKKFMLMKANIQAVSLKIQTLRSQNTMAQAMKGVTKAMQSMNRQLNLPQIQRILQEFEKQSEIMDMKEEVMNDAIDDAMEGDDDEEETDAVVNQVLDELGLQLNDTLSGLPQTAGSLPASGQKHPAAAAAVAGGGNGGTGTGGSGGNSGGGGGLSDADADLQARLDNLRRE

SEQ ID NO: 21961 - protein, 361 aa, Diabrotica virgifera
  misc_feature: Coding regions on vcDNA: vcDNA=SeqID_1658; Strand=+; Position=97-1182
  misc_feature: Homolog annotation: Hit_ID=NP_651455.1; Match level="QueryCoverage =64%, HitCoverage=90%, E-value=6e-95, Identity=76%"; Hit description =CG14542-PA [Drosophila melanogaster] gb|AAF56559.1| CG14542-PA [Drosophila melanogaster]
  misc_feature: Gene Ontology Annotation: Molecular function=molecular_function unknown; Cellular component=endosome; Biological process=locomotory behavior
  misc_feature: Pfam annotation: Pfam_ID=SNF7; Match level="Score=212.7, E-value=7.3e- 61, Copies=1"; Pfam description=SNF7
MEWLFGKKVTPEEMLRKNQRALNKAMRDLDREKQKMEQQEKKVINDIKKLAKEGQMDAVKIMAKDLVRTRRYVKKFMLMKANIQAVSLKIQTLRSQNTMAQAMKGVTKAMQSMNRQLNLPQIQRILQEFEKQSEIMDMKEEVMNDAIDDAMEGDDDEEETDAVVNQVLDELGLQLNDTLSGLPQTAGSLPASGQKNPAAAAFFAGGRDGGTGTGGGGGGKDGGGGGPDAARGLHAPLKNFSRKKKFCNKKKEVKKKEFVLPPFFFNSNKNCFFSKKNFFCLFFFPLKGGEFLGVFFKKKKNFPKKKKLWGKNFFFFFFKKKNKRGKIFFCSLNYFKIFSKKKKIIIKKNDFFAFFFFFCLK

SEQ ID NO: 21962 - protein, 61 aa, Diabrotica virgifera
  misc_feature: Coding regions on vcDNA: vcDNA=SeqID_1659; Strand=+; Position=208-390
LCATIIFLFCSAQKMERQNSVAPPDGGWGWMVVFGAALINMVNQAMFANFGLIFGEYLEEI

SEQ ID NO: 21963 - protein, 261 aa, Diabrotica virgifera
  misc_feature: Coding regions on vcDNA: vcDNA=SeqID_1660; Strand=+; Position=62-842
  misc_feature: Homolog annotation: Hit_ID=XP_317855.1; Match level="QueryCoverage =99%, HitCoverage=67%, E-value=1e-114, Identity=76%"; Hit description= ENSANGP00000014920 [Anopheles gambiae]
  misc_feature: Gene Ontology Annotation: Molecular function=flap endonuclease activity; Cellular component=replication fork; Biological process =histogenesis and organogenesis
  misc_feature: Pfam annotation: Pfam_ID=XPG_I; Match level="Score=185.7, E-value =9.8e-53, Copies=1"; Pfam description=XPG I-region
  misc_feature (238)..(238): Xaa can be any naturally occurring amino acid
  misc_feature (251)..(251): Xaa can be any naturally occurring amino acid
MGILNLTKLLADVAPQALKDYELKNYFGRKVAVDASMCLYQFLIAVRAEGAQLTSADGETTSHLLGAFHRTIRLVENGIKPVYVFDGKPPDLKSGELNKRQEKRNEAQAALAKATEAGDAAEIDKYNRRLVKVTKQHSEEVKQLLTLMGIPYVNAPCEAEAQCAALVKAGKVYATATEDMDALTFGSKVLVRHMTFSEARKMPIQEIHLDKVLTGLDLTQEQFIDLCILLGCDYTDSXRGIGPKRAIELIXKHKSIESILP

SEQ ID NO: 21964 - protein, 298 aa, Diabrotica virgifera
  misc_feature: Coding regions on vcDNA: vcDNA=SeqID_1661; Strand=+; Position=3-899
KVSQQETALKTCKADLVNKNKELSELSSVLLDRDTKITSLLQQESDLKTCKADLANKYKELAELSSVLLDRDNKIEHLAAAVHANEIKMSNVLLEIAEKNEANLRLEEELQVVRDNFAKTESMLENTLVSSEQKSKNEFEELNGSAKIDTTLETISSFTDIIADCCQELQRTFMNFIQQWKNEIESHPSFKLLPSIKLCHSLDVEDILSVLVDNIKAVVLLLNIMTSKAPKKMIDKSDPRLICPAPLKFTEYNESKLVKRFTLKSPDELRLTRSASPDSPGMETDSDMYMDECEPRKH

SEQ ID NO: 21965 - protein, 590 aa, Diabrotica virgifera
  misc_feature: Coding regions on vcDNA: vcDNA=SeqID_1662; Strand=+; Position=116-1888
  misc_feature: Homolog annotation: Hit_ID=XP_317536.1; Match level="QueryCoverage =88%, HitCoverage=95%, E-value=0.0, Identity=59%"; Hit description =ENSANGP00000010113 [Anopheles gambiae]
  misc_feature: Gene Ontology Annotation: Molecular function=serine C -palmitoyltransferase activity; Cellular component=mitochondrion; Biological process=gametogenesis
  misc_feature: Pfam annotation: Pfam_ID=Aminotran_1_2; Match level="Score=105.9, E -value=1e-28, Copies=1"; Pfam description=Aminotransferase class I and II
MSATRLENGAGDYIQTELISGIDFVNKNNSKGHCANGETGLNEHTKYKNGFKKSVISNGHVTSSDEETTKNRTKNGYKTDTSTDEPKIRQIKESFEPPTLITKALTHISFYILMFLGYLSQALFPPKLVKEKNREGYRPLSDRFAAFYSQYVYRRIKDCWNLPICSVPGDEVVLKDRITRDHCWTFEFTGSKTKCINLASYNYLGFAEATGPCAEHAIRTIYTDGISTGSTRQQYGTCALHDELEQLIAEFVGAEDSITFGMGFATNSLNIPTLASPGCLILSDEKNHASLILGIKLNHPTVRVFKHNNVKHLEKLLQEAIYYGQPGQPNNEYKPWKKIIIFIEGVYSMEGTIGRLPEIIALKKKYKAYLYLDEAHSIGAMGKHGKGVVDYFNCDPKDIDILMGTFTKSFGGAGGYIAGSKEFISFIREHSHASGHAWAMSPPVAAQIISVLKIIMGKDGTNEGQKRIERLARNSRYVRLRLEQMGLIVHGNQDSPVVPILVYRYSNVAVVVRTLIKEKIATVGVGYPATPLAECRIRICISAGHTKEQLDYALSVIEKVADEIGIKYSRKPRDPKPIDYNKIKIYQDLF

SEQ ID NO: 21966 - protein, 224 aa, Diabrotica virgifera
  misc_feature: Coding regions on vcDNA: vcDNA=SeqID_1663; Strand=+; Position=261-932
  misc_feature: Homolog annotation: Hit_ID=XP_395473.1; Match level="QueryCoverage =93%, HitCoverage=21%, E-value=3e-29, Identity=32%"; Hit description =similar to ENSANGP00000009437 [Apis mellifera]
  misc_feature (205)..(205): Xaa can be any naturally occurring amino acid
MFLKFDTFGKDYAQMAAIAIGCLSSCISGMTIAWSSPYVVKITQDKETYNITEEEASYFTMINVIGLVVSLPFTSLLPDRLGRKPVLMLSALPYSLCWLLKLFFTNVYILYLARFCAGIGDGLLFASLPLYIGEIATPEVRGIWGNGLMIFGFLGQFLINVFGIFLTVPQTSIVSLSVPLIFVSAFYFMPDSPYFFAMKDRDEEXKAALRFFRLRDDVDDEYKY

SEQ ID NO: 21967 - protein, 112 aa, Diabrotica virgifera
  misc_feature: Coding regions on vcDNA: vcDNA=SeqID_1664; Strand=+; Position=2-340
  misc_feature: Homolog annotation: Hit_ID=XP_397055.1; Match level="QueryCoverage =88%, HitCoverage=46%, E-value=1e-25, Identity=59%"; Hit description =similar to CG13887-PB [Apis mellifera]
  misc_feature: Gene Ontology Annotation: Molecular function=receptor-associated protein activity; Cellular component=integral to plasma membrane; Biological process=immune response
  misc_feature: Pfam annotation: Pfam_ID=Bap31; Match level="Score=-74.9, E-value =0.0073, Copies=1"; Pfam description=B-cell receptor-associated protein 31
RRLVILISEQATLQAQSEASMRQAQSATTAAKSLLAQRGEVAQNESNEAHDQVNELKTKIQKLEDELKTEQKDKTAIKSQAENLAKEYDRLAEEHSKLQKKVTIQGAEKKGE

SEQ ID NO: 21968 - protein, 228 aa, Diabrotica virgifera
  misc_feature: Coding regions on vcDNA: vcDNA=SeqID_1665; Strand=+; Position=206-892
  misc_feature: Homolog annotation: Hit_ID=XP_397055.1; Match level="QueryCoverage =94%, HitCoverage=96%, E-value=4e-74, Identity=66%"; Hit description =similar to CG13887-PB [Apis mellifera]
  misc_feature: Gene Ontology Annotation: Molecular function=receptor-associated protein activity; Cellular component=integral to plasma membrane; Biological process=immune response
  misc_feature: Pfam annotation: Pfam_ID=Bap31; Match level="Score=322.7, E-value =5.7e-94, Copies=1"; Pfam description=B-cell receptor-associated protein 31
MSLQWTIIAGFLYAEIAVVLLLVLPVASPRRWNSFFKSKFLQGLQKQAGFYFLMLLGILVLFLLDAIREMRKYSNLEAEEHGHAHLDREMQGSMRLFRAQRNFYISGFALFLSLVIRRLVILISEQATLQAQSEASMRQAQSATTAAKSLLAQRGEVAQNESNEAHDQVNELKTKIQKLEDELKTEQKDKTAIKSQAENLAKEYDRLAEEHSKLQKKVTIQGAEKKGE

SEQ ID NO: 21969 - protein, 250 aa, Diabrotica virgifera
  misc_feature: Coding regions on vcDNA: vcDNA=SeqID_1666; Strand=+; Position=46-798
  misc_feature: Homolog annotation: Hit_ID=EAL27524.1; Match level="QueryCoverage =96%, HitCoverage=93%, E-value=9e-42, Identity=39%"; Hit description =GA22042-PA [Drosophila pseudoobscura]
  misc_feature: Pfam annotation: Pfam_ID=GILT; Match level="Score=112.5, E-value=1.1e- 30, Copies=1"; Pfam description=Gamma interferon inducible lysosomal
MKLLLLPGFLLALSVLVKSQHEHHHTHEQHRVNVSVYYESLCPDSKKFFTQQLYPSLQPQNNISDFVNLTLVPYGKSTRTFDITDWKFECHHGEIECYGNKIQACALRLIDKGLPSEGKGFNKGAVGFINCLMDKADKTAKVVFPTTECALINPVSNLQDIENCANHTDAANYLALLGKATDAIQKPLKSVPTIVFNGEYKQSDNDLAQTNFIKALCQYIQDDKPDVCSSAGTFTFSLSLISMAVLFTLY

SEQ ID NO: 21970 - protein, 439 aa, Diabrotica virgifera
  misc_feature: Coding regions on vcDNA: vcDNA=SeqID_1667; Strand=+; Position=14-1330
  misc_feature: Homolog annotation: Hit_ID=XP_310327.1; Match level="QueryCoverage =77%, HitCoverage=60%, E-value=2e-76, Identity=45%"; Hit description =ENSANGP00000022969 [Anopheles gambiae]
  misc_feature: Gene Ontology Annotation: Biological process=reproduction
  misc_feature: Pfam annotation: Pfam_ID=GMC_oxred_N; Match level="Score=320.5, E -value=2.6e-93, Copies=1"; Pfam description=GMC oxidoreductase
MKILWLCSLVSSAFTQDLDQLYSYVSAKIAETNSYQTPINNERLFKTNNSTIYDFGQYDFIIVGAGAAGCVLANRLTEISKWNVLLLEAGGETNAFSDIPRYSNALKQTDMNWGYLTTPQKTCCQGMNNNQCIYPRGKVIGGSTTINAAIYARGSASDYNHWAAMGNLGWSYNHILKYFKKSEHVALKSYDINYHGKNGELYVNQTTPPSIVSKYYIDANKEKHLKEIDYNGRRQLGVSRIQFNQKDRVHQNAAHAFLDGIKTRSNLKIVLNAGVNKILLKGKKATGVTFILNGTIYKATAGKEVILSAGAINSPQLLILSGVGPKTDLENLNIPVRNDLPAVGRNMQDHPLFGNLYFRTNLSSPVLSLKENLANYLEGKAPFTNGNGLENIAFINSDHITTGELDIEFFTFAPPLGVPAKNLQNLQDDVAKVFSEYNT

SEQ ID NO: 21971 - protein, 57 aa, Diabrotica virgifera
  misc_feature: Coding regions on vcDNA: vcDNA=SeqID_1668; Strand=-; Position=66-238
  misc_feature (33)..(33): Xaa can be any naturally occurring amino acid
MTKLVELGYKLLLHPPYSPDLTSCDFFLFWQLXFVLSWQKFKPDEQIIFSPEVYVYS

SEQ ID NO: 21972 - protein, 273 aa, Diabrotica virgifera
  misc_feature: Coding regions on vcDNA: vcDNA=SeqID_1669; Strand=+; Position=188-1005
  misc_feature: Homolog annotation: Hit_ID=XP_308963.1; Match level="QueryCoverage =97%, HitCoverage=73%, E-value=1e-126, Identity=81%"; Hit description= ENSANGP00000020185 [Anopheles gambiae]
  misc_feature: Pfam annotation: Pfam_ID=Epimerase; Match level="Score=-130.2, E -value=4.3e-05, Copies=1"; Pfam description=NAD dependent epimerase/dehydratase fa
  misc_feature (262)..(262): Xaa can be any naturally occurring amino acid
  misc_feature (265)..(265): Xaa can be any naturally occurring amino acid
MASGEIRKVALLTGVNGQDGSYLSEFLLNKGYEVHGIIRRASSFNTGRIDHLHSDPYAHKGGRFFLHYGDMTDSSCLVKIIGQIKPTEIYNLAAQSHVKVSFDLSEYTAEVDAVGTLRLLDAIRTCGLENSTKFYQASTSELYGKVVETPQNEKTPFYPRSPYAAAKLYAYWIVVNYREAYNIFACNGILFNHESPRRGETFVTRKITREVAKIHLGLSEYIELGNLDSKRDGGHARDYVEAMWLMMQEESPEDFVIASGEXHSXREFVEAAF

SEQ ID NO: 21973 - protein, 173 aa, Diabrotica virgifera
  misc_feature: Coding regions on vcDNA: vcDNA=SeqID_1670; Strand=+; Position=3-524
  misc_feature: Homolog annotation: Hit_ID=XP_396375.1; Match level="QueryCoverage =99%, HitCoverage=26%, E-value=1e-69, Identity=72%"; Hit description =similar to ROP protein [Apis mellifera]
  misc_feature: Gene Ontology Annotation: Molecular function=protein binding; Cellular component=cytoplasm; Biological process=synaptic vesicle priming
KNGITDENLSKLATHAQIKDKQTIANLQLLGVNVINDGGPRKKQYTVPRKERITEQTYQMSRWTPIIKDIMEDCIDDKLDQKHYPYLSGRAQSTGYHAAPSSARYGQWHKDRGQQAVKNVPRLLVFVVGGISFSEIRCAYEVTNAQKNWEVIIGSSHILTPEDFLSNLATLAG

SEQ ID NO: 21974 - protein, 109 aa, Diabrotica virgifera
  misc_feature: Coding regions on vcDNA: vcDNA=SeqID_1671; Strand=+; Position=1-330
  misc_feature: Homolog annotation: Hit_ID=EAL30075.1; Match level="QueryCoverage =98%, HitCoverage=24%, E-value=8e-29, Identity=55%"; Hit description =GA18298-PA [Drosophila pseudoobscura]
  misc_feature: Gene Ontology Annotation: Biological process=axonogenesis
IYFIDKEVSYPLRDFMTESCPNLVGLVNRMKERCFSDWDDICTTLDLNSHLPKPKAEESKDNKEESKDEKESDKEKEPEEKDIEKEKADEKEKDKAKEKSEENKEKEGK

SEQ ID NO: 21975 - protein, 377 aa, Diabrotica virgifera
  misc_feature: Coding regions on vcDNA: vcDNA=SeqID_1672; Strand=+; Position=207-1340
  misc_feature: Homolog annotation: Hit_ID=XP_393141.1; Match level="QueryCoverage =95%, HitCoverage=92%, E-value=1e-140, Identity=66%"; Hit description= similar to ENSANGP00000008196 [Apis mellifera]
  misc_feature: Gene Ontology Annotation: Molecular function=molecular_function unknown; Cellular component=integral to membrane; Biological process= axonogenesis
  misc_feature: Pfam annotation: Pfam_ID=GST_C; Match level="Score=2.5, E-value =0.031, Copies=1"; Pfam description=Glutathione S-transferase, C -terminal
VFILLEIELAMATEVENNAPETKEIKEEIPSGDNKADEAGKQENAGDAPASAKEKEPTPPKVLVHKPNFEKDVVYLYQFSRTPLLPSLSPYCLKVETWLRLAGVKYENVDHKMKYRSKKGQLPFIELNGEEIADSAIIIKDLSQKFGHDLDVCLTAEQRNLAHATISMIENHLAWVVMWWRTKYPDQVLKGYKVNLQHALGTRIPNGILNFFFKFAFGRKWFQGTKKVKAQGMGVHSAEEINEFGQEDLKVLSEMLADKPFFFGDEPTTLDVVVFAHLAQIYFIDKEVSYPLRDFMTESCPNLVGLVNRMKERCFSDWDDICTTLDLNSHLPKPKAEESKDNKEESKDEKESDKEKEPQGQKNLKKPKRDKKKFLKG

SEQ ID NO: 21976 - protein, 251 aa, Diabrotica virgifera
  misc_feature: Coding regions on vcDNA: vcDNA=SeqID_1673; Strand=+; Position=550-1305
  misc_feature: Homolog annotation: Hit_ID=XP_394993.1; Match level="QueryCoverage =96%, HitCoverage=95%, E-value=1e-84, Identity=59%"; Hit description =similar to Proteasome subunit beta type 4 precursor (Proteasome beta chain) (Macropain beta
  misc_feature: Gene Ontology Annotation: Molecular function=endopeptidase activity; Cellular component=26S proteasome; Biological process=proteolysis and peptidolysis
  misc_feature: Pfam annotation: Pfam_ID=Proteasome; Match level="Score=104.2, E -value=3.3e-28, Copies=1"; Pfam description=Proteasome A-type and B -type
MFNSAAPPLWHNGPVPGEFYNFPGKQTSYSNPITHTQSPVTTSTSVLAITYDKGVLITGDLVASYGSLARYRNCPRVIKVNQNIILGAGGDYADFQYVKSFIEQKIIDEECIDDGLKMKPKSLYCWLTRVMYQRRSKLDPFWNNLVIGGIQDGVPFLGTVDKLGTAYTDKVICTGYGAHIALPLLRDSLDKNGALNLADAKTLIHKCMEVLFYRDARSFPKYQLGVIDKDDGVSIEGPISVEENWSIAHMT

SEQ ID NO: 21977 - protein, 277 aa, Diabrotica virgifera
  misc_feature: Coding regions on vcDNA: vcDNA=SeqID_1674; Strand=+; Position=2-835
TIRCLFEMNFLITILAVALVGSTTTRAEISGPPGQNLVRYVGQLLGKCFPNQSNAEDQMYTGNNILEVLNAQAGVDIFVKTQNGIKINADIFAAILSDCIQSSLQGQGSTAIRINKRDVTPAINALLYNQEMSVQDIDMFVFSRQLNPRFRRDLAFPLNLFQEVISTIILQPLIAHVNSIFDGIDKLILSYYVDPASVTDPIQSIVINTINNAVQTVSGIIKNIKAQITELFSTVIKEGTSTTTASIQAKSKILQTKDAFSDSYRKFARPAHNLSRK

SEQ ID NO: 21978 - protein, 65 aa, Diabrotica virgifera
  misc_feature: Coding regions on vcDNA: vcDNA=SeqID_1675; Strand=-; Position=40-237
FPLFFNVRIYFIHVITKLMKNVLIMVLVMVMMVNVYMNVFKNGFNWRSFCSFRLEYSQCNKTKHK

SEQ ID NO: 21979 - protein, 81 aa, Diabrotica virgifera
  misc_feature: Coding regions on vcDNA: vcDNA=SeqID_1676; Strand=-; Position=834-1079
QHSYNLANLSVQSLNSTKNSLSARSRRTTRSASVAHPNRQRNRQATQVPRRFYSAIGFKERSNHGISTTNVKRDLSIFNFV

SEQ ID NO: 21980 - protein, 220 aa, Diabrotica virgifera
  misc_feature: Coding regions on vcDNA: vcDNA=SeqID_1677; Strand=+; Position=43-705
  misc_feature: Homolog annotation: Hit_ID=NP_610462.3; Match level="QueryCoverage =100%, HitCoverage=100%, E-value=1e-74, Identity=65%"; Hit description=CG8055-PA [Drosophila melanogaster] gb|AAF58977.2| CG8055-PA [Drosophila melanogaster]
  misc_feature: Gene Ontology Annotation: Molecular function=molecular_function unknown; Cellular component=endosome; Biological process =intracellular protein transport
  misc_feature: Pfam annotation: Pfam_ID=SNF7; Match level="Score=220.2, E-value=3.9e- 63, Copies=1"; Pfam description=SNF7
MSFFGKLFGGKKEEIAPSPGEAIQKLRETEEMLIKKQDFLEKKIEEFTMVAKKNASKNKRVALQALKKKKRLEKTQLQIDGTLTTIEMQREALEGASTNTAVLDSMKNAADALKKAHKNLNVDDVHDIMDDIAEQHDIANEITNAISNPVGFTDDLDDDELEKELEELEQEGLEEDLLQVPGPTQLPAVPADAVATKPIKPAAKKVEDDDDMKELEAWAS

SEQ ID NO: 21981 - protein, 159 aa, Diabrotica virgifera
  misc_feature: Coding regions on vcDNA: vcDNA=SeqID_1678; Strand=+; Position=64-539
  misc_feature: Homolog annotation: Hit_ID=XP_392565.1; Match level="QueryCoverage =92%, HitCoverage=77%, E-value=3e-59, Identity=77%"; Hit description =similar to ribosomal protein L18 [Apis mellifera]
  misc_feature: Gene Ontology Annotation: Cellular component=cytosolic ribosome (sensu Eukarya); Biological process=protein biosynthesis
  misc_feature: Pfam annotation: Pfam_ID=Ribosomal_L18e; Match level="Score=268.5, E -value=1.1e-77, Copies=1"; Pfam description=Eukaryotic ribosomal protein L18
  misc_feature (125)..(125): Xaa can be any naturally occurring amino acid
  misc_feature (145)..(145): Xaa can be any naturally occurring amino acid
KLFYIFGSLLLEKMYRYLARRTGAKFDKILLKRLFMSKINRPPLSLSKLVRLMKKPGRDGLIAVVVGTITDDARIFEIPKLSVCALRVTQTARARILKAGGEVITFDQLALRAPTGKKTVLLQGXRRNAREAVKHFGPAPGVPHXSHANPLVLSPGTPI

SEQ ID NO: 21982 - protein, 188 aa, Diabrotica virgifera
  misc_feature: Coding regions on vcDNA: vcDNA=SeqID_1679; Strand=+; Position=57-623
  misc_feature: Homolog annotation: Hit_ID=XP_392565.1; Match level="QueryCoverage =100%, HitCoverage=100%, E-value=3e-90, Identity=85%"; Hit description=similar to ribosomal protein L18 [Apis mellifera]
  misc_feature: Gene Ontology Annotation: Cellular component=cytosolic ribosome (sensu Eukarya); Biological process=protein biosynthesis
  misc_feature: Pfam annotation: Pfam_ID=Ribosomal_L18e; Match level="Score=428.8, E -value=6.4e-126, Copies=1"; Pfam description=Eukaryotic ribosomal protein L18
MGIDINHKYDRKVRRTEPRSQDVYLRLLVKLYRYLARRTGAKFNKIILKRLFMSKINRPPLSLSKLVRLMKKPGRDGLIAVVVGTITDDARIFEIPKLSVCALRVTQTARARILKAGGEVITFDQLALRAPTGNKTVLLQGRRNAREAVKHFGPAPGVPHSHAKPLVHSKGRKFERARGRRRSCGYKK

SEQ ID NO: 21983 - protein, 114 aa, Diabrotica virgifera
  misc_feature: Coding regions on vcDNA: vcDNA=SeqID_1680; Strand=-; Position=54-398
  misc_feature: Homolog annotation: Hit_ID=CAD22154.1; Match level="QueryCoverage =99%, HitCoverage=50%, E-value=3e-43, Identity=65%"; Hit description =pherophorin-dz1 protein [Volvox carteri f. nagariensis]
  misc_feature: Gene Ontology Annotation: Molecular function=small GTPase regulatory/interacting protein activity; Cellular component=actin cytoskeleton; Biological process=actin polymerization and/or depolymerization
PPPPDQPPWPPPPPPPPLGTRILIILTVLPPPPYPPPPPPPYPPPPPPIHPPPPPDFQPLDPPPDQPPPPYPPPPPYPPPPPDQPPPPPDFQPPPPPPPDQPPPPPPLRKPPCT

SEQ ID NO: 21984 - protein, 318 aa, Diabrotica virgifera
  misc_feature: Coding regions on vcDNA: vcDNA=SeqID_1681; Strand=+; Position=25-983
  misc_feature: Homolog annotation: Hit_ID=XP_312881.1; Match level="QueryCoverage =92%, HitCoverage=89%, E-value=1e-128, Identity=70%"; Hit description= ENSANGP00000014751 [Anopheles gambiae]
  misc_feature: Gene Ontology Annotation: Molecular function=molecular_function unknown; Cellular component=nuclear pore; Biological process=protein- nucleus import
  misc_feature: Pfam annotation: Pfam_ID=WD40; Match level="Score=158.2, E-value=1.8e- 44, Copies=6"; Pfam description=WD domain, G-beta repeat
  misc_feature (295)..(295): Xaa can be any naturally occurring amino acid
ILLISRIKIFNIKMVSILNSIDTGHEDMIHDAEVDYYGLRLATCSSDNSIKVYDIKSGASTLLDDLKGHYGPVWQIAWSHPKFGNLLASCSYDRKVIIWKEQQRKWIKYYEYANHDSSVNSVQFAPAELGLILACGSSDGSISLLTYNVGSNIWDAKKIQNAHAIGCNAVSWAPAITPVFGDETTPVKRLVSGGCDNLVKIWREDGDRWIEESKLEVHSDWVRDVAWAPSVGLHRYTIASCSQDRRVVIWTSNDCINWNSTVLHTFDDVVWNLSWSLNGNILAVSGGDNKITFVXKTQKGSWQCISDIARGQGKIISM

SEQ ID NO: 21985 - protein, 174 aa, Diabrotica virgifera
  misc_feature: Coding regions on vcDNA: vcDNA=SeqID_1682; Strand=+; Position=1-525
  misc_feature: Homolog annotation: Hit_ID=XP_313613.1; Match level="QueryCoverage =100%, HitCoverage=6%, E-value=2e-73, Identity=73%"; Hit description =ENSANGP00000003616 [Anopheles gambiae]
  misc_feature: Gene Ontology Annotation: Molecular function=actin binding; Cellular component=actin cytoskeleton; Biological process=signal transduction
  misc_feature: Pfam annotation: Pfam_ID=Filamin; Match level="Score=100.2, E-value =5.3e-27, Copies=1"; Pfam description=Filamin/ABP280 repeat
MDCTEVEEGYKVRYTPLAPGDYYISIKYNNHHIVGSPFKVTSKGDKKVADIGGQESSSTVVETVAKTGKANNNKGPVLPAFKSDASKVLSKGMGLKKAYLGKQNQFTVSAQNAGVNILFVGIHGPKGPCEEVFIKHQGHNQYAVNYMVRDRGDYLVIVKWGDDHIPGSPFKVEV

SEQ ID NO: 21986 - protein, 304 aa, Diabrotica virgifera
  misc_feature: Coding regions on vcDNA: vcDNA=SeqID_1683; Strand=+; Position=34-945
  misc_feature: Homolog annotation: Hit_ID=XP_317284.1; Match level="QueryCoverage =74%, HitCoverage=48%, E-value=8e-44, Identity=43%"; Hit description =ENSANGP00000021851 [Anopheles gambiae]
  misc_feature: Pfam annotation: Pfam_ID=PT; Match level="Score=7.9, E-value=0.083, Copies=1"; Pfam description=PT repeat
  misc_feature (217)..(217): Xaa can be any naturally occurring amino acid
  misc_feature (267)..(267): Xaa can be any naturally occurring amino acid
  misc_feature (281)..(281): Xaa can be any naturally occurring amino acid
  misc_feature (284)..(284): Xaa can be any naturally occurring amino acid
  misc_feature (297)..(297): Xaa can be any naturally occurring amino acid
MRLTVHICLCLTVISLKVYAEDDLEGVVVEAAALPGETRSSRQFYFRGPSIPVYNPFMIPQVWSSFSTNSLNIPTIGQCFTAKGVVGKCTSFRQCYPFFKIAEFGNFESWVLGMYDTCSYYTAQGRQMFGVCCTNPNPGKPAESSPGSSTELPIVEAEDTVIDALQTNSSAIPYFPQIFNWPPPLPTHSPDNTIPPLPTHPPSLGLPTVSPTAWPPXPNKPVSPIYQPTVKPIYQPSFPTYKPPTYKPPTHKPTSKPTIATVATQPXPSGACGAKNGYSDXKRXIVGGHNAEGHEWXPWIAALF

SEQ ID NO: 21987 - protein, 155 aa, Diabrotica virgifera
  misc_feature: Coding regions on vcDNA: vcDNA=SeqID_1684; Strand=+; Position=455-917
  misc_feature: Homolog annotation: Hit_ID=XP_485924.1; Match level="QueryCoverage =98%, HitCoverage=49%, E-value=8e-40, Identity=47%"; Hit description =similar to Zinc finger protein 267 (Zinc finger protein HZF2) [Mus musculus]
  misc_feature: Gene Ontology Annotation: Molecular function=protein binding; Cellular component=nucleus; Biological process=regulation of transcription, DNA-dependent
  misc_feature: Pfam annotation: Pfam_ID=zf-C2H2; Match level="Score=135.8, E-value =1e-37, Copies=5"; Pfam description=Zinc finger, C2H2 type
  misc_feature (126)..(126): Xaa can be any naturally occurring amino acid
  misc_feature (132)..(132): Xaa can be any naturally occurring amino acid
NEIRKFVGNSHWRKALKCEICFNQFSRAGHFKEHLRTHTGEKPYKCEICFKQLSRGGNLKTHLRIHTGEKPHKCEICFKQFVHAGNLNVHMRTHTGERSYECAICLKQFTQASHLKLHNRSHTGEXPYKCEXCYERFVKASILNVHLRKHTVKRA

SEQ ID NO: 21988 - protein, 276 aa, Diabrotica virgifera
  misc_feature: Coding regions on vcDNA: vcDNA=SeqID_1685; Strand=+; Position=145-975
  misc_feature: Homolog annotation: Hit_ID=EAL26776.1; Match level="QueryCoverage =96%, HitCoverage=53%, E-value=5e-24, Identity=30%"; Hit description =GA20710-PA [Drosophila pseudoobscura]
  misc_feature: Gene Ontology Annotation: Molecular function=cytoskeletal regulatory protein binding; Cellular component=microtubule associated complex; Biological process=embryogenesis and morphogenesis
  misc_feature: Pfam annotation: Pfam_ID=PWWP; Match level="Score=50.9, E-value=3.6e -12, Copies=1"; Pfam description=PWWP domain
MKRPNFKVGDKIFAKVKGYPVWPARIVSEAGKKFNVLFYGTGETGCISSEHLFYYLKNKKKFQKPLKRQDYIAAFKEIEDAIKKDGGDGDESPDKNDSLAADVSLDTSTANNSPVVKTEKKTPAKRKRSSVADDAAAAETSTPKKKSSRLSRNSEEPPKVEKDKDIVEPETPSKKPEEPEKVVPKKEKVVPKKTPKAKVKEEKKKADKKEEETPVEEKKTSDAIKEETETVTDMSVEDEKPENKEKPLEIIAECLRHNILYANHVKKTESDYKESQ

SEQ ID NO: 21989 - protein, 167 aa, Diabrotica virgifera
  misc_feature: Coding regions on vcDNA: vcDNA=SeqID_1686; Strand=+; Position=140-643
  misc_feature: Homolog annotation: Hit_ID=XP_311723.1; Match level="QueryCoverage =100%, HitCoverage=86%, E-value=5e-84, Identity=89%"; Hit description= ENSANGP00000014274 [Anopheles gambiae]
  misc_feature: Gene Ontology Annotation: Molecular function=protein binding; Cellular component=Golgi apparatus; Biological process=signal transduction
  misc_feature: Pfam annotation: Pfam_ID=PX; Match level="Score=123.0, E-value=7.2e -34, Copies=1"; Pfam description=PX domain
MMAEADATVEATRRLNVKKQTLDDAYAAPANFLEIDVVNPVTTIGVGKKRFTDYEVKMRTNLPVFKVKESSVRRRYSDFEWLRNELERDSKIVVPPLPGKAWKRQLPFRGDDGIFEEDFIEDRRKGLEVFINKIAGHPLAQNERCLHMFLQEPQIDRNYVPGKIRNT

SEQ ID NO: 21990 - protein, 293 aa, Diabrotica virgifera
  misc_feature: Coding regions on vcDNA: vcDNA=SeqID_1687; Strand=+; Position=2-883
  misc_feature: Homolog annotation: Hit_ID=XP_415416.1; Match level="QueryCoverage =51%, HitCoverage=30%, E-value=9e-19, Identity=36%"; Hit description =PREDICTED: similar to small nuclear RNA activating complex, polypeptide 4, 190kDa; small
  misc_feature: Gene Ontology Annotation: Molecular function=transcription factor activity; Cellular component=nucleus; Biological process =transcription from Pol II promoter
  misc_feature: Pfam annotation: Pfam_ID=Myb_DNA-binding; Match level="Score=56.2, E -value=9.1e-14, Copies=3"; Pfam description=Myb-like DNA-binding domain
WADIAKELGTNRTCFSLFINYINNFHSKLKKGGFTPAEDKKLANLVRKFRVGDYIPWTKIARHFRYRERSQLHHRFKYFLNHVDKKQGKFSLAEDCLIYICVEKFGMAYHEVTEHLKGRSRTQIRTRYITCLKLDAKKNTWTEAEDDTLIRLREQQTKMDWTTIAQTLRRTPGQTRQRYHVIKKYLEKNSGSTIMNVPRRIHVKEENNAVLKQVANIFGAQNVIPTLEEIGEILSNYLNEPLSSQNDSVEDIDVLLYDFFLSTSDQSLEILSDPLAVKTGCRLCRISNEFSLR

SEQ ID NO: 21991 - protein, 143 aa, Diabrotica virgifera
  misc_feature: Coding regions on vcDNA: vcDNA=SeqID_1688; Strand=+; Position=30-458
RPASAMKYFYLTYVLITYFYYINAEESPSLAALAPKCECGDIIDKILCQLTENSKEILTLQVKLVSIRKESTELQNNVAENTCLVNSIEADVTVIEQQQNQTVTVVNNHTAIIVDIETNLEVIIQEQNVLETNIEANSCTLAD

SEQ ID NO: 21992 - protein, 277 aa, Diabrotica virgifera
  misc_feature: Coding regions on vcDNA: vcDNA=SeqID_1689; Strand=+; Position=110-943
  misc_feature: Homolog annotation: Hit_ID=NP_649757.1; Match level="QueryCoverage =94%, HitCoverage=82%, E-value=5e-67, Identity=48%"; Hit description =CG2767-PA [Drosophila melanogaster] gb|AAF54175.1| CG2767-PA [Drosophila melanogaster]
  misc_feature: Gene Ontology Annotation: Molecular function=electron transporter activity; Cellular component=cytoplasm; Biological process=glucose metabolism
  misc_feature: Pfam annotation: Pfam_ID=Aldo_ket_red; Match level="Score=323.6, E -value=2.9e-94, Copies=1"; Pfam description=Aldo/keto reductase family
MAKTVPCGSLNMPTVGLGTWQATDEAELEKALNVALETGYRHIDTAAAYENEHIIGKVLNQWISAGKLKRDDLFIVTKLPIQGIHRDRVEKYLTESLKKLELDYVDLYLIHFPVGLAGTEGGIVFEKEDHLGVWKSMEKQVEAGRTKTIGLSNFTVSQIDNILKNCKIKPANNQVELHVFLQQPELVQFCQKSGISVTAYSPIGSPGMNIFLKKMGVKEKTLVNVLANPVVLDIAKKHNKTTAQVALRFLLQQNIIVIPESVNPETIKSNFDISTLI

SEQ ID NO: 21993 - protein, 225 aa, Diabrotica virgifera
  misc_feature: Coding regions on vcDNA: vcDNA=SeqID_1690; Strand=+; Position=36-714
  misc_feature: Homolog annotation: Hit_ID=XP_318845.1; Match level="QueryCoverage =84%, HitCoverage=90%, E-value=1e-36, Identity=51%"; Hit description =ENSANGP00000014460 [Anopheles gambiae]
  misc_feature: Gene Ontology Annotation: Molecular function=cyclin-dependent protein kinase inhibitor activity; Biological process=G1 phase of mitotic cell cycle
  misc_feature: Pfam annotation: Pfam_ID=GRP; Match level="Score=-11.0, E-value =0.00081, Copies=1"; Pfam description=Glycine rich protein family
  misc_feature (179)..(179): Xaa can be any naturally occurring amino acid
MCAMMSLQYCGLVLLAGLLLVSAHPGTDSKAEAKVSSVAEKKQEKRGLLDLGYGGGHDFGGGLELGGHGLDLGGHGGFDGGYGGGLGGGYGGLDEGHVKHITITKEVKVPVPAPYPVHIEKKIPVPVPVKVPVPVDRPYPVHVPKPYPVPVEKPVPYPVIKKVPYPVKVPYKVPYPVPXPVPVPKPVPYPVHKPVPYPVKVPVIVEKKSQLLSTSMTIMDLEGAF

SEQ ID NO: 21994 - protein, 150 aa, Diabrotica virgifera
  misc_feature: Coding regions on vcDNA: vcDNA=SeqID_1691; Strand=+; Position=92-544
  misc_feature: Homolog annotation: Hit_ID=EAA14884.2; Match level="QueryCoverage =99%, HitCoverage=99%, E-value=5e-49, Identity=64%"; Hit description =ENSANGP00000013934 [Anopheles gambiae str. PEST] ref|XP_552771.1| ENSANGP00000013934 [Anopheles gambiae st
  misc_feature: Gene Ontology Annotation: Cellular component=Arp2/3 protein complex; Biological process=growth
  misc_feature: Pfam annotation: Pfam_ID=P16-Arc; Match level="Score=235.3, E-value =1.1e-67, Copies=1"; Pfam description=ARP2/3 complex 16 kDa subunit (p16-Arc
MAKNTFSSAFRKIDVDQYSENNFKEDETDSGGSVGPDETEVNNLLQKGKNFDALKVVLNNAPLGIKNQQIKETAFNVTFKVLLAIKPSQIEETVNSLDIESLDTLMKYVYKGFEYPSEGSSGHLLLWHEKIYNLAGVGCIVRVLSDTRRI

SEQ ID NO: 21995 - protein, 348 aa, Diabrotica virgifera
  misc_feature: Coding regions on vcDNA: vcDNA=SeqID_1692; Strand=+; Position=21-1067
  misc_feature: Homolog annotation: Hit_ID=NP_651529.2; Match level="QueryCoverage =92%, HitCoverage=93%, E-value=2e-63, Identity=45%"; Hit description =CG6131-PA [Drosophila melanogaster] gb|AAF56660.2| CG6131-PA [Drosophila melanogaster]
  misc_feature: Gene Ontology Annotation: Molecular function=cyclin-dependent protein kinase inhibitor activity; Cellular component=actin filament; Biological process=signal transduction
  misc_feature: Pfam annotation: Pfam_ID=Chitin_bind_4; Match level="Score=45.3, E -value=1.8e-10, Copies=1"; Pfam description=Insect cuticle protein
MTILRNLAVLTLVVATFAQDYYDDEPQPAPRPRPAPARVQPNYSGPSAPRPTPVPILKQINRHNEDGSYTYGYESADGTFKIETKLPTGDVKGKYGYIDDTGKVRVVEYGATKYGFDPSGEGITVPPPTLVDESQKEGPQDADYYEPQPQPQIPIRKAAIARPRPQQQPQPQQAFEDYSPPQQFEPAPAPPRPAPAQSNFDFDFGPVARPSPARSFAPAPAPAPRPRPLQIPGARPSPIDDGFGPAPASVTRTQVPRVTYAQPAPIPSRPAPSYDIPSARFAPAPAPAPRPAPVYHPRPAPSIPVAGRSGGILDQLRKDYPFAGKRNWPPFMKLTLGLFLKLKKGIFI

SEQ ID NO: 21996 - protein, 293 aa, Diabrotica virgifera
  misc_feature: Coding regions on vcDNA: vcDNA=SeqID_1693; Strand=+; Position=201-1079
RRSTMNVEQNSLSHYHKALLATSASTILQSGLLLDEDLQILINFYKHDPSITFPVYTPSLFFRIGLASFVGSLVLANRFTKWLVLPSTMMATVATVVEVKQSRKITNRKEIVENVVNISKKINTLNSSIKKYLKTRIDIKDKSQNEFFQGYNIQTHEFLKNMRDDEKMFVVTIMNNLEILTNYSDNLKDDFNLFKDFKPLDKVQLENIEDGLKFIIQVQDLHIWIISKLLSYISTVSLGPNNKLDAAAVNTLFDVTLDSLLRFLKNHYEVTRKSFASLRSSVHTLQQIRNGQK

SEQ ID NO: 21997 - protein, 161 aa, Diabrotica virgifera
  misc_feature: Coding regions on vcDNA: vcDNA=SeqID_1694; Strand=+; Position=362-847
  misc_feature: Homolog annotation: Hit_ID=NP_724010.1; Match level="QueryCoverage =88%, HitCoverage=7%, E-value=1e-66, Identity=93%"; Hit description =CG17927-PM, isoform M [Drosophila melanogaster] gb|AAN10970.1| CG17927-PM, isoform M [Drosophila
  misc_feature: Gene Ontology Annotation: Molecular function=structural constituent of muscle; Cellular component=muscle myosin; Biological process =striated muscle contraction
MSNCKKKNPRVRPRVRQKAFDKIIGGWKLKVDDLAAELDASQKECRNYSTELFRLKGAYEEGQEQLEAVRRENKNLADEVKDLLDQIGEGGRNIHEIEKARKRLEAEKDELQAALEEAEAALEQEENKVLRSQLELSVRQEIDRRIQEKELNTQESRLHAS

SEQ ID NO: 21998 - protein, 1315 aa, Diabrotica virgifera
  misc_feature: Coding regions on vcDNA: vcDNA=SeqID_1695; Strand=+; Position=3-3950
  misc_feature: Homolog annotation: Hit_ID=NP_724006.1; Match level="QueryCoverage =100%, HitCoverage=66%, E-value=0.0, Identity=87%"; Hit description =CG17927-PI, isoform I [Drosophila melanogaster] gb|AAN10965.1| CG17927-PI, isoform I [Drosophila
  misc_feature: Gene Ontology Annotation: Molecular function=structural constituent of muscle; Cellular component=muscle myosin; Biological process =striated muscle contraction
  misc_feature: Pfam annotation: Pfam_ID=Myosin_tail_1; Match level="Score=1723.3, E -value=0, Copies=1"; Pfam description=Myosin tail
SAYKEQLNNLMTTLRSTQPHFVRCIIPNELKQPGVIDSHLVMHQLTCNGVLEGIRICRKGFPNRMVYPDFKLRYKILNPAAVSKESDPKKCAEHILDASGLDAELYRLGHTKVFFRAGVLGQMEELRDDRLGKIVTWMQSWVRGYLSRKEFKKLQEQRLALQVCQRNLRKYLKLRTWPWYKLWQKVRPLLNVTRIEDEIAKLEEKAQKAQEAFEREEKAKKELEALYAKLLAEKTELLSNLEGEKGSLSETQERANKLQAQKNDLESQLSETQDRLSQEEDARNQLMQQKKKLEQEMSGFKKDIEDLELNLQKSEQDKATKDHQIRNLNDEIAHQDELINKLNKEKKMSGENNQKVSEELQAAEDKVNHLNKVKAKLEQTLDELEDSLEREKKLRGDVEKSKRKVEGDLKLTQEAVADLERNKKELEQTIQRKDKEISSLTAKLEDEQSVVGKQQKQVKELQARIEELEEEVEAERQARAKAEKQRADLARELEELGERLEEAGGATSAQIELNKKREAELAKLRRDLEESNIQHEGTLANLRKKHNDAVSEMGEQIDQLNKLKAKAEKEKSQYFGELNDLRASVDHLANEKAAIEKVSKQLGQQLNDVQGKLDETNRTLNDFDAAKKKLSIENSDLLRQLEEAESQVSQLSKIKVSLTTQLEDTKRLADEESRERATLLGKFRNLEHDLDNIREQVEEEAEAKADIQRQLSKANAESQLWRQKYESEGVARSEELEEAKRKLQARLAEAEETIESLNQKVVALEKTKQRLATEVEDLQLEVDRANAIANAAEKKQKAFDKIIGEWKLKVDDLAAELDASQKECRNYSTELFRLKGAYEEGQEQLEAVRRENKNLADEVKDLLDQIGEGGRNIHEIEKARKRLEAEKDELQAALEEAEAALEQEENKVLRSQLELSQVRQEIDRRIQEKEEEFENTRKNHQRALDSMQASLEAEAKGKAEALRMKKKLEADINELEIALDHANKANAEAQKTIKRYQQQLKDTQTALEEEQRARDEAREQLGISERRANALQNELEESRTLLEQADRARRQAEQELGDAHEQLNDLGAQNASLSAAKRKLETELQTLHSDLDELLNEAKNSEEKAKKAMVDAARLADELRAEQDHAQTQEKLRKALEAQIKDLQVRLDEAEANALKGGKKAIAKLEQRVRELENELDGEQRRHADAQKNLRKSERRIKELSFQAEEDRKNHERMQDLVDKLQQKIKTYKRQIEEAEEIAALNLAKFRKAQQELEEAEERADLAEQAIAKFRAKGRSGSAARGASPAPQRQRPTLGMGDALGGPFPPRFDLAPDFE

SEQ ID NO: 21999 - protein, 84 aa, Diabrotica virgifera
  misc_feature: Coding regions on vcDNA: vcDNA=SeqID_1696; Strand=+; Position=416-670
FHKICLGNNIPPVYGSYLRAAKLNKFLEHCESLVTLSILRWSIYLRPRQGENPRNILLVNRCPYLHRRRRGVFFFLVTGDQATV

SEQ ID NO: 22000 - protein, 92 aa, Diabrotica virgifera
  misc_feature: Coding regions on vcDNA: vcDNA=SeqID_1697; Strand=+; Position=83-361
  misc_feature: Pfam annotation: Pfam_ID=GRP; Match level="Score=-14.2, E-value =0.0018, Copies=1"; Pfam description=Glycine rich protein family
MMGNKLICLMICFACISLYLMESVEAKNYDPNPPQRSPSPQERGRSRTVPAHLQNQGQNGNGHQNGNGQQNGNGHTNGNGQQNGNGHHNGRR

SEQ ID NO: 22001 - protein, 69 aa, Diabrotica virgifera
  misc_feature: Coding regions on vcDNA: vcDNA=SeqID_1698; Strand=-; Position=0-206
ASNYRWAILKNHISSITSKPLSETRWESTIDAITTIRYQIEEIYDTLVEITVFSLAFVEITPRVRGRVV

SEQ ID NO: 22002 - protein, 72 aa, Diabrotica virgifera
  misc_feature: Coding regions on vcDNA: vcDNA=SeqID_1699; Strand=-; Position=114-332
IFTFLSLTVIFLKKFRGLTSIYIKFSFAGFVAKLLRNHLTDFHEIWQVYSTEHGVGCYLYFIAVRLKGALPP

SEQ ID NO: 22003 - protein, 276 aa, Diabrotica virgifera
  misc_feature: Coding regions on vcDNA: vcDNA=SeqID_1700; Strand=+; Position=108-938
  misc_feature: Homolog annotation: Hit_ID=XP_310710.1; Match level="QueryCoverage =100%, HitCoverage=100%, E-value=1e-133, Identity=81%"; Hit description=ENSANGP00000010110 [Anopheles gambiae] ref|XP_310709.1| ENSANGP00000024702 [Anopheles gambiae]
  misc_feature: Pfam annotation: Pfam_ID=DUF714; Match level="Score=482.2, E-value =5.3e-142, Copies=1"; Pfam description=Domain of unknown function
MDPEAFLDIANQVVKLKMFPYFDIAHCTLCALSVREDLGSGAQAFSRKHPLSCWLSYMLVVFAGGMVANGLLAEPILAPLKNTPQVLVATAVWYVVFYTPLDLGYKLAKFLPVKIIFSAMKEIYRCKKVYDGVTHAAKLYPNAYLVMVIIGTIKGNGAGFTRLMERLIRGVWTPTAMEFMQPSFYTKACLVGSIIFILDKKTELISAPHALVYFGIVIFFVYFKLSSIILGIHDPFVPFENLMCALFFGGVFDTLAKVFGRGQLKEGENKDVKKTN

SEQ ID NO: 22004 - protein, 292 aa, Diabrotica virgifera
  misc_feature: Coding regions on vcDNA: vcDNA=SeqID_1701; Strand=+; Position=3-878
  misc_feature: Homolog annotation: Hit_ID=NP_997855.1; Match level="QueryCoverage =97%, HitCoverage=34%, E-value=2e-63, Identity=43%"; Hit description =Unknown (protein for MGC:66193) [Danio rerio] gb|AAH55539.1| Unknown (protein for MGC:66193)
  misc_feature: Gene Ontology Annotation: Molecular function=phospholipase A2 activator activity; Cellular component=cellular_component unknown; Biological process=signal transduction
FVTSDEDRCVRFWQNNENKGCIELPAQPVWAVDCLPNGDIVTGSSDGIVRIFTKDDSRVADEVNLTKFTEEVNALKRQAVQEIGGVKVSDLPGKEALYDPGKRNGQMKMVRDGSSVVAYTWVEDGENSHWDKVGEVLGGTDKNDSGKTMYEGQYYDYVFSVDVEDGKPPLKLPFNKGDDPYQAAHKFLAKHMLPAEYLEQVVDFILKNSKEQYVPQVSMEYQDPFTGGSRYTPSYGSANQGQTGMNLDPFTGGSSYSTSGTRSPPPAASAGQNSDPFTGSSSYSNGKCGIRS

SEQ ID NO: 22005 - protein, 253 aa, Diabrotica virgifera
  misc_feature: Coding regions on vcDNA: vcDNA=SeqID_1702; Strand=+; Position=64-825
  misc_feature: Homolog annotation: Hit_ID=XP_311461.1; Match level="QueryCoverage =89%, HitCoverage=72%, E-value=2e-85, Identity=65%"; Hit description =ENSANGP00000023686 [Anopheles gambiae]
  misc_feature: Gene Ontology Annotation: Molecular function=3'-5' exoribonuclease activity; Cellular component=exosome (RNase complex); Biological process=rRNA processing
  misc_feature: Pfam annotation: Pfam_ID=RNase_PH; Match level="Score=111.7, E-value =1.8e-30, Copies=1"; Pfam description=3' exoribonuclease family, domain 1
MSLCEAEKTFVLHGVEENFRVDGREREDYRPMELETDIVSHAFGSARLRLANTDVLVAVKIEVDVPFPETPNLGKLEFFVDCSANATPDFEGRGGEDLAIAISNTLSSAYSSPLAFDLKKLCILNGRKCWKIYVDILILECGGNLFDAVSLAVKAALWNTQVPLVKNVNIDGNNVEINVSDELYDCKRLDVQNAPIMVTVCKIGEKCIVDPNAAEEQCSVGSVVVAVSGDNLAQFIKQEQDRYIPQPSLKVCS

SEQ ID NO: 22006 - protein, 178 aa, Diabrotica virgifera
  misc_feature: Coding regions on vcDNA: vcDNA=SeqID_1703; Strand=+; Position=104-640
  misc_feature: Homolog annotation: Hit_ID=XP_391948.1; Match level="QueryCoverage =97%, HitCoverage=97%, E-value=3e-42, Identity=50%"; Hit description =similar to ENSANGP00000012985 [Apis mellifera]
  misc_feature: Pfam annotation: Pfam_ID=MARVEL; Match level="Score=89.7, E-value =7.8e-24, Copies=1"; Pfam description=Membrane-associating domain
MMTETVVNVQEAPNNNAAKPPPPRQGTAEQPLGWIKINVAYFKTTPGILKGVEFLFGILCMALASPAYYSGTHFFLFVATTSFILTVLWIFIYLLGIREALQLPINWILSELVNTGFWAVMYLIAFIVQLIVATGVHPLLSFRGSYIAAGVFGLFNAITYAFASYLLYIEWTRSRTPN

SEQ ID NO: 22007 - protein, 65 aa, Diabrotica virgifera
  misc_feature: Coding regions on vcDNA: vcDNA=SeqID_1704; Strand=+; Position=53-250
FLIPFNKFLCNRNFTENMKRGPLNRPRLFNEVIEAIASLKESHGSTKDTIMDQVETILSKRITRL

SEQ ID NO: 22008 - protein, 133 aa, Diabrotica virgifera
  misc_feature: Coding regions on vcDNA: vcDNA=SeqID_1705; Strand=+; Position=49-451
  misc_feature: Homolog annotation: Hit_ID=AAF16721.1; Match level="QueryCoverage =89%, HitCoverage=93%, E-value=1e-15, Identity=30%"; Hit description =sensory appendage protein 4 [Manduca sexta]
  misc_feature: Gene Ontology Annotation: Molecular function=structural molecule activity; Cellular component=extracellular; Biological process=post -mating behavior
  misc_feature: Pfam annotation: Pfam_ID=OS-D; Match level="Score=31.6, E-value=9.3e -10, Copies=1"; Pfam description=Insect pheromone-binding family, A10/
  misc_feature (86)..(86): Xaa can be any naturally occurring amino acid
MNRWCLSALLVTVLVAVVYGKSFQDNIKILKKIDIETVIKNDRIIKGYIDCVTGKKGCTPEGAALKESWKEGIDKGCDDCDEEEKXKIKKVVKHIYLKHPDWYEEVANALDKDKKYRKKYQKYIDELVADPTL

SEQ ID NO: 22009 - protein, 66 aa, Diabrotica virgifera
  misc_feature: Coding regions on vcDNA: vcDNA=SeqID_1706; Strand=+; Position=1-201
GPTHASSLGITRKTVFYSKEKKIPPIPKIKSLQSMYTPSPHIWLLDMDTYKGKYGKNKNMKHEKFH

SEQ ID NO: 22010 - protein, 359 aa, Diabrotica virgifera
  misc_feature: Coding regions on vcDNA: vcDNA=SeqID_1707; Strand=+; Position=205-1281
  misc_feature: Homolog annotation: Hit_ID=AAQ94568.1; Match level="QueryCoverage =95%, HitCoverage=86%, E-value=1e-100, Identity=58%"; Hit description= potassium channel modulatory factor 1 [Danio rerio] ref|NP_957246.1| similar to potassium channel modulat
  misc_feature: Pfam annotation: Pfam_ID=ZZ; Match level="Score=42.3, E-value=1.4e -09, Copies=1"; Pfam description=Zinc finger, ZZ type
MSRHEGVSCDSCLKGNFRGRRYKCLVCYDYDLCATCYEGGATNTRHTTDHPMQCILTRSDYELYYGGEALTSLELPQSYTCPYCSRMGFTDVTLQEHVTADHQDINFEVVCPLCAAMPGGDPNLMTDDFSGHLTLEHRTGARDLISFLDEPVGTRHNVRRIPHNTSHGTTHLGRGSTTALRPRRSNMHFGSGGLSSSSPSSRDSVDPIAELLSQLSGVRRSASNTNSSTPTQLQQLQMQLQLERQQVNAARQQLERYPRRQTQSQTLREPNTSNCSSSTLMLNASPVVVQTSSNTPLAPSQQSQFLLTGLLEELSLQTASEQVRRERSRFVQELVIASAERKNRDQKNIGTPNTKSIYK

SEQ ID NO: 22011 - protein, 139 aa, Diabrotica virgifera
  misc_feature: Coding regions on vcDNA: vcDNA=SeqID_1708; Strand=+; Position=2-418
  misc_feature: Homolog annotation: Hit_ID=XP_395419.1; Match level="QueryCoverage =66%, HitCoverage=16%, E-value=2e-10, Identity=35%"; Hit description =similar to CG10107-PA [Apis mellifera]
PTRPQKLGNSVTISPKSKEPSLADIQRHLSKNDSPTKSIAEKEIIRTKVHCRTVRIGSYRCIPLEDIVIDSEAVTIKVPHPHKEKGVKTITFAKCDTVKVLVSFNSSLPVIFYYLNPSAASQVRTVLDMMTDSDYYYDP

SEQ ID NO: 22012 - protein, 285 aa, Diabrotica virgifera
  misc_feature: Coding regions on vcDNA: vcDNA=SeqID_1709; Strand=+; Position=50-907
  misc_feature: Homolog annotation: Hit_ID=BAA78480.1; Match level="QueryCoverage =88%, HitCoverage=42%, E-value=1e-17, Identity=26%"; Hit description =56 kDa early-staged encapsulation-inducing protein [Tenebrio molitor]
MKSALVFLSVIALSCALTFGTGKQVTINDDGTLTILGENGKKIVISNAIGGTGPKDIEISINGPYGAVKKISVNGETNERTISLVEPSLSEQYNTDEEDRAKRSSSTKDKKDSKNSKDTKEYKGKEGKSKTQAQLLQEIFSEHQEATDAKSYGELLTKVDYYVKSGQLSAGVYDVIRSLRDFNNGVTQYGNQQPLRNPGYPVDTTVPSYYQSPEQYPYPSYSPYGYGYNNYNNLGGYGGAYGVNQGLYPSGISATPANPWSNMWSSLAQQKIAGKSYTPSTDKTY

SEQ ID NO: 22013 - protein, 111 aa, Diabrotica virgifera
  misc_feature: Coding regions on vcDNA: vcDNA=SeqID_1710; Strand=+; Position=126-461
  misc_feature: Homolog annotation: Hit_ID=NP_726909.1; Match level="QueryCoverage =73%, HitCoverage=83%, E-value=2e-17, Identity=56%"; Hit description =CG4944-PC, isoform C [Drosophila melanogaster] gb|AAN09116.1| CG4944- PC, isoform C [Drosophila
  misc_feature: Pfam annotation: Pfam_ID=Thymosin; Match level="Score=19.6, E-value =0.0072, Copies=2"; Pfam description=Thymosin beta-4 family
MSCTVPAAPAPPALKDLPKVAGDLKSELETFKSSNLKNADTHEKVVLPSAEDVAQERTHNALMDGVENFQTSTLKRTDTKEKIDLMHKMWLLRKPKTLLLKIFIYINIKYF

SEQ ID NO: 22014 - protein, 173 aa, Diabrotica virgifera
  misc_feature: Coding regions on vcDNA: vcDNA=SeqID_1711; Strand=+; Position=126-647
  misc_feature: Homolog annotation: Hit_ID=EAL31561.1; Match level="QueryCoverage =72%, HitCoverage=97%, E-value=4e-38, Identity=61%"; Hit description =GA18544-PA [Drosophila pseudoobscura]
  misc_feature: Pfam annotation: Pfam_ID=Thymosin; Match level="Score=132.5, E-value =1e-36, Copies=4"; Pfam description=Thymosin beta-4 family
MSCTVPAAPAPPALKDLPKVAGDLKSELETFKSSNLKNADTHEKVVLPSAEDVAAEKTEKALIEGIERFDTSKLKHTLTQEKNPLPDKEAVQQEKTHQTLLNGVEHFDKTTMKHTETEEKVVLPDKAVIEQEKGQMNLISGIENFDNSKLRHAETLEKNPLPTKEIIDQEKSA

SEQ ID NO: 22015 - protein, 135 aa, Diabrotica virgifera
  misc_feature: Coding regions on vcDNA: vcDNA=SeqID_1712; Strand=+; Position=183-590
  misc_feature: Homolog annotation: Hit_ID=EAL31561.1; Match level="QueryCoverage =94%, HitCoverage=99%, E-value=5e-41, Identity=64%"; Hit description =GA18544-PA [Drosophila pseudoobscura]
  misc_feature: Pfam annotation: Pfam_ID=Thymosin; Match level="Score=103.3, E-value =6e-28, Copies=3"; Pfam description=Thymosin beta-4 family
MSCTVPAAPAPPALKDLPKVAGDLKSELETFKSSNLKNADTHEKVVLPSAEDVAAEKTEKALIEGIERFDTSKLKHTLTQEKNPLPDKEVIEQEKGQMNLISGIENFDNSKLRHAETLEKNPLPTKEIIDQEKSA

SEQ ID NO: 22016 - protein, 73 aa, Diabrotica virgifera
  misc_feature: Coding regions on vcDNA: vcDNA=SeqID_1713; Strand=+; Position=46-267
TNILTYSTEISTFDYQWAQFFFIRYVYYNWLVQTYKTKERICNFTLIFPIYLLISFYLFYYKRTRGHTIKQVV

SEQ ID NO: 22017 - protein, 68 aa, Diabrotica virgifera
  misc_feature: Coding regions on vcDNA: vcDNA=SeqID_1714; Strand=-; Position=391-597
RTVIFILFLVKRRAYSSHKRVVYCLRAATVRLNCVPAVTILRRPQHGHHVCGFTIWLEKAINYYMWRF

SEQ ID NO: 22018 - protein, 166 aa, Diabrotica virgifera
  misc_feature: Coding regions on vcDNA: vcDNA=SeqID_1715; Strand=+; Position=716-1216
  misc_feature: Homolog annotation: Hit_ID=XP_311555.1; Match level="QueryCoverage =98%, HitCoverage=50%, E-value=1e-68, Identity=72%"; Hit description =ENSANGP00000010221 [Anopheles gambiae] gb|EAA07240.1| ENSANGP00000010221 [Anopheles gambiae
  misc_feature: Gene Ontology Annotation: Molecular function=calcium ion binding; Cellular component=endoplasmic reticulum lumen
  misc_feature: Pfam annotation: Pfam_ID=efhand; Match level="Score=52.6, E-value =1.1e-12, Copies=4"; Pfam description=EF hand
DDLLRSNQRRWKTADRDQDGELSKEEFAAFLHPEENDYMRDLVVQETMEDIDKDKDGKISVEEYIGDMYRSDENEEEPDWVKSEREQFNTYRDKDGDGYMDEEEIKNWILPQDFDHAEAEARHLIYEADSDADEQLTKDEVLTKYDLFVGSQALDFGEALTRHDEF

SEQ ID NO: 22019 - protein, 323 aa, Diabrotica virgifera
  misc_feature: Coding regions on vcDNA: vcDNA=SeqID_1716; Strand=+; Position=76-1047
  misc_feature: Homolog annotation: Hit_ID=XP_311555.1; Match level="QueryCoverage =95%, HitCoverage=93%, E-value=1e-114, Identity=64%"; Hit description= ENSANGP00000010221 [Anopheles gambiae] gb|EAA07240.1| ENSANGP00000010221 [Anopheles gambiae
  misc_feature: Gene Ontology Annotation: Molecular function=calcium ion binding; Cellular component=endoplasmic reticulum lumen
  misc_feature: Pfam annotation: Pfam_ID=efhand; Match level="Score=78.6, E-value =1.6e-20, Copies=5"; Pfam description=EF hand
MDHKLCFVVFCLISAVLAVPKEEVHGEKRVHNKELSDKEHLENGHHNPEYDHEAFLGAEEAKTFDQLPPEESKRRLGIIADKIDVNNDGFINREELKDWIRFTQKRYITEDVDRQWKQQNPDDKPTLPWERYQTLVYGFLENMDPAEIENDSTGFSYKKMMARDQRRWKTADRDQDGELSKEEFAAFLHPEENDYMRDLVVQETMEDIDKDKDGKISVEEYIGDMYRSDENEEEPDWVKSEREQFNTYRDKDGDGYMDEEEIKNWILPQDFDHAEAEARHLIYEADSDADEQLTKDEVLTKYDLFVGSQALDFGEALTRHDEF

SEQ ID NO: 22020 - protein, 92 aa, Diabrotica virgifera
  misc_feature: Coding regions on vcDNA: vcDNA=SeqID_1717; Strand=+; Position=1386 -1661
KQKNFFFKCFFFNYSFKLFKGGLQNPPGTKWVCAPPRNPLKLGLKKNKTFLIKIYKKIGFFFKNFFYFGFFFKKFFFLLEQGGEIEPPPPPP

SEQ ID NO: 22021 - protein, 68 aa, Diabrotica virgifera
  misc_feature: Coding regions on vcDNA: vcDNA=SeqID_1718; Strand=-; Position=691-897
GRVGKKRFCMNRAFQCFSFISGTCHMSYINIIHRLYNIRQVKISMSYVFGLYHWYIRITYVPWEFGND

SEQ ID NO: 22022 - protein, 140 aa, Diabrotica virgifera
  misc_feature: Coding regions on vcDNA: vcDNA=SeqID_1719; Strand=+; Position=2-421
  misc_feature: Homolog annotation: Hit_ID=XP_394516.1; Match level="QueryCoverage =99%, HitCoverage=22%, E-value=3e-59, Identity=79%"; Hit description =similar to ENSANGP00000021505 [Apis mellifera]
  misc_feature: Gene Ontology Annotation: Biological process=cell growth and/or maintenance
GRPRVHPRVRPRVRVVGNQIMATVLPGIQLIIGLRHSTSSDKKQQNPPPSKSDHDHVLEHSLHQLLREVHHKNTHHPFPHPATGPLGPSKKRMLAGPMAADRYELLEMTKTQTLLEQIVQQAQHFIMRMRTEYVLDTITK

SEQ ID NO: 22023 - protein, 87 aa, Diabrotica virgifera
  misc_feature: Coding regions on vcDNA: vcDNA=SeqID_1720; Strand=+; Position=36-299
  misc_feature: Homolog annotation: Hit_ID=XP_396687.1; Match level="QueryCoverage =90%, HitCoverage=16%, E-value=2e-15, Identity=47%"; Hit description =similar to ENSANGP00000018533 [Apis mellifera]
MVSCKLIAVFVSLIAAVLASPVPGGWGSHHKHVIIKVPYHVHTVHHHHVEKVHVPVHVPVHVPVVKKIVVHEPIHHHEPIIEHGGWW

SEQ ID NO: 22024 - protein, 77 aa, Diabrotica virgifera
  misc_feature: Coding regions on vcDNA: vcDNA=SeqID_1721; Strand=-; Position=992-1225
KTQERHLYLFLLRSFSNSPCIYFCAWRLRGHHVTKNDQPTTSLRPSWHLHLGHLAFALPWVDRCLCLYYLCFLRIFF

SEQ ID NO: 22025 - protein, 75 aa, Diabrotica virgifera
  misc_feature: Coding regions on vcDNA: vcDNA=SeqID_1722; Strand=-; Position=191-418
LVSLPETYLLEAALVVDVLDVATFAEIFVLCKRPAVLGVDEGIFTGLLMFCWTSCKGILDFFGNFDLLVESILFQ

SEQ ID NO: 22026 - protein, 260 aa, Diabrotica virgifera
  misc_feature: Coding regions on vcDNA: vcDNA=SeqID_1723; Strand=+; Position=61-843
  misc_feature: Homolog annotation: Hit_ID=NP_650744.1; Match level="QueryCoverage =75%, HitCoverage=79%, E-value=4e-17, Identity=31%"; Hit description =CG7709-PA [Drosophila melanogaster] gb|AAF55584.1| CG7709-PA [Drosophila melanogaster]
  misc_feature: Gene Ontology Annotation: Molecular function=RNA binding; Cellular component=nucleus; Biological process=mRNA processing
MKSQQISVAIICMFITWQQVAAVVNNNPLKVEKQNESSAETTDANKSSSTIEVVDSVAEASEESGNRREASLGDKYGVPLPGGVPGDSYLPVEPSNPNLPIPVYGVPDGSANNVVYPAPPPDIPPTIALPSLGFGLSPLGNTYGPPKVNFLPPSNSYGPPNNNFIPPGPPISTYGPPSVSHGPINNNFGPPINTFGPPRPSFGPGRPKPQYGPPRFQYGPPGKPIPSNVKFGFKPPYKNFGGPKYPSKPVWYLWTTRRIL

SEQ ID NO: 22027 - protein, 31 aa, Diabrotica virgifera
  misc_feature: Coding regions on vcDNA: vcDNA=SeqID_1724; Strand=-; Position=337-432
GYLFFFFFFFFFFFFFFFFFFFFFFRIQILF

SEQ ID NO: 22028 - protein, 210 aa, Diabrotica virgifera
  misc_feature: Coding regions on vcDNA: vcDNA=SeqID_1725; Strand=+; Position=3-634
  misc_feature: Homolog annotation: Hit_ID=AAP94046.1; Match level="QueryCoverage =100%, HitCoverage=62%, E-value=1e-100, Identity=81%"; Hit description=cathepsin-L-like cysteine peptidase 02 [Tenebrio molitor]
  misc_feature: Gene Ontology Annotation: Molecular function=cathepsin S activity; Cellular component=extracellular space; Biological process =proteolysis and peptidolysis
  misc_feature: Pfam annotation: Pfam_ID=Peptidase_C1; Match level="Score=415.9, E -value=4.8e-122, Copies=1"; Pfam description=Papain family cysteine protease
  misc_feature (13)..(13): Xaa can be any naturally occurring amino acid
RPKGAVTAVSGRXGCGSCWSFSATGSLEGQHYRKTGKLVSLSEQNLVDCSTKFGNNGCNGGLMDNAFRYIKANGGIDTEASYKYKAEDEKCHFNPKKVGATDKGFVDIESGSEDALKAAVATVGPVSVAIDASHETFQLYNQGVYYEPECSSEELDHGVLVVGYGTEDDQDYWLVKNSWGPSWGLDGYIKMARNRNNSCGIATQASYPLV

SEQ ID NO: 22029 - protein, 343 aa, Diabrotica virgifera
  misc_feature: Coding regions on vcDNA: vcDNA=SeqID_1726; Strand=+; Position=124-1155
  misc_feature: Homolog annotation: Hit_ID=AAP94046.1; Match level="QueryCoverage =98%, HitCoverage=99%, E-value=1e-144, Identity=73%"; Hit description= cathepsin-L-like cysteine peptidase 02 [Tenebrio molitor]
  misc_feature: Gene Ontology Annotation: Molecular function=cathepsin S activity; Cellular component=extracellular space; Biological process =proteolysis and peptidolysis
  misc_feature: Pfam annotation: Pfam_ID=Peptidase_C1; Match level="Score=386.7, E -value=3.1e-113, Copies=1"; Pfam description=Papain family cysteine protease
MKFLLLFVAFFVGCQAISFVDLVQEEWTAFKMTHRKSYESPTEEKFRMKIFMENKHKVAKHNKLFALGLVSYKLGLNKYADMLHHEFIDTLNGFNKTKNLLRQSELEDSVTFIKPANVELPSEVDWRPKGAVTAVKDQGHCGSCWSFSATGSLEGQHYRKTGKLVSLSEQNLVDCSTKFGNNGCNGGLMDNAFRYIKANGGIDTEASYKYKAEDEKCHFNPKKVGATDKGFVDIESGSEDALKAAVATVGPVSVAIDASHETFQLYNQGVYYEPECSSEELDHGVLVVGYGTENDQDYWLVKNSCGPSLLGTRRTSNKKPQKNRSNFPGGIATQASYPYTSNL

SEQ ID NO: 22030 - protein, 258 aa, Diabrotica virgifera
  misc_feature: Coding regions on vcDNA: vcDNA=SeqID_1727; Strand=+; Position=92-865
  misc_feature: Homolog annotation: Hit_ID=NP_651079.2; Match level="QueryCoverage =93%, HitCoverage=27%, E-value=3e-37, Identity=39%"; Hit description =CG4917-PA, isoform A [Drosophila melanogaster] gb|AAN13917.2| CG4917- PA, isoform A [Drosophila
  misc_feature: Gene Ontology Annotation: Molecular function=protein prenyltransferase activity; Cellular component=integral to membrane; Biological process=protein amino acid prenylation
  misc_feature (150)..(150): Xaa can be any naturally occurring amino acid
  misc_feature (172)..(172): Xaa can be any naturally occurring amino acid
  misc_feature (188)..(188): Xaa can be any naturally occurring amino acid
  misc_feature (225)..(225): Xaa can be any naturally occurring amino acid
MAGVVPKKSASGRKQWTLRDNSQYSLKRLRSQLASDGCPESQVVLAKQLLDEECEVEPDKKENACLGVYWLIKASKQGNIEATNLLKACLQSGKGITEHNYMDVKSCINMTQDEKLARKAAREMFASLSNGGEYITSYQLKRKMLAIDRXKRAQNLQKLMTSTEDNWGLGKXPNEYEEFSSESEKETXLVTKDPIVPMKKLTQDHLLAAAVDYSHGQLPGSESPXLWLSNPDPKALDHIPYVHRAILTSLVGFLNNSF

SEQ ID NO: 22031 - protein, 255 aa, Diabrotica virgifera
  misc_feature: Coding regions on vcDNA: vcDNA=SeqID_1728; Strand=+; Position=70-838
  misc_feature: Homolog annotation: Hit_ID=NP_573228.1; Match level="QueryCoverage =88%, HitCoverage=92%, E-value=3e-96, Identity=74%"; Hit description =CG5703-PA [Drosophila melanogaster] gb|AAF48745.1| CG5703-PA [Drosophila melanogaster]
  misc_feature: Gene Ontology Annotation: Molecular function=NADH dehydrogenase activity; Cellular component=respiratory chain complex I (sensu Eukarya); Biological process=electron transport
  misc_feature: Pfam annotation: Pfam_ID=Complex1_24kDa; Match level="Score=335.7, E -value=6.7e-98, Copies=1"; Pfam description=Respiratory-chain NADH dehydrogenase
  misc_feature (222)..(222): Xaa can be any naturally occurring amino acid
MLKLFKEISSSLGKSLTKRGLQTTSTLQHDSLFVHRDTPEDNPDIVFEFTPENKKRAEAILAIYPEGHKRAAMIPLLDLAQRQYGWLPISAMHKVAEILNLPRMRVYEVATFYTMFMRKPTGKYHVQICTTTPCWLRGSDEILEAIKKNLKLEVGETSKDMLWTLSEVECLGACVNAPMVQINDDYYEDLTVEATNEILDELKSGGKPAPGPRSGRFAAEPXGEPTSLKAEPPGPGVGVRANLEIYFIYINKHDS

SEQ ID NO: 22032 - protein, 150 aa, Diabrotica virgifera
  misc_feature: Coding regions on vcDNA: vcDNA=SeqID_1729; Strand=+; Position=69-521
  misc_feature: Homolog annotation: Hit_ID=XP_393544.1; Match level="QueryCoverage =99%, HitCoverage=98%, E-value=2e-59, Identity=71%"; Hit description =similar to putative MLC1 protein [Apis mellifera]
  misc_feature: Gene Ontology Annotation: Molecular function=muscle motor activity; Cellular component=muscle myosin; Biological process=muscle contraction
  misc_feature: Pfam annotation: Pfam_ID=efhand; Match level="Score=22.6, E-value =0.0012, Copies=2"; Pfam description=EF hand
MSDLSARDVERANFVFSIYDFEGNGTVDAVNLGDMLRALNLNPTLVTIEKVGGTKKKNEKKLKLDEFLPIFSQVKKDKEQGNFDDFLECLKLYDKEENGKMMAAELSHTLLSLGERLADAETEQVLADCMDKEDDDGFIPYEPFLKKLMA

SEQ ID NO: 22033 - protein, 145 aa, Diabrotica virgifera
  misc_feature: Coding regions on vcDNA: vcDNA=SeqID_1730; Strand=+; Position=447-884
LKMADHLIMPPGTQARLVCEWPHLNLGDLVTIIRYDPTQGYFVRTSSSLEEFWIPAHVLANYSRKLWSFRLKKPRKSLEGILSENSDRCVPEFRDRLKDITVQSGSKVVFKCRVKNWNRNTRQTWKKMEPNVVVLHNGKFVQGDK

SEQ ID NO: 22034 - protein, 311 aa, Diabrotica virgifera
  misc_feature: Coding regions on vcDNA: vcDNA=SeqID_1731; Strand=+; Position=132-1064
  misc_feature: Homolog annotation: Hit_ID=NP_504775.1; Match level="QueryCoverage =96%, HitCoverage=94%, E-value=4e-33, Identity=28%"; Hit description =putative protein, with 4 coiled coil-4 domains (5H491) [Caenorhabditis elegans] gb|AAC25848.1|
  misc_feature: Gene Ontology Annotation: Molecular function=translation initiation factor activity; Cellular component=cytoskeleton; Biological process= embryogenesis and morphogenesis
  misc_feature (250)..(250): Xaa can be any naturally occurring amino acid
MGKSKKIRKGGDESESDNENSTQEVIDKAKTKKTKPAKSQSTSDETKEEKADAKKAKGKKEKKQVDSEGSDTEVVSKVKKSFALLQIDDEDSDDNSKPAVEDDDDESETKPAKKDSKKKSSDERTTKNQGGKKGKKNRKRDDSDEDIEKVLAELEMEYAGIKKEPEPSNEEKPVEKVKEKKKDKIDEPKGEAAEEDSKQEETSTVKTAAQKKKEKKEREKQKKLAQKKQDVPKEGSEEPAEHQEQSKPEXAENKPEAKDKDDKQEDDEQDGDKKSKKKKKKGKEDDEKDAKDAKDAKKGPGKKAIAAMQEA

SEQ ID NO: 22035 - protein, 38 aa, Diabrotica virgifera
  misc_feature: Coding regions on vcDNA: vcDNA=SeqID_1732; Strand=-; Position=43-159
IYFVYLSTNDNIYIILKCACVLLLICRRLDADRHRERT

SEQ ID NO: 22036 - protein, 428 aa, Diabrotica virgifera
  misc_feature: Coding regions on vcDNA: vcDNA=SeqID_1733; Strand=+; Position=108-1390
  misc_feature: Homolog annotation: Hit_ID=NP_722636.1; Match level="QueryCoverage =82%, HitCoverage=80%, E-value=8e-49, Identity=35%"; Hit description =CG4427-PA, isoform A [Drosophila melanogaster] gb|AAF51489.2| CG4427- PA, isoform A [Drosophila
  misc_feature: Gene Ontology Annotation: Molecular function=transcription factor activity; Cellular component=nucleus; Biological process=cell-cell signaling
  misc_feature: Pfam annotation: Pfam_ID=zf-C2H2; Match level="Score=66.9, E-value =5.6e-17, Copies=2"; Pfam description=Zinc finger, C2H2 type
  misc_feature (341)..(341): Xaa can be any naturally occurring amino acid
  misc_feature (349)..(349): Xaa can be any naturally occurring amino acid
MLIHEKMSQGIISPPSTPPLKNISDDEHMQQSTILQLRNFLGQKRTIQTSGLLTPQPSDSEPEEHDIPLKKRYRISNLEIPYPPPTITPPKSPSKTPPLYPPPTPCPIPLIKSTSPIFPKPNVVPQQTYAPVQIFFPPSPPVAPVAKPQPTPTRSVSVIMKANKTGICTSLPIPQLKEKGEENLLKSLKFKMGKNKERVKSCEKDVSREEKEEAKPEPVVTQKISLPILAPKLISPATPNTIFISADGTVLPTQFVLITHTPPATVPTRRRVYECKYEGCGKNYFKSSHLKAHNRIHTGEKPFVCQWADCGRRFSRSDELSRHKRTHTGEKKFKCSHCQKXKFMRSDHXLAQNVKRHTKERLNTPKVNGMPVLRPNSPAPKLSNFDKEANFLHNLRIFFWEVIYRNLYIFPDVGKCWDNGSISFETSL

SEQ ID NO: 22037 - protein, 314 aa, Diabrotica virgifera
  misc_feature: Coding regions on vcDNA: vcDNA=SeqID_1734; Strand=+; Position=86-1027
  misc_feature: Homolog annotation: Hit_ID=AAV91006.1; Match level="QueryCoverage =82%, HitCoverage=68%, E-value=6e-63, Identity=48%"; Hit description =hemolymph proteinase 8 [Manduca sexta]
  misc_feature: Gene Ontology Annotation: Molecular function=serine-type endopeptidase activity; Cellular component=extracellular; Biological process=Tl signaling pathway
  misc_feature: Pfam annotation: Pfam_ID=Trypsin; Match level="Score=43.3, E-value =6.9e-10, Copies=1"; Pfam description=Trypsin
  misc_feature (310)..(310): Xaa can be any naturally occurring amino acid
MKDCDFCSCCDIKMRRSFGLLLVFLGLWTLCIAQTEYCMTPRQEGGDCKIITQCPSLFKILKNRPIRSEDADYLRKSQCGFEGTLPKVCCALQETVQTTTQRQVDYDTPKPADSPLLPSKEDCGIGSIPDKIYGGNTTDLDEFPWMALLDYEKDNGNHGFYCGGVLINSRYILTAAHCVKGKDLPRNWKLVGVRLGEYNLETDTDCVQTVSGQKCAPPPVNVAVEEQIAHEQYKPYDQNQYHDIALLRLARNVKITGFVRPICLPKTADDQSKNYTGKKLTVAGWGKTETRSESNIKLKLDVPVKANTEXVRTY

SEQ ID NO: 22038 - protein, 137 aa, Diabrotica virgifera
  misc_feature: Coding regions on vcDNA: vcDNA=SeqID_1735; Strand=+; Position=1-411
  misc_feature: Homolog annotation: Hit_ID=XP_393785.1; Match level="QueryCoverage =78%, HitCoverage=4%, E-value=1e-40, Identity=72%"; Hit description =similar to zinc-finger homeodomain protein 4 [Apis mellifera]
  misc_feature: Gene Ontology Annotation: Molecular function=RNA polymerase II transcription factor activity, enhancer binding; Cellular component =nucleus; Biological process=neurogenesis
  misc_feature: Pfam annotation: Pfam_ID=Homeobox; Match level="Score=11.6, E-value =8.4e-05, Copies=1"; Pfam description=Homeobox domain
RADPRVKKILRAHFDINNSPSEDQIHEMASQSGLPPKVIKHWFRNTLFKERQRNKDSPYNFNNPPSTTLNLEEYEKTGEAKVMPLNSSGSSIEENKSKESPKLSQEIKHELKEEPVDDFPKLNEEKIQEPIDEKPNI

SEQ ID NO: 22039 - protein, 215 aa, Diabrotica virgifera
  misc_feature: Coding regions on vcDNA: vcDNA=SeqID_1736; Strand=+; Position=323-966
  misc_feature: Homolog annotation: Hit_ID=NP_523829.2; Match level="QueryCoverage =93%, HitCoverage=39%, E-value=5e-64, Identity=59%"; Hit description =CG4084-PA [Drosophila melanogaster] gb|AAF47050.1| CG4084-PA [Drosophila melanogaster]
  misc_feature: Gene Ontology Annotation: Molecular function=alpha-13 -mannosyltransferase activity; Cellular component=integral to endoplasmic reticulum membrane; Biological process=protein amino acid glycosylation
  misc_feature: Pfam annotation: Pfam_ID=ALG3; Match level="Score=88.5, E-value=1.8e -23, Copies=1"; Pfam description=ALG3 protein
  misc_feature (175)..(175): Xaa can be any naturally occurring amino acid
MAPLKKYQNYRKYLEKDYIMKLIFDPHYLWPVCIVLLIFEFLLNLMIIHRVKYTEIDWIAYMQEVEGFLNGTLDYKELKGDTGPLVYPAGFVYIYTLFYYVTSKGTNILLAQYIFLFLYLLQTYLIQRIFRKTMKIPPYALVIATLTSYRIHSIFVLRLFNDPIAVLLFYISLNXFMDDRWKLGSIFYSLAVSVKMNIFAACSMPSLTYLENLTN

SEQ ID NO: 22040 - protein, 180 aa, Diabrotica virgifera
  misc_feature: Coding regions on vcDNA: vcDNA=SeqID_1737; Strand=+; Position=636-1175
  misc_feature: Homolog annotation: Hit_ID=XP_307144.1; Match level="QueryCoverage =95%, HitCoverage=48%, E-value=6e-31, Identity=41%"; Hit description =ENSANGP00000024852 [Anopheles gambiae]
  misc_feature (168)..(168): Xaa can be any naturally occurring amino acid
YFVAIYIWGDPLSPLLFNLALEYVMRKMYPKLKPDITARGAKIILAFADDVDAVAQSTLEIKDIFSSSEEAALNIGLKINENKTKYMVVSKQERRRIRQNITINDHNFEVVKEFKYLGATITNDNKLEREVETRIMAGNRSFFAMKHLMKSKLLSRGGKIQIYKTIIXPAVAYGNETWTL

SEQ ID NO: 22041 - protein, 145 aa, Diabrotica virgifera
  misc_feature: Coding regions on vcDNA: vcDNA=SeqID_1738; Strand=-; Position=90-527
  misc_feature: Homolog annotation: Hit_ID=CAD22154.1; Match level="QueryCoverage =75%, HitCoverage=50%, E-value=4e-36, Identity=60%"; Hit description =pherophorin-dz1 protein [Volvox carteri f. nagariensis]
  misc_feature: Gene Ontology Annotation: Molecular function=protein binding; Cellular component=cytoplasm; Biological process=response to pathogenic bacteria
  misc_feature (61)..(61): Xaa can be any naturally occurring amino acid
  misc_feature (69)..(69): Xaa can be any naturally occurring amino acid
  misc_feature (71)..(71): Xaa can be any naturally occurring amino acid
  misc_feature (78)..(79): Xaa can be any naturally occurring amino acid
  misc_feature (89)..(89): Xaa can be any naturally occurring amino acid
  misc_feature (105)..(105): Xaa can be any naturally occurring amino acid
  misc_feature (113)..(114): Xaa can be any naturally occurring amino acid
  misc_feature (130)..(130): Xaa can be any naturally occurring amino acid
MHSICIAYRCGSTQPLFMLKYGIFAGYAAASRPYPPCPPAPPPPPWYPPAPPWYPPPLPPXYPPPEPPXSXPPPDPPXXPPPAPPWPPXYPPPEPPWYPPPEPPXYPPPDPPXXPPPLPPPVPGATAPGXPPGPPPPALPRPGGR

SEQ ID NO: 22042 - protein, 192 aa, Diabrotica virgifera
  misc_feature: Coding regions on vcDNA: vcDNA=SeqID_1739; Strand=+; Position=203-877
  misc_feature: Homolog annotation: Hit_ID=AAK07681.1; Match level="QueryCoverage =92%, HitCoverage=36%, E-value=2e-12, Identity=30%"; Hit description =leucine-rich repeat/extensin 1 [Arabidopsis thaliana] gb|AAC17609.1| Strong similarity to extensin-like pr
  misc_feature (156)..(156): Xaa can be any naturally occurring amino acid
  misc_feature (164)..(164): Xaa can be any naturally occurring amino acid
  misc_feature (172)..(173): Xaa can be any naturally occurring amino acid
MNDTELASIPPPPGTIDNPPLPPEPPSSPPPPPPATEHPQTPNMFLPNQNWANYNNYMNYYQQYAQFYPYLFMSSPYQSYNQFNKKDESVQPPLPPGSPNPPLPSPMSHNIRSPLLNSPKQFGHIRNKNNQNNAVNNQNLNMNNTPPLPPPELSLXQPAPPPPXTSPESPLXXMPVDVNPPLPPSESGLYGT

SEQ ID NO: 22043 - protein, 296 aa, Diabrotica virgifera
  misc_feature: Coding regions on vcDNA: vcDNA=SeqID_1740; Strand=+; Position=115-1005
  misc_feature: Homolog annotation: Hit_ID=EAL28962.1; Match level="QueryCoverage =90%, HitCoverage=49%, E-value=2e-33, Identity=31%"; Hit description =GA20833-PA [Drosophila pseudoobscura]
  misc_feature: Gene Ontology Annotation: Molecular function=acyltransferase activity; Cellular component=integral to membrane; Biological process=cholesterol metabolism
MYHRGKEKETGNKETDVPNQKPKQNVNHKPKLPEKIFEVRKSILTELYEDNIHTRAIINFIIGFSVFNMVTLILKDYVYYGRLSSAFILIFNQFAKLPVTFLIWILLNLLIFACYYVYLLWGKLRRKVPNTWFWDRIWLVVFIGYIMIMFYATTILVIHLELQFATRLLILSESTRLLMKLYSFVRSNVPRVTNTRSSNDYVHIPTFGKYLYFLYAPTLIYRDEYPRTGHIRWSFVFYRLLEVFGIIVALAFLAENIENMIFMDTCKQPITVPQFLVLILAGKFNFHRNVLYTMGG

SEQ ID NO: 22044 - protein, 501 aa, Diabrotica virgifera
  misc_feature: Coding regions on vcDNA: vcDNA=SeqID_1741; Strand=+; Position=2-1504
  misc_feature: Homolog annotation: Hit_ID=NP_652026.2; Match level="QueryCoverage =84%, HitCoverage=74%, E-value=0.0, Identity=49%"; Hit description =CG9432-PA, isoform A [Drosophila melanogaster] gb|AAM70821.2| CG9432- PA, isoform A [Drosophila
  misc_feature: Gene Ontology Annotation: Molecular function=protein disulfide isomerase activity; Cellular component=sarcoplasmic reticulum; Biological process=regulation of muscle contraction
  misc_feature: Pfam annotation: Pfam_ID=Thioredoxin; Match level="Score=-10.4, E -value=0.00016, Copies=1"; Pfam description=Thioredoxin
TDEMMELLINSEKYLAVLFYDKDDKQDIRVLNELENIDDDLEKEGITMIRIDNDAEAKEFGIDHLPTLIYFEDKIPSLYEGDLMNEDEVLKWLIEQKQTATIEEVTDEILEDLIQEHEYVVVYFSGNCEEGQECDNILKELENIDDELDETGIIFVTTEDLVIAKKYNIKTYPKLVFFRNKEPLVYTGDIEDEDEVLAWLTDEDTLEIPDRIEEVNSKMLDKILGENEHVVVYFYKEGDKRSQKILQELENIDDECEDKDIDFVKISDDGIQKEYDLPSLPAVVFYRNRFREIYTGDLMHEEAILDWVLNLRDSDPDVIENVDRKTLQVLINDVEHLAVLFYSDDCEDCKQILEELETIDDDTDKHNIQFVKSMDAKLASEIGIFSFPALVYYETGVPIMYDGDLLNEDKVLEWLVDQKSDDHDDDDDDDDDDDDDDDEDDDDDDDNTLMKMMTTTMMNMTMMTTVTMMMMMITATSSSQQKEHEEDSPPLTASSTASHPI

SEQ ID NO: 22045 - protein, 189 aa, Diabrotica virgifera
  misc_feature: Coding regions on vcDNA: vcDNA=SeqID_1742; Strand=+; Position=75-644
  misc_feature: Homolog annotation: Hit_ID=XP_393576.1; Match level="QueryCoverage =98%, HitCoverage=94%, E-value=2e-26, Identity=41%"; Hit description =similar to ENSANGP00000018891 [Apis mellifera]
  misc_feature: Gene Ontology Annotation: Molecular function=chaperone activity; Cellular component=cytosol; Biological process=protein folding
  misc_feature: Pfam annotation: Pfam_ID=HSP20; Match level="Score=121.2, E-value =2.4e-33, Copies=1"; Pfam description=Hsp20/alpha crystallin family
MPFIPVVFRENQWAPHCPRRQVAVPNRNFVEDITHDVLNSIALAQALFGPEQDRGDTEVIRQNSKLLNQSRSSVTIDEHKFQANFDVQHFKPEEITVKVNGDRSITIEAEHEEKQDEHGGIYRHFVRKYKLPENCDIEKVDSKLSSDGVLSITAPTIGQKSSSHRTIPIIQTGKPIKPAEKPQVEQKSA

SEQ ID NO: 22046 - protein, 61 aa, Diabrotica virgifera
  misc_feature: Coding regions on vcDNA: vcDNA=SeqID_1743; Strand=-; Position=442-627
IKRRVKPPEYRNQSPKKVFDQQIRIASHLERTTNLISFSDNIKIHVHFVRKRLANTSFKNE

SEQ ID NO: 22047 - protein, 126 aa, Diabrotica virgifera
  misc_feature: Coding regions on vcDNA: vcDNA=SeqID_1744; Strand=+; Position=36-416
  misc_feature: Homolog annotation: Hit_ID=AAF42866.1; Match level="QueryCoverage =66%, HitCoverage=8%, E-value=2e-19, Identity=53%"; Hit description =staufen [Musca domestica]
  misc_feature: Gene Ontology Annotation: Molecular function=intracellular transporter activity; Cellular component=microtubule associated complex
  misc_feature: Pfam annotation: Pfam_ID=dsrm; Match level="Score=7.4, E-value=0.039, Copies=1"; Pfam description=Double-stranded RNA binding motif
MDKPVQQPPTQIKPPSTIQGVRSKDKLLYLAQLMNIQVQFSDFPKANHEMYLTLVSLSTNPPQVCHGEGPTTEASHEKAALEALKALSELGLDIAPKDGSGGPNGNENASPVVSNKGPVHQNGVKN

SEQ ID NO: 22048 - protein, 549 aa, Diabrotica virgifera
  misc_feature: Coding regions on vcDNA: vcDNA=SeqID_1745; Strand=+; Position=103-1752
  misc_feature: Homolog annotation: Hit_ID=XP_308394.1; Match level="QueryCoverage =87%, HitCoverage=53%, E-value=8e-87, Identity=40%"; Hit description =ENSANGP00000019093 [Anopheles gambiae]
  misc_feature: Gene Ontology Annotation: Molecular function=intracellular transporter activity; Cellular component=microtubule associated complex; Biological process=regulation of transcription from Pol II promoter
  misc_feature: Pfam annotation: Pfam_ID=dsrm; Match level="Score=172.1, E-value=1.2e- 48, Copies=4"; Pfam description=Double-stranded RNA binding motif
MKRGERTVYVVENGGAPPHQNYVTQPGYYPRHNLYNAQTQPQRYTYDARRNIRGHYPYHENRYYGQFRPGAPHNPGDPYTVRLRVGEREYPGQGYTVQAARHDAASKAIEHIKQLGTSDQSDGDISPDVTQQISNDSAQGSLSDINSDLKSPISLVYEIALKRNLNVHFEVLSEKGPPHMKVFITQCCVGSFIAEGEGNGKKISKKRAAEKMLEQLSKLPPLPNVTNIAQLKKKRVTNKKKTRNLIKVNTDRSTEVVEEINPISRLIQIQQANKEREPVYTVLEERGAPRRREFVIEASVAGHSCTGVGPNKKVAKRNAAEALLIDLGYSNTNINNVKPIAKDKEEGVAPNIHPNMDKNRKVTFVEEVPEVQPTQSVGGSGGRQLVPGILLVTEQSGFPKPKDTMDKPVQQPPTQIKPPSTIQGVRSKDKLLYLAQLMNIQVQFSDFPKANHEMYLTLVSLSTNPPPVCHGEGPTTEASHEKAALEALKALSELGLDIAPKDGSGGPNGNENASPVVARQGAGNPPKKEKKNLNFCVGLVPNGPLPFCP

SEQ ID NO: 22049 - protein, 268 aa, Diabrotica virgifera
  misc_feature: Coding regions on vcDNA: vcDNA=SeqID_1746; Strand=+; Position=134-935
  misc_feature: Homolog annotation: Hit_ID=NP_648174.3; Match level="QueryCoverage =99%, HitCoverage=41%, E-value=5e-36, Identity=35%"; Hit description =CG7927-PA [Drosophila melanogaster] gb|AAF50489.3| CG7927-PA [Drosophila melanogaster]
  misc_feature: Gene Ontology Annotation: Cellular component=nucleus
  misc_feature (143)..(143): Xaa can be any naturally occurring amino acid
  misc_feature (257)..(257): Xaa can be any naturally occurring amino acid
MSSRVLRKLQGDKEKELAEEISDTETDTPVSGGARRKQLNINRYDLLNQQSHSESEVKEDDNETEAAKSCEGEHHEIKRKKKKKKKKSGKHTNTQRSSEDNADVDEVEKSLREVNKILGENYASKASTVPNVKHEKVNFKKKXLSVQHKHLNPNNELKRIFGSKIVQCDHKRKNRGRGHVKQTTMVNCKENYPNAGKIRSFDVISREQKHIHYFTYEHSQSYRQVQNKFLDAVESLNPDNIIGILNEHQYHVDALIXLSDVCELSEHL

SEQ ID NO: 22050 - protein, 189 aa, Diabrotica virgifera
  misc_feature: Coding regions on vcDNA: vcDNA=SeqID_1747; Strand=+; Position=37-606
  misc_feature: Homolog annotation: Hit_ID=NP_609157.3; Match level="QueryCoverage =97%, HitCoverage=96%, E-value=2e-65, Identity=65%"; Hit description =CG14534-PA [Drosophila melanogaster] gb|AAF52571.2| CG14534-PA [Drosophila melanogaster]
  misc_feature: Gene Ontology Annotation: Molecular function=molecular_function unknown
  misc_feature: Pfam annotation: Pfam_ID=DUF243; Match level="Score=147.8, E-value =2.5e-41, Copies=1"; Pfam description=Domain of unknown function (DUF243)
MIVLVAILSLVAVSSARPEAGYSYSAPSAPSAPGGGYPSGPSAPAPQYGAPAAGPIVQKHVYVHVPPPETDIPAPRKPITVAPPQKHYKIIFIKAPTPPTPTAPIIPAQPQNEEKTLVYVLVKKPEPEPEIVIPTPAPTQPSKPEVYFIRYKTQKEEGGYAPSGTPDSSYGAPPAGGPPSSEYGAPRSF

SEQ ID NO: 22051 - protein, 77 aa, Diabrotica virgifera
  misc_feature: Coding regions on vcDNA: vcDNA=SeqID_1748; Strand=+; Position=129-362
KEIFYILRRKQEFEIPNYDDMQFLRGTHVLHIQNSFRQFSTSTREKVYNARKLIGFANQDIYEVIADVRNYENFLPF

SEQ ID NO: 22052 - protein, 81 aa, Diabrotica virgifera
  misc_feature: Coding regions on vcDNA: vcDNA=SeqID_1749; Strand=-; Position=65-310
KAHRYLLFRSYSCLIGGQYFLLLQPFMYQMLMTRFCKLDVLQKRFRLLLSVSIPKVSYFINYIYIYFHLCFKLCVISLFSK

SEQ ID NO: 22053 - protein, 287 aa, Diabrotica virgifera
  misc_feature: Coding regions on vcDNA: vcDNA=SeqID_1750; Strand=+; Position=18-878
MIYFSKPFLKSRKFFLIVTGVVVGIVLLIIIIVAASETHTGTKSSNVEDHTDEPNDPSGPCEINQIQYRNTHPLLLSPKTDNVIYPQGKANTIFASNEEVEFSCSQSEVRANGVNLGSNITVVCKSNETFTYNGTNIEWKNVACSKTLVPTIKEVPVQNLSSDDPNKPCDIGDDSTIFLNLGYTVDLNRFINIVNICFNTTNKIALYSHYILTSVTIFGSRNVTRSNIRQEDSLYKLGYSVKTVYDDSKKTMNNLLGLPDDSDNILTTRYLLLRNNLFLKMIFILTT

SEQ ID NO: 22054 - protein, 222 aa, Diabrotica virgifera
  misc_feature: Coding regions on vcDNA: vcDNA=SeqID_1751; Strand=+; Position=67-735
  misc_feature: Homolog annotation: Hit_ID=CAA78762.1; Match level="QueryCoverage =88%, HitCoverage=80%, E-value=1e-24, Identity=41%"; Hit description =glycine-rich_protein_(aa1-291) [Brassica napus] pir||S31415 glycine -rich protein GRP22 - rape
  misc_feature: Gene Ontology Annotation: Molecular function=structural molecule activity; Cellular component=intermediate filament; Biological process=epidermal differentiation
SHTHTMASRFLIASFLVLTLLGLCLAGGHGGGEHKRVIIHVPFKVKHIHHTHTVVKHVGHEGGGGGGGEEYKVIGYSGGIDDGEVVAHGGGGGGDFGGHGHGWEGGIGGGSIGGGHGIEIGHAGGQEGGIGGGHGYGHALESQGSALGGHGASLSALGGHGAGLSDGGIDYSASSHGLGSYGGGGFDQNSISQDGGHDFSGGLGAEGGGYESAGSEGHGGYE

SEQ ID NO: 22055 - protein, 334 aa, Diabrotica virgifera
  misc_feature: Coding regions on vcDNA: vcDNA=SeqID_1752; Strand=+; Position=1-1002
  misc_feature: Homolog annotation: Hit_ID=EAL25657.1; Match level="QueryCoverage =98%, HitCoverage=88%, E-value=1e-91, Identity=49%"; Hit description =GA18906-PA [Drosophila pseudoobscura]
  misc_feature: Gene Ontology Annotation: Molecular function=peptidylamidoglycolate lyase activity; Cellular component=integral to plasma membrane; Biological process=peptide metabolism
  misc_feature: Pfam annotation: Pfam_ID=NHL; Match level="Score=106.5, E-value=6.9e -29, Copies=3"; Pfam description=NHL repeat
MVTSIVSAVSVLGLLVLRLSALPFEEDGQRDTKALYDEVRQLLQLNQGYLQDAPQSEEQTTVADISEKPDVPKVVQNWPEEPLKLGQVSGVSVNSALQPVIFHRVDRVWDETTFNETHHYQQTHLGPIREHTVLTLDPQTGKVLGRWGADFFYMPHGLTIDRHDNIWVTDVALHQVFKFKPGELQPSQTFGQRLEPGADKRHFCKPTSTAIASTGEIFIADGYCNSRILKYNAAGVLLRIFPTAPEILSLQVPHGLALIESLDRICVADRENMRVVCPRAGLYTLQGKKEPPLTITLPDMGRVFGVSAKGKLVYAVNGPTSTLPVQGMTIDPQT

SEQ ID NO: 22056 - protein, 137 aa, Diabrotica virgifera
  misc_feature: Coding regions on vcDNA: vcDNA=SeqID_1753; Strand=+; Position=646-1059
  misc_feature: Homolog annotation: Hit_ID=AAH46858.1; Match level="QueryCoverage =91%, HitCoverage=18%, E-value=2e-32, Identity=52%"; Hit description =Loc89944-prov protein [Xenopus laevis]
  misc_feature: Gene Ontology Annotation: Molecular function=beta-galactosidase activity; Cellular component=extracellular space
  misc_feature: Pfam annotation: Pfam_ID=Glyco_hydro_35; Match level="Score=-110.2, E- value=3.6e-09, Copies=1"; Pfam description=Glycosyl hydrolases family 35
NKRNKTKLATANFQHEPEKELTLLKNFQPDKPLMVMEYWTGWFDHWAERHHTRTADNFGEVLDGILNFGASVNFYMFHGGTNWGFLNGANLKNKSVTATDNGSFQPDITSYDYDAPLSEAGDYTDKYYKAQENHRQI

SEQ ID NO: 22057 - protein, 228 aa, Diabrotica virgifera
  misc_feature: Coding regions on vcDNA: vcDNA=SeqID_1754; Strand=+; Position=215-898
  misc_feature: Homolog annotation: Hit_ID=EAL26722.1; Match level="QueryCoverage =96%, HitCoverage=24%, E-value=7e-59, Identity=47%"; Hit description =GA11373-PA [Drosophila pseudoobscura]
  misc_feature: Gene Ontology Annotation: Molecular function=enzyme activator activity; Cellular component=integral to membrane; Biological process=lipid transport
  misc_feature: Pfam annotation: Pfam_ID=SapA; Match level="Score=63.1, E-value=8e -16, Copies=1"; Pfam description=Saposin A-type domain
  misc_feature (177)..(177): Xaa can be any naturally occurring amino acid
  misc_feature (225)..(225): Xaa can be any naturally occurring amino acid
MVKMKILIIVAVFAAFASGVFVPPRPGHKKHLLGADLCTRGPGHWCQNLTTAADCHATKHCIQTVWIHQTLPPDDSSVCQICLDMVKQARDQLESNETQEEIKEVFEGSCALLYIKPIVKECDKLADDYIPDLIDTLASQMNPQVVCSVAGLCNNERVKKLLEEADDEPTTEVMPGXVDKCKGCHQVVDILDNKFNKMSRDEFLHGLLNFCGKFSSFSDGCSNLXITY

SEQ ID NO: 22058 - protein, 802 aa, Diabrotica virgifera
  misc_feature: Coding regions on vcDNA: vcDNA=SeqID_1755; Strand=+; Position=163-2568
  misc_feature: Homolog annotation: Hit_ID=T00207; Match level="QueryCoverage=96%, HitCoverage=81%, E-value=0.0, Identity=43%"; Hit description=P109 protein - silkworm dbj|BAA23126.1| BmP109 [Bombyx mori]
  misc_feature: Gene Ontology Annotation: Molecular function=enzyme activator activity; Cellular component=extracellular space; Biological process= lipid transport
  misc_feature: Pfam annotation: Pfam_ID=SapB_2; Match level="Score=281.2, E-value =1.8e-81, Copies=7"; Pfam description=Saposin-like type B, region 2
MVKMKILIIVAVFAAFASGVFVPPRPGHKKHLLGADLCTRGPGHWCQNLTTAADCHATKHCIQTVWIHQTLPPDDSSVCQICLDMVKQARDQLESNETQEEIKEVFEGSCALLYIKPIVKECDKLADDYIPDLIDTLASQMNPQVVCSVAGLCNNERVKKLLEEADDEPTTEVMPGKVDKCKGCHQVVDILDNKFNKMSRDEFLHGLLNFCGKFSSFSDGCSNLVITYFTEIYNHLQQHLNSEEVCLFSGECSAQFHAHRARVEITPNSHIGYVNVGDDKDDVPCQLCEQLVDHLRNLLVANTTEDEFKRVMEGLCKQTGKFSEECVELIDQYYGEVYTFLVDHLNATEVCDEIGICKASKEKEDLYIAPLLEKNNAEKALEISSERKPEKVDMSALSEVNLEQQLPIDLLMPPHTQILYNKELCAFCEYFLHYVQIALTDPKTETEIKSVIEKACKELPVSVNATCMSFVDMYEPALVALLDQAIDPSQVCPLIKVCPSSKSGIEVFMEAKSDSKCPLCLVAVTKLEEMVSNNKSVAQIKAALEKLCNVLPKSIDNQCEAFVDKYTDHIVDMLLADLTPEEVCVALKLCTDDRKVNSLPPYVVRQIGGNIETNVIPDNTVNGQIVVDIHTGSIGSKPECILCEFVMKEIEDQLNDKSTDAEIETVVKDICKIMPSSVRQDCDKFVDQYADTVIQLLIAALEPSKICSYIKLCAGSQMDMIKVQILECPVCEMTVEVMEKILSNPNVDHDIVHVIEKTCRGLPAKYRPQCIQIVEAYGKEMIDLIVHQGGKTVCRKFGYCKS

SEQ ID NO: 22059 - protein, 141 aa, Diabrotica virgifera
  misc_feature: Coding regions on vcDNA: vcDNA=SeqID_1756; Strand=+; Position=21-443
  misc_feature: Pfam annotation: Pfam_ID=DUF1676; Match level="Score=9.6, E-value =0.0059, Copies=1"; Pfam description=Protein of unknown function (DUF1676)
MKYLVLVSVIFLLSDVRTETTPVYGGLQILTKVFRQYLKSQPDDVKLGDGVHIVSVKSENDARASVDDGTVLGVIEHYLENHELRIRLPELMPGEGFGRAFKTAMEEVDAKDESTGRGKRGKCGGGMGGVMIIGLMMGKLL

SEQ ID NO: 22060 - protein, 97 aa, Diabrotica virgifera
  misc_feature: Coding regions on vcDNA: vcDNA=SeqID_1757; Strand=+; Position=2-295
RKYWLAIAIAINFATAKYTYKLGDTEIDFTATSNGIEIYIRDAEIGSQLYGTIGVGKNASCIDFPRCKVGDNDVAFRFLPGTSLSVISTTNNTQRGA

SEQ ID NO: 22061 - protein, 370 aa, Diabrotica virgifera
  misc_feature: Coding regions on vcDNA: vcDNA=SeqID_1758; Strand=+; Position=71-1180
  misc_feature: Homolog annotation: Hit_ID=AAT38514.1; Match level="QueryCoverage =95%, HitCoverage=70%, E-value=2e-71, Identity=38%"; Hit description =antennae-rich cytochrome P450 [Phyllopertha diversa]
  misc_feature: Gene Ontology Annotation: Molecular function=cytochrome P450 activity; Cellular component=microsome; Biological process=steroid metabolism
  misc_feature: Pfam annotation: Pfam_ID=p450; Match level="Score=-70.6, E-value=4.8e- 08, Copies=1"; Pfam description=Cytochrome P450
MLLTSTWNLSILLIFIALYVLYKYFTRNFNYWEKRGIFYIKPLPFFGNFFDTFTFKSTIAHGLKAIYDQSKGDFVGAFVFDTPVLILRSPKLIEHVLIKDFSFFKDRSLASPKHNPIVANWLLFQGYSDWKKTRPKVTSIFSSGKIKGMFYTAKPIIDDMYAFITNKDVVIEVKDLSRRYSTEVVSRCYFGMGGRCFEKGNSEIQNIATRLFEFSARNAIIQGLHVFKPQWVELFKLDFMIRSDQDYMLDAFMDVVNERKKVKAQDGKAFDYIDIILETQESTNNDNKIGMTEVMSNTLQFFIAGTETMSSVQSFCLYELAIHPEIQDKARKEVNVVVKRHGALTYEAIHDMEYVHFCVLETLRKYVSLQ

SEQ ID NO: 22062 - protein, 137 aa, Diabrotica virgifera
  misc_feature: Coding regions on vcDNA: vcDNA=SeqID_1759; Strand=+; Position=34-445
  misc_feature (20)..(20): Xaa can be any naturally occurring amino acid
  misc_feature (38)..(38): Xaa can be any naturally occurring amino acid
  misc_feature (63)..(63): Xaa can be any naturally occurring amino acid
YCIRLIFMYYFNFFLGLFYXFSIISILIFFVYFMIILXFTFVLPIMLNFIALFLLFLLITYIXYRFILLHSFYTLILLYILYPFFFLYCPCSLLKSTLKGKGAKCRLQKFSMCFKCIHYFRILRGLMGIFEKFERKM

SEQ ID NO: 22063 - protein, 259 aa, Diabrotica virgifera
  misc_feature: Coding regions on vcDNA: vcDNA=SeqID_1760; Strand=+; Position=88-864
  misc_feature: Homolog annotation: Hit_ID=XP_394309.1; Match level="QueryCoverage =92%, HitCoverage=71%, E-value=1e-52, Identity=45%"; Hit description =similar to CG11994-PA [Apis mellifera]
  misc_feature: Pfam annotation: Pfam_ID=A_deaminase; Match level="Score=-49.3, E -value=4.8e-06, Copies=1"; Pfam description=Adenosine/AMP deaminase
MEKRDKKYSISSFCRILPKIELHAHLNGSLNTDILKKLGCNNDAIAEYQLTDIMSKSSRTLEEVFQLFNVAHNATKTKENVYLAAKSVIEDFDKEHTIYLELRTTPRCEEAMSEEEYVETVIKAITDCKKTCKYVLVKLLLSINRRANKESSMKTLDVIIKMKEKYPDIIKGIDLSGNPMVGTFDEDLFEKARQAGLKTAIHCAEVKNDEEVSKILKFGPDRIGHGIFLHPDHGGSRENWDLYCEKKIPLECCLTSNVL

SEQ ID NO: 22064 - protein, 105 aa, Diabrotica virgifera
  misc_feature: Coding regions on vcDNA: vcDNA=SeqID_1761; Strand=-; Position=1081 -1398
SSLKYFSHVSVGIPFVSTIQLLVYIHFNIIFNNFNIIFISILLILPHTVVKKTSIKPSMHRKRGYENKPSSVRNSNKGRHTATKLCSIIISALYFVAKQRSYWIK

SEQ ID NO: 22065 - protein, 127 aa, Diabrotica virgifera
  misc_feature: Coding regions on vcDNA: vcDNA=SeqID_1762; Strand=-; Position=107-490
PWFLLFSVFRGTCGVSRSVLLLVWRPQQFSILLIYRKSIGFEKKIILECYPIIKACKKLSYLNFNCEISSVPMEWFSPMAVRLFVTFCMMMDGFIDGMCVFDGVNVFWDFEYYVMVATMSSAINSKN

SEQ ID NO: 22066 - protein, 72 aa, Diabrotica virgifera
  misc_feature: Coding regions on vcDNA: vcDNA=SeqID_1763; Strand=+; Position=115-333
  misc_feature: Homolog annotation: Hit_ID=AAV73808.1; Match level="QueryCoverage =90%, HitCoverage=87%, E-value=8e-16, Identity=64%"; Hit description =antioxidant enzyme [Gryllotalpa orientalis]
  misc_feature: Pfam annotation: Pfam_ID=HMA; Match level="Score=47.9, E-value=3e-11, Copies=1"; Pfam description=Heavy-metal-associated domain
MSKVHEFNVKMTCDGCSGAVERVLNKLKDKGVEDFTINLETQKVTVKSSLPANDILEVIKKTGKETTLLSSS

SEQ ID NO: 22067 - protein, 151 aa, Diabrotica virgifera
  misc_feature: Coding regions on vcDNA: vcDNA=SeqID_1764; Strand=+; Position=69-524
  misc_feature: Homolog annotation: Hit_ID=EAL29527.1; Match level="QueryCoverage =67%, HitCoverage=17%, E-value=1e-13, Identity=36%"; Hit description =GA16733-PA [Drosophila pseudoobscura]
MSSLLKHSRVNRNKRQHSKKDKKLIKLIKSKSESEDEGSEHELSFYLNDRVKLMKEVLKIIKPRKIKSMAPDCMKSMDNEEINSMLLEELLGISNKRLKYIFNGQNLNEESSSTDPEDQPDDIISLDDISDDDLEIIELDQDSEMKKGKKT

SEQ ID NO: 22068 - protein, 70 aa, Diabrotica virgifera
  misc_feature: Coding regions on vcDNA: vcDNA=SeqID_1765; Strand=+; Position=58-270
MANHSLLCVLVLVAALNILAIMGAPQHDHHHVNDHHDHHDHRHYDNHYLHILDDEHHLYGHYNDCNHHHI

SEQ ID NO: 22069 - protein, 195 aa, Diabrotica virgifera
  misc_feature: Coding regions on vcDNA: vcDNA=SeqID_1766; Strand=-; Position=175-762
YRIRAKQRDTDAVAACAYNKRKFYFNKIKSNIKIIHNILIERTQKCHYMALQQVTLNQNKSPIKFYSPKNAKIPLFTPSSIPKTHHHRFGRKFAHRYPKDRTSSGQKDLNYITTPKKLHAVISDSKVYISPVGIAFDLECRAAQNFIFLIFKGVNSSLNLKSRMNSSVTLAAILILKENLFGSISPPFLTFRQKW

SEQ ID NO: 22070 - protein, 259 aa, Diabrotica virgifera
  misc_feature: Coding regions on vcDNA: vcDNA=SeqID_1767; Strand=+; Position=88-864
  misc_feature: Homolog annotation: Hit_ID=NP_524306.2; Match level="QueryCoverage =99%, HitCoverage=42%, E-value=1e-43, Identity=34%"; Hit description =CG6547-PA [Drosophila melanogaster] gb|AAF54554.2| CG6547-PA [Drosophila melanogaster]
MRKSPVLLRQHIGWHFYKHWVVQGKRKPLDTGAEKILKSKNIPVYDSKDFLIEKREFEKVEVIGFKDQPKPLDETHPEWNEKPLLSYKDHSVLLEGLDQARIITNTVQLQEGLPDSFEIKNLPKEVDKASKDIIFDSHLFDAEQKKLPKIKNPAKPAWNFPRVYGVTQERRNKLITHRLMKLLESINDRQLVKQRYIFEDLLFSFPFQRNGNLIQLELSGDFVLSSEKTLSPITNSATEHLELPNIPPIDPLITLNKEN

SEQ ID NO: 22071 - protein, 292 aa, Diabrotica virgifera
  misc_feature: Coding regions on vcDNA: vcDNA=SeqID_1768; Strand=+; Position=87-961
  misc_feature: Homolog annotation: Hit_ID=XP_397379.1; Match level="QueryCoverage =89%, HitCoverage=43%, E-value=9e-93, Identity=62%"; Hit description =similar to ENSANGP00000011599 [Apis mellifera]
  misc_feature: Gene Ontology Annotation: Molecular function=acetate-CoA ligase activity; Cellular component=cytosol; Biological process=acetyl-CoA biosynthesis
  misc_feature (269)..(269): Xaa can be any naturally occurring amino acid
  misc_feature (271)..(271): Xaa can be any naturally occurring amino acid
  misc_feature (280)..(280): Xaa can be any naturally occurring amino acid
MISTRNQEVVKKKMASRTSVPFPLASYELEFAESIQHPERFWAKVGQYVTWSKPWKRVLDNTYEPFTKWFVGGELNACYNAVDRHVEAGKGDKVALIYDSPLLGIVRKITYFELQEKVSKLGGLLQRLGVSKGDKVIIYMPLIPETIMAMLAVARIGAVHSVVFGGFAANELCIRIQHAEPKVIIAASCGIEPSRVVNYISELNEAIALSSHKPSKCIIYQRKGVEIGDLDPDRDMDWEEAIKNCESAPCIPVDANDPLYILYTSGTTXEXKGIIRPIGXHLCTLVYNLKTL

SEQ ID NO: 22072 - protein, 90 aa, Diabrotica virgifera
  misc_feature: Coding regions on vcDNA: vcDNA=SeqID_1769; Strand=+; Position=3-275
  misc_feature: Homolog annotation: Hit_ID=XP_309797.1; Match level="QueryCoverage =97%, HitCoverage=3%, E-value=3e-22, Identity=54%"; Hit description =ENSANGP00000023406 [Anopheles gambiae]
  misc_feature: Gene Ontology Annotation: Molecular function=microtubule binding; Cellular component=plasma membrane; Biological process=neuromuscular synaptic transmission
GGEPPLSLRKAVANVAQDYKKKKFVFRLKLESGGEFLFQSQNDTEMNTWISKINSHADTESAGPSRSHTLPASGQKEDSKRRSFFTLKKT

SEQ ID NO: 22073 - protein, 91 aa, Diabrotica virgifera
  misc_feature: Coding regions on vcDNA: vcDNA=SeqID_1770; Strand=-; Position=88-363
  misc_feature: Homolog annotation: Hit_ID=NP_498141.1; Match level="QueryCoverage =81%, HitCoverage=29%, E-value=2e-09, Identity=38%"; Hit description =reverse transcriptase family member (3G426) [Caenorhabditis elegans] gb|AAA81063.1|
KTKVKDVSTQVAKLKWKLAGHTLRQKVEGWTKMIIQWRPWNHKRKRGRPQMRWSDDLKKHTGSNWMQIAQYREAWKKEEEAYIQEWMFRAH

SEQ ID NO: 22074 - protein, 260 aa, Diabrotica virgifera
  misc_feature: Coding regions on vcDNA: vcDNA=SeqID_1771; Strand=-; Position=995-1777
  misc_feature: Homolog annotation: Hit_ID=XP_392027.1; Match level="QueryCoverage =98%, HitCoverage=98%, E-value=1e-102, Identity=70%"; Hit description= similar to CG10997-PA [Apis mellifera]
  misc_feature: Gene Ontology Annotation: Molecular function=chloride channel activity; Cellular component=membrane fraction; Biological process =transport
MADEVAENGHAENGDVPEIELIIRASTIDGRRKGACLFCQEYFMELYLLAELKTISLKVTTVDMQKPPPDFRTNFEATPPPILIDRGMAILENEKIERHIMKNVPGGHNLFVQDKEVATLIENLYTKFKTYVRKFESTDTTENRQPLYSHLERINDFMAKRGTRFLTGDTMSCFDCELMPRLQHIRIGAKAFRKFEIPSTFKALWNYMANMYELEAFIQSCPADQDIISHIKNQLGLKTTARIELETPVYTTAIPVLSES

SEQ ID NO: 22075 - protein, 257 aa, Diabrotica virgifera
  misc_feature: Coding regions on vcDNA: vcDNA=SeqID_1772; Strand=+; Position=19-792
  misc_feature: Homolog annotation: Hit_ID=XP_396168.1; Match level="QueryCoverage =74%, HitCoverage=10%, E-value=4e-12, Identity=26%"; Hit description =similar to RE58116p [Apis mellifera]
MKVLICGIICLFAFCGANPVNPSVHDVVSRALERIDYNNIIPKELITRLRFLTEADILGGSEITVFLNQYADTIFNNLQNFIRQHNWQNVDIPDTHLKISGGSVDLTRGNLNDLDTISRGGDVILTYEGDNKKLVIELPITFGDLRFHYHHHTKVLFISMSGEVDGTVKHIQVSAIASFDFNSNTVFLDHYDMKHSGDVTVHFSGNPVVDWLANAISAVVTTFMGQVIINVMAKFIRDNLRAVIENLNEAIAQIINH

SEQ ID NO: 22076 - protein, 248 aa, Diabrotica virgifera
  misc_feature: Coding regions on vcDNA: vcDNA=SeqID_1773; Strand=+; Position=1-747
  misc_feature: Homolog annotation: Hit_ID=XP_396168.1; Match level="QueryCoverage =50%, HitCoverage=7%, E-value=4e-11, Identity=30%"; Hit description =similar to RE58116p [Apis mellifera]
PTRPSLCLFAFCGANPVNPSVHDVVSRALERIDYNNIIPKELITRLRFLTEADILGGSEITVFLNQYADTIFNNLQNFIRQHNWQNVDIPDTHLKISGGSVDLTRGNLNDLDTISRGGDVILTYEGDNKKLVIELPITFGDLRFHYHHHTKVLFISMSGEVDGTVKHIQVSAIASFDFNSNTVFLDHYDMKHSGDVTVHFSGNPVVDWLANAISAVVTTFMGQVIIPRVRTSSKNWRAAAPFFFFFFR

SEQ ID NO: 22077 - protein, 310 aa, Diabrotica virgifera
  misc_feature: Coding regions on vcDNA: vcDNA=SeqID_1774; Strand=+; Position=46-975
  misc_feature: Homolog annotation: Hit_ID=XP_396619.1; Match level="QueryCoverage =93%, HitCoverage=84%, E-value=2e-48, Identity=41%"; Hit description =similar to ENSANGP00000017978 [Apis mellifera]
  misc_feature: Gene Ontology Annotation: Molecular function=electron transporter activity; Cellular component=mitochondrion; Biological process =induction of apoptosis
  misc_feature: Pfam annotation: Pfam_ID=adh_short; Match level="Score=101.0, E-value= 3.1e-27, Copies=1"; Pfam description=short chain dehydrogenase
  misc_feature (303)..(303): Xaa can be any naturally occurring amino acid
MIVYNYTIYIKYIAFAVIAISLPFIALIVLKFFQKFSAGKVRSLVCLSGKTAIVTGAGSGIGYETALHLASRGCRVILADRKEAAKAKAKIIAITNNSNIETKILDLTSLQSVRKFAKEINSTEERLDILINNARVLSNGNKHTDDGLHSTMQVNHFGPFLLTHLLTDLLKKSAPSRIVFVSSALAFCSNLNLETLNYPVDHPLSIFRQGIIYANSKLANVITANIFAEKLKESGVTSNSLHPGLVNLYLFRKSARFDGLKTVYRLIRYFFLYIYGQTPEEGAQNTLHLALANSVKDITGKHXLGLQSLP

SEQ ID NO: 22078 - protein, 94 aa, Diabrotica virgifera
  misc_feature: Coding regions on vcDNA: vcDNA=SeqID_1775; Strand=+; Position=91-372
  misc_feature (75)..(75): Xaa can be any naturally occurring amino acid
KMNNNMGYNNKAWGRTNNSSNLMNQNQLQSQQPGGLRNMVPFPGNQQIFQNPLGLQQHNLGLGLQQINNAIDGAXALSSQIASNPIFQTGIVPE

SEQ ID NO: 22079 - protein, 107 aa, Diabrotica virgifera
  misc_feature: Coding regions on vcDNA: vcDNA=SeqID_1776; Strand=+; Position=3-326
  misc_feature: Homolog annotation: Hit_ID=S13329; Match level="QueryCoverage=93%, HitCoverage=10%, E-value=2e-19, Identity=44%"; Hit description =hypothetical protein 2 - fruit fly (Drosophila melanogaster)
YNTIFKSVWAYGLQLWGTASKSNVSIIERFQSKVLRSIIDAPWFVTNRDIYNDLETKTVSEVIVELSAKYIVRLESHANVLAINLLDNSQETRRLKRQTPLDLPHRH

SEQ ID NO: 22080 - protein, 489 aa, Diabrotica virgifera
  misc_feature: Coding regions on vcDNA: vcDNA=SeqID_1777; Strand=+; Position=96-1565
  misc_feature: Homolog annotation: Hit_ID=XP_319831.1; Match level="QueryCoverage =98%, HitCoverage=95%, E-value=0.0, Identity=77%"; Hit description =ENSANGP00000016528 [Anopheles gambiae]
  misc_feature: Gene Ontology Annotation: Molecular function=proteasome endopeptidase activity; Cellular component=proteasome regulatory particle (sensu Eukarya); Biological process=proteolysis and peptidolysis
  misc_feature: Pfam annotation: Pfam_ID=PCI; Match level="Score=97.1, E-value=4.4e -26, Copies=1"; Pfam description=PCI domain
MVTLEDVEMKNADSPPGLEAGDTKKDTDLQSVIEIREHARQIEKSVTSKENRFILRVLRCLPNTRRKLNGLVLRSLITQIYPVAERDALLSFVEEASGELDATQSRARSAVKSPVPEVDTYINLLILVRLIDTNKLVEAERCSQALMNKITNQNRRTIDHIAAKCYFYHSRVAELTNKLDSIRGFLHSRLRTATLRNDFEGQAVLINCLLRNYLHYSLYDQADKLVSKCVFPETASNNEWARFLYYLGRIKAARLEYSVAHKHLVQAMRKAPQNAAIGFRQVVQKLTVVVELLLGDIPERQIFRQSSMRHSLAPYFQLTQAVRMGNLQRFGEVLENFGPQFRQDHTFTLILRLRHNVIKTAIRSIGLSYSRISPQDIAKKLGLDSAEDAEFIVAKAIRDGVIEATLDPQGGYMRSKESTDIYCTKEPQLAFHQRISFCLDLHNQSVKAMRYPPKAYGKELESAEERREREQQDLELAKEMAEEDDDGFP

SEQ ID NO: 22081 - protein, 368 aa, Diabrotica virgifera
  misc_feature: Coding regions on vcDNA: vcDNA=SeqID_1778; Strand=+; Position=3-1103
  misc_feature: Homolog annotation: Hit_ID=T13799; Match level="QueryCoverage=99%, HitCoverage=53%, E-value=1e-161, Identity=54%"; Hit description =neurexin IV - fruit fly (Drosophila melanogaster) emb|CAA60383.1| neurexin IV [Drosophila
  misc_feature: Gene Ontology Annotation: Molecular function=protein binding; Cellular component=integral to plasma membrane; Biological process =synaptic vesicle docking
  misc_feature: Pfam annotation: Pfam_ID=Laminin_G_2; Match level="Score=122.2, E -value=1.2e-33, Copies=1"; Pfam description=Laminin G domain
  misc_feature (343)..(343): Xaa can be any naturally occurring amino acid
  misc_feature (361)..(361): Xaa can be any naturally occurring amino acid
WVSRHNQKMDYWGGALAGSRKCECGILSSCTDSTKWCNCDGVQNADIWQVDAGDLTDKETLPVKQLRFGDTGSALDEKEGRYTLGPLICEGDDLFNNVVTFRVADSTINLPTFDMGHSGDIYFEFRTASASAVLFHSTGPSDYIKLSIVNGNQLQFQYQAGSGPIAVIREVSYRLNDDEWHSVSVERNRKEAMIVIDGALKAEVREPPGPVRALHLTSELFIGASTDYRDGFTGCIRALLINGLHIDLRQYARMGLYGIQEGCVGKCQSGPCLNNGTCHERYDSYMCDCRWTAFKGPICADEIGVNLRQSSLIRYDFEGSFRSTIAEHIRSGITTTNPKGFLXWGLISNMTREYMTIMVSXNSGHLRI

SEQ ID NO: 22082 - protein, 123 aa, Diabrotica virgifera
  misc_feature: Coding regions on vcDNA: vcDNA=SeqID_1779; Strand=+; Position=16-384
  misc_feature: Homolog annotation: Hit_ID=XP_311760.1; Match level="QueryCoverage =66%, HitCoverage=37%, E-value=2e-15, Identity=41%"; Hit description =ENSANGP00000013622 [Anopheles gambiae]
MFSKKYLTFLSVLCIAIAVFADDEIPEPKPKSEYKKSLSRDCATSYSTTCLKLDIVSWVDKLNEENNYSVLPGVSVIKEEQSDKSSTADMVSELARDFPNDPDARLDAFLLKKVTSYLNSHSL

SEQ ID NO: 22083 - protein, 116 aa, Diabrotica virgifera
  misc_feature: Coding regions on vcDNA: vcDNA=SeqID_1780; Strand=+; Position=43-390
  misc_feature: Homolog annotation: Hit_ID=XP_393747.1; Match level="QueryCoverage =100%, HitCoverage=35%, E-value=5e-47, Identity=76%"; Hit description= similar to ENSANGP00000009970 [Apis mellifera]
  misc_feature: Gene Ontology Annotation: Molecular function=enzyme binding; Cellular component=delta-DNA polymerase cofactor complex; Biological process =DNA replication
MVQKESQKVNLPWVEKYRPSTLDDLVSHEDIIKTVSKFIRDDQVPHLLFYGPPGTGKTSTVLACARQLYTPAQFPSMVLELNASDDRGIGIVRGHILTFASTGTIFKSGFKLIILD

SEQ ID NO: 22084 - protein, 202 aa, Diabrotica virgifera
  misc_feature: Coding regions on vcDNA: vcDNA=SeqID_1781; Strand=+; Position=140-748
  misc_feature: Homolog annotation: Hit_ID=AAH72336.1; Match level="QueryCoverage =92%, HitCoverage=89%, E-value=8e-34, Identity=37%"; Hit description =MGC83206 protein [Xenopus laevis]
  misc_feature: Gene Ontology Annotation: Molecular function=molecular_function unknown; Cellular component=integral to synaptic vesicle membrane; Biological process=synaptic transmission
  misc_feature: Pfam annotation: Pfam_ID=MARVEL; Match level="Score=90.9, E-value =3.3e-24, Copies=1"; Pfam description=Membrane-associating domain
MDFNLAVFQEPRGVMRIVQFIFSICGFATITGYTGYINVVCGTLTKHTFVYPFEVIIQNISSKCSIDIVGDFSSDAKFFVTTGVLSMLYSLAIMVVYTKLDKMYKSNPKIPLIDFVITVIMAVLWLSSSAAWANGLTGLKTDTTLDSSKCQNCTITTSSYTTLNISVIFGFLNFFLWASDLWFLYKETSWFQGNQRQTGDGV

SEQ ID NO: 22085 - protein, 380 aa, Diabrotica virgifera
  misc_feature: Coding regions on vcDNA: vcDNA=SeqID_1782; Strand=+; Position=3-1145
  misc_feature: Homolog annotation: Hit_ID=XP_319582.1; Match level="QueryCoverage =98%, HitCoverage=92%, E-value=1e-142, Identity=64%"; Hit description= ENSANGP00000016672 [Anopheles gambiae]
  misc_feature: Gene Ontology Annotation: Molecular function=molecular_function unknown; Cellular component=integral to membrane; Biological process= biological_process unknown
  misc_feature: Pfam annotation: Pfam_ID=Peptidase_A22B; Match level="Score=458.7, E -value=6.2e-135, Copies=1"; Pfam description=Signal peptide peptidase
FVVSGRSFENMANLFNVIVAQASENLTENAKNATQKTPSTPEGTAVAYISLVVMALLPIFFGSFRSVSYHKDNKVEKMTKRDAAVFPIVASCSLFGLYIVFKLFSKEYINLLLTGYFFFLGVLALTHLLSPVVSKLVPAAIPNIPFHIMFTQGEGDNTEYLIDYRFSTYDIVALIACSLVGAWYLVQKHWVANNLFGLAFAIHGVELLHLNNVATGCILLGGLFVYDIFWVFGTDVMVTVAKSFEAPIKLVFPQDLLQNGFAANNFAMLGLGDIIIPGIFIALLLRFDNSLKRQTRTYFNASVIAYFLGLTATMLVMHVFKHAQPALLYLVPACIGTPLGLALIKGDLTAMFKYEDAPEEKKAGEKKKGTENKQEVKKVK

SEQ ID NO: 22086 - protein, 814 aa, Diabrotica virgifera
  misc_feature: Coding regions on vcDNA: vcDNA=SeqID_1783; Strand=+; Position=48-2491
  misc_feature: Homolog annotation: Hit_ID=XP_394300.1; Match level="QueryCoverage =88%, HitCoverage=96%, E-value=0.0, Identity=56%"; Hit description =similar to CG6953-PA [Apis mellifera]
  misc_feature: Gene Ontology Annotation: Molecular function=protein binding; Cellular component=extracellular space; Biological process=axon guidance
  misc_feature: Pfam annotation: Pfam_ID=Spond_N; Match level="Score=487.8, E-value =1.1e-143, Copies=1"; Pfam description=Spondin_N
  misc_feature (724)..(724): Xaa can be any naturally occurring amino acid
MKALFLLFFIVNYANCCGRTPSIYQSRKIKTPGDNGYEIKINENPQKYVPGNIYTMYLMAPTYPNTNRLRKFTRFTINIESTSNRTDAPQNVGSFQLYGDKVASFNEECINTISEVNTSPKSEVFFMWSAPPPGSGCVTFRAMVLENSDVWFSEDGNLTKTICEQKDEDLPSDDECCACDEAKYKLVFEGIWSSKTHPKDYPTLLWLTHFSDVIGASHEKNFSFWGEGQIASEGFRSLAEWGSVRLMETELRAKSKYLRTIIKASGLWYPNVNSNTSTTFRVDRRHHLISVASMFGPSPDWVVGINGLNLCLKNCTWTEKLAIDLYPYDAGTDGGISYMSPNAETNPRERMYRITTTYPEDPRAPFYDPSRKEMPALARLFLTREKLIPKNCDDNFLSSQLDISENTEESTRPECAVSEYSQWSDCSVTCGKGLRMRTRQYLFPQKASVNNCNRQLISKEMCVAAVPECDGDAEKDSQEIDSLDNNGVCATTEWSSWSSCSEICGPGQKMRTRKFLNRSGLKKCSHILTMEKEQCINRQCKPDEIDSDDPSCPTTAWSDWSPCSASCGKGIKMRTRLLLVDPSRQQECSSRVELIQQLPCEDIPNCIIEMNTAKVVCMQDGDPGPCQGYFNRWWFDATKLKCFPFVYGGCRGNRNNFLTQDQCMDTCKIVKDAITGTLDSTTLLRQNTRLEPTDCILSQWSDWSPCSASCGRGYRERFRVVKHXATNGGACPNGLFQRGCFKLLAKKNIMQLHMSRMHDMVMGRNLPTCMNAYILPVDAFSALIVKSSLICRHILLRGFSSYTFSYWTSLGSPV

SEQ ID NO: 22087 - protein, 259 aa, Diabrotica virgifera
  misc_feature: Coding regions on vcDNA: vcDNA=SeqID_1784; Strand=+; Position=62-841
  misc_feature: Homolog annotation: Hit_ID=AAN05630.1; Match level="QueryCoverage =70%, HitCoverage=77%, E-value=3e-32, Identity=38%"; Hit description =diapause-associated transcript-2 [Leptinotarsa decemlineata]
MNKFLVNFGLFVLAASCVVCAPNDGGRTKGVIEEADIQIGELVKPYIGERRVVSKALQKYLKESDYQVIKDLTREFDRHKDKCADIEKKMNATIEDLANCIEDITIGSSTVCATAQRTIEKCAKPVIELVSGCLPEESKELPALAEGIVLAVLKQACASTVEEVLELFNPCQWKAFGSIEKVDSCKAVATEVDSWDNKKPVPTTENICTVLPKLKKCSSDFHGQYCKSPVTLSSFAKFHKAVETETEKICHNPVKNEVA

SEQ ID NO: 22088 - protein, 122 aa, Diabrotica virgifera
  misc_feature: Coding regions on vcDNA: vcDNA=SeqID_1785; Strand=+; Position=66-431
  misc_feature: Homolog annotation: Hit_ID=AAB34025.1; Match level="QueryCoverage =85%, HitCoverage=89%, E-value=7e-15, Identity=50%"; Hit description =Tm-E1a=cuticular protein [Tenebrio molitor=yellow meal worms, pharate larval and pupal abdominal cuticle,
  misc_feature (113)..(113): Xaa can be any naturally occurring amino acid
MLTKVTVLIVLVASTQAGLLGAPAAYSTVTSHGVLGGHALAAPAVSYASPAVSYAAPAVSYASPAVSYAAAAPALSYAAPAIAAPAIAHTYAAPTIVKAAPVIKAAPSVDYVXYPKYQFNYG

SEQ ID NO: 22089 - protein, 284 aa, Diabrotica virgifera
  misc_feature: Coding regions on vcDNA: vcDNA=SeqID_1786; Strand=+; Position=102-955
  misc_feature: Homolog annotation: Hit_ID=NP_523570.3; Match level="QueryCoverage =95%, HitCoverage=67%, E-value=2e-88, Identity=51%"; Hit description =CG4182-PA [Drosophila melanogaster] gb|AAF53432.3| CG4182-PA [Drosophila melanogaster]
  misc_feature: Gene Ontology Annotation: Biological process=courtship behavior
  misc_feature: Pfam annotation: Pfam_ID=MRJP; Match level="Score=64.2, E-value=3.7e -16, Copies=1"; Pfam description=Major royal jelly protein
  misc_feature (257)..(257): Xaa can be any naturally occurring amino acid
MILKSVILVSVLCISGVISQLQDVFEWKELTFAWPNEEAKNAALTNGDYVPKNNLPLGLARWKDKLFVTVPRWKNGVAANLNYIPLNTTEKSPSLHPYPDWKANQIPKEGESPAENQIVSVFRLKVDECDRLWLIETGLSEILGNGRQVIPTSIAIFDLNTDQLIRRFNLPDTDIKGADSFFANIIVDTTKSQCDKAFAYLPDLGGYGIVVYSFADNISYRVKHNYFHFDPLKGNLNVGGVNFQWTDGVFSIALGPXNETTGYRTAYFHALASCNEFSVQHGKF

SEQ ID NO: 22090 - protein, 84 aa, Diabrotica virgifera
  misc_feature: Coding regions on vcDNA: vcDNA=SeqID_1787; Strand=+; Position=149-400
  misc_feature: Homolog annotation: Hit_ID=AAR19394.1; Match level="QueryCoverage =94%, HitCoverage=38%, E-value=4e-19, Identity=56%"; Hit description =modified lacZ' [Cloning vector pTA6]
KLLNGKNPGVTQFNPLAEKPPFTTWLNTKKARTFRPSKNLPTLNGKWNPPCTGPLTPAVLVVTPTLTAKLATAQPPAPSASFPS

SEQ ID NO: 22091 - protein, 467 aa, Diabrotica virgifera
  misc_feature: Coding regions on vcDNA: vcDNA=SeqID_1788; Strand=+; Position=112-1515
  misc_feature: Homolog annotation: Hit_ID=XP_320478.1; Match level="QueryCoverage =94%, HitCoverage=92%, E-value=0.0, Identity=85%"; Hit description =ENSANGP00000015768 [Anopheles gambiae]
  misc_feature: Gene Ontology Annotation: Molecular function=citrate (SI)-synthase activity; Cellular component=mitochondrion; Biological process=TCA intermediate metabolism
  misc_feature: Pfam annotation: Pfam_ID=Citrate_synt; Match level="Score=741.1, E -value=6.2e-220, Copies=1"; Pfam description=Citrate synthase
MALFRRLTPTKLSETPKLKSQVAVVLRQLSDSSTDLKAVLAAKIPKEQERVKNFRKQHGGSKVGEVTVDMMYGGMRGIKALVTETSVLDPDEGIRFRGLSIPECQNVLPKAPGGSEPLPEGLFWLLLTGDVPTEAQVKALSKEWAERAELPSHVVQVLNSLPTSVHPMSQLSAAITVMNSESKYAKAYASGVHKSKYWEYTYEDAMDLIAKLPVVAATIYRNSFRDGSGIGAIDTSKDWSYNFTTMLGYDDPKFIELMRLYLTIHSDHEGGNVSAHTVHLVGSALSDPYLSFSAGMNGLAGPLHGLANQEVLVWLQKLRQQVGDRATEDQLKDFIWKTLKSGQVVPGYGHAVLRKTDPRYTCQREFALKHLPDDPLFQLVSNVYKVVPPILLELGKVKNPWPNVDAHSGVLLQYYGLKEMNYYTVLFGVSRALGVMASLIWDRALGLPIERPKSMSTDGLMKLLKAK

SEQ ID NO: 22092 - protein, 298 aa, Diabrotica virgifera
  misc_feature: Coding regions on vcDNA: vcDNA=SeqID_1789; Strand=+; Position=25-917
  misc_feature: Homolog annotation: Hit_ID=AAG23133.1; Match level="QueryCoverage =100%, HitCoverage=61%, E-value=1e-178, Identity=99%"; Hit description=alpha-amylase [Diabrotica virgifera virgifera]
  misc_feature: Pfam annotation: Pfam_ID=Alpha-amylase; Match level="Score=106.0, E -value=9.8e-29, Copies=1"; Pfam description=Alpha amylase, catalytic domain
  misc_feature (175)..(175): Xaa can be any naturally occurring amino acid
  misc_feature (296)..(296): Xaa can be any naturally occurring amino acid
MKIVILFCALSVTVSSVIGQKDNHFAQGRNTIVHLFEWHWDAIASECENFLGPKGFAGVQVSPPNENSVIGDRPWWERYQPVSYQLTTRSGDESAFANMVQRCNNVGVRIYVDVVFNHMSATSGGGTAGGSCDVGSLSYPSVPFGSNDFHSKCDVNNYQDANNIRNCWLSGLPDXDQSHDYVRQKIVEYLNHLVDLGVAGFRVDAAKHMWPADLEAIYGSVKDLTGSGLSGRPFIYQEVIDLGGEAVKKTEYNSFGTVLEFKYGTELGNAFQGHNALHWLENWGPAWGLLAGTDAXAF

SEQ ID NO: 22093 - protein, 329 aa, Diabrotica virgifera
  misc_feature: Coding regions on vcDNA: vcDNA=SeqID_1790; Strand=+; Position=59-1045
  misc_feature: Homolog annotation: Hit_ID=XP_391843.1; Match level="QueryCoverage =100%, HitCoverage=82%, E-value=1e-110, Identity=61%"; Hit description=similar to ENSANGP00000013285 [Apis mellifera]
  misc_feature: Gene Ontology Annotation: Molecular function=3-oxoacyl-[acyl-carrier protein] reductase activity; Cellular component=mitochondrion; Biological process=lipid metabolism
  misc_feature: Pfam annotation: Pfam_ID=Thiolase_N; Match level="Score=324.3, E -value=1.8e-94, Copies=1"; Pfam description=Thiolase, N-terminal domain
MTSLTKGIFIVGAKRTPFGTFGGKLAKSHITDLQVIASKGALAAANVKPELVDTVVIGNVIPSVAADGGFLARHVLLKSGIPLEKPAFSVNRLCGSGFQSLINGLQDITTGVAEIALTGGVENMSASPYIVRNIRFGNIPLGVSPVLEDNVTVSGLDTMCGLTMALTAEKLGEQFKLSRDEVEQFSFSSQQRWKAAQDAGKFKDEIVPVPIKEKKEMVNFEVDEHPRPWTTLDMLKKLPTIFKKDGLVTAGTASGISDGAGAVVVASEAASSKHNLKPLARIVAHSVVGVDPSIMGFGPAPAIRNILKATGKTLDDIDLIEINEAFGAQ

SEQ ID NO: 22094 - protein, 51 aa, Diabrotica virgifera
  misc_feature: Coding regions on vcDNA: vcDNA=SeqID_1791; Strand=+; Position=255-407
ELFPNIVYLGIKNTIVIICLTQIIYFQLTEILVCRLLKVLCNNNIFTPKNI

SEQ ID NO: 22095 - protein, 288 aa, Diabrotica virgifera
  misc_feature: Coding regions on vcDNA: vcDNA=SeqID_1792; Strand=+; Position=67-934
  misc_feature: Homolog annotation: Hit_ID=NP_573114.2; Match level="QueryCoverage =99%, HitCoverage=90%, E-value=1e-103, Identity=62%"; Hit description= CG9914-PA [Drosophila melanogaster] gb|AAF48586.2| CG9914-PA [Drosophila melanogaster]
  misc_feature: Pfam annotation: Pfam_ID=3HCDH_N; Match level="Score=170.1, E-value =4.7e-48, Copies=1"; Pfam description=3-hydroxyacyl-CoA dehydrogenase, NAD
  misc_feature (273)..(273): Xaa can be any naturally occurring amino acid
MSNKKIGIIGSGLIGRSWAMIFAAAGYKVSLYDIDSQQIEVALADINQQLQTLEKEKVLRGTLTGKQQFALISGTTSLAETVKDATIVQECVPEVLDLKRKVWKQVDDIASPNTILSSSTSTFMPSLFSDHLKNKKNIIVSHPVNPPYYVPVVEVVPAPWTDPEVAKKTRAIWEEVGQTPVSLTKEVPGFIINRLQYAVLNEAWHLVTEGVLDVKDVDKVMSEGLGMRYAFLCTLETTHLNEQGFVNYCKRYGDTIYAVSKDFKPTPKFEGPXFLEIAKQLEADVPLE

SEQ ID NO: 22096 - protein, 70 aa, Diabrotica virgifera
  misc_feature: Coding regions on vcDNA: vcDNA=SeqID_1793; Strand=-; Position=131-343
RRRVHTCRLKIPCRTHSATTASEERMDLWMNISSSRMFLLPHTHFVAMTLVHLRLGKYFCLKLQPQRKLR

SEQ ID NO: 22097 - protein, 332 aa, Diabrotica virgifera
  misc_feature: Coding regions on vcDNA: vcDNA=SeqID_1794; Strand=+; Position=62-1057
  misc_feature: Homolog annotation: Hit_ID=XP_318845.1; Match level="QueryCoverage =96%, HitCoverage=91%, E-value=1e-111, Identity=57%"; Hit description= ENSANGP00000014460 [Anopheles gambiae]
  misc_feature: Gene Ontology Annotation: Molecular function=structural constituent of muscle; Cellular component=sarcomere; Biological process=striated muscle contraction
  misc_feature: Pfam annotation: Pfam_ID=GRP; Match level="Score=-18.9, E-value =0.0054, Copies=1"; Pfam description=Glycine rich protein family
  misc_feature (316)..(316): Xaa can be any naturally occurring amino acid
MKPLITLWFLVLVAVAINAEAKEKKSAEADDKKQKKRGLLSLGYGYGGDFDNGYHLGQGGYGIDGGYTLGLGQLDLGHTTSIEKTITLVKGVPVPYPVERHIPYPVTKHVPYPVKVLVPQPYPVEKPVAYPVKVHVKVPVPVPQPYPVEKIVHVPVKVPVDRPYPVKVLVPQPYPVEKHIPVPVKVPVPQPYPVEKPVPYPVKVPVHVPQPYPVIKQVPVPVKVPVDRPYPVHVPQPYPVHVIKNIPVPVEKPVPYPVKVHVDRPYPVPVEKPYPVPVKVPYPAPYPVERPVPVPVERPVPYAVKIPVDRPVPYAXERPVAVPGERPVPYPV

SEQ ID NO: 22098 - protein, 272 aa, Diabrotica virgifera
  misc_feature: Coding regions on vcDNA: vcDNA=SeqID_1795; Strand=+; Position=2-820
  misc_feature: Homolog annotation: Hit_ID=JE0234; Match level="QueryCoverage=96%, HitCoverage=54%, E-value=1e-105, Identity=69%"; Hit description =phosphogluconate dehydrogenase (decarboxylating) (EC 1.1.1.44) - Ascidia sydneiensis samea
  misc_feature: Gene Ontology Annotation: Molecular function=electron transporter activity; Cellular component=cytoplasm; Biological process=pentose -phosphate shunt
  misc_feature: Pfam annotation: Pfam_ID=6PGD; Match level="Score=524.6, E-value=9.1e- 155, Copies=1"; Pfam description=6-phosphogluconate dehydrogenase, C-t
SQSRTDGQHFDKWNKGALNIFPIEIIRDILRYKDSDGQYLLPKIRDTAGQKGTGKWTAISALNYGVPVTLIGESVFSRCLSALKTERQHASTKLQGPNAKFSGNVAKFLDDLEQALYAAKIVSYTQGFMLLREAAKVHNWELDYGAIALMWRGGCIIRSVFLGKIKEAFDKDMNLNSLLLDPFFLDAITKAQQGWRNVLTTAVTLGIPTPALSTALAFYDGYRSERLPANLLQAQRDYFGAHTYELLGKEGKFVHTNWTGHGGNVSASTYDA

SEQ ID NO: 22099 - protein, 65 aa, Diabrotica virgifera
  misc_feature: Coding regions on vcDNA: vcDNA=SeqID_1796; Strand=+; Position=895-1092
LKIPLDEYRGQGLFRPKKRVGLLKKCPKRGKKIPLRPGEINWYYKKILIPREKKKIYKKILFKKK

SEQ ID NO: 22100 - protein, 92 aa, Diabrotica virgifera
  misc_feature: Coding regions on vcDNA: vcDNA=SeqID_1797; Strand=+; Position=285-563
RAINIKDKVIFFIKYIMSLQNVGYHHSYLILFTATLNNMLVSTAYQSHKFFNHEVLLRPGLRLRAIFPCIIFCSNLYLGPVITCPKYSTFSS

SEQ ID NO: 22101 - protein, 57 aa, Diabrotica virgifera
  misc_feature: Coding regions on vcDNA: vcDNA=SeqID_1798; Strand=-; Position=428-601
RRVKHRLQPALLKFACIGEIHTNSSSSKIYVVVEEYIKKNMDKEVKRRDKLCRLTFT

SEQ ID NO: 22102 - protein, 103 aa, Diabrotica virgifera
  misc_feature: Coding regions on vcDNA: vcDNA=SeqID_1799; Strand=+; Position=98-409
  misc_feature: Homolog annotation: Hit_ID=EAA05846.2; Match level="QueryCoverage =86%, HitCoverage=91%, E-value=2e-31, Identity=68%"; Hit description =ENSANGP00000011079 [Anopheles gambiae str. PEST] ref|XP_559756.1| ENSANGP00000011079 [Anopheles gambiae st
  misc_feature: Pfam annotation: Pfam_ID=ATP-synt_G; Match level="Score=139.1, E -value=1e-38, Copies=1"; Pfam description=Mitochondrial ATP synthase g subunit
QPVKMSKLVASIPVLAGRLVQEGRPKFNTFMKYARVELSPPTPADIPQIRAGIGRLITSARTGAWKNQSVKEAWLNTLVGIEVLCWFYVGECIGKRHIVGYDV

SEQ ID NO: 22103 - protein, 432 aa, Diabrotica virgifera
  misc_feature: Coding regions on vcDNA: vcDNA=SeqID_1800; Strand=+; Position=146-1442
  misc_feature: Homolog annotation: Hit_ID=AAH64232.1; Match level="QueryCoverage =100%, HitCoverage=99%, E-value=1e-141, Identity=50%"; Hit description=Hypothetical protein MGC76181 [Xenopus tropicalis] ref|NP_989360.1| hypothetical protein MGC76181 [Xenop
  misc_feature: Gene Ontology Annotation: Molecular function=enzyme inhibitor activity; Cellular component=cytoplasm; Biological process=protein folding
  misc_feature: Pfam annotation: Pfam_ID=TPR_1; Match level="Score=235.3, E-value =1.2e-67, Copies=8"; Pfam description=Tetratricopeptide repeat
  misc_feature (370)..(370): Xaa can be any naturally occurring amino acid
MEQVAVLKDKGNQALSANKIDEALKYYTEAINLDPQNAVLYSNRSAAYAKANQYDLALKDAEKAVEIKPDWSKAYSRKGAALSYLGRHDEAITTYEKGLEIDPSNAQLNEGLNEVRAQKAKKSRSFPNPFSAPDVIPKLRADPKTRAFLDDPEYLALLAQLQANPQSMGTKLQDPRVLTTLSVLLGVDIGSEEPMDTEPAYTPPPRKPEPKPEPKKEPEPDLPENKRLAKAEKEQGNNFYKNKDFENAIVHYNKAIEHDPTDITFYNNLAAVYFEQKEYEQCIKECQRAIDLGRENRADFKLIAKSFMRIGNAYKKLKDYKTAKTYYEKSMSEHRTPEIKTLLSDVERIIKDEERKSYINPELAEKEKEXGNDMFKKGDYATAVKHYTEAIKRNPDDAKLYSNRAACYTKLAAFDLGLKDCDKCVELDPKVI

SEQ ID NO: 22104 - protein, 283 aa, Diabrotica virgifera
  misc_feature: Coding regions on vcDNA: vcDNA=SeqID_1801; Strand=+; Position=134-985
  misc_feature: Homolog annotation: Hit_ID=AAH64232.1; Match level="QueryCoverage =96%, HitCoverage=99%, E-value=1e-82, Identity=47%"; Hit description =Hypothetical protein MGC76181 [Xenopus tropicalis] ref|NP_989360.1| hypothetical protein MGC76181 [Xenopus
  misc_feature: Gene Ontology Annotation: Molecular function=enzyme inhibitor activity; Cellular component=cytoplasm; Biological process=protein folding
  misc_feature: Pfam annotation: Pfam_ID=TPR_1; Match level="Score=131.2, E-value =2.5e-36, Copies=4"; Pfam description=Tetratricopeptide repeat
MEQVAVLKDKGNQALSANKIDEALKYYTEAINLDPQNAVLYSNRSAAYAKANQYDLALKDAEKAVEIKPDWSKAYSRKGAALSYLGRHDEAITTYEKGLEIDPSNAQLNEGLNEVRAQKAKKSRSFPNPFSAPDVIPKLRADPKTRAFLDDPEYLALLAQLQANPQSMGTKLQDPRVLTTLSVLLGVDIGSEEPMDTEPAYTPPPRKPEPKPEPKKEPEPDLPENKRLAKAEKEQGNNFYKNKDFENAIVHYNKAIEHDPTDITFYNNLAAVYFFLKNTNIKN

SEQ ID NO: 22105 - protein, 173 aa, Diabrotica virgifera
  misc_feature: Coding regions on vcDNA: vcDNA=SeqID_1802; Strand=+; Position=279-800
  misc_feature: Homolog annotation: Hit_ID=AAS89976.1; Match level="QueryCoverage =94%, HitCoverage=92%, E-value=1e-20, Identity=32%"; Hit description =peritrophin membrane protein 1 [Spodoptera frugiperda]
  misc_feature: Pfam annotation: Pfam_ID=CBM_14; Match level="Score=123.4, E-value =5.3e-34, Copies=2"; Pfam description=Chitin binding Peritrophin-A domain
YCARTRGVNCSKIIPLPHPVCTDSRTTFYIYPYNCKKFYECYENVLYILECPDDLLWNNDAKVCDDSYNVDCSYIIPENAETDEPTSAPTSTSPVTTERPTTTTVPPPPTKPPVQCEHSRQYIPDPYNCSMYYECSNGVPVSMSCPGGEYWNPDEETCDWPFNVDCTEAPLPA

SEQ ID NO: 22106 - protein, 309 aa, Diabrotica virgifera
  misc_feature: Coding regions on vcDNA: vcDNA=SeqID_1803; Strand=+; Position=105-1034
  misc_feature: Homolog annotation: Hit_ID=XP_393366.1; Match level="QueryCoverage =84%, HitCoverage=94%, E-value=2e-50, Identity=43%"; Hit description =similar to ENSANGP00000020267 [Apis mellifera]
MSIFGPLMGDMEDDPFFGCHMRHMRQMSNMMNSLFSDPFSMLRPPMLGYDDYENRALTSRHNMHNSLMSPFSMPIMPNFNRLLSGSLDSMANTGNYHSSNTGNYHSSSTVISMTSGPDGRQQVYKATSSTRVAPGGVKETQKTVTDSMTGTKKMSIGHHIGERAHIIEKEQNIHTGERVESEDLINIEDDEKEEFNNEWESKTRRSEIPRITAGSSRNRHGSYIHSSIPAITAGSSSRRHRDRTVPATSPSVISSRRGIRSPKLALPSTSAPSAAGRHPYSSPNQPQQPKKSKSLKTYEEDPSPPQADN

SEQ ID NO: 22107 - protein, 112 aa, Diabrotica virgifera
  misc_feature: Coding regions on vcDNA: vcDNA=SeqID_1804; Strand=+; Position=95-431
  misc_feature: Homolog annotation: Hit_ID=NP_956519.1; Match level="QueryCoverage =98%, HitCoverage=36%, E-value=3e-18, Identity=43%"; Hit description =hypothetical protein MGC56305 [Danio rerio] gb|AAH46060.1| Hypothetical protein MGC56305 [Danio
  misc_feature (36)..(36): Xaa can be any naturally occurring amino acid
MESADITEEDLLKKHRQEKKDLQSKIQALKKTVPKXDKTEKKEITEEIAKLELELDEKHRTELGESNICSEQLNISTENGEDESEMTEDQTVENGINSTRISRAQKRRNKGE

SEQ ID NO: 22108 - protein, 165 aa, Diabrotica virgifera
  misc_feature: Coding regions on vcDNA: vcDNA=SeqID_1805; Strand=-; Position=3-497
  misc_feature: Homolog annotation: Hit_ID=CAD22154.1; Match level="QueryCoverage =99%, HitCoverage=51%, E-value=3e-50, Identity=57%"; Hit description =pherophorin-dz1 protein [Volvox carteri f. nagariensis]
  misc_feature: Gene Ontology Annotation: Molecular function=RNA binding; Cellular component=nucleus; Biological process=mRNA processing
PPNCPGALFCPGPPGPPGPPGPPLPPPGPPRPLKPPGPPLPIPRPPGPPGPPLPPPGPPRPLKPPGPPLPPIPRPPPLPPIPPSPGPPPGNRPLGAPLGPPRPLIIGPPRPPGPPGPPRPLNPPRPPGPPGPPGPPLPGPPGPPLPLPIPIPLPPPIPPPDAWPG

SEQ ID NO: 22109 - protein, 289 aa, Diabrotica virgifera
  misc_feature: Coding regions on vcDNA: vcDNA=SeqID_1806; Strand=+; Position=114-983
  misc_feature: Homolog annotation: Hit_ID=XP_395833.1; Match level="QueryCoverage =84%, HitCoverage=93%, E-value=2e-40, Identity=32%"; Hit description =similar to KIAA1068 protein [Apis mellifera]
  misc_feature: Gene Ontology Annotation: Cellular component=nucleus; Biological process=embryogenesis and morphogenesis
  misc_feature: Pfam annotation: Pfam_ID=Nuclear_move; Match level="Score=110.9, E -value=3.2e-30, Copies=1"; Pfam description=Nuclear movement protein
MSENNHDDMLFEMLKDCRTLPKFLDDIFGFLARRTDFYNVSMMNPGLGLPKGLSEKLVRHTFLKWKAVPRDVIYTPNEIPVSTEEVVVSCSEESDQQVSSTTKDELLEDGVEEFSFSKSEYYNGAVFEHYCWSQSINEIDVIVRIPKDVSTKDLEVKLQSSSISVKLRDGEYILSGDLCEKCKAADTVWSLDGRKLLLHLDKCQEKWWNCLIKSEPELDISTIDCTRPYDELPEHAQVKIEELQWNHERKRLGLPTTEELQVHETLKKVWNGEGSHLRGPFCSHHCEKK

SEQ ID NO: 22110 - protein, 326 aa, Diabrotica virgifera
  misc_feature: Coding regions on vcDNA: vcDNA=SeqID_1807; Strand=+; Position=35-1012
  misc_feature: Homolog annotation: Hit_ID=BAC10661.1; Match level="QueryCoverage =71%, HitCoverage=62%, E-value=2e-13, Identity=30%"; Hit description =cuticle protein [Bombyx mori]
  misc_feature: Pfam annotation: Pfam_ID=Extensin_2; Match level="Score=-101.8, E -value=0.002, Copies=1"; Pfam description=Extensin-like region
MRFICLAIVTLAVVAQAEKAKDKRLAVDPNTGYHQGASAYSHQSSQPQYVSAQPQQQHYYQPEAVQQQAISYTQPISKYASAGAAPVQKYTFAPQPAKQQVQYSSAADVSSFSYSSPIVSYNNLGLLKQIAGQQASSHDVPVTYQTEQSAKADYSSQPKVQYITSPKVQYTHTPSAVQYTSSPKIQYTSAAKTQYAAAPSSAYSASAASANAYTASAAPNYEEIYQQIAQKAAYAAAEQQPQAPQQAVYHQAAPQKLSYQQAASPVVYQYQKAAAAQAATQEENYSSAPSQTYTYQLPQEYESAAQSATALLFSVSRFRCASSTVL

SEQ ID NO: 22111 - protein, 172 aa, Diabrotica virgifera
  misc_feature: Coding regions on vcDNA: vcDNA=SeqID_1808; Strand=+; Position=1-519
  misc_feature: Homolog annotation: Hit_ID=NP_524833.2; Match level="QueryCoverage =91%, HitCoverage=5%, E-value=4e-14, Identity=39%"; Hit description =CG9696-PA, isoform A [Drosophila melanogaster] gb|AAM70871.1| CG9696- PA, isoform A [Drosophila
  misc_feature: Gene Ontology Annotation: Cellular component=nucleus; Biological process=establishment and/or maintenance of chromatin architecture
LSIAQVGKNNLQAQLIVGSKPLSTAMTVQQFQQVIRSPLNVSQGPVVLAKGPPTRVIPVNTQGSKQTIQVVAAGSSQALNTALRPQAGTSTLAGALTGIKVQGASGTTQQALLSQVSAALNQNVAGMRQGSPVRIQTSTGAPLVAVNVQNVQQQAASSSSNAAPQVTNPEQE

SEQ ID NO: 22112 - protein, 203 aa, Diabrotica virgifera
  misc_feature: Coding regions on vcDNA: vcDNA=SeqID_1809; Strand=+; Position=23-634
  misc_feature: Homolog annotation: Hit_ID=CAG04463.1; Match level="QueryCoverage =97%, HitCoverage=36%, E-value=8e-93, Identity=79%"; Hit description =unnamed protein product [Tetraodon nigroviridis]
  misc_feature: Gene Ontology Annotation: Molecular function=molecular_function unknown; Cellular component=membrane; Biological process=biological _process unknown
MPVRVEITPPLPANSKQPGVTKSLLYNGSKFQGFQKSKGNSYEVEVILQHVDEENSYLCGYLQINGLTDEYPKLTTFFDGEIISQKYPFLTRKWDADEDVDRKHWSKFSLFSQYAKTFNSDSFDYKALADTDYVFMRWKEHFLVPDHTIKDISGASFAGFYYICFQKSKATIEGYYYHRSSEWFQSLNLTHVPENSIQIYEFR

SEQ ID NO: 22113 - protein, 217 aa, Diabrotica virgifera
  misc_feature: Coding regions on vcDNA: vcDNA=SeqID_1810; Strand=+; Position=76-729
  misc_feature: Homolog annotation: Hit_ID=NP_611325.2; Match level="QueryCoverage =97%, HitCoverage=95%, E-value=9e-58, Identity=54%"; Hit description =CG17524-PA [Drosophila melanogaster] gb|AAF57699.1| CG17524-PA [Drosophila melanogaster]
  misc_feature: Gene Ontology Annotation: Molecular function=glutathione transferase activity; Cellular component=cellular_component unknown; Biological process=glutathione conjugation reaction
  misc_feature: Pfam annotation: Pfam_ID=GST_N; Match level="Score=67.1, E-value=5e -17, Copies=1"; Pfam description=Glutathione S-transferase, N-terminal
MAPTLYLITASPAVRSVTLCAKALNVELNEKQVNLLAGEHLSPEFLKINPQHTVPVLDDDGFVIVDSHAINTYLVAKYGKDDSLYPKDLKKRAIVDHRLHYDSSTLFVRGVAISRSLLFEGEKVIAPKLLTALEEAYNITEKFLEKNNYIAGDQLTVADFSFITSITSWNAFFNLKEAKYPKIVAWMKRMQALPYYKEGNQVGLDQYYAIMKDKVPK

SEQ ID NO: 22114 - protein, 42 aa, Diabrotica virgifera
  misc_feature: Coding regions on vcDNA: vcDNA=SeqID_1811; Strand=-; Position=107-235
CLTIFLLLFFFIVFLLFFIIKHTIQYYLFKNCDRLQSKQNRI

SEQ ID NO: 22115 - protein, 152 aa, Diabrotica virgifera
  misc_feature: Coding regions on vcDNA: vcDNA=SeqID_1812; Strand=+; Position=440-898
  misc_feature: Homolog annotation: Hit_ID=XP_331555.1; Match level="QueryCoverage =32%, HitCoverage=10%, E-value=2e-15, Identity=85%"; Hit description =hypothetical protein [Neurospora crassa] gb|EAA29837.1| hypothetical protein [Neurospora crassa]
  misc_feature: Gene Ontology Annotation: Molecular function=molecular_function unknown; Cellular component=small nucleolar ribonucleoprotein complex; Biological process=snRNP protein-nucleus import
NSIHIKKKKKKKKKKKKKKKKKKKKKKKKKKKKKKKKKKKGKKEKRGAPLKEPNFYHRGLGTKNFLKRAPKLISRGPFLNTAGWEKPGGSPNFSVWNTPPFSPMGVKTKKAPPPIPPFPKFLQTLKRKKGNPPLNGPNKTGGGGGVNPRGEP

SEQ ID NO: 22116 - protein, 150 aa, Diabrotica virgifera
  misc_feature: Coding regions on vcDNA: vcDNA=SeqID_1813; Strand=+; Position=2-451
PRVRNNTAVSIMKCFVLFACCVAYISASALNFQPFQSVYVDPCACRKCLEEIWNRTLQLNQNLNSVNRTLNNLTVILEKNVTTEVTYQLDELCKVEENLDNLVATEKNITVVLQAQICNLTDVVGDLEKCCRDMECLGQKVDEQTCILAN

SEQ ID NO: 22117 - protein, 339 aa, Diabrotica virgifera
  misc_feature: Coding regions on vcDNA: vcDNA=SeqID_1814; Strand=+; Position=247-1266
  misc_feature: Homolog annotation: Hit_ID=EAA13248.2; Match level="QueryCoverage =95%, HitCoverage=97%, E-value=1e-100, Identity=56%"; Hit description= ENSANGP00000010677 [Anopheles gambiae str. PEST] ref|XP_554533.1| ENSANGP00000010677 [Anopheles gambiae s
  misc_feature: Gene Ontology Annotation: Molecular function=RNA binding; Cellular component=nucleoplasm; Biological process=snRNP recycling
  misc_feature: Pfam annotation: Pfam_ID=RTC; Match level="Score=377.3, E-value=2.1e -110, Copies=1"; Pfam description=RNA 3'-terminal phosphate cyclase
MIQEIDGSLLEGGGQILRIALTLSALKKIPIRITKIRGGRSKPGLMEQHLKGVELLRDICSAKVKGAQLGSTEIEFWPQEIKGGSYRAQVKTAGSISLLLQVSLPCIIFADTPTTLLLRGGTNTEMAPQIDYLTEVFRPILEKFGATFDLDLKRRGYFPKGGGEVIINVKPVEKLNPIEMTTQGSVTDIFGWSFVAGNLPERLSHQMADSAANELKKIASVNIERYKEDQNIAPDSCSGIILVANTSTNCVLGASALGKRSESLQETGRRAAEELQRSIKAGACVDEYSQDQVIIFMALAKGPSKVRVGDITMHTKTAIYVIEKLTTVKYEITPSEAQI

SEQ ID NO: 22118 - protein, 91 aa, Diabrotica virgifera
  misc_feature: Coding regions on vcDNA: vcDNA=SeqID_1815; Strand=+; Position=2-274
PRVRYDSTKTVTFDMQQCLFIPLVHSSVTFYKRQLWTFNLTVYNWSHATIYCPFVIYKFISEAIKPVVKSLTMYSDTCGDQNKNTHVAAMP

SEQ ID NO: 22119 - protein, 147 aa, Diabrotica virgifera
  misc_feature: Coding regions on vcDNA: vcDNA=SeqID_1816; Strand=+; Position=3-443
  misc_feature: Homolog annotation: Hit_ID=XP_320711.1; Match level="QueryCoverage =89%, HitCoverage=23%, E-value=3e-17, Identity=38%"; Hit description =ENSANGP00000008820 [Anopheles gambiae]
  misc_feature: Gene Ontology Annotation: Molecular function=receptor activity; Cellular component=cytoplasm; Biological process=intracellular protein transport
  misc_feature: Pfam annotation: Pfam_ID=PUA; Match level="Score=9.1, E-value=0.0015, Copies=1"; Pfam description=PUA domain
HASAHASAIFMLWKFPNIIYAFTTHQQVMSFITSGADLMLAGVVTPHPSTNLPKYGNVLENEVVYVNLSNNRAAVAVGVASQSSGAMNLANCRGKCVNIYHFYGDHLCTVEGLPNLPIATLGSPTWLRMDSYDNDFPALGGPTKTHS

SEQ ID NO: 22120 - protein, 179 aa, Diabrotica virgifera
  misc_feature: Coding regions on vcDNA: vcDNA=SeqID_1817; Strand=+; Position=134-673
  misc_feature: Homolog annotation: Hit_ID=NP_956352.1; Match level="QueryCoverage =96%, HitCoverage=90%, E-value=1e-48, Identity=50%"; Hit description =Unknown (protein for MGC:73197) [Danio rerio] gb|AAH59545.1| Unknown (protein for MGC:73197)
  misc_feature: Gene Ontology Annotation: Molecular function=molecular_function unknown; Cellular component=integral to membrane; Biological process= biological_process unknown
  misc_feature: Pfam annotation: Pfam_ID=TB2_DP1_HVA22; Match level="Score=182.9, E -value=6.5e-52, Copies=1"; Pfam description=TB2/DP1, HVA22 family
MAQKFNEIKQQLDVALRDNSKPWTPLLAAAEQKTGLDRVYLALGAAAFLGIWLVFGYFAQLICNSLGFLYPAYVSIKAIESKEKDDDTKWLTYWVVFSLFSVTEYFVDVIVRWFPLYWLIKCIFMVWLMLPGDMNGSVILYRRVIKPYFLKHQGEIDGVVNKVKNTVKDTVNKVSEKAE

SEQ ID NO: 22121 - protein, 117 aa, Diabrotica virgifera
  misc_feature: Coding regions on vcDNA: vcDNA=SeqID_1818; Strand=+; Position=67-417
  misc_feature: Homolog annotation: Hit_ID=CAG00968.1; Match level="QueryCoverage =92%, HitCoverage=41%, E-value=3e-34, Identity=62%"; Hit description =unnamed protein product [Tetraodon nigroviridis]
  misc_feature: Pfam annotation: Pfam_ID=Mov34; Match level="Score=82.7, E-value=9.7e- 22, Copies=1"; Pfam description=Mov34/MPN/PAD-1 family
MISENYLKRVNITADVYAICVQHALTTEKQEIMGLLIGEVNESERVSNISACVILHRSDKQPDRVEISPEQLCHASMHADQLAKKLNRPMRVLGWYHSHPHITVWPSHVDIRTQATY

SEQ ID NO: 22122 - protein, 164 aa, Diabrotica virgifera
  misc_feature: Coding regions on vcDNA: vcDNA=SeqID_1819; Strand=+; Position=122-616
  misc_feature: Homolog annotation: Hit_ID=EAL33774.1; Match level="QueryCoverage =95%, HitCoverage=98%, E-value=5e-61, Identity=66%"; Hit description =GA21363-PA [Drosophila pseudoobscura]
  misc_feature: Gene Ontology Annotation: Molecular function=NADH dehydrogenase (ubiquinone) activity; Cellular component=membrane fraction; Biological process=growth
MPEDAAPRNILEKFIFSVANTLEAPTIWVREKIVEPNQKQSAWYHQKFRRVPTIDECYTDDIVCISEANIQFKRDKLVDSEILSIMRERFEECTLYEAPDHIERCKPLLEQYQEASTNWFIKYGDLGAYGNAHDAYMKQKHRLIWERRHGPVGGGMKSATPTEE

SEQ ID NO: 22123 - protein, 286 aa, Diabrotica virgifera
  misc_feature: Coding regions on vcDNA: vcDNA=SeqID_1820; Strand=+; Position=100-960
  misc_feature: Homolog annotation: Hit_ID=XP_391934.1; Match level="QueryCoverage =99%, HitCoverage=100%, E-value=1e-111, Identity=67%"; Hit description=similar to ENSANGP00000021554 [Apis mellifera]
  misc_feature: Gene Ontology Annotation: Molecular function=translation factor activity, nucleic acid binding; Cellular component=eukaryotic 48S initiation complex; Biological process=regulation of translational initiation
  misc_feature: Pfam annotation: Pfam_ID=RRM_1; Match level="Score=65.2, E-value=1.8e- 16, Copies=1"; Pfam description=RNA recognition motif. (a.k.a. RRM, R
MPAADEIKSSWADEVELEGGALPPPSEVFENGFKIVTEYKYNEDDKKVKIVRTYKIEKRVVSKSIALRKTWKKFGDVANDKPGPNPATTIVAEDVYMQYITSKEEDNKQDDDSLDKLKGMGDKKFFKCRTCNGEHWTTKCPWKDTMFVGGKPPDDKKISAVGGAAVGEAGKQGSKYVPPNLRDGGVKRTDGSGVAKRDDSSCAIRIANLSESTTETDLEDLVKQFGPIQKLYLAKDKITGGCKGFAYIHFKFRSDAAKAIAMLHGHGYDHLILNVDWSKPSPNSNQ

SEQ ID NO: 22124 - protein, 320 aa, Diabrotica virgifera
  misc_feature: Coding regions on vcDNA: vcDNA=SeqID_1821; Strand=+; Position=9-971
  misc_feature: Homolog annotation: Hit_ID=CAH86804.1; Match level="QueryCoverage =86%, HitCoverage=62%, E-value=5e-09, Identity=21%"; Hit description =hypothetical protein PC302162.00.0 [Plasmodium chabaudi]
MRENSRDPRVVRDTRERDSDVKDIRDPRLNREGSVNRENTVTKQTLDAAEKINRDPRLNRGRSSSREDSKFDRLYSRTNRNRSRSRSRSSTRTEVIEGDTFSSPLDSLYNSREEQKSGKGYGVQSFRIPKKKKDEKEKAKEPEVETSKETISQDEEGHDYSNKTIDISDNEEDSKTSVNCVDNKESVPVSTLIETKIKSDPNKNLNKEEIHNSSVCIDNDVLEVTSTTMDISSPVYKEEESQPSVSEEQTKSDVTDDKKAENISNSQDSKTSTKIEEPVKPPVTEQTILAQFFANLLGSQNKKEKKTALYSLISTFSDSF

SEQ ID NO: 22125 - protein, 62 aa, Diabrotica virgifera
  misc_feature: Coding regions on vcDNA: vcDNA=SeqID_1822; Strand=-; Position=121-309
TTYVLTLCKKWNDVPGLYSISYSSSFKQWNNVNNDRSTKCMITAAYFTIRSEVLTECDNGQY

SEQ ID NO: 22126 - protein, 254 aa, Diabrotica virgifera
  misc_feature: Coding regions on vcDNA: vcDNA=SeqID_1823; Strand=+; Position=118-880
  misc_feature: Homolog annotation: Hit_ID=EAL25663.1; Match level="QueryCoverage =92%, HitCoverage=87%, E-value=5e-54, Identity=49%"; Hit description =GA17871-PA [Drosophila pseudoobscura]
  misc_feature: Gene Ontology Annotation: Molecular function=transporter activity; Cellular component=integral to plasma membrane; Biological process =cell-cell signaling
  misc_feature: Pfam annotation: Pfam_ID=MIP; Match level="Score=142.7, E-value=8.2e -40, Copies=1"; Pfam description=Major intrinsic protein
  misc_feature (221)..(221): Xaa can be any naturally occurring amino acid
  misc_feature (226)..(226): Xaa can be any naturally occurring amino acid
  misc_feature (232)..(232): Xaa can be any naturally occurring amino acid
  misc_feature (234)..(234): Xaa can be any naturally occurring amino acid
  misc_feature (236)..(236): Xaa can be any naturally occurring amino acid
MVKGKVIQLTDNMSTKDRVTICAAEIGGTAMLVFLGCMGCVSSLASGGVIPHEQISFTFGLAVMVAVQTFGHVSGSHINPIVTVAAATLGDIALIQVPVYFVGQMIGGLLGYALLLVATPDVYMGNVYNNSTGAKIGTGVCSPAINPLISAPQALFVEFMLCLILVLFCCGVWDSRNSTKHDSVAIRFGLLIAVLAMAGGPYTGANMNPARSFAPALFNGXLEHHXVYWLGXLXAXLVGAVLYRLIFQKTETSF

SEQ ID NO: 22127 - protein, 438 aa, Diabrotica virgifera
  misc_feature: Coding regions on vcDNA: vcDNA=SeqID_1824; Strand=+; Position=51-1367
  misc_feature: Homolog annotation: Hit_ID=AAV68692.1; Match level="QueryCoverage =98%, HitCoverage=99%, E-value=1e-165, Identity=61%"; Hit description= putative IDGF [Diaprepes abbreviatus]
  misc_feature: Gene Ontology Annotation: Molecular function=chitinase activity; Cellular component=extracellular; Biological process=response to bacteria
  misc_feature: Pfam annotation: Pfam_ID=Glyco_hydro_18; Match level="Score=286.8, E -value=3.5e-83, Copies=1"; Pfam description=Glycosyl hydrolases family 18
MAAGFKIFLLVLFSYVCYTQANPKVVCYYDEKGNSRQGQGKFDVAFLEPALQFCTHLIYGYAGIDPNTYKIKLMNEQLDLNQHNFRQVTDLKRKFPGLRVFLSVGGDRDVSGEDTEKNMVYRNVLEAVDRRLTFINSAKDLIKNYGFDGIDLAWEMPRTKPKKIFGTVKNFLVGIKRRIVGSSVVDDKADEHREQFTAFIREFKNALRHDGFWLTLSVLPNVNSTVYYDPRALAPHLDFVTLQNFDFYTPERNPKEADYSSPLYKIFDRKDDENGDFQVMYWLNNGMPANKILYGIRTFGRSWKMTQASGLTGVPPLTIEEAPGEAGPYTQEPGLLSYNEVCTKIANPTEIKAGYVGKLRKVNDPTKRMGTYAFREPKNGQEGIWVSFEDPDTAGQIGSYVKAKGIGGVSIVDLSLDDFRGLCTGDKYPILRAAKFRL

SEQ ID NO: 22128 - protein, 121 aa, Diabrotica virgifera
  misc_feature: Coding regions on vcDNA: vcDNA=SeqID_1825; Strand=+; Position=52-414
  misc_feature: Homolog annotation: Hit_ID=XP_320568.1; Match level="QueryCoverage =97%, HitCoverage=42%, E-value=1e-36, Identity=42%"; Hit description =ENSANGP00000008696 [Anopheles gambiae]
  misc_feature: Gene Ontology Annotation: Biological process=regulation of pole plasm oskar mRNA localization
  misc_feature: Pfam annotation: Pfam_ID=Neuralized; Match level="Score=14.8, E-value= 2.2e-05, Copies=1"; Pfam description=Neuralized
MAYFHYRCGERITLINENCTAIRNESEFDHGLVISAEPLQNDVLFEIKIDKKVNTWSGSLEIGVVDCDPLDFDFPPCASKIQSGSWIMSGTTVFKNGACLVEGYGMDLDRLNQDDRIGLMR

SEQ ID NO: 22129 - protein, 221 aa, Diabrotica virgifera
  misc_feature: Coding regions on vcDNA: vcDNA=SeqID_1826; Strand=+; Position=3-666
  misc_feature: Homolog annotation: Hit_ID=XP_315793.1; Match level="QueryCoverage =100%, HitCoverage=29%, E-value=1e-109, Identity=88%"; Hit description=ENSANGP00000024063 [Anopheles gambiae]
  misc_feature: Gene Ontology Annotation: Molecular function=chloride channel activity; Cellular component=integral to plasma membrane; Biological process=transport
  misc_feature: Pfam annotation: Pfam_ID=CBS; Match level="Score=49.6, E-value=8.8e -12, Copies=2"; Pfam description=CBS domain
  misc_feature (171)..(171): Xaa can be any naturally occurring amino acid
MFELTGGVRYIVPLMAAAMASKWVGDALGRQGIYDAHIALNGYPFLDSKDEFQHTSLAADVMQPKRNETLSVLTQDSMTVDDVETLLKETEHNGYPVVVSRESQYLVGFVVRRDLNLAIANAKRMVDGICGQSLVLFTQGNAPQTLGPPPLNLKKILDMAPITITDQTPMXETVVDMFRKLGLRQTLVTHNGRLLGVITKKDVLRHIKQMDNEDPNSVLFN

SEQ ID NO: 22130 - protein, 100 aa, Diabrotica virgifera
  misc_feature: Coding regions on vcDNA: vcDNA=SeqID_1827; Strand=+; Position=113-412
IMSMSDRTKKLLDLALDNVNKPDEEITTAPFYRLRPRAESRKNTTHNLPEDNESFVFSSDDSIIDPDITMQDLVGTYSYEDYDFPESNQSQLIWRHSLEI

SEQ ID NO: 22131 - protein, 325 aa, Diabrotica virgifera
  misc_feature: Coding regions on vcDNA: vcDNA=SeqID_1828; Strand=+; Position=171-1148
  misc_feature: Homolog annotation: Hit_ID=XP_320723.1; Match level="QueryCoverage =87%, HitCoverage=34%, E-value=1e-58, Identity=41%"; Hit description =ENSANGP00000020175 [Anopheles gambiae]
  misc_feature: Gene Ontology Annotation: Molecular function=serine-type endopeptidase activity; Cellular component=plasma membrane; Biological process=cytoskeleton organization and biogenesis
  misc_feature: Pfam annotation: Pfam_ID=Trypsin; Match level="Score=140.1, E-value =5.1e-39, Copies=1"; Pfam description=Trypsin
MTENEAKQENSNRKLCKGGKFEGEMVCCKVGPTNSSAESRNPVIEDDNSTPAAMHQCGVQRTKINVRIMTDEDSDEEVNPLDGEFPWITAVYKINKKGRWVFHSSGALIHPKVILTANHYFHRKNANDFKIILTGDVELSKVGNNVDNERNVVEIVNHPKYYGGALYNDGALLILDRPFESTKTDAWDTLCLPPDNLNMNSGRCLVAGWGKGSEEEGIKVLKKVELPIVPFHKCEEQLRKTRLGAGFILNESFMCAGGEKNKDACKGDGGSPLMCLLPGQTRYFHMGIVSWGIGCGTENVPGVYASTIKLKPWIMEELKKRNLEL

SEQ ID NO: 22132 - protein, 80 aa, Diabrotica virgifera
  misc_feature: Coding regions on vcDNA: vcDNA=SeqID_1829; Strand=+; Position=890-1132
  misc_feature (67)..(67): Xaa can be any naturally occurring amino acid
  misc_feature (74)..(74): Xaa can be any naturally occurring amino acid
IHHFLPHFQYQIYNLWLQLMAVNQSVLFPESHKNVDKIKSKHIYITTNLLLSELVFPLVYLECSVSXYACFYLXVSPFFF

SEQ ID NO: 22133 - protein, 64 aa, Diabrotica virgifera
  misc_feature: Coding regions on vcDNA: vcDNA=SeqID_1830; Strand=+; Position=1-195
YLIYFFMYFKGLSALTNNLVFHSAFKFFKNIYWFFQERGFEKNIHNVRGNIFQIYVCHTTHSVE

SEQ ID NO: 22134 - protein, 107 aa, Diabrotica virgifera
  misc_feature: Coding regions on vcDNA: vcDNA=SeqID_1831; Strand=-; Position=1-321
NSICKKRELFQNLLSPNECVSKLAFSKSLLQISLSPNKNASSSSSSFCIDITLSVFQCASSKLSFHLFRGLPTDRLLIGEPSLAVLTTLFVVIRLMWSFHSTLLLFT

SEQ ID NO: 22135 - protein, 188 aa, Diabrotica virgifera
  misc_feature: Coding regions on vcDNA: vcDNA=SeqID_1832; Strand=+; Position=227-793
  misc_feature: Homolog annotation: Hit_ID=EAL42252.1; Match level="QueryCoverage =69%, HitCoverage=98%, E-value=2e-19, Identity=37%"; Hit description =ENSANGP00000025437 [Anopheles gambiae str. PEST] ref|XP_561090.1| ENSANGP00000025437 [Anopheles gambiae st
  misc_feature: Pfam annotation: Pfam_ID=UPF0224; Match level="Score=29.4, E-value =1.9e-06, Copies=1"; Pfam description=Uncharacterised protein family (UPF022
MEHYLDPEEQIQCPYNSAHLIRRKVFNTHLVKCRKANPDIKLVPCDFNVTHWVEEPCLQHHHENCPDRKKIETKFYVDDKTDLNKYPVRNTYIPSDENWDDENVPTYNPQKTCLSKEVIRHLDVASAGKKKNFRMEERQRMSQFTNNTNRPPKSDFPSSQKVELPETRQFSDAINENENTPNSVEQFL

SEQ ID NO: 22136 - protein, 95 aa, Diabrotica virgifera
  misc_feature: Coding regions on vcDNA: vcDNA=SeqID_1833; Strand=-; Position=235-522
LSVFQCASSKLSFHRFLGLPTDRLPIGEPSLAVLFVVFRLMWSFRSTLLFFTQLLMLSTLHLRRIICTSILNLQSRGSKKKKKKGGPLLKGTKLY

SEQ ID NO: 22137 - protein, 318 aa, Diabrotica virgifera
  misc_feature: Coding regions on vcDNA: vcDNA=SeqID_1834; Strand=+; Position=1-955
  misc_feature: Homolog annotation: Hit_ID=AAC24982.2; Match level="QueryCoverage =96%, HitCoverage=31%, E-value=2e-23, Identity=26%"; Hit description =reverse transcriptase [synthetic construct]
  misc_feature (84)..(84): Xaa can be any naturally occurring amino acid
  misc_feature (144)..(144): Xaa can be any naturally occurring amino acid
  misc_feature (176)..(176): Xaa can be any naturally occurring amino acid
  misc_feature (228)..(228): Xaa can be any naturally occurring amino acid
DRVTFKDVIHLLYSREVPLGIIKSIENIYQNNTIKVKVEDELTYSIEDGNGIRQGKSLSPLLLNLIMDEIIKNVRTKKGYQIGXKKLKIICYSGDAILISQSEGDLQCMLHQFNITARKFNMLISSKNTECMVLTADPIRCNLXLEGQIIEQVMEFIYLHITLSSYGRLETEVEDXVIRANRTAGCLNDTIWRNKNVGKEIKGRIYKTVIRPIMTYAGETRPDTEETXKLLETAEIKTLRIIDGKTLWDKARSTDIRRRCKVDNINNWVRNRRIEWNDHISRMTTNRVVRTARDGSPIGRRSVGGPRKRWNDNLLEAH

SEQ ID NO: 22138 - protein, 161 aa, Diabrotica virgifera
  misc_feature: Coding regions on vcDNA: vcDNA=SeqID_1835; Strand=-; Position=728-1213
LYLFFQCASSKLSFHRFRGVPTDHLPIGEPSVAVLTTLFVVIRLMWSFHSILLFLTQLLMLSTLHLHRISVLLAVSNRVLPSISRRGFISAVSSNLFVLSVSGRVSAAFVIIGLMTVFVNSAFHFFSDIFISPHCVIQATCGSVCSIHLIFHFCFEPSVAR

SEQ ID NO: 22139 - protein, 216 aa, Diabrotica virgifera
  misc_feature: Coding regions on vcDNA: vcDNA=SeqID_1836; Strand=+; Position=17-666
  misc_feature: Homolog annotation: Hit_ID=AAC24982.2; Match level="QueryCoverage =93%, HitCoverage=20%, E-value=1e-19, Identity=29%"; Hit description =reverse transcriptase [synthetic construct]
  misc_feature (42)..(42): Xaa can be any naturally occurring amino acid
  misc_feature (88)..(88): Xaa can be any naturally occurring amino acid
  misc_feature (103)..(103): Xaa can be any naturally occurring amino acid
LDPIFPLAMRIRQGDSLSPLLFNLIMDEIIKKVRTKKGYQMXEKQLKIICYGDDAILISQSEDDLQRMLHEFNITTRKFNMLISPKKXKCMVYNSTSNKVKIXMLEGQIIEQVMEFKYLGITLCSYGKLETEVEDQANKANRAAGCLNETIWRNKNIGKEVKGRIYKTVIRPIMTYAAETRPDTARTKRMMETAQMKTLRKIDSNPMWIRARRADR

SEQ ID NO: 22140 - protein, 106 aa, Diabrotica virgifera
  misc_feature: Coding regions on vcDNA: vcDNA=SeqID_1837; Strand=+; Position=588-908
ITYTEEEGLETEVEDQVNRANRATGCLNDTIWKNKNIGKEMKGRIYKTVIRPIMTYAAETRPDTERTKRLFETAEMKTLRKIDGKTLWTELEVQKVDNINNWVRNR

SEQ ID NO: 22141 - protein, 120 aa, Diabrotica virgifera
  misc_feature: Coding regions on vcDNA: vcDNA=SeqID_1838; Strand=-; Position=1627 -1989
  misc_feature: Homolog annotation: Hit_ID=CAA10770.1; Match level="QueryCoverage =80%, HitCoverage=28%, E-value=3e-12, Identity=34%"; Hit description =reverse transcriptase-like [Bos taurus]
ENLENTLDNPHHQQKCSEAWTPNITLMNKLEAFELWFYRRILKIPWTTHTTNENVLRRIGTDRQLLKIIKVRKVSYLGHIMRNEKYRLPQLIIQGMIEGKRGPGRRQISWLRNIKDWTGL

SEQ ID NO: 22142 - protein, 115 aa, Diabrotica virgifera
  misc_feature: Coding regions on vcDNA: vcDNA=SeqID_1839; Strand=-; Position=1372 -1719
EFLHGKKKKTLFPFARENFWEIFKISWVLKPFVLIRLWFFKMLGPFFIFFKLFGKKIATAALFFFFSSFLRSRYMCTINAIFHCLTYIVALQHCNIKISCRATFYVISTILTNVV

SEQ ID NO: 22143 - protein, 185 aa, Diabrotica virgifera
  misc_feature: Coding regions on vcDNA: vcDNA=SeqID_1840; Strand=+; Position=1-558
  misc_feature: Homolog annotation: Hit_ID=XP_393381.1; Match level="QueryCoverage =90%, HitCoverage=80%, E-value=2e-81, Identity=81%"; Hit description =similar to Peptidyl-prolyl cis-trans isomerase (PPIase) (Rotamase) (Cyclophilin)
  misc_feature: Gene Ontology Annotation: Molecular function=peptidyl-prolyl cis -trans isomerase activity; Cellular component=extracellular space; Biological process=protein folding
  misc_feature: Pfam annotation: Pfam_ID=Pro_isomerase; Match level="Score=402.2, E -value=6.5e-118, Copies=1"; Pfam description=Cyclophilin type peptidyl-prolyl cis-
GVSSQFVNFLSCTLVRNLSQKMGLPRVYFDMTAENEPVGRIIIELRNDVVPKTAENFRALCTGEKGFGYKGSTFHRVIPNFMCQGGDFTNHNGTGGKSIYGNKFADENFTLKHTGPGVMSMANAGPDTNGSQFFITTVKTSWLDNRHVVFGAVVEGMDVVKKIEALGSQSGKTSKKIVVADCGQL

SEQ ID NO: 22144 - protein, 197 aa, Diabrotica virgifera
  misc_feature: Coding regions on vcDNA: vcDNA=SeqID_1841; Strand=+; Position=3-596
  misc_feature: Homolog annotation: Hit_ID=XP_393381.1; Match level="QueryCoverage =85%, HitCoverage=80%, E-value=3e-81, Identity=81%"; Hit description =similar to Peptidyl-prolyl cis-trans isomerase (PPIase) (Rotamase) (Cyclophilin)
  misc_feature: Gene Ontology Annotation: Molecular function=peptidyl-prolyl cis -trans isomerase activity; Cellular component=extracellular space; Biological process=protein folding
  misc_feature: Pfam annotation: Pfam_ID=Pro_isomerase; Match level="Score=402.2, E -value=6.5e-118, Copies=1"; Pfam description=Cyclophilin type peptidyl-prolyl cis-
RQAGLQSAFAGRGVSSQFVNFLSCTLVRNLSQKMGLPRVYFDMTAENEPVGRIIIELRNDVVPKTAENFRALCTGEKGFGYKGSTFHRVIPNFMCQGGDFTNHNGTGGKSIYGNKFADENFTLKHTGPGVMSMANAGPDTNGSQFFITTVKTSWLDNRHVVFGAVVEGMDVVKKIEALGSQSGKTSKKIVVADCGQL

SEQ ID NO: 22145 - protein, 402 aa, Diabrotica virgifera
  misc_feature: Coding regions on vcDNA: vcDNA=SeqID_1842; Strand=+; Position=44-1252
  misc_feature: Homolog annotation: Hit_ID=XP_318844.1; Match level="QueryCoverage =85%, HitCoverage=96%, E-value=1e-113, Identity=61%"; Hit description= ENSANGP00000022326 [Anopheles gambiae]
  misc_feature: Gene Ontology Annotation: Molecular function=structural constituent of muscle; Cellular component=sarcomere; Biological process=striated muscle contraction
  misc_feature: Pfam annotation: Pfam_ID=GRP; Match level="Score=-9.1, E-value =0.00051, Copies=1"; Pfam description=Glycine rich protein family
MKLLGYSAFCALLLLANAEDKSSATDTKSAESQTKEKRGLSLGYGGGGHDFGGGGDFGGGDYGGHDFGGGYDQGGHHEHHEKTVTVVKKVAVPYPVTKEVPYPVEKTVHVPVKVHVPQPYPVEKKVPYPVKVPVKVTVPIHKPVPVERTVPYPVKVHVDRPYPVKVLVPQPYPVEKHVAVPYKVIVPQPYPVEKEVPYPVKVPVHIPKPYPVEKIVPYPVKVHIDRPYPVHVPKPVPVPVEKKIPYPVFKPVPVPVKVPVERPIPYPVEKPQPYPVKVPVPAPYPVEKNIPYPVEKPVPYPVKIPIFNPVPYTVIKKVPHIVEKPVPVPVKVAIPVPVKEHHHEESSGGHDFGGQDYGGQDFGGHDIGGGQDLGGHDLGGHDFGGGDIGGGDHGDLGGHGYH

SEQ ID NO: 22146 - protein, 138 aa, Diabrotica virgifera
  misc_feature: Coding regions on vcDNA: vcDNA=SeqID_1843; Strand=+; Position=2-415
  misc_feature: Homolog annotation: Hit_ID=XP_393887.1; Match level="QueryCoverage =100%, HitCoverage=17%, E-value=1e-60, Identity=76%"; Hit description= similar to CG6551-PA [Apis mellifera]
  misc_feature: Gene Ontology Annotation: Molecular function=protein serine/threonine kinase activity; Cellular component=cAMP-dependent protein kinase complex; Biological process=smoothened signaling pathway
  misc_feature: Pfam annotation: Pfam_ID=Pkinase; Match level="Score=29.6, E-value =2.2e-10, Copies=1"; Pfam description=Protein kinase domain
LHSNRVLHRDLKPQNILLDMNNTAKLCDFGFARNMSTGTHVLTSIKGTPLYMAPELIDEQPYDYTADLWSLGCIIYELLMGSPPFCTPSILHLIRLIRHEQIQWPTFLSDSCISFLKGLLQKNPTKRLKWDEILDHPF

SEQ ID NO: 22147 - protein, 486 aa, Diabrotica virgifera
  misc_feature: Coding regions on vcDNA: vcDNA=SeqID_1844; Strand=+; Position=730-2189
  misc_feature: Homolog annotation: Hit_ID=XP_308390.1; Match level="QueryCoverage =87%, HitCoverage=97%, E-value=1e-54, Identity=29%"; Hit description =ENSANGP00000009437 [Anopheles gambiae]
  misc_feature: Gene Ontology Annotation: Molecular function=glucose transporter activity; Cellular component=integral to plasma membrane; Biological process=glucose transport
  misc_feature: Pfam annotation: Pfam_ID=Sugar_tr; Match level="Score=147.5, E-value =3.1e-41, Copies=1"; Pfam description=Sugar (and other) transporter
  misc_feature (140)..(140): Xaa can be any naturally occurring amino acid
MTKGTMKTCEKPKNNETESEVGCVWPQIVAILAACLGAFNDGVLYAWTSPFLVKLVNDKEHYDISESEANNMTIVQPLAMVLTGYFFSKLTNLIGRKKTMLLVGVPQVLSLLICAFARSIYVFYVGRVFAGIGSAIIWSXLPAYVGEVASPDVRGVWGNSLTSVIYAGQFFINVAGSYCDILTASCIFSSVSVLFSVVFYFMPESPFFFIMKGDDESAKKSLRFLTRKTNVDKDFSMLKNDVDRQMSETGNWKDLICIKSNRKALTIALFLRITQTFSGNAILTQYNQYIIQKAGGNVSPETASIIFSGLCIVFNIFVISFIVDRFSRKVLYSSSLVLCSMAILALAAYLYFDEFVPNTDLDSVAWLPLTCLITFQIGWSYGLAVIPTLMMGELFSVSIKSKAMLIMMVALGGGISFVNVLFNILNSVLGTFAPFVFFALCSIGAAIVSLYIIPETKGKTLEEIQMDLKASSKDKKKNNIIPAIEA

SEQ ID NO: 22148 - protein, 113 aa, Diabrotica virgifera
  misc_feature: Coding regions on vcDNA: vcDNA=SeqID_1845; Strand=-; Position=3-344
  misc_feature: Homolog annotation: Hit_ID=BAB32292.1; Match level="QueryCoverage =77%, HitCoverage=82%, E-value=1e-19, Identity=50%"; Hit description =unnamed protein product [Mus musculus]
IPIRVGIYVRLKKLIFIFDYILILAYIYIYIYTHIYIYIYTYIHTHIYINTYIHIYIYTLYIHTYIYTYIYIWNNNYLSGHLKKYKKTIFGVKHILTFYFYFFILLACNAWAE

SEQ ID NO: 22149 - protein, 147 aa, Diabrotica virgifera
  misc_feature: Coding regions on vcDNA: vcDNA=SeqID_1846; Strand=+; Position=134-577
IPTRIGIQVLNCNYKTSNTTGAANYFKMSEITLYLWKPKLPCSVGHIAMQFPDGEYISFWPSTCKSITAKGTDAWVSYKEDIGVNKEKREADKILKLPSSIINQEDAINWWNDYLCSSSTNYNLVAVNCATSVFNCLVQGGILSNCA

SEQ ID NO: 22150 - protein, 244 aa, Diabrotica virgifera
  misc_feature: Coding regions on vcDNA: vcDNA=SeqID_1847; Strand=+; Position=21-755
  misc_feature: Homolog annotation: Hit_ID=EAA06947.2; Match level="QueryCoverage =97%, HitCoverage=49%, E-value=1e-87, Identity=67%"; Hit description =ENSANGP00000021359 [Anopheles gambiae str. PEST] ref|XP_559445.1| ENSANGP00000021359 [Anopheles gambiae st
  misc_feature: Gene Ontology Annotation: Biological process=wing morphogenesis
IGQTMTMVLAIKDDDNKFDMLVRNCMAHDGKRAPIQLVDQRGCVTRPKLMSRFTKIKNFGASASVLSYAHFQAFKFPDSMEVHFQCTIQICRYQCPDQCSDSSGQHLHGLLDLVHGPPDTGYGAPPPLPIEAYLHPGRPRDERRSKRALAVDPEKEVGVNRIIRVVSTGDLTFTLDENSNSTTPPTMVFPAKEEINNGGLICMTTPGFAATLVVLLAILIVSCLMSAFLCVKLRPFAENNSQVS

SEQ ID NO: 22151 - protein, 107 aa, Diabrotica virgifera
  misc_feature: Coding regions on vcDNA: vcDNA=SeqID_1848; Strand=+; Position=453-776
DRCLFELFVEFMVVLDFHTQLTLIGPNIFLRTISSKVLISSSNSTVRLFPLALACVSFVVFCLFISSPVSFAPVFNYEYISPIFSVLRDIMLMSSAYTAICIDLFVC

SEQ ID NO: 22152 - protein, 193 aa, Diabrotica virgifera
  misc_feature: Coding regions on vcDNA: vcDNA=SeqID_1849; Strand=+; Position=18-596
  misc_feature: Homolog annotation: Hit_ID=XP_396195.1; Match level="QueryCoverage =78%, HitCoverage=17%, E-value=3e-71, Identity=82%"; Hit description =similar to ENSANGP00000016886 [Apis mellifera]
  misc_feature: Gene Ontology Annotation: Molecular function=helicase activity; Cellular component=nucleus; Biological process=chromatin modeling
MDLFTGFLLILFKNHVLRIVRGTSRILYTVRTQSDESRNGNVFASKDSEITDEDIDSILEKGEMKTAQLAQKMETMGESSLRNFTVETPTESVYQFEGEDYREKQKTIGLSNWIEPPKRERKANYAVDAYFREALRVSEPKAPKAPRPPKQPIVQDFQFFPPRLFELLDQEIYFYRKSLGYKVPKNLELGPDA

SEQ ID NO: 22153 - protein, 184 aa, Diabrotica virgifera
  misc_feature: Coding regions on vcDNA: vcDNA=SeqID_1850; Strand=+; Position=32-586
  misc_feature: Homolog annotation: Hit_ID=AAQ11716.1; Match level="QueryCoverage =91%, HitCoverage=30%, E-value=3e-27, Identity=37%"; Hit description =luciferase [Pyrophorus plagiophthalamus] gb|AAQ11713.1| luciferase [Pyrophorus plagiophthalamus]
MVAEENSFVLYGPKTDIPIPEGLLGNFMYNSLLNTDVNHYCMVDVFTGETRTFRRLLEDSCTLAQALRNFGLKPNTIVSICSENNVRFYEAVLASLYVGATIAPINHVYTEDELRHALTLYQPEIVFCSKTTINKFLNFQKEFSFIKKLIIIYGDEAFGIENIQSFTKRLLRSEIVRPEVVKPL

SEQ ID NO: 22154 - protein, 70 aa, Diabrotica virgifera
  misc_feature: Coding regions on vcDNA: vcDNA=SeqID_1851; Strand=-; Position=0-209
SADITKKRKRHHTKNRLHFPESNEPFTTHRTNGTMVLASECQIQTRALCRQKTSSSLKISCKFFLFSNGR

SEQ ID NO: 22155 - protein, 167 aa, Diabrotica virgifera
  misc_feature: Coding regions on vcDNA: vcDNA=SeqID_1852; Strand=+; Position=585-1088
  misc_feature: Homolog annotation: Hit_ID=AAF90147.1; Match level="QueryCoverage =95%, HitCoverage=68%, E-value=1e-29, Identity=37%"; Hit description =tetraspanin D107 [Manduca sexta]
  misc_feature: Gene Ontology Annotation: Molecular function=signal transducer activity; Cellular component=integral to plasma membrane; Biological process=cell adhesion
  misc_feature: Pfam annotation: Pfam_ID=Tetraspannin; Match level="Score=20.9, E -value=4.5e-07, Copies=1"; Pfam description=Tetraspanin family
QCGAVKESTCMLTTYAIILLTIFILQVAIGVYAFLQIKDKNSFNSVLTKSMQDTFDKIYVSQEANETMMVTQRFLKCCGVRGPEDYDIAGRKPPTSCCRNINVQCPSPNNEVNSEGCVAKLQTELEKGLKIIGGVAIGIAVVEIVGAIFALCLASSIRNSYRRHIYA

SEQ ID NO: 22156 - protein, 244 aa, Diabrotica virgifera
  misc_feature: Coding regions on vcDNA: vcDNA=SeqID_1853; Strand=+; Position=165-899
  misc_feature: Homolog annotation: Hit_ID=AAF90150.1; Match level="QueryCoverage =98%, HitCoverage=98%, E-value=1e-43, Identity=36%"; Hit description =tetraspanin F139 [Apis mellifera]
  misc_feature: Gene Ontology Annotation: Molecular function=signal transducer activity; Cellular component=integral to plasma membrane; Biological process=protein amino acid glycosylation
  misc_feature: Pfam annotation: Pfam_ID=Tetraspannin; Match level="Score=140.9, E -value=2.9e-39, Copies=1"; Pfam description=Tetraspanin family
MGCATGIVKYLVFLANLLFALAGLALIIIGILIKLNVSEATNVLPKDFGLAPILSIIIGSIVFITAFLGCCGAVKESTCMLTTYAIILLTIFILQVAIGVYAFLQIKDKNSFNSVLTKSMQDTFDKIYVSQEANETMMVTQRFFKCCGVRGAEDYGDTPVPPSCCNDINYPCPVTNLQIGDHSYLYNSINDRGCVEALKIQWDIIARILLLSLGCVAIVEIVGVICSFILARSAKNGYRRHMYA

SEQ ID NO: 22157 - protein, 44 aa, Diabrotica virgifera
  misc_feature: Coding regions on vcDNA: vcDNA=SeqID_1854; Strand=-; Position=1052 -1186
  misc_feature: Homolog annotation: Hit_ID=ZP_00357698.1; Match level="QueryCoverage =93%, HitCoverage=22%, E-value=6e-11, Identity=79%"; Hit description =hypothetical protein Chlo02002738 [Chloroflexus aurantiacus]
ERALFFFFFFFFFFFFFFFFFFFFFFFFFFSIGSFTLFIQFIKC

SEQ ID NO: 22158 - protein, 236 aa, Diabrotica virgifera
  misc_feature: Coding regions on vcDNA: vcDNA=SeqID_1855; Strand=+; Position=375-1085
  misc_feature: Homolog annotation: Hit_ID=AAF90147.1; Match level="QueryCoverage =97%, HitCoverage=97%, E-value=6e-46, Identity=38%"; Hit description =tetraspanin D107 [Manduca sexta]
  misc_feature: Gene Ontology Annotation: Molecular function=signal transducer activity; Cellular component=integral to plasma membrane; Biological process=cell adhesion
  misc_feature: Pfam annotation: Pfam_ID=Tetraspannin; Match level="Score=180.9, E -value=2.7e-51, Copies=1"; Pfam description=Tetraspanin family
MGCATGIVKYLVFLANLLFALAGLALIIIGILIKLNVSEATNVLPKDFGLAPILSIIIGSIVFITAFLGCCGAVKESTCMLTTYAIILLTIFILQVAIGVYAFLQIKDKNSFNSVLTKSMQDTFDKIYVSQEANETMMVTQRFLKCCGVRGPEDYDIAGRKPPTSCCRNINVQCPSPNNEVNSEGCVAKLQTELEKDSKIIGGVAIGIAVVEIVGAIFALCLASSIRNSYRRHIYA

SEQ ID NO: 22159 - protein, 365 aa, Diabrotica virgifera
  misc_feature: Coding regions on vcDNA: vcDNA=SeqID_1856; Strand=+; Position=166-1262
  misc_feature: Homolog annotation: Hit_ID=EAA12403.2; Match level="QueryCoverage =96%, HitCoverage=53%, E-value=1e-111, Identity=54%"; Hit description= ENSANGP00000011857 [Anopheles gambiae str. PEST] ref|XP_555470.1| ENSANGP00000011857 [Anopheles gambiae s
  misc_feature: Gene Ontology Annotation: Molecular function=molecular_function unknown; Cellular component=membrane; Biological process=G-protein coupled receptor protein signaling pathway
  misc_feature: Pfam annotation: Pfam_ID=Ras; Match level="Score=-73.5, E-value =0.00078, Copies=1"; Pfam description=Ras family
  misc_feature (342)..(342): Xaa can be any naturally occurring amino acid
NSLKVPTGSTTELSFKGQQFLTHLFERFDKDRDKALSPSEYEELFSTCPTPAWGPDVSSMVPTNEKGWITYQGYMCQWALMTLVDLPTTFEYLAYLGYNIYENETQVTAVQVTRDKKTDLAKKQSSRNVYQCHVIGPSASGKSTFCRSFIKSILESNPLQPEKTGVPNCTVNVIQVYGQEKIMVLRDINVRNVSDPLLPAEVQCDVACLVYDQNNPKSFEYIARIYIKYFAESKIPVLVVACKDDLEEVRQDYMLQPQSFCQKYKILPPQKFSAKGHNRKDVFIKLATMAAFPPLRRMVHALLVRPQPTEWLDHFCRNFREFGVMAADSTVWWKAGISLAAXTAIGFILAKSMHTADKQDKLCNI

SEQ ID NO: 22160 - protein, 75 aa, Diabrotica virgifera
  misc_feature: Coding regions on vcDNA: vcDNA=SeqID_1857; Strand=-; Position=155-382
SIVMKSSHGQHLDRMEDFQNMEAQTRKIIRFTRYSNSVAARDLSIRVGDTIRVYNIICTYLYRHEGVKNGPMPIA

SEQ ID NO: 22161 - protein, 262 aa, Diabrotica virgifera
  misc_feature: Coding regions on vcDNA: vcDNA=SeqID_1858; Strand=+; Position=51-839
  misc_feature: Homolog annotation: Hit_ID=XP_393076.1; Match level="QueryCoverage =100%, HitCoverage=60%, E-value=1e-85, Identity=57%"; Hit description= similar to ENSANGP00000018341 [Apis mellifera]
  misc_feature: Gene Ontology Annotation: Molecular function=molecular_function unknown; Cellular component=Golgi apparatus; Biological process=cell organization and biogenesis
  misc_feature: Pfam annotation: Pfam_ID=GRASP55_65; Match level="Score=200.1, E -value=4.4e-57, Copies=1"; Pfam description=GRASP55/65 family
MGNSESVDVPGGGTDGYHVLKVQENSPASLAGLQPFFDFIISINGTRLDRENDTLRTILKNGVGKQLPLTIYSYKTQSVRTVTVVPSDTWGGQGYLGVSIKFCSFDVAKEIVWHILEVHPNSPASLANLRPFSDYIIGADSILHESEDLYNLIENHDGVPLKFYVYNSDDDTCRDVTITPNSKWGGDGMLGCGIGYGYLHRIPVRGSAIQPPPTTTIFNQVPTISPSNDQSVSPATTQPITTLIQKTENFEFRANWTSSPRN

SEQ ID NO: 22162 - protein, 143 aa, Diabrotica virgifera
  misc_feature: Coding regions on vcDNA: vcDNA=SeqID_1859; Strand=+; Position=1-429
NHKSAHASGEMPMDIMRKKLGINLLVRLYEKKASLISKIHQLFIADLTEKYWIKKKTLNMVDLYSEMTIYDKQLYKYDINPNYNIDFNSMEQVQVYFLRDYSKLPISLRKLVFISDSSQMFKDYCMLYTDASKNIECVGCAYW

SEQ ID NO: 22163 - protein, 235 aa, Diabrotica virgifera
  misc_feature: Coding regions on vcDNA: vcDNA=SeqID_1860; Strand=+; Position=3-710
  misc_feature: Homolog annotation: Hit_ID=XP_317854.1; Match level="QueryCoverage =94%, HitCoverage=24%, E-value=1e-55, Identity=46%"; Hit description =ENSANGP00000014393 [Anopheles gambiae]
FQIEGNLGASPTVISMLTKMHKILKDENGLELQAEYCNLWPATVSNANSYNIVAVNELLLEVITHGLNQYPNNVAWLRLMGDINFANGHYQISLSYYLKSLLVFHDYFNTPIGYDDHVFRRMIKCCTTLGANTQAAVLCQFLEETDYMLAFRILSEQKTCNDAVDAYYHCFWDTSILEYLIYTHNKKGEFQRRKIAIQVIGMLELNSSNNGEIQREASNLRKSTFLRALCKQYVF

SEQ ID NO: 22164 - protein, 89 aa, Diabrotica virgifera
  misc_feature: Coding regions on vcDNA: vcDNA=SeqID_1861; Strand=+; Position=193-459
  misc_feature: Homolog annotation: Hit_ID=AAF61412.1; Match level="QueryCoverage =96%, HitCoverage=17%, E-value=2e-27, Identity=64%"; Hit description =suppressor of fused [Mus musculus] ref|NP_056567.1| suppressor of fused homolog [Mus musculus]
MDEASGLPHGPPMNILPPTPAGLESLYSLCRKIYPDQVNPLQVTALLKFWLGGPDPLDYISMYANPGIPHENIPPHWHYISFGLSDLHG

SEQ ID NO: 22165 - protein, 276 aa, Diabrotica virgifera
  misc_feature: Coding regions on vcDNA: vcDNA=SeqID_1862; Strand=+; Position=117-943
  misc_feature: Homolog annotation: Hit_ID=NP_523968.1; Match level="QueryCoverage =100%, HitCoverage=66%, E-value=1e-144, Identity=87%"; Hit description=CG7558-PA [Drosophila melanogaster] gb|AAF50488.1| CG7558-PA [Drosophila melanogaster]
  misc_feature: Gene Ontology Annotation: Molecular function=actin cross-linking activity; Cellular component=cytoskeleton; Biological process=cell cycle dependent actin filament reorganization
  misc_feature: Pfam annotation: Pfam_ID=Actin; Match level="Score=63.2, E-value=7.4e- 16, Copies=1"; Pfam description=Actin
  misc_feature (268)..(268): Xaa can be any naturally occurring amino acid
MDGKLPACVIDVGTGYTKLGFAANKEPQFIIPSAIAIKETAKVGDTTSRRLNKGVEDLDFFIGDEAFDATGYAVKYPVRHGLVEDWDLMEKFLEQCIFKYLRAEPEDHYFLLTEPPLNTPENREYIAEIMFESFNVPGLYIAVQAVLALAASWASRSIEERTLTGIVIDSGDGVTHVIPVAEGYVIGSCIKHIPIAGRNITYFIQSLLREREIGIPPEQSLETAKAIKEKYCYICPDIAKEFSKYDTDPAKWMKKYEGVNSVTNNPFXVDVGYERF

SEQ ID NO: 22166 - protein, 184 aa, Diabrotica virgifera
  misc_feature: Coding regions on vcDNA: vcDNA=SeqID_1863; Strand=+; Position=2-556
LVHTSIAMKYLYYVYFFCTLSCYVSAEDVLLGTDLCECNECLKPILDQLGGSNVTIQKIEALIQRLRKDVVTITVILNGTCEKIEGIQEDIKNLDAVLDVNVELVNQENLIIHDIDVRVRELGLEGQELDDMIDSNNGTINDIETIVDELQTCACAVTTPVGSGTPTTTPYYFNHTYYVKIKAR

SEQ ID NO: 22167 - protein, 174 aa, Diabrotica virgifera
  misc_feature: Coding regions on vcDNA: vcDNA=SeqID_1864; Strand=+; Position=203-728
  misc_feature: Homolog annotation: Hit_ID=AAH88447.1; Match level="QueryCoverage =90%, HitCoverage=36%, E-value=1e-22, Identity=35%"; Hit description =Unknown (protein for MGC:95091) [Rattus norvegicus]
  misc_feature: Gene Ontology Annotation: Cellular component=nuclear origin of replication recognition complex; Biological process=DNA replication
  misc_feature (108)..(108): Xaa can be any naturally occurring amino acid
MAHNLSNLRQFLPCRDIQIELLYNLFAYKDEPQIESVYVYGGPSSGKSIVVTSTLEHLGINHAIVNIIECYSSKILFETILNKISGHQLDPKNPVPYARCDNMMDFLXTWRNGTRKIILTGLFLVLDNADELRNMEHNLLPCFLRLKQLTGISLLLVMISENPVLKNIYTEITR

SEQ ID NO: 22168 - protein, 194 aa, Diabrotica virgifera
  misc_feature: Coding regions on vcDNA: vcDNA=SeqID_1865; Strand=+; Position=258-842
  misc_feature: Homolog annotation: Hit_ID=EAA13083.2; Match level="QueryCoverage =98%, HitCoverage=98%, E-value=1e-75, Identity=69%"; Hit description =ENSANGP00000014483 [Anopheles gambiae str. PEST] ref|XP_554741.1| ENSANGP00000014483 [Anopheles gambiae st
  misc_feature: Gene Ontology Annotation: Molecular function=protein tyrosine phosphatase activity; Cellular component=transcription factor complex; Biological process=cell cycle
  misc_feature: Pfam annotation: Pfam_ID=Ssu72; Match level="Score=409.0, E-value=6e -120, Copies=1"; Pfam description=Ssu72-like protein
MYISDLRIAVICSSNMNRSMEAHAFLAKKGFDVKSYGTGDKVKIPGSSFDKPNVYEFGTSYEEIYLDLLKKDKSLYTQNGLLHTLDRNRRIKTHPEKFQETPEKFEILITCEERVYDQVLEYMENKTPTENSIVHVVNIDIQDNLEEATIGAFLITDLCLMIARAEDLDNEIEEVLHNFEEKSNRSILHSIVFN

SEQ ID NO: 22169 - protein, 304 aa, Diabrotica virgifera
  misc_feature: Coding regions on vcDNA: vcDNA=SeqID_1866; Strand=+; Position=72-983
  misc_feature: Homolog annotation: Hit_ID=AAC79868.1; Match level="QueryCoverage =95%, HitCoverage=41%, E-value=2e-09, Identity=24%"; Hit description =fimbriae-associated protein Fap1 [Streptococcus parasanguinis] pir||T17451 fimbriae-associated protein Fap
MNRRPIYLSEDALLETPQVHKYSNISLEIEKEDFEETRHVFSSPFLNNSSNEISTSVASRDISYSGFETDQTNVSAEVPVCKKIVVDKASVQNTKTMYSSPDLNDIKREIIRDMHHTKNSAFNNITNTLSSEQKKKLTLVFSKDGKENFFSVKRKYPSLTPDKSINDSTGSFLLPTPKKFDNNSKIESEHESINETTSFTSSSELSESVRSESFSQGNELAESYMQESLSVILENESNFTQDISSNNVTESESVCFDYSMSESKSEKLVENVKSGIIEEGNHGRDHVTENVGLQTCEPISEVNR

SEQ ID NO: 22170 - protein, 177 aa, Diabrotica virgifera
  misc_feature: Coding regions on vcDNA: vcDNA=SeqID_1867; Strand=+; Position=77-610
  misc_feature: Homolog annotation: Hit_ID=NP_728587.1; Match level="QueryCoverage =69%, HitCoverage=66%, E-value=2e-24, Identity=40%"; Hit description =CG9134-PC, isoform C [Drosophila melanogaster] ref|NP_728586.1| CG9134-PA, isoform A [Drosophila
  misc_feature: Pfam annotation: Pfam_ID=Lectin_C; Match level="Score=85.8, E-value =1.1e-22, Copies=1"; Pfam description=Lectin C-type domain
MNCKIVLIWFACYICSVNLQKPSESAFVSPILQTNRRGPNWITHKGKTYYINNVFRTNFYRALQFCRQQGMHLLSLKNQEESDLIKNHIEANAGFKHRGYFTSGVNLVGDDQWIWLSTGLDVTYTNWYPGEPSGRSGSNVTENCMEIREWGGFTWNDLNCLLEAYFICESARECQRV

SEQ ID NO: 22171 - protein, 208 aa, Diabrotica virgifera
  misc_feature: Coding regions on vcDNA: vcDNA=SeqID_1868; Strand=+; Position=160-786
  misc_feature: Homolog annotation: Hit_ID=EAL29380.1; Match level="QueryCoverage =74%, HitCoverage=35%, E-value=8e-19, Identity=35%"; Hit description =GA10397-PA [Drosophila pseudoobscura]
MEESTSRNLTSVDKSFVYKLPRKLVRIEYPGLVKNVSNAIETLGGIDSIETAIVDERKKLELRFHPDNKYNKPCTSDRYDNPSLLIKVKEKDGQYDYEIIGYTATNFKFNRTVDFQYLPIVQDDKTGSTEFIYYDIMPKKLADLEYFTSKEAVNQPLFLLPHNFCRYDITHPTLYFEANEKFNLNVPSANTNTMFKMFQPKKKEQSVI

SEQ ID NO: 22172 - protein, 60 aa, Diabrotica virgifera
  misc_feature: Coding regions on vcDNA: vcDNA=SeqID_1869; Strand=-; Position=52-234
SFFRSSVSKFGLLFLLIQLLLHVVFRTYENFSKNSRNDCKTFPMGLLWWDFVFYDNYHYF

SEQ ID NO: 22173 - protein, 248 aa, Diabrotica virgifera
  misc_feature: Coding regions on vcDNA: vcDNA=SeqID_1870; Strand=+; Position=206-949
KLTTGKMDPWDYFQKFQAQNSESENPSQQGAGVKKQRKRPPPGERRKAIIEKVLAANSALLSETEKKVVGSIFSQSDGQSTTCIRDPFKRTNFANSAILRKDPDIREWSEIYGKASRTYDDKDRNRKARYEEDRNGRYCSGTKQPETMAESFSRKESNMYRRTSPLGYDRASNSYGQIPSREMNTFGGERSQVHRDTRGRSPFTSERSQQHRADRRRSPEGIGKNDIRRETHGRSPPTSERSRFGHET

SEQ ID NO: 22174 - protein, 113 aa, Diabrotica virgifera
  misc_feature: Coding regions on vcDNA: vcDNA=SeqID_1871; Strand=+; Position=2-343
  misc_feature: Homolog annotation: Hit_ID=EAL39070.1; Match level="QueryCoverage =79%, HitCoverage=68%, E-value=9e-34, Identity=74%"; Hit description =ENSANGP00000027614 [Anopheles gambiae str. PEST] ref|XP_553145.1| ENSANGP00000027614 [Anopheles gambiae st
RRAAYGQRFPWRVLVSGLKTDDIEQLKRFASGGYCDDSTIVYMVHPCVILSALEVLGYRVVASSSTSVKQDYNEYMWTMRKDFSEPEPISEEKLPEFKIDHKLENKLSPSEEI

SEQ ID NO: 22175 - protein, 255 aa, Diabrotica virgifera
  misc_feature: Coding regions on vcDNA: vcDNA=SeqID_1872; Strand=+; Position=155-919
  misc_feature: Homolog annotation: Hit_ID=XP_315556.1; Match level="QueryCoverage =94%, HitCoverage=38%, E-value=4e-32, Identity=30%"; Hit description =ENSANGP00000007196 [Anopheles gambiae]
  misc_feature: Pfam annotation: Pfam_ID=zf-A20; Match level="Score=43.1, E-value =8.3e-10, Copies=1"; Pfam description=A20-like zinc finger
MYATKQPSLRIKQADLKCKSGCGFYGNADWNGYCSACYRNHMDIERQKKTTDQSRSQVPGFSKFEEKKRQQTDKKNKYLKSLPVFRKSSNVKDAGRPEKYIDIMRQTNPDANKLMVEFISMYSQWGELVRKDFFKFSQVFSNKIVNELDVKPIEELAEIAQNHYNLYHNRVNSNVIYQDVPSEVREKLVEFFEKYSMISLYSFLFCPPTTNDEEKDLIIQDRIPQLSWDNAHHLDCCISETSIEVRDLVYTGHHD

SEQ ID NO: 22176 - protein, 137 aa, Diabrotica virgifera
  misc_feature: Coding regions on vcDNA: vcDNA=SeqID_1873; Strand=+; Position=108-518
  misc_feature: Homolog annotation: Hit_ID=XP_395378.1; Match level="QueryCoverage =100%, HitCoverage=38%, E-value=5e-31, Identity=50%"; Hit description= similar to ENSANGP00000011414 [Apis mellifera]
  misc_feature: Gene Ontology Annotation: Molecular function=Ran GTPase activator activity; Biological process=signal transduction
  misc_feature (104)..(104): Xaa can be any naturally occurring amino acid
MSAFNVDSIAASLENARVSDSGVSFAGKSLKLNTEEDAKQVTKEIDGCSNLQFLNMEGNTLGVDASKEIAKSLEKHPEFRRALWKDMFTGRMKTEIPKALQYLXDGLIKVGTRLTELDLADIAFVTIAEKNLFSLTT

SEQ ID NO: 22177 - protein, 240 aa, Diabrotica virgifera
  misc_feature: Coding regions on vcDNA: vcDNA=SeqID_1874; Strand=+; Position=1-723
  misc_feature: Homolog annotation: Hit_ID=AAH83267.1; Match level="QueryCoverage =81%, HitCoverage=73%, E-value=5e-28, Identity=37%"; Hit description =Interferon gamma inducible protein 30 [Danio rerio] ref|NP _001006057.1| interferon gamma inducible protein
  misc_feature: Gene Ontology Annotation: Biological process=regulation of protein activity, epigenetic
  misc_feature: Pfam annotation: Pfam_ID=GILT; Match level="Score=94.5, E-value=2.7e -25, Copies=1"; Pfam description=Gamma interferon inducible lysosomal
VRNRRPPRVRFVSKLVLFFAATVCVSSSVQGADLTLTLFYEGLCPGCHQFILTQLYPSYAKLADSLKLDFVPYGWSDSSRSADGKVTFECQHGDEECYINRIHACVLDQNPSSLDYVTFIYQHLSKTDERDRNERQELELAQSLLPSSLSWDSVSDCYHGERGTELLLGYEKRQAELNPVLPWVPNIRFNGVYDEDVEDQAMMDLTATVCNLLKDNKPDVCKDHATKAHPKMLKNNKCEK

SEQ ID NO: 22178 - protein, 241 aa, Diabrotica virgifera
  misc_feature: Coding regions on vcDNA: vcDNA=SeqID_1875; Strand=+; Position=918-1643
  misc_feature: Homolog annotation: Hit_ID=AAH83267.1; Match level="QueryCoverage =80%, HitCoverage=73%, E-value=4e-29, Identity=37%"; Hit description =Interferon gamma inducible protein 30 [Danio rerio] ref|NP _001006057.1| interferon gamma inducible protein
  misc_feature: Gene Ontology Annotation: Biological process=regulation of protein activity, epigenetic
  misc_feature: Pfam annotation: Pfam_ID=GILT; Match level="Score=97.9, E-value=2.5e -26, Copies=1"; Pfam description=Gamma interferon inducible lysosomal
FYYSIYNIKPSMFVSKLVLFFAATVCVSSSVQGADLTLTLFYEGLCPGCHQFILTQLYPSYAKLADSLKLDLVPFGWSESSRSADGKVTFTCQHGDEECYINRIHACVLDQNPSSLDFVTFIYQHLSKTDERDRNEREELELAQSLLPSSLSWDKVSDCYHGDRGTELLLSYEDRQSKLNPELPWVPNIRFNGVYDADIEDQAFTDLTSVVCNLLKDNKPDVCKDHVTNVHPKMIKNIKKC

SEQ ID NO: 22179 - protein, 198 aa, Diabrotica virgifera
  misc_feature: Coding regions on vcDNA: vcDNA=SeqID_1876; Strand=+; Position=234-827
  misc_feature: Homolog annotation: Hit_ID=XP_394022.1; Match level="QueryCoverage =83%, HitCoverage=47%, E-value=4e-56, Identity=63%"; Hit description =similar to ENSANGP00000021441 [Apis mellifera]
MRKINNLTAMSLHLNCLALLLCVTASTAIATIIPSSTIAPEVASDVRVQCNNDQIVINIGTISGRFNGMVYPRGLSKNSSCLGEWIETKTPIEYTLPLRGCNTMSTDLDDGGIEYYNTIVVQPHLKLVTNQGRGFHIRCRYSTRNNTVMNDSLKVDLMRADPIQALSPMPGCNMKIFSGDPAMKEVAENVKIGDPLTL

SEQ ID NO: 22180 - protein, 247 aa, Diabrotica virgifera
  misc_feature: Coding regions on vcDNA: vcDNA=SeqID_1877; Strand=+; Position=69-811
  misc_feature: Homolog annotation: Hit_ID=XP_217740.2; Match level="QueryCoverage =95%, HitCoverage=25%, E-value=3e-41, Identity=42%"; Hit description =similar to hypothetical protein FLJ13441 [Rattus norvegicus]
  misc_feature: Gene Ontology Annotation: Molecular function=molecular_function unknown; Cellular component=nucleus; Biological process=biological _process unknown
  misc_feature: Pfam annotation: Pfam_ID=Bromodomain; Match level="Score=108.2, E -value=2.1e-29, Copies=1"; Pfam description=Bromodomain
  misc_feature (150)..(150): Xaa can be any naturally occurring amino acid
  misc_feature (235)..(235): Xaa can be any naturally occurring amino acid
  misc_feature (240)..(240): Xaa can be any naturally occurring amino acid
MSSPVMSPTPPQKKHKKHKSEKREKEDKPGLKLILKVGSQTTPEHNPEFGPSLPLVGEGLEEQMQIDPNDPYFGLARAHHKKSKKKKKKKDKNKDREKRHKHHHKDKKRKREETEENNEDITIYPQIGSPGREQRTCVIKKLQERTPLSXGLDHLLSQLEKKDPQNFFAWPVTDNIAPGYSTIISNPMDFSTMRQKIEENQYAHLDQFIEDFKLMCTNAMKYNHVDTVYYKASKXLLQAXLKIMVPE

SEQ ID NO: 22181 - protein, 521 aa, Diabrotica virgifera
  misc_feature: Coding regions on vcDNA: vcDNA=SeqID_1878; Strand=+; Position=22-1587
  misc_feature: Homolog annotation: Hit_ID=XP_313698.1; Match level="QueryCoverage =82%, HitCoverage=97%, E-value=1e-131, Identity=51%"; Hit description= ENSANGP00000003768 [Anopheles gambiae]
  misc_feature: Gene Ontology Annotation: Molecular function=molecular_function unknown; Cellular component=cellular_component unknown; Biological process=biological_process unknown
  misc_feature: Pfam annotation: Pfam_ID=TTL; Match level="Score=179.5, E-value=6.9e -51, Copies=1"; Pfam description=Tubulin-tyrosine ligase family
MNLVEEESKGAKPSRPPPKPLIETAIGQWTILSVVLGAVAVLTVIAITADECRKCFDKASNLQPLEKIQKAYWAYGKDVDGGHLKEVFTILDRLGYKKDDNYSEWDLLWAHDYPFTELRSQLDNLKPHQKVNHLPGIGHITNKVTLATSGLNYIPPAFKLPVDKDKLLEYSQKFTNVSFVQKNNDHREVKIKKIFDVNLDEEGTFLQEYVDKPLLVSGHRFDIGIYTIITSVEPLRVYIYNGEGLLRFCPEKYHPFDPENLDKYVVGDDYLPVWKIPALDYYYNELGFGMRDSLNAYLKSLGKDPSTIWNQIEDAIRTVVLAKEAAIVDVLQRYTSKRNFFELMRFDFLVDENLKIYLLEANMSPNLSSAHFTPNRLLYQQVLYNVLGLVGVGESIYRSSLAVRSKSEEDMVVSDKTLAVYPNVCNSHTCRSSCMALEWQLCKTWITTETPQYLVTAGKEHLPKGDWKRIFPPPMDPEEACTGINVDQYSPENQLQYKWFRESVFRRLLVLFFRVHSRIEK

SEQ ID NO: 22182 - protein, 120 aa, Diabrotica virgifera
  misc_feature: Coding regions on vcDNA: vcDNA=SeqID_1879; Strand=+; Position=153-512
  misc_feature: Homolog annotation: Hit_ID=EAL44090.1; Match level="QueryCoverage =96%, HitCoverage=69%, E-value=2e-15, Identity=42%"; Hit description =hypothetical protein 298.t00006 [Entamoeba histolytica HM-1:IMSS]
  misc_feature (118)..(118): Xaa can be any naturally occurring amino acid
MDTQNVDESATSPTAESPKTEKPESTESTEAATVLNGEASKDEIASEAPKTEAATPVEEEPKKEEPVVDEPAKEEAKEEPKIEEPKAEEPKPVEEAESPKVPEPVTESAPSPPEQEEXRY

SEQ ID NO: 22183 - protein, 181 aa, Diabrotica virgifera
  misc_feature: Coding regions on vcDNA: vcDNA=SeqID_1880; Strand=+; Position=98-640
  misc_feature: Homolog annotation: Hit_ID=EAA00389.2; Match level="QueryCoverage =100%, HitCoverage=69%, E-value=1e-91, Identity=89%"; Hit description= ENSANGP00000020093 [Anopheles gambiae str. PEST] ref|XP_551884.1| ENSANGP00000020093 [Anopheles gambiae s
  misc_feature: Gene Ontology Annotation: Molecular function=molecular_function unknown; Cellular component=cellular_component unknown; Biological process=embryogenesis and morphogenesis
  misc_feature: Pfam annotation: Pfam_ID=DUF572; Match level="Score=268.7, E-value =9.8e-78, Copies=1"; Pfam description=Family of unknown function (DUF572)
MSERKVLNKYYPPDFDPSKIPRMKLPKNRQYTVRLMAPFNMRCATCGEYIYKGKKFNARKEDVENQDYLGIRIYRFYIKCTRCLQEISFKTDPKNTDYEIEAGATRNFMALKLAEEQALREEEEAKEEEANNPMKLLENRTQQSKNEIELLESLEELKDLNKRQQVVDYDTMLSAYDTTIS

SEQ ID NO: 22184 - protein, 268 aa, Diabrotica virgifera
  misc_feature: Coding regions on vcDNA: vcDNA=SeqID_1881; Strand=+; Position=279-1082
  misc_feature: Homolog annotation: Hit_ID=XP_310200.1; Match level="QueryCoverage =100%, HitCoverage=81%, E-value=2e-77, Identity=41%"; Hit description= ENSANGP00000010968 [Anopheles gambiae]
  misc_feature: Gene Ontology Annotation: Molecular function=RNA polymerase II transcription factor activity; Cellular component=nuclear chromatin; Biological process=regulation of transcription from Pol II promoter
  misc_feature: Pfam annotation: Pfam_ID=Kelch_2; Match level="Score=123.5, E-value =5.2e-34, Copies=5"; Pfam description=Kelch motif
  misc_feature (244)..(244): Xaa can be any naturally occurring amino acid
MPWITCLEGGPKRVNHAAVAVGHKIYSFGGYCTGENSREYTSMDVHVLNTTTLRWTQHPVSDLPYFENDDILPYKRYGHTAIVYGEKVYIWGGRNDRASCSTLFCFDTVWHCWTAPKTTGHFPPARDGHTACLWKHYMIIYGGYEEHSDAFARIIYYLDLDTMHWTYVPIGGPEPTPRDFHTTVVINDRMYLFGGRGTLHDHFVGGRQVLYCNELWYLDLNTFTWHHCKVTGTVPVGRRSHSAXVYDEKMYIFGGYNSEKDRHYYNIY

SEQ ID NO: 22185 - protein, 265 aa, Diabrotica virgifera
  misc_feature: Coding regions on vcDNA: vcDNA=SeqID_1882; Strand=+; Position=184-979
  misc_feature: Homolog annotation: Hit_ID=XP_309066.1; Match level="QueryCoverage =97%, HitCoverage=55%, E-value=3e-63, Identity=43%"; Hit description =ENSANGP00000019574 [Anopheles gambiae]
  misc_feature: Gene Ontology Annotation: Molecular function=zinc ion binding; Cellular component=extracellular space; Biological process =nucleotide metabolism
  misc_feature: Pfam annotation: Pfam_ID=Amidohydro_1; Match level="Score=5.1, E -value=0.00014, Copies=1"; Pfam description=Amidohydrolase family
  misc_feature (249)..(249): Xaa can be any naturally occurring amino acid
MRTDNVQVIVGNIIHCSDQFNVQLIDNGFIIIAGSKILAIGTESDLSETVTRLKLKNFSTRLLKKSQILIPGLVDTHIHAPQYPNCGLGYDMPLLDWLNNYTYKLERQYKDLEFSKRVYTTLVQKTLSHGTTTACYFGCLFNNSTNILVDTVIEHRQRALIGKINMTHLAPEDYIETPEESISNTKEFINYVLSKQSNLVKPIITPRFALSVDMALMKEFGVLAKYHNLHIQTHISENVDEVALVPSQXMNYAKVYDQANLLTEK

SEQ ID NO: 22186 - protein, 306 aa, Diabrotica virgifera
  misc_feature: Coding regions on vcDNA: vcDNA=SeqID_1883; Strand=+; Position=51-968
  misc_feature: Homolog annotation: Hit_ID=XP_320261.1; Match level="QueryCoverage =42%, HitCoverage=56%, E-value=2e-16, Identity=34%"; Hit description =ENSANGP00000025087 [Anopheles gambiae]
MFLKVLIAFHAAAALVSMSQAVPSDIPESPLASPCPETFTYGTIDKPGYWTGNLILRPDHDISGVWVRLIFDKEVEKVTLNSEEFIIKLSEDSKMVKLQSPDMLLKADNPKLLEVTVNYKGSAVPSLQEYRLNARTICPQKNHNRHDVFLGDANADYFLSSIQHKPESPNIPFECGVSYPSNQYPWQASIHLHFAKEKRYACEALLISSEYLLTSAHCVTFINDTEIIPRAFVKVHLGSDKESKDQHYIREIFVHPGYRAGSIIDDIAVIKLLDYVDVNKVYRPLCLDNENADIDKLVITGFRMEK

SEQ ID NO: 22187 - protein, 390 aa, Diabrotica virgifera
  misc_feature: Coding regions on vcDNA: vcDNA=SeqID_1884; Strand=+; Position=3-1175
  misc_feature: Homolog annotation: Hit_ID=AAC64004.1; Match level="QueryCoverage =93%, HitCoverage=94%, E-value=7e-70, Identity=40%"; Hit description =prophenol oxidase activating enzyme precursor [Manduca sexta]
  misc_feature: Gene Ontology Annotation: Molecular function=serine-type endopeptidase activity; Cellular component=extracellular; Biological process=Tl signaling pathway
  misc_feature: Pfam annotation: Pfam_ID=Trypsin; Match level="Score=213.4, E-value =4.4e-61, Copies=1"; Pfam description=Trypsin
VSEQLCFEHFCTVFLTASRQKRNVASTCTTPNGELATCASIYDCRHFAKAIRNRIPSQLNFVKKSQCGYDTSPLVCCGSAIEFSTTTNPPSDPVGNSNPVGRVLPAAFTRSSALPDRSTCGFQKSDENEKVEGLIYGGVETELKDFPWMALLGYRTRYGTTKWACGGTLISHRYILTAAHCVTGEVSTSVGQLTYVKLGEHDKTKERDCDKNGNCNEKPVITGIERVMFHEKYDATDRTSPNDIAVLRLNQRITYTDFIRPICLPEPNEGSTIDDYLTTAGWGLTEHDATNVKLKVDLPFRTRDDWLTAFRSARLRLTEAQICAGGEDGKDSCKGDSGGPLMKRSNENYLQWYQEGIVSFGNEDCGTAGLPGIYTKVSKFVSWIHSRVKE

SEQ ID NO: 22188 - protein, 48 aa, Diabrotica virgifera
  misc_feature: Coding regions on vcDNA: vcDNA=SeqID_1885; Strand=+; Position=32-178
AFRHNPTDGSFAPLPARVINGVTNTTSTFFYIYRCKIFKWLLKNNGLR

SEQ ID NO: 22189 - protein, 58 aa, Diabrotica virgifera
  misc_feature: Coding regions on vcDNA: vcDNA=SeqID_1886; Strand=-; Position=893-1069
  misc_feature: Homolog annotation: Hit_ID=XP_453849.1; Match level="QueryCoverage =84%, HitCoverage=100%, E-value=8e-19, Identity=87%"; Hit description= unnamed protein product [Kluyveromyces lactis] emb|CAH00945.1| unnamed protein product
  misc_feature (40)..(40): Xaa can be any naturally occurring amino acid
GSQIPRHLISDAHEWINEIPTVPTHYLAKPLPRERAWKNXRGKKTLLSLTLVWHCKET

SEQ ID NO: 22190 - protein, 70 aa, Diabrotica virgifera
  misc_feature: Coding regions on vcDNA: vcDNA=SeqID_1887; Strand=-; Position=1042 -1254
FLSFDMFYVSDLLKCPTYLSDKHFFIYYIKFAVFFLCSTTELYSLCFDRLQDFSYILTNLMDQVTYTKIL

SEQ ID NO: 22191 - protein, 118 aa, Diabrotica virgifera
  misc_feature: Coding regions on vcDNA: vcDNA=SeqID_1888; Strand=-; Position=674-1030
QKVPRVLKIGTLINSCLSKNSIECVLSRSRITKLFKVLRKYMNYKFSIRINYLYGKQATIKMKKITSSTLRRPNRVPLPKYKTLLKQTKVLLLSKKILLIIYLISLIYIGNSDIYYTF

SEQ ID NO: 22192 - protein, 146 aa, Diabrotica virgifera
  misc_feature: Coding regions on vcDNA: vcDNA=SeqID_1889; Strand=-; Position=3-440
  misc_feature: Homolog annotation: Hit_ID=XP_307807.1; Match level="QueryCoverage =93%, HitCoverage=64%, E-value=2e-26, Identity=41%"; Hit description =ENSANGP00000018035 [Anopheles gambiae] ref|XP_318135.1| ENSANGP00000023920 [Anopheles gambiae]
HNPIEGLNIFQYLGATFTRRPNIKEEIQARIMAGNRCIFALNNLLRNKNISRGAKIRIYKTVIRPIVLYASETWTMNKSEQVMLKVWERKVLRKIFGGKIWNGMWIRRPNVELERMYGEPNIVWIVKSQRLRWVGDISRGAKTGVF

SEQ ID NO: 22193 - protein, 124 aa, Diabrotica virgifera
  misc_feature: Coding regions on vcDNA: vcDNA=SeqID_1890; Strand=-; Position=579-953
  misc_feature: Homolog annotation: Hit_ID=Q25532; Match level="QueryCoverage=94%, HitCoverage=99%, E-value=1e-39, Identity=70%"; Hit description =Vacuolar ATP synthase subunit G (V-ATPase G subunit) (Vacuolar proton pump G subunit) (V-ATPase
  misc_feature: Gene Ontology Annotation: Molecular function=hydrogen-exporting ATPase activity, phosphorylative mechanism; Cellular component =hydrogen-translocating V-type ATPase complex; Biological process =vacuolar acidification
  misc_feature: Pfam annotation: Pfam_ID=V-ATPase_G; Match level="Score=167.0, E -value=4.1e-47, Copies=1"; Pfam description=Vacuolar (H+)-ATPase G subunit
MASHQSQGVQQLLAAEKRAADKVTEARKRKARRLKQAKEEAQDEIEKYRKERERQFREFEAKHMGSREDVAAKIEVDTKRRIEEMDKAIINQKEPVIQEILKLVNDIKPEFFMIYRVYNARCYM

SEQ ID NO: 22194 - protein, 419 aa, Diabrotica virgifera
  misc_feature: Coding regions on vcDNA: vcDNA=SeqID_1891; Strand=-; Position=339-1598
  misc_feature: Homolog annotation: Hit_ID=XP_394723.1; Match level="QueryCoverage =98%, HitCoverage=58%, E-value=1e-172, Identity=70%"; Hit description= similar to ENSANGP00000015773 [Apis mellifera]
  misc_feature: Gene Ontology Annotation: Molecular function=RNA helicase activity; Cellular component=nucleus; Biological process=cell growth
  misc_feature: Pfam annotation: Pfam_ID=DEAD; Match level="Score=241.1, E-value=2.1e- 69, Copies=1"; Pfam description=DEAD/DEAH box helicase
  misc_feature (246)..(246): Xaa can be any naturally occurring amino acid
KAKEITVEGEAPNPIQNFDEANFPDYILTEVCNKGYEAPTPIQAQGWPIAMSGHDMVGLAQTGSGKTLAYILPAAIHINNQPPLNKGEGPIVLVLAPTRELAQQIQEVSNDFGRSTNIRNSCIFGGAPKGPQARDLQRGIEICIATPGRLIDFLEKGSTNLERCTYLVLDEADRMLDMGFEPQIRKILSQVRPDRQTLMWSATWPKEVRKLASDFMKNPVYINIGSKNLSANNNIVQFVDVCQEHXKERKLGSLLQEINTNADTGSKIIIFVETKKEVEGITRSIRSIGWSALSMHGDKSQQERDYVLREFRTGKSSILVATDVAARGLDVEGIKYVVNYDYPHSSEDYIHRIGRTGRSDSAGTSYAFFTPSNYKQARDLISVLNETNQAINPKLTEIAGKTNSYGKGNSRWGNGRRFQ

SEQ ID NO: 22195 - protein, 162 aa, Diabrotica virgifera
  misc_feature: Coding regions on vcDNA: vcDNA=SeqID_1892; Strand=-; Position=196-684
  misc_feature: Homolog annotation: Hit_ID=AAH85813.1; Match level="QueryCoverage =32%, HitCoverage=9%, E-value=3e-12, Identity=70%"; Hit description =Unknown (protein for IMAGE:7122468) [Rattus norvegicus]
PCLFQTIPGGGGPFYRPLELTEMVLLSPHPLLSTTWRRMYIVVHLFIFLIAVNKFNILARAKYRLYFCHSETANIAVSLSSSCRVNHFELCGSQMYRCYIWLNVTKIFFKHCIIISLMVNKKQKKNRKKKKKKKKKKKKKKKKKKKKKKKKKTPKKKKGGAP

SEQ ID NO: 22196 - protein, 143 aa, Diabrotica virgifera
  misc_feature: Coding regions on vcDNA: vcDNA=SeqID_1893; Strand=-; Position=3-431
  misc_feature: Homolog annotation: Hit_ID=XP_391841.1; Match level="QueryCoverage =88%, HitCoverage=51%, E-value=4e-62, Identity=92%"; Hit description =similar to ENSANGP00000009311 [Apis mellifera]
  misc_feature: Gene Ontology Annotation: Molecular function=protein kinase C inhibitor activity; Cellular component=cellular_component unknown; Biological process=protein kinase C activation
  misc_feature: Pfam annotation: Pfam_ID=14-3-3; Match level="Score=133.5, E-value =5.1e-37, Copies=1"; Pfam description=14-3-3 protein
IKSKLIKKKKKKRKKKKKMKGDYYRYLAEVATGDTRNTVVDYSQKAYQDAFEISKAKMTPTHPIRLGLALNFSVFYYEILNSPDKACQLAKQPFDDAIAELDTLNEDSYKDSTLIMQLLRDNLTLWTSDTQGEADEPQEAGDN

SEQ ID NO: 22197 - protein, 225 aa, Diabrotica virgifera
  misc_feature: Coding regions on vcDNA: vcDNA=SeqID_1894; Strand=+; Position=44-721
  misc_feature: Homolog annotation: Hit_ID=CAE47497.1; Match level="QueryCoverage =79%, HitCoverage=56%, E-value=9e-96, Identity=94%"; Hit description =cathepsin L-like proteinase [Diabrotica virgifera virgifera]
  misc_feature: Gene Ontology Annotation: Molecular function=cathepsin K activity; Cellular component=extracellular space; Biological process =proteolysis and peptidolysis
  misc_feature: Pfam annotation: Pfam_ID=Peptidase_C1; Match level="Score=204.9, E -value=1.6e-58, Copies=1"; Pfam description=Papain family cysteine protease
MFVRLKIWSTGKDRSHRKPIISTEIRARATVVANYDCLVKSHCFEPFDSRNSKRYRCAIHKNQRVPLSEQELVDCDTSRNAGCNGGLMTDAFNYVKRHGLSSESQYAYTGRDDRCKNVENKPLSSISGYVELETTEDALASAVASVGPVSIAVDADTWQLYGGGLFNNKNCRTNLNHGVLAVGYTKDAFIVKNSWGTSWGEQGYIRVARGENLCGINLMNSYPKL

SEQ ID NO: 22198 - protein, 86 aa, Diabrotica virgifera
  misc_feature: Coding regions on vcDNA: vcDNA=SeqID_1895; Strand=-; Position=309-569
GNPVPIPEPVSGTVKKSGPRKRVRRGNPKGPGDVVERSGKSFLFCISVRVPWNPLAGRYGLERVKHRIFRGIYFFIINIKYFEVRA

SEQ ID NO: 22199 - protein, 213 aa, Diabrotica virgifera
  misc_feature: Coding regions on vcDNA: vcDNA=SeqID_1896; Strand=+; Position=130-771
  misc_feature: Homolog annotation: Hit_ID=AAP57194.1; Match level="QueryCoverage =97%, HitCoverage=97%, E-value=2e-88, Identity=75%"; Hit description =ferritin [Leptinotarsa decemlineata]
  misc_feature: Gene Ontology Annotation: Molecular function=ferrous iron binding; Cellular component=ferritin complex; Biological process=iron ion homeostasis
  misc_feature: Pfam annotation: Pfam_ID=Ferritin; Match level="Score=140.7, E-value =3.4e-39, Copies=1"; Pfam description=Ferritin-like domain
MKSVSLFVFLACIAGLYAIQLKCAHQELDIPNEWIDMHNDCVNKMRGQVEEELKASMQYMAMGAHFSKDTINRPGFAELFFDAASEEREHAIKLIHYLLMRGELTSNLSELIQRNLVPSVTTWGNGVSALKQALQLEASVTRKIRDVTKVCEEAESFNDYHLVDYLAGDFLGEQYHGQRDLAGKVSDLQKMMAEHGALGEWLFDKKLQNKAIV

SEQ ID NO: 22200 - protein, 81 aa, Diabrotica virgifera
  misc_feature: Coding regions on vcDNA: vcDNA=SeqID_1897; Strand=-; Position=3-245
  misc_feature: Homolog annotation: Hit_ID=CAG10773.1; Match level="QueryCoverage =87%, HitCoverage=12%, E-value=8e-24, Identity=71%"; Hit description =unnamed protein product [Tetraodon nigroviridis]
  misc_feature: Gene Ontology Annotation: Molecular function=RNA helicase activity; Cellular component=nucleus; Biological process=cell growth
  misc_feature (61)..(61): Xaa can be any naturally occurring amino acid
YVFSYLDVEGIKYVVNYDYPHSSEDYIHRIGRTGRSDSAGTSYAFFTPSNYKQARDLISVXHETNQAINPKLTEIAGKTNS

SEQ ID NO: 22201 - protein, 364 aa, Diabrotica virgifera
  misc_feature: Coding regions on vcDNA: vcDNA=SeqID_1898; Strand=-; Position=1-1092
  misc_feature: Homolog annotation: Hit_ID=XP_315981.1; Match level="QueryCoverage =81%, HitCoverage=55%, E-value=8e-34, Identity=29%"; Hit description =ENSANGP00000010725 [Anopheles gambiae]
  misc_feature: Pfam annotation: Pfam_ID=FG-GAP; Match level="Score=15.0, E-value =0.072, Copies=2"; Pfam description=FG-GAP repeat
FVRSDSEKEDRLEGNSHYITNGVNQTKVSFSQPKNGHITKDYGEDIDKFKTFRHKLSTKRKIALAISIVFCFLPIITFLWILPCNDFNTCSLKIPNWESLHENLEFLGSVNLVRGVFQKNLNLALMYKGSFTNTKPFKNGILSIMGTTGAIAWDFQQESFPIQMNCSIIDVDNNGYNDCLVVDSRGLKVVETISGEALWHAHSLEEKSIPEIDMPVKIEDLNKDGVSELLAIYKKSGFLIISGKTGQALKNIQLPSTCSSISLASCNTYSISYRCIQMPGNLVTYEVLLEDIKAKYYNSSANLRLNLGKNEGFETFYEVGDRKLTVENVNTCPKCQSTVTLYSANQTKLNFWTFDNSIVMHLFL

SEQ ID NO: 22202 - protein, 141 aa, Diabrotica virgifera
  misc_feature: Coding regions on vcDNA: vcDNA=SeqID_1899; Strand=+; Position=62-487
  misc_feature: Homolog annotation: Hit_ID=EAL33384.1; Match level="QueryCoverage =93%, HitCoverage=60%, E-value=1e-35, Identity=60%"; Hit description =GA18330-PA [Drosophila pseudoobscura]
  misc_feature: Gene Ontology Annotation: Molecular function=structural constituent of ribosome; Cellular component=cytosolic ribosome (sensu Eukarya); Biological process=protein biosynthesis
  misc_feature: Pfam annotation: Pfam_ID=Ribosomal_L13e; Match level="Score=110.4, E -value=4.4e-30, Copies=1"; Pfam description=Ribosomal protein L13e
  misc_feature (78)..(78): Xaa can be any naturally occurring amino acid
KLYINLLFGFTLQELKAAGLNPRFARTVGIAVDHRRRNKSAESIQLNAQRLKEYKSKLILFPIHEKKKIRAGEATGEXRTIASQLQGEVLPIKQSSLRTKVRVPTDEEKKFVAYVTLRNARVDARLVWIRAKRIEEASQSS

SEQ ID NO: 22203 - protein, 64 aa, Diabrotica virgifera
  misc_feature: Coding regions on vcDNA: vcDNA=SeqID_1900; Strand=+; Position=663-857
QLFLLKKCSYFQMIHKQIYLIKKQLIFEQFLNHLQHRSAPIYLLLLGINNIFQFYIIHNVMIRK

SEQ ID NO: 22204 - protein, 228 aa, Diabrotica virgifera
  misc_feature: Coding regions on vcDNA: vcDNA=SeqID_1901; Strand=-; Position=1-684
  misc_feature: Homolog annotation: Hit_ID=AAF97940.2; Match level="QueryCoverage =96%, HitCoverage=48%, E-value=1e-41, Identity=40%"; Hit description =cytochrome P450 CYP6N4v1 [Aedes albopictus]
MSLFLTLLSYGTALLLVAAVSFYAYFLYSYTYWSKKGVPYLEPKFPYGNCTSLFAKAKGYSVGMVDSCYKKMREQGWKVGGFFTVARPTLLVLDPEYVRDILVKDFSNFVDRGFYYVKHDKTTENLFVVDEINWKNIRTKLTPTFTTGKMKMMFPLITHACGQMTKFMEQLAEKKQDIDIRECLAMFTTDVIVSCALGLDSNCFTDKESKFRNIGKSYFSFKDVLLAA

SEQ ID NO: 22205 - protein, 97 aa, Diabrotica virgifera
  misc_feature: Coding regions on vcDNA: vcDNA=SeqID_1902; Strand=+; Position=41-334
VNSRVSTYFIFLVLLIYPCIIDIIYNLNKIIVKSEFGINFESKLNVRPNTYDVGIVSRGFSWFSLVIYYEISNARILMSPLHVFVFLKTDHMLRFFL

SEQ ID NO: 22206 - protein, 118 aa, Diabrotica virgifera
  misc_feature: Coding regions on vcDNA: vcDNA=SeqID_1903; Strand=-; Position=795-1151
NSYFYFCYSKCLKIIIINYRVHSVVQNFVSSNQNVHIVKRVLIHNFWGSTIKFFFYIQYILFHNQFCYKTICHDLIKKNFLSIICLYVVIENLISVVVYVINITWFGGLVTSKRILIN

SEQ ID NO: 22207 - protein, 398 aa, Diabrotica virgifera
  misc_feature: Coding regions on vcDNA: vcDNA=SeqID_1904; Strand=-; Position=2-1195
  misc_feature: Homolog annotation: Hit_ID=XP_393186.1; Match level="QueryCoverage =100%, HitCoverage=79%, E-value=1e-165, Identity=67%"; Hit description=similar to CG6322-PA [Apis mellifera]
  misc_feature: Gene Ontology Annotation: Molecular function=pre-mRNA splicing factor activity; Cellular component=spliceosome complex; Biological process =mRNA splicing
  misc_feature: Pfam annotation: Pfam_ID=WD40; Match level="Score=123.4, E-value=5.6e- 34, Copies=4"; Pfam description=WD domain, G-beta repeat
MSDEEEVQYVKKTKTIHYGSLEDSEKARLEAQSEDSNEEKSAPAAASPVQEPSEYMELEDAMSRDKQALIEEFERRRKARSINVSTDDAEVRRNLRQLGEAICLFGEGPADRRSRLRDILSRIGEDAVIRREAEEERKQHEKDQETTWYHEGPDSLRVARLWIAHYSLPKAKARLEEARRMGELPAATKTARTQELQKKIHAMSIYCSQVGDVRPISYCQFSPDSKLLATASWSGLCKVWSVPDCELKQTLKGHTCNVGAIVFHPNATSESEEKICSMASCAADGSVKLWDFASEEPIADIEGHMPHRVSRIGFHPSGRFLGTCCFDNSWRLWDLHQCTEVLHQEGHVKPVYCISFQVDGSVCATGGMDAFARVWDLRTGRCIMFMEGHLKGILGIDF

SEQ ID NO: 22208 - protein, 169 aa, Diabrotica virgifera
  misc_feature: Coding regions on vcDNA: vcDNA=SeqID_1905; Strand=+; Position=307-812
  misc_feature: Homolog annotation: Hit_ID=EAL32818.1; Match level="QueryCoverage =95%, HitCoverage=9%, E-value=7e-65, Identity=79%"; Hit description =GA15316-PA [Drosophila pseudoobscura]
  misc_feature: Gene Ontology Annotation: Molecular function=ATP binding; Cellular component=nucleolus; Biological process=protein biosynthesis
  misc_feature: Pfam annotation: Pfam_ID=GTP_EFTU; Match level="Score=26.0, E-value =1.4e-08, Copies=1"; Pfam description=Elongation factor Tu GTP binding domai
  misc_feature (127)..(127): Xaa can be any naturally occurring amino acid
  misc_feature (133)..(133): Xaa can be any naturally occurring amino acid
  misc_feature (148)..(148): Xaa can be any naturally occurring amino acid
QAQTILYCKHVADPNVQAVEEVDFSSEVTAALRVTDGALVVVDCVSGVCVQTETVLRQAIAERIKPILFMNKMDRALLELQLESEELYQTFQRIDENVNVIIATYNDDSGPMSEVRVDPSKGSVGFXSGLHGXSFPSPKISEMNAEKXQIDEIKLMNRLGGENFFNPQT

SEQ ID NO: 22209 - protein, 174 aa, Diabrotica virgifera
  misc_feature: Coding regions on vcDNA: vcDNA=SeqID_1906; Strand=+; Position=11-535
  misc_feature: Homolog annotation: Hit_ID=CAE47497.1; Match level="QueryCoverage =95%, HitCoverage=53%, E-value=2e-72, Identity=78%"; Hit description =cathepsin L-like proteinase [Diabrotica virgifera virgifera]
  misc_feature: Gene Ontology Annotation: Molecular function=cathepsin K activity; Cellular component=lysosome; Biological process=proteolysis and peptidolysis
  misc_feature: Pfam annotation: Pfam_ID=Peptidase_C1; Match level="Score=190.9, E -value=2.7e-54, Copies=1"; Pfam description=Papain family cysteine protease
IYHFSLTVIHKNQRVPLSEQELVDCDKVNDGCDGGLMTDAFFYIEHHGLSSEEQYPYTGVDGHCNHVKDKQVSSISGYVELDETESALADALANVGPVSIAVEADTWQFYSGGVFNNKNCGDALNHGVLAVGYTKDVFIVKNSWGTGWGEQGYIRVARGSNLCGINLMNSYPKL

SEQ ID NO: 22210 - protein, 121 aa, Diabrotica virgifera
  misc_feature: Coding regions on vcDNA: vcDNA=SeqID_1907; Strand=-; Position=438-803
  misc_feature: Homolog annotation: Hit_ID=CAA67590.1; Match level="QueryCoverage =67%, HitCoverage=55%, E-value=6e-45, Identity=95%"; Hit description =ribosomal protein L27a [Tenebrio molitor] sp|Q27021|RL2A_TENMO 60S ribosomal protein L27a
  misc_feature: Gene Ontology Annotation: Molecular function=structural constituent of ribosome; Cellular component=cytosolic ribosome (sensu Eukarya); Biological process=protein biosynthesis
MSTHRKKTRKLRGHVSHGHGRIGKHRKHPGGRGNAGGMHHHRINFDKYHPGYFGKLGMRNYHVRKNSKWCPAINLDKLWTLVIVFNSWFNYCMFLTPAINIGGSFSSCFLPLQFLLLASLH

SEQ ID NO: 22211 - protein, 246 aa, Diabrotica virgifera
  misc_feature: Coding regions on vcDNA: vcDNA=SeqID_1908; Strand=+; Position=160-900
  misc_feature: Homolog annotation: Hit_ID=AAR06265.1; Match level="QueryCoverage =94%, HitCoverage=93%, E-value=4e-28, Identity=29%"; Hit description =peritrophic membrane chitin binding protein 1 [Trichoplusia ni]
  misc_feature: Gene Ontology Annotation: Molecular function=chitin binding; Biological process=cytokinesis after mitosis
  misc_feature: Pfam annotation: Pfam_ID=CBM_14; Match level="Score=128.0, E-value =2.3e-35, Copies=3"; Pfam description=Chitin binding Peritrophin-A domain
MNGFTVVFVVFCVGVVVADDSQICPSDDSVAYFPAEDCSQFWQCTEGKPIIQNCPQGLRFNTELNICDWPSNARCANDDDRNNKIPEEKEESDNDNDNQNGNGNNGGEIKEVQICENVECPAEDPDVVVQKPGPSPSQFCKCSHGIPYLLACPDGLVYNADLEVCDYPENETDDRPNNSDEENESKEEANDENNITCQGDCPETDGTPFASSNSNNFCVCGGGVQHVMKCPDGLIFNVKEGICDWP

SEQ ID NO: 22212 - protein, 218 aa, Diabrotica virgifera
  misc_feature: Coding regions on vcDNA: vcDNA=SeqID_1909; Strand=-; Position=3-880
  misc_feature: Homolog annotation: Hit_ID=AAV34814.1; Match level="QueryCoverage =100%, HitCoverage=70%, E-value=1e-102, Identity=81%"; Hit description=ribosomal protein L5 [Bombyx mori]
  misc_feature: Gene Ontology Annotation: Molecular function=5S RNA binding; Cellular component=ribosome; Biological process=protein biosynthesis
  misc_feature: Pfam annotation: Pfam_ID=Ribosomal_L18p; Match level="Score=248.8, E -value=9.8e-72, Copies=1"; Pfam description=Ribosomal L18p/L5e family
  misc_feature (188)..(188): Xaa can be any naturally occurring amino acid
MAFVKVVKNKQYFKRFQVKFKRRRQGKTDYYARKRLIVQDKNKYNTPKYRLIVRISNRNITCQIAYSRIEGDKIVCAAYSHELPRYGIKTGLTNYAAAYATGLLLARRLLKKLGLDNLYSGTTDVTGDEYNVEAAEQGPGAFRTKHSFLCYLDTGLNRTSTGARVFGAMKGAVDGGLNIPHSTKRFPXGFDSESKSFNAEVHRNHIFGIHVADYMKSL

SEQ ID NO: 22213 - protein, 93 aa, Diabrotica virgifera
  misc_feature: Coding regions on vcDNA: vcDNA=SeqID_1910; Strand=+; Position=734-1012
IIRIFLLSNNIFVYFSSILYFDNETRFGLRNVNKIIFLVKLWLVPIDYKNATRKIASEQTFNKTTMISDLTKKKGQHSELCMALFFFKYWSLF

SEQ ID NO: 22214 - protein, 120 aa, Diabrotica virgifera
  misc_feature: Coding regions on vcDNA: vcDNA=SeqID_1911; Strand=-; Position=474-836
HASESTMASKTVLFGLLVVLLVNHSLARDLTVCPNSDKATKAVYDKEVATSVVGSTIRVRVPDSLFLKKPITCIVIVDNNQSDSVPEVEDGGVDSTWVTVNIAPAITELLSYRIQVYTNE

SEQ ID NO: 22215 - protein, 300 aa, Diabrotica virgifera
  misc_feature: Coding regions on vcDNA: vcDNA=SeqID_1912; Strand=+; Position=9-908
  misc_feature: Homolog annotation: Hit_ID=BAA78480.1; Match level="QueryCoverage =48%, HitCoverage=27%, E-value=2e-11, Identity=26%"; Hit description =56 kDa early-staged encapsulation-inducing protein [Tenebrio molitor]
MKVLVLFSLVVLSVALPTLLGRTVRVKEDGTVSLFDSRGYQLVILKSVADPSQVEVVLRSPNTRTQMFQVGEPLRTGEAIDRRTLAGVSVYQNYNQADILTDIFRQYEGILDDTKYYNLLNRIQMLVEAGLINETIYDVIRNWDREYRMQGIRALDQGLLQTYSPLRHFQTLLGQIQQQRVLQQGLLTQQQYLPQQYLSGEYLLEDQMNTNQILNQIYRQQLGQSPLNRYLVNMRLVNGEQVYEVPEEFVNVQLLEQLFAKQELINQELTEITERRQPITEDVHYQQQLINQQIQKLIEQ

SEQ ID NO: 22216 - protein, 254 aa, Diabrotica virgifera
  misc_feature: Coding regions on vcDNA: vcDNA=SeqID_1913; Strand=+; Position=85-849
  misc_feature: Homolog annotation: Hit_ID=XP_392518.1; Match level="QueryCoverage =100%, HitCoverage=100%, E-value=1e-112, Identity=78%"; Hit description=similar to C 3.4.25.1 proteasome endopeptidase complex () chain XC8 - clawed frog [Apis mellifera]
  misc_feature: Gene Ontology Annotation: Molecular function=endopeptidase activity; Cellular component=cytosol; Biological process=proteolysis and peptidolysis
  misc_feature: Pfam annotation: Pfam_ID=Proteasome; Match level="Score=242.6, E -value=7.2e-70, Copies=1"; Pfam description=Proteasome A-type and B -type
MSSIGTGYDLSASQFSPDGRVFQVEYAMKAVENSGTVIGLRGTDGIVLAAEKLIMSKLHEPSTNKRIFNIDKHIGMAFSGLIADARQIVEIARKEASNYRHQYGSNIPLKYLNDRVSMYMHAYTLYSAVRPFGCSVILASYEDSDPSMYLIDPSGVSYGYFGCATGKAKQSAKTEIEKLKMGNLTCKELVKEAAKIIYLVHDELKDKNFELELSWVCKDTNGLHTKVPESVFADAEKAAKQAMEADSESDTEDM

SEQ ID NO: 22217 - protein, 103 aa, Diabrotica virgifera
  misc_feature: Coding regions on vcDNA: vcDNA=SeqID_1914; Strand=+; Position=122-430
  misc_feature: Homolog annotation: Hit_ID=AAP57194.1; Match level="QueryCoverage =100%, HitCoverage=48%, E-value=5e-37, Identity=69%"; Hit description= ferritin [Leptinotarsa decemlineata]
  misc_feature: Gene Ontology Annotation: Molecular function=ferrous iron binding; Cellular component=ferritin complex; Biological process=iron ion homeostasis
MKSVGLFVFLACIAGLYAIQLKCAHQELNIPNEWIDMHKECVHKMRGQVEEELKASMQYMAMGAHFSKDTINRPGFADLFFDAASEEREHAIKLIHYLLMRGE

SEQ ID NO: 22218 - protein, 109 aa, Diabrotica virgifera
  misc_feature: Coding regions on vcDNA: vcDNA=SeqID_1915; Strand=-; Position=279-608
LPKNIVLVSDPNSEYFGHLTLQSGSAKNIADNLFNFLKSKCDFSTLVAIGCDGTAVNTGVHNGAIRKLELQIKKPLQWFSLSFIWKRATITTLDEVFRWRNRRTYRIFG

SEQ ID NO: 22219 - protein, 60 aa, Diabrotica virgifera
  misc_feature: Coding regions on vcDNA: vcDNA=SeqID_1916; Strand=-; Position=2-181
  misc_feature: Homolog annotation: Hit_ID=CAE70245.1; Match level="QueryCoverage =75%, HitCoverage=31%, E-value=1e-10, Identity=72%"; Hit description =Hypothetical protein CBG16734 [Caenorhabditis briggsae]
RTDYSSPVVYRLYKTNKWKYLTKKKKKKKKKKKKKKKKEKRKKKKKEENKKKKKGGAPLK

SEQ ID NO: 22220 - protein, 200 aa, Diabrotica virgifera
  misc_feature: Coding regions on vcDNA: vcDNA=SeqID_1917; Strand=+; Position=368-967
  misc_feature: Homolog annotation: Hit_ID=AAV34856.1; Match level="QueryCoverage =100%, HitCoverage=65%, E-value=8e-95, Identity=83%"; Hit description= ribosomal protein SA [Bombyx mori]
  misc_feature: Gene Ontology Annotation: Molecular function=structural constituent of ribosome; Cellular component=cytosolic ribosome (sensu Eukarya); Biological process=protein biosynthesis
  misc_feature: Pfam annotation: Pfam_ID=Ribosomal_S2; Match level="Score=329.8, E -value=4e-96, Copies=1"; Pfam description=Ribosomal protein S2
MSGGIEALSLKEDDVTKMLAASTHLGTANVDFQMEQYVYKRRHDGTHIINLRKTWEKILLAARAIVAIEHPGEVFVISSRPYGQRAVLKFAAHTGATPIAGRFTPGAFTNQIQAAFREPRLLIVTDPAFDHQPITEASYVNIPVIALCNTDSPLRFVDIAIPGNNKASHSIGLLWWLLAREVLRLIGIIPRDTKWDVVVD

SEQ ID NO: 22221 - protein, 270 aa, Diabrotica virgifera
  misc_feature: Coding regions on vcDNA: vcDNA=SeqID_1918; Strand=+; Position=91-899
  misc_feature: Homolog annotation: Hit_ID=AAL83698.1; Match level="QueryCoverage =99%, HitCoverage=31%, E-value=1e-137, Identity=92%"; Hit description= translation elongation factor 2 [Spodoptera exigua]
  misc_feature: Gene Ontology Annotation: Molecular function=ATP binding; Cellular component=nucleolus; Biological process=protein biosynthesis
  misc_feature: Pfam annotation: Pfam_ID=GTP_EFTU; Match level="Score=238.2, E-value =1.5e-68, Copies=1"; Pfam description=Elongation factor Tu GTP binding doma
  misc_feature (226)..(226): Xaa can be any naturally occurring amino acid
  misc_feature (252)..(252): Xaa can be any naturally occurring amino acid
MVNFTVDEIRAMMDKKRNIRNMSVIAHVDHGKSTLTDSLVSKAGIIAGAKAGETRFTDTRKDEQERCITIKSTAISMFFELDDKDLVFITNADQREKDVKGFLINLIDSPGHVDFSSEVTAALRVTDGALVVVDCVSGVCVQTETVLRQAIAERIKPILFMNKMDRALLELQLESEELYQTFQRIVENVNVIIATYNDDSGPMGEVRVDPSKGSVGFGSGLHGWAXFTLKQFSEMYAEKFKIDVFKLMNRLXRENFFNPKTKKWSNQNDD

SEQ ID NO: 22222 - protein, 152 aa, Diabrotica virgifera
  misc_feature: Coding regions on vcDNA: vcDNA=SeqID_1919; Strand=-; Position=127-585
  misc_feature: Homolog annotation: Hit_ID=CAH04336.1; Match level="QueryCoverage =100%, HitCoverage=100%, E-value=3e-80, Identity=96%"; Hit description=S18e ribosomal protein [Cicindela campestris]
  misc_feature: Gene Ontology Annotation: Cellular component=mitochondrion
  misc_feature: Pfam annotation: Pfam_ID=Ribosomal_S13; Match level="Score=280.8, E -value=2.2e-81, Copies=1"; Pfam description=Ribosomal protein S13/S18
MSLVIPEKFQHILRILGTNIDGKRKVQFALTAIKGVGRRYANIVLKKADVNLDKRAGECSDEEVEKIITIMSNPRQYKIPDWFLNRQKDIIDGKYSQLTSSSLDSKLREDLERMKKIRAHRGMRHYWGLRVRGQHTKTTGRRGRTVGVSKKK

SEQ ID NO: 22223 - protein, 310 aa, Diabrotica virgifera
  misc_feature: Coding regions on vcDNA: vcDNA=SeqID_1920; Strand=-; Position=2-931
  misc_feature: Homolog annotation: Hit_ID=AAL16466.1; Match level="QueryCoverage =96%, HitCoverage=68%, E-value=1e-115, Identity=69%"; Hit description= cytochrome c oxidase subunit I [Hypseleotris compressa]
  misc_feature: Pfam annotation: Pfam_ID=COX1; Match level="Score=346.2, E-value=4.6e- 101, Copies=1"; Pfam description=Cytochrome C and Quinol oxidase polyp
  misc_feature (22)..(22): Xaa can be any naturally occurring amino acid
  misc_feature (78)..(78): Xaa can be any naturally occurring amino acid
  misc_feature (100)..(100): Xaa can be any naturally occurring amino acid
  misc_feature (149)..(149): Xaa can be any naturally occurring amino acid
  misc_feature (201)..(201): Xaa can be any naturally occurring amino acid
  misc_feature (236)..(236): Xaa can be any naturally occurring amino acid
  misc_feature (253)..(253): Xaa can be any naturally occurring amino acid
NKKKKKTNHKDIGTLYFIFGIXAGMVGTSLRILVRAELGRPGSLIGNDQIYNVIVTAHAFIIIFFIVIPIIIGGFGNXLVPLIIGAPDIAFPRINNIRFXLLPPSLLLLLSLPVLAGAITILLTDRNLNTSFFDPAGGGDPILYQHLFXFFGHPEVYILILPGFGLISHIVRQERRKKEAFGTLGIIYAIIAIGLLGFIVXAHHIFTVGMDVDTRAYFTSATIIIAVPTGIKVFRXLATYHGTTITYSPVTLXALGFIFLFTVGGLTGVVLANSSIDIVLHDTYYVVAHFHYVLSIGAVFAIIAGIYPMI

SEQ ID NO: 22224 - protein, 318 aa, Diabrotica virgifera
  misc_feature: Coding regions on vcDNA: vcDNA=SeqID_1921; Strand=-; Position=41-997
  misc_feature: Homolog annotation: Hit_ID=BAB78478.1; Match level="QueryCoverage =79%, HitCoverage=34%, E-value=4e-17, Identity=26%"; Hit description =preproMP73 [Cucurbita maxima]
MSHLIIRCILALFLFQAISAYRKISDVINEKRSIGYKEGTLEKRSDDDFNLWLSRANEEERERGGNHDDVRKRSDDDFNLWLSRANEEERERGGNHDDVRKRSDDDFNLWLSRANEEERERGGNHDDVRKRSDDDFNLWLSRANEEERERGGNHDDVRKRSDDDFNLWLSRANEEERERGGNHDDVRKRSDDDFNLWLSRANEEERERGGNHDDVRKRSDDDFNLWLSRANEEERERGGNHDDVRKRSDDDFNLWLSRAKEEERERDGNHDEVRKRSDDDFNLWLSRAKEEERERGGNHDEVRKRGVKSDYIADMYSS

SEQ ID NO: 22225 - protein, 336 aa, Diabrotica virgifera
  misc_feature: Coding regions on vcDNA: vcDNA=SeqID_1922; Strand=+; Position=170-1180
  misc_feature: Homolog annotation: Hit_ID=NP_649582.1; Match level="QueryCoverage =88%, HitCoverage=82%, E-value=9e-82, Identity=46%"; Hit description =CG2091-PA [Drosophila melanogaster] gb|AAF51960.1| CG2091-PA [Drosophila melanogaster]
  misc_feature: Gene Ontology Annotation: Molecular function=molecular_function unknown; Cellular component=exosome (RNase complex); Biological process=rRNA processing
  misc_feature: Pfam annotation: Pfam_ID=DcpS; Match level="Score=358.8, E-value=7.6e- 105, Copies=1"; Pfam description=Scavenger mRNA decapping enzyme (DcpS
MSASSCVEIIEAEISPAKKKPKLNIDENLIQQESKSINNDLTDLSNFNITEILSNNTNRKTVCLRGSFESKEGEAVVILEKSAFVEEDLKTKEYFNKSSLLEKTFQNDIYGDYHYFPNRDLSVIKTTVIHPATEKHLVKFSAQKLYIVDETPKLYEEVILPQLSDEQLHLQWVYNILEHKSEVERLVFEDTDPVNGFVMVPDLKWNGKVDTLYLLAIVNRRDIKSIRDLTGEHLPLLKNIQQKGTEAIKSKYSLDSSRLRIYLHYQPSFYHLHIHFGYLQHEAPGILTEKAHLLSQVISNIELLPDYYQKVTIPFVVREQDKFFKKLEEKGVLSKS

SEQ ID NO: 22226 - protein, 183 aa, Diabrotica virgifera
  misc_feature: Coding regions on vcDNA: vcDNA=SeqID_1923; Strand=+; Position=25-573
  misc_feature: Homolog annotation: Hit_ID=CAE47497.1; Match level="QueryCoverage =100%, HitCoverage=58%, E-value=2e-94, Identity=92%"; Hit description= cathepsin L-like proteinase [Diabrotica virgifera virgifera]
  misc_feature: Gene Ontology Annotation: Molecular function=cathepsin K activity; Cellular component=extracellular space; Biological process =proteolysis and peptidolysis
  misc_feature: Pfam annotation: Pfam_ID=Peptidase_C1; Match level="Score=-106.0, E -value=0.00096, Copies=1"; Pfam description=Papain family cysteine protease
MKLFILAAALIVATSANLGAFEKWTSFKATHNKSYNVIEDKLRFAVFQENLKKIEEHNAKYESGEETYYLAVNKFADWSSAEFQAMLARQMANKPTQTFIGKHVEDPNVQAADEVDWRSSADLGVKDQGSCGSCWAFSTTGSLEGQLAIHKNQRVPLSEQELVDCDTVNAGCDGGLMTDAFNY

SEQ ID NO: 22227 - protein, 100 aa, Diabrotica virgifera
  misc_feature: Coding regions on vcDNA: vcDNA=SeqID_1924; Strand=+; Position=930-1232
NVFGRFHFVPEILQAFLVALKKNLPFRFCLDKYSFGNLAKKLFKFGSLDFLWRNVTFWNRSVEIVLPYCTFEIIDTFNVKKLSNLYINLSFKIYCSFFLI

SEQ ID NO: 22228 - protein, 281 aa, Diabrotica virgifera
  misc_feature: Coding regions on vcDNA: vcDNA=SeqID_1925; Strand=+; Position=270-1113
  misc_feature: Homolog annotation: Hit_ID=AAN76688.1; Match level="QueryCoverage =98%, HitCoverage=54%, E-value=1e-120, Identity=72%"; Hit description= catalase [Apis mellifera ligustica]
  misc_feature: Gene Ontology Annotation: Molecular function=catalase activity; Cellular component=cytoplasm; Biological process=response to hydrogen peroxide
  misc_feature: Pfam annotation: Pfam_ID=Catalase; Match level="Score=403.0, E-value =3.6e-118, Copies=1"; Pfam description=Catalase
  misc_feature (223)..(223): Xaa can be any naturally occurring amino acid
MANRDSATNQLLNYKKKTQGGESVTTGYGNPVGQFASLSVGPRGPILFQDQILVDELSHFNRERIPERVVHAKGAGAFGYFECTNDITKYSAAKLFSSIGKKTPIAIRFSTVGGESGSADTVRDPRGFAIKFYTEEGIWDLAGNNTPIFFIRDPIFFASFIRTQKRNPQTHLKDPDMFWDFMSLRPETMHQLLFLFSDRGIPDGYRHMNGYGSHTFKFVNKRXQVHFCKFHHKTDQGIQNLDVNKADDLSASDPDYSIRDLVNAIADGNYPSWTTYCQIMT

SEQ ID NO: 22229 - protein, 57 aa, Diabrotica virgifera
  misc_feature: Coding regions on vcDNA: vcDNA=SeqID_1926; Strand=+; Position=462-635
SAYLFYKIYISHNVIPTLKKNFWLKPLYLPLPREVSSGEKFNNEQIQNKKDNLKQCY

SEQ ID NO: 22230 - protein, 255 aa, Diabrotica virgifera
  misc_feature: Coding regions on vcDNA: vcDNA=SeqID_1927; Strand=-; Position=3-767
  misc_feature: Homolog annotation: Hit_ID=AAF97940.2; Match level="QueryCoverage =100%, HitCoverage=55%, E-value=1e-43, Identity=40%"; Hit description= cytochrome P450 CYP6N4v1 [Aedes albopictus]
MSLFLTLLSYGTALLLVAAVSFYAYFLYSYTYWSKKGVPYLEPKFPYGNCTSLFAKVRGYSVGVVDSCYKKMREQGWKVGGFFTIARPTLLVLDPEYVRDVLVKDFSNFVDRGFYYFKHDKISENLFVMDETNWKNIRIKLTPTFTTGKMKMMFPLITHACGQMTKFMEQLVEKKQDIDLRECLAMFTTDVIVSCAFGLNSNCFTDKENKFRNIGKSFFSFKDVLLAAKVSLMNYAPELALQLGIPSMKKEQRQF

SEQ ID NO: 22231 - protein, 409 aa, Diabrotica virgifera
  misc_feature: Coding regions on vcDNA: vcDNA=SeqID_1928; Strand=-; Position=554-1783
  misc_feature: Homolog annotation: Hit_ID=AAF87759.1; Match level="QueryCoverage =98%, HitCoverage=91%, E-value=0.0, Identity=88%"; Hit description =cytochrome oxidase subunit I [Diabrotica virgifera virgifera]
  misc_feature: Pfam annotation: Pfam_ID=COX1; Match level="Score=506.7, E-value=2.3e- 149, Copies=1"; Pfam description=Cytochrome C and Quinol oxidase polyp
  misc_feature (21)..(21): Xaa can be any naturally occurring amino acid
  misc_feature (81)..(81): Xaa can be any naturally occurring amino acid
  misc_feature (131)..(131): Xaa can be any naturally occurring amino acid
  misc_feature (183)..(183): Xaa can be any naturally occurring amino acid
  misc_feature (218)..(218): Xaa can be any naturally occurring amino acid
  misc_feature (235)..(235): Xaa can be any naturally occurring amino acid
  misc_feature (291)..(291): Xaa can be any naturally occurring amino acid
  misc_feature (345)..(345): Xaa can be any naturally occurring amino acid
  misc_feature (368)..(368): Xaa can be any naturally occurring amino acid
  misc_feature (389)..(389): Xaa can be any naturally occurring amino acid
MLYREHQLLRRIVERGVGTGXTVYPPLSSNIAHGGPSVDLPIFRLHLAGISSILGAINFITTVINIRPIGITFDRIPLFVXAVVITAILLLLSLPVLAGAITILLTDRNLNTSFFDPAGGGDPILYQHLFXFFGHPEVYILILPGFGLISHIVRQERRKKEAFGTLGIIYAIIAIGLLGFIVXAHHIFTVGMDVDTRAYFTSATIIIAVPTGIKVFRXLATYHGTTITYSPVTLXALGFIFLFTVGGLTGVVLANSSIDIVLHDTYYVVAHFHYVLSIGSVFAIIAGFIQXFPLFTGITLNNFYLKIQFFIIFIGVNLTFFPQHFLGLIGIPRRYSDYPDVFILXNIVSSIGSLISLIGVLFLIFIIXEAFSFQRKRLRPLRITSSIEXLQFNPPAEHRYSELPILSSN

SEQ ID NO: 22232 - protein, 290 aa, Diabrotica virgifera
  misc_feature: Coding regions on vcDNA: vcDNA=SeqID_1929; Strand=-; Position=327-1196
  misc_feature: Homolog annotation: Hit_ID=XP_308512.1; Match level="QueryCoverage =85%, HitCoverage=98%, E-value=1e-118, Identity=80%"; Hit description= ENSANGP00000024398 [Anopheles gambiae]
  misc_feature: Gene Ontology Annotation: Molecular function=succinate dehydrogenase (ubiquinone) activity; Cellular component=mitochondrial inner membrane; Biological process=electron transport
  misc_feature: Pfam annotation: Pfam_ID=Fer2; Match level="Score=14.5, E-value =0.007, Copies=1"; Pfam description=2Fe-2S iron-sulfur cluster binding dom
  misc_feature (213)..(213): Xaa can be any naturally occurring amino acid
  misc_feature (268)..(268): Xaa can be any naturally occurring amino acid
  misc_feature (276)..(276): Xaa can be any naturally occurring amino acid
MSREMQLFRLWKGRLAQVRLIHVAATSNAAAAEAKRAEKPARPKTFAIYRWNPDKPDTKPYMQEYTVDLNSCGPMVLDALIKIKNEVDPTLTFRRSCREGICGSCAMNIGGVNTLACISKIETSSKSTKIYPLPHMYVVKDLVPDMNNFYRQYKSIEPWLQRSDDSQKKNTEYLQSVEDRQKLDGLYECILCACCSTSCPSYWWNGDKYLGPXAVLMQAYRWIIDSRDEATNKRLDKMRDPFSAYRCHTIMNCTRTCPKGLNPGRAIXAEIKKLLXGVAKKRAPQLNSAA

SEQ ID NO: 22233 - protein, 198 aa, Diabrotica virgifera
  misc_feature: Coding regions on vcDNA: vcDNA=SeqID_1930; Strand=+; Position=143-739
  misc_feature: Homolog annotation: Hit_ID=AAL37254.1; Match level="QueryCoverage =98%, HitCoverage=100%, E-value=5e-86, Identity=75%"; Hit description= 2-Cys thioredoxin peroxidase [Aedes aegypti]
  misc_feature: Gene Ontology Annotation: Molecular function=molecular_function unknown; Cellular component=cellular_component unknown; Biological process=biological_process unknown
  misc_feature: Pfam annotation: Pfam_ID=AhpC-TSA; Match level="Score=265.2, E-value =1.1e-76, Copies=1"; Pfam description=AhpC/TSA family
MPVPSLQKPAPVFKGTAVVNGMFKDISLEDYKGQYVVLFFYPLDFTFVCPTEIIAFSDRFEEFKKINTAVVACSTDSQFSHLAWINTPRKQGGLGEMAIPLLSDKSGAVAKAYGVLDEETGIPSRGLFIIDGKGNLRQITINDLPVGRSIDETLRLVQAFQFTDEHGEVCPVGWKPGQKTMKPDPTGSKDYFSTVNKN

SEQ ID NO: 22234 - protein, 121 aa, Diabrotica virgifera
  misc_feature: Coding regions on vcDNA: vcDNA=SeqID_1931; Strand=-; Position=316-681
  misc_feature: Homolog annotation: Hit_ID=XP_393157.1; Match level="QueryCoverage =96%, HitCoverage=20%, E-value=2e-43, Identity=76%"; Hit description =similar to ENSANGP00000016262 [Apis mellifera]
  misc_feature: Gene Ontology Annotation: Molecular function=hydrogen-exporting ATPase activity, phosphorylative mechanism; Cellular component =hydrogen-translocating V-type ATPase complex; Biological process =vacuolar acidification
  misc_feature: Pfam annotation: Pfam_ID=V-ATPase_G; Match level="Score=171.7, E -value=1.6e-48, Copies=1"; Pfam description=Vacuolar (H+)-ATPase G subunit
ITHRMASHQSQGVQQLLAAEKRAADKVTEARKRKARRLKQAKEEAQDEIEKYRKERERQFREFEAKHMGSREDVAAKIEVDTKRRIEEMNKAIINQKEPVIQEILKLVYDIKPEVHKNYRQ

SEQ ID NO: 22235 - protein, 310 aa, Diabrotica virgifera
  misc_feature: Coding regions on vcDNA: vcDNA=SeqID_1932; Strand=+; Position=28-960
  misc_feature: Homolog annotation: Hit_ID=CAE47497.1; Match level="QueryCoverage =100%, HitCoverage=98%, E-value=1e-150, Identity=82%"; Hit description=cathepsin L-like proteinase [Diabrotica virgifera virgifera]
  misc_feature: Gene Ontology Annotation: Molecular function=cathepsin K activity; Cellular component=extracellular space; Biological process =proteolysis and peptidolysis
  misc_feature: Pfam annotation: Pfam_ID=Peptidase_C1; Match level="Score=314.6, E -value=1.5e-91, Copies=1"; Pfam description=Papain family cysteine protease
MKLLILAATLIVAINANLSAFEQWTSFKATHNKSYNVIEDKLRFAVFQENLRKIDAHNAKYEKGEETYYMAVNKFADWSSAEFQAMLDRQMANKPKQSFIAKHVVDPNVQAVEEVDWRETAVLGVKDQGQCGSCWAFSTTGAIEGQLAIHKNERVPLSEQELVDCDKVNLGCDGGLMTDAFFYVEHHGLSSEEQYPYTGVGGHCNHVKNKQVSSINGYVELDETESALADALATVGPVSIAVDADTWQFYSGGVFNNKNCGNALNHGVLAVGYTKDAFVVKNSWGTSWGEQGYIRVARGSNLCGINLMNS

SEQ ID NO: 22236 - protein, 554 aa, Diabrotica virgifera
  misc_feature: Coding regions on vcDNA: vcDNA=SeqID_1933; Strand=-; Position=53-2989
  misc_feature: Homolog annotation: Hit_ID=EAA16908.1; Match level="QueryCoverage =93%, HitCoverage=59%, E-value=1e-27, Identity=24%"; Hit description =Drosophila melanogaster CG8797 gene product-related [Plasmodium yoelii yoelii]
  misc_feature: Gene Ontology Annotation: Molecular function=hormone activity; Cellular component=extracellular; Biological process=regulation of protein activity, epigenetic
  misc_feature (192)..(192): Xaa can be any naturally occurring amino acid
  misc_feature (238)..(238): Xaa can be any naturally occurring amino acid
MKTNLEQTQKDLKANFEQGHKDFTKKAEEVGEGIADIGHKVFNWKPWGNNGHPGRHDNGRRPWNRGQGNRYQQQIEDQEQIGQQQEPDEDLGQRQEQGSRYSKITKITHVGQHVEDLGQEQVEDLGQQVELGQNQIDLGQQLEDNDDFSQHQIQRNKYRVSKIIRGQSHSQIGQQTEDLGQQTEDLGQQLEXHLKPIDQSQQVEDLSQQQQVDFGQQIEEGGKIHQTNGGKIQQKNLXNQQTEDLSQQPQIDFGQQIEEETTTIGQEIEETTTVVYQKVENIDQQQQIDFGQQIEETHLDQSKLHLKPLDQSQQQEELGQEQEEVNFTIGPQVEDDFPHGNQGKIQIGGSQDQEQEQDTQQVEQQISGWHDQPRIQQKPLDQSQEPTDTQQVEIFDVNSVKDIEDPHSHYYTRHEVHVEEVPHHTHSHSYQQEQEIIGQESGYDDQAQEEESIPLPNEQLQSSSQEQQKIEVIRHDHYDDVNAVPSVSVDQEVEEPHHHDVIHIEEVHVDQENSVPPEVYEELPWWKKAASKIRHGAHKVKEGAIKLKEKVVGC

SEQ ID NO: 22237 - protein, 360 aa, Diabrotica virgifera
  misc_feature: Coding regions on vcDNA: vcDNA=SeqID_1934; Strand=+; Position=660-1742
  misc_feature: Homolog annotation: Hit_ID=NP_649329.1; Match level="QueryCoverage =94%, HitCoverage=14%, E-value=5e-14, Identity=24%"; Hit description =CG7177-PA [Drosophila melanogaster] gb|AAF51744.2| CG7177-PA [Drosophila melanogaster]
  misc_feature: Gene Ontology Annotation: Biological process=regulation of protein activity, epigenetic
PNNNLPQQYLSGEYLLEDQMNTNQILNQIYRQQLGQSPLNRYLVNMRLVNGEQVYEVPEEFVNVQLLEQLFAKQELINQELTEITERRQPITEDVHYQQQLINQQIQKLIEQLAYHQNLITREVEQYIVKGQVVPQELVSQQRLVYQQVHEVIERLTSQQIFLNHLAESTEATEVDTISIQRWVVQQNIINEQIQQLIQQVLYQQTHVRQQIQVLIQQGHVIPQELVLYQKITYQYVERFLQVLIKQFVNQQTNYKQLIQILGQQRHTIPQELVSQYFAMYTQLLQLIQHGDIVPQELIYQQRQIHQQIVLMLQQLKVVPQQLVNQLVFNTQDRMWQTQGTYQRVPLMMQRTYQRVPLMM

SEQ ID NO: 22238 - protein, 242 aa, Diabrotica virgifera
  misc_feature: Coding regions on vcDNA: vcDNA=SeqID_1935; Strand=+; Position=54-782
  misc_feature: Homolog annotation: Hit_ID=CAH04314.1; Match level="QueryCoverage =99%, HitCoverage=100%, E-value=1e-115, Identity=87%"; Hit description=S3e ribosomal protein [Carabus granulatus]
  misc_feature: Gene Ontology Annotation: Molecular function=structural constituent of ribosome; Cellular component=cytosolic ribosome (sensu Eukarya); Biological process=protein biosynthesis
  misc_feature: Pfam annotation: Pfam_ID=Ribosomal_S3_C; Match level="Score=116.1, E -value=8.4e-32, Copies=1"; Pfam description=Ribosomal protein S3, C -terminal doma
MATSISKKRKFVGDGVFKAELNEFLTRELSEDGYSGVEVRVTPTRTEIIIMATRTDRVLGEKNRRIRELTSVVQKRFSFPPDSVVLYGEKVANRGLCAIAQAESLRFKLIGGLAVRRACYGVLRYIMECGAKGCEVVVSGKLRGQRAKSMKFVDGLMIHSGDPCNDYVDTATRHVLLRQGVLGIKVKIMLPWDPSGKTGPKKPLPDNVSVVEPKEETLPQSPSSEIKASKPDAPPAVPIAVA

SEQ ID NO: 22239 - protein, 107 aa, Diabrotica virgifera
  misc_feature: Coding regions on vcDNA: vcDNA=SeqID_1936; Strand=+; Position=764-1087
KIYASYLKCFWEISLCTRNIASFRCSIEKNLPFRFCLDKYSFGNLAKKLFRFGSLYFLWRNVTFWNRSVEIVLPYCTFEIIDTFNVKKLSNLYINLSFKIFCSFFLI

SEQ ID NO: 22240 - protein, 314 aa, Diabrotica virgifera
  misc_feature: Coding regions on vcDNA: vcDNA=SeqID_1937; Strand=+; Position=24-968
  misc_feature: Homolog annotation: Hit_ID=CAE47497.1; Match level="QueryCoverage =100%, HitCoverage=100%, E-value=1e-131, Identity=73%"; Hit description=cathepsin L-like proteinase [Diabrotica virgifera virgifera]
  misc_feature: Gene Ontology Annotation: Cellular component=extracellular space
  misc_feature: Pfam annotation: Pfam_ID=Peptidase_C1; Match level="Score=349.4, E -value=5.1e-102, Copies=1"; Pfam description=Papain family cysteine protease
MKLLIIAAALIVAANAKLSAFEHWSSFKATHNKSYNVIEEQLRFGVFQENLRKIEEHNTKYENGEETYYLAVNQFADWSNAEFKAMLDSQMAQRPKLLVAETFEADSNLQVPTEVDWRNKKADLGVRNQGSCGSCWAFSAVGAIEGQLAIHKKQHVQLSEQELVDCDTVNEGCNGGLMTDAFNYVKRHGLAPESKYKYTGKRGSCKKVHKQVSSLSGFVNLARTETALVNALANVGPISIAVDADTWQHYGGGVFNNKNCGTALNHGILAVGYTKDAFIVKNSWGTSWGENGYIRVIRGKNLCGINQMNSYPKL

SEQ ID NO: 22241 - protein, 275 aa, Diabrotica virgifera
  misc_feature: Coding regions on vcDNA: vcDNA=SeqID_1938; Strand=+; Position=118-942
  misc_feature: Homolog annotation: Hit_ID=AAB37398.1; Match level="QueryCoverage =95%, HitCoverage=94%, E-value=3e-91, Identity=55%"; Hit description =D-ERp60=protein disulphide isomerase isoform/multifunctional endoplasmic reticulum luminal polypeptide
  misc_feature: Gene Ontology Annotation: Molecular function=phospholipase C activity; Cellular component=mitochondrion; Biological process =protein-nucleus import
  misc_feature: Pfam annotation: Pfam_ID=Thioredoxin; Match level="Score=149.0, E -value=1.1e-41, Copies=1"; Pfam description=Thioredoxin
MMILFKVLTISMFFLLGSAKEEDVLDLGDSDFASRIAEHETALVMFYAPWCGHCKRLKPEYAKAAEDLLRNDPPIALVKVDCTEAGKETCDKNSVSGYPTLKIFRNGEVSQDYNGPRDASGIVKYMQSKVGPSSRELKTSECLKNFLETQKESVVVGFFEKESDLKAAFLKTADKLREKVKFAHTSFKELLDAQKVKDGLVLFRPVHLQNKFEDSKVQYSGSADAGSIQTFITKNLHGLVGHRKPDNKQEFENPLFVAYFSVDYAKNPKGTNYWR

SEQ ID NO: 22242 - protein, 151 aa, Diabrotica virgifera
  misc_feature: Coding regions on vcDNA: vcDNA=SeqID_1939; Strand=+; Position=47-502
  misc_feature: Homolog annotation: Hit_ID=CAH04329.1; Match level="QueryCoverage =100%, HitCoverage=100%, E-value=3e-80, Identity=98%"; Hit description=S13e ribosomal protein [Timarcha balearica]
  misc_feature: Gene Ontology Annotation: Molecular function=structural constituent of ribosome; Cellular component=cytosolic small ribosomal subunit (sensu Eukarya); Biological process=protein biosynthesis
  misc_feature: Pfam annotation: Pfam_ID=Ribosomal_S15; Match level="Score=103.8, E -value=4.3e-28, Copies=1"; Pfam description=Ribosomal protein S15
MGRMHAPGKGIAQSALPYRRSVPTWLKVTPEEVKDHIFKLGKKGLTPSQIGVILRDSYGVAQVRFVSGNKILRIMKAMGLAPDLPEDLYYLIKKAVAIRKHLERNRKDKDSKFRLILVESRIHRLARYYKTKSVLAPNWKYESSTASALVA

SEQ ID NO: 22243 - protein, 305 aa, Diabrotica virgifera
  misc_feature: Coding regions on vcDNA: vcDNA=SeqID_1940; Strand=+; Position=239-1153
  misc_feature: Homolog annotation: Hit_ID=AAN76688.1; Match level="QueryCoverage =95%, HitCoverage=57%, E-value=1e-126, Identity=71%"; Hit description= catalase [Apis mellifera ligustica]
  misc_feature: Gene Ontology Annotation: Molecular function=catalase activity; Cellular component=cytoplasm; Biological process=response to hydrogen peroxide
  misc_feature: Pfam annotation: Pfam_ID=Catalase; Match level="Score=482.8, E-value =3.4e-142, Copies=1"; Pfam description=Catalase
MANRDSATNQLLNYKKKTQGGESVTTGYGNPVGQFASLSVGPRGPILFQDQILVDELSHFNRERIPERVVHAKGAGAFGYFECTNDITKYSAAKLFSSIGKKTPIAIRFSTVGGESGSADTVRDPRGFAIKFYTEEGIWDLAGNNTPIFFIRDPIFFASFIRTQKRNPQTHLKDPDMFWDFMSLRPETMHQLLFLFSDRGIPDGYRHMNGYGSHTFKFVNKEGQVHFCKFHHKTDQGIQNLDVNKADDLSASDPDYSIRDLFNAIADGNYPSWTTYVQIMTPEQAQRSPFDPFDLEPGLGPQANI

SEQ ID NO: 22244 - protein, 543 aa, Diabrotica virgifera
  misc_feature: Coding regions on vcDNA: vcDNA=SeqID_1941; Strand=+; Position=3-1634
  misc_feature: Homolog annotation: Hit_ID=EAA16908.1; Match level="QueryCoverage =71%, HitCoverage=19%, E-value=2e-15, Identity=25%"; Hit description =Drosophila melanogaster CG8797 gene product-related [Plasmodium yoelii yoelii]
  misc_feature: Gene Ontology Annotation: Biological process=regulation of protein activity, epigenetic
LSADAWATMKVLVLLSLVAFSAALPTLLGRTALVKEDGTVTLTDSRGYQLVILKSVTDPRQVEVILRSPNTRTQMFQVGEPLRTRETIDRTLVGVSAYQNYNQADILTDIFRQYEGTLDDTKYYSLLNRIQMLVEAGLINETIYDIIRDWDLKHRVQGIRNLDQDLLQNYSPLRHFQTLLGQIQQQRQLQQGLLRQQQYLPQQYLSGEYRLEDQMNTNQILNQIYRQQLGQSPLNRYLVNMRLVNGQKVYEVPEEFVNIQLLEQLTAQQEMINQRWAQMMERRQPITEDVHSQQHLINQQIEKLIEQLAYHQNLITREVEQYIVKGQVVPQQLVYQQRLVYQQVHEVIERLYYQQLFMTRLAENITEVGTISLQRWILQHNIINEQIQQLIQQVLYQQTHVRQQIQVLIQQGQVIPQELVLYQRITYQNVERVLQVLIKQFVYQQTYFKQLIQLLGQQRYAVPQELVSQYFTIYSQLLQLVQHGDVVPQELVYQQRLIHQQIVLMLQQLKVVPQQVMAQRVPTTKQERLWQTQNLYQTLPRVY

SEQ ID NO: 22245 - protein, 128 aa, Diabrotica virgifera
  misc_feature: Coding regions on vcDNA: vcDNA=SeqID_1942; Strand=+; Position=1113 -1496
  misc_feature: Homolog annotation: Hit_ID=AAK12347.1; Match level="QueryCoverage =85%, HitCoverage=17%, E-value=1e-52, Identity=96%"; Hit description =elongation factor-2 [Machiloides banksi]
  misc_feature: Gene Ontology Annotation: Molecular function=ATP binding; Cellular component=nucleolus; Biological process=protein biosynthesis
  misc_feature: Pfam annotation: Pfam_ID=GTP_EFTU; Match level="Score=-29.0, E-value =7.9e-05, Copies=1"; Pfam description=Elongation factor Tu GTP binding domai
TLQKKKKRAAARDLELVLVSKAGIIAGAKAGETRFTDTRKDEQERCITIKSTAISMFFELDDKDLVFITNADQREKDVKGFLINLIDSPGHVDFSSEVTAALRVTDGALVVVDCVSGVCVQTETVLPS

SEQ ID NO: 22246 - protein, 48 aa, Diabrotica virgifera
  misc_feature: Coding regions on vcDNA: vcDNA=SeqID_1943; Strand=+; Position=1-147
LVLDRERPPFFFFFLFFFFFFFFFFFFFNIYLNIKIILYIWSFRTKIY

SEQ ID NO: 22247 - protein, 491 aa, Diabrotica virgifera
  misc_feature: Coding regions on vcDNA: vcDNA=SeqID_1944; Strand=+; Position=166-1641
  misc_feature: Homolog annotation: Hit_ID=NP_725084.2; Match level="QueryCoverage =97%, HitCoverage=97%, E-value=0.0, Identity=65%"; Hit description =CG8983-PA, isoform A [Drosophila melanogaster] gb|AAF58609.2| CG8983- PA, isoform A [Drosophila
  misc_feature: Gene Ontology Annotation: Molecular function=phospholipase C activity; Cellular component=mitochondrion; Biological process =protein-nucleus import
  misc_feature: Pfam annotation: Pfam_ID=Thioredoxin; Match level="Score=325.1, E -value=1e-94, Copies=2"; Pfam description=Thioredoxin
MMILFKVLTISMFFLLGSAKEEDVLDLGDSDFASRIAEHETALVMFYAPWCGHCKRLKPEYAKAAEDLLRNDPPIALVKVDCTEAGKETCDKNSVSGYPTLKIFRNGEVSQDYNGPRDASGIVKYMQSKVGPSSRELKTSECLKNFLETQKESVVVGFFEKESDLKAAFLKTADKLREKVKFAHTSFKELLDAQKVKDGLVLFRPVHLQNKFEDSKVQYSGSADAGSIQTFITKNLHGLVGHRKPDNKQEFENPLFVAYFSVDYAKNPKGTNYWRNRILKVAKEFQERANFAISSNDEFQHELNEFGLDYVKGDKPVVGARDAKNQKFVLKEFSLEAFEVFVSDVLDGALEPYLKSEPIPEDADAPLKTLVAKNFDQVIDNSKDALIEFYAPWCGHCKKLAPIYEELAEKLKDEDVVIAKMDATANDVPSNFEVRGFPTIFWVPKNSKDSPVTYEGGRDVDDFVKYVAKHATNELKGYDRSGSPKEGKTEL

SEQ ID NO: 22248 - protein, 132 aa, Diabrotica virgifera
  misc_feature: Coding regions on vcDNA: vcDNA=SeqID_1945; Strand=+; Position=2271 -2666
  misc_feature: Homolog annotation: Hit_ID=XP_394723.1; Match level="QueryCoverage =96%, HitCoverage=18%, E-value=8e-58, Identity=81%"; Hit description =similar to ENSANGP00000015773 [Apis mellifera]
  misc_feature: Gene Ontology Annotation: Molecular function=RNA helicase activity; Cellular component=nucleus; Biological process=cell growth
  misc_feature: Pfam annotation: Pfam_ID=DEAD; Match level="Score=94.2, E-value=3.5e -25, Copies=1"; Pfam description=DEAD/DEAH box helicase
NRRPIQAQGWPIAMSGHDMVGIAQTGSGKTLAYILPAAIHINNQPPLNKGEGPIVLVLAPTRELAQQIQEVSNDFGRSTNIRNSCIFGGAPKGPQARDLQRGIEICIATPGRLIDFLEKGSTNLKKCTYLVL

SEQ ID NO: 22249 - protein, 339 aa, Diabrotica virgifera
  misc_feature: Coding regions on vcDNA: vcDNA=SeqID_1946; Strand=+; Position=79-1098
  misc_feature: Homolog annotation: Hit_ID=XP_315409.1; Match level="QueryCoverage =100%, HitCoverage=100%, E-value=1e-176, Identity=80%"; Hit description=ENSANGP00000014266 [Anopheles gambiae] gb|EAA10887.2| ENSANGP00000014266 [Anopheles gambiae
  misc_feature: Gene Ontology Annotation: Molecular function=protein binding; Cellular component=nucleus; Biological process=regulation of transcription from Pol II promoter
  misc_feature: Pfam annotation: Pfam_ID=LIM; Match level="Score=222.5, E-value=7.9e -64, Copies=5"; Pfam description=LIM domain
MGDVEVSSNFTITEKKTKKVKKTTKQRRGSNEQTEVTIQELKNGNQGGEYTKAMNKDWHGQHFCCWQCDESLTGQRYVLRDEHPYCVSCYESVFANACEKCSKVIGIDSKDLSYKDKHWHEACFLCTTCGESLVDKQFGSKGDRIYCGNCYDQQFASRCDGCHEIFRAGTKKMEYKTRQWHEKCFCCCVCKVPIGTQSFIPREQEIYCAKCYEEKFATRCIKCNKVITSGGVTYKNEPWHRECFTCTNCQRSLAGERFTSRDDKPYCAECFGELFAKRCTACRKPITGIGGTKFISFEERHWHNDCFFCASCKTSLVGRGFITDQDDIICPDCAKTKLM

SEQ ID NO: 22250 - protein, 1014 aa, Diabrotica virgifera
  misc_feature: Coding regions on vcDNA: vcDNA=SeqID_1947; Strand=-; Position=1212 -4256
  misc_feature: Homolog annotation: Hit_ID=Q03277; Match level="QueryCoverage=90%, HitCoverage=92%, E-value=1e-103, Identity=28%"; Hit description =Retrovirus-related POL polyprotein from type I retrotransposable element R1 [Contains:
  misc_feature: Pfam annotation: Pfam_ID=RVT_1; Match level="Score=182.1, E-value =1.2e-51, Copies=1"; Pfam description=Reverse transcriptase (RNA -dependent
MRSTTVLHEVRKFAEDQKLDIVCMQEAYTKQGKIQFMPLKAQKASIGDNPMAVTVLFNNEMKLFLLRQFSDEHCVCVEVLTKVGKVIIANLYCQFNDDIEPYIEKMRAIFLAYRNEKVVVVADANAKSVLWNSPQTDERGALVEDIINELQLIVHNRPGNPPTFQNRAGAASNIDISISNVKAANLVKNWKVVEHATTSDHNFIVFELANTANSTYLSSKKKYNLGKANWEQLKAEFLPPRPILRGCNVHEEAKHLTAAIRAAMDIAIPKVASAKSVTNTAWKESLTRLRSRVRLARKRYQRCGIYLERQRLLQEYRDIKSEYKREIVQTKAKSWEMFVSRNLELDMWGVPYKIVSNKIKSPIMLSTLLKEDGSLTESWEESADILLDVLLPPDDLENETEIQTQIREAMIQRYETPGVPVTEEFTENEIRENLRTMKKRKAPGPDNIHVEILQALHEQVVPTLVALYNECVRQRKFPNNFKQADVIIISKGEDKDPTQPKSYRPICLLNTMGKLFEKLLCARLNHVRSINGLHPDQYGYRSGKSTEDAINKVYEIVDSSEGKYVVTVFIDISGAFDNLWWPAFFERLRRMRCPGDLYGSFRNYCQDRYASLSCPNAKKTRHITKGCPQGSVCGPIFWDLMLEELLGEMTVCPDVLGCIAYADDLLLIIDADSRRQLEGKANDVLQIISNWTSKVKLSISQTKTVYSLIKGRLERDPIIRIDGRPIRRTSTAKYLGIVIDEPRLFSKHITSVCEKATRLMHGIASLAQRDYRVPFRQVRVYLSSILASIIGYGASTWAHRLKNVKNREKVDRAQRGFLVRMTGAFSTTPTEALTVLTGVLPLHLEITRRGSQYWLRKHNPDKVIEILGVHVHTRNEINNVIERKRQNEWDASVKGRRLYQYIPRLNEIPPYFNPKPGLVHFLTGHGPYPSYLHRFSLKQDDLCECGQVGTPEHAIFDCDIYEDVGDLRQRLQARQIAEILNDEELYNNLNDLTDRVSKKQLELYNQRRNIQRIP

SEQ ID NO: 22251 - protein, 278 aa, Diabrotica virgifera
  misc_feature: Coding regions on vcDNA: vcDNA=SeqID_1948; Strand=+; Position=84-917
  misc_feature: Homolog annotation: Hit_ID=AAB37398.1; Match level="QueryCoverage =95%, HitCoverage=94%, E-value=6e-93, Identity=55%"; Hit description =D-ERp60=protein disulphide isomerase isoform/multifunctional endoplasmic reticulum luminal polypeptide
  misc_feature: Gene Ontology Annotation: Molecular function=phospholipase C activity; Cellular component=mitochondrion; Biological process =protein-nucleus import
  misc_feature: Pfam annotation: Pfam_ID=Thioredoxin; Match level="Score=149.0, E -value=1.1e-41, Copies=1"; Pfam description=Thioredoxin
MMILFKVLTISMFFLLGSAKEEDVLDLGDSDFASRIAEHETALVMFYAPWCGHCKRLKPEYAKAAEDLLRNDPPIALVKVDCTEAGKETCDKNSVSGYPTLKIFRNGEVSQDYNGPRDASGIVKYMQSKVGPSSRELKTSECLKNFLETQKESVVVGFFEKESDLKAAFLKTADKLREKVKFAHTSFKELLDAQKVKDGLVLFRPVHLQNKFEDSKVQYSGSADAGSIQTFITKNLHGLVGHRKPDNKQEFENPLFVAYFSVDYAKNPKGTNYWRNRI

SEQ ID NO: 22252 - protein, 213 aa, Diabrotica virgifera
  misc_feature: Coding regions on vcDNA: vcDNA=SeqID_1949; Strand=+; Position=115-756
  misc_feature: Homolog annotation: Hit_ID=AAP57194.1; Match level="QueryCoverage =97%, HitCoverage=97%, E-value=2e-88, Identity=75%"; Hit description =ferritin [Leptinotarsa decemlineata]
  misc_feature: Gene Ontology Annotation: Molecular function=ferrous iron binding; Cellular component=ferritin complex; Biological process=iron ion homeostasis
  misc_feature: Pfam annotation: Pfam_ID=Ferritin; Match level="Score=138.8, E-value =1.3e-38, Copies=1"; Pfam description=Ferritin-like domain
MKSVGLFVFLACIAGLYAIQLKCAHQELNIPNEWIDMHKECVHKMRGQVEEELKASMQYMAMGAHFSKDTINRPGFADLFFDAASEEREHAIKLIHYLLMRGELTSNLSELIKRNLVPSVTTWDNGVSALKQALQLEASVTRKIRDVTKVCEEAESFNDYHLVDYLAGDFLGEQYHGQRDLAGKVSDLQKMMAEHGALGEWLFDKKLQNKAIV

SEQ ID NO: 22253 - protein, 438 aa, Diabrotica virgifera
  misc_feature: Coding regions on vcDNA: vcDNA=SeqID_1950; Strand=+; Position=392-1705
  misc_feature: Homolog annotation: Hit_ID=BAA78480.1; Match level="QueryCoverage =52%, HitCoverage=42%, E-value=5e-14, Identity=29%"; Hit description =56 kDa early-staged encapsulation-inducing protein [Tenebrio molitor]
MKVLVLLSLVAFSAALPTLLGRTALVKEDGTVTLTDSRGYQLVILKSVTDPRQVEVILRSPNTRTQMFQVGEPLRTRETIDRTLVGVSAYQNYNQADILTDIFRQYEGTLDDTKYYSLLNRIQMLVEAGLINETIYDIIRDWDLEHRVQGISDIVPTQGVNTLRQYVGQVGDVMPLGENVQSGIYRNWNLDQDLLQNYSPLRHFQTLLGQIQQQRQLQQGLLSQQQYLPQQYLSGEYRLEDQMNTNQILNQIYRQQLGQSPLNRYLVNMRLVNGQQVYEVPEEFVNIQLLEQLTAQQEMINQRWAQMMERRQPITEDVHSQQHLINQQIEKLIEQLAYHQNLITREVEQYIVKGQVVPQQLVYQQRLVYQQVHEVIERLYYQQLFMTRLAENITEVGTISLQRWILQHNIINEQIQQLIQQVLYQQTHVREQIQVLIH

SEQ ID NO: 22254 - protein, 314 aa, Diabrotica virgifera
  misc_feature: Coding regions on vcDNA: vcDNA=SeqID_1951; Strand=+; Position=45-989
  misc_feature: Homolog annotation: Hit_ID=CAE47497.1; Match level="QueryCoverage =100%, HitCoverage=100%, E-value=1e-165, Identity=90%"; Hit description=cathepsin L-like proteinase [Diabrotica virgifera virgifera]
  misc_feature: Gene Ontology Annotation: Molecular function=cathepsin K activity; Cellular component=extracellular space; Biological process =proteolysis and peptidolysis
  misc_feature: Pfam annotation: Pfam_ID=Peptidase_C1; Match level="Score=320.3, E -value=2.8e-93, Copies=1"; Pfam description=Papain family cysteine protease
MKLFILAAALIVATSANLGAFEKWTSFKATHNKSYNVIEDKLRFAVFQENLKKIEEHNAKYESGEETYYLAVNKFADWSSAEFQAMLARQMANKPKQTFIGKHVEDPNVQAADEVDWRSSADLGVKDQGNCGSCWAFSTTGSLEGQLAIHKNQRVPLSEQELVDCDTVNAGCDGGLMTDAFNYVKGHGLSSESQYAYTGRDGRCKNVQNKQVSSISGYVELATTENALVSALASVGPVSIAVDADTWQFYGGGVFNNRNCGTALNHGILAVGYTKDVFIVKNSWGTSWGEKGYIRVARGHNLCGINLMNSYPKL

SEQ ID NO: 22255 - protein, 306 aa, Diabrotica virgifera
  misc_feature: Coding regions on vcDNA: vcDNA=SeqID_1952; Strand=+; Position=365-1285
  misc_feature: Homolog annotation: Hit_ID=AAV34856.1; Match level="QueryCoverage =99%, HitCoverage=99%, E-value=1e-120, Identity=71%"; Hit description= ribosomal protein SA [Bombyx mori]
  misc_feature: Gene Ontology Annotation: Molecular function=structural constituent of ribosome; Cellular component=cytosolic ribosome (sensu Eukarya); Biological process=protein biosynthesis
  misc_feature: Pfam annotation: Pfam_ID=Ribosomal_S2; Match level="Score=335.7, E -value=6.5e-98, Copies=1"; Pfam description=Ribosomal protein S2
MSGGIEALSLKEDDVTKMLAASTHLGTANVDFQMEQYVYKRRHDGTHIINLRKTWEKILLAARAIVAIEHPGEVFVISSRPYGQRAVLKFAAHTGATPIAGRFTPGAFTNQIQAAFREPRLLIVTDPAFDHQPITEASYVNIPVIALCNTDSPLRFVDIAIPGNNKASHSIGLLWWLLAREVLRLRGIIPRDTKWDVVVDLFFYREPEEAEKEEQAAKEAVAAVVKPVDIPAPLEGQDLDWNTTETTDWNAEVAPVAPVAAPAYNVSATQDWASEVAQEEWSTSQPAAPAAPAAAAPNWGGASEWR

SEQ ID NO: 22256 - protein, 94 aa, Diabrotica virgifera
  misc_feature: Coding regions on vcDNA: vcDNA=SeqID_1953; Strand=+; Position=1293 -1578
  misc_feature: Homolog annotation: Hit_ID=XP_453836.1; Match level="QueryCoverage =100%, HitCoverage=98%, E-value=7e-25, Identity=63%"; Hit description= unnamed protein product [Kluyveromyces lactis] emb|CAH00932.1| unnamed protein product
  misc_feature (68)..(68): Xaa can be any naturally occurring amino acid
LRQVSCYTLLGGFRLPWPPSCCLKLPTPFMVSHKRRFWRFNSTFGSSHSASSAYQKWPTWHSDSFLTXHKFEQAEDLTHLKFENRLRSFRPQCL

SEQ ID NO: 22257 - protein, 392 aa, Diabrotica virgifera
  misc_feature: Coding regions on vcDNA: vcDNA=SeqID_1954; Strand=-; Position=67-1245
  misc_feature: Homolog annotation: Hit_ID=AAL62468.1; Match level="QueryCoverage =91%, HitCoverage=87%, E-value=0.0, Identity=88%"; Hit description =ribosomal protein L3 [Spodoptera frugiperda]
  misc_feature: Gene Ontology Annotation: Molecular function=structural constituent of ribosome; Cellular component=ribosome; Biological process=protein biosynthesis
  misc_feature: Pfam annotation: Pfam_ID=Ribosomal_L3; Match level="Score=583.1, E -value=2.3e-172, Copies=1"; Pfam description=Ribosomal protein L3
MPCSNTGNFTKTFVCLTGQFLCVPTRSNTFVSMTHVVREADRPGSKINKKEIVEAVTILETPPMVIVGVVGYIETPHGLRALATVWAEHLSEDCRRRFYKNWYKSKKKAFTKASKKWSDDLGKKSIEKDLKKIVKYCKVVRVIAHTQMKLLKQRQKKAHIMEIQLNGGSVADKVAWAKEHLEKPIPIANVFAQDEMIDCIGVTKGHGYKGVTSRWHTKKLPRKTHKGLRKVACIGAWHPSRVSFTVARAGQKGYHHRTEMNKKIYRIGAGIHTKDGKVVKNNAATAYDLSEKTITPMGGFPHYGEVNNDFVMIKGCCMGPKKRVITLRKSLLVHTKRIALEKINLKFIDTSSKFGHGRFQTAADKAAFMGPLKKDRVKEEEKAAAPAAAASS

SEQ ID NO: 22258 - protein, 162 aa, Diabrotica virgifera
  misc_feature: Coding regions on vcDNA: vcDNA=SeqID_1955; Strand=-; Position=98-586
  misc_feature: Homolog annotation: Hit_ID=AAV34814.1; Match level="QueryCoverage =96%, HitCoverage=52%, E-value=1e-60, Identity=70%"; Hit description =ribosomal protein L5 [Bombyx mori]
  misc_feature: Gene Ontology Annotation: Molecular function=5S RNA binding; Cellular component=ribosome; Biological process=protein biosynthesis
MHRPGAFRCYLDTGLNRTSTGARVFGAMKGAVDGGLNIPHSTKRFPGFDSESKSFNAEVHRNHIFGIHVADYMKSLEEEDPEAFKRQFSQYIKLGINADQIENMYKNAHAAIRANPELEKKAEKAPAPAKRWNRRKLTLAERKDRVAQKKKSYLAKLQDQES

SEQ ID NO: 22259 - protein, 305 aa, Diabrotica virgifera
  misc_feature: Coding regions on vcDNA: vcDNA=SeqID_1956; Strand=+; Position=293-1207
  misc_feature: Homolog annotation: Hit_ID=XP_317256.1; Match level="QueryCoverage =87%, HitCoverage=51%, E-value=3e-61, Identity=43%"; Hit description =ENSANGP00000021816 [Anopheles gambiae]
  misc_feature: Pfam annotation: Pfam_ID=p450; Match level="Score=-165.9, E-value =0.0013, Copies=1"; Pfam description=Cytochrome P450
MDLFIGYTSYASIYIYSKRQFSYWKDRNVVHIEPVFFYGNIKPVMKRRAHITDVLGELYNKVKAQGKRFGGHYALFTPQFIPVDLDLIKCILHKDFASFTNRGLYVNEEKDPLTGHLFNLEDEKWRNLRAKLTPTFTSGKMKMMFQTMVSSSEGLQEMLKTTSSSTEPVDIKDILGCFTTDVIGSVAFGLDINSMKNPDSEFREYGKRIFRTTLMGRIKFMFLTIFPRWLSKKIGIKIFSKDTESFYINLVKKTVAYREENDVYRKDFMQLLYQLKSMGKVSEENEDQLVQKTKIATSQGLSLNE

SEQ ID NO: 22260 - protein, 568 aa, Diabrotica virgifera
  misc_feature: Coding regions on vcDNA: vcDNA=SeqID_1957; Strand=+; Position=17-1723
  misc_feature: Homolog annotation: Hit_ID=BAA78480.1; Match level="QueryCoverage =87%, HitCoverage=89%, E-value=5e-16, Identity=27%"; Hit description =56 kDa early-staged encapsulation-inducing protein [Tenebrio molitor]
  misc_feature: Gene Ontology Annotation: Biological process=regulation of protein activity, epigenetic
MKVLVLLSLVAFSAALPTLLGRTALVKEDGTVTLTDSRGYQLVILKSVADPSQVEVVLRSPNTRTQMFQVGEPLRTGEAIDRTLVGVSRYQNNNQGDILTDIFRQYEGTLDDTKYYSLLNRIQMLVEAGLINETIYDIIRDWDLKHRVQGISDIVPTQGVSTLRQYAGQVGDVMPLGENVQSVIYRNWNLDQDLLQNYSPLRHFQTLLGQIQQQRELQQGLLSQQQYLPQQYLSGEYLLEDQMNTNQILNQIYRQQLGQSPLNRYLVNMRLVNGQQVYEVPEEFVNVQLLEQLTAKQEIINQKWTQMMERRQPITEDVQHQQQLINQQIERLIEQLAYHQNLITREVEQYIVKGQVVPQQLVYQQRLVYQQVHEVIERLYYQQLFMTRLAENITEVGTISLQRWILQHNIINEQIQQLIQQVLYQQTHVRQQIQVLIQQGEVIPHELVLYQRITYQDVERVLQVLIKQFVYQQTYFKQLIQLLGQQRYAVPQELVSQYFTIYTQLVQLIQHGDVVPQELIYQQRLIHQQIVLMLQQLKVVPQQVMTQMVPTTQERLWQTQYQTLPRVY

SEQ ID NO: 22261 - protein, 412 aa, Diabrotica virgifera
  misc_feature: Coding regions on vcDNA: vcDNA=SeqID_1958; Strand=-; Position=45-1283
  misc_feature: Homolog annotation: Hit_ID=AAV34812.1; Match level="QueryCoverage =99%, HitCoverage=99%, E-value=0.0, Identity=89%"; Hit description =ribosomal protein L3 [Bombyx mori]
  misc_feature: Gene Ontology Annotation: Molecular function=structural constituent of ribosome; Cellular component=ribosome; Biological process=protein biosynthesis
  misc_feature: Pfam annotation: Pfam_ID=Ribosomal_L3; Match level="Score=597.4, E -value=1.1e-176, Copies=1"; Pfam description=Ribosomal protein L3
MSHRKFSAPRHGSMGFYPKKRSQRHRGKVKAFPKDDPSKPVHLTAFIGYKAGMTHVVREADRPGSKINKKEIVEAVTILETPPMVIVGVVGYIETPHGLRALATVWAEHLSEDCRRRFYKNWYKSKKKAFTKASKKWSDDLGKKSIEKDLKKIVKYCKVVRVIAHTQMKLLKQRQKKAHIMEIQLNGGSVADKVAWAKEHLEKPIPIANVFAQDEMIDCIGVTKGHGYKGVTSRWHTKKLPRKTHKGLRKVACIGAWHPSRVSFTVARAGQKGYHHRTEMNKKIYRIGAGIHTKDGKVVKNNAATAYDLSEKTITPMGGFPHYGEVNNDFVMIKGCCMGPKKRVITLRKSLLVHTKRIALEKINLKFIDTSSKFGHGRFQTAADKAAFMGPLKKDRVKEEEKAAAPAAAASS

SEQ ID NO: 22262 - protein, 460 aa, Diabrotica virgifera
  misc_feature: Coding regions on vcDNA: vcDNA=SeqID_1959; Strand=+; Position=30-1412
  misc_feature: Homolog annotation: Hit_ID=BAA78480.1; Match level="QueryCoverage =50%, HitCoverage=42%, E-value=5e-13, Identity=26%"; Hit description =56 kDa early-staged encapsulation-inducing protein [Tenebrio molitor]
MKVLVLFSLVVLSVALPTLLGRTVRVKEDGTVSLFDSRGYQLVILKSVADPSQVEVVLRSPNTRTQMFQVGEPLRTGEAIDRRTLAGVSVYQNYNQADILTDIFRQYEGILDDTKYYNLLNRIQMLVEAGLINETIYDVIRNWDREYRMQGISDIVPVQGVRTLRQYAEQVGDVMPLGQNLQYGNQRNWALDQGLLQTYSPLRHFQTLLGQIQQQRVLQQGLLTQQQYLPQQYLSGEYLLEDQMNTNQILNQIYRQQLGQSPLNRYLVNMRLVNGEQVYEVPEEFVNVQLLEQLFAKQELINQELTEITERRQPITEDVHYQQQLINQQIQKLIEQLAYHQNLITREVEQYIVKGQVVPQELVSQQRLVYQQVHEVIERLTSQQIFLNHLAESTEATEVDTISIQRWVVQQNIINEQIQQLIQVFVPTNSRKATNPSTNSTRTCYPTGTRPLPKNYLPIC

SEQ ID NO: 22263 - protein, 316 aa, Diabrotica virgifera
  misc_feature: Coding regions on vcDNA: vcDNA=SeqID_1960; Strand=+; Position=558-1508
  misc_feature: Homolog annotation: Hit_ID=CAE47497.1; Match level="QueryCoverage =99%, HitCoverage=100%, E-value=1e-152, Identity=83%"; Hit description=cathepsin L-like proteinase [Diabrotica virgifera virgifera]
  misc_feature: Gene Ontology Annotation: Molecular function=cathepsin K activity; Cellular component=extracellular space; Biological process =proteolysis and peptidolysis
  misc_feature: Pfam annotation: Pfam_ID=Peptidase_C1; Match level="Score=337.7, E -value=1.7e-98, Copies=1"; Pfam description=Papain family cysteine protease
TILKLLILAATLIVAINANLSAFEQWTSFKATHNKFYNVIEDKLRFAVFQENLRKIDAHNAKYEKGEETYYMAVNKFADWSSAEFQAMLDRQMANKPKQSFIAKHVVDPNVQAVEEVDWRESAVLGVKDQGQCGSCWAFSTTGSLEGQLAIHKNQRVPLSEQELVDCDKVNDGCDGGLMTDAFFYIEHHGLSSEEQYPYTGVDGHCNHVKDKQVSSISGYVELDETESALADALANVGPVSIAVEADTWQFYSGGVFNNKNCGDALNHGVLAVGYTKDVFIVKNSWGTGWGEQGYIRVARGSNLCGINLMNSYPKL

SEQ ID NO: 22264 - protein, 372 aa, Diabrotica virgifera
  misc_feature: Coding regions on vcDNA: vcDNA=SeqID_1961; Strand=+; Position=483-1600
  misc_feature: Homolog annotation: Hit_ID=CAC51710.1; Match level="QueryCoverage =99%, HitCoverage=97%, E-value=1e-164, Identity=75%"; Hit description= cytochrome b [Tribolium castaneum] ref|NP_203166.1|CYTB_15766 cytochrome b [Tribolium castaneum]
  misc_feature: Pfam annotation: Pfam_ID=Cytochrom_B_N; Match level="Score=336.0, E -value=5.6e-98, Copies=1"; Pfam description=Cytochrome b(N -terminal)/b6/petB
  misc_feature (32)..(32): Xaa can be any naturally occurring amino acid
  misc_feature (78)..(78): Xaa can be any naturally occurring amino acid
  misc_feature (90)..(90): Xaa can be any naturally occurring amino acid
  misc_feature (115)..(115): Xaa can be any naturally occurring amino acid
  misc_feature (137)..(137): Xaa can be any naturally occurring amino acid
  misc_feature (143)..(143): Xaa can be any naturally occurring amino acid
  misc_feature (165)..(165): Xaa can be any naturally occurring amino acid
  misc_feature (167)..(167): Xaa can be any naturally occurring amino acid
  misc_feature (274)..(274): Xaa can be any naturally occurring amino acid
  misc_feature (328)..(328): Xaa can be any naturally occurring amino acid
  misc_feature (339)..(339): Xaa can be any naturally occurring amino acid
MKIPLRKINPLLKIINNSLIILPTPSNISSIXNFGSLLGLCLGIQIITGLFLAIHYCPNVELAFNRVAHICRDVNYGXLLRTLHANGASXFFFICLYIHIGRGIYYRSYNIIETXIIGVTIFFLTIATAFLGYVLPXGQISFXGATVITNLISAIPYLGNILVQXFXGGFAVDNATLTRFFTFHFILPFIIFAFIIIHLLFLHQTGSRNPLGTKRNIDKIPFHPYFTFKDILGFLILLLLLTTLTLKDPYLLGDPDNFTPANPLVTPVHIQPEXIFLFAYAILRSIPNKLGGVIALIISIAILYILPFINKKKYLRTQFYPINKILFXRLLSIVILLTXIGARPVEDPYILTGQILTIVYFLYYLINPLIRK

SEQ ID NO: 22265 - protein, 483 aa, Diabrotica virgifera
  misc_feature: Coding regions on vcDNA: vcDNA=SeqID_1962; Strand=+; Position=712-2160
  misc_feature: Homolog annotation: Hit_ID=BAA78480.1; Match level="QueryCoverage =94%, HitCoverage=82%, E-value=5e-15, Identity=27%"; Hit description =56 kDa early-staged encapsulation-inducing protein [Tenebrio molitor]
  misc_feature: Gene Ontology Annotation: Biological process=regulation of protein activity, epigenetic
  misc_feature (475)..(475): Xaa can be any naturally occurring amino acid
TLADAWATMKVLVLLSLVAFSAALPTLLGRTALVKEDGTVTLTDSRGYQLVILKSVTDPRQVEVILRSPNTRTQMFQVGEPLRTRETIDRTLVGVSAYQNYNQADILTDIFRQYEGTLDDTKYYSLLNRIQMLVEAGLINETIYDIIRDWDLKHRVQGISDIVPTQGVNTLRQYVGQVGDVMPLGENVQSGIYRNWNLDQDLLQNYSPLRHFQTLLGQIQQQRQLQQGLLRQQQYLPQQYLSGEYRLEDQMNTNQILNQIYRQQLGQSPLNRYLVNMRLVNGQKVYEVPEEFVNIQLLEQLTAQQEMINQRWAQMMERRQPITEDVHSQQHLINQQIEKLIEQLAYHQNLITREVEQYIVKGQVVPQQLVYQQRLVYQQVHEVIERLYYQQLFMTRLAENITEVGTISLQRWILQHNIINEQIQQLIQQVLYQQTHVRQQIQVLIQQGQVIPQELVLYQRITYQNVERSLFSLIXQFVYQQTY

SEQ ID NO: 22266 - protein, 306 aa, Diabrotica virgifera; identical to SEQ ID NO: 22255
  misc_feature: Coding regions on vcDNA: vcDNA=SeqID_1963; Strand=+; Position=1247 -2167
  misc_feature: Homolog annotation: Hit_ID=AAV34856.1; Match level="QueryCoverage =99%, HitCoverage=99%, E-value=1e-120, Identity=71%"; Hit description= ribosomal protein SA [Bombyx mori]
  misc_feature: Gene Ontology Annotation: Molecular function=structural constituent of ribosome; Cellular component=cytosolic ribosome (sensu Eukarya); Biological process=protein biosynthesis
  misc_feature: Pfam annotation: Pfam_ID=Ribosomal_S2; Match level="Score=335.7, E -value=6.5e-98, Copies=1"; Pfam description=Ribosomal protein S2

SEQ ID NO: 22267 - protein, 587 aa, Diabrotica virgifera
  misc_feature: Coding regions on vcDNA: vcDNA=SeqID_1964; Strand=+; Position=842-2605
  misc_feature: Homolog annotation: Hit_ID=EAA16908.1; Match level="QueryCoverage =70%, HitCoverage=21%, E-value=2e-14, Identity=24%"; Hit description =Drosophila melanogaster CG8797 gene product-related [Plasmodium yoelii yoelii]
  misc_feature: Gene Ontology Annotation: Biological process=regulation of protein activity, epigenetic
LAKMKVLVLFSLVALSVALPTLLGRTVRVTEDGTVSLFDSRGYQLVILKSVTDPRQVEVVLRSPNTRTHMFQVGEPLRTGEAIDRRTLAGVSVYQNYNQADILTDIFRQYEGTLDDTKYYSLLNRIQMLVEAGVVNETIYDVIRNWDREYRMQGISDIVPVQGVRTLRQYAGQVGNVMPLGQNLEYGNHRTWALDQGLLQTYSPLRHFQTLLGQIQQQRQLQQGLLSQQQYLPQQYLSGESLLEDQMNTNQILSQIYRQQLGQSPLNRYLVNMRLVNGEQVYEVPEEFVNVQLLEKLFAKQELINQELTEITERRQPVTEDVHYQQQMINEQIEKLIEQLAYHQNLITREVEQYIVKGQVVPQQLVYQQRLVYQQVHEVIERLTYQQIFLNRLAESTEATEVDTISIQRWVVQQNIINEQIQQLIQQVLYQQTHVRQQIQVLIQQGHVIPQELVLYQRITYQHVERFLQVLIKQFVYQQTYYKQLIQVLAQQKHTIPQELVSQYFAIYTQILQLIQHGDAVPQELIYQQRQIHQQIVLMLQQLKVVPQQLLNQLMSNTQGRMWQTQGTYQRVPIMVQGTYQRVPLMM

SEQ ID NO: 22268 - protein, 191 aa, Diabrotica virgifera
  misc_feature: Coding regions on vcDNA: vcDNA=SeqID_1965; Strand=-; Position=1117 -1694
  misc_feature: Homolog annotation: Hit_ID=XP_391841.1; Match level="QueryCoverage =96%, HitCoverage=74%, E-value=5e-88, Identity=88%"; Hit description =similar to ENSANGP00000009311 [Apis mellifera]
  misc_feature: Gene Ontology Annotation: Molecular function=protein domain specific binding; Cellular component=cellular_component unknown; Biological process=protein targeting
  misc_feature: Pfam annotation: Pfam_ID=14-3-3; Match level="Score=286.0, E-value =6.1e-83, Copies=1"; Pfam description=14-3-3 protein
  misc_feature (21)..(21): Xaa can be any naturally occurring amino acid
KIHHGLRVSSTERETDRSEKXTEVLTEYREKVEKELREICDDVLGLLDKYLIPKASNAESKVFYLKMKGDYYRYLAEVATGDTRNTVVDYSQKAYQDAFEISKAKMTPTHPIRLGLALNFSVFYYEILNSPDKACQLAKQAFDDAIAELDTLNEDSYKDSTLIMQLLRDNLTLWTSDTQGEADEPQEAGDN

SEQ ID NO: 22269 - protein, 251 aa, Diabrotica virgifera
  misc_feature: Coding regions on vcDNA: vcDNA=SeqID_1966; Strand=+; Position=1038 -1792
  misc_feature: Homolog annotation: Hit_ID=BAB33421.1; Match level="QueryCoverage =74%, HitCoverage=65%, E-value=2e-64, Identity=67%"; Hit description =putative senescence-associated protein [Pisum sativum]
  misc_feature (56)..(56): Xaa can be any naturally occurring amino acid
  misc_feature (68)..(68): Xaa can be any naturally occurring amino acid
  misc_feature (135)..(135): Xaa can be any naturally occurring amino acid
  misc_feature (144)..(144): Xaa can be any naturally occurring amino acid
  misc_feature (176)..(176): Xaa can be any naturally occurring amino acid
AFRLSELQEISLPPLTRKDTALEAFRHNPTDGSFAPLPARVSASTKCPNLRFLSYXSRITIATTSHQXGKTNLSHDGLNPAHVPCLWVNNPTLGEFCFAMIGRADIEGSKSDVAMNAWPPQASYPCGNFSDTSCXNSSSQKDRXAVLSQSLCILNIRIKPAFALLLYARFLSSLSXALGHLRYSLTDVPPQSNSPPGSVLESNQAGGKLTLETKHTDASRVSERQALSEPRNRRTAQRNETSLRALGSRIP

SEQ ID NO: 22270 - protein, 844 aa, Diabrotica virgifera
  misc_feature: Coding regions on vcDNA: vcDNA=SeqID_1967; Strand=+; Position=98-2632
  misc_feature: Homolog annotation: Hit_ID=AAL83698.1; Match level="QueryCoverage =100%, HitCoverage=100%, E-value=0.0, Identity=91%"; Hit description =translation elongation factor 2 [Spodoptera exigua]
  misc_feature: Gene Ontology Annotation: Molecular function=ATP binding; Biological process=protein biosynthesis
  misc_feature: Pfam annotation: Pfam_ID=GTP_EFTU; Match level="Score=303.8, E-value =2.8e-88, Copies=1"; Pfam description=Elongation factor Tu GTP binding doma
MVNFTVDEIRAMMDKKRNIRNMSVIAHVDHGKSTLTDSLVSKAGIIAGAKAGETRFTDTRKDEQERCITIKSTAISMFFELDDKDLVFITNADQREKDVKGFLINLIDSPGHVDFSSEVTAALRVTDGALVVVDCVSGVCVQTETVLRQAIAERIKPILFMNKMDRALLELQLESEELYQTFQRIVENVNVIIATYNDDSGPMGEVRVDPSKGSVGFGSGLHGWAFTLKQFSEMYAEKFKIDVVKLMNRLWGENFFNPKTKKWSKQKDDDNKRSFCMYILDPIYKIFDSIMNYKKEEYEALLPKLGIALKHEDKDKDGKQLLKVVMRTWLPAGEALLQMIAIHLPSPVVAQKYRMEMLYEGPHDDEAAVGIKNCDPNAPLMMYVSKMVPTSDKGRFYAFGRVFSGKVATGMKARIMGPNYTPGKKEDLYEKAIQRTILMMGRYVEAIEDVPSGNICGLVGVDQFLVKTGTITTFKDAHNLKVMKFSVSPVVRVAVEPKNPADLPKLVEGLKRLTKSDPMVQCIIEESGEHIIAGAGELHLEICLKDLEEDHACIPIKKSDPVVSYRETVSEESDQMCLSKSPNKHNRLFMKACPMPDGLAEDIDDGKVNPRDDFKVRARYLTEKYDYDITEARKIWCFGPDGTGPNILVDCTKGVQYLNEIKDSVVAGFQWATKEGVLSEENLRGVRFNIYDVTLHADAIHRGGGQIIPTTRRCLYACLMTAAPRLMEPIYKCEIMCPEVAVGGIYGVLNRRRGHVFEEAQIAGTPMFLVKAYLPVNESFGFTADLRSNTGGQAFPQSVFDHWQILPGDPMEPSTKPYGIVQDTRKRKGLKEGLPDLAQYLDKL

SEQ ID NO: 22271 - protein, 219 aa, Diabrotica virgifera
  misc_feature: Coding regions on vcDNA: vcDNA=SeqID_1968; Strand=+; Position=870-1529
  misc_feature: Homolog annotation: Hit_ID=CAE47497.1; Match level="QueryCoverage =94%, HitCoverage=65%, E-value=1e-116, Identity=99%"; Hit description= cathepsin L-like proteinase [Diabrotica virgifera virgifera]
  misc_feature: Gene Ontology Annotation: Cellular component=extracellular space
  misc_feature: Pfam annotation: Pfam_ID=Peptidase_C1; Match level="Score=19.8, E -value=2.8e-12, Copies=1"; Pfam description=Papain family cysteine protease
MKLFILAAALIVATSANLGAFEKWTSFKATHNKSYNVIEDKLRFAVFQDNLKKIEEHNAKYESGEETYYLAVNKFADWSSAEFQAMLARQMANKPKQSFIAKHVADPNVQAVEEVDWRDSAVLGVKDQGQCGSCWAFSTTGSLEGQLAIHKNQRVPLSEQELVDCDTSRNAGCNGGLMTDAFNYVKRHGLSSESQYAYTGRDDRCRCMHLQLFQVLRSH

SEQ ID NO: 22272 - protein, 300 aa, Diabrotica virgifera
  misc_feature: Coding regions on vcDNA: vcDNA=SeqID_1969; Strand=-; Position=513-1415
  misc_feature: Homolog annotation: Hit_ID=AAO32817.1; Match level="QueryCoverage =99%, HitCoverage=99%, E-value=1e-152, Identity=86%"; Hit description= ADP/ATP translocase [Bombyx mori]
  misc_feature: Gene Ontology Annotation: Molecular function=adenine transporter activity; Cellular component=integral to plasma membrane; Biological process=transport
  misc_feature: Pfam annotation: Pfam_ID=Mito_carr; Match level="Score=303.7, E-value= 2.9e-88, Copies=3"; Pfam description=Mitochondrial carrier protein
MSLADPVAFMKDFLAGGISAAISKTCVAPIERVKLLLQVQHISKQIAEDQRYKGMVDCFVRIPKEQGVLAYWRGNTANVIRYFPTQALNFAFKDKYKQIFLSGVDKKTQFWRYFLGNLASGGAAGATSLCFVYPLDFARTRLAADVGKGAGEREFSGLGNCLVKIFKADGLGGLYRGFGVSVQGIIIYRAAFFGFYDTAKGILPDPKNTPLVVSWAIAQTVTTVAGIISYPFDTVRRRMMMQSGRKKTEIIYKSTAHCWATIAKTEGTGAFFKGAFSNVLRGTGGAIVLVMYDEIKNLIV

SEQ ID NO: 22273 - protein, 470 aa, Diabrotica virgifera
  misc_feature: Coding regions on vcDNA: vcDNA=SeqID_1970; Strand=-; Position=2675 -4087
  misc_feature: Homolog annotation: Hit_ID=NP_731035.2; Match level="QueryCoverage =96%, HitCoverage=78%, E-value=1e-153, Identity=60%"; Hit description= CG10279-PB, isoform B [Drosophila melanogaster] ref|NP_731034.1| CG10279-PF, isoform F [Drosophila
  misc_feature: Gene Ontology Annotation: Molecular function=RNA helicase activity; Cellular component=nucleus; Biological process=cell growth
  misc_feature: Pfam annotation: Pfam_ID=DEAD; Match level="Score=242.1, E-value=1e -69, Copies=1"; Pfam description=DEAD/DEAH box helicase
IRVQRFRAKRKLKMTYPQNGDDGYQARSNGFSNFKSGGNSGGGGGYNNRNGGGYNKTGGGFNNGRFNNSFGDNSYNNRNGGGYQNNFNRNNQGYGGNGGLRQVEWANKKLRPVEKHFYVPHPSVASRTPFEVEQFRKAKEITVEGEAPNPIQNFDEANFPDYILTEVCNKGYEAPTPIQAQGWPIAMSGHDMVGIAQTGSGKTLAYILPAAIHINNQPPLNKGEGPIVLVLAPTRELAQQIQEVSNDFGRSTNIRNSCIFGGAPKGPQARDLQRGIEICIATPGRLIDFLEKGSTNLERCTYLVLDEADRMLDMGFEPQIRKILSQVRPDRQTLMWSATWPKEVRKLASDFMKNPVYINIGSKNLSANNNIVQFVDVCQEHEKERKLGSLLQEINTNADTGSKIIIFVETKKKVEGITRSIRSIGWSALSMHGDKSQQERDYVLREFRTGKSSILVATDVAARGLGEFPP

SEQ ID NO: 22274 - protein, 420 aa, Diabrotica virgifera
  misc_feature: Coding regions on vcDNA: vcDNA=SeqID_1971; Strand=-; Position=41-1304
  misc_feature: Homolog annotation: Hit_ID=CAD60245.1; Match level="QueryCoverage =97%, HitCoverage=78%, E-value=0.0, Identity=78%"; Hit description =cytochrome oxidase subunit I [Meligethes coracinus]
  misc_feature: Pfam annotation: Pfam_ID=COX1; Match level="Score=621.4, E-value=6.6e- 184, Copies=1"; Pfam description=Cytochrome C and Quinol oxidase polyp
  misc_feature (26)..(26): Xaa can be any naturally occurring amino acid
  misc_feature (58)..(58): Xaa can be any naturally occurring amino acid
  misc_feature (82)..(82): Xaa can be any naturally occurring amino acid
  misc_feature (104)..(104): Xaa can be any naturally occurring amino acid
  misc_feature (127)..(127): Xaa can be any naturally occurring amino acid
  misc_feature (187)..(187): Xaa can be any naturally occurring amino acid
  misc_feature (237)..(237): Xaa can be any naturally occurring amino acid
  misc_feature (289)..(289): Xaa can be any naturally occurring amino acid
  misc_feature (324)..(324): Xaa can be any naturally occurring amino acid
  misc_feature (341)..(341): Xaa can be any naturally occurring amino acid
KGGRSRSRTRTNHKDIGTLYFIFGIXAGMVGTSLRILVRAELGRPGSLIGNDQIYNVXVTAHAFIIIFFIVIPIIIGGFGNXLVPLIIGAPDIAFPRINNIRFXLLPPSLLLLLLRRIVERGVGTGXTVYPPLSSNIAHGGPSVDLAIFRLHLAGISSILGAINFITTVINIRPIGITFDRIPLFVXAVVITAILLLLSLPVLAGAITILLTDRNLNTSFFDPAGGGDPILYQHLFXFFGHPEVYILILPGFGLISHIVRQERRKKEAFGTLGIIYAIIAIGLLGFIVXAHHIFTVGMDVDTRAYFTSATIIIAVPTGIKVFRXLATYHGTTITYSPVTLXALGFIFLFTVGGLTGVVLANSSIDIVLHDTYYVVAHFHYVLSIRAVFAIYSGDLSHEFPFFFRKNIKKNFFSKKSTFFY

SEQ ID NO: 22275 - protein, 85 aa, Diabrotica virgifera
  misc_feature: Coding regions on vcDNA: vcDNA=SeqID_1972; Strand=-; Position=122-379
KPLYFEKCPRYCSKKFNKVTNILKEKWHNSKCVCFCSYTVMNIHVSMFFHYLSKKLFFELCGVLPEERHILINNILKKKVKKIMV

SEQ ID NO: 22276 - protein, 122 aa, Diabrotica virgifera
  misc_feature: Coding regions on vcDNA: vcDNA=SeqID_1973; Strand=+; Position=1-369
VAVFNAVSALDCYTCTDDACKKDVKEMQKVTCGKPADQNQESVCQKVTYKGKDGKEHIERKCAYAPKNGEAQCPASINKADVTDLKCPSCKADLCNSATTINFSLTAFAAVVFAIVGQKFLM

SEQ ID NO: 22277 - protein, 132 aa, Diabrotica virgifera
  misc_feature: Coding regions on vcDNA: vcDNA=SeqID_1974; Strand=+; Position=378-776
MAKLVILLACVAVFNAVSALDCYTCTDDACKKDVKEMQKVTCGKPADQNQESVCQKVTYKGKDGKEHIERKCAYAPKNGEAQCPASINKADVTDLKCPSCKADLCNSATTINFSLTAFAAVVFAIVGQKFLM

SEQ ID NO: 22278 - protein, 207 aa, Diabrotica virgifera
  misc_feature: Coding regions on vcDNA: vcDNA=SeqID_1975; Strand=+; Position=82-705
  misc_feature: Homolog annotation: Hit_ID=XP_320119.1; Match level="QueryCoverage =80%, HitCoverage=19%, E-value=5e-36, Identity=44%"; Hit description =ENSANGP00000001808 [Anopheles gambiae]
  misc_feature: Gene Ontology Annotation: Molecular function=signal transducer activity; Cellular component=extracellular space; Biological process= signal transduction
  misc_feature: Pfam annotation: Pfam_ID=Peptidase_M16; Match level="Score=51.6, E -value=2.2e-12, Copies=1"; Pfam description=Insulinase (Peptidase family M16)
MKLFKYILQNPLIRSVSATHITSTTSILRRTAMATPQFEILPSPIQGESDEKEYRVIKLKNNLVACLISDKAPIPKEEMEMEDSESESDNKLSESESDSEGSDSSSEAGETTSTPDQKMAAAALCIGVGSFSDPKEVPGMAHFLEHMVFMGSEKFPAENDFDSFIKKCGGTDDASTDMETTCYYFECLEKKLHETVEKFAQFFISPF

SEQ ID NO: 22279 - protein, 286 aa, Diabrotica virgifera
  misc_feature: Coding regions on vcDNA: vcDNA=SeqID_1976; Strand=+; Position=4-864
  misc_feature: Homolog annotation: Hit_ID=XP_393673.1; Match level="QueryCoverage =63%, HitCoverage=41%, E-value=2e-62, Identity=49%"; Hit description =similar to receptor tyrosine kinase [Apis mellifera]
  misc_feature: Gene Ontology Annotation: Molecular function=lipid transporter activity; Cellular component=extracellular space; Biological process= lipid metabolism
  misc_feature: Pfam annotation: Pfam_ID=Lipocalin; Match level="Score=29.3, E-value =1.2e-05, Copies=1"; Pfam description=Lipocalin / cytosolic fatty -acid bind
MIRVYLLCCAVVLARAQIPSLGFCPDYLPMSEFDIESFLGKWYEAERYFQFTEVTSRCVVTDYAKGPSGKIYVSNEVTSRLTGIKRVIDGQLELSGRSGEGKFNIRYSTPLSSQAQLTVLDTDYDNYAVIWSCSGFGPIHTQSVWAMTRERLPSGPVLQKIYGVLDKYKISRNFFVKTDQEGCALAASDINAANGITVISTVAESSGIPQRKSPSSNKKKVTEKVPSVQAVKVSDNDVNDDPNVQAVKSIEIDLKAPEDILPEPFASNVIYLKLLQLKKSSRSFCS

SEQ ID NO: 22280 - protein, 50 aa, Diabrotica virgifera
  misc_feature: Coding regions on vcDNA: vcDNA=SeqID_1977; Strand=-; Position=383-535
PMSIVAHYLYLMIMYNQNLTIFSRDFESLNYIYLLHIFKKVNPFNVESVF

SEQ ID NO: 22281 - protein, 407 aa, Diabrotica virgifera
  misc_feature: Coding regions on vcDNA: vcDNA=SeqID_1978; Strand=+; Position=73-1296
  misc_feature: Homolog annotation: Hit_ID=NP_732692.1; Match level="QueryCoverage =88%, HitCoverage=88%, E-value=1e-109, Identity=54%"; Hit description= CG6343-PB, isoform B [Drosophila melanogaster] ref|NP_524445.1| CG6343-PA, isoform A [Drosophila
  misc_feature: Gene Ontology Annotation: Molecular function=NADH dehydrogenase (ubiquinone) activity; Cellular component=membrane fraction; Biological process=growth
  misc_feature: Pfam annotation: Pfam_ID=dNK; Match level="Score=90.8, E-value=3.6e -24, Copies=1"; Pfam description=Deoxynucleoside kinase
MSTFVRVGFGRVNQGLCNVLNKTQNVTLIRAISSKNTRSAEERSPKPAPWPYQEKGFNLFNYLYDKTTARLDENSKIIVVEGPPAAGKSKLAKQLAAEFEMLYLPEANLDMEYINSYGFDLRKLDSEIPESCRSWDVMDFLKNPKHRHTLRFQMQQYQVKLSQYVDALAHVLSTGQGVILDRCVYSDFVFTEAMFSQNYLHKLARKTYYELRDNTIGELLRPHLVIYLDTPVPKVIENIKKRAISYEKDSTVLTPQYLGVIEKQYKQNYLKDISKHAELLVYDWSEEGDVEIVVEDIERIDFNRYDEQDSYMKDWVYRLEEEWAVLRHKYADKKDPEIMAYCNIPAYNVPELVIEAEDADKYHKAMAEAPGQEYEIGYNAALGDTGLLFKMRSPHRETLPLRERRTV

SEQ ID NO: 22282 - protein, 107 aa, Diabrotica virgifera
  misc_feature: Coding regions on vcDNA: vcDNA=SeqID_1979; Strand=+; Position=217-537
  misc_feature: Homolog annotation: Hit_ID=EAA10728.2; Match level="QueryCoverage =82%, HitCoverage=16%, E-value=4e-20, Identity=51%"; Hit description =ENSANGP00000020407 [Anopheles gambiae str. PEST] ref|XP_557085.1| ENSANGP00000020407 [Anopheles gambiae st
MPSISGYRYKPNKKKTKMNVHPNVPLGVRFLQKLTDTCTCCPRFHFNRELCYRMSVIFLTYISYMCYHLSRKPISVVKAVLHRNCSNLVPPDSNEPSNWCDWAPFDG

SEQ ID NO: 22283 - protein, 482 aa, Diabrotica virgifera
  misc_feature: Coding regions on vcDNA: vcDNA=SeqID_1980; Strand=+; Position=75-1525
  misc_feature: Homolog annotation: Hit_ID=NP_524016.4; Match level="QueryCoverage =86%, HitCoverage=44%, E-value=1e-148, Identity=58%"; Hit description= CG8107-PA [Drosophila melanogaster] gb|AAF50189.2| CG8107-PA [Drosophila melanogaster]
  misc_feature: Gene Ontology Annotation: Molecular function=calcium ion binding; Cellular component=intracellular; Biological process=digestion
  misc_feature: Pfam annotation: Pfam_ID=Peptidase_C2; Match level="Score=644.3, E -value=8.7e-191, Copies=1"; Pfam description=Calpain family cysteine protease
  misc_feature (432)..(432): Xaa can be any naturally occurring amino acid
  misc_feature (444)..(444): Xaa can be any naturally occurring amino acid
MDSKSSTVTKVTVVKSTYRVSPADSTSPSRTGFAEDGEQVDQKRTVQAVHAAVVPSKPGVANHGAAAGKPPGPPAGRGGPPAKPHGPPAGRGGPPVSGKQTEKTVKSVPDTDSRKLTSAVLKMVYKFGEKGSGTRSKSGDSQDFYALRDECLANGTLFEDPEFPCNDSSLFFSQRPDRNYEWKRPNEICNDPKFFVEGFSRFDVQQGILGDCWLLAATANLTLNSRLFFQIVPDDQEFDDKYAGIFHFRFWQYGKWIDIVIDDRLPTYRGELVFLHSAEDNEFWSALLEKAYAKLNGSYETLKGGSTCEAMEDFTGGVSEMYEMESSPPNLFQIMVKAYERSSLMACSIEPDPRVLEAHTPQGLIRGHAYSITRIKYVEIHTPNVSGKIPLLRLRNPWGNEDEWNGAWSDEAPEWRYISQEEKEELGLTFDXDGEFWISFQDFXNTFSRLEICNLIPDSLSKNRITPKSLKKYGKRDDLKEG

SEQ ID NO: 22284 - protein, 243 aa, Diabrotica virgifera
  misc_feature: Coding regions on vcDNA: vcDNA=SeqID_1981; Strand=+; Position=261-992
  misc_feature: Homolog annotation: Hit_ID=EAA09472.2; Match level="QueryCoverage =91%, HitCoverage=36%, E-value=1e-58, Identity=55%"; Hit description =ENSANGP00000003404 [Anopheles gambiae str. PEST] ref|XP_558446.1| ENSANGP00000003404 [Anopheles gambiae st
  misc_feature: Gene Ontology Annotation: Molecular function=RNA binding; Cellular component=nucleus; Biological process=mRNA processing
  misc_feature: Pfam annotation: Pfam_ID=RRM_1; Match level="Score=36.7, E-value=7.1e- 08, Copies=1"; Pfam description=RNA recognition motif. (a.k.a. RRM, R
MMQANNRVPPIKLENDIDLYADDIEDFAQDDFGGENVDLYDDVISAPPGNNDNPGDSNHHAPPGAGEDGGGNFVGSGGAPNNINSSGRRHQLYVGNLTWWTTDQDIENAVHDIGVTDFHEVKFFEHRANGQSKGFCVISLGSEGSMRLCLELLSKKEINGQNPLVTLPTKQALSNFESQSKTRPSPTNNSNSRPPHPNNNVHSGPMQNYGGRMPMNPSMRPMPPGMQGAPRMQGPPGFNEPQT

SEQ ID NO: 22285 - protein, 121 aa, Diabrotica virgifera
  misc_feature: Coding regions on vcDNA: vcDNA=SeqID_1982; Strand=-; Position=199-564
  misc_feature: Homolog annotation: Hit_ID=XP_314867.1; Match level="QueryCoverage =95%, HitCoverage=14%, E-value=1e-15, Identity=39%"; Hit description =ENSANGP00000005174 [Anopheles gambiae]
  misc_feature (75)..(75): Xaa can be any naturally occurring amino acid
  misc_feature (111)..(111): Xaa can be any naturally occurring amino acid
WSEYFEELLIIQNFFEEKDENDGNNRNEYQTVEFEIPPPSREEIRNVKETLKNDKTPDLDNIDAKSIKKGGHELXSKMHQLTEKAWQQEIMPKQWCGSIIAPIHKKGKRNXCSNYKRRINK

SEQ ID NO: 22286 - protein, 135 aa, Diabrotica virgifera
  misc_feature: Coding regions on vcDNA: vcDNA=SeqID_1983; Strand=+; Position=54-458
GSLKRLPKVGTLVNIYLFWCIVIEIKTPTYVFLENKVNRLDEGFLKRFLVGRQYDTIAALRAIQNFESFVHRHRNKWLKLKKSRIELIINSQIVEILENTGLQGQHIVWIRLENWDPQIITADEILEVSGLLCEL

SEQ ID NO: 22287 - protein, 370 aa, Diabrotica virgifera
  misc_feature: Coding regions on vcDNA: vcDNA=SeqID_1984; Strand=+; Position=2-1114
  misc_feature: Homolog annotation: Hit_ID=CAG32000.1; Match level="QueryCoverage =88%, HitCoverage=57%, E-value=1e-109, Identity=60%"; Hit description= hypothetical protein [Gallus gallus]
  misc_feature: Gene Ontology Annotation: Molecular function=asparagine synthase (glutamine-hydrolyzing) activity; Cellular component=soluble fraction; Biological process=asparagine biosynthesis
  misc_feature: Pfam annotation: Pfam_ID=Asn_synthase; Match level="Score=284.2, E -value=2.2e-82, Copies=1"; Pfam description=Asparagine synthase
VKLVRSQRYFSPGDRPSFKPFLPYEDLIPNDHQANIRKLLQMSVKKRLMAERKIGCMLSGGLDSSLIAALLVKEAKSANVPYKVQSFSIGMGDSPDLRAARVVAKHVGTDHHEVSFTEEDVAKVLDDVIYTLETPDITTIRASIPMYLISKYIQENTETTVLLSGEGADEIAQGYIYFRDAPSPQAAHEDSLRLLREIYLFDGLRADRTTASQSLELRVPFLDLQFTDYYLNLEKTLKQPKNNVEKYLLRSAFDGTDLLPHEILWRHKEAFSDGVASNTKSLFVIIQEIIDKRMPEPFDLEKAKHKYPHCTPTTKEAYYYREVFEKSYPKLAQNFLPYYWMPRWCEGVTDPSARFIKHYAADEKPEINGH

SEQ ID NO: 22288 - protein, 246 aa, Diabrotica virgifera
  misc_feature: Coding regions on vcDNA: vcDNA=SeqID_1985; Strand=+; Position=2-742
  misc_feature: Homolog annotation: Hit_ID=CAG32000.1; Match level="QueryCoverage =90%, HitCoverage=39%, E-value=1e-68, Identity=59%"; Hit description =hypothetical protein [Gallus gallus]
  misc_feature: Gene Ontology Annotation: Molecular function=asparagine synthase (glutamine-hydrolyzing) activity; Cellular component=soluble fraction; Biological process=asparagine biosynthesis
  misc_feature: Pfam annotation: Pfam_ID=Asn_synthase; Match level="Score=-5.2, E -value=3.8e-06, Copies=1"; Pfam description=Asparagine synthase
RHAGYRGPRISRESTSRGPAIVFSISKYIQENTETTVSSSGEGADEIAQGYIYFRDAPSPQAAHEDSLRLLREIYLFDGLRADRTTASQSLELRVPFLDLQFTDYYLNLEKTLKQPKNNVEKYLLRSAFDGTDLLPHEILWRHKEAFSDGVASNTKSLFVIIQEIIDKRMPEPFDLEKAKHKYPHCTPTTKEAYYYREVFEKSYPKLAQNFLPYYWMPRWCEGVTDPSARFIKHYAADEKPEINGH

SEQ ID NO: 22289 - protein, 361 aa, Diabrotica virgifera
  misc_feature: Coding regions on vcDNA: vcDNA=SeqID_1986; Strand=+; Position=325-1411
  misc_feature: Homolog annotation: Hit_ID=XP_397277.1; Match level="QueryCoverage =99%, HitCoverage=80%, E-value=1e-114, Identity=55%"; Hit description= similar to asparagine synthase (glutamine-hydrolysing) (EC 6.3.5.4) [similarity] - Chinese
  misc_feature: Gene Ontology Annotation: Molecular function=asparagine synthase (glutamine-hydrolyzing) activity; Cellular component=soluble fraction; Biological process=asparagine biosynthesis
  misc_feature: Pfam annotation: Pfam_ID=Asn_synthase; Match level="Score=47.0, E -value=5.4e-11, Copies=1"; Pfam description=Asparagine synthase
  misc_feature (344)..(344): Xaa can be any naturally occurring amino acid
MCGIWAVFGLTSNIHSHCASTFCQIGHRGPDAWRVEYDNKLKNCCIGFHRLAIVGCKFGMQPMKLHQYPHSMLICNGELYNFQRLGEQYDFDYETRCDVECIFHLYEKFGIEECVKNLDGVFAFCLIDVPRRKVLLGRDPYGVRPLFKVISSSGVLGICSEAKGLVGIEKDLNGESKKIEPFPPGTFEEYDLLENGKVKLVRSQRYFSPGDRPSFKPFLPYEDLIPNDHQANIRKLLQMSVKKRLMAERKIGCMLSGGLDSSLIAALLVKEAKSANVPYKVQSFSIGMGDSPDLRAARVVAKHVGTDHHEVSFTEEDVAKVLDDVIYTLETPEITTIRAPIPMXLISKNIQENTETTPLFC

SEQ ID NO: 22290 - protein, 68 aa, Diabrotica virgifera
  misc_feature: Coding regions on vcDNA: vcDNA=SeqID_1987; Strand=+; Position=211-417
GDRVSQFSFVREFCWRSSIRAAIKLSFVWQREKLPVPRAANMRLPAKLVVKFQLSFFCNCIAEVIVFS

SEQ ID NO: 22291 - protein, 154 aa, Diabrotica virgifera
  misc_feature: Coding regions on vcDNA: vcDNA=SeqID_1988; Strand=+; Position=100-564
  misc_feature: Homolog annotation: Hit_ID=EAL28672.1; Match level="QueryCoverage =79%, HitCoverage=80%, E-value=1e-34, Identity=60%"; Hit description =GA16258-PA [Drosophila pseudoobscura]
  misc_feature: Gene Ontology Annotation: Molecular function=structural constituent of ribosome; Cellular component=mitochondrial small ribosomal subunit; Biological process=protein biosynthesis
  misc_feature: Pfam annotation: Pfam_ID=Ribosomal_S18; Match level="Score=17.4, E -value=0.00062, Copies=1"; Pfam description=Ribosomal protein S18
MNLLLKQIKNIRLDLNSNIKNFSIFPALRLKEIQEIQNDKELIISAKHVPSGRESYLLKNDHPTACSVCASGLDIKHTDVLILSQFVRTDGCMLPKRITGLCSRSQKRIATLVAMAQKSGLMPNLTPGYSHKDPKKRYRWRYNKYFDESTIKIR

SEQ ID NO: 22292 - protein, 56 aa, Diabrotica virgifera
  misc_feature: Coding regions on vcDNA: vcDNA=SeqID_1989; Strand=+; Position=56-226
  misc_feature: Homolog annotation: Hit_ID=BAD26661.1; Match level="QueryCoverage =100%, HitCoverage=100%, E-value=2e-26, Identity=92%"; Hit description=Ribosomal protein S29 [Plutella xylostella]
  misc_feature: Pfam annotation: Pfam_ID=Ribosomal_S14; Match level="Score=103.2, E -value=6.6e-28, Copies=1"; Pfam description=Ribosomal protein S14p/S29e
MGFQNIWYSHPRKYGQGSRSCRACSNRHGLIRKYGLNLCRQCFREYAGDIGFKKLD

SEQ ID NO: 22293 - protein, 174 aa, Diabrotica virgifera
  misc_feature: Coding regions on vcDNA: vcDNA=SeqID_1990; Strand=+; Position=181-705
  misc_feature: Homolog annotation: Hit_ID=NP_511057.1; Match level="QueryCoverage =100%, HitCoverage=100%, E-value=3e-90, Identity=92%"; Hit description=CG3595-PA [Drosophila melanogaster] gb|EAL32148.1| GA17546-PA [Drosophila
  misc_feature: Gene Ontology Annotation: Molecular function=structural constituent of muscle; Cellular component=muscle myosin; Biological process =regulation of muscle contraction
  misc_feature: Pfam annotation: Pfam_ID=efhand; Match level="Score=55.9, E-value =1.2e-13, Copies=2"; Pfam description=EF hand
MSSRKTVSRRGTTKKRAQRATSNVFAMFDQAQIAEFKEAFNMIDQNHDGFVDKEDLHDMLASLGKNPTDDYLDGMMNEAPGPINFTMFLTLFGERLQGTDPEDVIKNAFGCFDEDNNGVLNEERLRELLTSMGDRFTDDEVDEMYREAPIKNGLFDYVEFTRILKHGAKDKDEQ

SEQ ID NO: 22294 - protein, 68 aa, Diabrotica virgifera
  misc_feature: Coding regions on vcDNA: vcDNA=SeqID_1991; Strand=-; Position=535-741
RYLQNARSCLYKNMHIKIMFRLKYRCLYKIYTLQIYLCIKMLMSILFFIIYYYISIDYTFEVCKDEIY

SEQ ID NO: 22295 - protein, 279 aa, Diabrotica virgifera
  misc_feature: Coding regions on vcDNA: vcDNA=SeqID_1992; Strand=+; Position=218-1054
  misc_feature: Homolog annotation: Hit_ID=XP_392073.1; Match level="QueryCoverage =93%, HitCoverage=33%, E-value=4e-50, Identity=40%"; Hit description =similar to Colorectal mutant cancer protein (MCC protein) [Apis mellifera]
MSENKPDTVPGLGFKDKDKALDTLKNLEGRDPDYQRLSIKGLIGRAKRTLTLTKDKEKIQNINDAVKVFEDFLRDFEINNMSKENRAYLPLASVQSLLPLKEKFDINDELVEAFLEAYTKKAKGEYKNLRTVSSGEGKPSWDIVRNVEIKKLLKAMEESRPDMWKDDLPTKEHLELILWAYSPDASKIKKNVSNYEEKLGSKKPDSSEDEEMDDDDDDEEEEEEEKPKKKPEKASKRRSSGDTKEGSPEKNRKKMIECLLYCEKGFLYYYFQIYFYYFF

SEQ ID NO: 22296 - protein, 156 aa, Diabrotica virgifera
  misc_feature: Coding regions on vcDNA: vcDNA=SeqID_1993; Strand=+; Position=3-473
  misc_feature: Homolog annotation: Hit_ID=AAM51959.1; Match level="QueryCoverage =96%, HitCoverage=27%, E-value=8e-51, Identity=65%"; Hit description =GM01935p [Drosophila melanogaster]
  misc_feature: Gene Ontology Annotation: Molecular function=electron transporter activity; Cellular component=DNA-directed RNA polymerase I complex; Biological process=electron transport
KQLWCEITFGLPLSFKKLDLTAILKETAGKSVLWETPQIKRAITYVKDDKLMLRTDGINIVEMFKYNTLLDLPQLYCNDIHKVAETYGIEAASKVIVKEVKDVFNVYGIKVDPRHLSLVADYMTFNGTFEPLSRRGMENSASPLQQMSFESSFSIF

SEQ ID NO: 22297 - protein, 103 aa, Diabrotica virgifera
  misc_feature: Coding regions on vcDNA: vcDNA=SeqID_1994; Strand=-; Position=143-454
FIYIQPCYVLRLFIIKLFFEFCIFCNIRVPIKRMRTSTLMNKFHQIPLYWMESMYGFHPYIKYKIIFVILLVNTRNVFRNFAHLRRAQTGKVFRKKELDERRD

SEQ ID NO: 22298 - protein, 67 aa, Diabrotica virgifera
  misc_feature: Coding regions on vcDNA: vcDNA=SeqID_1995; Strand=+; Position=779-982
ALFGHFTPKYFIWSLTNMNLPLTSYNFASTRCRDDIYTIFLNFLYRLYFCQECFSTKYLLSELFATF

SEQ ID NO: 22299 - protein, 143 aa, Diabrotica virgifera
  misc_feature: Coding regions on vcDNA: vcDNA=SeqID_1996; Strand=+; Position=34-462
  misc_feature: Homolog annotation: Hit_ID=XP_397536.1; Match level="QueryCoverage =83%, HitCoverage=57%, E-value=4e-21, Identity=44%"; Hit description =hypothetical protein XP_397536 [Apis mellifera]
MFFQQVTVVVLLVLKTTLASFDEHGLGDFGESHGWGAPAEPSVEHKYDYTPTNTIEHTKPVHIPVVKKTGVPQPHPVGVPVPQVVKVPVPQPYPVQVSVPTPVAVPIYKLVPQEIEKKIPIHVNKLVPVYIKKPYTVVLEKHY

SEQ ID NO: 22300 - protein, 95 aa, Diabrotica virgifera
  misc_feature: Coding regions on vcDNA: vcDNA=SeqID_1997; Strand=+; Position=176-463
VLSYYYLNYYTYNYHNILIRALYMYRHPFYTDFFLCMNKNIFVKLSSLNIHHSNLGSKLHFRFQHHQKHKARPKLDIYLTVVSTMLFWGCVPRVY

SEQ ID NO: 22301 - protein, 245 aa, Diabrotica virgifera
  misc_feature: Coding regions on vcDNA: vcDNA=SeqID_1998; Strand=+; Position=155-892
  misc_feature: Homolog annotation: Hit_ID=XP_391906.1; Match level="QueryCoverage =96%, HitCoverage=16%, E-value=3e-64, Identity=55%"; Hit description =similar to CG11172-PA [Apis mellifera]
  misc_feature: Gene Ontology Annotation: Biological process=germ-cell migration
  misc_feature: Pfam annotation: Pfam_ID=Stathmin; Match level="Score=37.1, E-value =5.4e-08, Copies=1"; Pfam description=Stathmin family
MEMDKATEVRCQEKTKGGLRYEVILGEPDVKAPPPKLSLSPKGSMSVQDIEDKLKAAEERRQQLESNKMAAWSAKIMKIEEASRKKNEKTCQFISTTRDALEQKMGTHVEKREAYITDLRSKLKDHIENVEKTRLSLEVQTEEVRSAIEDKLKTASQQRDDNIKKMLERLKEHEEQVAKVREQNTIKLQQLDLAITEKLEQAQSRKEQLEQEQKEKLKSYEKRAELVRQNKANLVAEGKLIPSSG

SEQ ID NO: 22302 - protein, 276 aa, Diabrotica virgifera
  misc_feature: Coding regions on vcDNA: vcDNA=SeqID_1999; Strand=+; Position=61-891
MFQKLVFFACLQVIFSYYLYNDKTNQVISYPALDKLPEGFKIIRPPRTLKRAFIDRSNLVCQDSGFHCKEPFDKSATFQFECEIDDQCPQNYKCCPQKCFTHKICSQGNIHSYGIGNGPSVNPFIPRRSSQPDNDLSNNQKTPRHCQKWPYPCSRPYSYQFSNPYKCDIDAQCPQGYLCCQQDCFLHKICSKELSSDEYVEELRRKDDQSAVTKRTTTLEPEMTSTTDAQTETTTEEATTLTTTEPTTTEESNSEDEENEETTTIIEKTHNQETDI

SEQ ID NO: 22303 - protein, 211 aa, Diabrotica virgifera
  misc_feature: Coding regions on vcDNA: vcDNA=SeqID_2000; Strand=+; Position=128-763
  misc_feature: Homolog annotation: Hit_ID=EAL25663.1; Match level="QueryCoverage =88%, HitCoverage=73%, E-value=2e-33, Identity=44%"; Hit description =GA17871-PA [Drosophila pseudoobscura]
  misc_feature: Gene Ontology Annotation: Molecular function=transporter activity; Cellular component=integral to plasma membrane; Biological process =cell-cell signaling
  misc_feature: Pfam annotation: Pfam_ID=MIP; Match level="Score=32.4, E-value=1.2e -10, Copies=1"; Pfam description=Major intrinsic protein
  misc_feature (122)..(122): Xaa can be any naturally occurring amino acid
  misc_feature (151)..(151): Xaa can be any naturally occurring amino acid
MAKKDIKGAPNAVTMFASEFIGTGLLMFIGCMGCVPEFDNPAAVHHMASLTFGLVILLIIQTFGHISWAHLNPAVTFAAVFMKLVSPMMSIVYIAAQFLSATLGVALLKALLPTDFYKDGFXMRLPHPEITAMQDVAIETIISTTWRLIAXAVWDLRNEEKTDSTRLKFDVIIAEIYMDAEPLTGALMDTARDFAPALLLRKFRESTDKTC

SEQ ID NO: 22304 - protein, 328 aa, Diabrotica virgifera
  misc_feature: Coding regions on vcDNA: vcDNA=SeqID_2001; Strand=+; Position=53-1035
  misc_feature: Homolog annotation: Hit_ID=NP_001004638.1; Match level="QueryCoverage= 87%, HitCoverage=90%, E-value=2e-80, Identity=50%"; Hit description =zgc:101630 [Danio rerio] gb|AAH81382.1| Zgc:101630 [Danio rerio]
  misc_feature: Gene Ontology Annotation: Molecular function=molecular_function unknown; Cellular component=cellular_component unknown; Biological process=biological_process unknown
  misc_feature: Pfam annotation: Pfam_ID=CN_hydrolase; Match level="Score=174.6, E -value=2.1e-49, Copies=1"; Pfam description=Carbon-nitrogen hydrolase
  misc_feature (272)..(272): Xaa can be any naturally occurring amino acid
MFKLPTCHKLVTVTKSFRNLSKMSSINKCKVAVCQFTACNDKSKNLVTVKRLVDEAVTNNAKVVFLPEGCDYIANNKDESRSLAESLDGELVDEYKKIANKNKIWLSVGGFHEKIDNNTMYNTHLLIDDTGNISSLYRKTHLFDVSIPEKNILLQESDYCTAGSAIIPPVETPAGLIGLSICYDLRFPEISTLQTKFGANILTYPSAFTATTGPAHWEILLRARAVENQCYVIAAAQYGKHNSKRTSYGHSMIVDPWGVVVAECPKYNENNXINESIAVAEINTEYIKKIRQEMPVQKHRRTDIYNLNLLPNNNKNDERNSYSFADIY

SEQ ID NO: 22305 - protein, 169 aa, Diabrotica virgifera
  misc_feature: Coding regions on vcDNA: vcDNA=SeqID_2002; Strand=+; Position=3-512
  misc_feature: Homolog annotation: Hit_ID=EAL32136.1; Match level="QueryCoverage =73%, HitCoverage=12%, E-value=6e-20, Identity=51%"; Hit description =GA15372-PA [Drosophila pseudoobscura]
QRSRKNSNSRSSYRSEADLRSMSEMTVDFGRQDNFSETSSYYPDKRYYEDSEHGHPSLARSLSQPSLARSASEFTERWVAPSRYDTASEFTSPEGTPKSQRSSRFQPPRGAGEQRAVWQTSQASTTAGPRGTSQVVTQEFRSQASSSYVGRSQPPKGWFGDNDSEASYK

SEQ ID NO: 22306 - protein, 181 aa, Diabrotica virgifera
  misc_feature: Coding regions on vcDNA: vcDNA=SeqID_2003; Strand=+; Position=50-595
  misc_feature: Homolog annotation: Hit_ID=AAK72378.1; Match level="QueryCoverage =100%, HitCoverage=100%, E-value=8e-53, Identity=63%"; Hit description=60S ribosomal protein L7/L12 precursor [Spodoptera frugiperda]
  misc_feature: Gene Ontology Annotation: Molecular function=structural constituent of ribosome; Cellular component=mitochondrion; Biological process =growth
  misc_feature: Pfam annotation: Pfam_ID=Ribosomal_L12; Match level="Score=24.3, E -value=3.3e-05, Copies=1"; Pfam description=Ribosomal protein L7/L12 C-terminal d
MQSVKLILRPLQGYRRISNCAALCQSVEAQTNPVEKIQIPPPSNVEQPVSPKIDKLATEISKLNLIEVSELSSVLKKRLNLPDAPVFPVGGFAPVAAPAEEEDAAPKKEKSVFTVKLMKFEEKQKVALIKEIKALVEGMNLVQAKKFVEGVPAVVKADVPKEEAEKLKAAIEKVGGVVVLD

SEQ ID NO: 22307 - protein, 138 aa, Diabrotica virgifera
  misc_feature: Coding regions on vcDNA: vcDNA=SeqID_2004; Strand=+; Position=2-415
PRDRKYERNCVVITQIHSHEYQELPTVMPSVGAINCWIHEDPLAEPDSSEESGEEYTFYTPFNFDPHPRGLGNYLFNRMHHHTHHIAQYIADTDEEQTYAELLQRCVHTACHLSTRGLTNDHVAEHCSYNHMASSVPL

SEQ ID NO: 22308 - protein, 310 aa, Diabrotica virgifera
  misc_feature: Coding regions on vcDNA: vcDNA=SeqID_2005; Strand=-; Position=160-1092
  misc_feature: Homolog annotation: Hit_ID=CAB52319.1; Match level="QueryCoverage =70%, HitCoverage=95%, E-value=1e-94, Identity=78%"; Hit description =cytochrome oxidase subunit II [Timarcha hispanica] emb|CAB52318.1| cytochrome oxidase subunit II [Timarcha
  misc_feature: Pfam annotation: Pfam_ID=COX2; Match level="Score=261.2, E-value=1.8e- 75, Copies=1"; Pfam description=Cytochrome C oxidase subunit II, peri
  misc_feature (154)..(154): Xaa can be any naturally occurring amino acid
  misc_feature (193)..(193): Xaa can be any naturally occurring amino acid
  misc_feature (195)..(195): Xaa can be any naturally occurring amino acid
  misc_feature (252)..(252): Xaa can be any naturally occurring amino acid
GSFDFFPGPLGEKEQRNFCFFFFSPWIYIYKKGAKIKLGGLTLNGGEFIFKWGFKKIHLAIWGVLGEIFFAFFCFFLVGWPQFSLRTRGRTRPKNFILQDRSSPLIEQLSYFHDHALIILVIITVLVGQLIFFLFFNKFLHRNLLEGQLIEIIXTILPTITLIFIAIPSLRLIYILDEVNNPAITIKTIGHQXYXSYEYSDFKNVEFDSYIIPTNELNDFNFRLLDVDNRIAVPFETNIRILVTAADVIHSXTIPSLGVKIDATPGRLNQISFSLRRSGIFFGQCSEICGANHRFIPIVLERISPKYFSK

SEQ ID NO: 22309 - protein, 237 aa, Diabrotica virgifera
  misc_feature: Coding regions on vcDNA: vcDNA=SeqID_2006; Strand=+; Position=210-923
  misc_feature: Pfam annotation: Pfam_ID=DUF233; Match level="Score=-4.9, E-value =0.0095, Copies=1"; Pfam description=Odorant binding protein
LHNLLHNKMKQFLVLLALACAVVAMPSIEYLNSNEFAQQFETEEQLRDFIGDIINSTLNGAISKMSDPMTIADIHMDQNSEALAGTIDIKDIAISGIHKIVSTAVSTNLITQQLNISVLVPDLTINFGAAVNVVVLELVPLYGSGKQNINIGDVKLSINAVADLSKIPKIQVSKVDVVLNVGSITFNLNGLLDNPEFTALVNTLLNDNVAKFIDEHGNFLMPIIDDAIKTLINSLFA

SEQ ID NO: 22310 - protein, 272 aa, Diabrotica virgifera
  misc_feature: Coding regions on vcDNA: vcDNA=SeqID_2007; Strand=+; Position=416-1234
  misc_feature: Homolog annotation: Hit_ID=XP_393709.1; Match level="QueryCoverage =99%, HitCoverage=99%, E-value=2e-46, Identity=43%"; Hit description =similar to activating transcription factor [Apis mellifera]
  misc_feature: Gene Ontology Annotation: Molecular function=specific RNA polymerase II transcription factor activity; Cellular component=transcription factor complex; Biological process=positive regulation of transcription from Pol II promoter
  misc_feature: Pfam annotation: Pfam_ID=bZIP_1; Match level="Score=43.8, E-value=5e -10, Copies=1"; Pfam description=bZIP transcription factor
MMSICYEPFLLDEKILPILDEVEPPRAIPVPVQNLKNEFVNSNDTQYFLKEFQNVYEVVEFSHGTLTPPQSPPSQPMLTNLEPLLQYPVETKHVYVQPEKQFLPENYEINYSLPVNTPQPDIAMELAVVDELVRTRVEDMQWSSSGSSSPGSPSSSSSSSNFGDCSSDPEWMPEPIEQYNDELPVKSSRKRTRPYSKSGTEDKKVRKKEQNKNAATRYRQKKKAEIEVILSEEKGLLDKNVDLGSQIADLNREIKYLKGLMRDLFKAKGLIN

SEQ ID NO: 22311 - protein, 296 aa, Diabrotica virgifera
  misc_feature: Coding regions on vcDNA: vcDNA=SeqID_2008; Strand=+; Position=278-1168
  misc_feature: Homolog annotation: Hit_ID=XP_393709.1; Match level="QueryCoverage =74%, HitCoverage=81%, E-value=2e-28, Identity=39%"; Hit description =similar to activating transcription factor [Apis mellifera]
MSSVLVWKQEPASPSSDYDEAALLDATIYNATPFELDIKLNNELDNLAEFESKAEVASHILENLENLMDLDELIKDEPFLLDEKILPILDEVEPPRAIPVPVQNLKNEFVNSNDTQYFLKEFQNVYEVVEFSHGTLTPPQSPPSQPMLTNLEPLLQYPVETKHVYVQPEKQFLPENYEINYSLPVNTPQPDIAMELAVVDELVRTRVEDMQWSSSGSSSPGSPSSSSSSSNFGDCSSDPEWMPEPIEQYSDELPVKSSRKRTRPYSKSGTEDKKVRKKEQNKNAATRYPQKKKAEI

SEQ ID NO: 22312 - protein, 301 aa, Diabrotica virgifera
  misc_feature: Coding regions on vcDNA: vcDNA=SeqID_2009; Strand=+; Position=56-962
  misc_feature: Homolog annotation: Hit_ID=EAL42024.1; Match level="QueryCoverage =92%, HitCoverage=93%, E-value=1e-111, Identity=69%"; Hit description= ENSANGP00000029416 [Anopheles gambiae str. PEST] ref|XP_565619.1| ENSANGP00000029416 [Anopheles gambiae s
  misc_feature (274)..(274): Xaa can be any naturally occurring amino acid
MAQANVITTRSLGTASEGIRDQYADGKAAKVWEVFIGDKNSRTQNYKNFLVGLLKRKGCKRILDVACGTGIDSIMLLEEGFEVVSVDASDKMLKYALKSRWNRRKEPAFDKWVIEEANWVSLYDDIEDLVGNGFDAVICLGNSFAHLLDNYGDQREQMRALMNFEKCVKPGGLLLIDHRNYDDIIDTGRTAPKCIYYNSYHTTDIKTSVLYIAGKAALVTLDYLIDISAENGKRDTVIEDSVSEFRLSYYPHRLKVFNEMLRKSFGENSEYKIXGDFKRFGRDRRTQTFISTSFEKGLLFF

SEQ ID NO: 22313 - protein, 297 aa, Diabrotica virgifera
  misc_feature: Coding regions on vcDNA: vcDNA=SeqID_2010; Strand=+; Position=141-1033
  misc_feature: Homolog annotation: Hit_ID=XP_396117.1; Match level="QueryCoverage =99%, HitCoverage=93%, E-value=6e-95, Identity=54%"; Hit description =similar to CG12876-PA [Apis mellifera]
  misc_feature: Gene Ontology Annotation: Molecular function=molecular_function unknown; Cellular component=cytosol; Biological process=invasive growth
  misc_feature: Pfam annotation: Pfam_ID=BRO1; Match level="Score=-12.7, E-value=4.5e- 06, Copies=1"; Pfam description=BRO1-like domain
  misc_feature (78)..(78): Xaa can be any naturally occurring amino acid
MAEILSVPLKKPSDVDLITPLKNLIQSRYSTADKPEDCSEAINEFSKQRNNAIWKAFEKYESSLEIIYGKLLESSTIXKSTVMLALQQDPTPDLNPDTLGALSQLMLAQAQQIFVHKAIHDNMKDVIVAKLASQCEDLYAECLKVFQRDNLKHIWDKDWIPIIAGKQAALGAVAEFYQSLVCKTNKTIGQEISRLRRSNELFKAAQSRSGRSFFNEVASRVERHLNEAVKDNDFIYHEIIPDIKSVDPIGKAQPAKVLQVAHPMSQNFNDLFTELVPVAVHQVLASYDIRKTDIVQY

SEQ ID NO: 22314 - protein, 332 aa, Diabrotica virgifera
  misc_feature: Coding regions on vcDNA: vcDNA=SeqID_2011; Strand=+; Position=29-1027
  misc_feature: Homolog annotation: Hit_ID=NP_651582.1; Match level="QueryCoverage =98%, HitCoverage=39%, E-value=1e-110, Identity=59%"; Hit description= CG12876-PA [Drosophila melanogaster] gb|AAF56740.1| CG12876-PA [Drosophila melanogaster]
  misc_feature: Gene Ontology Annotation: Molecular function=molecular_function unknown; Cellular component=cytosol; Biological process=invasive growth
  misc_feature: Pfam annotation: Pfam_ID=BRO1; Match level="Score=239.5, E-value=6.3e- 69, Copies=1"; Pfam description=BRO1-like domain
MAEILSVPLKKPSDVDLITPLKNLIQSRYSTADKPEDCSEAINEFSKQRNNAIWKAFEKYESSLEIIYGYYDQIVALEGKIPPQELQVPFKWKDAFDKGNLFGTRMSLTISSLSFEKVCVLFNIAALQSSVAAAQSVESDEGLKLAAKLLQQASGIFNYLKSTVMLALQQDPTPDLNPDTLGALSQLMLAQAQQIFVHKAIHDNMKDVIVAKLASQCEDLYAECLKVFQRDNLKHIWDKDWIPIIAGKQAALGAVAEFYQSLVCKTNKTIGQEISRLRRSNELFKAAQSRSGRSFFNEVASRVERHLNEAVKDNDFIYHEIIPDIKSVDPID

SEQ ID NO: 22315 - protein, 300 aa, Diabrotica virgifera
  misc_feature: Coding regions on vcDNA: vcDNA=SeqID_2012; Strand=+; Position=44-943
  misc_feature: Homolog annotation: Hit_ID=XP_308033.1; Match level="QueryCoverage =97%, HitCoverage=28%, E-value=5e-25, Identity=30%"; Hit description =ENSANGP00000019383 [Anopheles gambiae]
  misc_feature (267)..(268): Xaa can be any naturally occurring amino acid
MGCGVGTAIFVFASVILLAESTLFDLGKTKELEGVINDDKFIVSLRHIKPRKRSRGMIETLFAVDFPESNDKFALLLDRKVKKVTVETVENGKKRSQHFKVDSLDEDNSIKSLILEVNQNEPGAHATLYLDCTSYGMVALPKTLREMHKTPDRKLEVHHERKYTIEIDGHHRDLRMVLNRNDCPLSLYTNQSKSYDNYLNDDLNNNLNDDPNIQAQQPDYDQYRRGGEDPYRRTSPGGVPYRGDIPLVSKLEDSGILQALNLLIERXXFEVKRCEASAAAIDNLRRLIEQCELCKAQPIR

SEQ ID NO: 22316 - protein, 387 aa, Diabrotica virgifera
  misc_feature: Coding regions on vcDNA: vcDNA=SeqID_2013; Strand=+; Position=48-1211
  misc_feature: Homolog annotation: Hit_ID=XP_308432.1; Match level="QueryCoverage =92%, HitCoverage=88%, E-value=4e-87, Identity=46%"; Hit description =ENSANGP00000018380 [Anopheles gambiae]
  misc_feature: Gene Ontology Annotation: Molecular function=protein tyrosine phosphatase activity; Cellular component=extracellular; Biological process=regulation of cell cycle
  misc_feature: Pfam annotation: Pfam_ID=Acid_phosphat_A; Match level="Score=76.4, E -value=7.8e-20, Copies=1"; Pfam description=Histidine acid phosphatase
MRRWTFICGTVTAMAAVLVFLGVGIKAIHVSGIPDRELKMVHIVMRHGARTPVSTYPNDPYKNDPLYPTGWGQLTNEGKKALYEIGKYYRERYGKFLGDKYSPDEYYTQSTDVDRTKASMMLVNAGLWPPKGEQVWGPLDWQPIPVASEPLSQDMLLLVRKPCPKYHVEKKKVFESKEVKDMLSKYEDLYKELTDITGQKTEDFEGVQDIYTTLMAEEKFHLKLPDWTKNYYPDRMYFPTVRSFVLNAYNDQMNRLIGGVLVKKLIEDWSAKSEGKLARKAVLYGGHDGTIVNLMSALKVWDEQVPDYAISILFELSKDRSTNEYGVEIYLRNTTVVPPFKLRIPGCDSFCPLTKLKELTKSIIPGNWEEECKVDDEGFVVPELRGP

SEQ ID NO: 22317 - protein, 193 aa, Diabrotica virgifera
  misc_feature: Coding regions on vcDNA: vcDNA=SeqID_2014; Strand=+; Position=172-750
  misc_feature: Homolog annotation: Hit_ID=XP_395611.1; Match level="QueryCoverage =47%, HitCoverage=19%, E-value=4e-22, Identity=49%"; Hit description =similar to ENSANGP00000010733 [Apis mellifera]
  misc_feature: Gene Ontology Annotation: Biological process=courtship behavior
  misc_feature (136)..(136): Xaa can be any naturally occurring amino acid
MATTENWFQNWHPPTTLFTEQQPFQPIHFQNSSPAFEYGYQLSQNSPNVGPNSFLPYLVSLSMVKPPGSEYIDNRASRHSTRGYGNRNQLINLETTGPFKTWYYWNVLDFAYPSETDRDIAIQNEDFIPKNNLPLXVEVYGNRIFVSMPKLKPGVPATLAVIPRVPKEPSPKLVPYPNWEWHTSRGCQSINSV

SEQ ID NO: 22318 - protein, 236 aa, Diabrotica virgifera
  misc_feature: Coding regions on vcDNA: vcDNA=SeqID_2015; Strand=+; Position=99-809
  misc_feature: Homolog annotation: Hit_ID=T12688; Match level="QueryCoverage=96%, HitCoverage=92%, E-value=2e-85, Identity=60%"; Hit description =hypothetical protein 63B12.2 - fruit fly (Drosophila melanogaster) emb|CAA15945.1| EG:63B12.2
  misc_feature: Pfam annotation: Pfam_ID=Ribosomal_L16; Match level="Score=20.5, E -value=1.5e-07, Copies=1"; Pfam description=Ribosomal protein L16
MLRELQLLRPLRILFVQSSGFKHFPSPPKFDHIQLPEKPRLKFIDKVPQLPPSIRPPKMQKKLKLMRGPEQVHTFLLHKQYGIMATGGGRLKWGHFEMMRMTIGRKMDNNRMFALWRVDAPWQPVTKQGLGVRMGGGKGAIDHYVTPVRAGRIILELGGKCEYAEVKDFLQDVANKLPFKAMPVSQDILDEMKEREKWEEENNQNEYTMKYIIQNNMGGCQKWLSPYEIKYFCKYV

SEQ ID NO: 22319 - protein, 217 aa, Diabrotica virgifera
  misc_feature: Coding regions on vcDNA: vcDNA=SeqID_2016; Strand=+; Position=244-897
  misc_feature: Homolog annotation: Hit_ID=NP_477383.1; Match level="QueryCoverage =97%, HitCoverage=93%, E-value=2e-58, Identity=51%"; Hit description =CG8717-PA [Drosophila melanogaster] gb|AAF59142.1| CG8717-PA [Drosophila melanogaster]
  misc_feature: Gene Ontology Annotation: Molecular function=molecular_function unknown
  misc_feature: Pfam annotation: Pfam_ID=MtN3_slv; Match level="Score=231.5, E-value =1.6e-66, Copies=2"; Pfam description=MtN3/saliva family
MNESDFKSILATTASICTILQFLTGTLTCQKIVQNKSTGDISSFPFVSGCLSTSLWLRYGFLINDSSIILVNTVGATLFFAYVLTFYLYSINKTAIVRQFLGCLFFLVIILLHIHNNVTDEELVRSHLGLVCCGVTILFFAAPFVSLLHVIKMKSTESLPYHLIFATFIVSLQWLIYGYVLKDEFIQVPNLIGCILSGIQLSLFLIYPKKSKVSALV

SEQ ID NO: 22320 - protein, 291 aa, Diabrotica virgifera
  misc_feature: Coding regions on vcDNA: vcDNA=SeqID_2017; Strand=+; Position=83-957
  misc_feature: Homolog annotation: Hit_ID=1V3V; Match level="QueryCoverage=84%, HitCoverage=71%, E-value=2e-65, Identity=53%"; Hit description=Chain B, Crystal Structure Of Leukotriene B4 12- Hydroxydehydrogenase15-Oxo- Prostaglandin 13-Reductase Complexed
  misc_feature: Gene Ontology Annotation: Molecular function=molecular_function unknown; Cellular component=cellular_component unknown; Biological process=biological_process unknown
  misc_feature: Pfam annotation: Pfam_ID=ADH_zinc_N; Match level="Score=-65.1, E -value=0.00069, Copies=1"; Pfam description=Zinc-binding dehydrogenase
  misc_feature (269)..(269): Xaa can be any naturally occurring amino acid
MWKWLVLVFFQLSVFDCAVKNNNNRSLHVPNFANRNLGDASSTCKAKYWTLVKYFDGFPKNTDMTIREENLPPLKNGEFLAKAVFLSVDPYQRVLGSFPDQVKLGEPFLGQQIAQIVETKNTRYPIGKYVRAPFGWRTLTISNGQIPDEDKPLDVLPDYGKLPVSLGLGVLGMTGMTAYFGLLEVCKPKAGETIVISGAAGAVGNLVGQIAKIKGLTVIGIAGSDEKGKWLKQELGFDQFINYKKDNIDEKLKQVAPKGVDCYFDNVGXEISSSVLYQMNDFGRVAVWGSK

SEQ ID NO: 22321 - protein, 127 aa, Diabrotica virgifera
  misc_feature: Coding regions on vcDNA: vcDNA=SeqID_2018; Strand=+; Position=125-508
  misc_feature: Homolog annotation: Hit_ID=XP_394434.1; Match level="QueryCoverage =100%, HitCoverage=12%, E-value=3e-43, Identity=64%"; Hit description= similar to CG1782-PA [Apis mellifera]
  misc_feature: Gene Ontology Annotation: Molecular function=ubiquitin activating enzyme activity; Cellular component=nucleus; Biological process=DNA replication
MSSGSLADNSIDPPAKKRKLESKIATLEMANNEASGSSTSDIDEGLYSRQLYVLGHEAMRRMANSDVLISGLGGLGVEVAKNVILGGVKSVTLHDEALCTIKDLSSQFYLTEGDIGKNRAEACCSSI

SEQ ID NO: 22322 - protein, 320 aa, Diabrotica virgifera
  misc_feature: Coding regions on vcDNA: vcDNA=SeqID_2019; Strand=+; Position=113-1071
  misc_feature: Homolog annotation: Hit_ID=XP_313681.1; Match level="QueryCoverage =93%, HitCoverage=60%, E-value=1e-104, Identity=61%"; Hit description= ENSANGP00000003733 [Anopheles gambiae]
  misc_feature: Pfam annotation: Pfam_ID=MGAT2; Match level="Score=186.7, E-value =4.7e-53, Copies=1"; Pfam description=N-acetylglucosaminyltransferase II (M
  misc_feature (270)..(271): Xaa can be any naturally occurring amino acid
  misc_feature (287)..(287): Xaa can be any naturally occurring amino acid
  misc_feature (296)..(296): Xaa can be any naturally occurring amino acid
  misc_feature (302)..(302): Xaa can be any naturally occurring amino acid
MKVWWLCRTMSSGSSQIWRRRSGTAWIRAGLVIFILVFIWIQMTFLSFAGSSPQYSELNDSNAAILSMVPAVLHKFLSPRPKNLSTITFANGSFSKFISTDVLNISEIKRNIAQYNRQQIVYNENIFEPLQNDSIVILVQIHDRITYLRHLIVSLAQAPGISQTLLIFSHDYYDEEMNNLVRSIDFCKVVQIFYPYSIQTHPYEFPGEDPGDCPRNIKKDLALRKKCNNALYPDVYGHYREAKFTQTKHHWWWKANRVFSDLEVTRNHTXXVVLLEEDHYVAEDFIXFVRLMERPXQDLCSXCNILSLGTYFETYNYYAD

SEQ ID NO: 22323 - protein, 100 aa, Diabrotica virgifera
  misc_feature: Coding regions on vcDNA: vcDNA=SeqID_2020; Strand=+; Position=2-304
  misc_feature: Homolog annotation: Hit_ID=NP_524698.1; Match level="QueryCoverage =100%, HitCoverage=15%, E-value=7e-23, Identity=50%"; Hit description= CG4501-PA [Drosophila melanogaster] gb|AAF53368.1| CG4501-PA [Drosophila melanogaster]
GIPRDNLTSEVKYWLRSIGCPAETVKEVLAAGPDKRVLDELLKGIERVNKQATSNAQTIKKISVLPADFSIPTGELGPTMKVKRRIVEQKYKDIIERMYS

SEQ ID NO: 22324 - protein, 254 aa, Diabrotica virgifera
  misc_feature: Coding regions on vcDNA: vcDNA=SeqID_2021; Strand=+; Position=539-1303
  misc_feature: Homolog annotation: Hit_ID=XP_392065.1; Match level="QueryCoverage =99%, HitCoverage=99%, E-value=1e-69, Identity=57%"; Hit description =similar to ENSANGP00000011647 [Apis mellifera]
  misc_feature: Gene Ontology Annotation: Molecular function=molecular_function unknown; Cellular component=DNA-directed RNA polymerase I complex; Biological process=transcription from Pol I promoter
  misc_feature: Pfam annotation: Pfam_ID=SWIB; Match level="Score=126.6, E-value=5.9e- 35, Copies=1"; Pfam description=SWIB/MDM2 domain
MADISKEDLRKEIAAILKDADLSSTSAKKVRQELEEKLETNLQSRKKEIDDLVMEFVSSKQDKKKGGKKKAESEEEEEEEEEEEEEEPSEDEKKKKRASTGKKPAAKKAKKTSEDESASEQSDGDSEEEYSPKKAKPVKTRKLPPKKKKGSESDSDEDWGKKKGKKGGGGGKKGGSGYTKVMNLSPELAALVGQDTMARHEVVKKVWSIIKEKDLYDPKNKQYAICDDALMKVIGTKRFRTFGMMKYLKNHFIS

SEQ ID NO: 22325 - protein, 268 aa, Diabrotica virgifera
  misc_feature: Coding regions on vcDNA: vcDNA=SeqID_2022; Strand=+; Position=114-920
  misc_feature: Homolog annotation: Hit_ID=XP_396942.1; Match level="QueryCoverage =85%, HitCoverage=37%, E-value=1e-27, Identity=32%"; Hit description =similar to F-box only protein 21 isoform 2; F-box protein 21 [Apis mellifera]
  misc_feature: Gene Ontology Annotation: Molecular function=ubiquitin-protein ligase activity; Cellular component=ubiquitin ligase complex; Biological process=ubiquitin-dependent protein catabolism
  misc_feature: Pfam annotation: Pfam_ID=F-box; Match level="Score=17.4, E-value =0.044, Copies=1"; Pfam description=F-box domain
MEKLPVEVIENILTFQKISIEDVVHFSLTCHYFHNIVTNNNKIWKTKLFQKFPQLRSLLESKHIIFQHEVKYIYELKKRTRALLEKMPAKFYKRYEISDSDLYEWSSILLEREEVYKCLVTDLMEIVNTDVSIKSIEVVPLNTPGNKTFQYYANKVLRYIRQHHLSKVWKEYISLPPSKQILEVGAVFVAQWCQPNVEVTVENIGHRLDLIAEEVKSALRTVYPEHPIFKATQEQLDLWRRQNKEQNEWKVNECRQLITIMREVLFHR

SEQ ID NO: 22326 - protein, 95 aa, Diabrotica virgifera
  misc_feature: Coding regions on vcDNA: vcDNA=SeqID_2023; Strand=-; Position=2-286
LRSNFSHLVPSLHYKLSFDTSFVIIPGIMTEDSCIRGRTDRQPRSNISPLVPSLDYMLLFDTFCHSTWYNDGGVIFAVGRTDVQTAQFKYLTFST

SEQ ID NO: 22327 - protein, 304 aa, Diabrotica virgifera
  misc_feature: Coding regions on vcDNA: vcDNA=SeqID_2024; Strand=+; Position=74-984
  misc_feature: Homolog annotation: Hit_ID=XP_309809.1; Match level="QueryCoverage =99%, HitCoverage=78%, E-value=1e-102, Identity=59%"; Hit description= ENSANGP00000018221 [Anopheles gambiae]
  misc_feature: Gene Ontology Annotation: Molecular function=(S)-2-hydroxy-acid oxidase activity; Cellular component=peroxisome; Biological process =fatty acid alpha-oxidation
  misc_feature: Pfam annotation: Pfam_ID=FMN_dh; Match level="Score=410.5, E-value=2e- 120, Copies=1"; Pfam description=FMN-dependent dehydrogenase
  misc_feature (277)..(277): Xaa can be any naturally occurring amino acid
MSDLVSVLEFEEHAVKVLPRNALDYYRSGAGKQETLADNRRAFFRYKLRPRCLRNVENIDLSTIVLGEKISMPLGIAPTAMQRMAHPLGECANARAAQALGIIYTLSTLSTSSIEEVAEAAPHAVKWYQLYIYRDRNVTKNLVLRAERAGYKALVLTVDAPVFGLRLADLKNKFTLPPHLRLANFQGHTSEMSQDLEKGSGLNAYVTDLFDATISWEDIKWLKSITKLPIVLKGILTAEDALLAVQAGVAAVQVSNHGARQIDGTPASIEALPEIVXAMGDRIEVYVDGGITDGIDILKAVALG

SEQ ID NO: 22328 - protein, 242 aa, Diabrotica virgifera
  misc_feature: Coding regions on vcDNA: vcDNA=SeqID_2025; Strand=+; Position=128-856
  misc_feature: Homolog annotation: Hit_ID=AAH68213.1; Match level="QueryCoverage =82%, HitCoverage=65%, E-value=2e-18, Identity=43%"; Hit description =Hypothetical protein MGC76055 [Xenopus tropicalis] ref|NP _001001248.1| hypothetical protein MGC76055 [Xeno
  misc_feature: Gene Ontology Annotation: Molecular function=pre-mRNA splicing factor activity; Cellular component=nucleus; Biological process=mRNA splice site selection
METDTPQTAAPAVTQIPAEIEAIIKATVEQTVATLMEKRLGKRKHRRSRSRSKSRSRSRSRSRGGRSRSRSKGRHDRSKSRGKHDRSRSRGRHDRSKSRGRRDRSRSRGRHDRSKSRGRRDRSRSRGKHDRCGSRGPCERFGNNRDEWNGWVGFGHPPHHHDHFHHHHPPGCFSEHFRPHGRHGRHGKRFPFPCGCSCSSRKEEEQNMESEKEEQNVQSEKEGTPAADKSLRENFKNLEVDN

SEQ ID NO: 22329 - protein, 88 aa, Diabrotica virgifera
  misc_feature: Coding regions on vcDNA: vcDNA=SeqID_2026; Strand=+; Position=147-413
  misc_feature: Pfam annotation: Pfam_ID=zf-C2H2; Match level="Score=47.3, E-value =4.3e-11, Copies=2"; Pfam description=Zinc finger, C2H2 type
YECYFFFTDPLPYKCSRCWRSYSVSYTLERHLRYECGVAKQFTCSICSKKFSRRDILRVHQKNFRHDINHGMVQPLEPNQDLSQMQGS

SEQ ID NO: 22330 - protein, 145 aa, Diabrotica virgifera
  misc_feature: Coding regions on vcDNA: vcDNA=SeqID_2027; Strand=+; Position=861-1298
  misc_feature: Homolog annotation: Hit_ID=NP_473211.1; Match level="QueryCoverage =71%, HitCoverage=25%, E-value=4e-27, Identity=49%"; Hit description =hypothetical protein [Plasmodium falciparum 3D7] pir||T18435 hypothetical protein C0390w - malaria
MDYYYGLPLWITIMDYHYGLPLWITIMDYHCDTIMDYHCDTIMDYHCDTIMDYHCDTIMDYHCDTIMDYHCDTIMNYHCDTIMDYHCDTIMDYHCDTIMDYHCDTIMDYHCDTIMDYHCDTIMDYHCDYHYGLPIWFIIMDLTYI

SEQ ID NO: 22331 - protein, 82 aa, Diabrotica virgifera
  misc_feature: Coding regions on vcDNA: vcDNA=SeqID_2028; Strand=-; Position=945-1193
KRKSFFRPRERNRLVRNNREKVSLNHFVSIFGIILKFSSESVGKLKVGYSHRLHSFFGVYRPSSELFLPRPRNFHRDVKGSV

SEQ ID NO: 22332 - protein, 134 aa, Diabrotica virgifera
  misc_feature: Coding regions on vcDNA: vcDNA=SeqID_2029; Strand=-; Position=258-662
TKVKNKNEIEGHHYNYKTSTDHTPHLKSNLEKPKPGAQSNSRIWFVQAQTKVTIPNEKRSTGSLYGENRFGGNEKNNLRKIKRNEWENKKTPRPRVSVKKPKVLSNTNLKVIVRLVTNFDEECRYIKVKLVYVM

SEQ ID NO: 22333 - protein, 305 aa, Diabrotica virgifera
  misc_feature: Coding regions on vcDNA: vcDNA=SeqID_2030; Strand=+; Position=77-1030
  misc_feature: Homolog annotation: Hit_ID=XP_397150.1; Match level="QueryCoverage =88%, HitCoverage=54%, E-value=9e-46, Identity=38%"; Hit description =similar to ENSANGP00000020271 [Apis mellifera]
  misc_feature: Gene Ontology Annotation: Molecular function=ubiquitin-protein ligase activity; Cellular component=ubiquitin ligase complex; Biological process=protein ubiquitination
  misc_feature: Pfam annotation: Pfam_ID=TPR_2; Match level="Score=23.7, E-value =0.00058, Copies=1"; Pfam description=Tetratricopeptide repeat
  misc_feature (246)..(246): Xaa can be any naturally occurring amino acid
  misc_feature (254)..(254): Xaa can be any naturally occurring amino acid
MEIWILCKKMKKSHNLQNETGERDVSREEDLSSFREQWQNEIRSTKQSQTDEQLKKVLKPTSSENVARHNADVQGPTQDEDINERATKLFLKGVEMENSGKLYEAIQYYKQAVQIVPDIEFIMHKKTKPKNIETEDTSTDDDDDEDNEEDIFLRIQRKASKKISLCTPKHSKNGLHIGQMPVELILYILKWVVSDQLDMRSLEMFSSVCRGFYLCARNEGIWKVACLRVWGGNCGSTNGDYKSLRXMFIEKNKXVTFNGCYLSKTTYIQKRKKKVSKTKFIKPWEFGGKFTDFLKFFPPWDRIGA

SEQ ID NO: 22334 - protein, 134 aa, Diabrotica virgifera
  misc_feature: Coding regions on vcDNA: vcDNA=SeqID_2031; Strand=+; Position=104-508
  misc_feature: Homolog annotation: Hit_ID=XP_320178.1; Match level="QueryCoverage =99%, HitCoverage=95%, E-value=4e-54, Identity=80%"; Hit description =ENSANGP00000011800 [Anopheles gambiae]
  misc_feature: Gene Ontology Annotation: Molecular function=pre-mRNA splicing factor activity; Cellular component=nucleus; Biological process=mRNA splicing
  misc_feature: Pfam annotation: Pfam_ID=LSM; Match level="Score=57.7, E-value=3.3e -14, Copies=1"; Pfam description=LSM domain
MSIGVPIKVLHEAEGHVITCETITGEVYRGKLIEAEDNMNCQMTQITVTYRDGRVAQLENVYIRGSKIRFLVLPDMLKNAPMFKKQTKAGTAGRGKSAILRAQARGRGRGQQQPMRGRGNWQQNQQQAPAGRGR

SEQ ID NO: 22335 - protein, 256 aa, Diabrotica virgifera
  misc_feature: Coding regions on vcDNA: vcDNA=SeqID_2032; Strand=+; Position=69-839
  misc_feature: Homolog annotation: Hit_ID=AAM52624.1; Match level="QueryCoverage =99%, HitCoverage=100%, E-value=1e-116, Identity=83%"; Hit description=GH14462p [Drosophila melanogaster]
  misc_feature: Gene Ontology Annotation: Molecular function=electron transfer flavoprotein; Cellular component=mitochondrial matrix; Biological process=biological_process unknown
  misc_feature: Pfam annotation: Pfam_ID=ETF_beta; Match level="Score=358.5, E-value =9e-105, Copies=1"; Pfam description=Electron transfer flavoprotein beta s
VVKMARVLVGVKRVIDYAVKIRVKPDKTGVVTDGIKHSMNPFDEIAVEEAVRLKEKKVASEIIAVSCGPAQSQEVLRTALAMGVDKGIHVEISGPEYETLQPIHVSKILAKIAQNEKADLVIVGKQAIDDDCNQTAQMTAAVLDWPQATFTSKLEKGDKDLTVTREIDGGLETIKCKIPAVISADLRLNEPRYATLPNIMKAKKKPIQKLTPKDLGVDVSPRIKVISVEDPPVRQAGAILPDVDALVGKLKEGGHI

SEQ ID NO: 22336 - protein, 210 aa, Diabrotica virgifera
  misc_feature: Coding regions on vcDNA: vcDNA=SeqID_2033; Strand=+; Position=102-734
  misc_feature: Homolog annotation: Hit_ID=AAK94897.1; Match level="QueryCoverage =93%, HitCoverage=92%, E-value=3e-72, Identity=62%"; Hit description =mRNA cap-binding protein eIF4E [Spodoptera frugiperda]
  misc_feature: Gene Ontology Annotation: Molecular function=translation factor activity, nucleic acid binding; Cellular component=nucleus; Biological process=protein biosynthesis
  misc_feature: Pfam annotation: Pfam_ID=IF4E; Match level="Score=356.0, E-value=5.1e- 104, Copies=1"; Pfam description=Eukaryotic initiation factor 4E
MSTNSLENEIDKNEQKNDNDLEIPMDFSIKHPLQNAWTLWYYENDRTQAWEKNQKEIATFQTVEDFWSLYNHIKPSSELRQGTDYSLFKKGIRPMWEDDANKRGGRWLLSLEKKQRNNDLDRYWLDIILCLIGEAFENSEEICGAVVNIRQKGDKIAVWTADAQNSHAVLEIGSKLKERLHIPSRVTLGYQLHKDTIQKTGSVSKYSYTV

SEQ ID NO: 22337 - protein, 173 aa, Diabrotica virgifera
  misc_feature: Coding regions on vcDNA: vcDNA=SeqID_2034; Strand=+; Position=37-556
  misc_feature: Homolog annotation: Hit_ID=XP_393038.1; Match level="QueryCoverage =80%, HitCoverage=44%, E-value=2e-37, Identity=58%"; Hit description =similar to CG5085-PA [Apis mellifera]
  misc_feature: Gene Ontology Annotation: Molecular function=DNA binding; Cellular component=cytoplasm; Biological process=gene silencing
  misc_feature: Pfam annotation: Pfam_ID=SIR2; Match level="Score=-53.6, E-value=9.9e- 06, Copies=1"; Pfam description=Sir2 family
  misc_feature (121)..(121): Xaa can be any naturally occurring amino acid
MSTKEEQDTPPNQTQESEEHSASGSSSEDEQEENMEHLRRFFAEKLNFSKAEDKEKVKVLNDVSIDGIVNYINEKNCKNIITMAGAGISTSAGIPDFRSPGTGLYHNLQKYNLPHPQAIFXLDFFHNNRTNPLSCKRTLPKYIQTALCHYFVKMVDEKGLLLRHYTQNIDTLE

SEQ ID NO: 22338 - protein, 190 aa, Diabrotica virgifera
  misc_feature: Coding regions on vcDNA: vcDNA=SeqID_2035; Strand=+; Position=136-708
  misc_feature: Homolog annotation: Hit_ID=NP_649972.1; Match level="QueryCoverage =94%, HitCoverage=97%, E-value=7e-34, Identity=40%"; Hit description =CG12811-PA [Drosophila melanogaster] gb|AAF54483.1| CG12811-PA [Drosophila melanogaster]
MVFKEQLAIQISLIFSLSICTLCQIAFPELPTQRLDSDQTKGRVPLYAPNRCPENQLYYPGYQQHDWICDCGPTYIYYPPKDFCYPAYRQGPCKDGEHLVVLRGEVIPSCNKNPCEEGFARYKGTCYEMGKPNGPCLPIQQGGGIFDVNATTLVVECLKGTDRLSLFNLPKFCMPGSKRDSNGNCRVIYN

SEQ ID NO: 22339 - protein, 83 aa, Diabrotica virgifera
  misc_feature: Coding regions on vcDNA: vcDNA=SeqID_2036; Strand=-; Position=403-654
HLYNEASLLITRENEVEEHVSSPVFGAVMAINKYPRCLYTEMPKICMLIESTSSCLSTKYFSTAPFKQYLISYIARNGFTIGS

SEQ ID NO: 22340 - protein, 404 aa, Diabrotica virgifera
  misc_feature: Coding regions on vcDNA: vcDNA=SeqID_2037; Strand=+; Position=2-1216
  misc_feature: Homolog annotation: Hit_ID=XP_318627.1; Match level="QueryCoverage =99%, HitCoverage=36%, E-value=1e-153, Identity=67%"; Hit description= ENSANGP00000020973 [Anopheles gambiae]
  misc_feature: Gene Ontology Annotation: Molecular function=ATP dependent RNA helicase activity; Cellular component=nucleolus; Biological process =RNA localization
  misc_feature: Pfam annotation: Pfam_ID=Helicase_C; Match level="Score=48.9, E-value= 1.5e-11, Copies=1"; Pfam description=Helicase conserved C-terminal domain
  misc_feature (155)..(155): Xaa can be any naturally occurring amino acid
  misc_feature (388)..(388): Xaa can be any naturally occurring amino acid
LYAMQMTKLDFNTTAEKQLVDEVFNNAMDVLSDDDKQLPQVENLLPLLRRGIGIHHGGLLPILKETIEILFGEGLIKALFATETFAMGLNMPARTVLFTGMRKFDGSEYRWITSGEYIQMSGRAGRRGLDDKGIVILMVDEKVPPAAGRNIVKGXPDPINSAFHLTYNMVLNLLRVEEINPEYMLERSFFQFQNQAAIPGYYDDYNEKLELFNSLEIKDEERIQSYHVIRTELDLLGVKFRTYLTSSQYLLPFLQPGRLLKIKSTEDEYDWGAVVNFKKVQEIIPGRKNKQGQSKTQTKVKVDILLHVLPENSDETMIPKPCLEDQKGEIEVVTVDSTLITHLSSVRLFCPNDLRSKDSRKGMYKAIKEVKKRFPEGPPLLNPVTDMXFKEEEFLSIVEKILLL

SEQ ID NO: 22341 - protein, 264 aa, Diabrotica virgifera
  misc_feature: Coding regions on vcDNA: vcDNA=SeqID_2038; Strand=+; Position=119-909
  misc_feature: Homolog annotation: Hit_ID=XP_395325.1; Match level="QueryCoverage =97%, HitCoverage=68%, E-value=1e-104, Identity=71%"; Hit description= similar to CG5395-PA [Apis mellifera]
  misc_feature: Gene Ontology Annotation: Molecular function=ATPase activity; Cellular component=mitochondrial outer membrane; Biological process =mitochondrial translocation
  misc_feature: Pfam annotation: Pfam_ID=AAA; Match level="Score=101.3, E-value=2.4e -27, Copies=1"; Pfam description=ATPase family associated with various
  misc_feature (246)..(246): Xaa can be any naturally occurring amino acid
MADTAFTKNEVIGLVVRLTLVSAVTFLSIKWIMNQVDPTNKSKKKARRQAEEQLKRLSATGHAPVLIEKLNDYEMMIAAHLVHPQDIKVTWSSIAGLEGLIQELRETVILPIQRKELFADSQLTTAPKGVLLHGPPGCGKTLIAKATAREAGTRFINLDLSILTDKWYGESQKLAAAVFTLAVKIQPCIIFIDEIDSFLRSRTSSDHEATAMMKAQFMSLWDGLITDLNCTVIVMGATNRPQDLDXAILRRNAATFHVPMPNAA

SEQ ID NO: 22342 - protein, 90 aa, Diabrotica virgifera
  misc_feature: Coding regions on vcDNA: vcDNA=SeqID_2039; Strand=-; Position=854-1126
RFYQRLNVKNIYKLNSCLNNPTYRKFSINISISLLPNSVTTSVGNDKNLLLLSKIKQTKQKELTLLNRLKNSSELVAYIRKYKKHTVNIS

SEQ ID NO: 22343 - protein, 69 aa, Diabrotica virgifera
  misc_feature: Coding regions on vcDNA: vcDNA=SeqID_2040; Strand=-; Position=1948 -2157
PPFFHPGPRGFFPYSDPPPFHFLFYKRSGSKNHFKKKILGEGEFYFLLYISPYTPNINKKKKIAHLDFL

SEQ ID NO: 22344 - protein, 110 aa, Diabrotica virgifera
  misc_feature: Coding regions on vcDNA: vcDNA=SeqID_2041; Strand=-; Position=1013 -1345
IARCNLKMKCFLVYSSTILDICFPCLSGAICYNIPFRKRVTFQVSQALIQIQDRLRMFIKPLCPKMTNPRLSIDLFMSESMVTDRQSTKNPVDHSFPCSLGTKIVPLHLA

SEQ ID NO: 22345 - protein, 253 aa, Diabrotica virgifera
  misc_feature: Coding regions on vcDNA: vcDNA=SeqID_2042; Strand=+; Position=181-940
  misc_feature: Homolog annotation: Hit_ID=XP_316141.1; Match level="QueryCoverage =96%, HitCoverage=75%, E-value=1e-77, Identity=56%"; Hit description =ENSANGP00000020387 [Anopheles gambiae]
  misc_feature: Gene Ontology Annotation: Molecular function=calcium activated cation channel activity; Cellular component=intracellular; Biological process=cation transport
  misc_feature: Pfam annotation: Pfam_ID=NUDIX; Match level="Score=14.9, E-value =0.012, Copies=1"; Pfam description=NUDIX domain
  misc_feature (236)..(236): Xaa can be any naturally occurring amino acid
MLLKRMVHTKCRDIFYPFSEVKRFQIKDEEVPWSVSLNKYDPPEYNSKVLINKPWADPPLNDGVFNPKWNQLDGKINRQSHTGTYNIVDGRPLNPEGRTGIKGRGVLGKWGPNHAADPIVTRWKMDNNLKVINKSTNLPILQFCAIQRKDSKHWAIPGGMVDPGEKVSETLHREFQEEALNSLQTSKEQAERDAQIIKDFFKTGVEIYKGYVDDPRNTDNAWMETVAYNFHDDDGXTLGKFNLTAGDDAQNVT

SEQ ID NO: 22346 - protein, 78 aa, Diabrotica virgifera
  misc_feature: Coding regions on vcDNA: vcDNA=SeqID_2043; Strand=+; Position=88-321
  misc_feature: Homolog annotation: Hit_ID=XP_392323.1; Match level="QueryCoverage =100%, HitCoverage=9%, E-value=2e-13, Identity=40%"; Hit description =similar to ENSANGP00000009134 [Apis mellifera]
  misc_feature: Gene Ontology Annotation: Molecular function=ATP binding; Cellular component=plasma membrane; Biological process=biological_process unknown
MPEDKKMAVDNDTLSSKKSSTIIRSSGSTTAQVTMLDGSILPIVIDKRAKGKDLLDKVCEAINLIEKDYFGLVYADRH

SEQ ID NO: 22347 - protein, 171 aa, Diabrotica virgifera
  misc_feature: Coding regions on vcDNA: vcDNA=SeqID_2044; Strand=-; Position=223-738
IQTIIILLEYFKMYFSRCVQLFLCVILFYQISSIKAQCVGRFTIEDEESHDILYRFMDTLERYTGLSGDYQKAVTVNCPRNGICVVNPQGSAIWEARLEFYTPYVLNSSGTHSSTETLDSCICYSRTNYEFQDCLINVRQNMLLDLDTKLVPTFRRIVEQDRCALFKENCL

SEQ ID NO: 22348 - protein, 180 aa, Diabrotica virgifera
  misc_feature: Coding regions on vcDNA: vcDNA=SeqID_2045; Strand=+; Position=224-766
  misc_feature: Homolog annotation: Hit_ID=NP_608332.2; Match level="QueryCoverage =87%, HitCoverage=40%, E-value=2e-27, Identity=43%"; Hit description =CG14211-PB [Drosophila melanogaster] gb|AAF48988.1| CG14211-PB [Drosophila melanogaster]
  misc_feature: Gene Ontology Annotation: Molecular function=protein binding; Cellular component=cytoplasm; Biological process=regulation of actin polymerization and/or depolymerization
  misc_feature: Pfam annotation: Pfam_ID=DSPc; Match level="Score=119.3, E-value=9.1e- 33, Copies=1"; Pfam description=Dual specificity phosphatase, catalyt
MSVLSRISNIYSKSGSRQYPDELDMIETNLYLSGEAEARNVETLKKYKITHILTINDFPLTGTVKSALGYLQIKYIRLPDLSSSDLLSYFDETYEFIREGVAKGAVLVHCQMGVSRSASVVIAYIMKKYNLTYREALDKVKMKRCVFPNPGFVSQLQSYRDMGYTTIRRYDPRLARYMMR

SEQ ID NO: 22349 - protein, 395 aa, Diabrotica virgifera
  misc_feature: Coding regions on vcDNA: vcDNA=SeqID_2046; Strand=+; Position=55-1238
  misc_feature: Homolog annotation: Hit_ID=XP_311497.1; Match level="QueryCoverage =82%, HitCoverage=45%, E-value=1e-106, Identity=60%"; Hit description= ENSANGP00000013687 [Anopheles gambiae]
  misc_feature: Gene Ontology Annotation: Molecular function=ATP-dependent peptidase activity; Cellular component=mitochondrion; Biological process =proteolysis and peptidolysis
  misc_feature: Pfam annotation: Pfam_ID=LON; Match level="Score=249.8, E-value=5e -72, Copies=1"; Pfam description=ATP-dependent protease La (LON) domai
  misc_feature (382)..(382): Xaa can be any naturally occurring amino acid
MNFVKLTRIAQTLTIRGCTVRRYSYKLSQNTPITSYNNSSSRLRISFRKETVKSSLFQRKLLIPRETVAFRHFATKTPDGPEDGAPAAEENFNPQLPATVAVPEVWPHVPVIAISKNIVFPRFIKLIELTNPQLIKLLRRKVKLNQPYCGIFLKKREDNDSEVVSNISDVYDVGVFAQIHEMQDLGDRLRLVVMAHRRIKITGQIFENEEQKEETESEKPRRKLRNNRVVKPPIESTKTKEQTESKDPKATPSASAKPLIEGLLMAEVENVVHNKFRQTEEVKALTQEVIKTIRDIISLNPLYRDSLQQMMHQGQRVVDNPVYLSDLGAALTAAESKELQEVLEEMDIPKRLMLSLSLLKKEYELSKLQQKIGREVEEKLKXHHRKYILQEQLKG

SEQ ID NO: 22350 - protein, 311 aa, Diabrotica virgifera
  misc_feature: Coding regions on vcDNA: vcDNA=SeqID_2047; Strand=+; Position=182-1117
  misc_feature: Homolog annotation: Hit_ID=NP_001003510.1; Match level="QueryCoverage= 96%, HitCoverage=97%, E-value=4e-62, Identity=44%"; Hit description =zgc:91936 [Danio rerio] gb|AAH78374.1| Zgc:91936 [Danio rerio]
  misc_feature: Gene Ontology Annotation: Molecular function=electron transporter activity; Cellular component=nucleus; Biological process=induction of apoptosis
  misc_feature: Pfam annotation: Pfam_ID=adh_short; Match level="Score=133.1, E-value= 6.4e-37, Copies=1"; Pfam description=short chain dehydrogenase
MLYIVLYSIGAYLIFNLVFKIYVKLNTMSCKNKVCLVGKTVIVTGANTGIGFETALDCAKRGARVILACRDHLKGTVAVQNIQTLTKNQNVVLKILDLASLSSVKNFANDILRTEEKLDILINNAGALLLGDQLTEDGLQFEMQINYFGPVLLTLMLVNLLKKSAPSRIINVSSVVAKYAKLDVKNLNGKPSYPITKLCNILFTQELAKKLNEFNISVFALHPGMIATDIMTRHLWPIVNSCVIPLSRVVIKTPEEGAQTTIYAATEPGIEHLTGGFFSECRYQKHYKTARDPQLAQQLWDETMKLLNYND

SEQ ID NO: 22351 - protein, 618 aa, Diabrotica virgifera
  misc_feature: Coding regions on vcDNA: vcDNA=SeqID_2048; Strand=+; Position=111-1966
  misc_feature: Homolog annotation: Hit_ID=XP_393233.1; Match level="QueryCoverage =91%, HitCoverage=99%, E-value=0.0, Identity=59%"; Hit description =similar to ENSANGP00000013395 [Apis mellifera]
  misc_feature: Gene Ontology Annotation: Molecular function=general RNA polymerase II transcription factor activity; Cellular component=transcription factor complex; Biological process=establishment and/or maintenance of chromatin
  misc_feature: Pfam annotation: Pfam_ID=DUF1546; Match level="Score=176.1, E-value =7.3e-50, Copies=1"; Pfam description=Protein of unknown function (DUF1546)
  misc_feature (159)..(159): Xaa can be any naturally occurring amino acid
MSKIGDHDLYGTNFSTESMKVIAESIGIGYLADDAAKELAEDISFRIKHIIQDAAKFMNNAKRTKLLQTDVDSALKVKNIEPQYGFQSTEHLPFRFASGGGRELHFIEEKEVDLNDLLQNMCPKAPLETTLRSHWMFIDGVQPTIPENPPPVAKVVQKXESVDPVNKKPIKETSGKPTTGKQKLKNVETVQIKQLATHELSVEQQLYYKEITEACVGSDEARRAEALQSLASDPGLHEMLPRMCTFIIEGVRVNVVQNNLALLIYLMRMVKALLDNQSLYLEKYLHELIPSVTTCIVSKQLCMRPELDNHWALRDFASRLMAQICKNFNTSTNNIQTRVTRMFTNALQQDKVPLSSLYGALQGLSELGAEVTRIFILPRVRNIGNRIEGYLDGNPTSNMEKIASGHIKQLLIKVLAPVLKSIRNPPDNPDEYRQEYGYLGLSLHAAVVKARTQPNILPTSVSNVNNPITCSSPITKTINTPSGIIQQQTPAGRTIVMNPSPRAQIPQSNQKFVFVTQRPQTPMSTSHQIQQSQSISTSQNTVVKFVSNPNQAQPKLATQQKLVMVSNPSAQGNFQTQSPGSTLLLSNNRISLCSNRYSINSSNNNSSNSLLLWMIYLI

SEQ ID NO: 22352 - protein, 243 aa, Diabrotica virgifera
  misc_feature: Coding regions on vcDNA: vcDNA=SeqID_2049; Strand=+; Position=149-877
  misc_feature: Homolog annotation: Hit_ID=XP_314743.1; Match level="QueryCoverage =96%, HitCoverage=26%, E-value=6e-68, Identity=53%"; Hit description =ENSANGP00000013023 [Anopheles gambiae]
  misc_feature: Gene Ontology Annotation: Molecular function=zinc ion binding; Cellular component=cellular_component unknown; Biological process =signal transduction
MPVDGSTTGSDSASRLPRHHHNIYGHPYDPGYAQMESWLDEHPDFVNDYFLRKATRQIVEQWQVSHATPTSSNVELASPTHNNPSRASSGATTPVRKISAHEFERSGLLKPMINTIDGQPTFLTSENQTPAGTGSPTPGRRQRRSRHELRQMDEKDLIFELVKDICNELEIRSLCHKILQNVCMLLNADRGSLFLVEGDKTSGCEVDSGHRDRCLVSKLFDVCSKSTLVDIEKKEEIKFPLVR

SEQ ID NO: 22353 - protein, 192 aa, Diabrotica virgifera
  misc_feature: Coding regions on vcDNA: vcDNA=SeqID_2050; Strand=+; Position=29-607
  misc_feature: Homolog annotation: Hit_ID=AAV91360.1; Match level="QueryCoverage =97%, HitCoverage=95%, E-value=1e-58, Identity=60%"; Hit description =heat shock protein 1 [Lonomia obliqua]
  misc_feature: Gene Ontology Annotation: Molecular function=chaperone activity; Cellular component=cytosol; Biological process=protein folding
  misc_feature: Pfam annotation: Pfam_ID=HSP20; Match level="Score=137.1, E-value=4e -38, Copies=1"; Pfam description=Hsp20/alpha crystallin family
MSMVPLLFRDWWDEEDLMRPSRLLDQQFGLGLRRDDLLNSIRDIPRRSALSSRYIRPWATSTALQRQDSGSTITQDQNKFQVILDVQQFAPNEITVKTNGNSILVEGKHEEKQDEHGYIMRHFVRRYVLPQTHDAENVVSSLSSDGVLTVSAPKKSEKPVASERVVPITQTGPAKSTVTPVVESPQPQPQVN

SEQ ID NO: 22354 - protein, 679 aa, Diabrotica virgifera
  misc_feature: Coding regions on vcDNA: vcDNA=SeqID_2051; Strand=+; Position=146-2185
  misc_feature: Homolog annotation: Hit_ID=NP_477158.1; Match level="QueryCoverage =100%, HitCoverage=100%, E-value=0.0, Identity=70%"; Hit description =CG11567-PA, isoform A [Drosophila melanogaster] gb|AAF52367.1| CG11567-PA, isoform A [Drosophila
  misc_feature: Gene Ontology Annotation: Molecular function=oxidoreductase activity; Cellular component=integral to membrane; Biological process =embryogenesis and morphogenesis
  misc_feature: Pfam annotation: Pfam_ID=FAD_binding_1; Match level="Score=407.0, E -value=2.3e-119, Copies=1"; Pfam description=FAD binding domain
MSEAEANIGTQQIPEASESLFGTLDIVLLALIVGGISWYLVNKHKKTKTIANGRSYSIQPTSINLQTSTDNSFIKKLQSSGRSLVVFYGSQTGTGEEFAGRLAKEGVRYRMKGMVADPEECDMEELVNLKTLPNSLAVFCLATYGEGDPTDNAMEFYEWLQNGDADLTGLNYAVFGLGNKTYEHYNKVAIYVDKRLEELGATRLYDLGLGDDDANIEDDFITWKDKFWPAVCEHFGIESTGEDINMRQYRLEEFEETPDRVFTGEMARLQSLKNQRPPYDAKNPFLSKVKINRELHKNGDRSCMHIEFDIEGSKMRYDAGDHLAVYPINDVELVEKLGKYCGKDLNTIFSLINTDEDSSKKHPFPCPCSYRTALMHYVDITQNPRTHVLKELAEYCTDPAEKEKLKSMSTTTPEGKALYQKWIIEDNRNIVHILEDMKSCQPALDHLCELMPRLQPRYYSISSSPKLYPNTVHITAVLVEYDTPTGRHNKGVATTWLKTKMPDPEKELPTVPIFVRKSQFRLPTKPQTPIIMIGPGTGFAPFRGFIQDRNLCKEEGKPVGDTVLYFGCRKAAEDYIYEEELVEYHKNGLLTLHLAFSRDQAKKVYVTHLLEQQADEVWKIIGENNGHIYICGDAKSMATDVRAILTKILQEKGSLTEEQATAYLKKMETQKRLSADVWS

SEQ ID NO: 22355 - protein, 86 aa, Diabrotica virgifera
  misc_feature: Coding regions on vcDNA: vcDNA=SeqID_2052; Strand=-; Position=3-260
NTKKTCCSIKCTFCNICIHLFSWACIDYSTKNTISKHIHYVAILQIPFNLKTFHFLKIKWCPVMLNSFFIISLLCTPVTAVQNIIL

SEQ ID NO: 22356 - protein, 108 aa, Diabrotica virgifera
  misc_feature: Coding regions on vcDNA: vcDNA=SeqID_2053; Strand=+; Position=60-386
  misc_feature: Pfam annotation: Pfam_ID=AT_hook; Match level="Score=22.0, E-value =0.0018, Copies=2"; Pfam description=AT hook motif
MSDDAATTPSKRGRKANAEKAEKVEKAEKVDTKKRGKKDADDEGASPAKRGRGRPKGTTKKKSAVKPKAKSAGASRGRGRPKKKEEPKDSGDEDNDDNDAGEEEEDDD

SEQ ID NO: 22357 - protein, 296 aa, Diabrotica virgifera
  misc_feature: Coding regions on vcDNA: vcDNA=SeqID_2054; Strand=+; Position=22-909
  misc_feature: Homolog annotation: Hit_ID=NP_476974.1; Match level="QueryCoverage =99%, HitCoverage=86%, E-value=5e-27, Identity=31%"; Hit description =CG5370-PA [Drosophila melanogaster] gb|AAF47027.1| CG5370-PA [Drosophila melanogaster]
  misc_feature: Gene Ontology Annotation: Molecular function=caspase activity; Cellular component=cytoskeleton; Biological process=cleavage of lamin
  misc_feature: Pfam annotation: Pfam_ID=Peptidase_C14; Match level="Score=124.0, E -value=3.7e-34, Copies=1"; Pfam description=Caspase domain
MATQRDAGVFKPQKLLTPPPPETPPATSRSPFRVVDDLPVKKFVERKHLRTDRFEYERKGDDPGYIIIFNQETFYDKELGTRRGTRRDVNELTTCLQRLGFNIDKENILTDKTTEEVEQVLEKASQIDFTNYNCLILFFLSHGEELNFLHTKDGQILAKDIWLKFKDSPGLNGKPKMFVFQACKGENFTTVGNELPKSAVLTPSSTFSPDYLYDDLLIVHSSTEGNCAFRNQYTGSWFIQELCKNFTAYGRKDEVISLIIRVTKCVSNNFTKGKDPTTNLEYSNAKQMPFFISTLR

SEQ ID NO: 22358 - protein, 431 aa, Diabrotica virgifera
  misc_feature: Coding regions on vcDNA: vcDNA=SeqID_2055; Strand=+; Position=85-1377
  misc_feature: Homolog annotation: Hit_ID=XP_318041.1; Match level="QueryCoverage =99%, HitCoverage=75%, E-value=0.0, Identity=70%"; Hit description =ENSANGP00000003410 [Anopheles gambiae]
  misc_feature: Gene Ontology Annotation: Molecular function=pre-mRNA splicing factor activity; Cellular component=nucleus; Biological process=mRNA splice site selection
  misc_feature: Pfam annotation: Pfam_ID=zf-CCHC; Match level="Score=16.8, E-value =0.0024, Copies=1"; Pfam description=Zinc knuckle
MATNHQNLPISSILKSKSEVDDEPKKKSREDWRKAKELEEARKAGTAPAAVDEEGKDINPHIPQYISNAPWYYGTSGPTLKHQRPQEEKQKEYSNIDEWYKRGVDTSKIVTKYRKGACENCGAMTHKKKDCMERPRKVGAKFSGANIAPDEFAQKNLALSFDGKRDRWSGYDPSEHKAVIEEFQKVEEAKRQLKADKLNANESSDDEEKDEDKYVDEVDMPGTKVDSKQRITVRNLRIREDTAKYLRNLDLGSAYYDPKTRSMRENPNPEKDATYSGENFVRFTGDTTNHAKAQLFAWEAYEKGVDVHLLAEPTKLELLKKEYEKKKEQVKSTIQGSVLDKYGGQEHLEAPPKSLLLAQSEVYVEYSRSGRVITGAEKEVIRSKYEEDVYINNHTSVWGSYWRGGQWGYKCCHSFIKNSYCLGEAGKALTL

SEQ ID NO: 22359 - protein, 155 aa, Diabrotica virgifera
  misc_feature: Coding regions on vcDNA: vcDNA=SeqID_2056; Strand=-; Position=624-1091
VFSDLEWLKHWLLEPPIKNSASAIQKNEKKIHKKLLFKSKPKILNITQKILKVSIIFARPNFQLKNLKKSDCFVFKRYISLNFLRFFKAKLRSQKIKSEKGTFLCSRGSMASVKLESCMKANFICLIKITAPRFIKVAGLIVAGVVLSILSRYSL

SEQ ID NO: 22360 - protein, 131 aa, Diabrotica virgifera
  misc_feature: Coding regions on vcDNA: vcDNA=SeqID_2057; Strand=-; Position=564-959
  misc_feature (10)..(10): Xaa can be any naturally occurring amino acid
LHGVRSVIIXGEMQSPIKMVRNHKHGCSMWRMFPPPYRIYVCQSAVTSSFFLTKTVKIHVRTGEYRRNKFVYTALPQPSHGHVKVLCIPYALKEGTDFSLPVKLMVHGSYHLEREQILAAVPKATREIPRT

SEQ ID NO: 22361 - protein, 270 aa, Diabrotica virgifera
  misc_feature: Coding regions on vcDNA: vcDNA=SeqID_2058; Strand=+; Position=80-892
  misc_feature: Homolog annotation: Hit_ID=EAL31888.1; Match level="QueryCoverage =97%, HitCoverage=75%, E-value=2e-50, Identity=38%"; Hit description =GA20171-PA [Drosophila pseudoobscura]
MLKSSVQHKILNYLPDDRPITAIQIIENLDKCPRGFFAINKTYDQDSDADLRESSIFKSSSARYLCLSKTEGLPNFVVQEILVLADKANPPKGFSLLNKTADSEQKAWKKKQICYRLVNRKDIKTAVTDIIICSRLKKAPSGFSFAGELNGVTLCYKMGNVQDSQANTNDQFPPERPPKPNVIPTGAPVYPPLSNTDHDYEILRPGAYPSVLPGGPGGPTRPAPKPPAPLQHQNSTNTMSGPSHFGLDGVPFIVNPKFLTTSNQKGGAVS

SEQ ID NO: 22362 - protein, 229 aa, Diabrotica virgifera
  misc_feature: Coding regions on vcDNA: vcDNA=SeqID_2059; Strand=+; Position=81-770
  misc_feature: Homolog annotation: Hit_ID=NP_572939.1; Match level="QueryCoverage =69%, HitCoverage=75%, E-value=8e-18, Identity=39%"; Hit description =CG1368-PA [Drosophila melanogaster] gb|AAF48343.1| CG1368-PA [Drosophila melanogaster]
MKFLVLVVAAFAVCAAVEDKKEKRGLLGLGDSLLDGHGGLELAPAPILAKAPIYSSYSAPIISKTIAEPIISAPLISKAVLPAPISYSAPLSYAAPVSYSSPLSYSAPLSYSAPLSYSAPVISKSYAAPILSAPILKSAPLLSAPLLTKSYSAPLLSAPIAHAAPIYSAPAPILSKSISYAAPAISYGAPLAHAPISYAAPIAHAAPISYAAPVSYGHGLDLGYGKLYH

SEQ ID NO: 22363 - protein, 262 aa, Diabrotica virgifera
  misc_feature: Coding regions on vcDNA: vcDNA=SeqID_2060; Strand=+; Position=83-869
  misc_feature: Homolog annotation: Hit_ID=NP_523568.2; Match level="QueryCoverage =62%, HitCoverage=37%, E-value=1e-33, Identity=49%"; Hit description =CG3688-PA [Drosophila melanogaster] gb|AAF53430.2| CG3688-PA [Drosophila melanogaster]
  misc_feature: Gene Ontology Annotation: Molecular function=RNA binding; Cellular component=nucleus; Biological process=mRNA capping
  misc_feature: Pfam annotation: Pfam_ID=Pox_MCEL; Match level="Score=-173.1, E-value= 0.0027, Copies=1"; Pfam description=mRNA capping enzyme
  misc_feature (244)..(244): Xaa can be any naturally occurring amino acid
MIEISFLFLIQELVVIFFYYRRKMSEINELEQALVMVAADADSRNYEDQKLYENEEEQEEEATSKDPYFYAKVSDDDSTNNYPSQVINNSNQSRKRQSEDLENVTRAERESKSVKRKHENSEDVTKSQRVYSNVANEDKPQKFKRDDPEDGITKSQRGYANVVATHYNQLEEKGLEERTKSRIVHLRNFHNWIKSMLINEYLTKIKDGKRHNAPVRVHDMCCGKGGDLLKWKKGGISHLICRDXIAEVSLDQCKARYTDMKK

SEQ ID NO: 22364 - protein, 294 aa, Diabrotica virgifera
  misc_feature: Coding regions on vcDNA: vcDNA=SeqID_2061; Strand=+; Position=187-1065
  misc_feature: Homolog annotation: Hit_ID=NP_648549.1; Match level="QueryCoverage =88%, HitCoverage=54%, E-value=4e-61, Identity=42%"; Hit description =CG11534-PA [Drosophila melanogaster] gb|AAF49957.1| CG11534-PA [Drosophila melanogaster]
  misc_feature: Pfam annotation: Pfam_ID=C1_1; Match level="Score=25.9, E-value=7.2e -05, Copies=1"; Pfam description=Phorbol esters/diacylglycerol binding
  misc_feature (245)..(245): Xaa can be any naturally occurring amino acid
  misc_feature (264)..(264): Xaa can be any naturally occurring amino acid
  misc_feature (271)..(271): Xaa can be any naturally occurring amino acid
  misc_feature (274)..(275): Xaa can be any naturally occurring amino acid
MSEPININNNSDNENISYSPSVSSTSGIECDLVPASLASEELKLALNKEATEEELLKAVTRCKSLILESDHCSEERKWLVRHLIELRLRLEECRDAMNDPLHPRNHSSGVSKRVIKGHHLHLQPLLRHASSKYCDHCTGTIWSVVQAWYECEDCEYACHHKCLASIVRECAHVIASEKGCFDYDICPELGLSAQRYLCAECKSLLPVNRDWSEARRCDYSGLYFCTACHWSSSAIIPARVVHNWXDFDPQPVSQAALQLLRITXRRPIIHXNNXXPKLFLLVHELDLVRRLRQL

SEQ ID NO: 22365 - protein, 69 aa, Diabrotica virgifera
  misc_feature: Coding regions on vcDNA: vcDNA=SeqID_2062; Strand=-; Position=550-759
RPPFFFFFFFFFFFFFFFFFLSIARDKEDLLPKNCIINLVAMLLFMSIFQCVTNDRKKGKSVIIYILVT

SEQ ID NO: 22366 - protein, 98 aa, Diabrotica virgifera
  misc_feature: Coding regions on vcDNA: vcDNA=SeqID_2063; Strand=+; Position=161-457
SLFLFRISGTCSKIKFDAKCKKSILKIFQLELSVFFFFFFYGTLVQIEPWPPLFFASTLACLWLLFSIHGLLKGLVRRCLLCLPSAFLAFQPVSFPAF

SEQ ID NO: 22367 - protein, 76 aa, Diabrotica virgifera
  misc_feature: Coding regions on vcDNA: vcDNA=SeqID_2064; Strand=+; Position=58-288
IDNRQVSTYQKLHKVIFLITILYILLFVNRLAFKQKTFQCVYCFTMLYLFPILLSFYENPSPSISYLLIFFSNTVL

SEQ ID NO: 22368 - protein, 78 aa, Diabrotica virgifera
  misc_feature: Coding regions on vcDNA: vcDNA=SeqID_2065; Strand=-; Position=335-571
HGSKVPFPPLNELLPSAILGRKSSTFVPCYTNSYYSVFCTKNLYLRLYFSTSNHFLISTYVAFLPSAKLNLSSDCTDT

SEQ ID NO: 22369 - protein, 69 aa, Diabrotica virgifera
  misc_feature: Coding regions on vcDNA: vcDNA=SeqID_2066; Strand=-; Position=704-913
NNELYQLYKKTPLSDFIKIQRLQWTGHVIRMGEDRIPKRALNARMQGKRPVGKQSKSWKDTVSSDAQAF

SEQ ID NO: 22370 - protein, 186 aa, Diabrotica virgifera
  misc_feature: Coding regions on vcDNA: vcDNA=SeqID_2067; Strand=-; Position=392-952
  misc_feature: Homolog annotation: Hit_ID=XP_312124.1; Match level="QueryCoverage =71%, HitCoverage=49%, E-value=2e-22, Identity=42%"; Hit description =ENSANGP00000023417 [Anopheles gambiae]
MKKFRQANQGIFFAPFANIFSGQKSLPRKYKDEESNKTYNLDPNNIFMAGEVGVQKETSKNKLYTFERKVLRRILGPVRENGIFRSRYNNELYQLYKETPLSDFIRLQRLQWAGHVIRMGEDRLPKRALHALMQGKRPVGKPRKRWEDTVNSDAQALLGVRVWRRAATDRQGWRQKIKEAKAQFGL

SEQ ID NO: 22371 - protein, 99 aa, Diabrotica virgifera
  misc_feature: Coding regions on vcDNA: vcDNA=SeqID_2068; Strand=+; Position=1197 -1496
CKFKISTEFLRCVSRHFHFKRELFLPNISVIFNLSTKSIRTKIVENVIFYNFFHYQFFCAVGIFRFMGENNNCHYFELEIKGTANGLLLRGLNETLLTN

SEQ ID NO: 22372 - protein, 99 aa, Diabrotica virgifera
  misc_feature: Coding regions on vcDNA: vcDNA=SeqID_2069; Strand=+; Position=524-823
  misc_feature (40)..(40): Xaa can be any naturally occurring amino acid
FLLYYNIIYYIQYYIIAKIYMFLDFLKSRLFIKNSYLYNXGRKVLFFLPRMKFTGRRVAEGSNHSREEKALYSHVISYGFSTCLPQITSNFSFLLNLFM

SEQ ID NO: 22373 - protein, 76 aa, Diabrotica virgifera
  misc_feature: Coding regions on vcDNA: vcDNA=SeqID_2070; Strand=+; Position=1139 -1366
IKKKLFKKNTLKLFDISVSYLAESVGAVDADPTKLCQTTVLGYYHTRTTGESEWWTPPKFHATDGTATLAQLLLYS

SEQ ID NO: 22374 - protein, 65 aa, Diabrotica virgifera
  misc_feature: Coding regions on vcDNA: vcDNA=SeqID_2071; Strand=+; Position=3-200
PPRVPTPFASRNFISLKNILTLFLFLFLHIRINLLMVSRLKPIVNLLIVCGHIIKGTTLGYTILE

SEQ ID NO: 22375 - protein, 54 aa, Diabrotica virgifera
  misc_feature: Coding regions on vcDNA: vcDNA=SeqID_2072; Strand=+; Position=137-301
THILTQAEQSVELSDYTTFFRCSFCFTLTNSKATTVSFKGWGLLCEINISNTFL

SEQ ID NO: 22376 - protein, 120 aa, Diabrotica virgifera
  misc_feature: Coding regions on vcDNA: vcDNA=SeqID_2073; Strand=+; Position=1269 -1631
  misc_feature (72)..(72): Xaa can be any naturally occurring amino acid
SRRVNSVFTNIMVAAQIYLKSLNSFISKLLISSYQVIVLRRRFDLTCLKTILKNRGCSGKHFIYSNIFHLYXPFFFQIVIPRKKWELVIADVRGIVCLQRSLVIFYPCIGILHILVILSI

SEQ ID NO: 22377 - protein, 121 aa, Diabrotica virgifera
  misc_feature: Coding regions on vcDNA: vcDNA=SeqID_2074; Strand=-; Position=547-912
  misc_feature (35)..(35): Xaa can be any naturally occurring amino acid
IYHNLSEFDTTTSVINFMRKHPCQTFINIQRLQWXGHVIRMGEDMIPKRALNARMQGKRQLYQPLSDFIRIQRLQWVGHVIRMGEDMIPKRALNARMQGKRPVGKQSKRWEDTVSSDAQAF

SEQ ID NO: 22378 - protein, 103 aa, Diabrotica virgifera
  misc_feature: Coding regions on vcDNA: vcDNA=SeqID_2075; Strand=+; Position=134-445
SIKYEVITTNVEVLNRMGKQKEISFTIKKRKLEYLVHIMKHDKYHILQLIIQGKIENKRGPGRRRHSWLQNLRQWFGLTSIELFRNAANKIKIAMMIANVRNG

SEQ ID NO: 22379 - protein, 120 aa, Diabrotica virgifera
  misc_feature: Coding regions on vcDNA: vcDNA=SeqID_2076; Strand=-; Position=1152 -1514
TRPSSVIQRSESGMATARSTSLPKHFTFIYPQTVSKEALHFPHSPLFWSQDWAFFIIRASFPVCLIQYISYIRLPSKLIPSAFYSQYISLSPLSLVQLFFLLFFLLDHYTDIVVYAPCSN

SEQ ID NO: 22380 - protein, 182 aa, Diabrotica virgifera
  misc_feature: Coding regions on vcDNA: vcDNA=SeqID_2077; Strand=-; Position=910-1458
  misc_feature: Pfam annotation: Pfam_ID=Pacifastin_I; Match level="Score=27.6, E -value=3.7e-05, Copies=1"; Pfam description=Pacifastin inhibitor (LCMII)
STRPGKMDWRVIALCCIVCVNFSGATMCSPNSKFKMDCNFCICSSNGKEYTCTNDRCPQGNNNDQFYRTQTKDGHVLLVPKDKDQFKADDDAFVLTRNSRKPRVSEGYPYINDMMNKPMNDEDTSEDVEMIKPKRNSENLETSEFEPEVPVDVPVDDNADSNEIDNARWAPSQPRKVPDFPE

SEQ ID NO: 22381 - protein, 104 aa, Diabrotica virgifera
  misc_feature: Coding regions on vcDNA: vcDNA=SeqID_2078; Strand=+; Position=754-1068
LSIDGAIIEKKNIYELYNISTNIICTIYKAIQIKEIAICITREESATFPPEETIQGGPHVLYYSHVICVVCIFDGRAKQKAIGCGGLGKFWKRDLNSYHVLADK

SEQ ID NO: 22382 - protein, 99 aa, Diabrotica virgifera
  misc_feature: Coding regions on vcDNA: vcDNA=SeqID_2079; Strand=-; Position=878-1177
KTQRNCTKYKQLIFSIELFSTIFSVSKARPADGKTQTSYSSSLELIALLEYLELISIILPTPLTPKTHSISPFFYPTPGFTNQKNSPIFTLISKRKEKV

SEQ ID NO: 22383 - protein, 149 aa, Diabrotica virgifera
  misc_feature: Coding regions on vcDNA: vcDNA=SeqID_2080; Strand=+; Position=1543 -1992
MKYLVLIFINIPWVFSISQKSLCASMFDYCATDEHCKFFPCDEPKFCEKGLVLKKLPCKCCRECVPEDCEVDCSERLCLKPKCPRGQVPTKVDCKCCPRCARAEYLPDCNVEDCPELTCKHNEMKIDAPCRCCQICKDRNLFSFLALLK

SEQ ID NO: 22384 - protein, 223 aa, Diabrotica virgifera
  misc_feature: Coding regions on vcDNA: vcDNA=SeqID_2081; Strand=+; Position=3-674
  misc_feature: Homolog annotation: Hit_ID=XP_311750.1; Match level="QueryCoverage =100%, HitCoverage=58%, E-value=1e-107, Identity=81%"; Hit description=ENSANGP00000014289 [Anopheles gambiae]
  misc_feature: Gene Ontology Annotation: Molecular function=protein methyltransferase activity; Cellular component=nucleus; Biological process=organogenesis
LPDGIEKVDIIISEWMGYCLFYESMLDTVLFARDKWLQPDGLLFPDRCSLFVTAIEDRQYKDEKINWWDDVYGFDMSSIRKVAISEPLVDVVDPKQVVTGPALIKEVDLYTVKKEDLDFTSPFMLTVRRNDYVQALVTYFTVEFSKCHKRIGFTTAPDAPYTHWKQTVFYFENYMTVKKNEEIHGMFTMKPNPRNNRDLDFVIELHFKGELGEVHEVNRYRMR

SEQ ID NO: 22385 - protein, 309 aa, Diabrotica virgifera
  misc_feature: Coding regions on vcDNA: vcDNA=SeqID_2082; Strand=+; Position=2-928
  misc_feature: Homolog annotation: Hit_ID=XP_311936.1; Match level="QueryCoverage =99%, HitCoverage=24%, E-value=4e-56, Identity=40%"; Hit description =ENSANGP00000010910 [Anopheles gambiae]
  misc_feature: Gene Ontology Annotation: Molecular function=molecular_function unknown; Cellular component=ribosome; Biological process=rRNA processing
TEDCKRHFRLKIRDILDRLVRKYGCESLTPFVPNTDTVMYKRLRNLRKLNARKKRRKDEDREDESDDEEFTVKAKPKSVEEILADSDSEFEDMETDEPKVKNKKQAKTWIEEDPDNIVDFIDPSVISKITATKPGLVQPTLEKKKPEKDRGFKTAPDGRLIIKDDSSSDSDDDKKLKFSDDSDDDDDTQSKVETVLLTDRKRKRSNASVKSGFSSVSSQPPMKYKTGGVGIHRSLGASTSSVKSGFSSAGSEYKSRKASGDVKKKGKLDPYAYLPLKRTTLNKRKKNKAAGQFKHIVKAAKAGALKGAK

SEQ ID NO: 22386 - protein, 143 aa, Diabrotica virgifera
  misc_feature: Coding regions on vcDNA: vcDNA=SeqID_2083; Strand=+; Position=229-657
  misc_feature: Homolog annotation: Hit_ID=XP_318532.1; Match level="QueryCoverage =66%, HitCoverage=41%, E-value=2e-23, Identity=50%"; Hit description =ENSANGP00000019684 [Anopheles gambiae]
  misc_feature: Gene Ontology Annotation: Molecular function=receptor binding; Cellular component=microfibril; Biological process=signal transduction
  misc_feature: Pfam annotation: Pfam_ID=Fibrinogen_C; Match level="Score=-41.4, E -value=6.1e-08, Copies=1"; Pfam description=Fibrinogen beta and gamma chains, C-te
MKFSFAVDEQRNHNILEGCRNLVGVSQPSLCFLKSSSAAAEKYIAYPRSCREIQEIGNNKSGIYEIKPRTSSKPFAVLCDMEIQGGGWTHIQKRFDGSQDFYREWRDYKFGFGNLDGEFWIGLENIHHMTCFEASELLIELID

SEQ ID NO: 22387 - protein, 482 aa, Diabrotica virgifera
  misc_feature: Coding regions on vcDNA: vcDNA=SeqID_2084; Strand=+; Position=39-1487
  misc_feature: Homolog annotation: Hit_ID=AAF20998.1; Match level="QueryCoverage =100%, HitCoverage=100%, E-value=0.0, Identity=99%"; Hit description =alpha-amylase [Diabrotica virgifera virgifera]
  misc_feature: Gene Ontology Annotation: Cellular component=extracellular space
  misc_feature: Pfam annotation: Pfam_ID=Alpha-amylase; Match level="Score=297.2, E -value=2.6e-86, Copies=1"; Pfam description=Alpha amylase, catalytic domain
MKTYVIVFCVLSFTVSNVIGQKKNHFAGGRNTIVQLFEWHWDAIANECENFLGPKGFAGVQVSPPNENCVVNGRPWWERYQPVSYQLITRSGDETAFANMVRRCNNAGVRIYVDVVINHMSGITGNGTGGKSSDAGSLSYPGVPFGPNHFHSRCDINNYQESHNIRNCALTGLPDLDQSHEHVRKKIVEYLNHLVDLGVAGFRVDAAKHMWPADLKAIYDSVKDLTGNGLSGRPFVYQEVIDLGGEAVKKTEYTSFGAVLEFKYGSELGNAFQGRNDLHWLKSWGPQWGLLDGLDAVVFIDNHDNQRDGSSAILSYKNPKPYKMATAFMLAHPYGTTRIMSSYAFDHRDQGPPAKQAGFNTDNTCTNGWICEHRWRQIYNMVSFRNAVDGTGINNWWSNGHQQIAFGRGNKGFIAFTLYGDIKQSLQTSLPAGTYCDVISGSLEKGSCTGKTVNVDSSGKAAISLSTNEEDGVVAIHVNAKL

SEQ ID NO: 22388 - protein, 313 aa, Diabrotica virgifera
  misc_feature: Coding regions on vcDNA: vcDNA=SeqID_2085; Strand=+; Position=147-1083
  misc_feature: Homolog annotation: Hit_ID=XP_320595.1; Match level="QueryCoverage =90%, HitCoverage=56%, E-value=1e-148, Identity=84%"; Hit description= ENSANGP00000024392 [Anopheles gambiae]
  misc_feature: Gene Ontology Annotation: Biological process=regulation of protein activity, epigenetic
  misc_feature: Pfam annotation: Pfam_ID=CBM_14; Match level="Score=54.0, E-value =4.4e-13, Copies=1"; Pfam description=Chitin binding Peritrophin-A domain
  misc_feature (292)..(292): Xaa can be any naturally occurring amino acid
MADKRLWLCCFLLLTIAYAQDEDDDDSGEPQIDQLCENRPADEYFRLSTDGDCREVVRCTKSGLKQITCPSGLAFDIDKQTCDWKGKVTNCDKLEKPRKVLPILKTDEPRCPEGKLMCGNEECIDKDLFCNGKPDCKDESDENACDVDSDPNRAPDCDPTQCVIPDCFCSADGTRIPGALEPANVPQMITISFNGAVNVDNIDLYEEIFSGTRLNPNGCQIKGNFFVSHKYTNYSAVQDLHRRGHEIAVFSLTHKEDPNYWSQGSYDDWLAEMAGARLIIERFANITDGSIXIGVRAPYLKVGGNRQFEMMTD

SEQ ID NO: 22389 - protein, 535 aa, Diabrotica virgifera
  misc_feature: Coding regions on vcDNA: vcDNA=SeqID_2086; Strand=+; Position=123-1730
  misc_feature: Homolog annotation: Hit_ID=XP_320594.1; Match level="QueryCoverage =99%, HitCoverage=85%, E-value=0.0, Identity=81%"; Hit description =ENSANGP00000015352 [Anopheles gambiae]
  misc_feature: Gene Ontology Annotation: Biological process=regulation of protein activity, epigenetic
  misc_feature: Pfam annotation: Pfam_ID=CBM_14; Match level="Score=44.5, E-value =3.1e-10, Copies=1"; Pfam description=Chitin binding Peritrophin-A domain
  misc_feature (507)..(508): Xaa can be any naturally occurring amino acid
MADKRLWLCCFLLLTIAYAQDEDDDDSGEPQIDQLCENRPADEYFRLSTDGDCREVVRCDLNSDLKGGTRLAAVKCPTGLAFDLFRQTCDWKVNVKNCDIVEKPRKVLPILKTDEPRCPEGKLMCGNEECIDKDLFCNGKPDCKDESDENACDVDSDPNRAPDCDPTQCVIPDCFCSADGTRIPGALEPANVPQMITISFNGAVNVDNIDLYEEIFSGTRLNPNGCQIKGNFFVSHKYTNYSAVQDLHRRGHEIAVFSLTHKEDPNYWSQGSYDDWLAEMAGARLIIERFANITDGSIIGVRAPYLRVGGNRQFEMMTDQFFIYDSSITASLGRVPIWPYTLYFRMPHKCNGNAHNCPSRSHPVWEIVMNELDRRDDPTFDESLPGCHMVDSCSNVQTGDQFARLLRHNFNRHLNSNRAPLGLNFHASWLKSKKEFKEELIKFIEDMLARNDVYFVTNSQVIQWVQNPTELSGLRDFQEWKEKCDIKGQPYCSLPNSCPLHTRELPXXTLRLFTCMECPNNYPWILDPTGDGFST

SEQ ID NO: 22390 - protein, 92 aa, Diabrotica virgifera
  misc_feature: Coding regions on vcDNA: vcDNA=SeqID_2087; Strand=+; Position=637-915
RFVSLKTVFDETSMILKHQCSFSKMLLSFASCCIIALASADRNFKTNTLLLINLVIYLSIPKARQLPIVSFIHSFFLKKISLYFLYILCVFC

SEQ ID NO: 22391 - protein, 89 aa, Diabrotica virgifera
  misc_feature: Coding regions on vcDNA: vcDNA=SeqID_2088; Strand=+; Position=491-760
QSKSTIIMKPYFSQSIFQPHTHYICGVRRLCTNTKLYSNIVFKGIIRRHFTSATPSFLSLLTVKVVYSFSLSYFQFYSSLLCWFFVRYI

SEQ ID NO: 22392 - protein, 309 aa, Diabrotica virgifera
  misc_feature: Coding regions on vcDNA: vcDNA=SeqID_2089; Strand=+; Position=22-947
  misc_feature: Homolog annotation: Hit_ID=XP_393083.1; Match level="QueryCoverage =73%, HitCoverage=48%, E-value=3e-13, Identity=27%"; Hit description =similar to DKFZP572C163 protein [Apis mellifera]
  misc_feature: Gene Ontology Annotation: Molecular function=ATP binding
  misc_feature: Pfam annotation: Pfam_ID=zf-C2H2; Match level="Score=39.0, E-value =1.4e-08, Copies=4"; Pfam description=Zinc finger, C2H2 type
  misc_feature (269)..(269): Xaa can be any naturally occurring amino acid
MKHKQCNGDIVIKSEPNLFCDNQSVDEGKLELQKVKEELPSEEYDKLTNFEEVMLTEECNLPIKSEADLEEKTSSNYHPRAVSNQKQEKFFYASIKEYITKTKNDRRKKLKNAKSIITCPYCGKWYYRKNELLKHFLSYRVKKSVFVKRFMHKNDNILTNMKDGNSNNKPATEKKVSSKVACKLCSKLVDKYYMNAHILVHNNKPATEKKVSSKVACKLCAKLVDKYYMKAHILVHTGEKRFQYQCEICFKTFQSNSIKNHMYTHLEEXPMKCTFCFKPLGEPDTLRPTVLILRKKYLNVIYVQNLLNE

SEQ ID NO: 22393 - protein, 421 aa, Diabrotica virgifera
  misc_feature: Coding regions on vcDNA: vcDNA=SeqID_2090; Strand=+; Position=176-1441
  misc_feature: Homolog annotation: Hit_ID=XP_315893.1; Match level="QueryCoverage =98%, HitCoverage=86%, E-value=1e-155, Identity=65%"; Hit description= ENSANGP00000017396 [Anopheles gambiae]
  misc_feature: Pfam annotation: Pfam_ID=FAA_hydrolase; Match level="Score=327.1, E -value=2.6e-95, Copies=1"; Pfam description=Fumarylacetoacetate (FAA) hydrolase fa
MKCFLKYPKYCDFPIENLPYGVFTTPQEPSPRIGVAIADLILDLNEVAHLFIGPELRNHQNVFKEATLNSLMALSPQAWKEARETIQSLLSEDNTILQNDVDLRKRAFVSQSEATMHLPARIGDYTDFYSSIHHATNVGIMFRSRENALMPNWKHLPVGYHGRASSVVVSGTSIHRPYGQTLVMDGTDPVFGPCKLMDFELEMAFFVGGSNKLGEPIKMENAEDHIFGFVIMNDWSARDIQKWEYVPLGPFLAKNLGTTISPWVVTTLALEPFKTDNFPQDPKPLPYLRHTDKFNFDINLQVDLTPKGGNVSTTVSRSNYKYLYWTPKQQLVHHTITGCNVNPGDLMGSGTISGETSDSFGSMLEISWKGTKPVSLLDGSQRKFLQDGDTVTMKAVCEGHNFNIGFGTCVGTLLPAKNLTW

SEQ ID NO: 22394 - protein, 137 aa, Diabrotica virgifera
  misc_feature: Coding regions on vcDNA: vcDNA=SeqID_2091; Strand=+; Position=36-449
  misc_feature: Pfam annotation: Pfam_ID=PBP_GOBP; Match level="Score=27.7, E-value =3.6e-05, Copies=1"; Pfam description=PBP/GOBP family
MKYLVVLACVVVAAVASNLPNLPEGERLKLAQVHRDCQADPKTHVDEDKLRKLPNFVEDKQVGVHMRCMVVKAGLMKQNGKLDVPSITEKFRLVIKDASKVNALVQQCAVDSETPEKTSILFTLCCVKNDIQYYHKL

SEQ ID NO: 22395 - protein, 60 aa, Diabrotica virgifera
  misc_feature: Coding regions on vcDNA: vcDNA=SeqID_2092; Strand=+; Position=1231 -1410
NLIGSKFKKDFYGSFGPPAKKWKFLFLPSANFRKNFISFFSRARKSELNSPTSFESKNFF

SEQ ID NO: 22396 - protein, 86 aa, Diabrotica virgifera
  misc_feature: Coding regions on vcDNA: vcDNA=SeqID_2093; Strand=+; Position=846-1106
TDYVSHFNYYFFGTFCHICNILLTSTDLPFFYTIFVFHLHNICNLFLFFSWSGLRWYHTLCYLHLAFKSLYKCFPFRKFVLPVHPF

SEQ ID NO: 22397 - protein, 296 aa, Diabrotica virgifera
  misc_feature: Coding regions on vcDNA: vcDNA=SeqID_2094; Strand=+; Position=111-1001
  misc_feature: Homolog annotation: Hit_ID=EAL41877.1; Match level="QueryCoverage =97%, HitCoverage=53%, E-value=1e-103, Identity=56%"; Hit description= ENSANGP00000026372 [Anopheles gambiae str. PEST] ref|XP_565108.1| ENSANGP00000026372 [Anopheles gambiae s
  misc_feature: Gene Ontology Annotation: Molecular function=kinase activity; Cellular component=cellular_component unknown; Biological process =protein amino acid phosphorylation
  misc_feature: Pfam annotation: Pfam_ID=START; Match level="Score=64.2, E-value=3.7e- 16, Copies=1"; Pfam description=START domain
MKFRRYKIEGPHSVLADDEFYDALESGLDKMEEEQELRDRLKTGPVVPVTPPPTSPACQHRLWPQIENVVKSQVNMAKMGIGESGAGWQLFAEDGEMKMYRREEEVDGMVCDPLKAVHVVKGISGHEVCHYFFNPQYRYDWESTLEHMTVLETISEDTLVFLQTHKRIWPASQREGLFWSHIRKLPNEKDRDGPDIWTVVNNSTEYSEHPANNGKCVRIFLTVCLLCQTTVDPPKDGTTLTRDNLSCKITYCSVVNPGGWAPASVLRAVYKREYPKFLKRFTAYVKNQTKNKPIMF

SEQ ID NO: 22398 - protein, 245 aa, Diabrotica virgifera
  misc_feature: Coding regions on vcDNA: vcDNA=SeqID_2095; Strand=+; Position=135-872
  misc_feature: Homolog annotation: Hit_ID=EAL41212.1; Match level="QueryCoverage =96%, HitCoverage=90%, E-value=7e-24, Identity=29%"; Hit description =ENSANGP00000028832 [Anopheles gambiae str. PEST] ref|XP_565967.1| ENSANGP00000028832 [Anopheles gambiae st
  misc_feature: Gene Ontology Annotation: Molecular function=molecular_function unknown; Cellular component=endoplasmic reticulum; Biological process=lipid metabolism
MPVIDGYKVLYILLHSLYTIFENIWRTLLFIYQNCIRVINPESTFDDADQLKKRLSRLTKKPQHLTIIIGVEEYSLVDLANLVYWCLGLNIPYVSFYDYKGNLKKHEEKLQQIVESRKSENINIIWHTHAEQRHKNGFLGPKIHVKVLTHADGKQSIVNVTKKLALNKEKDISKEKISELLLRQYEFPDPEMAIICGKKLNIYNYPPWQLRLTEFFKVNKVNNITFPVFCGKLEKYSKCEQRVGK

SEQ ID NO: 22399 - protein, 122 aa, Diabrotica virgifera
  misc_feature: Coding regions on vcDNA: vcDNA=SeqID_2096; Strand=-; Position=930-1298
  misc_feature: Homolog annotation: Hit_ID=AAS77441.1; Match level="QueryCoverage =34%, HitCoverage=24%, E-value=4e-09, Identity=71%"; Hit description =LP04080p [Drosophila melanogaster]
LDREERGGGGGGWPPPPPPPPPRACKKKKKKKKKKKKKKKKKKKKKKKKKKKLSFFFFSFFLWENPPPGGGGGGGNIFFSLFFFFKSGGREELEKKEKKIFLFKKKKRTPPSLPPKKNSPFL

SEQ ID NO: 22400 - protein, 343 aa, Diabrotica virgifera
  misc_feature: Coding regions on vcDNA: vcDNA=SeqID_2097; Strand=+; Position=275-1306
  misc_feature: Homolog annotation: Hit_ID=NP_524984.1; Match level="QueryCoverage =99%, HitCoverage=94%, E-value=1e-178, Identity=87%"; Hit description= CG17437-PA [Drosophila melanogaster] gb|AAF45791.1| CG17437-PA [Drosophila melanogaster]
  misc_feature: Gene Ontology Annotation: Molecular function=transcription factor activity; Cellular component=nucleoplasm; Biological process =establishment and/or maintenance of chromatin architecture
  misc_feature: Pfam annotation: Pfam_ID=WD40; Match level="Score=280.4, E-value=3.1e- 81, Copies=7"; Pfam description=WD domain, G-beta repeat
MMPIGGAPPVHGSSSLSQSNTSQNASLTPTGGSSKSSSSLKPNYALKFTLAGHTKAVSSVKFSPNGEWLASSSADKLVKIWGAYDGKFEKTISGHKLGISDVAWSSDSRLLVSGSDDKTLKIWELSSGKCLKTLKGHSNYVFCCNFNPQSNLIVSGSFDESVRIWDVRTGKCLKTLPAHSDPVSAVHFNRDGSLIVSSSYDGLCRIWDTASGQCLKTLIDDDNPPVSFVKFSPNGKYILAATLDNTLKLWDYAKGKCLKTYSGHKNEKFCIFANFSVTGGKWIVSGSEDNLVYVWNLQTKEIVQKLQGHTDVVLCTTCHPTENIIASAALENDKTIKLWKSDT

SEQ ID NO: 22401 - protein, 278 aa, Diabrotica virgifera
  misc_feature: Coding regions on vcDNA: vcDNA=SeqID_2098; Strand=+; Position=53-889
  misc_feature: Homolog annotation: Hit_ID=EAL26988.1; Match level="QueryCoverage =93%, HitCoverage=66%, E-value=2e-30, Identity=35%"; Hit description =GA19968-PA [Drosophila pseudoobscura]
  misc_feature: Gene Ontology Annotation: Molecular function=molecular_function unknown; Cellular component=nucleolus; Biological process=growth
  misc_feature: Pfam annotation: Pfam_ID=RRM_1; Match level="Score=68.0, E-value=2.6e- 17, Copies=1"; Pfam description=RNA recognition motif. (a.k.a. RRM, R
MTKTRAAEVLSLEKSKQKEVVKETKQLKKKIKDGTVTVKGTKKALIAAQEQKRGLIFISHLPHGFYEDELKKYFTQFGKVTNVIVCRSGKTGNSKGYGYVEFVNPEVAKIAAETMNNYLMFKKRITANFVAPEKRPKGLFMGKPNTITRYSSKVRRQKQYLVNIKLDPKTQAKRTANRLTKINKKLEWLKNAGVETSFTPSNLEVKQKKSVPRVSNTHKELDFDSDIELKIPVKKAKSAVTSSKNSPKVLSTKASKSNKKLNKSVSSESEKTPIIKKK

SEQ ID NO: 22402 - protein, 198 aa, Diabrotica virgifera
  misc_feature: Coding regions on vcDNA: vcDNA=SeqID_2099; Strand=+; Position=211-803
  misc_feature: Homolog annotation: Hit_ID=XP_311575.1; Match level="QueryCoverage =95%, HitCoverage=39%, E-value=1e-39, Identity=43%"; Hit description =ENSANGP00000016038 [Anopheles gambiae]
  misc_feature: Gene Ontology Annotation: Molecular function=inorganic phosphate transporter activity; Cellular component=integral to membrane; Biological process=phosphate transport
  misc_feature (172)..(172): Xaa can be any naturally occurring amino acid
  misc_feature (189)..(189): Xaa can be any naturally occurring amino acid
MAQLIIKKCIPVRAIIWILCFTCTLFLYMLRINLSIIILAMVQPMTKGNTTFVPECKLLRQSTHNESIVAEALHSDPPDYGTKFEWSTELQGLILGSYFWGFTISAIPGGVLAERFGPSKCITISFLVCGFLTLLGPWAAGWDAWVLIASRFLIGLFGGVVFPSLHCLIARXAPPDEKGKFIGSLLGGXLGTVITWPL

SEQ ID NO: 22403 - protein, 70 aa, Diabrotica virgifera
  misc_feature: Coding regions on vcDNA: vcDNA=SeqID_2100; Strand=-; Position=715-927
  misc_feature (5)..(5): Xaa can be any naturally occurring amino acid
  misc_feature (7)..(7): Xaa can be any naturally occurring amino acid
NKFVXNXVEILPSLELLGANKSYQNKKKINKRVGIGLLHLYKGANLNYCKSITDIEAGKCVWKQCCKLNA

SEQ ID NO: 22404 - protein, 77 aa, Diabrotica virgifera
  misc_feature: Coding regions on vcDNA: vcDNA=SeqID_2101; Strand=+; Position=967-1197
GTADFGFNYHVFVKTIKSTLLSNKTLTQHKHYTLHYWDRASSAKRPLFLRSVLLFALLIILANYISPGCWIIVKTIV

SEQ ID NO: 22405 - protein, 81 aa, Diabrotica virgifera
  misc_feature: Coding regions on vcDNA: vcDNA=SeqID_2102; Strand=-; Position=548-793
RISVMWGAMFSFIIELILIFHRFFRFHFTFWFVFIILFLSLFVILLLIFCVIDFFSYLEIYAQIFLYHSIAMLIYFSLVIF

SEQ ID NO: 22406 - protein, 83 aa, Diabrotica virgifera
  misc_feature: Coding regions on vcDNA: vcDNA=SeqID_2103; Strand=-; Position=694-945
QINVGISYHSPFFTTQLFWIKIRYCKIHISSYRLIMSVIDFMTFFSLDLRLFLYMSEVIYYVGLYYYIKVLDYVFSFGYCMWF

SEQ ID NO: 22407 - protein, 97 aa, Diabrotica virgifera
  misc_feature: Coding regions on vcDNA: vcDNA=SeqID_2104; Strand=+; Position=1155 -1445
FSLIFLCSITRAFRLRKTGGAIPDRTRSRIRDKILRSPGLEWEASQRFNYNWDRASSAKRPLFLRSVLLFALLIILANYISPGCWIIADAWADAWSV

SEQ ID NO: 22408 - protein, 92 aa, Diabrotica virgifera
  misc_feature: Coding regions on vcDNA: vcDNA=SeqID_2105; Strand=-; Position=316-594
IVAYFPIKIVNFIFCSPIRPLFIHYRIVSDAYATGLTANFQHKRNSSYFIFTNTSLFFIHHRYDHFTLNLKILDKFKTKIHFLAIAKSKQIE

SEQ ID NO: 22409 - protein, 92 aa, Diabrotica virgifera
  misc_feature: Coding regions on vcDNA: vcDNA=SeqID_2106; Strand=+; Position=739-1017
NIQGVPINGGVLKLYFFLRNTLFFIAFFNCPQKTRYSFISLPYWDRASSAKRPLFLRSVLLFALLIILANYISPGCWIIVKTIVQKNNKKKK

SEQ ID NO: 22410 - protein, 79 aa, Diabrotica virgifera
  misc_feature: Coding regions on vcDNA: vcDNA=SeqID_2107; Strand=+; Position=760-999
KEMKLVESGNLATKTNKSTLYPLFFTSRSIRGVCQLKLSLSQWHLPNSSDWDRASSAKQHLVSTLSNIIRTFDYIGQLY

SEQ ID NO: 22411 - protein, 217 aa, Diabrotica virgifera
  misc_feature: Coding regions on vcDNA: vcDNA=SeqID_2108; Strand=+; Position=367-1020
  misc_feature: Homolog annotation: Hit_ID=NP_775392.1; Match level="QueryCoverage =76%, HitCoverage=49%, E-value=4e-09, Identity=25%"; Hit description =hypothetical protein FLJ20272 (human) - like [Danio rerio] gb|AAM28212.1| AK027570-like protein
MKKNYKMELDLEDLNIYLVSDDNWKIFFDRSFDVEQLKTHFSTLQENDRIDCLKFGISCILNFVQCNFTGPDLSKEIKDYLSKDTYDTLNFAKLLSVNNEDININTRYPALLVTSKIIFEHCAVDNMINNWWYWRSILVHQEILEELSPSLLSDADRLYKHFQINPDLSINIKSSLDIEVAQLYLLFRHISKAKEHILSAIEKIRCRLCLANVNNCM

SEQ ID NO: 22412 - protein, 581 aa, Diabrotica virgifera
  misc_feature: Coding regions on vcDNA: vcDNA=SeqID_2109; Strand=+; Position=191-1933
  misc_feature: Homolog annotation: Hit_ID=NP_649026.1; Match level="QueryCoverage =80%, HitCoverage=59%, E-value=3e-69, Identity=36%"; Hit description =CG5290-PA [Drosophila melanogaster] gb|AAF49283.1| CG5290-PA [Drosophila melanogaster]
  misc_feature: Gene Ontology Annotation: Molecular function=molecular_function unknown; Cellular component=cellular_component unknown; Biological process=biological_process unknown
  misc_feature (322)..(322): Xaa can be any naturally occurring amino acid
  misc_feature (572)..(572): Xaa can be any naturally occurring amino acid
HLRNPIFFNDSRYGICQFQLTIRKVARFLRYSCTIVSRIPSKYLHTANSALSNYFKVRRLCGAPCKSSFSHLEDLNIYLVSDDNWKIFFDRSFDVEQLKTHFSTLQENDRIDCLKFGISCILNFVQCNFTGPDLSKEIKDYLSKDTYDTLNFAKLLSVNNEDININTRYPALLVTSKIIFEHCAVDNMINNWWYWRSILVHQEILEELSPSLLSDADRLYKHFQINPDLSINIKSSLDIEVAQLYLLFRHISKAKEHILSAIELLGIHYDLMGALGKRTKFQEREIAQLSLKVTVTEKDIITRDRGIDDMTTVMYPWMFQLXDDVRLNTIEFTEDLGNLAKLGSLEQKLFVTIIKDMLISKPPDELQVEEIMPFIDAILKQKNTFAVRVVTLLLRCKLESKTRRTIERALSQSEEIIKSLLREKPVALKRITDVFGTGMPPVWKIETQYADLLLNIGLVKNALDIYLKIKLWEEVIVCYTILKLRHKAAEVILDQLKEKPTVKLWCLLGDATDDITCYVKAWELSKRRSHRAQRHWGQFLFARKQNEECIPHFEKSVNINPLQSNVLVPTGXAALQTENWA

SEQ ID NO: 22413 - protein, 73 aa, Diabrotica virgifera
  misc_feature: Coding regions on vcDNA: vcDNA=SeqID_2110; Strand=-; Position=388-609
PNIILIFFLILIFAKHSHKLIRECEYAKICEYSRMRIRISVASLIHSNSQWTLVGHEIALATGGRQIVFLVLD

SEQ ID NO: 22414 - protein, 104 aa, Diabrotica virgifera
  misc_feature: Coding regions on vcDNA: vcDNA=SeqID_2111; Strand=+; Position=165-479
TSCDNRFINPEKLSTLFYTIIYAFLFSLNIKILQMKNQLEFERLLLCCVGTTANAWIQVWLDSTDNLVILYNSSSVSNFFNHFIGVFMLIFPIYLLVTLANTTI

SEQ ID NO: 22415 - protein, 125 aa, Diabrotica virgifera
  misc_feature: Coding regions on vcDNA: vcDNA=SeqID_2112; Strand=-; Position=1395 -1772
ELFILVDSVYIFLQFISFLPSLVECSKLVCTSDTSNFLLIRELRLRRRTKILMDNDATEFDQKVHTKKIVTRRVINNCFTGVNLMNSYSRCASTWKGKRETTVRESRRNIATILNNSYCQLKLSN

SEQ ID NO: 22416 - protein, 293 aa, Diabrotica virgifera
  misc_feature: Coding regions on vcDNA: vcDNA=SeqID_2113; Strand=+; Position=53-931
  misc_feature: Homolog annotation: Hit_ID=BAD38675.1; Match level="QueryCoverage =97%, HitCoverage=81%, E-value=1e-138, Identity=85%"; Hit description= glycerol-3-phosphate dehydrogenase-2 [Bombyx mori]
  misc_feature: Gene Ontology Annotation: Molecular function=ATP binding; Cellular component=cytoplasm; Biological process=nucleotide-sugar metabolism
  misc_feature: Pfam annotation: Pfam_ID=NAD_Gly3P_dh_N; Match level="Score=355.2, E -value=9.4e-104, Copies=1"; Pfam description=NAD-dependent glycerol-3- phosphate de
  misc_feature (271)..(271): Xaa can be any naturally occurring amino acid
MAHSDCTQPKKICIVGSGNWGSAIAKIVGNNAERLDNLDPRVTMYVYEEMINGKKLTEIINETHENVKYLPGHKLPPNVVAVPDVVDAAKDADVLIFVVPHQFIRTLCATLLGKIKPTAVALSLIKGFDRAKGGGIDLISHIITRHLKIPCSVLMGANLAGEVADEKFCETTIGCKDVSLGPLLRDIIQTDYFRVVVVDDEDTVEVCGALKNIVACGAGFVDGLGLGDNTKAAVIRLGLMEMVKFVDVFYPGGKLATFFESCGVADLITTXYGGRNRKVSEAFGKTGKTIKEL

SEQ ID NO: 22417 - protein, 405 aa, Diabrotica virgifera
  misc_feature: Coding regions on vcDNA: vcDNA=SeqID_2114; Strand=+; Position=1-1215
  misc_feature: Homolog annotation: Hit_ID=NP_649154.2; Match level="QueryCoverage =95%, HitCoverage=18%, E-value=1e-112, Identity=58%"; Hit description= CG8103-PA [Drosophila melanogaster] gb|AAF49099.2| CG8103-PA [Drosophila melanogaster]
  misc_feature: Gene Ontology Annotation: Molecular function=transcriptional repressor activity; Cellular component=nucleus; Biological process =chromatin assembly/disassembly
  misc_feature: Pfam annotation: Pfam_ID=DUF1086; Match level="Score=305.6, E-value =7.9e-89, Copies=1"; Pfam description=Domain of Unknown Function (DUF1086)
KRVRKQVNYNDGGMTTDTREDTTWQENLSDYHSDFSAGSDEDKEDDDFDEKNDADLSRRSRRKMERKDEKDRPLPPLLARVGGNIEVLGFNARQRKAFLNAIMRYGMPPQDAFNSQWLVRDLRGKSEKIFKAYVSLFMRHLCEPGADNADTFADGVPREGLSRQHVLTRIGVMSLIRKKVQEFEHINGEYSMPEVIKKSIMDQNKINAAGTATTSEAETPKSATTSTSATPATSAAPSPAPTQGEDKDKDKDSVQSDENKDKEVVNKTETEDEEKKTGESSTEKPKTEPEEVKEASPKTEIPEASSEADKSEIKSEVDTSSVTSEEKKEEKEEEAKKEEPEETKMEIQEEELVKEEKKEEEDDKKKEEIKKEVEKKEEDDVMVIDDDKDKKDKKEIDLEAKKRFM

SEQ ID NO: 22418 - protein, 442 aa, Diabrotica virgifera
  misc_feature: Coding regions on vcDNA: vcDNA=SeqID_2115; Strand=+; Position=1-1330
  misc_feature: Homolog annotation: Hit_ID=AAG15513.1; Match level="QueryCoverage =99%, HitCoverage=78%, E-value=0.0, Identity=75%"; Hit description =phosphoglucose isomerase; glucose-6-phosphate isomerase [Gryllus veletis]
  misc_feature: Gene Ontology Annotation: Molecular function=glucose-6-phosphate isomerase activity; Cellular component=cytosol; Biological process =neurogenesis
  misc_feature: Pfam annotation: Pfam_ID=PGI; Match level="Score=830.6, E-value=6.9e -247, Copies=1"; Pfam description=Phosphoglucose isomerase
  misc_feature (424)..(424): Xaa can be any naturally occurring amino acid
NRPILVDGKDVMPDVNAVLNHMKSFTEQVLSGAWKGYSGKKITDVVNIGIGGSDLGPLMVTEALKPYSKGLNLHFVSNIDGTHLAEVLKKVVPETVLFIIASKTFTTQETCTNAKSAKDWFLATAQDPAAVAKHFVALSTNAEKVSEFGIDTANMFGFWDWVGGRYSLWSAIGLSISLSIGFDNFSQLLDGGFFMDQHFQSASLEQNAPVILALLGVWYGNFFGSETHALLPYDQYLHRFAAYFQQGDMESNGKYITRSGQQVNFQTGPIVWGEPGTNGQHAFYQLIHQGTKTIPADFIAPATTHNPISGGTHHKILLANFLAQTEALMAGKTPEVAKAELEKQGLQGEALQKILPHKVFLGNRPTNSIVVKKVTPFILGALFALYEQKIFTQGIIWDINSYDQWGVELGITVAKAIEPEMQDXKPESFFTMGSPNGLINFH

SEQ ID NO: 22419 - protein, 451 aa, Diabrotica virgifera
  misc_feature: Coding regions on vcDNA: vcDNA=SeqID_2116; Strand=+; Position=61-1413
  misc_feature: Homolog annotation: Hit_ID=EAL26086.1; Match level="QueryCoverage =92%, HitCoverage=74%, E-value=1e-157, Identity=67%"; Hit description= GA20931-PA [Drosophila pseudoobscura]
  misc_feature: Gene Ontology Annotation: Molecular function=glucose-6-phosphate isomerase activity; Cellular component=cytosol; Biological process =neurogenesis
  misc_feature: Pfam annotation: Pfam_ID=PGI; Match level="Score=522.9, E-value=2.9e -154, Copies=1"; Pfam description=Phosphoglucose isomerase
MEPKPLLTTEPSWQKLQQYYDSKGNKLVIKDLFASDPARFDKLSLKIATPNDGDILIDFSKNRIDEEGLKLLLDLARSRKVEAARDAMFNGSKINFTENRAVLHIALRNRSNRPILVDGKDVMPDVNAVLNHMKSFTEQVLSGAWKGYSGKKITDVVNIGIGGSDLGPLMVTEALKPYSKGLNLHFVSNIDGTHLAEVLKKVNPETVLFIIASKTFTTQETCTNAKSAKDWFLATAQDPAAVAKHFVALSTNAEKVSEFGIDTANMFGFWDWVGGRYSLWSAIGLSISLSIGFDNFSQLLDGGFFMDQHFQSASLEQNAPVILALLGVWYGNFFGSKTHALLPYNQYLHRFAAYFSQGGEREKKKGITRKTQTVNNKTGIILRGEPKTVGGGLFPCQSIQGKKPFPFLFYSPRAPTKQPQLRGWKRDSQKSFFWANFLLGSKTRRVFLGGA

SEQ ID NO: 22420 - protein, 352 aa, Diabrotica virgifera
  misc_feature: Coding regions on vcDNA: vcDNA=SeqID_2117; Strand=+; Position=154-1211
  misc_feature: Homolog annotation: Hit_ID=XP_310100.1; Match level="QueryCoverage =83%, HitCoverage=89%, E-value=1e-36, Identity=31%"; Hit description =ENSANGP00000018871 [Anopheles gambiae] ref|XP_310098.1| ENSANGP00000018873 [Anopheles gambiae]
  misc_feature: Pfam annotation: Pfam_ID=zf-CCHC; Match level="Score=14.4, E-value =0.0058, Copies=1"; Pfam description=Zinc knuckle
  misc_feature (228)..(228): Xaa can be any naturally occurring amino acid
MPKFDEFNAVKESFEAWEERLQQYFIVNDTENEKKVANLITFMGARTYDTLKTYLFPDTPAMKTYDQLVTILKARYAPATSVIYERYRFHSRNQQAEESLEQYVKEVKALSKSCKFEKFLDQALRDRLVCGISNTNIRTKLLSEAETLTFEDACKKALSQEAAECQSKLVQGVAAVSVGKLQMSSKQYRSQSKSQSESRNQSVLKPCFRCGRRHQPETCPAVNWECFXCQKVGHTSRVCKRKKVNQVEVTEEEESSELLQLGHIAALTTGMEKPWKVNVQVEGVPLVMEIDSGACKSIIHVSDFSKYFNKCKMNSTNVKFRAVTANNISFVDQIYVNDLYQNKIYPVCPDNT

SEQ ID NO: 22421 - protein, 44 aa, Diabrotica virgifera
  misc_feature: Coding regions on vcDNA: vcDNA=SeqID_2118; Strand=-; Position=267-401
  misc_feature (36)..(36): Xaa can be any naturally occurring amino acid
  misc_feature (41)..(41): Xaa can be any naturally occurring amino acid
LKNKILYKLNKHNFFFIQPFIPTFNKKTGRYSTLSXSKYLXHSN

SEQ ID NO: 22422 - protein, 166 aa, Diabrotica virgifera
  misc_feature: Coding regions on vcDNA: vcDNA=SeqID_2119; Strand=+; Position=132-633
  misc_feature: Homolog annotation: Hit_ID=EAL27776.1; Match level="QueryCoverage =99%, HitCoverage=96%, E-value=1e-27, Identity=38%"; Hit description =GA10165-PA [Drosophila pseudoobscura]
  misc_feature: Gene Ontology Annotation: Molecular function=electron transporter activity; Cellular component=mitochondrial membrane; Biological process=tricarboxylic acid cycle
  misc_feature: Pfam annotation: Pfam_ID=CybS; Match level="Score=101.0, E-value=3.1e- 27, Copies=1"; Pfam description=CybS
  misc_feature (155)..(155): Xaa can be any naturally occurring amino acid
MALAIILRNSTRIQASPNIFKTAIAINSRKSFTQLTTGANKNLNILPRINLASYVKRNMSADHSKLWPIERAVSIALLGITPLVFISPNTALNDIFAIATVAHFHWGLEACVVDYVRPIVVGPVLPKVTLALLYFLSISTLGGLLYYNHHSAGIXNAVRDFWKIKK

SEQ ID NO: 22423 - protein, 427 aa, Diabrotica virgifera
  misc_feature: Coding regions on vcDNA: vcDNA=SeqID_2120; Strand=+; Position=271-1551
  misc_feature: Homolog annotation: Hit_ID=XP_317960.1; Match level="QueryCoverage =94%, HitCoverage=98%, E-value=0.0, Identity=77%"; Hit description =ENSANGP00000004989 [Anopheles gambiae] gb|EAA13078.1| ENSANGP00000004989 [Anopheles gambiae
  misc_feature: Gene Ontology Annotation: Molecular function=enzyme inhibitor activity; Cellular component=heterotrimeric G-protein complex; Biological process=signal transduction
  misc_feature: Pfam annotation: Pfam_ID=Arrestin_C; Match level="Score=228.5, E -value=1.3e-65, Copies=1"; Pfam description=Arrestin (or S-antigen), C-terminal d
  misc_feature (408)..(408): Xaa can be any naturally occurring amino acid
MDDGGKRQATRVFKKSSPNGKITVYLGKRDFVDHISCVDPIDGVVLIDPDYVKDRRVFGHVLAAFRYGREDLDVLGLTFRKDLYLAAEQIYPQDSPQQNKRPLTRLQERLIKKLGSNAYPFYFELPPHCPASVTLQPAPGDTGKPCGIDYELKAFVGESQDDKPHKRNSVRLAIRKIMYAPNKQGEQPSVEVSKEFMMSPNKLYLEASLDKKLYHHGENIAVNVHIANNSNRTVKKIKVSVRQFADICLFSTAQYKCTVAETESEEGCPIGPGFTLSKVFTLTPLLANNKDKWGLALDGQLKHEDTNLASSTLVADMSQRENLGIIVQYKVKVKLCLGALGGDLVAELPFILMHPKPEEEILPPATPSRRVSEDVRSDVPVDANLIQLEEENHDDDIIFEDFARLRLXGGETDAWEATGPKPPFVPL

SEQ ID NO: 22424 - protein, 286 aa, Diabrotica virgifera
  misc_feature: Coding regions on vcDNA: vcDNA=SeqID_2121; Strand=+; Position=77-934
  misc_feature: Homolog annotation: Hit_ID=EAL27773.1; Match level="QueryCoverage =99%, HitCoverage=66%, E-value=1e-149, Identity=94%"; Hit description= GA10280-PA [Drosophila pseudoobscura]
  misc_feature: Gene Ontology Annotation: Molecular function=proteasome endopeptidase activity; Cellular component=proteasome regulatory particle (sensu Eukarya); Biological process=proteolysis and peptidolysis
  misc_feature: Pfam annotation: Pfam_ID=AAA; Match level="Score=-9.1, E-value =0.0019, Copies=1"; Pfam description=ATPase family associated with various
MATLEDVSIWEDGEEALGEEVLRMSTDEIVSRTRLLDNEIKIMKSEVMRINHELQAQNEKIKENTEKIKVNKTLPYLVSNVIELLDVDPQEEEEDGAVVDLDSQRKGKCAVVKTSTRQTYFLPVIGLVDEEKLKPGDLVGVNKDSYLILETLPAEYDARVKAMEVDERPTEQYSDIGGLDKQIQELIEAVVLPMTHKDKFVNLGIHPPKGVLLYGPPGTGKTLLARACAAQTKSTFLKLAGPQLVQMFIGDGAKLVRDAFALAKEKAPAIIFIDELDAIGTKRFDS

SEQ ID NO: 22425 - protein, 434 aa, Diabrotica virgifera
  misc_feature: Coding regions on vcDNA: vcDNA=SeqID_2122; Strand=+; Position=69-1374
  misc_feature: Homolog annotation: Hit_ID=EAL27773.1; Match level="QueryCoverage =99%, HitCoverage=99%, E-value=0.0, Identity=91%"; Hit description =GA10280-PA [Drosophila pseudoobscura]
  misc_feature: Gene Ontology Annotation: Molecular function=proteasome endopeptidase activity; Cellular component=proteasome regulatory particle (sensu Eukarya); Biological process=proteolysis and peptidolysis
  misc_feature: Pfam annotation: Pfam_ID=AAA; Match level="Score=287.8, E-value=1.8e -83, Copies=1"; Pfam description=ATPase family associated with various
  misc_feature (78)..(78): Xaa can be any naturally occurring amino acid
MATLEDVSIWEDGEEALGEEVLRMSTDEIVSRTRLLDNEIKIMKSEVMRINHELQAQNEKIKENTEKIKVNKTFYYIXTKYGKVLFTLIELLDVDPQEEEEDGAVVDLDSQRKGKCAVVKTSTRQTYFLPVIGLVDEEKLKPGDLVGVNKDSYLILETLPAEYDARVKAMEVDERPTEQYSDIGGLDKQIQELIEAVVLPMTHKDKFVNLGIHPPKGVLLYGPPGTGKTLLARACAAQTKSTFLKLAGPQLVQMFIGDGAKLVRDAFALAKEKAPAIIFIDELDAIGTKRFDSEKAGDREVQRTMLELLNQLDGFSSTADIKVIAATNRVDILDPALLRSGRLDRKIEFPHPNEEARARIMQIHSRKMTVNPDVNFEELARSTDDFNGAQCKAVCVEAGMIALRRSATAVTHEDYMDAIMEVQAKKKANLNYYA

SEQ ID NO: 22426 - protein, 274 aa, Diabrotica virgifera
  misc_feature: Coding regions on vcDNA: vcDNA=SeqID_2123; Strand=+; Position=79-900
  misc_feature (209)..(209): Xaa can be any naturally occurring amino acid
  misc_feature (245)..(245): Xaa can be any naturally occurring amino acid
MDIEEVQSVSVRKLISAFENQTNSPEATYFRPRTRSLGNILAKNVTVRENQFATLDEISDALEVIQQQLQVYDIYNKERHVAFQEELFNILTSIINIDNDDPIRARNLISTTKHLVSVLNNKLPSNNSVEHRYTKYSEQVNGTHQSNILVKKKETSKTNNNIKRENSVDLNKDIVKSTKETKGIGLTRSVSVKKLKELFQSDIKLSELXTHQNKYESKSEQTVKVSNTLKKSSTTTTVVTVPEAXYRVIKDERVYPLPEYYPVETASKDTDYAI

SEQ ID NO: 22427 - protein, 196 aa, Diabrotica virgifera
  misc_feature: Coding regions on vcDNA: vcDNA=SeqID_2124; Strand=+; Position=13-603
  misc_feature: Homolog annotation: Hit_ID=EAL26910.1; Match level="QueryCoverage =94%, HitCoverage=85%, E-value=5e-63, Identity=62%"; Hit description =GA15162-PA [Drosophila pseudoobscura]
  misc_feature: Gene Ontology Annotation: Molecular function=glucosamine-phosphate N -acetyltransferase activity; Cellular component=late endosome; Biological process=UDP-N-acetylglucosamine biosynthesis
  misc_feature: Pfam annotation: Pfam_ID=Acetyltransf_1; Match level="Score=39.0, E -value=1.4e-08, Copies=1"; Pfam description=Acetyltransferase (GNAT) family
MGANRHSIGEEDLYDPNLLKNLDWTSVQSSLNPEISSDNPGESWIVVRPLKLSDYDKGFLQILSQLTEVGNIGKLEFERQFWNMRKAGGYYVTVIEDTRSNTIIGSSTLITEFKFIHDCALRARLEDVVVNNTYRGKQLGKLIVLTVTLLAKRLGCYKMSLDCKDPLIAFYKSLGYKLEPGNSNSMMLRFEKVDPS

SEQ ID NO: 22428 - protein, 104 aa, Diabrotica virgifera
  misc_feature: Coding regions on vcDNA: vcDNA=SeqID_2125; Strand=+; Position=586-900
KINISFKMHYKKKEILPTVFVNCIPIFARFRQSNIFLLKITSTNYFLILFSPMAHSSAPKLKIRCYISSAINDFRVRSYSFYCKSRTKSSVVLVLLKISIHLKM

SEQ ID NO: 22429 - protein, 293 aa, Diabrotica virgifera
  misc_feature: Coding regions on vcDNA: vcDNA=SeqID_2126; Strand=+; Position=10-891
  misc_feature: Homolog annotation: Hit_ID=NP_032021.1; Match level="QueryCoverage =68%, HitCoverage=57%, E-value=2e-45, Identity=44%"; Hit description =ficolin A [Mus musculus] gb|AAH19180.1| Ficolin A [Mus musculus] sp|O70165|FCN1_MOUSE
  misc_feature: Gene Ontology Annotation: Molecular function=receptor binding; Cellular component=extracellular space; Biological process=cell adhesion
  misc_feature: Pfam annotation: Pfam_ID=Fibrinogen_C; Match level="Score=234.6, E -value=1.8e-67, Copies=1"; Pfam description=Fibrinogen beta and gamma chains, C-t
MYYNLSIVFLLLASSSAFTQDNNLGITQTQDNNKITLTIQIQKPNSHEGIRGATILGNGISNSVGVCQHLVGVSKGDYCPITETKVTNLNIPGSCQEIYRNGKTISGTYEILPTGQTKPVTVLCDMEIEGGGWTIIQKRFDGSVDFYRPWRDYKFGFGNLKGEFWLGLENIHHLTSSKSNELLIEVTDHNLLNYYARYPVFEIGSEYQGYKLKTLGSYSGNSSGDSMIYHLSQRFTTFDQDQDSWSEGNCAKFSHGGWWYNNCYSSNFNGSPRNIPHISPKDTSKRYGMNWGQ

SEQ ID NO: 22430 - protein, 431 aa, Diabrotica virgifera
  misc_feature: Coding regions on vcDNA: vcDNA=SeqID_2127; Strand=-; Position=1-1293
  misc_feature: Homolog annotation: Hit_ID=A32713; Match level="QueryCoverage=95%, HitCoverage=48%, E-value=4e-94, Identity=42%"; Hit description =reverse transcriptase homolog - fruit fly (Drosophila melanogaster)
  misc_feature: Pfam annotation: Pfam_ID=RVT_1; Match level="Score=166.0, E-value=8e -47, Copies=1"; Pfam description=Reverse transcriptase (RNA-dependent
  misc_feature (359)..(359): Xaa can be any naturally occurring amino acid
  misc_feature (414)..(414): Xaa can be any naturally occurring amino acid
DQTSKGNTYPKENKKLFKEKRKLRRKWQQTRAPQDKTNLNNASQKLKREIQNIKNESISYYLRELTDNSSTEYSLWKATKRLKRPVTHSPPIKLEDGSWARSNEQKAERFATYLENTFKPHDDQNNDQISIEPNQTEERIRPTSPKEVADEIKDNINPKKAPGYDLITGELLKNLPRKAIVKLTNIINAAFRLRYVPNLWKIAEVIMIPKPGKSPNEVSSYRPLSLLPVMSKFFEKLLLKRIKPIIEEKKMIPNHQFGFRNKHSTIDQVHRMTNIIDKSIEEKKVCSTIFLDVAKAFDKVWHEGLVYKLKILMPKQYSEILQSYISDRYFRIKQEDVYTDLKEIRAGVPQGSVLGPVLXLLYTYDIPEMENDTIATFADDTAILAVGDTSEEAAEKLQSAINKIHNWTKKWKIXLNESKFIHVNFTNKKIE

SEQ ID NO: 22431 - protein, 406 aa, Diabrotica virgifera
  misc_feature: Coding regions on vcDNA: vcDNA=SeqID_2128; Strand=-; Position=165-1385
  misc_feature: Homolog annotation: Hit_ID=A32713; Match level="QueryCoverage=83%, HitCoverage=38%, E-value=4e-67, Identity=41%"; Hit description =reverse transcriptase homolog - fruit fly (Drosophila melanogaster)
  misc_feature: Pfam annotation: Pfam_ID=RVT_1; Match level="Score=75.5, E-value=1.5e- 19, Copies=1"; Pfam description=Reverse transcriptase (RNA-dependent
  misc_feature (47)..(47): Xaa can be any naturally occurring amino acid
  misc_feature (109)..(109): Xaa can be any naturally occurring amino acid
  misc_feature (123)..(123): Xaa can be any naturally occurring amino acid
REVLNNPKTPENHPKEGFSLLRHFPFFPSEVGKLFEKLLLKRIKPIXKGKEMISKPQFGFRNKHFTIDPGFHRMINIIEKSLGGKESSVFQSFLDVVKAFGQKFWHEGXLVYKLKILMPKQIXEILHSYISDRYFRIKQEDAYTDLKEIRAGVPQGSVLGPVLYLLYTYDIPEMENDTIAKFADDTAILAVGDTSEEAAEKLQSAINKIHNWTKKWKIKLNESKSIHVNFTNKKIENIPIRINDAQIPYASSAKYLGITLDARLRWKVHIKKKREELGIRYKKMYWLMGRNSALSTCNKILLYKQILRPVWMYGCQLWGCANSSNIQIIQRFQNKVLRNIVDAPRYIRNVDLHKDLEMEDVDKVIKKMAGSHEQRLHSHVNIEAIQLLDNTRLERRLKRRKPFKLV

SEQ ID NO: 22432 - protein, 211 aa, Diabrotica virgifera
  misc_feature: Coding regions on vcDNA: vcDNA=SeqID_2129; Strand=-; Position=2-634
  misc_feature: Homolog annotation: Hit_ID=EAA48944.1; Match level="QueryCoverage =46%, HitCoverage=19%, E-value=3e-16, Identity=52%"; Hit description =hypothetical protein MG00602.4 [Magnaporthe grisea 70-15] ref|XP _368642.1| hypothetical protein MG00602.4
ERTVKSCGWGVDPWRLHWLGDAHCRTLPSDLSEGFRGGQGPTGCAAVRGCLARHCQGHCSGSLLPDTKSFPPPSFPSLTFLSLLCNQIHPIKPKQYLDRGINLNQQHRSQHLSPSLQNQRVANIIQATGHQLTSSAFTNRYSSSQNSRPQQFYASSAPSSASILNTQNRAQQRPPVPLFPKSTGSISHGKQGNKSRFLGDPLVSRAAAPAV

SEQ ID NO: 22433 - protein, 101 aa, Diabrotica virgifera
  misc_feature: Coding regions on vcDNA: vcDNA=SeqID_2130; Strand=+; Position=102-404
  misc_feature: Homolog annotation: Hit_ID=EAL31731.1; Match level="QueryCoverage =100%, HitCoverage=25%, E-value=1e-51, Identity=93%"; Hit description= GA22112-PA [Drosophila pseudoobscura]
  misc_feature: Gene Ontology Annotation: Molecular function=structural constituent of cytoskeleton; Cellular component=Arp2/3 protein complex; Biological process=actin filament organization
MDSEGRKVIVCDNGTGFVKCGYAGSNFPAYIFPSMVGRPIIRAVNKIGDIEVKDLMVGDEASALRSLLEVNYPMENGVVRNWEDMCHVWDYTFGPKKMDFN

SEQ ID NO: 22434 - protein, 113 aa, Diabrotica virgifera
  misc_feature: Coding regions on vcDNA: vcDNA=SeqID_2131; Strand=+; Position=28-369
HKHKMASKASFVSVLMLLVAVANAYDVTNCPSNTGRQRNLVYDNLLSGVSINVRMPPAGYFNRPITCLQLIDRQGTSVSPKIVEGGYLDTYMVVNITSLNGQVLYYQAQIYID

SEQ ID NO: 22435 - protein, 111 aa, Diabrotica virgifera
  misc_feature: Coding regions on vcDNA: vcDNA=SeqID_2132; Strand=+; Position=59-394
LKMASKASFVCVLMLLVVVANAYDATNCPSNTGRQKNLVYDSLLTGVSINVRIPQAGYFNRPITCLQLIDRQGTSVSPKIVEGGYLDTYMVVNITSLNGQVLYYYAQIYID

SEQ ID NO: 22436 - protein, 453 aa, Diabrotica virgifera
  misc_feature: Coding regions on vcDNA: vcDNA=SeqID_2133; Strand=+; Position=43-1404
  misc_feature: Homolog annotation: Hit_ID=XP_394469.1; Match level="QueryCoverage =99%, HitCoverage=98%, E-value=0.0, Identity=94%"; Hit description =similar to Tubulin beta-3 chain [Apis mellifera]
  misc_feature: Gene Ontology Annotation: Molecular function=structural constituent of cytoskeleton; Cellular component=tubulin; Biological process =microtubule-based process
  misc_feature: Pfam annotation: Pfam_ID=Tubulin; Match level="Score=365.6, E-value =6.8e-107, Copies=1"; Pfam description=Tubulin/FtsZ family, GTPase domain
MREIVHLQAGQCGNQVGAKFWEVISAEHGIDPSGIYIGDSDLQLERINVYYNEASVASSTNGGKYVPRAILLDLEPGTMDAVRSGMYGKLFRPDNFVFGQSGAGNNWAKGHYTEGAELVDAVLDVVRKEAENCDCLQGFQLTHSLGGGTGSGMGTLLISKIREEYPDRIMNTYSVMPSPKVSDTVVEPYNATLSVHQLVENTDETYCIDNEALYDICFRTLKVPNPSYGDLNHLVSLTMSGVTTCLRFPGQLNADLRKLAVNMVPFPRLHFFMPGFAPLTSRGNQQYRALTVPELTQQMFDSKNMMAACDPRHGRYLTVAAVFRGRMSMKEVDEQMLAVQNKNSSYFVEWIPNNVKTAVCDIPPVGLKMSSTFIGNTTAIQELFKRISEQFAAMFRRKAFLHWYTGEGMDEMEFTEAESNMNDLVSEYQQYQEATADDEYEAEEEPAADDFNC

SEQ ID NO: 22437 - protein, 293 aa, Diabrotica virgifera
  misc_feature: Coding regions on vcDNA: vcDNA=SeqID_2134; Strand=+; Position=313-1191
  misc_feature: Homolog annotation: Hit_ID=EAL34319.1; Match level="QueryCoverage =93%, HitCoverage=52%, E-value=1e-105, Identity=67%"; Hit description= GA17661-PA [Drosophila pseudoobscura]
  misc_feature: Gene Ontology Annotation: Molecular function=aldehyde dehydrogenase activity; Cellular component=mitochondrion; Biological process =carbohydrate metabolism
  misc_feature: Pfam annotation: Pfam_ID=Aldedh; Match level="Score=140.8, E-value =3.1e-39, Copies=1"; Pfam description=Aldehyde dehydrogenase family
  misc_feature (271)..(271): Xaa can be any naturally occurring amino acid
  misc_feature (284)..(284): Xaa can be any naturally occurring amino acid
MLRAIRNTINVVQKCNYSAYALPKPQPNPNVLYSGIFINNEWHKSKSGKTFESINPSTGQVITEIQQGSKQDVDLAVEAANEAFRFGSTWRTTDASERGRLLNKLADLMERDGAYLASLETLDNGKPFTQAWADVVGSLKVIRYMAGYADKVCGKYIPMDGKYMCYTRHEPVGVCGQIIPWNFPLMMMAWKIGPALSMGNTVVLKPAEQTPLSCLYVAELAKEAEIPPGVLNIVPGFGDAGQALVENPNVDKIAFTGSTEVGKLIQANAGXTLEENTLELGGKXPNIILADAD

SEQ ID NO: 22438 - protein, 187 aa, Diabrotica virgifera
  misc_feature: Coding regions on vcDNA: vcDNA=SeqID_2135; Strand=+; Position=16-579
  misc_feature: Homolog annotation: Hit_ID=NP_511055.1; Match level="QueryCoverage =97%, HitCoverage=43%, E-value=3e-41, Identity=42%"; Hit description =CG4317-PA [Drosophila melanogaster] gb|AAF46121.1| CG4317-PA [Drosophila melanogaster]
  misc_feature: Gene Ontology Annotation: Molecular function=phosphohistidine phosphatase activity; Cellular component=endoplasmic reticulum; Biological process=polyphosphate metabolism
MLFQMHTFGTAWNKKRKSPWCALFTGENLKVLEYLRDLKYYWQDGYGHELSYKQACPAFRDMSNFLQTKTRFPRVNVYFTHSGTLLKMIAHVGLYKDEEHLTAKNYDTARDRKWRTGLLDTFGTNLAFVAFECGRDTKILTMHQENIVRLPACPNTDLCSLKTFRDHYFQSLSKCDFGEMCHLKSKL

SEQ ID NO: 22439 - protein, 418 aa, Diabrotica virgifera
  misc_feature: Coding regions on vcDNA: vcDNA=SeqID_2136; Strand=+; Position=2-1258
  misc_feature: Homolog annotation: Hit_ID=AAO15689.1; Match level="QueryCoverage =86%, HitCoverage=89%, E-value=3e-22, Identity=29%"; Hit description =Riddle 4 [Xenopus laevis]
  misc_feature: Gene Ontology Annotation: Molecular function=ATP binding; Cellular component=integral to membrane; Biological process=regulation of protein activity, epigenetic
  misc_feature: Pfam annotation: Pfam_ID=TIL; Match level="Score=89.0, E-value=1.3e -23, Copies=4"; Pfam description=Trypsin Inhibitor like cysteine rich
EKVLFVLIALLCQGSLGQLIRCPRGEIWNNCASCDPEATCQNRIPEAPGICPAVCQQRCECDSKNGLIRDQISGACVPIDKCPGCSRGEIWNECASCTPEPTCQNRTSQIPKICPDVCYPRCECDANAGFIRDAISGQCIPREQCPGCSRGEIWNECASCNPEPTCQNRTSQIPKICLDVCYPRCECDANAGFIRDAISGQCIPREQCPAGQCGPLEVLNEYASPCAPERTCRNQSPDVPDSCILPCEQRCECDEKRGLIRDEETGNCIDIGKCQGRCGPLEIFNECASPCLPERTCQYQFPVAPKVCILSCEQRCECDRNQGLIRDKQSGECIDIGKCEDRCSRNQFWGCRRCCSRATCDNPNPSPCSRPCPKICINECLWYKRLRKKTPKTGEWVLIRPGPEDWGEKFQLEYKKKN

SEQ ID NO: 22440 - protein, 301 aa, Diabrotica virgifera
  misc_feature: Coding regions on vcDNA: vcDNA=SeqID_2137; Strand=+; Position=35-940
  misc_feature: Homolog annotation: Hit_ID=AAQ02499.1; Match level="QueryCoverage =70%, HitCoverage=89%, E-value=4e-49, Identity=46%"; Hit description =thymidine kinase 2, mitochondrial [synthetic construct]
  misc_feature: Gene Ontology Annotation: Molecular function=thymidine kinase activity; Cellular component=mitochondrion; Biological process =nucleoside diphosphate phosphorylation
  misc_feature: Pfam annotation: Pfam_ID=dNK; Match level="Score=93.5, E-value=5.3e -25, Copies=1"; Pfam description=Deoxynucleoside kinase
MVRKVHYFKKLPLLLKRLTAGCSLNLSKMEGVITTISGQKRPAASIDASPNKKTTFVGISPMRELTNVKTPVDRPFRVSVEGNIGAGKSTLIKYFQNMPGIETYLEPLEWWRNVDGHNLLDLMYSDVHEWLRVFQTYVQLTRLKIQTSKPSSSSTTVQMFERSIQNNRYCFLEQAYRSGYIHGADYAVIDQWYRWIRANEDIALDLIVYLRSSPETVYERVKARKRPEENSLSLEYLKELHDSHERWLMSDDERFNTIPVLVLDADKTLDEIIEQYKQNENKILGYEKRKRQKVEAEEKAK

SEQ ID NO: 22441 - protein, 342 aa, Diabrotica virgifera
  misc_feature: Coding regions on vcDNA: vcDNA=SeqID_2138; Strand=+; Position=3-1031
  misc_feature: Homolog annotation: Hit_ID=XP_311704.1; Match level="QueryCoverage =89%, HitCoverage=78%, E-value=3e-94, Identity=49%"; Hit description =ENSANGP00000014991 [Anopheles gambiae]
  misc_feature: Gene Ontology Annotation: Molecular function=stearoyl-CoA desaturase activity; Cellular component=mitochondrion; Biological process=lipid metabolism
  misc_feature: Pfam annotation: Pfam_ID=FA_desaturase; Match level="Score=231.5, E -value=1.6e-66, Copies=1"; Pfam description=Fatty acid desaturase
AHRPFGPRTLLHGGLSEPFYYTRNMAPHLLSNTNLLLAEVNETQKTHLSSKETYQPTQTTQAKPAKKEKSDGSEIVWLNVMVFILLHSAALYGLWLMLSLQTSWKTFVFSAIYLSFASTGVTGGAHRLWAHRAYKAKLPFRIWLMLGQTAALQNDIYEWVRDHRVHHKFTDTNADPHNSTRGFFFCHVGWLMMKKHEDVKVKGKTIDMSDVAADPVVRWQRKYYIPLVTLLTFLLPTYVPYYFWKEDFMMSFFVCIFRFVLQLNGTWCVNSAAHLWGYKPYDGSINPVENRFVSAIGFGESWHNYHHTFPWDYKAAELGNYKMNYTTRLIGLHGTHRPKPMT

SEQ ID NO: 22442 - protein, 314 aa, Diabrotica virgifera
  misc_feature: Coding regions on vcDNA: vcDNA=SeqID_2139; Strand=+; Position=8-952
  misc_feature: Homolog annotation: Hit_ID=AAD49730.1; Match level="QueryCoverage =98%, HitCoverage=56%, E-value=6e-87, Identity=50%"; Hit description =chrysoptin precursor [Chrysops sp.]
  misc_feature: Gene Ontology Annotation: Cellular component=integral to membrane
  misc_feature: Pfam annotation: Pfam_ID=Metallophos; Match level="Score=58.7, E -value=1.7e-14, Copies=1"; Pfam description=Calcineurin-like phosphoesterase
IDNKIMLSVAFLLFCVISKIGALPQTITSDYFELSVVHFNDFHARFEQTSPDGNSCKNETECIGGFSRLYSKINSLLEEKPKSVLLNAGDNYQGTLYYTVGHWNITQEFMNKLPIDAEVLGNHEFDDGVAGIVPYIKSIQHPIIVSNIDDSLEPSMQGIYQKSTIIERDGKKIGIIGVITSECAKLSSTGDLKFFDESTSVNAEAERLVKEENVFTIIVLSHSGYEVDQEIAQNAHEKISLIVGGHSHTFLWTGDNPPGPDPVGGPYPTIVKSNQGHNVLVTQASAYCKYVGNITVYLDHNGENCRLHWSPQYP

SEQ ID NO: 22443 - protein, 257 aa, Diabrotica virgifera
  misc_feature: Coding regions on vcDNA: vcDNA=SeqID_2140; Strand=+; Position=140-910
  misc_feature: Homolog annotation: Hit_ID=XP_318626.1; Match level="QueryCoverage =92%, HitCoverage=32%, E-value=5e-48, Identity=41%"; Hit description =ENSANGP00000020977 [Anopheles gambiae]
  misc_feature: Gene Ontology Annotation: Molecular function=extracellular matrix structural constituent; Cellular component=collagen type IX; Biological process=biological_process unknown
  misc_feature (234)..(234): Xaa can be any naturally occurring amino acid
MYRKFFERWRHLLYLLVPLLLDLKYIGAQLDEDEDIRRPCADFKIGDDDLEAYDFIRRFRLDLLNTPYPGVSRVRGTNRMQTAYRLDKEADLTVPTRRIFPLGLPDQFSFISTFRTKKPPRGVWHIIRITDVEFRPQFLITLNPINQTIEFSITNYEGRLQTIQFDNATVFDRNWHKIHFGVSRDSVMLYVDCRKISQEALEPRGAIDINGKVSLSKYENSTETVPITIPIDLXWMVMSCDPTRPVREHCTELPKPS

SEQ ID NO: 22444 - protein, 400 aa, Diabrotica virgifera
  misc_feature: Coding regions on vcDNA: vcDNA=SeqID_2141; Strand=-; Position=2-1201
  misc_feature: Homolog annotation: Hit_ID=NP_608445.1; Match level="QueryCoverage =96%, HitCoverage=21%, E-value=6e-59, Identity=32%"; Hit description =CG1718-PA [Drosophila melanogaster] gb|AAF50837.1| CG1718-PA [Drosophila melanogaster]
  misc_feature: Gene Ontology Annotation: Molecular function=ATP-binding cassette (ABC) transporter activity; Cellular component=integral to membrane; Biological process=transport
MSPTNIDNITRIMLDLTATNPNVVRRSYIIGSTFTEQEFEFGIIKTIHPVITAWFNNDPYHSPGIALGMALSSVYNHYTNGHIEFVNKPLPFKAATQIDNIVGGQSQGFQFAFNIGFSMAFISSFYVIFLIRENVSKSKHLQFVSGVKVYIFWFVNIICDMFVYLLVCSVLLITIYCFQQDGFKTSGDMGRLFFLLLLFGWSFMPIYYVASLIFTVPSTGYTRMTLVGIFIGNAAFLLVEVLKTQSTNLKRIGETLDNVFLVFPHYSLATGINKCYAIYSYNTLCEIVFDSCAQNNFTKDECISKFPSTVADICTNLNDNYFSWDNNGIAKNVTYSLISGVLWSILLFIIEYKFIARLMYYINQKFFPKQPILIQDEDDDVSKKKKKGRPARDLELAHAS

SEQ ID NO: 22445 - protein, 438 aa, Diabrotica virgifera
  misc_feature: Coding regions on vcDNA: vcDNA=SeqID_2142; Strand=+; Position=2-1316
  misc_feature: Homolog annotation: Hit_ID=NP_523596.2; Match level="QueryCoverage =98%, HitCoverage=33%, E-value=1e-116, Identity=48%"; Hit description= CG10302-PA [Drosophila melanogaster] gb|AAF53668.2| CG10302-PA [Drosophila melanogaster]
  misc_feature: Pfam annotation: Pfam_ID=PPR; Match level="Score=17.2, E-value=0.051, Copies=2"; Pfam description=PPR repeat
  misc_feature (414)..(414): Xaa can be any naturally occurring amino acid
  misc_feature (423)..(423): Xaa can be any naturally occurring amino acid
  misc_feature (433)..(433): Xaa can be any naturally occurring amino acid
AYHGNLEKAVEYYNLVKEKQGSDFALDSSKILRFAHLYIKSGQFDECIKLLENTPQDKKDDDRGFSYTSLVWRLLNSLAEEGKVEELDKLFDTLVKKEFIEVSNVVLGPLIKVHLIKKDLESALKKFEWCVNHFKATPWKNELACQLIQNEDAEKLQKLTDLSTSIHGEVNSLYDLVFAFVECGRVRQARKILETPGLQVRPQRINTACERYQQEGLIKPLEGLKDATKDLNHIDRSDIYYQLLLSYIKQDEVDKALGLWTQMQEEDLAPPEQFLLTLGDFLKNKGRQVPFVLPQTTVQAAEVPKPIAPQVTPAPVLFRQKLKSGNVDEALKVKKNSKEALPVVDLAVLIEKLLQQNRLNEASKVTFEILDRGNIPVNRVFRFLLNKLATAGDVDTLSKIGQKINSDVKRIVSXDNRMCPCNXVAGNAEAYLXKSSHD

SEQ ID NO: 22446 - protein, 360 aa, Diabrotica virgifera
  misc_feature: Coding regions on vcDNA: vcDNA=SeqID_2143; Strand=+; Position=175-1257
  misc_feature: Homolog annotation: Hit_ID=CAD33827.1; Match level="QueryCoverage =85%, HitCoverage=93%, E-value=1e-142, Identity=81%"; Hit description= glyceraldehyde-3-phosphate dehydrogenase [Plutella xylostella]
  misc_feature: Gene Ontology Annotation: Molecular function=glyceraldehyde 3 -phosphate dehydrogenase (phosphorylating) activity; Cellular component=cytoplasm; Biological process=glycolysis
  misc_feature: Pfam annotation: Pfam_ID=Gp_dh_C; Match level="Score=357.6, E-value =1.7e-104, Copies=1"; Pfam description=Glyceraldehyde 3-phosphate dehydrogen
MVKIGINGFGRIGRLVLRAALEKGVEVVAVNDPFLDVDYMVYLFKFDSTHGRYKGCVNSDGKNLVVDGKVISVHQERDPAAIPWGKAGADYVVESTGVFTTIEKAKKHLDGGAKKVIISAPSADAPMYVCGVNLDAYNPADPVISNASCTTNCLAPLAKVIHDNFEIVEGLMTTVHATTATQKTVDGPSGKLWRDGRGAGQNIIPASTGAAKAVGKVIPSLNGKLTGMAFRVPVPNVSVVDLTVRLGKPASYDQIKAKVKEAAEGPLKGILGYTDEEVVSNDFVGDTHSSVFDAKADTQLIDNLNNQISSKIFSSGEEKRRKRLFPPKEIPIITPSHPTPKKNFKGVAGPFFFYKAVFFR

SEQ ID NO: 22447 - protein, 419 aa, Diabrotica virgifera
  misc_feature: Coding regions on vcDNA: vcDNA=SeqID_2144; Strand=+; Position=177-1436
  misc_feature: Homolog annotation: Hit_ID=EAL30764.1; Match level="QueryCoverage =100%, HitCoverage=100%, E-value=0.0, Identity=76%"; Hit description =GA11516-PA [Drosophila pseudoobscura]
  misc_feature: Gene Ontology Annotation: Molecular function=acyl-CoA dehydrogenase activity; Cellular component=mitochondrial matrix; Biological process=fatty acid beta-oxidation
  misc_feature: Pfam annotation: Pfam_ID=Acyl-CoA_dh; Match level="Score=262.3, E -value=8.5e-76, Copies=1"; Pfam description=Acyl-CoA dehydrogenase, C- terminal do
MACLQKVSKEFLKKGVRLSPSLAKYSSSAPGGYNFTLNDTQREFQELARKFTREEIIPVAAEHDRTGKYPLDILKKAWALGLTNNHIPEKYGGMEMGVFDGCVIAEEIAYGCTGIKTALEGSGLGQTPVLLTGNDEQKKKYLGRLIEEPLVAAYAVTEPSAGSDVNGIKTRAEKKGDEWILNGQKMWITNGGVANWYFVLARTNPDPKAPASKAFTGFIVEREWAGVTPGRKEINMGQRASDTRGITFEDVRIPKENVLIGEGAGFKIAMGTFDMTRPPVAAGAVGLAQRALDEATKYAMERKAFGVPIAHHQGVAFMLADMAIGVETARLAWMKSAWEVDQGVRNTLAASVAKCYAADIANKCATDAVQIFGGNGFNSEYPVEKLMRDAKIYQIYEGTAQIQRLIISRAIFENAKQKA

SEQ ID NO: 22448 - protein, 162 aa, Diabrotica virgifera
  misc_feature: Coding regions on vcDNA: vcDNA=SeqID_2145; Strand=-; Position=349-837
  misc_feature: Homolog annotation: Hit_ID=KGZQHL; Match level="QueryCoverage=87%, HitCoverage=88%, E-value=7e-21, Identity=35%"; Hit description =histidine-rich glycoprotein precursor - Plasmodium lophurae emb|CAA25698.1| histidine-rich
LLVYHLVFQHFFVHHFTFHHFFFHYVIINHHFEGHHFFVHCLWNSLFGHHLSSHRHVWDHHLLIHHFRFHHFFIHHHIRLHQFLVHHLWNFVFGHHFSSHPHVRGHHFLIHHLLSQHSFAHHHGHHHFFVHHFVIHHHVWLHHFFGSIMWLGGIIIFFRSSI

SEQ ID NO: 22449 - protein, 229 aa, Diabrotica virgifera
  misc_feature: Coding regions on vcDNA: vcDNA=SeqID_2146; Strand=-; Position=1075 -1764
  misc_feature: Homolog annotation: Hit_ID=KGZQHL; Match level="QueryCoverage=92%, HitCoverage=85%, E-value=2e-33, Identity=38%"; Hit description =histidine-rich glycoprotein precursor - Plasmodium lophurae emb|CAA25698.1| histidine-rich
GFFLIFFFFFHPFFFFFFPFFYLFIFYFFINHHFEGHHFFVHCLWNSLFGHHLSSHRHVWDHHLLIHHFRFHHFFIHHHIRLHQFLVHHLWNFVFGHHFSSHPHVRGHHFLIHHLLSQHSFAHHHGHHHFFVHHFVIHHHVWLHHFLVHHVLGHHHFFVHHFVIHHHVWLHHFLVHHVLGHHHFFVHHFVIHHHVWLHHFLVHHVLGHHIIFHHSLVNHVLGHHVVVHH

SEQ ID NO: 22450 - protein, 429 aa, Diabrotica virgifera
  misc_feature: Coding regions on vcDNA: vcDNA=SeqID_2147; Strand=+; Position=278-1565
  misc_feature: Homolog annotation: Hit_ID=EAA08149.3; Match level="QueryCoverage =89%, HitCoverage=64%, E-value=1e-114, Identity=53%"; Hit description= ENSANGP00000002692 [Anopheles gambiae str. PEST] ref|XP_563427.1| ENSANGP00000002692 [Anopheles gambiae s
  misc_feature: Gene Ontology Annotation: Molecular function=transporter activity; Cellular component=mitochondrial inner membrane; Biological process =biological_process unknown
  misc_feature: Pfam annotation: Pfam_ID=ABC_membrane; Match level="Score=231.3, E -value=1.8e-66, Copies=1"; Pfam description=ABC transporter transmembrane region
  misc_feature (354)..(354): Xaa can be any naturally occurring amino acid
  misc_feature (390)..(390): Xaa can be any naturally occurring amino acid
MSQKISQNKTYISVEIPETTKGASRGFFSRIFKRNKEVKEKQEPRLKKSELKRLFSLAKPEKWKLTTAIGFLVVSSTVTMSIPYSLGKILDIIYVGSGDSDAARARLNQVCGILLGVFVLGAICNYARVYLMSTAGYRMTNALRRQVFGAILRQEQGWFDKRPTGELVNRLSADTQIVGSALSQNISDGLRSLVMVFAGTGMMLYMSPQLALVGLAIVPPVAVVAVLYGRFVRKISRKVQDSLADSTKVAEERIANIRTVKSFAQEPREITSYNISIENALSPCSRAAKARALFYGMTGFSGHIIIISVLYYGGVMVSSNTITVGNLSSFLLYAAYIGISVGGLSSFYSELNKXLGAATRIWEIIDREPTIPPQGGLIPMTDVEGHIEFXNVKFCYPSRSDIEIFKSLVLDIQPGKTLAVVGPSGSGKS

SEQ ID NO: 22451 - protein, 256 aa, Diabrotica virgifera
  misc_feature: Coding regions on vcDNA: vcDNA=SeqID_2148; Strand=+; Position=215-1031
  misc_feature: Homolog annotation: Hit_ID=XP_318381.1; Match level="QueryCoverage =96%, HitCoverage=45%, E-value=7e-61, Identity=47%"; Hit description =ENSANGP00000015925 [Anopheles gambiae]
  misc_feature: Gene Ontology Annotation: Molecular function=enzyme activator activity; Cellular component=integral to plasma membrane; Biological process=proteolysis and peptidolysis
  misc_feature: Pfam annotation: Pfam_ID=Peptidase_M10; Match level="Score=193.4, E -value=4.5e-55, Copies=1"; Pfam description=Matrixin
MSLLYFIVLFCFLNHCYCAPTHKSREVPSVKALEFMKRYGYIKMDTGDSEALYTEGGISEIIKVMQRFGGIEETGEFDDATKRLMTLPRCGVPDIIQNSRQKKISNWSPVLGEATVQKHIQKALDTWGGYGRLNFFRSPSQNADIIVQFAQGYHGDRFPFDGRSGILAHAFFPHEQDHLGGDIHFDADEIWIDKSQKDYDEDGTDFYFVALHELGHSLGLAHSPVRSSIMFPYYQDSGSPPQLGYDDIFGMYDLYI

SEQ ID NO: 22452 - protein, 510 aa, Diabrotica virgifera
  misc_feature: Coding regions on vcDNA: vcDNA=SeqID_2149; Strand=+; Position=248-1777
  misc_feature: Homolog annotation: Hit_ID=NP_731787.1; Match level="QueryCoverage =90%, HitCoverage=46%, E-value=9e-66, Identity=30%"; Hit description =CG32473-PC, isoform C [Drosophila melanogaster] gb|AAN13553.1| CG32473-PC, isoform C [Drosophila
  misc_feature: Gene Ontology Annotation: Molecular function=aminopeptidase activity; Cellular component=cytosol; Biological process=biological_process unknown
  misc_feature: Pfam annotation: Pfam_ID=Peptidase_M1; Match level="Score=284.0, E -value=2.5e-82, Copies=1"; Pfam description=Peptidase family M1
MFKYYFVVLCFSLYFAVGCFECLTYRLNPSEAVPITYEIVIKPDLDNDVFHGEVIIYVVTKISLNGITLHSDELNITDVYINQIKGCYVEETEERITVKYNNGPLQPGEHTLLFKYSGKIRPSHGLIKALYEYKDTKEYVYVTDLEPNKARRVFPCFDEPQFKAKYHIKLVSPNETYAAISNMPEITKFRTSYGIVHEFAASVPMSTYLVSFAFTNFPYYSENFEYQGRQIPIRIFTVNASKENNEFAMQCVKTALSFYSDYTDISYPLPKLDMIEYKREESAATENWGLITFRQGLLTTPLRIYSKFQIKLVAFHELSHFWFGNLVTNAWWNDIWLQEGFATYMSYKLSAQDNNNTQLDEMKSYNFNEFFETEIYEKSQPIVQYLPDPSKIADVFNGLVYEKASAILLMLEDEIGQEKFKEIIRTFLKKYAYHTATTNDFITVVEEVVSDIPLRTFLESYLYQNKFPVLNVDICNNSTYVITTIRRSNRNQLVLLNGRFQLTKLIISND

SEQ ID NO: 22453 - protein, 297 aa, Diabrotica virgifera
  misc_feature: Coding regions on vcDNA: vcDNA=SeqID_2150; Strand=+; Position=27-920
  misc_feature: Homolog annotation: Hit_ID=EAA45117.2; Match level="QueryCoverage =98%, HitCoverage=97%, E-value=1e-56, Identity=45%"; Hit description =ENSANGP00000015578 [Anopheles gambiae str. PEST] ref|XP_566034.1| ENSANGP00000015578 [Anopheles gambiae st
  misc_feature: Gene Ontology Annotation: Molecular function=DNA binding; Cellular component=nucleus; Biological process=regulation of transcription, DNA-dependent
  misc_feature: Pfam annotation: Pfam_ID=Chitin_bind_4; Match level="Score=50.8, E -value=4e-12, Copies=1"; Pfam description=Insect cuticle protein
MKLYILAAVFCAVASAAKNNQQYTTPVPILKQIDKHNEDGSYSYGYEAADGTFKIETKYPNGEVYGKYGYIDDTGALREVEYGASRRGFEPAGNEIQVAPPTLNSNSPNARPLAPNEEDDGQYREDPAAYYQDDPYVQRQQSQPQQRPAPRYRPESAYRQEPEPFEPFEPEIVRPNYRPQTSYRPQPAYRPQPAYRPQPAYRPQPAYKPQSYYRTDPEPEPLPAPRYQPQPAYRPQSNFGFQNDNNNYNPAPSWNSNPSWNNNPSYNAPQPNGPVWTGHPAQNVDINTGSYTGQYKR

SEQ ID NO: 22454 - protein, 89 aa, Diabrotica virgifera
  misc_feature: Coding regions on vcDNA: vcDNA=SeqID_2151; Strand=-; Position=2-268
INKTHLYLQKKSAAVFLLRILLGTSIFNKSSVETSAAFLFFMLTNGVDALLGDGVGVFRHFAIGLGEYTDLKSELTPSLSRDVASFPDA

SEQ ID NO: 22455 - protein, 600 aa, Diabrotica virgifera
  misc_feature: Coding regions on vcDNA: vcDNA=SeqID_2152; Strand=+; Position=174-1976
  misc_feature: Homolog annotation: Hit_ID=XP_396658.1; Match level="QueryCoverage =87%, HitCoverage=88%, E-value=1e-164, Identity=54%"; Hit description= similar to CG10565-PA [Apis mellifera]
  misc_feature: Gene Ontology Annotation: Molecular function=chaperone activity; Cellular component=nucleus; Biological process=protein folding
  misc_feature: Pfam annotation: Pfam_ID=DnaJ; Match level="Score=78.5, E-value=1.8e -20, Copies=1"; Pfam description=DnaJ domain
  misc_feature (569)..(569): Xaa can be any naturally occurring amino acid
MGEARIAKSGICTAVALRYYFIYENVGAGEPELRFVQHPLIELEVDIPKEDKEEELTPETVDYEDDVEYLRSLDPKEWKSQDHYKVLGIPNIRYKATDDIIKTAYRKKVLKHHPDKRKALGEEIKTDDDYFTCITMAYETLGNISRRRAYDSVDPQFDNDLPCTSDIKKDFYKTFTYYFDLNSRWSEKTRVPKLGTENSTREEVEHFYSFWYDFKSWREYSYEDEEDKDKCQDRDERRYVDKLNKAERLRKKKEEMSRIRQLVDLSYSNDPRIAKFKQEDKEKKLAAKRAKQNAAQAKKEEEERILKEAQLAKEQAEAAERAKIEAKRQEREVQKKALKKERKILRDICKSNNYYADNDDQNLSYMTAIEGMCERLSLTELEDLNKNLKNNGKSAFVKAIKENEAYLQKERMDLLNSAKSKVNTENNTTAVVMVAPDWNEENVQLLVKAVNLFPAGTNQRWDVVSNFINQHGTFSQNSNKFNAKMVLSKAKDLQNTDFSKNNLKEVANKQAFDNFKKDKKSVLNITESDISKKLDEVNLNDSAKKPTTNGEAKPKAELPWTTGEQPLLXQALNTYPASTPERWDKISECIPSISRMDCMT

SEQ ID NO: 22456 - protein, 297 aa, Diabrotica virgifera
  misc_feature: Coding regions on vcDNA: vcDNA=SeqID_2153; Strand=+; Position=67-958
  misc_feature: Homolog annotation: Hit_ID=AAS20591.1; Match level="QueryCoverage =98%, HitCoverage=90%, E-value=1e-81, Identity=50%"; Hit description =digestive cysteine proteinase intestain [Leptinotarsa decemlineata]
  misc_feature: Gene Ontology Annotation: Molecular function=cysteine-type peptidase activity; Cellular component=extracellular space; Biological process= protein catabolism
  misc_feature: Pfam annotation: Pfam_ID=Peptidase_C1; Match level="Score=225.9, E -value=7.4e-65, Copies=1"; Pfam description=Papain family cysteine protease
  misc_feature (265)..(265): Xaa can be any naturally occurring amino acid
MKILLTLIGTIVVVNALSTKQQWENFKRNHNKSYAHVLEENYRLSVFRLNLKKIEEHNARYQKGEVSYYMGVTKFADLTAVEFMSMLNKQISTKPNIQGILAQLSDDPIPDSFDWRGSGAVLEVKDQGSCGSCWSFSVTGALEGLNFLANNVTLPLSEQELVDCTALYGNAGCNGGNMQYGFKYVKSKGISSEAAYPYAGVDESCRRNASNIVFKIKGFQTVSKDDDSLRRAIATVGPISIAMQATENLQLYKGGVLGDPSCSKXVGAINHGVLAVGYGQEMTHIIGLSKNPWGTFL

SEQ ID NO: 22457 - protein, 614 aa, Diabrotica virgifera
  misc_feature: Coding regions on vcDNA: vcDNA=SeqID_2154; Strand=+; Position=78-1922
  misc_feature: Homolog annotation: Hit_ID=NP_611265.1; Match level="QueryCoverage =97%, HitCoverage=98%, E-value=5e-94, Identity=36%"; Hit description =CG6370-PA [Drosophila melanogaster] gb|AAF57793.1| CG6370-PA [Drosophila melanogaster]
  misc_feature: Gene Ontology Annotation: Biological process=locomotory behavior
  misc_feature: Pfam annotation: Pfam_ID=Ribophorin_II; Match level="Score=357.6, E -value=1.7e-104, Copies=1"; Pfam description=Ribophorin II (RPN2)
MRISTYYILVLSIILALFCATTYASIGGYISQADKNKFIQILEKTLKVDGDDIVSPYYAARGYQILTVPLDKKQTGDNCAHLKKNFKHQSTESTFYVYSTWNILGCQGALHSPEVVKTIQAALEDNKSTLADIRYALEILTLLKQQIPGPAKVSQAIQAKLKEDDSLQNLGQAVHAASLLGDNGKFALDRVEDIVVQADEVDGKLLQWEGGLTTTSLLLTGLFRLPGNSPLTAVQADKFANYLLTRKTVQTAKGVLSFLDASLALSSSSVSPVSISIIGTPQVSADKPDLKVQVSNLFGVPHKTPPSPVVAEKITKLADDSVVLSKQTLKAGVPSAEFVLPLKLDPGLYKVVINAGSHSADFVVRALGSLTVKSLEIGLSDSDGGAAVKLTKLTYKNKLPKPLQADSSQSLLIKFSLSRTVHQAFLRLYSGKKEIIFVAEQDSSKLYLVEVNLEKELSQSGNFEMELILGDALITNPIRWGLGTIEVNLGPNAKEDVKVVRGPKPEIQHLFRPAEKRPPEAVSLFFTALTAAPFLILLICWGRIGINLGNFTVLALPFHLGFGSILALFTLFWLKLDMFMTCAWLVPIGGFTFLSGHKLLSHLAANRKQDKADK

SEQ ID NO: 22458 - protein, 256 aa, Diabrotica virgifera
  misc_feature: Coding regions on vcDNA: vcDNA=SeqID_2155; Strand=+; Position=89-856
  misc_feature: Homolog annotation: Hit_ID=XP_392987.1; Match level="QueryCoverage =100%, HitCoverage=94%, E-value=4e-42, Identity=33%"; Hit description= similar to heterochromatin protein 1 alpha [Apis mellifera]
  misc_feature: Gene Ontology Annotation: Molecular function=chromatin binding; Cellular component=nucleus; Biological process=embryogenesis and morphogenesis
  misc_feature: Pfam annotation: Pfam_ID=Chromo; Match level="Score=87.5, E-value =3.5e-23, Copies=2"; Pfam description='chromo' (CHRromatin Organisation MOd
  misc_feature (242)..(242): Xaa can be any naturally occurring amino acid
MKRRGVKKAQKAEDDSNGVEDFVEKNGGASDVEDESDEQPKDKKRKSKSNRKSASPSKKTVDESMEEADPLEDVEEVKKPKEKTKKSKAVSEDEDEDGTGDETQYEVEKVLDDKMIAGVRHYLIRWKGYGQGDDTWEPEDTLNCPDAIKAFKDAKKKTKKVKKDAGEEWDENEDFEVSRILEVHHNKNGKREFLVSWKGFSPKDNSWEPEENMDCKDLIEKFMKKVDKAKDVDERELRVNRXHVQRLTLYTPDTSR

SEQ ID NO: 22459 - protein, 287 aa, Diabrotica virgifera
  misc_feature: Coding regions on vcDNA: vcDNA=SeqID_2156; Strand=+; Position=184-1045
  misc_feature: Homolog annotation: Hit_ID=XP_309434.1; Match level="QueryCoverage =94%, HitCoverage=56%, E-value=1e-105, Identity=68%"; Hit description= ENSANGP00000011244 [Anopheles gambiae]
  misc_feature: Gene Ontology Annotation: Molecular function=hexokinase activity; Cellular component=soluble fraction; Biological process=glycolysis
  misc_feature: Pfam annotation: Pfam_ID=Hexokinase_1; Match level="Score=341.1, E -value=1.6e-99, Copies=1"; Pfam description=Hexokinase
  misc_feature (250)..(250): Xaa can be any naturally occurring amino acid
  misc_feature (257)..(257): Xaa can be any naturally occurring amino acid
  misc_feature (271)..(271): Xaa can be any naturally occurring amino acid
MGYKRNIQATPLIRDKCRELILTNEKLHKLMKVFLENVHRGLKKETHPTSIVKCFPTYVQDLPNGTENGKFLALDLGGTNFRVLLIELSGEHFEMKSKIFAIPQHIMLGSGEQLFDHIAECLAIFVKEEQVADQKLPLGFTFSFPLSQKGLTVGYLERWTKGFNCSNVVGNDVVQMLNEAIERRGDVQIEICAILNDTTGTLMSCAWKNHSTRIGSIVGTGSNTCYVEKQANAETWSDVDMGSGNVLINXEWGAFGXDDGALDFIRTEYDXDIDRNSVNPGKQSTRR

SEQ ID NO: 22460 - protein, 486 aa, Diabrotica virgifera
  misc_feature: Coding regions on vcDNA: vcDNA=SeqID_2157; Strand=+; Position=100-1560
  misc_feature: Homolog annotation: Hit_ID=EAL41568.1; Match level="QueryCoverage =91%, HitCoverage=98%, E-value=1e-178, Identity=67%"; Hit description= ENSANGP00000028361 [Anopheles gambiae str. PEST] ref|XP_564289.1| ENSANGP00000028361 [Anopheles gambiae s
  misc_feature: Gene Ontology Annotation: Molecular function=hexokinase activity; Cellular component=soluble fraction; Biological process=glycolysis
  misc_feature: Pfam annotation: Pfam_ID=Hexokinase_1; Match level="Score=335.0, E -value=1.1e-97, Copies=1"; Pfam description=Hexokinase
MRFHTIFEQVDELGRVEVDLLGLHGHGGSESSVEYHITNEIRDKCRELILTNEKLHKLMKVFLENVHRGLKKETHPTSIVKCFPTYVQDLPNGTENGKFLALDLGGTNFRVLLIELSGEHFEMKSKIFAIPQHIMLGSGEQLFDHIAECLAIFVKEEQVADQKLPLGFTFSFPLSQKGLTVGYLERWTKGFNCSNVVGNDVVQMLNEAIERRGDFEISVMAILNDSTGTLMSCAWLNRQCRIGAIVGTGSNTCYVEKQANAETWSDVDMGSGNVLINLEWGAFGDDGALDFIRTEYDEDIDRNSVNPGKQKHEKMISGMYMGELVRLALERFTKEALLFGGKGSDMLFERGRFYTKYVSEIESDPPGVFNNLRDICEELGLKHATEQDFINIRYICECISRRSAHLVSAGLATLLNKMGEKKVTIGVDGSVYRFHPHFHNLMMEKIKELADPSIEFDLMLSEDGSGRGAALVAAVAARLQKEAGRT

SEQ ID NO: 22461 - protein, 334 aa, Diabrotica virgifera
  misc_feature: Coding regions on vcDNA: vcDNA=SeqID_2158; Strand=+; Position=3-1007
  misc_feature: Homolog annotation: Hit_ID=XP_312142.1; Match level="QueryCoverage =98%, HitCoverage=31%, E-value=2e-73, Identity=45%"; Hit description =ENSANGP00000022085 [Anopheles gambiae]
  misc_feature (7)..(7): Xaa can be any naturally occurring amino acid
  misc_feature (274)..(274): Xaa can be any naturally occurring amino acid
FSNIVWXSFGKHIQELDSCVRNDADHQSQNRLSDLVAEHLDHLHYLNDILCLNITDLNHVLTDHLLHKLLIPLYIYSLSSNRRRTSSNEVVVQAIGKTSLTPKSSQNSSPKVHDITNGKVSCVVALFLLSQVFLILSHSPLVQTLAWIILKTDRTVFENGVDKLLEYYEKIKERQNSEDEASGSVPSDRESSSSKENIVDEQTNTNVTDEEKQRMVIPADGAGITNFPFLETVYEALDCTENDYAALFGLSLLYAMANNAGITSDITEQVLRPXNRSFHKSSSASKDVRYTYNTFLVEKMLLIIIFSCQPSCRVRLVTLELALKLFIQLTVCEG

SEQ ID NO: 22462 - protein, 261 aa, Diabrotica virgifera
  misc_feature: Coding regions on vcDNA: vcDNA=SeqID_2159; Strand=+; Position=78-860
  misc_feature: Homolog annotation: Hit_ID=XP_392994.1; Match level="QueryCoverage =100%, HitCoverage=35%, E-value=1e-112, Identity=73%"; Hit description=similar to CG9940-PA [Apis mellifera]
  misc_feature: Gene Ontology Annotation: Molecular function=NAD+ synthase (glutamine- hydrolyzing) activity; Cellular component=cellular_component unknown; Biological process=nucleobase, nucleoside, nucleotide and nucleic acid
  misc_feature: Pfam annotation: Pfam_ID=CN_hydrolase; Match level="Score=130.8, E -value=3.2e-36, Copies=1"; Pfam description=Carbon-nitrogen hydrolase
MGRKVTIAASTLNQWALDFEGNLDRILQSILEAKEVGATFRTGPELEISGYSCEDHFYESDTFLHSWEVLAELLNAPLCKDILIDVGMPIMHKNVSYNCRVIFLNKKILLIRPKKILADSGNYRESRWFTSWKKERQTEDFYLPRMISSITNQKIVPIGDAVISTLDTCIGFEICEELWCSSSPHIPLSLDGVEIICNGSGSHTELRKNYVIADLVKNATMKCGGCYVYSNLRGCDGQRVYFDGVSCITLNGKGLNRTKQF

SEQ ID NO: 22463 - protein, 426 aa, Diabrotica virgifera
  misc_feature: Coding regions on vcDNA: vcDNA=SeqID_2160; Strand=+; Position=49-1326
  misc_feature: Homolog annotation: Hit_ID=NP_525064.1; Match level="QueryCoverage =95%, HitCoverage=14%, E-value=5e-28, Identity=28%"; Hit description =CG6450-PC [Drosophila melanogaster] gb|AAF45910.1| CG6450-PC [Drosophila melanogaster]
  misc_feature: Gene Ontology Annotation: Molecular function=actin binding; Cellular component=cell cortex; Biological process=cellularization
MYNALQSTFDERNQQISTLNQQLQVTQNNKEAEKLENELTRYKDECLKLQHYLDECQQQLFNITQDLATKTHEYQTVSQQLAYSQQNADFLQGQINDLNGTLHQKEQEYLVSLENLNKSRYKEIETHYEELMAAKDLDIQTLRAQVAESVYNASEQSTLKAELENQVKKLEEQIVELTTITGEQQSKIKELEEKLSEQTSLSEEETKQLSEMRGIIEEQVVKIEDLKKELFQKSNDYDSLIAQMDISRSAITQQPVASTSIEVPSHSSSQRPPLPEEEPELVNRAELDIALYMLHQRDVRCEELTVELTHLLEERDTLQLRLSTAIREKEDMRRKNVGGGATAEPTTSTSDESVSPRSRTSEIFLAASGTELTSEPAEHLTAKQDLASKLSELKQVGYRKRQTFVDEQELRRLQQMSINAQHIKEA

SEQ ID NO: 22464 - protein, 204 aa, Diabrotica virgifera
  misc_feature: Coding regions on vcDNA: vcDNA=SeqID_2161; Strand=+; Position=322-936
  misc_feature: Homolog annotation: Hit_ID=NP_572918.1; Match level="QueryCoverage =70%, HitCoverage=28%, E-value=2e-37, Identity=55%"; Hit description =CG10990-PA [Drosophila melanogaster] gb|AAF48312.2| CG10990-PA [Drosophila melanogaster]
  misc_feature: Gene Ontology Annotation: Biological process=apoptosis
  misc_feature: Pfam annotation: Pfam_ID=MA3; Match level="Score=-8.4, E-value=0.028, Copies=1"; Pfam description=MA3 domain
MASEKGDASVDVDATEEVDMEKAVNEELAAKENATAGESLIRRRPKKVHRQGSKEGALPAGFVHGPRSWKNSRRSRNGFGRGLPKKKGAGGKGVWGLPGSELLEAYEDVDDPNFDNENMSNGDIELKAVVPEVSDEEIKKKVEPIILEYFENGDTHEAVLTIEEQIPVKRRDTLVEQLIQIAMDHKTAHREMTSKLISDLFPIP

SEQ ID NO: 22465 - protein, 255 aa, Diabrotica virgifera
  misc_feature: Coding regions on vcDNA: vcDNA=SeqID_2162; Strand=+; Position=110-877
  misc_feature: Homolog annotation: Hit_ID=CAA31321.1; Match level="QueryCoverage =88%, HitCoverage=54%, E-value=2e-21, Identity=32%"; Hit description =K10 protein [Drosophila melanogaster]
  misc_feature: Gene Ontology Annotation: Molecular function=DNA binding; Cellular component=nucleus; Biological process=regulation of protein activity, epigenetic
MGAPVQQGKPNRRGPGNMRGRGGNPKMRGQGRAFNGQPPFGNPGMMRGGFRGNMRPPQGPPMRGGRPPMRGRPLPPPPPRMMGPRGPMMPPMRPPPPGMRPPPGMRPPPPMMMMGPMPPPMRGGMFRGGMRGKGPFRPGPPMMPNNNFRGINKKSKIIRKGKTVPVDIDLTKSFVTEAIKAEFEKKEEFFYKAKTSQKKEDWIKYKEQRDKCADVYEEAEKGSAGQQEVRIPQLLPETNFTRVTAPIDYTADIHL

SEQ ID NO: 22466 - protein, 311 aa, Diabrotica virgifera
  misc_feature: Coding regions on vcDNA: vcDNA=SeqID_2163; Strand=+; Position=6-938
  misc_feature: Homolog annotation: Hit_ID=EAA45149.2; Match level="QueryCoverage =53%, HitCoverage=67%, E-value=4e-57, Identity=62%"; Hit description =ENSANGP00000023020 [Anopheles gambiae str. PEST] ref|XP_566229.1| ENSANGP00000023020 [Anopheles gambiae st
MYDLLYLHARIILRKALNTMAIGFRQLIKFANFSSLVASRSSAFKFEKASQVQITQTNHQYLPKVVKKFNHEEGLQSQEVDNRESDNDLVIKEHVFIVDNPVVKDLNRLRCLNYSDVSSNSAATGSQFSVPNPHQFSSQNQDEKSNKPSLEKLTHVYDVLAETLPKIFIQSLDYKIYHKDIVFEDNIRNIRTVGLYNYVKQVALLRTIGHLKFAYVKFEILKITKHPEDSSVKVRWQIRGISALRVMLTFWKIKLWNFKEIFERTDSWYDGFSTFYVNSERQVIKHVAEKMMPDSDHVPVSSPKPIVGRKR

SEQ ID NO: 22467 - protein, 253 aa, Diabrotica virgifera
  misc_feature: Coding regions on vcDNA: vcDNA=SeqID_2164; Strand=+; Position=161-918
  misc_feature: Homolog annotation: Hit_ID=XP_316429.1; Match level="QueryCoverage =69%, HitCoverage=49%, E-value=5e-48, Identity=52%"; Hit description =ENSANGP00000021070 [Anopheles gambiae]
  misc_feature (232)..(232): Xaa can be any naturally occurring amino acid
MKKQIYISSSILWLTLLLSISTTHSRLERTFIDEKYKTLVRRLKIRLGTPSQHAVRTAKNIQLLKSSDTLAEESPFKDFPCDRSNTKIRSDTVPTNVNQVRPGDIDIIAAMGDSLSAGTGISSATMQQELFSEERGRSWSIGGEADWKRFLTLANILKEFNPNLFGYSLNTSQSWAWNSQFNVAENGAISQNLPFMAKELVKRIKNDKRTDMKNHWKMITIMAGHNDFCSEXCYYKNPNDILKYHRSDVIEIV

SEQ ID NO: 22468 - protein, 83 aa, Diabrotica virgifera
  misc_feature: Coding regions on vcDNA: vcDNA=SeqID_2165; Strand=-; Position=92-343
ATAPSLELANWLRYNASSISPGSNRKMAALMNFPFDISVAITFISVLPKCSCHSDYVLTPNCKRFFPYSETMSWPNTQVGGGQ

SEQ ID NO: 22469 - protein, 73 aa, Diabrotica virgifera
  misc_feature: Coding regions on vcDNA: vcDNA=SeqID_2166; Strand=-; Position=57-278
TTHSPFLNCYMHISVVQYNSFLVFSQFDTQRCFFIFGFKKFMVLLSISHIFTGNCKNVDHISIERLKFKGLST

SEQ ID NO: 22470 - protein, 98 aa, Diabrotica virgifera
  misc_feature: Coding regions on vcDNA: vcDNA=SeqID_2167; Strand=-; Position=1-294
LKLPPPKNLPKVRSESKKVLIKNQPRKNTIHGNERRYKKEDNYIKIKGEGDEYKFKEVSEFEYLVATVTNTGREEKEINKRLLKESRVVGSLNTRTRV

SEQ ID NO: 22471 - protein, 259 aa, Diabrotica virgifera
  misc_feature: Coding regions on vcDNA: vcDNA=SeqID_2168; Strand=+; Position=163-938
  misc_feature: Homolog annotation: Hit_ID=EAA01450.2; Match level="QueryCoverage =96%, HitCoverage=77%, E-value=3e-48, Identity=41%"; Hit description =ENSANGP00000016877 [Anopheles gambiae str. PEST] ref|XP_551439.1| ENSANGP00000016877 [Anopheles gambiae st
  misc_feature: Gene Ontology Annotation: Cellular component=mitochondrion
  misc_feature: Pfam annotation: Pfam_ID=Inositol_P; Match level="Score=-9.8, E-value= 1.1e-05, Copies=1"; Pfam description=Inositol monophosphatase family
  misc_feature (238)..(238): Xaa can be any naturally occurring amino acid
KCKDCNYNMNLGGTIRLNKFGIFIVLCIIFIFGLHVFTKNSEATSETKKINLSTLLNVAIKAAENGGKRVVESKENMNVQSKGLTKEGMQESVTNADILSHCDMTKTIKYFFPRVKLISEENVKNCDDKANVDYSLMNAVDINNNLINEEDITIWIDPLDATHEYTEKLYMYVTTMVCVAVKGKPVMGVIHKPFEKTTSWVWVDKAKSKDLINQEPENKSPNIKVIVSRSHKGDVEKXSSNNFKQKVDIITAAGAGYKA

SEQ ID NO: 22472 - protein, 369 aa, Diabrotica virgifera
  misc_feature: Coding regions on vcDNA: vcDNA=SeqID_2169; Strand=+; Position=171-1280
  misc_feature: Homolog annotation: Hit_ID=XP_392331.1; Match level="QueryCoverage =100%, HitCoverage=92%, E-value=1e-155, Identity=70%"; Hit description=similar to pDJA1 chaperone [Apis mellifera]
  misc_feature: Gene Ontology Annotation: Molecular function=heat shock protein activity; Cellular component=cytosol; Biological process=protein folding
  misc_feature: Pfam annotation: Pfam_ID=DnaJ_CXXCXGXG; Match level="Score=149.6, E -value=7e-42, Copies=1"; Pfam description=DnaJ central domain (4 repeats)
  misc_feature (297)..(297): Xaa can be any naturally occurring amino acid
  misc_feature (321)..(321): Xaa can be any naturally occurring amino acid
  misc_feature (327)..(327): Xaa can be any naturally occurring amino acid
  misc_feature (340)..(342): Xaa can be any naturally occurring amino acid
MVNETKFYDILGVKPDCSPEDLKKAYRKLALKYHPDKNPNEGEKFKQISQAYEVLSDPEKKKIYDLGGEQALKERGVGGGFSSPMDLFDMFFSGGFGGGRRRKEHRGKNVIHQLTVTLEELYKGAVRKLALQKNVICDKCEGRGGKKGAVEQCTTCRGTGVQVQVQQIGLGMLQQIQTVCPDCRGQGEKINPKDRCKQCNGKKVVRERKVLEVHIDKGMVDEQKIVFTGEGDQEPELEPGDIIIVLDEKEHPVFKRYNVHDLYMRMEIQLVEALCGFQKAVKTLDDRELVITVLPGXVIKNGDYKCILNEGMPQYKNPFEXGRSIIXVYVKFPDTLPPEXXXDLERVLPPREESMISDHAEEVTLVDFD

SEQ ID NO: 22473 - protein, 312 aa, Diabrotica virgifera
  misc_feature: Coding regions on vcDNA: vcDNA=SeqID_2170; Strand=+; Position=50-985
  misc_feature: Homolog annotation: Hit_ID=NP_524494.1; Match level="QueryCoverage =95%, HitCoverage=38%, E-value=1e-143, Identity=82%"; Hit description= CG7748-PA [Drosophila melanogaster] gb|AAF56391.1| CG7748-PA [Drosophila melanogaster]
  misc_feature: Gene Ontology Annotation: Molecular function=dolichyl-diphospho -oligosaccharide-protein glycosyltransferase activity; Cellular component=membrane; Biological process=protein modification
  misc_feature: Pfam annotation: Pfam_ID=STT3; Match level="Score=-138.8, E-value =0.0022, Copies=1"; Pfam description=Oligosaccharyl transferase STT3 subun
  misc_feature (277)..(277): Xaa can be any naturally occurring amino acid
  misc_feature (288)..(288): Xaa can be any naturally occurring amino acid
MVQAGLKKSSGSKINSKAGISSLIIFVVLLLAWIAGFSSRLFAVIRFESIIHEFDPWFNYRATAYMVKHGFYNFLNWFDERAWYPLGRIVGGTVYPGLMLTSGSIHYILHLLHINVHIRDICVFLAPVFSGLTSISTYYLTKELWSAGAGLFAACFIAIVPGYISRSVAGSYDNEGIAIFALQFTYYLWIKSVKTGSVFWSVAASLSYFYMVSAWGGYVFIINLIPLHVFVLLLMGRYSNRLFTSYTTFYILGLIFSMQIPFVGFQPIRTSGHMAAXAGVFALMFAVXALKYLQSMMSKSEFKSFRIIWGLI

SEQ ID NO: 22474 - protein, 58 aa, Diabrotica virgifera
  misc_feature: Coding regions on vcDNA: vcDNA=SeqID_2171; Strand=+; Position=949-1125
FISRLKIRYNLDLKIYKIIVNLSVNILLFNKGRRSSGCRISDSHAGRPGFETRAGENI

SEQ ID NO: 22475 - protein, 94 aa, Diabrotica virgifera
  misc_feature: Coding regions on vcDNA: vcDNA=SeqID_2172; Strand=-; Position=2296 -2580
DYSRLSSLGLRYTRKITGPVLRFNRLLLPLVLAKELILFRLSRPGAYLKMSSCSCRRWVSNPGLPASESDILPLNYAGPYVEFIIILYIIKEFD

SEQ ID NO: 22476 - protein, 121 aa, Diabrotica virgifera
  misc_feature: Coding regions on vcDNA: vcDNA=SeqID_2173; Strand=+; Position=13-379
  misc_feature: Homolog annotation: Hit_ID=AAC24982.2; Match level="QueryCoverage =91%, HitCoverage=10%, E-value=2e-13, Identity=35%"; Hit description =reverse transcriptase [synthetic construct]
  misc_feature (28)..(28): Xaa can be any naturally occurring amino acid
  misc_feature (40)..(40): Xaa can be any naturally occurring amino acid
  misc_feature (69)..(69): Xaa can be any naturally occurring amino acid
LANKQNKKLKDKELKKVEKVTYLGSSWXRKGGCMKDIQAXITKAQFAFNALNKIWQTSEITESTKINIXNTCVKSILLYGAETWKHDESTTKRLQTFVNRSLRKILKIYWPNIITNEELWK

SEQ ID NO: 22477 - protein, 258 aa, Diabrotica virgifera
  misc_feature: Coding regions on vcDNA: vcDNA=SeqID_2174; Strand=+; Position=72-848
  misc_feature: Homolog annotation: Hit_ID=XP_394891.1; Match level="QueryCoverage =99%, HitCoverage=32%, E-value=4e-78, Identity=54%"; Hit description =similar to ENSANGP00000024539 [Apis mellifera]
  misc_feature: Pfam annotation: Pfam_ID=adh_short; Match level="Score=236.4, E-value= 5.4e-68, Copies=1"; Pfam description=short chain dehydrogenase
MSISFKGKVVLVSGGSSGLGGATAKRFGRLGANVAIAHKNIPGDTIEEVVAEISKFSTPLVIECDLTDSKQIEHVVNQTVKHFGKIDVLVNAAGILQNGSIENTTLEMFDKVMNINVRAMFEMIRVCTPHLIKTQGAIVNISSVTGLRAFPGVLAYCISKSAVDQLTRCVALELASKQVRCNSVNPGVIDTILHKRSGLNDEQYKAFLEKSRLTHALGRAGTAEEVASGITFLANTDASFVTGNNFRIDGGRGIMCPR

SEQ ID NO: 22478 - protein, 194 aa, Diabrotica virgifera
  misc_feature: Coding regions on vcDNA: vcDNA=SeqID_2175; Strand=+; Position=1-585
  misc_feature: Homolog annotation: Hit_ID=XP_308625.1; Match level="QueryCoverage =92%, HitCoverage=34%, E-value=2e-37, Identity=45%"; Hit description =ENSANGP00000018884 [Anopheles gambiae]
GYNDEDQVLGGRKFGDRPKSTGESRYGRGGDYGDDYDHDTRPTRSKYSRFRRHQATENDSDTEPNTRVRFNEHKEKERERAFDTEDASRGPLSGITRLADSPRVMKKMQEHESGKTKKKEEPTPAPVQPKVVPKRPPPPAVRQVSEDDDIARIKKQNKGATTSTDTTTETVRPATEERQRKTPAPEVSLDELEQ

SEQ ID NO: 22479 - protein, 1156 aa, Diabrotica virgifera
  misc_feature: Coding regions on vcDNA: vcDNA=SeqID_2176; Strand=+; Position=235-3701
  misc_feature: Homolog annotation: Hit_ID=EAA04156.3; Match level="QueryCoverage =100%, HitCoverage=93%, E-value=0.0, Identity=59%"; Hit description =ENSANGP00000011104 [Anopheles gambiae str. PEST] ref|XP_565060.1| ENSANGP00000011104 [Anopheles gambiae str
  misc_feature: Gene Ontology Annotation: Molecular function=signal transducer activity; Cellular component=nucleolus; Biological process=oogenesis
  misc_feature: Pfam annotation: Pfam_ID=NHL; Match level="Score=166.0, E-value=8.1e -47, Copies=4"; Pfam description=NHL repeat
  misc_feature (1129)..(1129): Xaa can be any naturally occurring amino acid
MEQFEQLLTCAICLDRYRNPKLLPCQHSFCMEPCLEGTVDYVRRQIKCPECRAEHRIPYNGVQGFPTNVTLQRFLELHIEITGELPDPTSGQIMERCNVCSEKAYCSFCSHCDKKICEECKSAHMEILRREISRINNQIRRGIHRLQDTLALVEKNSQNMQTNCLSVGEEVEEIYRRLSKALKDRTDYLRGELDRYLGTEVRSLTTLKENLELEISNILSNCDLADKHMNENVDIWDDCELMDAKEIFLKTVEFIRNFEYENADYSRKVRLVLAHDPNQLVLHVAGFGDLNLPSQSHFGQQPGLLQPPNSGLMRSKSDHRLASQFRQQEERGYGERGYNDEDQVLGGRKFGDRPKSTGESRYGRGGDYGDDYDHDTRPTRSKYSRFRRHQATENDSDTEPNTRVRFNEHKEKERERAFDTEDASRGPLSGITRLADSPRVMKKMQEHESGKTKKKEEPTPAPVQPKVVPKRPPPPAVRQVSEDDEIARIKKQNKGATTSTDTTTETVRPATEERQRKTPAPEAVSSAEESEESVNSRQQSQKKTSPKSATAATPRRPSDASHKKSARSASSESHTSSESSTSSSAVRSTGAPFTTDEVKKKILSKVEPTTPSKKNSSPVQNKPFQSRFLNKNTTAPTKEEEEDETETSSEEETESEEESDEETQKTDTKEIAKSDIGPLLARSANARDNSVESVRRKSREEAESPVRTRYGTTRDEPSKYSRSRTSTVTEEETPKYGYTSRFLSKSKSSAAVPPEDEDYSSSRYNSTADDVDSKYPASGRSRYMALKERRQRLARSRSSQQFGDDEDIDEPVSPTTSNPSAYLAAKGYGTSSSAHDLARSRSSHALKSRDNSPDRSAAAAAEKDGAALSSWARYLKSKYGNRSGAKDKDVSSSASTPSASSSGAARRLSLGLPLRSSTELASSDDDSKNMQGSPTTPTAAIAVAGIAQAVAGTTPRSQYLQKCEQLFQIGSRGSEAGCFTWPRGVAVGPDNTIVVADSSNHRVQVFDANGRFIKEFGQYGNKEGEFDCLAGVAVNRIGQYIIADRYNHRIQVFDPSGRFLRAFGSQGTADGRFNYPWGITTDALGFIYVCDKENHRVQVFQSDGTFVGKFGSMGNKEGQLGHPHYIAVXNTNRVVVSDSHNRRIQIFDVNGKVLTS

SEQ ID NO: 22480 - protein, 69 aa, Diabrotica virgifera
  misc_feature: Coding regions on vcDNA: vcDNA=SeqID_2177; Strand=-; Position=1-207
FFTLSADLYSTCLHFKDKLKKFKNAVTKNQITVDQSIHKSRAKWFYGLLRENQGYCDVAKFIRMRGWPR

SEQ ID NO: 22481 - protein, 190 aa, Diabrotica virgifera
  misc_feature: Coding regions on vcDNA: vcDNA=SeqID_2178; Strand=-; Position=346-918
  misc_feature: Homolog annotation: Hit_ID=CAA10770.1; Match level="QueryCoverage =68%, HitCoverage=38%, E-value=2e-21, Identity=41%"; Hit description =reverse transcriptase-like [Bos taurus]
MTEHLVECLAKLWWDVRIRIRIEKARIDMKQILCSRDLNLNLRKRVLKCYVFSVLLYGVETWTLNKQCLNRLEAFAMWTYRRMLRISWTDRITHEEVLRRIQNSREILDSMKIRKLQYLGHVTRGDRYEFLKLIMQGKIQGRRSIGRSKMSWLRNLREWSGCSSTELFRAVVSKVRIAMMVANMSCGDGT

SEQ ID NO: 22482 - protein, 197 aa, Diabrotica virgifera
  misc_feature: Coding regions on vcDNA: vcDNA=SeqID_2179; Strand=+; Position=150-743
  misc_feature: Homolog annotation: Hit_ID=NP_647641.1; Match level="QueryCoverage =90%, HitCoverage=93%, E-value=9e-46, Identity=47%"; Hit description =CG7970-PA [Drosophila melanogaster] gb|AAF47541.1| CG7970-PA [Drosophila melanogaster]
  misc_feature: Gene Ontology Annotation: Cellular component=integral to membrane
  misc_feature: Pfam annotation: Pfam_ID=Mpv17_PMP22; Match level="Score=24.4, E -value=1.9e-07, Copies=1"; Pfam description=Mpv17 / PMP22 family
  misc_feature (31)..(31): Xaa can be any naturally occurring amino acid
QYCSVICRTWFYQKPLVNFLSFYFGQLFEHXLRTKAITCSIIATAGNYTSQKLSGEKVINHHSLLAYGLYGLIFGGTIPHYFYSFLEGAISEDASFAVVRKLLLERLIYLPLYQAFTLYVLARMEGKSHNAAMKQLQDLYWVLLSSSWKYLTVIHLLNLSVVPPVLRVLVTNLMGFFWTIYLANKRRQQQAKSKRSQ

SEQ ID NO: 22483 - protein, 68 aa, Diabrotica virgifera
  misc_feature: Coding regions on vcDNA: vcDNA=SeqID_2180; Strand=-; Position=725-931
HILWIFINYKFGKVRNLHKILCPNFSSPNRFIKIRQIRILANKKYLVTHSESVILSDLNKKSIRFFLV

SEQ ID NO: 22484 - protein, 89 aa, Diabrotica virgifera
  misc_feature: Coding regions on vcDNA: vcDNA=SeqID_2181; Strand=-; Position=137-406
IKINKKYINTICHQKLPRDWKLPRLNVPGVFIFLIKGRKTLFIYSINKLFPKSTHTYFIISLPSIGITLNAVSSRQRETLICNAIIFKL

SEQ ID NO: 22485 - protein, 259 aa, Diabrotica virgifera
  misc_feature: Coding regions on vcDNA: vcDNA=SeqID_2182; Strand=+; Position=139-915
  misc_feature: Homolog annotation: Hit_ID=XP_392002.1; Match level="QueryCoverage =99%, HitCoverage=43%, E-value=5e-52, Identity=40%"; Hit description =similar to ENSANGP00000024998 [Apis mellifera]
  misc_feature: Gene Ontology Annotation: Cellular component=membrane; Biological process=electron transport
MLQLILVAVVIGVLFYYYGVKPLSYWKERGVKQTNPWWLCGDNWGVVLQRQSFPDLVLKGYKTAPEARYSGMYQFTLPTLVITDIDLIKQLGVKDFDYFMDHRSFIPEKADPLWGKNLFALTGQRWKEMRPILSPSFTSSKMKSMFMLMSECGEKLVKFFMEKDQNAIEIEMKDTLTRYTNDVIASAAFGVQIDSLNNTENEFYLMRKNATNFRGFWRTMKLFGYMIIPKIFEFFQVTLFDMNVRRFFTELISGTNKIR

SEQ ID NO: 22486 - protein, 123 aa, Diabrotica virgifera
  misc_feature: Coding regions on vcDNA: vcDNA=SeqID_2183; Strand=+; Position=124-495
  misc_feature: Homolog annotation: Hit_ID=EAL25060.1; Match level="QueryCoverage =95%, HitCoverage=96%, E-value=6e-29, Identity=49%"; Hit description =GA12335-PA [Drosophila pseudoobscura]
  misc_feature: Gene Ontology Annotation: Molecular function=protein binding
MEKQGNPPPYTGPYNGPPGPQAGFHMPPPGMPQDQQQQTVIVTHTVAQVPVGPTPTSTTCPSCHAQIVTSVETETTTKTHLFALLLCLFGCCLCSCIPYCVDSCQAKTHYCPNCRAYIGRFEN

SEQ ID NO: 22487 - protein, 123 aa, Diabrotica virgifera
  misc_feature: Coding regions on vcDNA: vcDNA=SeqID_2184; Strand=+; Position=119-490
  misc_feature: Homolog annotation: Hit_ID=EAL25060.1; Match level="QueryCoverage =95%, HitCoverage=96%, E-value=2e-30, Identity=50%"; Hit description =GA12335-PA [Drosophila pseudoobscura]
  misc_feature: Gene Ontology Annotation: Molecular function=protein binding
MEKQGNPPPYTGPYNGPPGPQAGFHMPPPGMPQDQQQQTVIVTHTVAQVPVGPTPTSTTCPSCHAQIVTSVETETTTKTHLFALLLCLFGCWPCCLIPYCVDSCQAKTHYCPNCRAYIGRFEN

SEQ ID NO: 22488 - protein, 321 aa, Diabrotica virgifera
  misc_feature: Coding regions on vcDNA: vcDNA=SeqID_2185; Strand=+; Position=20-982
  misc_feature: Homolog annotation: Hit_ID=XP_312606.1; Match level="QueryCoverage =89%, HitCoverage=65%, E-value=9e-63, Identity=41%"; Hit description =ENSANGP00000014953 [Anopheles gambiae]
  misc_feature: Gene Ontology Annotation: Molecular function=lipid binding; Cellular component=cellular_component unknown; Biological process =triacylglycerol metabolism
  misc_feature: Pfam annotation: Pfam_ID=Abhydro_lipase; Match level="Score=77.7, E -value=3.2e-20, Copies=1"; Pfam description=ab-hydrolase associated lipase region
  misc_feature (271)..(271): Xaa can be any naturally occurring amino acid
  misc_feature (298)..(298): Xaa can be any naturally occurring amino acid
MLIKYIAVAVILVNSIFSEPVDVDKYLPKEWRGMVKNVKVHSDIGMTIYDFLRRYNYHYENHWISTEDGYKLLLHRIPYGQNQSVPDTKPRPVVLIMHGLGASSLNWIIKGPNDALGLALADQGYDVWLGNTRGNRYSRNHERLNPDIDTTEFWDFSFELTGRYDVAAKIDYILKLTGQQKLFYIGHSQGTSQFFALTSLRPEYNDKVALMTALAPIAYLEYLSSPILRLAADNMALLQTLVNIFNIHEFSQSPLTNTLVGLVCAKESPLXDICSTYTFLTSGFDNQEFDEGFLPLYXSHVGVGMSINMLLHFGQEINHII

SEQ ID NO: 22489 - protein, 242 aa, Diabrotica virgifera
  misc_feature: Coding regions on vcDNA: vcDNA=SeqID_2186; Strand=+; Position=85-813
  misc_feature: Homolog annotation: Hit_ID=NP_573355.1; Match level="QueryCoverage =90%, HitCoverage=75%, E-value=2e-15, Identity=27%"; Hit description =CG7453-PA, isoform A [Drosophila melanogaster] gb|AAF48925.2| CG7453- PA, isoform A [Drosophila
MAQFAKVCFLLIVIISCFSRGTAQDNNTTKIVSNQTSPVVSKALVSKETTDEKTKVTTQPPPNSHKSREHVTSATEKTLDVTSNKTSKNVTSVNTTTSEVLVSKNVSQPLNITVNNAPKVVNTTSKFVNSSTQLTTNHTSSTTKATTTSTTIKPKKPLFTEHDEVVVAPAKPNLDIPILAHIDTTMEKKVRRADYVVPIVAVILSVPLVAVILSVFYKKGKDWWQHRNYRRMDYLIEGMYNS

SEQ ID NO: 22490 - protein, 63 aa, Diabrotica virgifera
  misc_feature: Coding regions on vcDNA: vcDNA=SeqID_2187; Strand=+; Position=421-612
YFKRLSNIDVYKMSQNTTAYLPHKKSSRILDMDVAVYFKFYHDLGLFNYISLLVLILVLKFVK

SEQ ID NO: 22491 - protein, 184 aa, Diabrotica virgifera
  misc_feature: Coding regions on vcDNA: vcDNA=SeqID_2188; Strand=+; Position=1-552
  misc_feature: Homolog annotation: Hit_ID=CAB59947.1; Match level="QueryCoverage =78%, HitCoverage=32%, E-value=1e-28, Identity=44%"; Hit description =acid phosphatase-1 [Drosophila subobscura]
  misc_feature: Gene Ontology Annotation: Molecular function=protein tyrosine phosphatase activity; Cellular component=extracellular; Biological process=regulation of cell cycle
SQLQLLALLFSAAFAASDLSDLDQAASDQLVAVVQLASDGHRTPTEFYTNDQYSDLSKYWGGVDLGQLTNLGKQQHYELGQFTRKRYSKWLPKRYDKADFYAQTTDVDRTHMSGQTNLYSLYPAKEDQVWRRQTDWQPIPLHPADSNIWETFPSCAAYTTELAKVLVSDLFKAIDKQYAEVYSY

SEQ ID NO: 22492 - protein, 263 aa, Diabrotica virgifera
  misc_feature: Coding regions on vcDNA: vcDNA=SeqID_2189; Strand=+; Position=42-833
MKLLLLALCTFLVGQAYSKGQAYTVTQIYPTQSLELEFNGSKVCVNTNKGAKNTTDGSNQSGEKPHSGEKPHSGEKPHSGEKPHSGENGAPNSGEENGNRGVSYTLNRTDKDNVKITVISLVSRSDKKTRDLPATNQTLCKIAIPNRKDKIIIVRFGNKISKAEADAGRGDNHSKEDKSNPKVYYRIEAVQQNGGKPLVVVGKGIASISYTKVSLKITYTISVSIQEISVVVAINGSCSSGEKGQETNLHLEEKPTSPCARDN

SEQ ID NO: 22493 - protein, 86 aa, Diabrotica virgifera
  misc_feature: Coding regions on vcDNA: vcDNA=SeqID_2190; Strand=-; Position=771-1031
GPFEGLPQIIPVGVVFPERGKVKPALKKINQPSNVEKTMLLYRYLLLMNPFLWKVLGLCTDCSSMLISLFRSSHQLSSKTTLLITG

SEQ ID NO: 22494 - protein, 248 aa, Diabrotica virgifera
  misc_feature: Coding regions on vcDNA: vcDNA=SeqID_2191; Strand=+; Position=101-844
  misc_feature: Homolog annotation: Hit_ID=XP_308424.1; Match level="QueryCoverage =63%, HitCoverage=52%, E-value=2e-19, Identity=31%"; Hit description =ENSANGP00000017923 [Anopheles gambiae]
  misc_feature: Pfam annotation: Pfam_ID=BRCT; Match level="Score=35.5, E-value=1.6e -07, Copies=1"; Pfam description=BRCA1 C Terminus (BRCT) domain
MKPKISHGYLTPQPTKKKDKRENNNARSRDNLNTGLVFNEEHFSELMKDPIKRNLIINLITKEKDKIEAYKKELAKKHPSSPLLKTMKRPCESPTQLLRRRALEQMNNPQSSETEGGSNSRPTSGQSGASTVPSPVSYDKILEGVIAFVEVKTGTKDRSDAVKAHLQTMGAVIREKITKDVTHVIFKDGSFTTYQKANLLKVHLVSVLWLEACESRHMKVSDENYPAIGTEDYDHICICHLIANALGL

SEQ ID NO: 22495 - protein, 577 aa, Diabrotica virgifera
  misc_feature: Coding regions on vcDNA: vcDNA=SeqID_2192; Strand=+; Position=46-1780
  misc_feature: Homolog annotation: Hit_ID=XP_311739.1; Match level="QueryCoverage =97%, HitCoverage=96%, E-value=1e-148, Identity=47%"; Hit description= ENSANGP00000014220 [Anopheles gambiae]
  misc_feature (429)..(429): Xaa can be any naturally occurring amino acid
MPFVPSESLSKVSWPSNESIHAGSSSSGYAGSCSSGSGFQSPSSPTSFSPISSSPDATLRKRFRRASSLGSVIQEPFVIRSDVRDSRSQSPALSCHEEEEDEFVYSLLSKLIGWYPCFLLRLMKALFIAVLPQTWRQLIFALPMLWISMWVWCFTQLMQLPLTIIKAILSFILSPNTSKNSKKRTVLITGGSTIQALHLARNFYSAGARVVVCEVEGHFALAKYSTAVSKFYTVPKPTSDKQQNYVRALCEIVDKEQAVYFIPVAATTPAYYDAVAKPHLELLGCSCFCPGIREVWVLDDTLEVLKRCQKNQITTPIYHVVTSRDDVLKLYDTGAIRRGMFVMSTAGPRGLRERSKILLPLSRNDLKIPNDISEQKPWVVVQNLEGDHYLTCTTVKESHVIANVTCKMNKNTNELVPEENREINQWLTXFFNKINLLRPISGHISFRFVLCKESGTVIPLSSRVGVSLPYICYTSVHPRLVWKPCRHFSRQNSGPLINGNGVYNMPQTVMHTVSNPSLESVTRLIGTVLDRREALFAMWDPLPYCAYYHMQIPFKNVLGFVRRRQDSFPRPMTTAVR

SEQ ID NO: 22496 - protein, 368 aa, Diabrotica virgifera
  misc_feature: Coding regions on vcDNA: vcDNA=SeqID_2193; Strand=+; Position=213-1316
  misc_feature: Homolog annotation: Hit_ID=AAL96744.2; Match level="QueryCoverage =68%, HitCoverage=18%, E-value=1e-14, Identity=22%"; Hit description =similar to Dictyostelium discoideum (Slime mold). Homeobox -containing protein (Fragment)
MKEVDDKPQKPSEKVSLFAFLEDKLPVATKEEKLYQSQPIKNNFRDPEVLSENINKFDKYDHKYKKTQIVPKQFEKPTYNNNRYQSNKETNNSRPNTTEASHQPNKSNLEVTEQKPVNNAMKSKTSYTNRYESQQQKQNVDTFNKPKQSNNNFTGYNSNNQNRNHQQQNSNSHYSQYVPHNSQPNAFQPNNVPYNIQNSHPNRSNNQYSHQNPNVHNTTINVTLNNHHHNQQIPTQPRPSTNPSRPYQNDVNHITQETQRMSINSQFASRSLRQHLNLNPNTPRKNEDYAAKGEDTMHGCNVGDEVLKYWEDGKYYNATVISVTPRTFCLSVKGYGNIGEILKTDCFTSTEKQCETKHNQNQQYDYNK

SEQ ID NO: 22497 - protein, 94 aa, Diabrotica virgifera
  misc_feature: Coding regions on vcDNA: vcDNA=SeqID_2194; Strand=+; Position=118-400
  misc_feature: Homolog annotation: Hit_ID=XP_396106.1; Match level="QueryCoverage =100%, HitCoverage=64%, E-value=5e-40, Identity=88%"; Hit description= similar to CG1709-PG [Apis mellifera]
  misc_feature: Gene Ontology Annotation: Molecular function=transporter activity; Cellular component=cytoplasm; Biological process=negative regulation of locomotion
  misc_feature (77)..(77): Xaa can be any naturally occurring amino acid
MGSLFRSAEMTLCQLFLQSEAAYACVSELGELGLVQFRDLNPDVNAFQRKFVNEVRRCDEMERKLRYLEKEINKGGXPSLVTGKIPEPQQQREM

SEQ ID NO: 22498 - protein, 96 aa, Diabrotica virgifera
  misc_feature: Coding regions on vcDNA: vcDNA=SeqID_2195; Strand=+; Position=237-527
GFFLDSLICSLAFSVTCGQFMGTLLFFVDFKICSLIFETIGADFVVLKPLKHLNCCRESYAVYSKLAYVSYLCHFLSSLFSHTLHFLRVQSIALIF

SEQ ID NO: 22499 - protein, 183 aa, Diabrotica virgifera
  misc_feature: Coding regions on vcDNA: vcDNA=SeqID_2196; Strand=+; Position=32-583
MKWFTCLLLVGVCASQVLSAPTEEKKDFATILLERAAARAEAMAKRIEESGVIDKALAGAEAIGKKIEETGVIDRALAGADALAKRVEQTGIMDKAKQTAGQLYKQVEDTGIIGKAQAEAGRLYKSIDDTGVLNQAKEQANALINSPLAESMRQRTHQVLQKVGESKLGEALAARAEPYLKMV

SEQ ID NO: 22500 - protein, 212 aa, Diabrotica virgifera
  misc_feature: Coding regions on vcDNA: vcDNA=SeqID_2197; Strand=+; Position=143-781
MKWFTYLLLVGVCASQVLSAPTEEKKDFATVLLERAAARAEAMAKRIEESGVIDKALAGAQAVGKKIEETGVIDRALAGADALAKRVEQTGIMDKAKQTAGQLYKQVEDTGIIGKAQAEAGRLYKSIDDTGVLNQAKEQANALINSPLAESMRQRTHQVLEKVGESKLGEALAARAEPYMQAVAKSGCALAKSANQDGLKLPTDYHCQEENA

SEQ ID NO: 22501 - protein, 321 aa, Diabrotica virgifera
  misc_feature: Coding regions on vcDNA: vcDNA=SeqID_2198; Strand=+; Position=2-967
  misc_feature: Homolog annotation: Hit_ID=EAA00092.2; Match level="QueryCoverage =98%, HitCoverage=97%, E-value=1e-53, Identity=36%"; Hit description =ENSANGP00000017991 [Anopheles gambiae str. PEST] ref|XP_552572.1| ENSANGP00000017991 [Anopheles gambiae st
  misc_feature: Gene Ontology Annotation: Molecular function=triacylglycerol lipase activity; Cellular component=extracellular; Biological process =triacylglycerol metabolism
  misc_feature: Pfam annotation: Pfam_ID=Lipase; Match level="Score=178.3, E-value =1.7e-50, Copies=1"; Pfam description=Lipase
NNVLVLCAILACVAAIPTSVLDRDASAELYKIQDLSQPIQLTKSVCNDDIKLYFRNQNDMDNEHALDVNNTSSLQSLGFSPEKFTILLIHGWRNEYDSDINTVLTEAYLSKYDINVFVVDWSNLADDLYVNAASAVGGVGEIVGNYIQSLVKNNNLDFDRTAVVGHSLGAHVAGIVGHALGEKLDYIVGLDPALPLFLMVHDDFRLDATDAKFVQVIHTCAGFLGIDFNIGHSDYYPNGGRDQPGCWMDVVGTCAHGRSFRYFAESIKTGGFIAKKCGSYDDFQDNNCSEESSNMGEYHIDKRASGAYYLNTNDDPPYAKN

SEQ ID NO: 22502 - protein, 384 aa, Diabrotica virgifera
  misc_feature: Coding regions on vcDNA: vcDNA=SeqID_2199; Strand=+; Position=105-1259
  misc_feature: Homolog annotation: Hit_ID=NP_997754.1; Match level="QueryCoverage =98%, HitCoverage=99%, E-value=1e-101, Identity=41%"; Hit description= Unknown (protein for MGC:85960) [Danio rerio] gb|AAH44161.1| Unknown (protein for MGC:85960)
  misc_feature: Gene Ontology Annotation: Molecular function=heterogeneous nuclear ribonucleoprotein; Cellular component=nucleus; Biological process =RNA processing
  misc_feature: Pfam annotation: Pfam_ID=RRM_1; Match level="Score=120.3, E-value =4.5e-33, Copies=3"; Pfam description=RNA recognition motif. (a.k.a. RRM, R
MSSIGGDNDDAFIAKLRGLPWSATPDDILNFFDDCSILDGKDGVHMTTSREGRPSGEAFVEFESEEDLETALQKDREHIGNRYIEVFKVNKAEMEWVVKRSGTSSGLNDDGCVRLRGLPFGCSKEEIAQFFTGLEIVPNGITLLTDYSGRSSGEAYVQFVNREVAEKALLKHREKIGHRYIEIFRSSLSEVDTVMSFQGNSMGVSGRRMGGGSSMFSSRPGPYDRDPRYGGGGGGGGRFGSSRGSRSFKDYSSYDRPSPWGGSQRNGGDMGSRSSWDSWGGSGGGGGGAGVHCVHMRGLPFKASEHDIADFFKPVVPIFVRMIQDSSGRASGEADVEFVNHEDAVRAMSKDKGHMQHRYIELFLNSSGGQSNGGFSYGIGRRRM

SEQ ID NO: 22503 - protein, 389 aa, Diabrotica virgifera
  misc_feature: Coding regions on vcDNA: vcDNA=SeqID_2200; Strand=+; Position=31-1197
  misc_feature: Homolog annotation: Hit_ID=AAO53177.1; Match level="QueryCoverage =95%, HitCoverage=19%, E-value=1e-13, Identity=23%"; Hit description =similar to Dictyostelium discoideum (Slime mold). Adenylyl cyclase
MKFFILLSLVALCSCSPAHQKQNKYEQSKNAVQGNNPYNTFWKTYSQQRQGEEPWNQWAQYGQDNQAGNYWRQYVQGKNQVGGATVPWIYHYWDNQDYENLSPAQRVQLVLNYMQVHQQWNQLNSDVNNEDYLHQLMYQHLPEYVQYNHEDVLPHLVQYFEQNPARYTNMLHQAYQYSQSQQQLMYHVMYQLYQHYGQAPWSQEQIRNQIVKYQSVYPHQLSQGQIEQLVEFVYHIQQELTPRHYQQLEQVQPQLENYLEQSPMSHQQYPWSQRQLMYHVMYELYHHYGQAPWSQEQIRNHIVQYQNAFPNQLSQEQIEQLVGFVYNIQQELMPMHYQQLEQMQPWGQYTAQPSNYQTYYSRNNQNGLSWTYKTTQQRYEAAQWSYRQT

SEQ ID NO: 22504 - protein, 265 aa, Diabrotica virgifera
  misc_feature: Coding regions on vcDNA: vcDNA=SeqID_2201; Strand=+; Position=169-963
  misc_feature: Homolog annotation: Hit_ID=EAA04767.2; Match level="QueryCoverage =100%, HitCoverage=55%, E-value=5e-58, Identity=43%"; Hit description= ENSANGP00000014993 [Anopheles gambiae str. PEST] ref|XP_565176.1| ENSANGP00000014993 [Anopheles gambiae s
  misc_feature: Gene Ontology Annotation: Molecular function=transcription factor activity; Cellular component=membrane; Biological process=regulation of transcription, DNA-dependent
  misc_feature: Pfam annotation: Pfam_ID=Ank; Match level="Score=61.7, E-value=2.1e -15, Copies=2"; Pfam description=Ankyrin repeat
MTTNRFHKAAKDGMLEVLKETTSRDCNTRDEQGMTPTLYAAFYGNLDALRLLCGRGGNPDKADLFGNTALHLAAAQGHKHIVTFLVNFGANIYSMDIDKRTPQELAGINNRDDILRFIDGIQAKMEATDKKKAKTMQDKAKEEYKKRMKNFNKQMAKQEKQNEKLERRKTKPSMMSTWKSKFIGGSMSNLAVDNQAERRPTYSSIISGTVKGNMSTVQRKILANKNNRLGQNGEEFRVSHIEDGKLTISSLKGITRDSEVLYGGT

SEQ ID NO: 22505 - protein, 84 aa, Diabrotica virgifera
  misc_feature: Coding regions on vcDNA: vcDNA=SeqID_2202; Strand=+; Position=404-658
FCIKILLVGNHHGKSLSFFSICSSSLLLFSLHCFKSFNQDMLRLPVVFSFHLLFLFLNDHKTASHVFNDTNVIDLKTYLPTLQS

SEQ ID NO: 22506 - protein, 147 aa, Diabrotica virgifera
  misc_feature: Coding regions on vcDNA: vcDNA=SeqID_2203; Strand=+; Position=109-552
  misc_feature: Pfam annotation: Pfam_ID=PBP_GOBP; Match level="Score=15.1, E-value =0.0006, Copies=1"; Pfam description=PBP/GOBP family
TTPVCHQKEGRTSVSIIGTIRSVTMNHNQLLIAFVIVASFALEGYCAAAAPESPPTNVTIKDYCIKETKISPDKVKKIEEESEEEIDEQGYCYIQCIFVSMELIDSKGNLNVKKTMAAFDDMDEECLKKVKKIMECTDMAALDDCEK

SEQ ID NO: 22507 - protein, 251 aa, Diabrotica virgifera
  misc_feature: Coding regions on vcDNA: vcDNA=SeqID_2204; Strand=+; Position=22-777
  misc_feature: Homolog annotation: Hit_ID=XP_393614.1; Match level="QueryCoverage =99%, HitCoverage=95%, E-value=1e-114, Identity=79%"; Hit description= similar to ribosomal protein L7 [Apis mellifera]
  misc_feature: Gene Ontology Annotation: Molecular function=structural constituent of ribosome; Cellular component=cytosolic ribosome (sensu Eukarya); Biological process=protein biosynthesis
  misc_feature: Pfam annotation: Pfam_ID=Ribosomal_L30; Match level="Score=100.2, E -value=5.4e-27, Copies=1"; Pfam description=Ribosomal protein L30p/L7e
MAPTADKTKTVKGLPAVPESVLKHRKRREASRAKQLQSVIKKKAEQIKKRKDIFKRAEQYVKEYRLKERDEVRLVRQAKTRGNFYVPAEAKLAFVVRIKGINKVAPKVRKVLQLFRLLQINNGVFVKLNKATINMLRICEPYITWGYPNLKSVRELIYKRGFAKVNGQRVAITSNQIVEDRLGKSGIICVEDLIHEIFTVGPKFKYASNFLWPFKLNTPTGGWRKKTNHYVEGGDFGNREDRINELLRRMV

SEQ ID NO: 22508 - protein, 361 aa, Diabrotica virgifera
  misc_feature: Coding regions on vcDNA: vcDNA=SeqID_2205; Strand=+; Position=56-1141
  misc_feature: Homolog annotation: Hit_ID=NP_610268.2; Match level="QueryCoverage =91%, HitCoverage=94%, E-value=1e-123, Identity=58%"; Hit description= CG12164-PA [Drosophila melanogaster] gb|AAF59272.1| CG12164-PA [Drosophila melanogaster]
MKCFLLLVIVGSFLIVPLNSNPVSLSRSKRSFSSQPKGYWSKKLTWKTEWVKVWKQEKKLKWVSEWKKTQVPAWKEVQVPIWKEIQVPDWKVISKPIWKEIQVPAWKEIQVPDWKEVKVPAWKEIKVPDWKEIQVPDWKEVQVPAWKQIWIPIWKEVQVPAWKEIQVPDWKKSYAPEWVKEGIHGEHYLGKDDHGSEYTAHDIWKKKLIWKPVWKKVWRTEKKQIWVPQKKMEWKSEWKQIWKTEKKQIWRTEKVQIWRTEKQQIWIPKKEQIWRTEKKQIWVPKKQLIWKQEKVQIWRTEKVQKWVTEKKEIWKDEWKQIWVPVWKTIEVPAWKKIQKPIWEKVWVSVHVHEDHHGHGWD

SEQ ID NO: 22509 - protein, 157 aa, Diabrotica virgifera
  misc_feature: Coding regions on vcDNA: vcDNA=SeqID_2206; Strand=+; Position=69-542
  misc_feature: Homolog annotation: Hit_ID=XP_392645.1; Match level="QueryCoverage =96%, HitCoverage=98%, E-value=4e-50, Identity=67%"; Hit description =similar to ENSANGP00000023074 [Apis mellifera]
  misc_feature: Gene Ontology Annotation: Molecular function=nucleic acid binding; Cellular component=cellular_component unknown; Biological process =biological_process unknown
MGRRSRSKSPFGSRRRDRDRERDKERDRDRDRDKDKERHRRKRSRDRSRDRERRRYSTERDDHRKYSRSRSRSRSPVDRRRKNKVPDRPLITAADLEGKSAEEQEMMKLMGFCNFDTTKGKKVNGNDVGDVHVILKRKYRQYMNRKGGFNRPLDFVA

SEQ ID NO: 22510 - protein, 257 aa, Diabrotica virgifera
  misc_feature: Coding regions on vcDNA: vcDNA=SeqID_2207; Strand=+; Position=87-858
  misc_feature: Homolog annotation: Hit_ID=NP_611232.1; Match level="QueryCoverage =100%, HitCoverage=38%, E-value=1e-101, Identity=69%"; Hit description=CG6501-PA [Drosophila melanogaster] gb|AAF57834.1| CG6501-PA [Drosophila melanogaster]
  misc_feature: Gene Ontology Annotation: Molecular function=GTPase activity; Cellular component=nucleus; Biological process=biological_process unknown
  misc_feature (95)..(95): Xaa can be any naturally occurring amino acid
MPKVRSTTGAPRKQGFNRSNHSMNPERPTEGLKGVSKVRTKGTIKRLQMYRNFKAKRDKTGKILTPAPFQGRLPSGTQARVEPNQKWFGNSRVIXQNTLQKFQTEVGSALKNPFQVVMKPTTLPITLLNEKAKNARVHLLYTESFQSVFGPEKSRKRPNIGVKGLEELTELADKSANEYSQEKDSNVVRDDGGVRDLPRDWVMAAGQSRRIWNELYKVVDSSDVLLQVLDAIDPMITRSAYVEKYVKTEKPHKHLIF

SEQ ID NO: 22511 - protein, 248 aa, Diabrotica virgifera
  misc_feature: Coding regions on vcDNA: vcDNA=SeqID_2208; Strand=+; Position=128-875
  misc_feature: Homolog annotation: Hit_ID=XP_318886.1; Match level="QueryCoverage =93%, HitCoverage=43%, E-value=2e-60, Identity=53%"; Hit description =ENSANGP00000015835 [Anopheles gambiae]
  misc_feature: Gene Ontology Annotation: Molecular function=nuclear localization sequence binding; Cellular component=nucleoplasm; Biological process= NLS-bearing substrate-nucleus import
  misc_feature: Pfam annotation: Pfam_ID=Arm; Match level="Score=95.3, E-value=1.6e -25, Copies=2"; Pfam description=Armadillo/beta-catenin-like repeat
  misc_feature (202)..(202): Xaa can be any naturally occurring amino acid
MADENRIRSFKNKGKDTEEMRRRRIGQTVELRKARKDDQLLKRRNISTSEEPTSPLQENNSVSSPTMSAEEIMYGMMNSDEAIQYRATLACRKILSREKTPPIDHMIRLGVVPRCVEFLTKAHNPSLQFEACWALTNIASGTSEQTAAVVQEGAIPRLQGLLSSPRIDVAEQAVWALGNIAGDGSATRDMVLSCNVLNDLLXLITPTTSLSLLRNNRVDYFLIWGEIKNPSPDFNLSSARPSIYSTFF

SEQ ID NO: 22512 - protein, 315 aa, Diabrotica virgifera
  misc_feature: Coding regions on vcDNA: vcDNA=SeqID_2209; Strand=+; Position=59-1006
  misc_feature: Homolog annotation: Hit_ID=XP_318631.1; Match level="QueryCoverage =98%, HitCoverage=88%, E-value=1e-101, Identity=57%"; Hit description= ENSANGP00000021029 [Anopheles gambiae]
CPAGFLIQTFNMSVIQLDTEDKLEYSFFPNSSGFVQFRVRAANDAHLALTTQAAECEPMYEIFIGGWGNSKSIIRKNRSKPDVAEVPTPGILHPNEFRGFWIRWQNGNIAVGRENEQAPFLSWNDYEPIHNIEYVGVCTGWGANGSWVVEPPQSGGGGGGYGAPQNYTAPRSNFSSVCWAPGRSGQVPPRAFAGGEDNGEPLYVIRSQFNGGLLPGKLVPSHGVGYVAWGGQENAVHEYEVLCDFPGQWVATSRGNIPPNALTAGQSEDGEPLYVGRVVHDGALTVGKVQQSHGVCYIPYGGQEMSFPDYEILVQ

SEQ ID NO: 22513 - protein, 469 aa, Diabrotica virgifera
  misc_feature: Coding regions on vcDNA: vcDNA=SeqID_2210; Strand=+; Position=1-1411
  misc_feature: Homolog annotation: Hit_ID=NP_726062.2; Match level="QueryCoverage =96%, HitCoverage=27%, E-value=1e-129, Identity=51%"; Hit description= CG9485-PB, isoform B [Drosophila melanogaster] gb|AAM70868.2| CG9485 -PB, isoform B [Drosophila
  misc_feature: Gene Ontology Annotation: Molecular function=4-alpha -glucanotransferase activity; Cellular component=cellular_component unknown; Biological process=glycogen catabolism
  misc_feature (434)..(434): Xaa can be any naturally occurring amino acid
LVPSVAHALFLDQTHDNPSPVEKRSVFDLLPSTALINMACCASGSNRGYDELVPHHIHVVDEDREYTEWTATDNLSVGNLRYVTHKCGILKAKKAINDLHFLLGKQGFNQVYVDQMDADIVAVTRHCPVTHQSYILVAFTAFGHPNEDAGEHQRGIKPLRFEGNLDEIVLEATLSHVKHKSGGSKYTKWHPFIKDCKWINGLPDYQVCVKEHIQVPDSDIFEKVDSGTKNVTQLNFKNFKPGSVVVIKSSLPEPMRAAIKTVRTLISSISLAKPTELATIVNKMTLADMNRALYRCGQEERDEGFGFDTYNIPSFGSMVYAGLQGFMSLLANIRPNNDLGHPMCANLRDGNWMIEFIWKRLKLDPGTKELGDWIERNTKSFENIPRYLVPCYFDIVVTGLYLVLLEKTHKLMSNFVKNGSTFVRGLALGSVQFXAYIKSADLPTLSPNLAPPKPPSRKNWKTTLGSSLV

SEQ ID NO: 22514 - protein, 308 aa, Diabrotica virgifera
  misc_feature: Coding regions on vcDNA: vcDNA=SeqID_2211; Strand=+; Position=3-929
  misc_feature (302)..(302): Xaa can be any naturally occurring amino acid
LFIVFVKCMDKNPAPRFGIYERKDGRYFLKVIFFYVILTIIGFKRRLSNLRKKFRPLEKTQTLSFSQKNIDVISLEGSDKYGDSVILKITRRNSKQTGYMFLKIGESKFKASISLDPYVDKNEDYGETFSTDDLKLNIIEPLKAWKVTYRGEMADCDHNISKSHKVEVQGIWITDIPVFHFEDADALNFAKCLAYEKWNRDHFLNLKRSKATHYEQFGTLLVKVKIDDQVHKLKIDTIKSRYLGHDNMSYVWKGCVHRFIIDGRDCFTLRHTCNPIVTSRLIEAWVHQQILSLRRALSSAYXTYALNQ

SEQ ID NO: 22515 - protein, 63 aa, Diabrotica virgifera
  misc_feature: Coding regions on vcDNA: vcDNA=SeqID_2212; Strand=-; Position=141-332
LNLSHSRNRIYAFEEVFMQLLVLIPITDWKSRPEAHVKNQKESFHDLKHCVPRFTRENSLRGH

SEQ ID NO: 22516 - protein, 122 aa, Diabrotica virgifera
  misc_feature: Coding regions on vcDNA: vcDNA=SeqID_2213; Strand=+; Position=76-441
  misc_feature: Homolog annotation: Hit_ID=XP_392590.1; Match level="QueryCoverage =83%, HitCoverage=16%, E-value=3e-28, Identity=53%"; Hit description =similar to CG10327-PA [Apis mellifera]
  misc_feature: Gene Ontology Annotation: Molecular function=transcription factor activity; Cellular component=nucleus; Biological process=mitosis
  misc_feature: Pfam annotation: Pfam_ID=RRM_1; Match level="Score=51.7, E-value=2.1e- 12, Copies=1"; Pfam description=RNA recognition motif. (a.k.a. RRM, RB
MAGSVPLPRRVYVGRLTEEITAEDVRQYFKKFGEVTDVYMPKDFKAFCFVTFLDPEIAQALCGEDHIIKGSSVYVSDAAPKNNSRKPVTNGRGGDNNNVGHSFKGNNFQIKMTGSMEMIGIK

SEQ ID NO: 22517 - protein, 277 aa, Diabrotica virgifera
  misc_feature: Coding regions on vcDNA: vcDNA=SeqID_2214; Strand=+; Position=70-900
  misc_feature: Homolog annotation: Hit_ID=AAH75213.1; Match level="QueryCoverage =67%, HitCoverage=57%, E-value=6e-24, Identity=33%"; Hit description =MGC84305 protein [Xenopus laevis]
MVERIIPIQMEDDDNSGEESGANANGNVNSDTTKESCVENSQEKSDHKESSPNNEKEQKLLILIKPMSKTKDLLENLKKYDVFEERSKFSLPNINVPEKIILVIDRAQDEHCTSFAEANGKYTPLSMLRKSLHLFVNLKHSINKNHEFAIVLLNENTATWALPFTSELRKVNNCIEKITQCEVEDTFNMNLVFEEILPNIKIPQDEIAPPYIIRTIICYGRSYTIPEIKFSEKIVKLLDNPFFICDVLMTHEPVDDSNYCNKIFECLQNIDRKGISY

SEQ ID NO: 22518 - protein, 149 aa, Diabrotica virgifera
  misc_feature: Coding regions on vcDNA: vcDNA=SeqID_2215; Strand=-; Position=3-453
  misc_feature: Homolog annotation: Hit_ID=CAA10770.1; Match level="QueryCoverage =87%, HitCoverage=40%, E-value=3e-11, Identity=33%"; Hit description =reverse transcriptase-like [Bos taurus]
  misc_feature (56)..(56): Xaa can be any naturally occurring amino acid
MMDVLTKAQMVVKDRRIIQNLHWNQSATIRTNLEDEPTEAIQILRGVRQGCICIFXLFSDFDHRTLLNRERLNNIRYADGSVIFADSLNSLQQLINKVNNVSKRFGLQVNISKTKFIVIRKNKITDVQLLIKNTPVDRVKQFTYLGTIA

SEQ ID NO: 22519 - protein, 237 aa, Diabrotica virgifera
  misc_feature: Coding regions on vcDNA: vcDNA=SeqID_2216; Strand=+; Position=2-715
  misc_feature: Homolog annotation: Hit_ID=EAL34261.1; Match level="QueryCoverage =96%, HitCoverage=18%, E-value=6e-83, Identity=65%"; Hit description =GA21563-PA [Drosophila pseudoobscura]
  misc_feature: Gene Ontology Annotation: Molecular function=ATP binding; Cellular component=cytoplasm; Biological process='de novo' IMP biosynthesis
  misc_feature: Pfam annotation: Pfam_ID=AIRS_C; Match level="Score=110.4, E-value =4.4e-30, Copies=1"; Pfam description=AIR synthase related protein, C- termin
DYGNKFGEPLISGFVRSFGLVDAAGERKEWIKPIMFSGGIGSMEADMTEKLPPKLGHQIIKIGGPVYRIGVGGGSASSVEVQGDNKVELDFNAVQRGDAEMENKLNRVVRACLELGSKNPIVSIHDQGAGGNGNVLKELVEPVGGIIYANKFDLGDPTINVLELWGAEYQENNALLCKKEDLPRLKSICARERCPVNVVGEVTDTRRVVLALDESKAGTPFNLGLGHVFRKDASEGP

SEQ ID NO: 22520 - protein, 436 aa, Diabrotica virgifera
  misc_feature: Coding regions on vcDNA: vcDNA=SeqID_2217; Strand=+; Position=28-1338
  misc_feature: Homolog annotation: Hit_ID=XP_392420.1; Match level="QueryCoverage =86%, HitCoverage=38%, E-value=6e-18, Identity=24%"; Hit description =similar to ENSANGP00000010741 [Apis mellifera]
MVGMPFMANAGTRVQSIPVEVRASRAQPRSQNGTPDSTAAAPTFELTYLRASTGNETPTTTASDAGTGSDTGGTGADTTPNNQEGQQQGAGHNFNNPNVEFFMEVTPEVLRGALNGPPPELLNSLMQMAGQIMNRNIATTTTTASPTPATTSSESSQAQSGAGQGTTPNRGQNSQPRGGAQTNPTTSTHTRQGSRSGRHFRSRSHRCGFDPFLPCSSHHITRRRVNIDHLPPPPNWQPTAATNEPNTANNDDDGGPPDFQSLVNAFLSVRNSGSRRIGPLQANNEAGTSTSTTSINMPNSIDSIGAFNLPQISSIFSLTDMNGDLLQESTNPLRPDSTLEELVNQFQDEQYIPGENLLVDLIMLFVRNFSIVDILSLYGGSVEPINRHVRVLKAFFRTRICESDTTPSGIDRGIDRIIRELQPFLENFRTCQFKTI

SEQ ID NO: 22521 - protein, 534 aa, Diabrotica virgifera
  misc_feature: Coding regions on vcDNA: vcDNA=SeqID_2218; Strand=+; Position=95-1699
  misc_feature: Homolog annotation: Hit_ID=XP_393300.1; Match level="QueryCoverage =100%, HitCoverage=98%, E-value=0.0, Identity=81%"; Hit description =similar to CG7033-PA [Apis mellifera]
  misc_feature: Gene Ontology Annotation: Molecular function=chaperone activity; Cellular component=cytoplasm; Biological process=regulation of cell cycle
  misc_feature: Pfam annotation: Pfam_ID=Cpn60_TCP1; Match level="Score=570.9, E -value=1e-168, Copies=1"; Pfam description=TCP-1/cpn60 chaperonin family
MVSLNPVRILKQEAEEERAEIARLSSFVGAIAIGDLVRSTLGPKGMDKILVSSGRSAGSVEVTNDGATILKSVGVDNPAAKILVDMSKVQDDEVGDGTTSVTVLASELLKEAEKLVEQKIHPQTIIAGWRKAVDIARKALLETAKDNSSDSEKFREDLMNIARTTLSSKILSQHKEYFAKLAVDAVLRLKGTGDLQSIQLIKKTGGTLEDSFLDEGFLLDKKPGVHQPKRVENAKILIANTPMDTDKIKVFGSHIKVDSMAKIAELESAEKEKMKDKVNKILKHNANVFINRQLIYNYPEQLFADAGVMAIEHADFDGIERLALVTGGEIVSTFDHPELVKLGTCKLIEQIMIGEDILLRFSGVALGEACTIVIRGATQQIIDEADRSLHDALCVLSATVKESRIVYGGGCSETLMSTAVSRAAANTPGKEDVAMEAFARALLQLPTNIADNAGYDSAQLVSELKAAHNSGQSTMGLNMEKGELGDMKTLGITESFVVKRQVLVSASEAAEMILRVDNIIKAAPRRRTEDRGMC

SEQ ID NO: 22522 - protein, 121 aa, Diabrotica virgifera
  misc_feature: Coding regions on vcDNA: vcDNA=SeqID_2219; Strand=+; Position=12-377
SYTDICIKMYTKIPVLFVIVAIFAFSDGVSVSACVDVNDGSQLICDKDLENKISIHNKAENMISFKLETCRQVQHYTNLGIGANVVVSSGSCNEPFYISQCTIHGRGAKCIDTVTIRPFVY

SEQ ID NO: 22523 - protein, 290 aa, Diabrotica virgifera
  misc_feature: Coding regions on vcDNA: vcDNA=SeqID_2220; Strand=+; Position=283-1239
  misc_feature: Homolog annotation: Hit_ID=AAO53194.1; Match level="QueryCoverage =91%, HitCoverage=40%, E-value=3e-14, Identity=21%"; Hit description =similar to Plasmodium falciparum. Hypothetical protein [Dictyostelium discoideum]
MDYNNNGDLVLVNGEGAEFMISVSTPMLSLHERFSVNNPKEDNIMMNPLNLEEMDLEETGWIEKINEDDITGSSSDKQNEENSSESSDTVANDDGNVENLTDKGSIEDPKSTPNVIVCDNISEKINNQLTDAMQNIKLIVNNSNLNIEHSTNVNNELSQLNSNVTTEDKITNTNKDTNDNEQKVNINNNVCGEESSNILNGAGDSIHLESNSADGSKSDNNNSTVSIDESDVTNDGTNENSVAEKSEPPEPPQKIVPQILVDHYIAMTYPMLSLNIEYENGIPAHTLFQL

SEQ ID NO: 22524 - protein, 246 aa, Diabrotica virgifera
  misc_feature: Coding regions on vcDNA: vcDNA=SeqID_2221; Strand=+; Position=203-938
  misc_feature: Homolog annotation: Hit_ID=XP_311836.1; Match level="QueryCoverage =89%, HitCoverage=40%, E-value=6e-67, Identity=51%"; Hit description =ENSANGP00000017608 [Anopheles gambiae]
  misc_feature: Gene Ontology Annotation: Molecular function=organic cation transporter activity; Cellular component=integral to plasma membrane; Biological process=organic cation transport
  misc_feature (202)..(202): Xaa can be any naturally occurring amino acid
  misc_feature (205)..(205): Xaa can be any naturally occurring amino acid
  misc_feature (229)..(229): Xaa can be any naturally occurring amino acid
MTTSTIQNGKEKETATPTEVEVEQEDIIQKCIGVLGRWHIWLCFIIFLVKFGVSWHQLSIVFLAPPIKYYCINNATETCLSNCTHYLYDTSIFTNTISMEWDLVCSKSYLVSLTQTLTMLGILVGNMLFGYLSDKFGRKLPLVLAVALQGLSGLGAAFSPWFTLFIILKFLSAVATGGTMITSFVLIMEIIGTEWRTVLAIXYQXPFNLGHLLMPLFSYYLRNWRHFQXMISVPSLFLISYYWILP

SEQ ID NO: 22525 - protein, 293 aa, Diabrotica virgifera
  misc_feature: Coding regions on vcDNA: vcDNA=SeqID_2222; Strand=+; Position=105-986
  misc_feature: Homolog annotation: Hit_ID=XP_395522.1; Match level="QueryCoverage =93%, HitCoverage=53%, E-value=3e-76, Identity=47%"; Hit description =similar to ENSANGP00000017608 [Apis mellifera]
  misc_feature: Gene Ontology Annotation: Molecular function=organic cation transporter activity; Cellular component=integral to plasma membrane; Biological process=organic cation transport
  misc_feature (277)..(277): Xaa can be any naturally occurring amino acid
METEEKQNEASGLLQTVQNGKEKETATPTEVEAEQEDIIQKCIGVLGRWHIWLCFIIFLVKFGVSWHQLSIVFLAPPIKYYCINNATETCLSNCTHYLYDTSIFTNTISMEWDLVCSKSYLVSLTQTLTMLGILVGNMLFGYLSDKFGRKLPLVLAVALQGLSGLGAAFSPWFTLFIILKFLSAVATGGTMITSFVLIMEIIGTEWRTVLGILYQIPFHLGHLLMALFSYYLRNWRHFPIMISVPSLFLISYYWILPESPRWQLAVGKEKQAIETLXKAARAEQATNRNRTRR

SEQ ID NO: 22526 - protein, 108 aa, Diabrotica virgifera
  misc_feature: Coding regions on vcDNA: vcDNA=SeqID_2223; Strand=+; Position=104-427
  misc_feature: Homolog annotation: Hit_ID=XP_394528.1; Match level="QueryCoverage =98%, HitCoverage=19%, E-value=4e-42, Identity=74%"; Hit description =similar to CG4258-PA [Apis mellifera]
  misc_feature: Gene Ontology Annotation: Molecular function=molecular_function unknown; Cellular component=nucleolus; Biological process=rRNA processing
MPNSDIDDNEKVTGPVDNAWELKIPEFKPEDNPHGLLEESSFATLFPQYREQYLRQVWPLVKKTLGEYNIKAELDVVEGSMTVKTTRQTWDPYIIIKARDVIKLMSRS

SEQ ID NO: 22527 - protein, 86 aa, Diabrotica virgifera
  misc_feature: Coding regions on vcDNA: vcDNA=SeqID_2224; Strand=-; Position=214-474
KKVPYVTEKECDGLGEIWQHYLTTLPLSLSPNPFASLHLHCSISQHCLTTLPLSLSHPFPLAASALLSVGLASLRRWRSRSLCYVF

SEQ ID NO: 22528 - protein, 274 aa, Diabrotica virgifera
  misc_feature: Coding regions on vcDNA: vcDNA=SeqID_2225; Strand=+; Position=52-876
  misc_feature: Homolog annotation: Hit_ID=XP_397536.1; Match level="QueryCoverage =61%, HitCoverage=80%, E-value=3e-33, Identity=45%"; Hit description =hypothetical protein XP_397536 [Apis mellifera]
MKSVTVPIFLLALAVQTSLAGVISDQNYNNQQNYDQEKQETFNHQEHSDYGSNDIGDHEAQISQQATGGEHGGGDYGGDHGGYGDQQGWTGYSGEAGHDGGAQQSHASLENLGNLGSLISHGINLGGHDAGHEGGHDIGGADLHPQVEVQHDHIPTHTIEKTKEVPVTVVKKIGVPVPHPVGVPTPQIIKVPVPQPYAVHVPVPHPIAVPIYKLVPQEIEKRVPIHVEKLVPVYVEKPVKIEIEKHHVEYYDKPYPVHVPVYKHVLHTSGHKKW

SEQ ID NO: 22529 - protein, 273 aa, Diabrotica virgifera
  misc_feature: Coding regions on vcDNA: vcDNA=SeqID_2226; Strand=+; Position=577-1635
MGICHVILMKIGTQDGTNGMNLGPKSLKHLSCPHSRTRIHLKNRNQRNQFPGETQGVNLFNPQRSSFIQERSPGQDPPENRNQRNQFRGETQGVNLFNPQRSSFIQERSPGQDPPENRNQRNQFRGETQGVNLFNLQRSSFIQERNPLNSERNRNAKNVSGTSFWSNNRNERNEFLPETRDVSPFNPQRGPLIPERSPLPERSSLEQYGSSNNQQAKSVSGSSFWSKSRFERNEFRPETRDISPVTPQRNPIIPERSTLNFKKRFSRAIWKAE

SEQ ID NO: 22530 - protein, 290 aa, Diabrotica virgifera
  misc_feature: Coding regions on vcDNA: vcDNA=SeqID_2227; Strand=+; Position=213-1082
  misc_feature: Homolog annotation: Hit_ID=NP_573214.1; Match level="QueryCoverage =73%, HitCoverage=21%, E-value=8e-33, Identity=42%"; Hit description =CG8611-PA, isoform A [Drosophila melanogaster] gb|AAF48727.2| CG8611- PA, isoform A [Drosophila
  misc_feature: Gene Ontology Annotation: Molecular function=molecular_function unknown; Cellular component=nuclear membrane; Biological process =nucleobase, nucleoside, nucleotide and nucleic acid metabolism
  misc_feature: Pfam annotation: Pfam_ID=DEAD; Match level="Score=24.6, E-value=1.7e -07, Copies=1"; Pfam description=DEAD/DEAH box helicase
MTTFKFTFDKNKKPPKGVLVAKKRKATSEDTIIPKKLAKNKVLNESDNTKIKKRTEKPPKVVSSSETNTANTQQGIGNKNLDIRQATNTLNNEKSSDFSPNTSQKFIKRKWKKDKLAAKKAAAEGNTPTHTDPQKKPQQYSLFNTGHTTRPVKGNAKGKSVVEKVFSADKKFSDLDIHKYIVSNLEKHHFTTLTNVQEKSIPAILQGQNVLVRSQTGSGKTLAYAVPVLQALQNINPRIQRTDGVQVIIVVPTKELALQSYELFKKINTFQWIVVGNLCGGENRNTEKTR

SEQ ID NO: 22531 - protein, 822 aa, Diabrotica virgifera
  misc_feature: Coding regions on vcDNA: vcDNA=SeqID_2228; Strand=+; Position=818-3286
  misc_feature: Homolog annotation: Hit_ID=BAB17302.1; Match level="QueryCoverage =76%, HitCoverage=66%, E-value=2e-92, Identity=34%"; Hit description =inter-alpha-trypsin inhibitor heavy chain3 [Oryctolagus cuniculus]
  misc_feature: Gene Ontology Annotation: Molecular function=endopeptidase inhibitor activity; Cellular component=extracellular space
  misc_feature: Pfam annotation: Pfam_ID=VWA; Match level="Score=72.8, E-value=9.6e -19, Copies=1"; Pfam description=von Willebrand factor type A domain
MKVKFLILPFLVILNLRAVFSAPGDVSFIISTTEQPKEGKEGVTTDIEDVYLVPVIYEMDVHSNVTNRYAKTVITNRVKNPAKSAKQTTFSVVLPEKAFISEFVMEIGWNKYQAYVREKEEAKKIYTKAVESGQSAAHVAISTKDSNTFTVSVNVGAEEKATFYLTYEELLERKNNQYDLVLNIRPGQIVDHLNVQVYINESRPLVFVKTPSLRSGNEIAKNSDKLDPASFVEIINSTSALVKFQPDVVKQQEYAKELGGIELNGLAAQFIVQYEVERDPQGGEVLLQDGYFVHFFVPKDAEVIPKHVYFILDTSSSMYGNKLQQVKDAMTSILEEIKPEDSLSIVEFNSEIYVWDIDNEKSVLAQWDNYREPFEQLGKLNLPGPVSATKEAIEKAKKLVENMQAGGGTHMIGGLDAGLYLVKSEIERTKESNDHRQPLIIFLTDGQPNIGLHSTIEIIDVVTKLNENNIKTPLYTLAFGDSADENFLRKLSLKNKAFSRQIYESADAAIQLQQFYRQISSPLLSDVHFKYNDDASEVTNTGFPILYAGGEIVVTGRFVGNQFDPTIRAVGKQGPLTYRPRVHKPVNSLERLWAYLTVRETLQKMKIAKDKTKTELTKKALKLALQYSFVTEVTSLVVVKPNSTHPIYPDDGYPIPRPAYPYAPAEASGYGGGGFAGGLRSEVAQDSDLIVNRPAPRIVHKKVRKPKVQATTVKPLPKNTTVEDSLKWLSAALSEKKTLSLPSGELKLGEDSLNITPSEACPKTPEGKEGGFALSLKKLSSSIPPQLTDFPKYTKSSLVPCKTKMLGGSVGPQKKNAEMALA

SEQ ID NO: 22532 - protein, 154 aa, Diabrotica virgifera
  misc_feature: Coding regions on vcDNA: vcDNA=SeqID_2229; Strand=+; Position=59-523
  misc_feature: Homolog annotation: Hit_ID=XP_393511.1; Match level="QueryCoverage =100%, HitCoverage=100%, E-value=8e-69, Identity=80%"; Hit description=similar to ribosomal protein S19 [Apis mellifera]
  misc_feature: Gene Ontology Annotation: Molecular function=structural constituent of ribosome; Cellular component=cytosolic ribosome (sensu Eukarya); Biological process=protein biosynthesis
  misc_feature: Pfam annotation: Pfam_ID=Ribosomal_S19e; Match level="Score=335.8, E -value=6.2e-98, Copies=1"; Pfam description=Ribosomal protein S19e
MPSVTLKDVDQHKFVKAFSSFLKKTGKLRVPEWVDLVKTSRAKELAPYDPDWYYVRCAAIARHIYIRSPVGVGSVTKIFGSRKRNGTKPSHFCRSAGSIARKALQSLETVKLIEKSADGGRKITQQGRRDLDRIAAQVKAKERKALKASGVLTL

SEQ ID NO: 22533 - protein, 154 aa, Diabrotica virgifera; identical to SEQ ID NO: 22532
  misc_feature: Coding regions on vcDNA: vcDNA=SeqID_2230; Strand=+; Position=80-544
  misc_feature: Homolog annotation: Hit_ID=XP_393511.1; Match level="QueryCoverage =100%, HitCoverage=100%, E-value=8e-69, Identity=80%"; Hit description=similar to ribosomal protein S19 [Apis mellifera]
  misc_feature: Gene Ontology Annotation: Molecular function=structural constituent of ribosome; Cellular component=cytosolic ribosome (sensu Eukarya); Biological process=protein biosynthesis
  misc_feature: Pfam annotation: Pfam_ID=Ribosomal_S19e; Match level="Score=335.8, E -value=6.2e-98, Copies=1"; Pfam description=Ribosomal protein S19e

SEQ ID NO: 22534 - protein, 313 aa, Diabrotica virgifera
  misc_feature: Coding regions on vcDNA: vcDNA=SeqID_2231; Strand=+; Position=47-990
  misc_feature: Homolog annotation: Hit_ID=XP_517904.1; Match level="QueryCoverage =97%, HitCoverage=53%, E-value=1e-113, Identity=62%"; Hit description= PREDICTED: similar to Antiquitin [Pan troglodytes]
  misc_feature: Gene Ontology Annotation: Molecular function=aldehyde dehydrogenase (NAD+) activity; Cellular component=cellular_component unknown; Biological process=aldehyde metabolism
  misc_feature: Pfam annotation: Pfam_ID=Aldedh; Match level="Score=27.4, E-value =1.9e-18, Copies=1"; Pfam description=Aldehyde dehydrogenase family
  misc_feature (267)..(267): Xaa can be any naturally occurring amino acid
  misc_feature (298)..(298): Xaa can be any naturally occurring amino acid
MASGEFLINDSKYSFLKDLGLKERNLGVYDGAWKGSGAVVQSICPSNGKVIAEVQQGSITDYESCVEASKAAWNVWADLPAPARGEIVRQIGNALRENLVPLGKLVSIEMGKILPEGIGEVQEYVDICDYAVGLSRTLAGSIFPSERPGHVLLEKWNPLGVIGVISAFNFPIAVYGWNSAIAMVCGDTVLWKGAETTPLVSLATTKIVADVLKKNNLPGAVASLCCGGADVGKAMAADHRIKLLSFTGSTHIGHRWGVEVQKRFGKXLVELGGNNAIIVTEDPDLDMVGPARLFGWLXPAGQRWTTTKKIVTT

SEQ ID NO: 22535 - protein, 217 aa, Diabrotica virgifera
  misc_feature: Coding regions on vcDNA: vcDNA=SeqID_2232; Strand=+; Position=65-718
  misc_feature: Homolog annotation: Hit_ID=EAA13809.3; Match level="QueryCoverage =100%, HitCoverage=99%, E-value=1e-120, Identity=90%"; Hit description=ENSANGP00000012279 [Anopheles gambiae str. PEST] ref|XP _554099.1| ENSANGP00000012279 [Anopheles gambiae
  misc_feature: Pfam annotation: Pfam_ID=Lectin_C; Match level="Score=21.7, E-value =5.7e-06, Copies=1"; Pfam description=Lectin C-type domain
MLRQLMLLLVGAVAVMAQRRLALPDPRSCANRVRHATYRDARGVTHSYFFSWEHGPTRGLEVDWLDARNICRRHCMDAVSLETPQENEFIKQRIARGNVRYIWTSGRKCNFAGCERADLQPPNINGWFWSGSGAKIGPTTQRNTGDWSYTGGFGQQQPDNREAAQGNDESCLSILNNFYNDGLKWHDVACHHVKPFVCEDSEELLNFVASRNPGIRL

SEQ ID NO: 22536 - protein, 58 aa, Diabrotica virgifera
  misc_feature: Coding regions on vcDNA: vcDNA=SeqID_2233; Strand=-; Position=50-226
TMLYLFPSFFFHRLEQQITILKETKKFKNSKFKKQKDISKESFSIMDPHQCLIVILTV

SEQ ID NO: 22537 - protein, 308 aa, Diabrotica virgifera
  misc_feature: Coding regions on vcDNA: vcDNA=SeqID_2234; Strand=+; Position=192-1115
  misc_feature: Homolog annotation: Hit_ID=AAV91017.1; Match level="QueryCoverage =99%, HitCoverage=78%, E-value=2e-25, Identity=34%"; Hit description =hemolymph proteinase 19 [Manduca sexta]
  misc_feature: Gene Ontology Annotation: Molecular function=thrombin activity; Cellular component=soluble fraction; Biological process=STAT protein nuclear translocation
  misc_feature: Pfam annotation: Pfam_ID=Trypsin; Match level="Score=-11.2, E-value =0.0026, Copies=1"; Pfam description=Trypsin
MRLTYVVFILLAVAQKIKGAIESPCPKVFVFEPDKSIDDRWYGLISLTTQRSIKGITLELEFDKSIIQLGNWLGGVTSDDDNTIFTIKNDNKEVNAGQTYKAEIYVVYDPYYDLEPPRLVRIKFNGREICPHYEEEKVSTTILVESNDNNKPTILLNINVPRCGVTIATQIGLITHGEYTKPGQYPWHAALYRKEGSNRIYICGASLISEQHVITAAHCTTIDTQTRNPNDMVIVLGKHGLWVDGQNEQTFAATKIIVHESFNRSNFFNDISIIKLDKPSQYTKWVRPICLWEEDTDLTNIVNHTGTA

SEQ ID NO: 22538 - protein, 215 aa, Diabrotica virgifera
  misc_feature: Coding regions on vcDNA: vcDNA=SeqID_2235; Strand=+; Position=69-716
  misc_feature: Homolog annotation: Hit_ID=XP_395615.1; Match level="QueryCoverage =83%, HitCoverage=66%, E-value=6e-38, Identity=38%"; Hit description =similar to ENSANGP00000021546 [Apis mellifera]
  misc_feature: Pfam annotation: Pfam_ID=DUF1397; Match level="Score=114.0, E-value =3.8e-31, Copies=1"; Pfam description=Protein of unknown function (DUF1397)
MRVEIFLLILIAAVCYSIPTIPDLDDFEELKTKCDKRGGNGTFAKIKTSIDETQTCIEDLIDIDKFAEELEESKKTGSMDEVFAKYCKKRPDVRKCIKKFYDALEPCLDEAEKKGLNFTYSILTEISDFACAKDGDRLALFVAEGGPDCIKSKTEGIQKCLNQTLQFNPDNISKLSIKLAIDKKTCDDLGQVQTCVVAELEKCKESTPANSRRTF

SEQ ID NO: 22539 - protein, 438 aa, Diabrotica virgifera
  misc_feature: Coding regions on vcDNA: vcDNA=SeqID_2236; Strand=+; Position=34-1347
  misc_feature: Homolog annotation: Hit_ID=XP_315413.1; Match level="QueryCoverage =96%, HitCoverage=79%, E-value=1e-168, Identity=66%"; Hit description= ENSANGP00000014225 [Anopheles gambiae]
  misc_feature: Gene Ontology Annotation: Molecular function=mannose binding lectin; Cellular component=Golgi membrane; Biological process=ER to Golgi transport
  misc_feature: Pfam annotation: Pfam_ID=Lectin_leg-like; Match level="Score=437.9, E- value=1.2e-128, Copies=1"; Pfam description=Legume-like lectin family
MNICTQIFCGRHWRYCNLKPPYLAQKDGSVPFWEYAGNAIASSENVRLAPSLRSQKGAIWTKNPINFDWWDVDISFRVTGRGRIGADGLAFWYTQNKGSVTGEVFGSSDQWVGLGLFFDSFDNDNKHNNPYIMAVLNDGTKQFDHQNDGITQQLAGCLRDFRNKPFPTRARIEYYQNTLTVLFHNGRTNSDEDYEMCLRAENVVLPKGGYFGVSAATGGLADDHDVIHFLTSSLHPPDQVQQNQFQGEEQQKLQQEYQDYQQKLEAQKAEYKKEHPDVKEPEVEDWYESDSQRELRQIFQGQNQIYEVLRELNKKIDEVVGRQERTMSLISQQASMVQAGGAPPPPPGAAPVQPGETIRRHEVDALFNNHNQISGYLQELKQFVLEVKTRADTILNNQAKQPTAQVQSVGYDTQSLISEMRDGLNHVKQNIAQLLQKT

SEQ ID NO: 22540 - protein, 288 aa, Diabrotica virgifera
  misc_feature: Coding regions on vcDNA: vcDNA=SeqID_2237; Strand=+; Position=5-871
  misc_feature: Homolog annotation: Hit_ID=XP_315413.1; Match level="QueryCoverage =96%, HitCoverage=53%, E-value=4e-74, Identity=49%"; Hit description =ENSANGP00000014225 [Anopheles gambiae]
  misc_feature: Gene Ontology Annotation: Molecular function=mannose binding lectin; Cellular component=Golgi membrane; Biological process=ER to Golgi transport
MNLEVILFVFFGVVLNYSTATGGLADDHDVIHFLTSSLHPPDQVQQNQFQGEEQQKLQQEYQDYQQKLEAQKAEYKKEHPDVKEPEVEDWYESDSQRELRQIFQGQNQIYEVLRELNKKIDEVVGRQERTMSLISQQASMVQAGGAPPPPPGAAPVQPGETIRRHEVDALFNNHNQISGYLQELKQFVLEVKTRADTILNNQAKQPTAQVQSVGYDTQSLISEMRDGLNHVKQNIAQLSQKTPTTQGCPTVSCISLTAVLAIAAVQLGIILAYNIYRDNKDSSNKKFY

SEQ ID NO: 22541 - protein, 361 aa, Diabrotica virgifera
  misc_feature: Coding regions on vcDNA: vcDNA=SeqID_2238; Strand=+; Position=24-1107
  misc_feature: Homolog annotation: Hit_ID=XP_315413.1; Match level="QueryCoverage =94%, HitCoverage=64%, E-value=1e-147, Identity=71%"; Hit description= ENSANGP00000014225 [Anopheles gambiae]
  misc_feature: Gene Ontology Annotation: Molecular function=mannose binding lectin; Cellular component=Golgi membrane; Biological process=ER to Golgi transport
  misc_feature: Pfam annotation: Pfam_ID=Lectin_leg-like; Match level="Score=460.9, E- value=1.4e-135, Copies=1"; Pfam description=Legume-like lectin family
  misc_feature (315)..(315): Xaa can be any naturally occurring amino acid
MNLEVILFVFFGVVLNYSTANVVHKRFEYKYSFKPPYLAQKDGSVPFWEYAGNAIASSENVRLAPSLRSQKGAIWTKNPINFDWWDVDISFRVTGRGRIGADGLAFWYTQNKGSVTGEVFGSSDQWVGLGLFFDSFDNDNKHNNPYIMAVLNDGTKQFDHQNDGITQQLAGCLRDFRNKPFPTRARIEYYQNTLTVLFHNGRTNSDEDYEMCLRAENVVLPKGGYFGVSAATGGLADDHDVIHFLTSSLHPPDQVQQNQFQGEEQQKLQQEYQDYQQKLEAQKAEYKKEHPDVKEPEVEDWYESDSQRELRQIFXAKTKSTEVLKKMEQKIDEGVPQQKRTMEFFFSTSYSGSKGGAPPPP

SEQ ID NO: 22542 - protein, 259 aa, Diabrotica virgifera
  misc_feature: Coding regions on vcDNA: vcDNA=SeqID_2239; Strand=-; Position=23-802
  misc_feature: Homolog annotation: Hit_ID=AAU95793.1; Match level="QueryCoverage =62%, HitCoverage=10%, E-value=6e-52, Identity=57%"; Hit description =dual oxidase 1 [Lytechinus variegatus]
  misc_feature: Gene Ontology Annotation: Biological process=morphogenesis of an epithelium
MYLVFLILGVLHLCHQPVISQQPAIPVNPPANPVPTPAPATTPAPTQTFGGKPPDSVWVGNYTTNKQRRHIFGDWLLNGNWSDNFTPSPTSKTVEYPGYDGWYNNLARPDSGAIDRPLLRRWPAAYEDGTYLPSGSDRPNPLVLSDQLLSGAIGQKSNIGRNALFVFFGQQVVEEILDAQRPACPPEYFNIDIPDNHTYKLEHPKHSKLPLLRTRYDMRTGYSPNNPRQQLNEITPYIDGGLHYGITKQWSDQLRTYAI

SEQ ID NO: 22543 - protein, 434 aa, Diabrotica virgifera
  misc_feature: Coding regions on vcDNA: vcDNA=SeqID_2240; Strand=+; Position=439-1740
  misc_feature: Homolog annotation: Hit_ID=XP_309670.1; Match level="QueryCoverage =88%, HitCoverage=78%, E-value=4e-45, Identity=31%"; Hit description =ENSANGP00000024638 [Anopheles gambiae] ref|XP_309669.1| ENSANGP00000023240 [Anopheles gambiae]
  misc_feature: Gene Ontology Annotation: Molecular function=myo-inositol transporter activity; Cellular component=membrane; Biological process=myo -inositol transport
  misc_feature: Pfam annotation: Pfam_ID=Sugar_tr; Match level="Score=51.0, E-value =3.5e-12, Copies=1"; Pfam description=Sugar (and other) transporter
MNQEEEINNINSKNEAAVGMSVQDEAPKKPDTLFLYFTVLSGTIPLFVGGTSMVWMSPVLPTLLSNDTDLNPLNKPITTVEISLLAALPCLVGLIGCLIIPKFADFIGRKYFLLLMGAGMFITYLGKGFAHHVILLLIYRCIFTVFLNGVAVILQVYIAEVCEDHNRGKFMYLKSIFYPLGNLYAYAIGPHFNFRDFNLWCGLPIVPFLIFFCLAPETPVYYLSKNKGEDCRKSLMRLRGNKTYKEIEKDYIKIDETLKMTKSITSATLLSLFKTKESLVAVKLTVFLSALGYISGATSISTFLGPLLNQAGTSYSEGTMTVVVGITQVSSLFLTSFVVERTGRRGLLLISNLGCCLCILIFGLFYYLKHENFGIVTQVQWLPVACIIVYFLIYAIGLGPLPITIITELFPSDLASAALSFAITVMSGVIFIIT

SEQ ID NO: 22544 - protein, 234 aa, Diabrotica virgifera
  misc_feature: Coding regions on vcDNA: vcDNA=SeqID_2241; Strand=+; Position=300-1005
  misc_feature: Homolog annotation: Hit_ID=NP_996109.1; Match level="QueryCoverage =95%, HitCoverage=40%, E-value=2e-61, Identity=48%"; Hit description =CG32171-PH, isoform H [Drosophila melanogaster] ref|NP_730212.1| CG32171-PD, isoform D [Drosophila
  misc_feature: Gene Ontology Annotation: Biological process=establishment of ommatidial polarity (sensu Drosophila)
  misc_feature: Pfam annotation: Pfam_ID=PET; Match level="Score=94.2, E-value=3.3e -25, Copies=1"; Pfam description=PET Domain
  misc_feature (207)..(207): Xaa can be any naturally occurring amino acid
MISNDISGDLVPWTGLTLACVRILQLYCKVFQQDVQDFNKLKEKTCKHCKCSRDGHEIVAEHGARSRLGFVATHDGLDARSLGYTFVPPGLTSARQVDQYYSTLPSEEVPKLGSKGETNRSQRIVRQLPKQDLSLSACKFVEPQNQASYEDFISGRNQVALDVGLAKPTPPNSICAHCQKPIHSQQISVAAPRLGKSVWHPSCFKCXSCDDLLVDLAYCVYEDNIYCERHYAEK

SEQ ID NO: 22545 - protein, 251 aa, Diabrotica virgifera
  misc_feature: Coding regions on vcDNA: vcDNA=SeqID_2242; Strand=+; Position=94-846
  misc_feature: Homolog annotation: Hit_ID=CAG12608.1; Match level="QueryCoverage =82%, HitCoverage=21%, E-value=5e-20, Identity=31%"; Hit description =unnamed protein product [Tetraodon nigroviridis]
MSNDVESSENTEGSIHNEEEPQDETETKKTNSEDSALDPSGTDCSESGNENEDSISNSESIRTDDTEGSITDKLRETITYQQSILEQKSNKIRNLEVDYSKVLQTVKELESKLDIATKKKDAAVKEKEAMVVRYAVSEKNVLKEKQQKEAAEKKLSEAVRETEHMQYKVRLMVNEKSRICQMLDKKHHENKLLQQDCEQKKADLTSIDNKLKRVQINLKTESETVKDTQAKLGNITAKYQEVGSTIDQVKR

SEQ ID NO: 22546 - protein, 136 aa, Diabrotica virgifera
  misc_feature: Coding regions on vcDNA: vcDNA=SeqID_2243; Strand=+; Position=99-509
  misc_feature: Homolog annotation: Hit_ID=XP_537232.1; Match level="QueryCoverage =100%, HitCoverage=100%, E-value=3e-70, Identity=100%"; Hit description=PREDICTED: similar to H3 histone, family 3B [Canis familiaris] gb|AAH88835.1| H3 histone, family 3A
  misc_feature: Gene Ontology Annotation: Molecular function=DNA binding; Cellular component=nucleosome; Biological process=embryogenesis and morphogenesis
  misc_feature: Pfam annotation: Pfam_ID=Histone; Match level="Score=150.1, E-value =5.2e-42, Copies=1"; Pfam description=Core histone H2A/H2B/H3/H4
MARTKQTARKSTGGKAPRKQLATKAARKSAPSTGGVKKPHRYRPGTVALREIRRYQKSTELLIRKLPFQRLVREIAQDFKTDLRFQSAAIGALQEASEAYLVGLFEDTNLCAIHAKRVTIMPKDIQLARRIRGERA

SEQ ID NO: 22547 - protein, 367 aa, Diabrotica virgifera
  misc_feature: Coding regions on vcDNA: vcDNA=SeqID_2244; Strand=+; Position=137-1239
  misc_feature: Homolog annotation: Hit_ID=XP_392856.1; Match level="QueryCoverage =73%, HitCoverage=73%, E-value=2e-72, Identity=57%"; Hit description =similar to RAD23B protein [Apis mellifera]
  misc_feature: Gene Ontology Annotation: Molecular function=single-stranded DNA binding; Cellular component=nucleus; Biological process=nucleotide -excision repair
  misc_feature: Pfam annotation: Pfam_ID=ubiquitin; Match level="Score=101.4, E-value= 2.3e-27, Copies=1"; Pfam description=Ubiquitin family
  misc_feature (110)..(110): Xaa can be any naturally occurring amino acid
  misc_feature (248)..(248): Xaa can be any naturally occurring amino acid
MKVTLKNLQQQTFIVDIEATKTVKQLKQKIETEKGKDYPSENQRLIYAGKILTDETVLSEYNIDEKKFIVVMVTKPKQPEKTDSGDGNSTPASNTPATPATQPAPTSTPXHQDTPPPASAPTTQAASEAPSTISSVAESTLLMGEEYETMVRNIMDMGYARDEVEQALRASFNNPDRAVEYLINGIPLMDDQEAVSETADLSGVDERQSESDDPLAFLRTQPQFQQMRQVIQQNPQLLNAVLQQSEQXPALVQLISQKSESFVRMLNEPARGGAQRLGKGMSPRGGGGFIGEFPRPPGGAPPQGSFPQPPPKKKGPPPKRVRNPLGFPPKPIKGARPFFLFVKKKEKTRGGTNFSFLFPQNFHEKKK

SEQ ID NO: 22548 - protein, 114 aa, Diabrotica virgifera
  misc_feature: Coding regions on vcDNA: vcDNA=SeqID_2245; Strand=+; Position=310-654
AIDRIICKTNASSNFCFAVTIVSYTRFEIVESVYYLVFLQVVAQRLVLNLSYHHYFHLVFINFKTNYNGFPTLLLAEDLVFIVHLLSGVSSANFKLKIFPPPSFRTTIIAKAIS

SEQ ID NO: 22549 - protein, 150 aa, Diabrotica virgifera
  misc_feature: Coding regions on vcDNA: vcDNA=SeqID_2246; Strand=+; Position=3-452
  misc_feature: Homolog annotation: Hit_ID=XP_397395.1; Match level="QueryCoverage =100%, HitCoverage=12%, E-value=4e-43, Identity=55%"; Hit description= similar to ENSANGP00000004277 [Apis mellifera]
  misc_feature: Gene Ontology Annotation: Molecular function=15-hydroxyprostaglandin dehydrogenase (NAD+) activity; Cellular component=cellular_component unknown; Biological process=biological_process unknown
FVKVCMIASVNIHSKMFSTLLRAPMRFFDTNASGRILNRFSKDMGSIDEILPRVLLESVQIFLVLIGILVNVSISSPYAIIAMLLLGICFLKLRSCYLSIAMSLKHIEGKVKSPMFSHVNSSLHGMATIRASNTEDILIKEFDEHQNVHT

SEQ ID NO: 22550 - protein, 160 aa, Diabrotica virgifera
  misc_feature: Coding regions on vcDNA: vcDNA=SeqID_2247; Strand=+; Position=38-520
  misc_feature: Homolog annotation: Hit_ID=XP_321541.1; Match level="QueryCoverage =96%, HitCoverage=92%, E-value=4e-40, Identity=49%"; Hit description =ENSANGP00000018154 [Anopheles gambiae]
  misc_feature: Gene Ontology Annotation: Molecular function=muscle motor activity; Cellular component=muscle myosin; Biological process=muscle contraction
MADKLKDTEIETGEFALETYGDGDGKLDGSNLGKFMYCMGINPSLEYLKGAGMTEKEGEKKLTLDECLNAYAELKKSIKDFGCYEDFIECLKLYDKNENGFMLVGELSHSLLTLGEKLNDAEVDEVFEQCLDEENDDGEIPYIPFLRRMCELDPLKPKKK

SEQ ID NO: 22551 - protein, 242 aa, Diabrotica virgifera
  misc_feature: Coding regions on vcDNA: vcDNA=SeqID_2248; Strand=-; Position=113-843
  misc_feature: Homolog annotation: Hit_ID=XP_317161.1; Match level="QueryCoverage =87%, HitCoverage=33%, E-value=2e-52, Identity=49%"; Hit description =ENSANGP00000018282 [Anopheles gambiae]
  misc_feature: Gene Ontology Annotation: Molecular function=molecular_function unknown; Cellular component=cellular_component unknown; Biological process=growth
  misc_feature (68)..(68): Xaa can be any naturally occurring amino acid
  misc_feature (97)..(97): Xaa can be any naturally occurring amino acid
GVIFSNPPPFVFFYPNKKKKRFKILPLSPGFKGLGKKNFEIKKQGNKVIFFFEKNHGFLVSPEVLAKXGISTAHLAWMVLFVFIKKKTVADQLKEIXAAYGRHISLNSYYICTEPPIIKEIFTQIRTKRGVNTYPESILNGKYKITSVRDLTTGYDNNQPDNKAVLPVSADTEMITFYFENGLVCTLRTSGTEPKIKYYTELCASPEIRDRSQLTSLLKEMVDAICEEMFQPTKYNLKPQGA

SEQ ID NO: 22552 - protein, 309 aa, Diabrotica virgifera
  misc_feature: Coding regions on vcDNA: vcDNA=SeqID_2249; Strand=+; Position=77-1006
RLQHLTVNRIFSYRLKNGMGDCNFDRYSKEEKFSYRTWCSMCERGPQRRRSISETNEPCRRKSKELKTLTPKKYNRSQEYENMEFEYELKGQWQEKDMRYEFSRIRSNLCELPTSYISNNCQLSNNLAGLPKLSNESTGFECCKSAGTYETSGKFADIDDQIENLGSMQGKGKSRLEPVKISKIEIPTFQKKSEVRSPDKSITSHSYNNTSPRGHLYSRSDLLDKYPSPNKFKTSSSASPYCNEFCSYSNFKMHTLSNQIPVCFDTSTYFNKRCEAIPDKYTREIQDLREKLLSLKALAIFVAIAWSSS

SEQ ID NO: 22553 - protein, 315 aa, Diabrotica virgifera
  misc_feature: Coding regions on vcDNA: vcDNA=SeqID_2250; Strand=+; Position=139-1083
  misc_feature: Homolog annotation: Hit_ID=XP_391980.1; Match level="QueryCoverage =100%, HitCoverage=51%, E-value=2e-36, Identity=33%"; Hit description= similar to UBX domain containing 2 [Apis mellifera]
  misc_feature: Gene Ontology Annotation: Molecular function=molecular_function unknown; Cellular component=extracellular space; Biological process =N-linked glycosylation
MKWYSGEIADAVAFSKSKGAVFVVYIEGTDEKSQKITDLINNGDLGEKLEQDHFVAIKVIAGSTAHQQFSEIYKEPSVPSIYFIGQKGVPLDIITGSTNLETVSAKVDDVLNRAGFSTAPVHSISAESENFLAHEQAGETRRVESDNNALNTSEESPPEEELSPSETEIEKSSEDKPPAEQPSPSETHTEPAKEEEPAKEENAESTKGKEVTVAEENKEDKEVKVDKESEEVKTEKETTDTKEEAEAELSGEEKVRRAKELIDLIRKEKQKEEEENARLKELERRKTGQNAQPLKKWQEAQDLTRLIRKGQAVKA

SEQ ID NO: 22554 - protein, 460 aa, Diabrotica virgifera
  misc_feature: Coding regions on vcDNA: vcDNA=SeqID_2251; Strand=+; Position=66-1448
  misc_feature (460)..(460): Xaa can be any naturally occurring amino acid
VLKYVTTLYSLIYVEFKDKSLKNYRIIHKKMSAVDDSAEKEASEVLHTLLSVERIEKQEDVVENQTYQTSTSADGQEEAHIQWHTPVSISHSLFSAIDASGHFTHNLDEQQVVIWEGHTIVDPESNINTIYTGHSIEESETGDESPKGPENEIKKENPKAKKKITVKKKKKIVNGVPNDPTKIEESAAQVKDRFKRGCECQDESCFRGLNAESVYKHRLNIAELTKGEHDMYLMGVTMACLANPDTTVRHKERRRLRAQYVYQGRRVCLDAFLYLENCTHYQLKRIRKHVMTHGVAPRVHGNHGKKPHNTFSLDIYRHATEFLKQYLEQHTGEKDIVNTKQPIQLPWDVTRKNLHDSYKEYGQILEPGIKLMGYSTFRHFMKEQFPHVKFCKVEPKSCTPHHSTNQNTTHSSNQQQQQTPQVQTVTQNQQIQTVIERPREQQIQVQKCVIYQRSSQGDSX

SEQ ID NO: 22555 - protein, 240 aa, Diabrotica virgifera
  misc_feature: Coding regions on vcDNA: vcDNA=SeqID_2252; Strand=+; Position=147-866
  misc_feature: Homolog annotation: Hit_ID=XP_313014.1; Match level="QueryCoverage =94%, HitCoverage=40%, E-value=1e-70, Identity=56%"; Hit description =ENSANGP00000011250 [Anopheles gambiae]
  misc_feature: Gene Ontology Annotation: Biological process=courtship behavior
  misc_feature: Pfam annotation: Pfam_ID=MRJP; Match level="Score=-28.1, E-value=7.2e- 08, Copies=1"; Pfam description=Major royal jelly protein
TNETRNNASLIVFLITGSSSLQLIKEWNFLTFDFPPQLAAHNFKPEATVPTGIEITNDRIFISIPRLRSGVPATLTSIPINNPKDISPVLQAYPDWTLHGAGSGNYNCSGLISVYRTRIDSCNRLWVLDAGTLDTIENFRRACPPKILIFDLKTDQVVRTIVFPREVIQAASIFTNLIIDESIQGKCDSAFVYISDTIAPGIVVYDGSSDKTWRVSDPSMYPNPDYANINIAGEQFSLMD

SEQ ID NO: 22556 - protein, 353 aa, Diabrotica virgifera
  misc_feature: Coding regions on vcDNA: vcDNA=SeqID_2253; Strand=+; Position=2-1063
DSEVKCCKKCYKVAQSGLLCANCGTLSHSGCLKQLKSIKYIDDETVICCEESVRLSDPPNKTLDSEADDEDPRQTEIRYLKKIINQNETIISNQQITINLLKEQLDLFKYMQITDQSPSTKQNTNSINHSNRDPNFERPKQSSSKIYPKDENTTPAKNVAVNESLVVDKERSSPTKTLFKNSTNKNKQVVSLIENNKQLSADILRIQTEAKCSDIINLTNDENLINTESKNSVPVPNNNGQEWKTVRYKRRNGPIVIGNNENSEISGVPKFSHLHVTRVNQHTTADNLKKMLEKHFPEVICTSLTAKHPNIYSSFKVSIFEQHFGLAMDPKLWPVGSYVSRFFMKRPTHTQIK

SEQ ID NO: 22557 - protein, 246 aa, Diabrotica virgifera
  misc_feature: Coding regions on vcDNA: vcDNA=SeqID_2254; Strand=+; Position=58-798
  misc_feature: Homolog annotation: Hit_ID=EAL28870.1; Match level="QueryCoverage =91%, HitCoverage=86%, E-value=3e-27, Identity=28%"; Hit description =GA10301-PA [Drosophila pseudoobscura]
  misc_feature: Gene Ontology Annotation: Molecular function=molecular_function unknown
  misc_feature: Pfam annotation: Pfam_ID=DUF233; Match level="Score=90.3, E-value =4.9e-24, Copies=1"; Pfam description=Odorant binding protein
MKLFIPILLSLVVYVGSERKLPPVVTQCYRNDPKVNECLLDNILSLRPKLGHGVPELFIPALSPLKVDRAELHPDKSLNVDLYNINLYGLDSFNLKSIDLDVKTLKAGLDISWDSVGLVTDYKMVGKLLILAIDTVGHGFGNLTKIKADAGLVLDKEIKRGKEHLKINKMDINLKIGSYNMSFDKFFGDNAELNAKGNELLNDNTSLFLEEFIPVIETVVKDIVRSLFTTLFKKFSYDTLLPNKTE

SEQ ID NO: 22558 - protein, 407 aa, Diabrotica virgifera
  misc_feature: Coding regions on vcDNA: vcDNA=SeqID_2255; Strand=+; Position=1-1226
  misc_feature: Homolog annotation: Hit_ID=XP_541574.1; Match level="QueryCoverage =99%, HitCoverage=80%, E-value=1e-130, Identity=48%"; Hit description= PREDICTED: similar to ZNF228 protein [Canis familiaris]
  misc_feature: Gene Ontology Annotation: Molecular function=transcription factor activity; Cellular component=nucleus; Biological process=regulation of transcription, DNA-dependent
  misc_feature: Pfam annotation: Pfam_ID=zf-C2H2; Match level="Score=403.5, E-value =2.6e-118, Copies=14"; Pfam description=Zinc finger, C2H2 type
  misc_feature (44)..(44): Xaa can be any naturally occurring amino acid
  misc_feature (190)..(190): Xaa can be any naturally occurring amino acid
GTFKTHLRVHTQEKPYKCEICFKQCSQAAHLKNHLRVHTGEKPXKCEICFKVFSQGSDLKKHLRVHTGEKPHKCEICFKQFSEAGSLKRHLRVHTGEKPYKCGICSKRFSQSDSLKMHLRVHTGENPHKCEICFKVFSQGGNLKQHLRVHTLEKPYQCKICFKQCVRTDHLKTHLRVHTGEKTSQCEICXSNFIGTDYLKKHLRVHTGEKPHKCEICFKQFFEAGTLKRHLRVHTGEKPYKCEICSKRFRQAVTLKKHLRVHTLEKPYQCEICFKQFNRTDHLKTHLRVHTGEKPHKCEICFKQFIGTYDLKKHLRVHTGVNPHKCEICFKVFSQGSNLKKHLRLHTGEKPYQCEICFKQFNRADHLKTHLRVHTGEKPHKCEICFKQFIETDYLKKHLGVHTGCAL

SEQ ID NO: 22559 - protein, 526 aa, Diabrotica virgifera
  misc_feature: Coding regions on vcDNA: vcDNA=SeqID_2256; Strand=+; Position=1-1581
  misc_feature: Homolog annotation: Hit_ID=XP_314840.1; Match level="QueryCoverage =94%, HitCoverage=73%, E-value=1e-178, Identity=39%"; Hit description= ENSANGP00000015832 [Anopheles gambiae]
  misc_feature: Gene Ontology Annotation: Molecular function=transcription factor activity; Cellular component=nucleus; Biological process=negative regulation of transcription from Pol II promoter
  misc_feature: Pfam annotation: Pfam_ID=zf-NF-X1; Match level="Score=130.8, E-value =3.2e-36, Copies=6"; Pfam description=NF-X1 type zinc finger
VIKTCPCGRSPLKTQRVSCLDPVPCCDKVCDKILKCGQPNSPHRCEATCHEGACPPCPLTTVVKCRCGHMDKEIPCQELTTKADDARCQKKCTKKRLCGKHKCNQLCCIEIEHICPLPCNRLLSCGQHRCERTCHSGRCPTCVETSFEELYCECGASVIYPPVPCGTKPPNCLNPCSRPRHCGHEVNHACHTGPCPPCTVLCKRWCYGHHEQRPAIPCHQENFSCGLPCGKDMSCKRHKCVKPCHDGPCPTPCKLPCNVPREVCGHPCGRPCHVPPCPESSCKQMVPVTCPCGLQKSTRPCTEVADEFKNIQMAQLKEKMGSLSTSSTIDLTDIFNAPKKPTVLKILECIEECRVLDRNRRLAIGLQIRNPDLSQKLTPRYSDFMRQWAKKDPHFCQKIHDKLSELVQLAKNSKQKSRSYSFDSMNRDKRHFIHEYCEHFGVDSAAYDMEPNRNIVATAVKDKSWLPSMSLLEIIQRENGQRRVPGPVLGARGPTSKTETVSLKLPSRVQRSNTPPNEIVDNFRSS

SEQ ID NO: 22560 - protein, 269 aa, Diabrotica virgifera
  misc_feature: Coding regions on vcDNA: vcDNA=SeqID_2257; Strand=+; Position=2-811
  misc_feature: Homolog annotation: Hit_ID=NP_651619.1; Match level="QueryCoverage =75%, HitCoverage=63%, E-value=3e-21, Identity=31%"; Hit description =CG14064-PA [Drosophila melanogaster] gb|AAF56790.3| CG14064-PA [Drosophila melanogaster]
  misc_feature: Gene Ontology Annotation: Biological process=defasciculation of motor neuron
  misc_feature: Pfam annotation: Pfam_ID=ig; Match level="Score=22.7, E-value=0.0011, Copies=1"; Pfam description=Immunoglobulin domain
FRYICFVFVAGLACIQCTLCPERSVEVKIPNYVKAGDSATLVCNFRARNEEDHLINVRWYKENEEFYRFTPVDHPPIKVFSLPGITVDEQKSTAKTVVLKNVQDQLTANYTCEVSWTVPNTAIVRGSKRMFVVDELQGDLILTVDNESPGLGDNLQGACITPPSKVVPTFTWFLNGEKVYNWFSPATRRNSNVPKRFTSFFNERVQFVNDQANLTCVVQIENVYETRKSVILKKSNNQIRGYYLLRENAMGWKFESDHQLGYICSCFGG

SEQ ID NO: 22561 - protein, 457 aa, Diabrotica virgifera
  misc_feature: Coding regions on vcDNA: vcDNA=SeqID_2258; Strand=-; Position=14-1384
  misc_feature: Homolog annotation: Hit_ID=NP_729367.1; Match level="QueryCoverage =89%, HitCoverage=93%, E-value=0.0, Identity=78%"; Hit description =CG7176-PD, isoform D [Drosophila melanogaster] gb|AAN12002.1| CG7176- PD, isoform D [Drosophila
  misc_feature: Gene Ontology Annotation: Molecular function=isocitrate dehydrogenase (NADP+) activity; Cellular component=cytosol; Biological process =glutathione metabolism
  misc_feature: Pfam annotation: Pfam_ID=Iso_dh; Match level="Score=381.2, E-value =1.4e-111, Copies=1"; Pfam description=Isocitrate/isopropylmalate dehydrogen
  misc_feature (433)..(433): Xaa can be any naturally occurring amino acid
IKIKIIFPRIQFVFACLRESTHSADKYLLYSTCTKNTKMGKIKAGTVVDILGDEMTRIIWDAIKEKLILPYLDIDLKVYDLGIENRDKTNDQVTIDCAEAIKKYNVGIKCATITPDENRVIEFKLKQMWKSPNGTIRNILGGTVFREPIICKNIPRLVRGWDNPIIIGRHAHADQYKATDVIIPSAGKLELIFTGASGDTQKYVVHDYKGPGVAMGMFNTDDSIVAFAHSSFKYALERGYPLYLSTKNTILKKYDGRFKDIFQDIYDREYKSSYEAKKIWYEHRLIDDMVAYAMKSEGGFVWACKNYDGDVQSDSVAQGYGSLGLMTSVLISPDGKTVEAEAAHGTVTRHFRMHQQGKETSTNPIASIFAWTRGLLHRAKLDNNQELNKFAHALEQVCVETIESGSMTKDLAICIKGMSKVTREDYLETFEFXHKLAENLKKLNANVSYHQLKRRIS

SEQ ID NO: 22562 - protein, 444 aa, Diabrotica virgifera
  misc_feature: Coding regions on vcDNA: vcDNA=SeqID_2259; Strand=-; Position=383-1717
  misc_feature: Homolog annotation: Hit_ID=NP_729367.1; Match level="QueryCoverage =92%, HitCoverage=94%, E-value=1e-179, Identity=75%"; Hit description= CG7176-PD, isoform D [Drosophila melanogaster] gb|AAN12002.1| CG7176 -PD, isoform D [Drosophila
  misc_feature: Gene Ontology Annotation: Molecular function=isocitrate dehydrogenase (NADP+) activity; Cellular component=cytosol; Biological process =glutathione metabolism
  misc_feature: Pfam annotation: Pfam_ID=Iso_dh; Match level="Score=348.1, E-value =1.3e-101, Copies=1"; Pfam description=Isocitrate/isopropylmalate dehydrogen
MEIIFPRTLPVLGCLRGSTHSADKYLLYSTCTKNTKMGKIKAGTVVDILGDEMTRIIWDAIKEKLILPYLDIDLKVYDLGIENRDKTNDQVTIDCAEAIKKYNVGIKCATITPDENRVIEFKLKQMWKSPNGTIRNILGGTVFREPIICKNIPRLVRGWDNPIIIGRHAHADQYKATDVTDAWVSFRSSILRFYFYAILTDLCSAYISTTYFLRMFNTDDSIVAFAHSSFKYALERGYPLYLSTKNTILKKYDGRFKDIFQDIYDREYKSSYEAKKIWYEHRLIDDMVAYAMKSEGGFVWACKNYDGDVQSDSVAQGYGSLGLMTSVLISPDGKTVEAEAAHGTVTRHFRMHQQGKETSTNPIASIFAWTRGLLHRAKLDNNQELNKFAHALEQVCVDVIESGSMTKDLAICIKGMSKVTREDYLETFEFINKLAENLKKKLNA

SEQ ID NO: 22563 - protein, 278 aa, Diabrotica virgifera
  misc_feature: Coding regions on vcDNA: vcDNA=SeqID_2260; Strand=+; Position=17-853
  misc_feature: Homolog annotation: Hit_ID=NP_649489.1; Match level="QueryCoverage =98%, HitCoverage=98%, E-value=1e-119, Identity=74%"; Hit description= CG9769-PA [Drosophila melanogaster] gb|AAF52101.1| CG9769-PA [Drosophila melanogaster]
  misc_feature: Gene Ontology Annotation: Molecular function=translation initiation factor activity; Cellular component=eukaryotic translation initiation factor 3 complex; Biological process=regulation of translational initiation
  misc_feature: Pfam annotation: Pfam_ID=Mov34; Match level="Score=97.1, E-value=4.4e- 26, Copies=1"; Pfam description=Mov34/MPN/PAD-1 family
MALNLQVKVHPVVLFQVVDAYERRNADSHRVIGTLLGTADKGVVEVTNCFCVPHKETDDQVEAELSYAMDVYDLNRRVNSSESIVGWWATGHEVTNHSAVIHEYYSRECNNPVHITVDTSLQNGRMGLKAYVCVPLGVPNGKQGCMFTSIPVDVVCYDPEVFALQLCQKTMVAGASRSRNVNPMLDLNQVSEAGSKMSVLLEQVLQYVEDVLANRIAPNNAVGRSLLDLVNSVPHMNNEQFSEMFNSNVKDLLMVITLSQLIKTQLQLNEKLTLLTSF

SEQ ID NO: 22564 - protein, 298 aa, Diabrotica virgifera
  misc_feature: Coding regions on vcDNA: vcDNA=SeqID_2261; Strand=+; Position=79-972
  misc_feature: Pfam annotation: Pfam_ID=zf-C2H2; Match level="Score=26.3, E-value =9.5e-05, Copies=2"; Pfam description=Zinc finger, C2H2 type
MVDVSVSADPIVLSTDDPERRDCELCGIKYIHINDVEKHINSRKHKLNQRKLTEPEAQNRYNCKDCNKTLTSEEFLRRHVESKSHKKEVEKHLPKIEEYKEKTQSIWMQKWQLRSMSIIDSTMSPSKLDEATVTINEAEEETFDRKKYKVRSDNLAFDRLEPYVYSLVSYLSIRLALDPNTTDFNISVNNRNWPTFGDIIVEQTFSDKFVTYAIRCKNISETPQTIDNLKDAKIFLEKEYTYVTQHKNYSSTTFLIFTTCNTSSEFPEQIEIKPELIKHFIKPSEETPPPIKVKIFPN

SEQ ID NO: 22565 - protein, 478 aa, Diabrotica virgifera
  misc_feature: Coding regions on vcDNA: vcDNA=SeqID_2262; Strand=+; Position=136-1572
  misc_feature: Homolog annotation: Hit_ID=NP_650064.1; Match level="QueryCoverage =100%, HitCoverage=100%, E-value=1e-157, Identity=61%"; Hit description=CG5214-PA [Drosophila melanogaster] gb|AAF54625.1| CG5214-PA [Drosophila melanogaster]
  misc_feature: Gene Ontology Annotation: Molecular function=dihydrolipoamide S -succinyltransferase activity; Cellular component=alpha-ketoglutarate dehydrogenase complex (sensu Eukarya); Biological process=energy pathways
  misc_feature: Pfam annotation: Pfam_ID=2-oxoacid_dh; Match level="Score=429.8, E -value=3.2e-126, Copies=1"; Pfam description=2-oxoacid dehydrogenases acyltransfer
MSSMLNIIIKSVPRSTLRHILKSVEKGIPVVTANHRCVIQGEQIIRKYGININSSHTLRCRKSTSSSRYFQTSNACWDVQLVKVPPFADSITEGDVKLEKKVGDYVAADEVVMEIETDKTAMPVHAPAAGVIAEILVNDGDTVKPGQHLFKLTVGEGAPPPAAAKPAAAAPAPKPAAAPAAPPVAPPPPPPSAPPAAAPPKPAAAPPKPAAPMTSIPVAAIRHAQSLEAATVKLPPADPTKEISGTRTEHRVKMNRMRLKIAQRLKEAQNTNAMLTTFNEIDMTNIMAFRKENQEAFQKKYNAKLSFMSAFLKAAAYALQDQPIVNAVIDGTDILYRDYVDISVAVATPKGLVVPVVRNVERMTYADIELGIAALADKARKGQLAVEDMDGGTFTVSNGGVFGSLYGTPIINPPQSAILGMHGIFDRPIAIKGQAVVRPMMYIALTYDHRIIDGREAVLFFRKIKQAVENPATIVAGL

SEQ ID NO: 22566 - protein, 304 aa, Diabrotica virgifera
  misc_feature: Coding regions on vcDNA: vcDNA=SeqID_2263; Strand=+; Position=2-916
  misc_feature: Homolog annotation: Hit_ID=EAL39610.1; Match level="QueryCoverage =69%, HitCoverage=100%, E-value=2e-16, Identity=35%"; Hit description= ENSANGP00000016373 [Anopheles gambiae str. PEST] ref|XP_555219.1| ENSANGP00000016373 [Anopheles gambiae s
  misc_feature: Gene Ontology Annotation: Molecular function=molecular_function unknown; Cellular component=extracellular space; Biological process =biological_process unknown
IITTIEPIGSETETTTEIIMLETILVTLPSEISTTVDLLPQTTPTVISTQGESFPQTTITETTTDSLIEETTTEPSLSKETSTEASNEGETFTPAKSTATTIESVTFDSTLVPTETSTVAESFTQTQVTETITTETPATEIKPEVSTNTEAEDSTKEISTETESVPETTTLLSYPYPDASTPEIETSKDVDENEVFASDSPTLPAKRKRSKNSFKQLNSYKHRPRSTYTSDYNEYLSGKNRKLASGIGDSKRDPIRRTRSVVDYVIARYYDDYHSNNHHNLEPYVPQMRPSFLIGKYREIKLSS

SEQ ID NO: 22567 - protein, 186 aa, Diabrotica virgifera
  misc_feature: Coding regions on vcDNA: vcDNA=SeqID_2264; Strand=+; Position=109-669
  misc_feature: Homolog annotation: Hit_ID=XP_312200.1; Match level="QueryCoverage =80%, HitCoverage=73%, E-value=1e-38, Identity=54%"; Hit description =ENSANGP00000010792 [Anopheles gambiae]
  misc_feature: Pfam annotation: Pfam_ID=Chitin_bind_4; Match level="Score=21.9, E -value=9.8e-05, Copies=1"; Pfam description=Insect cuticle protein
MKKSLIILPFLLSIGLCDVHLLVPEEHTPPPPPKPYAFGYAAGRFPGHIDRTHSEVSDGSGLVQGSYSYVDPKFRIRKVDYVADKDGFHVTSNDDVPALPSDTPVVAAAKINHLRKYAAIADAQQASPGQVFVPADTVAVQYAKNKHLSLYEKIAADHARIAAELEAAKHEEGHGNEVGDGLYGHV

SEQ ID NO: 22568 - protein, 87 aa, Diabrotica virgifera
  misc_feature: Coding regions on vcDNA: vcDNA=SeqID_2265; Strand=+; Position=259-522
YPCCLFLFYTVICCDIHRMYTNINHWLIVQVLDCQTRCCWNLRNFLNWNPLSGKIRQRVQFLIRQIAAVGGHAILIDAAVPGTVAGV

SEQ ID NO: 22569 - protein, 237 aa, Diabrotica virgifera
  misc_feature: Coding regions on vcDNA: vcDNA=SeqID_2266; Strand=+; Position=22-735
  misc_feature: Homolog annotation: Hit_ID=XP_316039.1; Match level="QueryCoverage =32%, HitCoverage=68%, E-value=7e-09, Identity=34%"; Hit description =ENSANGP00000010846 [Anopheles gambiae] gb|EAA11707.1| ENSANGP00000010846 [Anopheles gambiae
  misc_feature: Pfam annotation: Pfam_ID=Chitin_bind_4; Match level="Score=37.4, E -value=4.2e-08, Copies=1"; Pfam description=Insect cuticle protein
MKLVIASVFLIAAASAAVVPVEHNQHAEPNSQPSSLVGKRSAGFGEHLDRPNQPNSQQSAGFGQHLDRPNQPNSQQSAGFGQHLDRPNQPNQQPQHPAHFGQHNQHAEPNSQPSSLVGQRSAGFGQHLDRPVTHKTSNEYNNYEKHSTNYHNGQESRILHYESEQDPEQGYKFGYHTSHGNEEVQRSEEAQIRRIDEEHASVAVQGVVEYVNHEGKRVRWTYTADENGYHPSEITVT

SEQ ID NO: 22570 - protein, 285 aa, Diabrotica virgifera
  misc_feature: Coding regions on vcDNA: vcDNA=SeqID_2267; Strand=+; Position=796-1653
  misc_feature: Homolog annotation: Hit_ID=XP_391957.1; Match level="QueryCoverage =85%, HitCoverage=26%, E-value=3e-19, Identity=33%"; Hit description =similar to CG6621-PA [Apis mellifera]
  misc_feature: Gene Ontology Annotation: Molecular function=pre-mRNA splicing factor activity; Cellular component=nuclear matrix; Biological process=mRNA splicing
MQIAGSSGNSRFKKKPERAPPASDWQSDRDKRERERERDRERERERERAKSSSASDDSPPPKKMSLPPLPPAEKAVSVRKAMALKEPPLKKPESPKKLKLTPAPPLPKIPQGQVVLDKFGNFRLISPPELKKGEGTSSGRRPPEPPGRPRSDSRSPKRRSRSRSRSSSGSRSRSRSRSRSYRSRSRSYYSRSRSRSGSYYSRSRSRSRSYSGDRRRYNRRGGFRGRHLNDRGTYYKPRFQTPRHNGQRGRGYYNNNRDSRYGDRDYRGRGRPYGFKIEVIETTAR

SEQ ID NO: 22571 - protein, 267 aa, Diabrotica virgifera
  misc_feature: Coding regions on vcDNA: vcDNA=SeqID_2268; Strand=+; Position=1034 -1832
  misc_feature: Homolog annotation: Hit_ID=XP_395247.1; Match level="QueryCoverage =65%, HitCoverage=36%, E-value=7e-76, Identity=56%"; Hit description =similar to ENSANGP00000024280 [Apis mellifera]
  misc_feature: Gene Ontology Annotation: Molecular function=transcription factor activity; Cellular component=nucleus; Biological process=regulation of transcription, DNA-dependent
  misc_feature: Pfam annotation: Pfam_ID=zf-C2H2; Match level="Score=112.6, E-value =9.9e-31, Copies=6"; Pfam description=Zinc finger, C2H2 type
  misc_feature (250)..(250): Xaa can be any naturally occurring amino acid
  misc_feature (258)..(258): Xaa can be any naturally occurring amino acid
MDNSSDSDFDPSSLTRVFSKKSNIIEVSSFHDGEFKDLLKLDSTSSEGTMKMSTSSSLEKKPIILRKKLSSYPIETVFEEEKSITAPISLPVVLKDGNIYTCVLCQGDETVAGDSKAIVAHVKEEHGFRLYICDVCGQDFCKRNQLSAHLDEHVLAEEGDFQCEVCNRIFSNLRLFRIHKRMHNPQTKAWVCDTCGKKYNSKNLLDEHVNTHLGVRPYVCEVCNKDFASKYTYKAHEKTHDVRPRPFKCXQCDKSFLXQPNLTQHER

SEQ ID NO: 22572 - protein, 478 aa, Diabrotica virgifera
  misc_feature: Coding regions on vcDNA: vcDNA=SeqID_2269; Strand=+; Position=299-1735
  misc_feature: Homolog annotation: Hit_ID=XP_319685.1; Match level="QueryCoverage =92%, HitCoverage=82%, E-value=1e-109, Identity=43%"; Hit description= ENSANGP00000021422 [Anopheles gambiae]
  misc_feature: Gene Ontology Annotation: Molecular function=inorganic phosphate transporter activity; Cellular component=integral to membrane; Biological process=phosphate transport
  misc_feature: Pfam annotation: Pfam_ID=MFS_1; Match level="Score=183.8, E-value =3.6e-52, Copies=1"; Pfam description=Major Facilitator Superfamily
MVQIDKFDTMDRVQPPKQFFGKRHVQYLLLFSVNVLAYGLRNILNVAVISMVSKTPPEGVTTYPEWAGSKNVMLSSFFWGYVLTQIPAGQLAERFGPKLFLSGAMVICSLFSILIPICGAQFGYLGVMFCRIIQGLMQGFIYPSIHHLISAWVPLSSRAKIAGFVYAGGPLGTVIVMPIVGIISGSKLGWQTVFYLLGGVGFTWTACWIFLGLDSPHKHKNISQDELKFIQDGIVTNKKKEQLPTPWKDILKSVPFWAILVCHFGDLWGFWTMLTEIPTYMDKILKYDIASNSTLSALPYLIYCLLNLVMSPIADYLITNKITSVGASRKIFNSIGVFIPSVALLTLCFIGSEEKALTVFMLVIAVGCNTGILIGFHVNHIDIAPNHAGTLMGITNAIGNVAAILAPLAVDMFKHVGGYEESDKELWNIVFITAAVLFSTTGLFYVFGASGEIQPWNDKRPKQEDSVPEKEPMYQNGT

SEQ ID NO: 22573 - protein, 294 aa, Diabrotica virgifera
  misc_feature: Coding regions on vcDNA: vcDNA=SeqID_2270; Strand=+; Position=122-1004
  misc_feature: Homolog annotation: Hit_ID=XP_537286.1; Match level="QueryCoverage =85%, HitCoverage=92%, E-value=3e-57, Identity=45%"; Hit description =PREDICTED: similar to Zinc finger protein 35 (Zfp-35) [Canis familiaris]
  misc_feature: Gene Ontology Annotation: Molecular function=transcription factor activity; Cellular component=nucleus; Biological process=regulation of transcription, DNA-dependent
  misc_feature: Pfam annotation: Pfam_ID=zf-C2H2; Match level="Score=226.4, E-value =5.5e-65, Copies=7"; Pfam description=Zinc finger, C2H2 type
  misc_feature (266)..(266): Xaa can be any naturally occurring amino acid
  misc_feature (288)..(288): Xaa can be any naturally occurring amino acid
MEVKQEVSEHGYKIEIDNNGVNDALLDTVKTEIKEEPQTEVTHDSFDYLNLEEFPLKTELKYDEDKLCPLEVKESFICEDTPTDECNALKDHVEKVNAAEKRFVCEICTKQFLHKSHLKVHQMRHTGEKPFECAICTKKFTRKQDLTRHLRIHNGEKPYLCNICTKQFSQSAHLKDHMVVHTVEKPFACEVCGKEFSRSSDLKMHMIIHTEEKPFGCHICAKNFSRSSSLKEHMKKHTGEGQFECKICSKQFTRNHALTTHMRIHXGEKLFVCNICTKRFSRRSTLKXHMLTHS

SEQ ID NO: 22574 - protein, 281 aa, Diabrotica virgifera
  misc_feature: Coding regions on vcDNA: vcDNA=SeqID_2271; Strand=+; Position=141-983
  misc_feature: Homolog annotation: Hit_ID=XP_394457.1; Match level="QueryCoverage =93%, HitCoverage=47%, E-value=7e-45, Identity=34%"; Hit description =similar to CG12789-PB [Apis mellifera]
  misc_feature: Gene Ontology Annotation: Molecular function=receptor activity; Cellular component=plasma membrane; Biological process=rhodopsin biosynthesis
  misc_feature: Pfam annotation: Pfam_ID=CD36; Match level="Score=-125.5, E-value =5.8e-08, Copies=1"; Pfam description=CD36 family
MKRRRRQIGQICLLVLGLLLIGAGVFIFVFFEAIYEFILAEALKFTPDSRPYKAWRNNDPPLSMDIFLFNWTNPEQIYNISDKPEFQEVGPYRFKEIKEKINISWHEDNYTVSYQHRKLYYFDHENSLRKLTDVISTINPVPLTIGFKTRWSSWFTKRVVSAALSSVSSLHVTKNVSQILFEGYDEPILGTLSKFPWLDVQDKFGIFYGKNNTFGKDGVFSMHYKNDENFGRLVTWNNKNQTNFYEGHCNDIKGSAGEFYPFHRQRQKVILYSAELCKYAE

SEQ ID NO: 22575 - protein, 251 aa, Diabrotica virgifera
  misc_feature: Coding regions on vcDNA: vcDNA=SeqID_2272; Strand=+; Position=209-964
  misc_feature: Homolog annotation: Hit_ID=NP_850032.1; Match level="QueryCoverage =99%, HitCoverage=41%, E-value=5e-17, Identity=25%"; Hit description =expressed protein [Arabidopsis thaliana]
  misc_feature: Gene Ontology Annotation: Molecular function=calcium/calmodulin -dependent protein kinase activity; Cellular component=microtubule associated complex; Biological process=microtubule bundling
MEETEASTGRKTRSSAAKTTPAVTKKEKPGPLSRKTRKKVVLMEVEVSDEEVDETVQEPVTETMETTEESKQSENQIDAEKVNGKENKPKSIDDQVILNDVTVFCEMQTENNKTEDTEKMEVDGDLEIKKTEDNVSSQQTDESKVKSSEKLDTKPNVSEPEVEEPAEKKIKLEEKPADTDSNKKEVEKESENDAIKTNKGCSEEELKTESEKMRKKVKTLRKKTEEETEKKQDVAKVEETDAKVKEIQMQK

SEQ ID NO: 22576 - protein, 252 aa, Diabrotica virgifera
  misc_feature: Coding regions on vcDNA: vcDNA=SeqID_2273; Strand=+; Position=51-809
  misc_feature: Homolog annotation: Hit_ID=EAL39843.1; Match level="QueryCoverage =98%, HitCoverage=100%, E-value=2e-57, Identity=48%"; Hit description= ENSANGP00000025535 [Anopheles gambiae str. PEST] ref|XP_556135.1| ENSANGP00000025535 [Anopheles gambiae s
  misc_feature: Gene Ontology Annotation: Molecular function=electron transporter activity
  misc_feature: Pfam annotation: Pfam_ID=adh_short; Match level="Score=162.1, E-value= 1.3e-45, Copies=1"; Pfam description=short chain dehydrogenase
MVLSMDRWVGKVAIVTGASSGIGAAVAELLVEKGLLVVGAARRKENVDALAQKLQGKKGKLYAVKADVAKEEDIKELFKWTSANVGPVSILINNAGCHHKTGLIGGDTAAWRATIDVNLIAVCIATREAIDIMQRNNIDGYIIHINSLVGHTVLNVPNVNVYPATKHGITALTETLRHELNARKSKIRVTSISPGVVDTELISDIKKSDAFALIKNAMLKSEDIADAISYVLSTPLHVQIHDIIIKPQGELL

SEQ ID NO: 22577 - protein, 251 aa, Diabrotica virgifera
  misc_feature: Coding regions on vcDNA: vcDNA=SeqID_2274; Strand=+; Position=2-757
  misc_feature: Homolog annotation: Hit_ID=XP_314469.1; Match level="QueryCoverage =95%, HitCoverage=88%, E-value=1e-102, Identity=77%"; Hit description= ENSANGP00000020592 [Anopheles gambiae]
  misc_feature: Gene Ontology Annotation: Molecular function=pre-mRNA splicing factor activity; Cellular component=nucleus; Biological process=mRNA splice site selection
  misc_feature: Pfam annotation: Pfam_ID=RRM_1; Match level="Score=128.0, E-value =2.2e-35, Copies=2"; Pfam description=RNA recognition motif. (a.k.a. RRM, R
GFLVQNLQNLSYLLKVLKKMSGPGRNDCRIYVGNLPPDIRTKDIQDLFYKFGKVTFVDLKNRRGPPFAFVEFEDPRDADDAVHARDGYDYDGYRLRVEFPRGGGGHGGGGGGGFRGGRGGERGRGSRGPPARRSQFRVLVTGLPPSGSWQDLKDHMREAGDVCFADSFKDGSGVVEFLRYEDMKYAIKKLDDSRFRSHEGEVAYIRVKEDKGGSERRSGGRSRSRSFSPRNRGSPTYSPVHRSFSRSRSRS

SEQ ID NO: 22578 - protein, 123 aa, Diabrotica virgifera
  misc_feature: Coding regions on vcDNA: vcDNA=SeqID_2275; Strand=-; Position=168-539
HVEKSLKSDSGFGSCGTSKVTHFWGVRLVLHPSVYCGSIDFYSFNELQIDVSFFEGFPKFTLWHSVGCFFLSICTLNEILNCRLFVCLLTVLHNIGGQWWICQHGSRLALRPLNLCILLLLFT

SEQ ID NO: 22579 - protein, 74 aa, Diabrotica virgifera
  misc_feature: Coding regions on vcDNA: vcDNA=SeqID_2276; Strand=+; Position=646-867
VKTHVIFMKALDLVHRKEIRGGKKTLGNVFNLSTICDVSGLFTCGCQFVGFFAVFCPVMLFFFRSYLYYTNSCF

SEQ ID NO: 22580 - protein, 53 aa, Diabrotica virgifera
  misc_feature: Coding regions on vcDNA: vcDNA=SeqID_2277; Strand=+; Position=479-640
VKTCYFYERSRLSALKRDRYKERRLRMFSHILSTISDVLVCLLLTIWIGNRCA

SEQ ID NO: 22581 - protein, 335 aa, Diabrotica virgifera
  misc_feature: Coding regions on vcDNA: vcDNA=SeqID_2278; Strand=+; Position=95-1098
  misc_feature: Homolog annotation: Hit_ID=AAH88570.1; Match level="QueryCoverage =97%, HitCoverage=59%, E-value=2e-87, Identity=49%"; Hit description =Unknown (protein for MGC:97766) [Xenopus tropicalis]
  misc_feature: Gene Ontology Annotation: Molecular function=transferase activity, transferring hexosyl groups; Cellular component=endoplasmic reticulum; Biological process=dolichol-linked oligosaccharide biosynthesis
  misc_feature: Pfam annotation: Pfam_ID=Alg6_Alg8; Match level="Score=181.8, E-value= 1.4e-51, Copies=1"; Pfam description=ALG6, ALG8 glycosyltransferase family
  misc_feature (270)..(270): Xaa can be any naturally occurring amino acid
  misc_feature (298)..(298): Xaa can be any naturally occurring amino acid
MYFRISSETWLVIFGTLFSILLRACTNLHSHSGEATPPMYGDYEAQRHWMEITTNLPINQWYYNTTNNDLNYWGLDYPPLTAYHMFICGKVANYLNENYTKLHDSRGYESDSHKVFMRYTVMLSDVLLYIPALIIYYQTCIKDGEVLENGVMKKKPQIPKKFTITKPMSSSLCTVLGLLYPGVILVDHGHFQYNSISLGFTILAITYILKEGDILASIFFCFALNYKQMELYHAIPFFLYLLSTCVPKPGQRTFWGIFRLFKISITVISXFGLIWLPFLFNFEDLMQVLHRLFPVARXGVYEDKDSNLWCVLYVVFKFKTRFNNFEMMRVCLFTT

SEQ ID NO: 22582 - protein, 251 aa, Diabrotica virgifera
  misc_feature: Coding regions on vcDNA: vcDNA=SeqID_2279; Strand=+; Position=30-782
  misc_feature: Homolog annotation: Hit_ID=XP_309675.1; Match level="QueryCoverage =94%, HitCoverage=51%, E-value=6e-34, Identity=33%"; Hit description =ENSANGP00000024473 [Anopheles gambiae]
  misc_feature: Gene Ontology Annotation: Molecular function=glucose transporter activity; Cellular component=plasma membrane; Biological process =glucose transport
  misc_feature: Pfam annotation: Pfam_ID=Sugar_tr; Match level="Score=-136.0, E-value= 0.011, Copies=1"; Pfam description=Sugar (and other) transporter
SKLKLILLHYKLLLYKMNAIITTVAGNLVSFSAGTAISWASPEISKLADASITKSASEESWVKAIFLLGAVFGTFPFGWLADKIGRRITLLSMGVPLVICFFIMAFVKSVGAFLVCRFITGVVVGGVFTVMPMYIGEIADSSNRGVLAGLLNIFICLGILFSYAVGPYTTILVFNIILALFPAFFLILFFIFSVESPRYLIGKQNISEAKVILKKLRGATADIDSEVTFIEKALKEEGKGGIMDIFKSSGN

SEQ ID NO: 22583 - protein, 406 aa, Diabrotica virgifera
  misc_feature: Coding regions on vcDNA: vcDNA=SeqID_2280; Strand=+; Position=110-1330
  misc_feature: Homolog annotation: Hit_ID=NP_725375.1; Match level="QueryCoverage =97%, HitCoverage=98%, E-value=0.0, Identity=88%"; Hit description =CG8553-PB, isoform B [Drosophila melanogaster] ref|NP_725374.1| CG8553-PA, isoform A [Drosophila
  misc_feature: Gene Ontology Annotation: Molecular function=ATP binding; Cellular component=cellular_component unknown; Biological process=protein modification
  misc_feature: Pfam annotation: Pfam_ID=AIRS; Match level="Score=104.2, E-value=3.3e- 28, Copies=1"; Pfam description=AIR synthase related protein, N-termi
MGDYQVTQVQQDALGAVQLELGGNPNTLALRRPFDPLAHDLEASFRLTRFADLKGRGCKVPQEVLNKLVEGLQQDYNSAEHEHAHFMHMAIPRIGIGLDCSVTPLRHGGLCLVQTTDFFYPLVDDPYMMGKIACANVLSDLYAMGVTECDNMLMLLGVSTKMTEKERDVVIPLIMRGFKDSALEAGTTVTGGQTVVNPWCTIGGVATTVCQPNEYIVPDNAVVGDVLVLTKPLGTQVAVNAHQWLDQPERWNRIKLVVSEEDVRKAYHRAMDSMARLNRIASRLMHKYNAHGATDITGFGLLGHAQTLASHQKNEVSFVIHNLPVIAKMAAVAKACGNMFQLLQGHSAETSGGLLICLPREQAAAYCKDIEKQEGYQAWIIGIVEKGNRTARIIDKPRVIEVPAKE

SEQ ID NO: 22584 - protein, 286 aa, Diabrotica virgifera
  misc_feature: Coding regions on vcDNA: vcDNA=SeqID_2281; Strand=+; Position=35-895
  misc_feature: Homolog annotation: Hit_ID=NP_001002065.1; Match level="QueryCoverage= 86%, HitCoverage=67%, E-value=3e-65, Identity=48%"; Hit description =zgc:86711 [Danio rerio] gb|AAH71388.1| Zgc:86711 [Danio rerio]
  misc_feature: Gene Ontology Annotation: Molecular function=cyclophilin; Cellular component=cytoplasm; Biological process=protein folding
  misc_feature: Pfam annotation: Pfam_ID=Pro_isomerase; Match level="Score=265.0, E -value=1.3e-76, Copies=1"; Pfam description=Cyclophilin type peptidyl- prolyl cis-t
  misc_feature (238)..(238): Xaa can be any naturally occurring amino acid
KILCGLWVPVYPLFSRIKKQNMDPEKKAANPFVYLDIQFDGLKAGRVVIELYNDQVPKTVENFRKLCTGEKGIGKKGKPLHYKGTKFHKVVSMCMVQTGDIINNNGTNGESIYGEYFEDENFSVTHDKEGIVGMVNNGPNTNQSQFYITTQPCFHLDNTNVAFGKVVKGLNILVEMSDQPRENDKPLGELIIADCGEFKADEPWNIKEDDGTEDKYPPWPDDWEEQDPDVPLMEQTLXYIKSSGNFYFNKQDFARAERKYVKCLRYADWYLSKKKQPTLEKVYDWT

SEQ ID NO: 22585 - protein, 273 aa, Diabrotica virgifera
  misc_feature: Coding regions on vcDNA: vcDNA=SeqID_2282; Strand=+; Position=155-976
  misc_feature: Homolog annotation: Hit_ID=XP_394952.1; Match level="QueryCoverage =98%, HitCoverage=95%, E-value=1e-97, Identity=63%"; Hit description =similar to CG4237-PA [Apis mellifera]
  misc_feature: Gene Ontology Annotation: Molecular function=ARF GTPase activator activity; Cellular component=cytoskeleton; Biological process=ER to Golgi transport
  misc_feature: Pfam annotation: Pfam_ID=ArfGap; Match level="Score=207.3, E-value=3e- 59, Copies=1"; Pfam description=Putative GTPase activating protein fo
MASPRTRRVLQELKPSNENDKCFECGTLNPQWVSVTYGIWICLECSGKHRGLGVHLSFVRSVTMDKWKDIELEKMKLGGNRNARIFFEAQPDWHDDMTLQQKYNSKAAALYRDKISTLAQGKPWDERKSPAQNYTSNLIGGNSLQHSSSKTNHTSSASTYQSSSYDTYEGGYQNMNSPEFKNQKEAFFSKKQMENASRPNDVPPSQGGKYSGFGYTMEPPPRSQSQEFVDSAISSLANGWSFLSSFSTKLASKASRNARKYGGFSSQKVAERS

SEQ ID NO: 22586 - protein, 318 aa, Diabrotica virgifera
  misc_feature: Coding regions on vcDNA: vcDNA=SeqID_2283; Strand=+; Position=1-954
  misc_feature: Homolog annotation: Hit_ID=AAN87269.1; Match level="QueryCoverage =97%, HitCoverage=13%, E-value=1e-78, Identity=45%"; Hit description =ORF [Drosophila melanogaster]
  misc_feature: Pfam annotation: Pfam_ID=rve; Match level="Score=39.3, E-value=1.1e -08, Copies=1"; Pfam description=Integrase core domain
  misc_feature (267)..(267): Xaa can be any naturally occurring amino acid
  misc_feature (305)..(305): Xaa can be any naturally occurring amino acid
PTRPDFFLVRLAQTESFVEEISLLNNGKDLSSKSRLLPLTPFLDETGLLRVGGRLRKSSRNYDGKHPLLLDKIHVLSKLILRHEHVQLQHAGPQLLLATVRQKFWIIAGMSLAKTVVRNCIRCYRFKPKPGSTIMADLPEHRVNISQPFFITGLDYAGPVTLKDRKGRGCKTYKAYICLFICFATKAVHLELISSLTSEAFMAGLRRFVFRRGKPGHLYSDNGTSFVGAKNELKILYDFIRKSEDEIVTSCVAQNIIWHFIPPSTPXFGGLWESNIKGVKYHLSRIIGQTLLTYEEFCTFLIQIXGTLNSRPLYALSS

SEQ ID NO: 22587 - protein, 217 aa, Diabrotica virgifera
  misc_feature: Coding regions on vcDNA: vcDNA=SeqID_2284; Strand=+; Position=110-763
  misc_feature: Homolog annotation: Hit_ID=AAS80329.1; Match level="QueryCoverage =56%, HitCoverage=20%, E-value=1e-34, Identity=52%"; Hit description =broad complex isoform Z4 [Aedes aegypti]
  misc_feature: Gene Ontology Annotation: Molecular function=transcription factor activity; Cellular component=nucleus; Biological process=autophagy
  misc_feature: Pfam annotation: Pfam_ID=BTB; Match level="Score=100.2, E-value=5.1e -27, Copies=1"; Pfam description=BTB/POZ domain
CLNHFIFRPIMTSKHFCLKWNKFESNILSAFESLQNTEDLADVTLTCEGINIKAHKFILSACSPYFRTIFKENPCPHPIVILKDVAHADLMAIINFMYHGEVIVSEEQFASFLNTAVVLQVLGLIDNEETHQKKHPFPAKKLKNISDCQESPQKKPKMTLPKPKKVIAASSGLEEPTQILNSRIHLHLHNLRLLKLVTLRLKKAASMNMMLVKMLRL

SEQ ID NO: 22588 - protein, 276 aa, Diabrotica virgifera
  misc_feature: Coding regions on vcDNA: vcDNA=SeqID_2285; Strand=+; Position=150-976
  misc_feature: Homolog annotation: Hit_ID=NP_611067.1; Match level="QueryCoverage =96%, HitCoverage=54%, E-value=9e-58, Identity=39%"; Hit description =CG8302-PA [Drosophila melanogaster] gb|AAF58091.1| CG8302-PA [Drosophila melanogaster]
  misc_feature: Pfam annotation: Pfam_ID=p450; Match level="Score=-184.6, E-value =0.0095, Copies=1"; Pfam description=Cytochrome P450
  misc_feature (236)..(236): Xaa can be any naturally occurring amino acid
  misc_feature (242)..(242): Xaa can be any naturally occurring amino acid
  misc_feature (244)..(244): Xaa can be any naturally occurring amino acid
MDYYLGYILTVLLTIFRTLKNYMRTVILAWKLPGPTALPILGNVLILKNHTELIYLGNHAPNMYGKFFRVWCSILPAIFITEPRHLKQILSTNKNNEKSLFYRAFHNFIGEGLITNNGYKWKKNRKMIQPYFHMNILEKFVDLFTECSSRFVSKLEGEQTVKITPFINDCVLDILHNGVLGVPFDQDSPYRKGQLQAIERFVRPWLLFDSIFDRTNSANYEKKQKHNLHSYTEEVXHNRRQXNXERNQRTKTCFLDMFIEIADNNSQFTEEDIIYE

SEQ ID NO: 22589 - protein, 278 aa, Diabrotica virgifera
  misc_feature: Coding regions on vcDNA: vcDNA=SeqID_2286; Strand=+; Position=68-904
  misc_feature: Homolog annotation: Hit_ID=XP_394751.1; Match level="QueryCoverage =91%, HitCoverage=74%, E-value=2e-61, Identity=47%"; Hit description =similar to ENSANGP00000019084 [Apis mellifera]
  misc_feature: Gene Ontology Annotation: Molecular function=structural constituent of ribosome; Cellular component=mitochondrial small ribosomal subunit; Biological process=biological_process unknown
MAALRYISKNLFKHIFRSELKANTEICLIYSRLLNYSSIEYDIKHDPAPKFFNKDIQLLLREITRVDLTKVNQKIKLGGKGLEDPIYKFMTDDELKEAIEEAKQKSHELLQIPPVVAVRKPMTHVLSEDPALQGLEESKLVFTDITFGLKNIERIIVVREPDGTLREADWELRNRMNQLYFPQKERHIKPPRMFFGELLNNLLEHYEYKFILDRACVQFEPNDPEYQRVVSVTYQHVNDHEKFDLLRSTRHFGALTFFLVWNKNIDNLLLELIETSQI

SEQ ID NO: 22590 - protein, 285 aa, Diabrotica virgifera
  misc_feature: Coding regions on vcDNA: vcDNA=SeqID_2287; Strand=+; Position=79-933
  misc_feature: Homolog annotation: Hit_ID=XP_321709.1; Match level="QueryCoverage =98%, HitCoverage=45%, E-value=3e-68, Identity=46%"; Hit description =ENSANGP00000015823 [Anopheles gambiae]
  misc_feature: Gene Ontology Annotation: Molecular function=single-stranded DNA binding; Cellular component=DNA replication factor A complex; Biological process=DNA dependent DNA replication
  misc_feature: Pfam annotation: Pfam_ID=Rep-A_N; Match level="Score=70.3, E-value =5.3e-18, Copies=1"; Pfam description=Replication factor-A protein 1, N-ter
  misc_feature (251)..(252): Xaa can be any naturally occurring amino acid
  misc_feature (255)..(255): Xaa can be any naturally occurring amino acid
  misc_feature (257)..(257): Xaa can be any naturally occurring amino acid
  misc_feature (267)..(267): Xaa can be any naturally occurring amino acid
  misc_feature (274)..(274): Xaa can be any naturally occurring amino acid
MRSPQTYNMSEGSLQTIMSGGEFPNPIMQVLGSKKINAGLGDKERIRILLSDGKYTISFAMLTAQINDRLGPNGVETFSIIQIDRYVTSIINNSGKGEARVLLILDMHVVVPGTEVTEKVGSPIPLPTDADAAKGSTAAPATNNSIKNVTVAKPNISNGNGTTAMNASTNDDIATHMIHPISSLTPYQNRWTIKARITNKPPIRTWSNSRGEGKLFSFDLVDESGEIRCTAFKEMVDKFYDYLQVDKVYYXXQCXLXQAKQQYSTLXHEYEMTXTHDTVIKECLD

SEQ ID NO: 22591 - protein, 312 aa, Diabrotica virgifera
  misc_feature: Coding regions on vcDNA: vcDNA=SeqID_2288; Strand=+; Position=177-1116
  misc_feature: Homolog annotation: Hit_ID=NP_610730.1; Match level="QueryCoverage =93%, HitCoverage=52%, E-value=1e-39, Identity=33%"; Hit description =CG8378-PA [Drosophila melanogaster] gb|AAF58578.1| CG8378-PA [Drosophila melanogaster]
  misc_feature: Pfam annotation: Pfam_ID=zf-MYND; Match level="Score=28.7, E-value =1.6e-05, Copies=1"; Pfam description=MYND finger
  misc_feature (20)..(20): Xaa can be any naturally occurring amino acid
  misc_feature (131)..(131): Xaa can be any naturally occurring amino acid
MKTAYSIQTIFQDLLKTIQXNNEVDNISKIFSKITTNHERVDFVIELLKKYQISCEFVKDKKCDKVSVNLREQGNQKFKGKLLQEALELYTQSLANAEENSENFSKALANRSAVLFELELYEECLKDIEIXENNYPKDLQPKLIKRKTNALSQVQSEKDRKPYFKPAPDLPIASKLSSIECSTNLLEIQSTPTQGRHVVAKENIEIGDILAVEKPFCHILASEFYSHCHECLKLSYNLVPCPNCTQVLYCSSECQKDAQKYHKYECNILKTLRSLKLDKMKLLPLKLSMLARDCYSEIAGITNWRVLTKIPI

SEQ ID NO: 22592 - protein, 306 aa, Diabrotica virgifera
  misc_feature: Coding regions on vcDNA: vcDNA=SeqID_2289; Strand=+; Position=20-938
  misc_feature: Homolog annotation: Hit_ID=EAL32572.1; Match level="QueryCoverage =76%, HitCoverage=39%, E-value=2e-50, Identity=43%"; Hit description =GA21853-PA [Drosophila pseudoobscura]
  misc_feature: Gene Ontology Annotation: Biological process=reproduction
  misc_feature: Pfam annotation: Pfam_ID=GMC_oxred_N; Match level="Score=108.7, E -value=1.5e-29, Copies=1"; Pfam description=GMC oxidoreductase
  misc_feature (270)..(270): Xaa can be any naturally occurring amino acid
MRPRSSSTLVALLFLVSVKAEFSPFDIVDEYVKQFRSGIGNLCKWSDNYSYQQRNYDKSEFNATLALGGAEEYDFIIVGGGTAGLTLAHRLSEEPRWRTLVLEAGGLETTITEVPAMQPQLQTTAYTWGYKTCVQKHACLGSVGNMCSVVKGKAVGGDTAINDMLYTRGHPRDYDLWADTGMKGWCWDNVLPYFKNMEDACVEDMDRKFRHYGGPIHLENLYPSDPILAEHFLKAGLESGLERIDYNGKEHLGLGLPQVITKHGKRHSVXGYLKPIKERKNLELSPYRPGTEVLVSPITKEGHGVT

SEQ ID NO: 22593 - protein, 152 aa, Diabrotica virgifera
  misc_feature: Coding regions on vcDNA: vcDNA=SeqID_2290; Strand=+; Position=14-469
  misc_feature: Homolog annotation: Hit_ID=AAW56443.1; Match level="QueryCoverage =97%, HitCoverage=59%, E-value=2e-51, Identity=61%"; Hit description =PR-5-like protein [Diaprepes abbreviatus]
  misc_feature: Pfam annotation: Pfam_ID=Thaumatin; Match level="Score=35.7, E-value =5.1e-11, Copies=1"; Pfam description=Thaumatin family
FRYILLVAVFSSAFAVEFEIVNKEIGAVWVGIQGNDGKEALANGGFILEAGASRSVQAPKDWAGRFWARTWCDINTQHCDTGDCGNRIECGGNGGAPPASLAEITLKGWGGLDYYDISLVDGFNIAVSFEPVGGNGDGSQYSCKKCACGRNL

SEQ ID NO: 22594 - protein, 381 aa, Diabrotica virgifera
  misc_feature: Coding regions on vcDNA: vcDNA=SeqID_2291; Strand=+; Position=3-1145
  misc_feature: Homolog annotation: Hit_ID=T17121; Match level="QueryCoverage=97%, HitCoverage=11%, E-value=1e-110, Identity=53%"; Hit description=CPY protein - midge (Chironomus thummi) emb|CAA57760.1| CPY [Chironomus thummi]
  misc_feature: Gene Ontology Annotation: Molecular function=protein binding
DAWVQEKLDFEAKVQRAAKRKRWLRANETLLRTLLSYCSLHGATGGLASVRMELMLLLQELQQEKTHQQLLSPLPFPTSLPLLAASVASSKTVVADPIRYLQCLTHDMLQTLMELQQPHTGQNQLLVIRDLAIALSACIYQSLCDSDTFKNSLQEAQEIGATFLVGRKRRISVNEGHSIITIPSKWPGLTSLRSLLAREKDDDTPRLTVILCESFTAVYLSLVLYGLVTYDCIILFHVNAHIFDSDVWGKLFGGGIKKLLRTASLAGNHPHHPQYLSQQSVKTPSTDEPNGPATWLSKQRVKLNTKLLGQQPSKMKEDKPTYREQFVPPEMSILAYLLQKPATIDYIEEVESDIEEEDEDEDVFDAPVTKTIKTVKHEHSD

SEQ ID NO: 22595 - protein, 302 aa, Diabrotica virgifera
  misc_feature: Coding regions on vcDNA: vcDNA=SeqID_2292; Strand=+; Position=253-1160
  misc_feature: Homolog annotation: Hit_ID=XP_392124.1; Match level="QueryCoverage =94%, HitCoverage=21%, E-value=1e-138, Identity=84%"; Hit description= similar to ENSANGP00000016735 [Apis mellifera]
  misc_feature: Gene Ontology Annotation: Molecular function=1-phosphatidylinositol-4- phosphate 5-kinase activity; Cellular component=cellular_component unknown; Biological process=peripheral nervous system development
  misc_feature: Pfam annotation: Pfam_ID=PIP5K; Match level="Score=154.5, E-value =2.4e-43, Copies=1"; Pfam description=Phosphatidylinositol-4 -phosphate 5-Ki
  misc_feature (270)..(270): Xaa can be any naturally occurring amino acid
  misc_feature (284)..(284): Xaa can be any naturally occurring amino acid
MIKTITRWRSKAYKTLTKKTLPSDNKPKNERERKIGHRRVGVGGEITYKKIQSTQIMGSIQLGIQHAVGGLASKPERDLLMQDFMTVETTNFPSEGSNHTPAHHYSEFKFKNYAPIAFRYFRDLFGIQPDDFLMSMCNTRLRELSNPGASGSIFYVTFDDEFIIKTVQHKEGEFLQKLLAGYYMNLNQNPRTLLPKFFGLYCYQCNSKNVRLVVMNNLLPSSITMHQKYDLKGSTYKRKASKAERAKRNPTYKDLDFMEHHPEGIFMEAXDTYNVLTKTIPKKXKGLKSFKIMDFDFFLTKT

SEQ ID NO: 22596 - protein, 262 aa, Diabrotica virgifera
  misc_feature: Coding regions on vcDNA: vcDNA=SeqID_2293; Strand=+; Position=137-922
  misc_feature: Homolog annotation: Hit_ID=XP_414838.1; Match level="QueryCoverage =93%, HitCoverage=63%, E-value=2e-86, Identity=60%"; Hit description =PREDICTED: similar to Hydroxyacylglutathione hydrolase (Glyoxalase II) (GLX II) [Gallus
  misc_feature: Gene Ontology Annotation: Molecular function=hydroxyacylglutathione hydrolase activity; Cellular component=cytoplasm; Biological process= sulfur metabolism
  misc_feature: Pfam annotation: Pfam_ID=Lactamase_B; Match level="Score=111.6, E -value=1.9e-30, Copies=1"; Pfam description=Metallo-beta-lactamase superfamily
GQAYWRNGFKGYHSNQLTITFEKMKIKILPALSDNYMYLISCENTKEAAIIDPVEPDTVLEAVKVEGVNLTKILTTHHHWDHAGGNEQLINKASGKLQVLGGDQRIGGLTQEVKQGDKFQIGDIAVECLFTPCHTSGHICYYLTAPGQDPAVFTGDTLFIAGCGRFFEGTAEQMYSALVEKLGKLPDNTRVFCGHEYTLQNLKFAKSVDQNNQDVLKKIEWAEGQRKKGLPTVPSTIGEEKTYNPFMRVTTSVIQNHAGCTS

SEQ ID NO: 22597 - protein, 68 aa, Diabrotica virgifera
  misc_feature: Coding regions on vcDNA: vcDNA=SeqID_2294; Strand=+; Position=69-275
VVRMVGLLYKIKKLYLKCKWVTRNCLFFFIFGFTKIKYIISFNNLCQSVTYVGQLYIPSRFYNLCKHN

SEQ ID NO: 22598 - protein, 61 aa, Diabrotica virgifera
  misc_feature: Coding regions on vcDNA: vcDNA=SeqID_2295; Strand=+; Position=163-348
TSVVEASSIVCLHEWSKLNCIKLCTSLSHTHSQLHLRKKLTSKNYKMFTSLLPLVQLTYLC

SEQ ID NO: 22599 - protein, 101 aa, Diabrotica virgifera
  misc_feature: Coding regions on vcDNA: vcDNA=SeqID_2296; Strand=+; Position=85-390
  misc_feature: Homolog annotation: Hit_ID=EAL33544.1; Match level="QueryCoverage =100%, HitCoverage=100%, E-value=1e-26, Identity=52%"; Hit description=GA11014-PA [Drosophila pseudoobscura]
MALSPWLKSPFTDLTGSLVNHQWYGECADMELKVLDCLDAYGLDRGLKKCDDLIEDFRECALKTKQFKRMYAMRNERHRQHFAGERTSENKYAKGPAYDSY

SEQ ID NO: 22600 - protein, 212 aa, Diabrotica virgifera
  misc_feature: Coding regions on vcDNA: vcDNA=SeqID_2297; Strand=+; Position=175-813
  misc_feature: Homolog annotation: Hit_ID=XP_311545.1; Match level="QueryCoverage =95%, HitCoverage=92%, E-value=5e-45, Identity=46%"; Hit description =ENSANGP00000010247 [Anopheles gambiae]
  misc_feature: Gene Ontology Annotation: Molecular function=glutathione peroxidase activity; Cellular component=cellular_component unknown; Biological process=glutathione conjugation reaction
  misc_feature: Pfam annotation: Pfam_ID=GST_N; Match level="Score=72.5, E-value=1.2e- 18, Copies=1"; Pfam description=Glutathione S-transferase, N-terminal
MPSYKLTYFNFTGRAEPVRVLLRYGGIPFEDVRVEHADWPSVKPTTPYGQVPVLEVDGKKFTQGIPLARYVANIVGLVGKSNEENLEIEIAVNILSEILKTAYESHFDPDEEQKKKHLKTLHELLAKYLPVLDEAAKKNGGHIGSNKLNWGDVYFVTAYEDIRNILGNKDIVENYSGLQNVKKNVLSDKNIKEYIQSRPKIPIFVYDLRSEA

SEQ ID NO: 22601 - protein, 76 aa, Diabrotica virgifera
  misc_feature: Coding regions on vcDNA: vcDNA=SeqID_2298; Strand=+; Position=499-729
NSLLALVFMKYSRTSIIRINWDRSPSGLSNYPDYRNYLKKRPVYRLKYNKHFKILCFLLYSKVSGGKINQNIFFYV

SEQ ID NO: 22602 - protein, 106 aa, Diabrotica virgifera
  misc_feature: Coding regions on vcDNA: vcDNA=SeqID_2299; Strand=+; Position=97-414
YQRTQNVMDEKSEHGDQTAEIHDPVVGSLDEGMDIRMDPEADVSAVDSAENAGTSQDTETPEVAEPNIESAVGNDDNTLISELNDVSLSAAATSNETDSFLDSFTS

SEQ ID NO: 22603 - protein, 85 aa, Diabrotica virgifera
  misc_feature: Coding regions on vcDNA: vcDNA=SeqID_2300; Strand=-; Position=1235 -1492
LKTHFIKFISYADEFCYQKITYLSAFNHSHTLVCFYQIRLIRKFMIKHSEMFKYNTQLKKSSIKFRRISTKCTYLKFTFLSNFLC

SEQ ID NO: 22604 - protein, 145 aa, Diabrotica virgifera
  misc_feature: Coding regions on vcDNA: vcDNA=SeqID_2301; Strand=+; Position=20-454
  misc_feature: Homolog annotation: Hit_ID=NP_003487.1; Match level="QueryCoverage =95%, HitCoverage=3%, E-value=9e-41, Identity=58%"; Hit description =transformation/transcription domain-associated protein [Homo sapiens] gb|EAL23887.1|
  misc_feature: Gene Ontology Annotation: Molecular function=molecular_function unknown; Cellular component=PCAF complex; Biological process=signal transduction
TLPNFKQDSGLMNVAYFKFDVDDSTGELDTTRPVPFRLTPNIIEYLSTIGVTGPLTTTMIATSRCFIYPNFKVLSILKPIIRDEMMLARAKKAEDLNNPEKMNDASEQIINMVNKAVTSISNRLTNLAQFEGTDSKVATLDAAAN

SEQ ID NO: 22605 - protein, 295 aa, Diabrotica virgifera
  misc_feature: Coding regions on vcDNA: vcDNA=SeqID_2302; Strand=+; Position=1-885
  misc_feature: Homolog annotation: Hit_ID=NP_608323.1; Match level="QueryCoverage =74%, HitCoverage=30%, E-value=9e-13, Identity=27%"; Hit description =CG14205-PA [Drosophila melanogaster] gb|AAF48977.2| CG14205-PA [Drosophila melanogaster]
  misc_feature (274)..(274): Xaa can be any naturally occurring amino acid
  misc_feature (278)..(278): Xaa can be any naturally occurring amino acid
  misc_feature (280)..(280): Xaa can be any naturally occurring amino acid
TRGPQFPGSAPPPPPPRPKNKKFFIIFLFFIITLVKSHRDIAETDVAHSDVAVLQDYNKWTTAIRSLLDNKTLSSECSKQFDELFKNGQADLWNFFDATSKFPWSGLAVSSYADFGNYPQCMQINHIYSGGRIKGKYCVFGLAIPSSKADLSNINVDDFFKLSVCMPDACSADDFNKIIILPLFNDQECHTQDDLDEYTPGDKAILVVLSIFAVILAASTSYDVYLVKTGKKSSHPLFLAFSVYTNCRKIITTTKKNREQIQIFNGIKSISIAXIIAXHXFNGWLVNVANYDYVK

SEQ ID NO: 22606 - protein, 945 aa, Diabrotica virgifera
  misc_feature: Coding regions on vcDNA: vcDNA=SeqID_2303; Strand=+; Position=31-2866
  misc_feature: Homolog annotation: Hit_ID=NP_733419.1; Match level="QueryCoverage =84%, HitCoverage=54%, E-value=0.0, Identity=56%"; Hit description =CG31004-PB, isoform B [Drosophila melanogaster] ref|NP_733418.1| CG31004-PA, isoform A [Drosophila
  misc_feature: Gene Ontology Annotation: Molecular function=cyclin-dependent protein kinase inhibitor activity; Biological process=G1 phase of mitotic cell cycle
  misc_feature: Pfam annotation: Pfam_ID=AMOP; Match level="Score=203.3, E-value=4.9e- 58, Copies=1"; Pfam description=AMOP domain
  misc_feature (435)..(435): Xaa can be any naturally occurring amino acid
LGLGGGLGGGGGGGATITTINRAVPVPVPQPYPVTVNRPVPVPVPQPVEVPVPRPVQVPVPVAQPVEVPRPYPVVVNRPVPVAVPTPVRVPVPQPVAVPVPQPYPVTVPQPVPVRVPQTIVVPVAQPIVVGGGGGGLGGGLGSGLGGGTNEVFGYVVDKNRAICVQPQLYAEGWVNLQIAVNSEAFKWKGKYYVESPASATQKIFFKDMKLHEKSPSELKITWEKQNLTTNDNANIRISLWGYRETTMKPVFVYITDIADNVQNIGEHTIVPSQFRTRVNQYLTDIKFGFLQINLTESITVNTYTTSQSSIELTPVIWSRPIPLGWYFQFQWENQYGKNWPKYLCDDWLRTDRYLKNFAHELAQCPCTVEQALADKGRFMPDFDCDKDSNPICYYNNQALHCVKTGSPTLEGSEQQCCYDKNGFLMLSYDQQWGXSSPRRCHNLGKMPYNEATKVPTLSQWFNDMVPKYLCCLWQDEQAVGCETLRFERRPTQDCVAYQAPGVAGVYGDPHFVTFDDVEYTFNGKGEFALVKSVTQTDNLEIQGRFEQMDPNTYGEVRATQLTSVVAKGNNTIAIEVRRRPLDSRWRYRLDVIADNRRLYFDRPSLKFQHFQGVTIYTPSYILNQSEVIIMFDNGAGMEVVDNQGFMSARVFLPWSFINKTIGLFGNWSFNKEDDFTLPDGSRAAIVNNINDMERVYNDFGSKWMLEDVLDPQKGRALFHREFGRTSATYNNKTFKPQFLMNPEDFLPTNRSTDLKRISEICPLKLYECYYDYAMTVDRDLAHYTKNYKATIYQYKETTRRKVVSCGVLETPRFGRKSTFLFVPGTKVTYECIQEFVLVGDQRRECQADGTWNIPEYGYTYCLRQEEYSSRQAAITSGIILAIIIPLVLLLGYVGYKIYERLTSNNQNYDYDTVQKTQNLQQFSRNFKSIPEKEDEDEKVSSKRH

SEQ ID NO: 22607 - protein, 165 aa, Diabrotica virgifera
  misc_feature: Coding regions on vcDNA: vcDNA=SeqID_2304; Strand=+; Position=113-607
  misc_feature: Homolog annotation: Hit_ID=XP_311111.1; Match level="QueryCoverage =99%, HitCoverage=63%, E-value=5e-33, Identity=47%"; Hit description =ENSANGP00000017440 [Anopheles gambiae]
NYYPQPQAVIGHDGRPDATYEVQAAKAAHFAAHAAAKYQSAPWAQSGYASHNALPADTPEVAAAKLQHYHDYAVAAQRNSVHGYAPAVAIGHGQPVDTPEVQYAKAAHFAAHAEAAARSYGHGHYRRRRGIYDFHIPVIDHNGVPVETPEVQAAKAHHFAEYSKV

SEQ ID NO: 22608 - protein, 86 aa, Diabrotica virgifera
  misc_feature: Coding regions on vcDNA: vcDNA=SeqID_2305; Strand=+; Position=676-936
AISYSTGATGKLRMELKNLLIGYLPEFYKFVLIFPRVRDCKQQHILTLFFCKLAFYILKTVTKSILKTYCTSYFTNFCCHFLRPFY

SEQ ID NO: 22609 - protein, 395 aa, Diabrotica virgifera
  misc_feature: Coding regions on vcDNA: vcDNA=SeqID_2306; Strand=+; Position=1-1186
  misc_feature: Homolog annotation: Hit_ID=CAB39733.1; Match level="QueryCoverage =99%, HitCoverage=34%, E-value=6e-73, Identity=38%"; Hit description =protease, reverse transcriptase, ribonuclease H, integrase [Drosophila buzzatii]
  misc_feature: Pfam annotation: Pfam_ID=rve; Match level="Score=48.7, E-value=1.7e -11, Copies=1"; Pfam description=Integrase core domain
  misc_feature (356)..(356): Xaa can be any naturally occurring amino acid
  misc_feature (362)..(362): Xaa can be any naturally occurring amino acid
  misc_feature (381)..(381): Xaa can be any naturally occurring amino acid
  misc_feature (388)..(388): Xaa can be any naturally occurring amino acid
MTDCSNTASGGVLYQIVDGEEHPIAYTSRKLNKAQKNYTTTEKELLAIITGIEHFRYFLEGRSFTVITDHSSLVWLQSMKNPSPRLARWILKLAQYDYKIVHRKAAGVVVADALSRTFDINLLDLSTLQPDDWYRKMLYDVQNVPGKFPDFKVEHGVLYKHVLSSMDALTGMSEWKIVVPTPNRAEVLATFHDHPTAAHFGFYKTFRRISELYYWPKMRQSIRSYIARCKICATCKPTNLPQPGLMGSYRRIDFPFQLISLDLIGPYPRSYQGSQYALVVVDYFTKFPLVHTMSKATTSAIIKYLENEVFLIYGVPQIVSCDNGPQFTAKAFRDLLSKYNVQKIWYNANYHPQVNXTERVNXSIVTGLRSYSFPDQRACDXHIHSIVXAIRTSSH

SEQ ID NO: 22610 - protein, 243 aa, Diabrotica virgifera
  misc_feature: Coding regions on vcDNA: vcDNA=SeqID_2307; Strand=+; Position=145-876
  misc_feature: Homolog annotation: Hit_ID=EAL28870.1; Match level="QueryCoverage =94%, HitCoverage=87%, E-value=6e-33, Identity=31%"; Hit description =GA10301-PA [Drosophila pseudoobscura]
  misc_feature: Gene Ontology Annotation: Molecular function=molecular_function unknown; Cellular component=cellular_component unknown; Biological process=circadian rhythm
  misc_feature: Pfam annotation: Pfam_ID=DUF233; Match level="Score=109.8, E-value=7e- 30, Copies=1"; Pfam description=Odorant binding protein
MKLLFVLSCVLFVQSAKKLPSFVEVCPRDNKEASECLARNVKNLTPMLGKGIPELFIPPLAPLVLQSAEIATSPSFTCSLKNAKVYHLDSIVMTDVFINFDTKSWGADVFFPVIEVESDYKMNGKILVLELNSEGKSRGNMTNIKTNVLVFFDVVTRNGKEHLHITDTKIKMDIEKCAFEFDDLFKGNEDLTQRANQILNQNYKVLLEEFSPVFEKIIATLTENVVESIYKKYPFDILYPKKN

SEQ ID NO: 22611 - protein, 50 aa, Diabrotica virgifera
  misc_feature: Coding regions on vcDNA: vcDNA=SeqID_2308; Strand=+; Position=49-201
NFRFNSSFSGASLFVTCSVHDIFRILLYTHDSNDSSFFIDVAFRAVAFIP

SEQ ID NO: 22612 - protein, 281 aa, Diabrotica virgifera
  misc_feature: Coding regions on vcDNA: vcDNA=SeqID_2309; Strand=+; Position=185-1024
  misc_feature: Homolog annotation: Hit_ID=AAP37655.1; Match level="QueryCoverage =98%, HitCoverage=53%, E-value=1e-104, Identity=68%"; Hit description= serine/threonine protein kinase Akt [Aedes aegypti]
  misc_feature: Gene Ontology Annotation: Molecular function=protein serine/threonine kinase activity; Cellular component=cytoplasm; Biological process =insulin receptor signaling pathway
  misc_feature: Pfam annotation: Pfam_ID=PH; Match level="Score=82.5, E-value=1.1e -21, Copies=1"; Pfam description=PH domain
  misc_feature (193)..(193): Xaa can be any naturally occurring amino acid
  misc_feature (263)..(263): Xaa can be any naturally occurring amino acid
  misc_feature (272)..(272): Xaa can be any naturally occurring amino acid
MNEASSVGGPTGPLTISKELIVKEGWLQKRGEHWKNWRPRYFILLNYGALVGFKSKLEDYYHVEPLNNFTVKGCQIMSIDRPKPFTFIIRGLQWTTVIERMFCVESEQEREEWVAAIKMVSEKISDCEDVEMNPANSETGTMEDLCEKFSLQGTSISKLTGKRKVTLESFEFIKVLGKGTFGKVILCREKTTXRLYAIKILKKEVIIQKDEVAHTQTENRVLRTTHHPFLTSLKYSFQTNDRLCFVMEYVNGGELFFHLSREXRVFSEDRTXRFYGAEIIS

SEQ ID NO: 22613 - protein, 280 aa, Diabrotica virgifera
  misc_feature: Coding regions on vcDNA: vcDNA=SeqID_2310; Strand=+; Position=72-910
  misc_feature: Homolog annotation: Hit_ID=NP_861421.1; Match level="QueryCoverage =57%, HitCoverage=53%, E-value=2e-33, Identity=39%"; Hit description =zinc finger protein 233 [Homo sapiens]
  misc_feature: Gene Ontology Annotation: Molecular function=zinc ion binding; Cellular component=nucleus; Biological process=regulation of transcription, DNA-dependent
  misc_feature: Pfam annotation: Pfam_ID=zf-C2H2; Match level="Score=119.7, E-value =7.2e-33, Copies=5"; Pfam description=Zinc finger, C2H2 type
  misc_feature (220)..(221): Xaa can be any naturally occurring amino acid
  misc_feature (231)..(231): Xaa can be any naturally occurring amino acid
  misc_feature (241)..(241): Xaa can be any naturally occurring amino acid
  misc_feature (249)..(249): Xaa can be any naturally occurring amino acid
  misc_feature (269)..(269): Xaa can be any naturally occurring amino acid
  misc_feature (276)..(276): Xaa can be any naturally occurring amino acid
  misc_feature (278)..(278): Xaa can be any naturally occurring amino acid
MEIKEETVYLSNINKMEIKQENAMSNIKCKIEPDWENYEDTPDLIKYELKGENPDEDYSTTNVDDSGDSKIFLSQIKSEISLDDLKPEPTLKDEILDYTEETQKSEHGFLNADIQNDSCGLLNNEDIQHSNQNLSVGTSYGCDICCKQFSDPRLLRNHMKYHNGENDFQCKLCFKRFVSNSHLQVHTRSHTGERPYRCEICTKGFHHKSALKIHMRLHTXXERPFQCKLCXKKFLQACHLXNHIRMHTXEKPYSCHICSKQFSQATNTXHMLFHSXEXSL

SEQ ID NO: 22614 - protein, 109 aa, Diabrotica virgifera
  misc_feature: Coding regions on vcDNA: vcDNA=SeqID_2311; Strand=-; Position=930-1259
CKRNYKLCTNGNHLIYHFYCKITVYHCTSKCNKEYIRGYVLVVIILWIISPTLKWTIFLAEHFNATINTMIPNGETHNKNYYKNNTQQVVADLVPKNCISLDSRLCIYD

SEQ ID NO: 22615 - protein, 258 aa, Diabrotica virgifera
  misc_feature: Coding regions on vcDNA: vcDNA=SeqID_2312; Strand=+; Position=190-962
  misc_feature: Homolog annotation: Hit_ID=XP_395016.1; Match level="QueryCoverage =100%, HitCoverage=69%, E-value=7e-72, Identity=54%"; Hit description= similar to CG12254-PA [Apis mellifera]
  misc_feature (204)..(204): Xaa can be any naturally occurring amino acid
MVVCSVEHGVQADVIFLIEGTAVNGAYINDIKTSYIIPSLEYFNQAKIDDANYVSENANSMYGIVVFHAADCLPHLSTDTFGPFISPTKLLSAVDKLDLAGGKGESHSNIAEGLATALHCFEELQQKRDVTTLVQKHCILICNSPPYALPVLESHTYSGKTAEQLAVILQEKNINFSVISPRKIPSLYKLFEKAGGDLSSSQTXNYAKDPRHLVLLKGFSLKERSVSPPPGARPQSDTNTNTGMPTMTSLPSPLQGSD

SEQ ID NO: 22616 - protein, 468 aa, Diabrotica virgifera
  misc_feature: Coding regions on vcDNA: vcDNA=SeqID_2313; Strand=+; Position=2277 -3683
  misc_feature: Homolog annotation: Hit_ID=NP_650854.1; Match level="QueryCoverage =99%, HitCoverage=59%, E-value=5e-68, Identity=35%"; Hit description =CG12254-PA [Drosophila melanogaster] gb|AAF55729.1| CG12254-PA [Drosophila melanogaster]
ICDSPPYGLTVLESHTYSGKTAEQLAVILQEKNINFSVISPRKIPSLYKLFEKAGGDLSSSQTKNYAKDPRHLVLLKGFSLKERSVSPPPGATTTSQTQITNTGMPTMTSLPSPLQGSDSPIPGTTQPNSNILVNTTAGVGANVGQNNVYRPQGTQGMNMPPQKGVGVVNVPGGRMMANNQISMMQVNAPPGYHATGHVNINRTSPHWPMAPPIQQVRPYIPQTNQQVNTTQGSALIAQLTQPPSSISGTGVNQFGQMTTNSPINKINMPPQSNVQTSMPQNQIAIQTSMAQVSQANAIATSQAQISQNMSQGVQGVQNVQGVQGVQGVQGQQQPIRERHTIWQGLLEWIEKPKNATEQKTTKHVPCQVSANSKDGEPELKADGWPQKLIMQLMPKQLIGNIGGAYLKNSKSVLFHPQNCDALESLTKVMSSGFAGCVHFTSVAPCDIKVLILLYTSDKKAYLGFYTK

SEQ ID NO: 22617 - protein, 293 aa, Diabrotica virgifera
  misc_feature: Coding regions on vcDNA: vcDNA=SeqID_2314; Strand=+; Position=67-944
  misc_feature: Homolog annotation: Hit_ID=XP_319825.1; Match level="QueryCoverage =100%, HitCoverage=69%, E-value=1e-145, Identity=87%"; Hit description=ENSANGP00000023803 [Anopheles gambiae]
  misc_feature: Gene Ontology Annotation: Molecular function=ATP dependent RNA helicase activity; Cellular component=nucleus; Biological process =RNA localization
  misc_feature: Pfam annotation: Pfam_ID=DEAD; Match level="Score=177.7, E-value=2.4e- 50, Copies=1"; Pfam description=DEAD/DEAH box helicase
  misc_feature (254)..(254): Xaa can be any naturally occurring amino acid
  misc_feature (287)..(287): Xaa can be any naturally occurring amino acid
MADADDLLDYEDEEQTEQTATETATTEVQKKGVKGTYVSIHSSGFRDFLLKPAILRAIVDCGFEHPSEVQHECIPQAVIGMDILCQAKSGMGKTAVFVLATLQVIDPTENVVYVLVMCHTRELAFQISKEYERFSKYMPNIKVGVFFGGLPIQKDEETLKNNCPHIVVGTPGRILALVRSKKLNLKHLKHFILDECDKMLELLDMRRDVQEIYRNTPHEKQVMMFSATLSKEIRPVCKKFMQDPMEVYVDDEAXLTLHGLQQHYVKLKENEKNKKLFELLDVLEFNXVVIFVK

SEQ ID NO: 22618 - protein, 102 aa, Diabrotica virgifera
  misc_feature: Coding regions on vcDNA: vcDNA=SeqID_2315; Strand=-; Position=8-316
NQHYTENRSHGLFSLNHVAMDTYISFHFDFDISNIQYFKMSRFGCNTDENINEIIESNIPKNTVYSKKFVWKAFMDFCNDRKYELDGNRTVEELLIAHLNKF

SEQ ID NO: 22619 - protein, 241 aa, Diabrotica virgifera
  misc_feature: Coding regions on vcDNA: vcDNA=SeqID_2316; Strand=+; Position=186-906
  misc_feature: Homolog annotation: Hit_ID=NP_919387.1; Match level="QueryCoverage =97%, HitCoverage=84%, E-value=9e-55, Identity=48%"; Hit description =carbonyl reductase 1 [Danio rerio] gb|AAH54914.1| Carbonyl reductase 1 [Danio rerio]
  misc_feature: Gene Ontology Annotation: Molecular function=carbonyl reductase (NADPH) activity; Cellular component=cytosol; Biological process =biological_process unknown
  misc_feature: Pfam annotation: Pfam_ID=adh_short; Match level="Score=52.5, E-value =1.2e-12, Copies=1"; Pfam description=short chain dehydrogenase
  misc_feature (215)..(215): Xaa can be any naturally occurring amino acid
  misc_feature (226)..(226): Xaa can be any naturally occurring amino acid
MSLQKVAVVTGGNKGIGYAIVKGLCERFNGTVYLTSRDVNRGKLAVAQLDKENNLKPVFHQLDINDQNSVDSFRDFIKKEHGGLDLLINNAAIAFKSDATEPVGVQARETVRVNYFGTLRVCEALFPLLRNNAKVVNVSSSAGHLFRIPSEALRQEFSKRDLTVPELTKLMERFVKSAENDKTVEEGWGGSTYVVSKVGVSALTNIQQRLFDEEXPNRNISINSVXPGYVKTDMTSQKGVL

SEQ ID NO: 22620 - protein, 300 aa, Diabrotica virgifera
  misc_feature: Coding regions on vcDNA: vcDNA=SeqID_2317; Strand=+; Position=27-927
  misc_feature: Homolog annotation: Hit_ID=XP_312116.1; Match level="QueryCoverage =94%, HitCoverage=73%, E-value=5e-97, Identity=55%"; Hit description =ENSANGP00000017035 [Anopheles gambiae]
  misc_feature: Pfam annotation: Pfam_ID=Glyco_hydro_16; Match level="Score=-10.7, E -value=5.1e-07, Copies=1"; Pfam description=Glycosyl hydrolases family 16
  misc_feature (248)..(249): Xaa can be any naturally occurring amino acid
MNLMKFMALVFHNLRGCEKSVTTVSGTHAPLLPCKGDLIFKDEFNNLDLKKWQHEVSLSGNGNWEFQWYTNNRSNSYVEDGVLHIRPTFVADDYGNEFLYSGTIDVNGGSPADECTNPQFYGCSRTGSATNIVNPIKSARIRSLNSFSFKYGKVEVRAKVPAGDWLWPAIWLLPRYNQYSTWPASGEIDIMESRGNRQLTNPSGVNIGVQQIGSTLHWGPNPNYNQYARTHFEENLETGYDKAFHNYXXEWTPDYIKFAIDDEEIGRVTPREGGFWELGELSSSGLDNPWKRNSKMAPFD

SEQ ID NO: 22621 - protein, 188 aa, Diabrotica virgifera
  misc_feature: Coding regions on vcDNA: vcDNA=SeqID_2318; Strand=-; Position=190-756
  misc_feature: Homolog annotation: Hit_ID=YP_133762.1; Match level="QueryCoverage =100%, HitCoverage=83%, E-value=1e-72, Identity=72%"; Hit description= ATP synthase F0 subunit 6 [Dermatobia hominis] gb|AAR16447.1| ATP synthase F0 subunit 6
  misc_feature: Pfam annotation: Pfam_ID=ATP-synt_A; Match level="Score=187.5, E -value=2.8e-53, Copies=1"; Pfam description=ATP synthase A chain
  misc_feature (10)..(10): Xaa can be any naturally occurring amino acid
  misc_feature (74)..(74): Xaa can be any naturally occurring amino acid
  misc_feature (82)..(82): Xaa can be any naturally occurring amino acid
LIPSRYNYLXIKIIITLHKEFKVLIGNYKSQGRTLIFISLFRLILFNNFLGLFPYIFTRTRHITLTLRLALPLXLRFIIYGXINNTIHILAHLVPQGTPPILIPFIVCIETIRNVIRPGTLAVRLTANIIAGHLLITLLGNTGPIISIYILNILIIVQLLLLILETAVSIIQSYVFAVLRTLYSREVN

SEQ ID NO: 22622 - protein, 92 aa, Diabrotica virgifera
  misc_feature: Coding regions on vcDNA: vcDNA=SeqID_2319; Strand=-; Position=165-443
  misc_feature: Homolog annotation: Hit_ID=AAH54266.1; Match level="QueryCoverage =92%, HitCoverage=40%, E-value=1e-33, Identity=78%"; Hit description =Rps8-prov protein [Xenopus laevis] sp|Q7SYU0|RS8_XENLA 40S ribosomal protein S8
  misc_feature: Gene Ontology Annotation: Cellular component=cytosolic ribosome (sensu Eukarya); Biological process=protein biosynthesis
  misc_feature: Pfam annotation: Pfam_ID=Ribosomal_S8e; Match level="Score=-25.2, E -value=0.026, Copies=1"; Pfam description=Ribosomal protein S8e
FGRSIPDRKGAKLTAEDEEMFNKKRSKKVQKKYETRQKTAKVEPALEEQFSTGRLLACLASRPGQCGRADGYVLEGKELEFYIRKIKSKKAK

SEQ ID NO: 22623 - protein, 262 aa, Diabrotica virgifera
  misc_feature: Coding regions on vcDNA: vcDNA=SeqID_2320; Strand=+; Position=22-811
  misc_feature: Homolog annotation: Hit_ID=YP_054488.1; Match level="QueryCoverage =100%, HitCoverage=91%, E-value=1e-91, Identity=66%"; Hit description= cytochrome c oxidase subunit III [Periplaneta fuliginosa] dbj|BAD32634.1| cytochrome c oxidase
  misc_feature: Pfam annotation: Pfam_ID=COX3; Match level="Score=395.4, E-value=7e -116, Copies=1"; Pfam description=Cytochrome c oxidase subunit III
  misc_feature (18)..(18): Xaa can be any naturally occurring amino acid
  misc_feature (41)..(42): Xaa can be any naturally occurring amino acid
  misc_feature (65)..(65): Xaa can be any naturally occurring amino acid
  misc_feature (83)..(83): Xaa can be any naturally occurring amino acid
  misc_feature (100)..(100): Xaa can be any naturally occurring amino acid
  misc_feature (130)..(130): Xaa can be any naturally occurring amino acid
  misc_feature (225)..(225): Xaa can be any naturally occurring amino acid
  misc_feature (245)..(245): Xaa can be any naturally occurring amino acid
  misc_feature (247)..(247): Xaa can be any naturally occurring amino acid
  misc_feature (254)..(254): Xaa can be any naturally occurring amino acid
PLLGAFRAILTILGIIKXFHLYNNNLLIIGLLITRLIIYQXXRDIVREGTYQGLHTLVVTKGLRXGIILFITSEVLFFISFFXGFFHRSLAPTIELGILXPPKGIQAFNPLEIPLLNTLILLTSGLTVTXAHHGYTLCASFFDLPYLPTKHIAHHSLIENNFSQGLQGLIFTVTLGIYFTILQGYEYIESPFAISDSIYGSSFFIATGFHGLHVIIGTTFLLICXRHYLNHFSSTHHFGFEAAAXYXHFVDVVXLFLYISIY

SEQ ID NO: 22624 - protein, 271 aa, Diabrotica virgifera
  misc_feature: Coding regions on vcDNA: vcDNA=SeqID_2321; Strand=-; Position=1-813
  misc_feature: Homolog annotation: Hit_ID=XP_321891.1; Match level="QueryCoverage =100%, HitCoverage=60%, E-value=1e-102, Identity=66%"; Hit description=ENSANGP00000013901 [Anopheles gambiae]
  misc_feature: Gene Ontology Annotation: Molecular function=UTP-glucose-1-phosphate uridylyltransferase activity; Cellular component=cellular_component unknown; Biological process=embryogenesis and morphogenesis
  misc_feature: Pfam annotation: Pfam_ID=UDPGP; Match level="Score=60.3, E-value=9.9e- 20, Copies=1"; Pfam description=UTP--glucose-1-phosphate uridylyltran
IRMLTVNEDKKVRGHSRNASDSSQFIEATKRDALNRLQKELEKIVQSSEPSKVAENKKQLDGFTKLFTRFLDETGPSLNWENIEKLPGDAVRDYKTLEQPTSDLVHQMLNKLVVVKLNGGLGTSMGCHGPKSVITVRNDLTFLDLTVQQIETLNKTFKVNVPLVLMNSFNTDDDTEKIIRKYKNLQVEIHMFNQSCYPRVNRDSLLPVPKDAKVNNNLEAWYPPGHGDFYNSFQDSGLLQKFLKEGREYCFLSNIDNLGATVDLSILNLLL

SEQ ID NO: 22625 - protein, 258 aa, Diabrotica virgifera
  misc_feature: Coding regions on vcDNA: vcDNA=SeqID_2322; Strand=+; Position=96-872
  misc_feature: Homolog annotation: Hit_ID=EAL24726.1; Match level="QueryCoverage =98%, HitCoverage=97%, E-value=3e-92, Identity=61%"; Hit description =GA17043-PA [Drosophila pseudoobscura]
  misc_feature: Gene Ontology Annotation: Molecular function=protein C-terminus binding; Cellular component=microtubule; Biological process =regulation of cell cycle
  misc_feature: Pfam annotation: Pfam_ID=EB1; Match level="Score=95.9, E-value=1.1e -25, Copies=1"; Pfam description=EB1-like C-terminal motif
MAVNVYSTNVTSENLSRHDMLAWVNECLQSSFAKIEELCTGAAYCQFMDMLFPGSVQLKRVKFRTNLEHEYIQNFKILQASFKKMQVDKIIPVDKLIKGRFQDNFEFLQWFKKFFDANYDGRQYEALEARAGVSLGAGATNNGHSVQHHIAPAPKPHIQNRQVPKVNAVKPTAAKPISNRPQAGDAGKIDELANQVAEFKLTVDGLEKERDFYFGKLRDIEVMCQECEDGNPIIQKILDVLYATEEGFAPPDEVEGVR

SEQ ID NO: 22626 - protein, 314 aa, Diabrotica virgifera
  misc_feature: Coding regions on vcDNA: vcDNA=SeqID_2323; Strand=+; Position=180-1119
  misc_feature: Homolog annotation: Hit_ID=AAG26008.1; Match level="QueryCoverage =86%, HitCoverage=54%, E-value=1e-73, Identity=48%"; Hit description =beta-glucosidase precursor [Tenebrio molitor]
  misc_feature: Gene Ontology Annotation: Cellular component=endoplasmic reticulum; Biological process=aging
  misc_feature: Pfam annotation: Pfam_ID=Glyco_hydro_1; Match level="Score=135.6, E -value=1.1e-37, Copies=1"; Pfam description=Glycosyl hydrolase family 1
  misc_feature (158)..(158): Xaa can be any naturally occurring amino acid
FTNKLIKNSIRSIGRVGANHFFYFLFLVTYAQAKNNGSFPKDFLFGVATSAYQIEGAWDEDGKGENIWDHMVHQVPSPIKNNDTGDIACDSYHKYKEDVDILEDLGVNFYRFSISWSRILPTGYPSTVNKAGLEYYKNLTKELVSRNITPVATIFHWXDLPQPLSEIDGWSNPRLADLFVEYSRIVIQGLPDVGVWITFNEPKQICHYGYGVGTVAPAIHSSGLREYWCAYTVLNAHAKTYHMYKSLNLKAPMGITIDCEWYEPLTDSVQDKQAAKRNLNFECGLYAHPLFIGDWAEDVKMRIYERSMAENITR

SEQ ID NO: 22627 - protein, 423 aa, Diabrotica virgifera
  misc_feature: Coding regions on vcDNA: vcDNA=SeqID_2324; Strand=+; Position=98-1369
  misc_feature: Homolog annotation: Hit_ID=XP_392109.1; Match level="QueryCoverage =88%, HitCoverage=61%, E-value=1e-46, Identity=30%"; Hit description =similar to cathepsin B mRNA 3-untranslated-region-binding protein CBBP [Apis mellifera]
  misc_feature: Gene Ontology Annotation: Molecular function=zinc ion binding; Cellular component=nucleus; Biological process=regulation of cell cycle
  misc_feature: Pfam annotation: Pfam_ID=zf-C2H2; Match level="Score=30.3, E-value =5.6e-06, Copies=4"; Pfam description=Zinc finger, C2H2 type
FIVFVLIKNRQGGGFNRDRKRSQNQKDQKKDKEDGTDGEDGETKRDWKDEKSNSETPETEEEAKARKEKEEKEGPYYDIPIKLLSCFVCNKEMWDGESMRKHVKGRAHRQMLDSLEESIHITVNILRENMRLLEEKKLIELNRVQRVTKRFNKPEPESHCNMCDLKFLGKIIAHRKTEGHQRLKHYLHPNCRLCSKEFPSRMEWIEHRLTPEHLRKLSKTLADKVGGADGNDIVEVEEETNDLALEPILDEPLEMEAENPILEITENINFSFMNLMPAYKPNRPISVNSLKPFSGFVCELCHRSFVDEEVSQNHLKTRRHHLKFIEALKLKFKEQQRKEKEAKEAEAKAEAEKNGANEDGDLYNPDEPTQEGDAEGDPSMDVSQEDAVKEETMEAEELEEEKPPAKGAAAKAKAAPAAAHQQL

SEQ ID NO: 22628 - protein, 279 aa, Diabrotica virgifera
  misc_feature: Coding regions on vcDNA: vcDNA=SeqID_2325; Strand=+; Position=94-933
  misc_feature: Homolog annotation: Hit_ID=AAR96139.1; Match level="QueryCoverage =100%, HitCoverage=100%, E-value=2e-93, Identity=59%"; Hit description=RH07059p [Drosophila melanogaster]
  misc_feature: Gene Ontology Annotation: Molecular function=protein C-terminus binding; Cellular component=microtubule; Biological process =regulation of cell cycle
  misc_feature: Pfam annotation: Pfam_ID=EB1; Match level="Score=95.9, E-value=1.1e -25, Copies=1"; Pfam description=EB1-like C-terminal motif
MAVNVYSTNVTSENLSRHDMLAWVNECLQSSFAKIEELCTGAAYCQFMDMLFPGSVQLKRVKFRTNLEHEYIQNFKILQASFKKMQVDKIVPIDRLVKGRFQDNFEFLQWFKKFFDANYKGTDYDALGARAGEQLGQGGSNAPRGQSLMLRRPNATPSAHVLQPQQTSPTKPKPAIRAMPKVNAVKPTAAKPISNRPQAGDAGKIDELANQVAEFKLTVDGLEKERDFYFGKLRDIEVMCQECEDGNPIIQKILDVLYATEEGFAPPDEVEGVGDEDEY

SEQ ID NO: 22629 - protein, 514 aa, Diabrotica virgifera
  misc_feature: Coding regions on vcDNA: vcDNA=SeqID_2326; Strand=+; Position=92-1636
  misc_feature: Homolog annotation: Hit_ID=XP_310977.1; Match level="QueryCoverage =96%, HitCoverage=84%, E-value=1e-135, Identity=48%"; Hit description= ENSANGP00000019297 [Anopheles gambiae]
  misc_feature: Gene Ontology Annotation: Molecular function=cystathione beta -synthase activity; Cellular component=cytoplasm; Biological process =cysteine metabolism
  misc_feature: Pfam annotation: Pfam_ID=PALP; Match level="Score=357.4, E-value=1.9e- 104, Copies=1"; Pfam description=Pyridoxal-phosphate dependent enzyme
MSKYVYRSPLNDAICAPEREQKCPWNPKVDRSTSIHTKVDWNAPKPKILPNALAAIGNTPLIKLNRIPQQEGLECDICVKCEFFNPGGSVKDRMANRILTDAENEGILKPGCTIIEPSSGNTGIGLAMAAAIKGYRCIIVMSEKISKEKEYVMRALGAEVIRCPVTANSFSPYGMFGTVHRLSKEIPNSVIFDQFSNPGNPLTHYDTTAEEIYDQCDKQVDMIIMGAGTGGTVTGIGRKFKEISPNTEIVCADPFGSSFALPEAINKTDVTFWEIEGMGYDFIPSTLDRKVIDTWIKVGDEKALPMARRLIKDEGLLIGASSGAMMWAAIQAAKAKNFGRGKKVVVVLPDSIRNYLTKFVCDQWMEERNLQPCVNVNNHPWWDLNVSQLGLPALQTVPVNSTFEEALNLMKKLGLNQIPALDGQGGVVGVVSMQLIINKLTSGNAKLSDPIADSLDRLYPRLEKSANIGLVSRVLEREPYLVILDPQGKGPSTVNKPVGVVTPLDFLQFIQKQN

SEQ ID NO: 22630 - protein, 208 aa, Diabrotica virgifera
  misc_feature: Coding regions on vcDNA: vcDNA=SeqID_2327; Strand=-; Position=93-719
  misc_feature: Homolog annotation: Hit_ID=CAH04320.1; Match level="QueryCoverage =100%, HitCoverage=100%, E-value=3e-99, Identity=83%"; Hit description=S8e ribosomal protein [Cicindela littoralis]
  misc_feature: Gene Ontology Annotation: Cellular component=cytosolic ribosome (sensu Eukarya); Biological process=protein biosynthesis
  misc_feature: Pfam annotation: Pfam_ID=Ribosomal_S8e; Match level="Score=351.6, E -value=1.1e-102, Copies=1"; Pfam description=Ribosomal protein S8e
MGISRDHWHKRRSTGGKRKPLRKKRKFELGRPAANTKLGARRIHYVRTRGGNLKYRALRIEKGNFAWGSEGTARKTRIIDVVYNASNNELVRTKTLVKNAIVVIDATPFRQWYESHYILPLGRKKGAKLTAEDEEMFNKKRSKKVQKKYETRQKTAKVEPALEEQFSTGRLLACLASRPGQCGRADGYVLEGKELEFYIRKIKSKKAK

SEQ ID NO: 22631 - protein, 224 aa, Diabrotica virgifera
  misc_feature: Coding regions on vcDNA: vcDNA=SeqID_2328; Strand=+; Position=150-824
  misc_feature: Homolog annotation: Hit_ID=YP_133762.1; Match level="QueryCoverage =100%, HitCoverage=100%, E-value=5e-83, Identity=68%"; Hit description=ATP synthase F0 subunit 6 [Dermatobia hominis] gb|AAR16447.1| ATP synthase F0 subunit 6
  misc_feature: Pfam annotation: Pfam_ID=ATP-synt_A; Match level="Score=187.5, E -value=2.8e-53, Copies=1"; Pfam description=ATP synthase A chain
  misc_feature (21)..(21): Xaa can be any naturally occurring amino acid
  misc_feature (36)..(36): Xaa can be any naturally occurring amino acid
  misc_feature (46)..(46): Xaa can be any naturally occurring amino acid
  misc_feature (110)..(110): Xaa can be any naturally occurring amino acid
  misc_feature (118)..(118): Xaa can be any naturally occurring amino acid
MIINLFSSFDPTSNFNLPINXLRTVLGLLIIPSKFXLIPSRYNYLXIKIIITLHKEFKVLIGNYKSQGRTLIFISLFRLILFNNFLGLFPYIFTRTRHITLTLRLALPLXLRFIIYGXINNTIHILAHLVPQGTPPILIPFIVCIETIRNVIRPGTLAVRLTANIIAGHLLITLLGNTGPIISIYILNILIIVQLLLLILETAVSIIQSYVFAVLRTLYSREVN

SEQ ID NO: 22632 - protein, 532 aa, Diabrotica virgifera
  misc_feature: Coding regions on vcDNA: vcDNA=SeqID_2329; Strand=+; Position=192-1790
  misc_feature: Homolog annotation: Hit_ID=JC7670; Match level="QueryCoverage=99%, HitCoverage=94%, E-value=1e-50, Identity=27%"; Hit description =cathepsin B mRNA 3'-untranslated-region-binding protein - flesh fly (Sarcophaga
  misc_feature: Gene Ontology Annotation: Molecular function=zinc ion binding; Cellular component=nucleus; Biological process=regulation of cell cycle
  misc_feature: Pfam annotation: Pfam_ID=zf-C2H2; Match level="Score=30.3, E-value =5.6e-06, Copies=4"; Pfam description=Zinc finger, C2H2 type
MANRRMGGGPGGGLRGNRSFNQPPFQGGSGVSPWQGSNSSGQGLISQITSNPQQLALALTSLLQPQQQNPPSLLSLNTSPGYNRDRDFGRGRDFRRHEPYSKNRQGGGFNRDRKRSQNQKDQKKDKEDGTDGEDGETKRDWKDEKSNSETPETEEEAKARKEKEEKEGPYYDIPIKLLSCFVCNKEMWDGESMRKHVKGRAHRQMLDSLEESIHITVNILRENMRLLEEKKLIELNRVQRVTKRFNKPEPESHCNMCDLKFLGKIIAHRKTEGHQRLKHYLHPNCRLCSKEFPSRMEWIEHRLTPEHLRKLSKTLADKVGGADGNDIVEVEEETNDLALEPILDEPLEMEAENPILEITENINFSFMNLMPAYKPNRPISVNSLKPFSGFVCELCHRSFVDEEVSQNHLKTRRHHLKFIEALKLKFKEQQRKEKEAKEAEAKAEAEKNGANEDDDLYNPDEPTQEGDAEGDPSMDVSQEDAVKEETMEAEELEEEKPPAKGAAAKGAKAAPAAATPAAVKNGAGPKSKKARK

SEQ ID NO: 22633 - protein, 511 aa, Diabrotica virgifera
  misc_feature: Coding regions on vcDNA: vcDNA=SeqID_2330; Strand=-; Position=300-1835
  misc_feature: Homolog annotation: Hit_ID=XP_321892.1; Match level="QueryCoverage =99%, HitCoverage=94%, E-value=0.0, Identity=74%"; Hit description =ENSANGP00000024060 [Anopheles gambiae]
  misc_feature: Gene Ontology Annotation: Molecular function=UTP-glucose-1-phosphate uridylyltransferase activity; Cellular component=cellular_component unknown; Biological process=embryogenesis and morphogenesis
  misc_feature: Pfam annotation: Pfam_ID=UDPGP; Match level="Score=802.0, E-value =2.9e-238, Copies=1"; Pfam description=UTP--glucose-1-phosphate uridylyltran
MTYNKLICEVRGHSRNASDSSQFIEATKRDALNRLQKELEKIVQSSEPSKVAENKKQLDGFTKLFTRFLDETGPSLNWENIEKLPGDAVRDYKTLEQPTSDLVHQMLNKLVVVKLNGGLGTSMGCHGPKSVITVRNDLTFLDLTVQQIETLNKTFKVNVPLVLMNSFNTDDDTEKIIRKYKNLQVEIHMFNQSCYPRVNRDSLLPVPKDAKVNDNLEAWYPPGHGDFYNSFQDSGLLQKFLKEGREYCFLSNIDNLGATVDLSILNLLLNPNQEQAQHEFVMEVTDKTRADVKGGTLIQYGGKLRLLEIAQVPKEHVDEFKSVKTFKFFNTNNLWVKLDAIDRVLQEDLLSMEIIVNNKSLDNGQNVIQLETAVGAAMKSFEGGIGINVPRSRFLPVKKTSDLFLVMSNLYTFKNGSLTMSPQRMFPTTPLVKLGDNHFSKVQQFLARFANIPDILELDHLTVSGDVTFGKGVSLRGTVIIIANHGDRIDIPAGAILENKIVSGNMRILDH

SEQ ID NO: 22634 - protein, 317 aa, Diabrotica virgifera
  misc_feature: Coding regions on vcDNA: vcDNA=SeqID_2331; Strand=-; Position=17-970
  misc_feature: Homolog annotation: Hit_ID=CAC51711.1; Match level="QueryCoverage =99%, HitCoverage=99%, E-value=1e-116, Identity=65%"; Hit description= NADH dehydrogenase subunit 1 [Tribolium castaneum] ref|NP _203167.1|ND1_15766 NADH dehydrogenase subunit 1
  misc_feature: Pfam annotation: Pfam_ID=NADHdh; Match level="Score=459.4, E-value =3.8e-135, Copies=1"; Pfam description=NADH dehydrogenase
  misc_feature (94)..(94): Xaa can be any naturally occurring amino acid
  misc_feature (129)..(129): Xaa can be any naturally occurring amino acid
  misc_feature (181)..(181): Xaa can be any naturally occurring amino acid
  misc_feature (193)..(193): Xaa can be any naturally occurring amino acid
  misc_feature (273)..(273): Xaa can be any naturally occurring amino acid
  misc_feature (291)..(291): Xaa can be any naturally occurring amino acid
YLFLNDLILIIISSLILIVCVLVSIAFLTLLERKVLGYIQIRKGPNKVGFLGLIQPFSDAIKLFTKEQIYPFISNFNLYYFSPILNLFLALFLXICIPFITINVTFNLTLLFFLSVSSLRVYTIILAGXSSNSNYALLGRLRSIAQTISYEVRLALILLSFLFLIISLNILDFIKYQEYIXFFYLFFPLCLIXIVSGLAETNRTPFDFAEGESELVSGFNVEYRSGGFAIIFLAEYGNILFIRIICVFIFLGANLIRLIFFFKLGLIRFLWLXVRGTLPRYRYDKLIYLAXKGYLPISLNYLIFFFRLSLFFFISII

SEQ ID NO: 22635 - protein, 516 aa, Diabrotica virgifera
  misc_feature: Coding regions on vcDNA: vcDNA=SeqID_2332; Strand=+; Position=1633 -3183
  misc_feature: Homolog annotation: Hit_ID=XP_310977.1; Match level="QueryCoverage =96%, HitCoverage=84%, E-value=1e-133, Identity=47%"; Hit description= ENSANGP00000019297 [Anopheles gambiae]
  misc_feature: Gene Ontology Annotation: Molecular function=cystathione beta -synthase activity; Cellular component=cytoplasm; Biological process =cysteine metabolism
  misc_feature: Pfam annotation: Pfam_ID=PALP; Match level="Score=348.7, E-value=8.1e- 102, Copies=1"; Pfam description=Pyridoxal-phosphate dependent enzyme
GRLSKYVYRSPLNDAICAPEREQKCPWNPKADRSTSIHTTVNWQAPRPKILPNALHAIGNTPLIKLNRIPQQEGLECDIYVKCEFFNPGGSVKDRMANRILTDAENEGILKPGCTIIEPSSGNTGIGLAMAAAIKGYRCIIVMSEKISKEKEYVMRALGAEVIRCPVTANSFSPYGMFGTVHRLSKEIPNSIIFDQFSNPGNPLTHYDTTAEEIYDQCDKKVDMIIMGAGTGGTVTGIGRKFKEISPNTEIVCADPIGSSFALPEIINKTDVTFWEIEGMGYDFIPSTLDRKVIDTWIKVGDENALPMARRLIKDEGLLIGASSGAMMWAAIQAAKAKNYGPGKRVVVMLPDSIRNYLTKFVCDQWMEERNLQPCVNTNNHPWWNLNVSQLNLPVPQTVPINSSIEQTLNLMKKLGLNQIPALDDQGGVVGVLSMQLIINKLTSGNATLNDPIADAIDRLYPRVEKSANIGLVSRVLEREPYLVILDTQGKGPSKINKPAGVVTPLDFLQFIQKQH

SEQ ID NO: 22636 - protein, 95 aa, Diabrotica virgifera
  misc_feature: Coding regions on vcDNA: vcDNA=SeqID_2333; Strand=+; Position=495-782
IKIKDSKNFSSFQNIVINSFSHHLIIFIFLNFFLKYKFKLFKFSNDDNISIKKFVYLVKIYRFNKGIRQHFFHLFIKNMVFFVLNIKSRLPTGLI

SEQ ID NO: 22637 - protein, 274 aa, Diabrotica virgifera
  misc_feature: Coding regions on vcDNA: vcDNA=SeqID_2334; Strand=+; Position=3-827
  misc_feature: Homolog annotation: Hit_ID=CAE72043.1; Match level="QueryCoverage =97%, HitCoverage=67%, E-value=3e-09, Identity=28%"; Hit description =Hypothetical protein CBG19125 [Caenorhabditis briggsae]
DIKENQEVYHTEDDQVDDKNLDTKIDKDAAPKLKYARGKKIKSDNDVTDEIQTKKYKFKNIDHDAIDTKFEKLDKKPNMENIDKHLDVSSKRSKHYVASKNVGLDDDQVDKSEKLVKLDKKTLLPKDNNIDNIQDLSNKRSKHTTSKNIDLDEDKIDKAEKIIRHNQKTVLIKEDDVNDFQDTSNKKIKYLSRKRSPENFEAVENTESTEKPGVSVEKTVKLETNIKYSQKPLAVSQKRVQLKDRSQMKKSFDEEYNRENKQHVKQNIKINTEI

SEQ ID NO: 22638 - protein, 387 aa, Diabrotica virgifera
  misc_feature: Coding regions on vcDNA: vcDNA=SeqID_2335; Strand=+; Position=2-1163
  misc_feature: Homolog annotation: Hit_ID=XP_393523.1; Match level="QueryCoverage =98%, HitCoverage=64%, E-value=1e-137, Identity=45%"; Hit description= similar to ENSANGP00000019179 [Apis mellifera]
  misc_feature: Gene Ontology Annotation: Molecular function=extracellular matrix structural constituent; Cellular component=collagen type V; Biological process=cell growth and/or maintenance
  misc_feature: Pfam annotation: Pfam_ID=COLFI; Match level="Score=204.0, E-value =3.1e-58, Copies=1"; Pfam description=Fibrillar collagen C-terminal domain
  misc_feature (86)..(86): Xaa can be any naturally occurring amino acid
AGRKGDPVGEQGPAGQDGAPGERGKQGAPGQQGSKGDRGEMGLIGPKGHAGLMGLQGLPGAQGAPGERGLPGERGLPGKDGESGSXGPPGREGSSGPQGPMGSPGSRGESGKDGRPGPPGAPGPAGPPGPPGEGMGYDAASLAALLAQGQNNQKGPDSMNDQPPRIFGKELTAEETRELIDKAYEQLKSSFEKLRKPNGQKNSPGKTCRDIKAAYPDSQNGQYWVDPNEGDIKDSILVYCNMEQRATCILPSPVRTPEVNYKGREPEIWLGDVNHGMKITYKADSTQIAFLHLLSSKASQNLTYHCKKSAAYFDATRHTFRRGIKLLTWNDIEVTPKGKLKYEVLSDECRYRRNTWEQSVITYSTEKPQRLPIVDIAIRDCGEQTIF

SEQ ID NO: 22639 - protein, 149 aa, Diabrotica virgifera
  misc_feature: Coding regions on vcDNA: vcDNA=SeqID_2336; Strand=+; Position=3-449
  misc_feature: Homolog annotation: Hit_ID=XP_393531.1; Match level="QueryCoverage =93%, HitCoverage=11%, E-value=1e-22, Identity=41%"; Hit description =similar to RIKEN cDNA 8430415E04 [Apis mellifera]
GSIQTSRTTLGVDSKIILIDFLKLIRDDSEEVLDALVPNIGPILVMFTSVGVLSRDKTTQATLDIGRGLLKCQVEIYSNYNWRRRMAFLVQLEDLPTCMPSDFIHQHFTPLVLKLSLESRARPVRTQAARTLLIFLRYNVKENHRKWIR

SEQ ID NO: 22640 - protein, 420 aa, Diabrotica virgifera
  misc_feature: Coding regions on vcDNA: vcDNA=SeqID_2337; Strand=+; Position=84-1344
  misc_feature: Homolog annotation: Hit_ID=EAL26357.1; Match level="QueryCoverage =92%, HitCoverage=43%, E-value=1e-118, Identity=53%"; Hit description= GA19555-PA [Drosophila pseudoobscura]
  misc_feature: Gene Ontology Annotation: Molecular function=sarcosine dehydrogenase activity; Cellular component=mitochondrial matrix; Biological process=biological_process unknown
  misc_feature: Pfam annotation: Pfam_ID=DAO; Match level="Score=309.5, E-value=5.3e -90, Copies=1"; Pfam description=FAD dependent oxidoreductase
  misc_feature (385)..(385): Xaa can be any naturally occurring amino acid
MLRLHKFHSIVSNQTKTRIITYANKKYFSNEGDLPKQADVVVVGGGVIGSSILYHLSKLGVNAILLEKNKLTSGTTWHSGALVWSLRATDVDNIMLKKTRDLLAGLEAETGVNPGWTQSGGIFIARTPERLEEYKRFHTLGHLLNIESHIISPTEAKKLASILDPKAFYGALWSPSDGHCDPSMYCAALIKGAKNRGAQVFEDTGVTKVLTAPTPNNEKKVTGVETSRGVIKTNIMVNAAGAWARHITQMVGLDLPLTPMKHSYVVTGSIPSAKGTPSIRDHDGNLYFKSQGDSIVFGGYEPNPEILHELPEVKFHLYELDMSLFDQHWKHACELCPEFEKAGIKSDICGPESFTPDHKPILGEDPKCVGLFHANAFNSLGIMLXGGVGDQLANWIVSGRPELPLYAFDIRRFTPVQRQD

SEQ ID NO: 22641 - protein, 279 aa, Diabrotica virgifera
  misc_feature: Coding regions on vcDNA: vcDNA=SeqID_2338; Strand=+; Position=94-928
  misc_feature: Homolog annotation: Hit_ID=EAL33124.1; Match level="QueryCoverage =98%, HitCoverage=64%, E-value=2e-66, Identity=46%"; Hit description =GA19813-PA [Drosophila pseudoobscura]
  misc_feature: Gene Ontology Annotation: Molecular function=molecular_function unknown; Cellular component=nucleus; Biological process=N signaling pathway
  misc_feature: Pfam annotation: Pfam_ID=WD40; Match level="Score=70.4, E-value=4.9e -18, Copies=3"; Pfam description=WD domain, G-beta repeat
  misc_feature (244)..(244): Xaa can be any naturally occurring amino acid
  misc_feature (247)..(247): Xaa can be any naturally occurring amino acid
MQGSSEGQLQIRLITKQDIYAVPDLPLSVPQAINANSLNELLNQLLKESNSDFLKPKDFDFLAIGELIRQPLIDHLQERNVSTETTVDVEYLERTPAPEPKDSLLHDDWVCGIETSDKWILTGCYDNSVNIWSTHGKIITSLKEHRNVVKAVSWIDKTDPSKGFISVSHDLTGLMWSFEPGTDNVVPQAVLRGHERGIDSVGVSPNSSRIATGGWDTNLKLWPTSIEEERSEPLPKRRKSRIIXATXTPLNTLKGPRETISGVTWIDNYVVSTVSMDHT

SEQ ID NO: 22642 - protein, 88 aa, Diabrotica virgifera
  misc_feature: Coding regions on vcDNA: vcDNA=SeqID_2339; Strand=-; Position=755-1021
GSPLPVNPPPPPRPLKLPALRGGFPFSPFRGGQIFGKGGIRGGPLFFFFPPTGKRGNWFKGNLIGLTQGFSHPGVLKRPPVNLILGAP

SEQ ID NO: 22643 - protein, 270 aa, Diabrotica virgifera
  misc_feature: Coding regions on vcDNA: vcDNA=SeqID_2340; Strand=+; Position=57-865
  misc_feature: Homolog annotation: Hit_ID=AAH46858.1; Match level="QueryCoverage =91%, HitCoverage=36%, E-value=2e-54, Identity=44%"; Hit description =Loc89944-prov protein [Xenopus laevis]
  misc_feature: Gene Ontology Annotation: Molecular function=beta-galactosidase activity; Cellular component=extracellular space
  misc_feature: Pfam annotation: Pfam_ID=Glyco_hydro_35; Match level="Score=180.4, E -value=3.7e-51, Copies=1"; Pfam description=Glycosyl hydrolases family 35
  misc_feature (262)..(262): Xaa can be any naturally occurring amino acid
MCALVADVLPTLYEYYTGGGIQTGLNADKPYFTLNNKNISIYSGAIHYFRIPKRYWRNRLRKLRAAGFNAVETYVPWNLHEPQPGWYDFGAGGSDMQEFLNVTEFLKIAQEEDLLAIVRPGPYICSEWEFGGFPSWFLREKNLKIRTSEPTYMKYVTRYFNVLLPILAMLQFTKGGPVIAFQVENEYGSTERTGRFVPDRQYLRELRTLFLNNGIVELLVTSDSPSQHGDIGTLPGVFLQTANFNFQTMIEFGALQKLQPNXPVMAMEFL

SEQ ID NO: 22644 - protein, 337 aa, Diabrotica virgifera
  misc_feature: Coding regions on vcDNA: vcDNA=SeqID_2341; Strand=+; Position=184-1194
  misc_feature: Homolog annotation: Hit_ID=CAG31537.1; Match level="QueryCoverage =87%, HitCoverage=70%, E-value=2e-92, Identity=56%"; Hit description =hypothetical protein [Gallus gallus] ref|NP_001006193.1| similar to Hypothetical protein MGC76107
  misc_feature: Gene Ontology Annotation: Molecular function=acyl-CoA dehydrogenase activity; Cellular component=mitochondrion; Biological process =energy pathways
  misc_feature: Pfam annotation: Pfam_ID=Acyl-CoA_dh_M; Match level="Score=190.3, E -value=4.1e-54, Copies=1"; Pfam description=Acyl-CoA dehydrogenase, middle domain
MSLSSTSQILCKGTTAIISRCFSLHKLPETHKLLQKTCRDFAEKELKPIAALLDREHKFPEQQINKLGELGILGICVSKEYGGAGYDGLGMAVAVEEISKGCAGTGAIVSIHNCLYASLLDRLGTPHQKEQYLRAFTKGTLGCFALSEPDAGSDVGAMSCTADKDGDHYILNGNKSWVTSGLQGKAAVVFATVDKGLKHKGITAFIVPIPSQGLTLGKKEDKLGIRASSTCNLILEDVKVPKENILGPIGGGFRIAMEQLDRARVGIAAQAVGIVQAALDLAARYSLQRKAFGKTISELDAGKLRPGEMGLRFESARILVGESSSPFETILPLINKR

SEQ ID NO: 22645 - protein, 248 aa, Diabrotica virgifera
  misc_feature: Coding regions on vcDNA: vcDNA=SeqID_2342; Strand=+; Position=71-816
  misc_feature: Homolog annotation: Hit_ID=EAL33469.1; Match level="QueryCoverage =83%, HitCoverage=29%, E-value=3e-84, Identity=70%"; Hit description =GA18821-PA [Drosophila pseudoobscura]
  misc_feature: Gene Ontology Annotation: Molecular function=threonine-tRNA ligase activity; Cellular component=cytoplasm; Biological process=tRNA modification
  misc_feature: Pfam annotation: Pfam_ID=tRNA-synt_2b; Match level="Score=176.9, E -value=4.3e-50, Copies=1"; Pfam description=tRNA synthetase class II core domain (
  misc_feature (216)..(216): Xaa can be any naturally occurring amino acid
MFKLCNKSLVSHLCRISNFTENYKFCLATFKLPINRRFKHDQKVKPNVPEKELPDHRKIGREQELFFFHEMSPGSCFFQPYGAHIYNTLVNFIRSEYRKRGYQEVISPNIYNTKLWETSGHWSHYSENIFSIDIENDKYALKPMNCPGHCLIFDHRIRSWRELPLRLADFGVLHRNELSGVLTGLTRVRRFQQDDAHIFCSPEQLKSEKSDCLNFXGNVYSTFEFPFELGRCTSSEIYMVDALWDSGG

SEQ ID NO: 22646 - protein, 119 aa, Diabrotica virgifera
  misc_feature: Coding regions on vcDNA: vcDNA=SeqID_2343; Strand=+; Position=32-391
IFLKKLSLKMVFKVSLLCTLLVLVAYSSAYDYSNCPGNTNRQKNLIYSSLLPPGYSVKTRIPATGYYQRPITCLLLIDQKGSASSPKIIEGGYLDTFAVVNITSTTAQPVSYYAIVFID

SEQ ID NO: 22647 - protein, 104 aa, Diabrotica virgifera
  misc_feature: Coding regions on vcDNA: vcDNA=SeqID_2344; Strand=-; Position=400-714
QISFHVISLLMRAPHSRRSRSRFNKYESVDGHLDITLPHFVLLPFSVGLVKGIFVGIAPLFVGIALPREVERVCREGTLNFGQLWRSNFAESVEPALDLCFSIV

SEQ ID NO: 22648 - protein, 67 aa, Diabrotica virgifera
  misc_feature: Coding regions on vcDNA: vcDNA=SeqID_2345; Strand=-; Position=25-228
KLQTVTLLLSMKKCYVSSTLSPKSIEVQQVRECRRTPCATLPRFALLPFSVGLARPSQRELCRYRIA

SEQ ID NO: 22649 - protein, 381 aa, Diabrotica virgifera
  misc_feature: Coding regions on vcDNA: vcDNA=SeqID_2346; Strand=-; Position=2-1144
MLFNISEKEQRGDVRPIGSPDPYTKQKLYVLDDPFGCIGEYQDENLLARRINRSAKISNFSASMDEICRKNGMMYKASFVQDQSKFSESDSMDKFKLTIKNSSLIIEGIKETMLNTVDQMKNRLQHFPKIPKSARLTPEFLVSNLFIKGNAGWVQGMLNKSSTYIHILATDYLCKLLKENINSIKKFKDVKIEFNYLINSDDSIVFCSCNNEEAIKFSYDFIQEGKKMFCLKMNIKKSYLSYVVGEVIQKYECNGKTINVWPKECISSYNLINKIDLIKDCEGAVGQLNSLQKLGAPETALIIVRKELRDLINRSYNIGPKKYINSEEIDREMLPIELGGWPGKLTTYEICSCGTFSQLTFLKNEIQKNLENKVLTKENKI

SEQ ID NO: 22650 - protein, 48 aa, Diabrotica virgifera
  misc_feature: Coding regions on vcDNA: vcDNA=SeqID_2347; Strand=-; Position=1-144
LKKHILSNHLQERLVYKRHFCLRDYFLLIFLLFSLFLHIFLGSCIVKR

SEQ ID NO: 22651 - protein, 265 aa, Diabrotica virgifera
  misc_feature: Coding regions on vcDNA: vcDNA=SeqID_2348; Strand=+; Position=153-949
  misc_feature: Homolog annotation: Hit_ID=XP_318854.1; Match level="QueryCoverage =84%, HitCoverage=35%, E-value=1e-109, Identity=80%"; Hit description= ENSANGP00000014359 [Anopheles gambiae]
  misc_feature: Gene Ontology Annotation: Molecular function=betaine/GABA:sodium symporter activity; Cellular component=integral to membrane; Biological process=transport
  misc_feature: Pfam annotation: Pfam_ID=SNF; Match level="Score=-141.8, E-value=3.5e- 13, Copies=1"; Pfam description=Sodium:neurotransmitter symporter fam
  misc_feature (258)..(258): Xaa can be any naturally occurring amino acid
MTHRREETQEYDENTLKLNRHEDIELPTLTNIPNLINQISYSKHPAQYPERGTWSSKLDFILSVVGLAIGLGNVWRFPYLCYKNGGGAFLVPYFITLILAGIPMFFMELALGQMLTIGGLGVFKIAPIFKGIGYAAAVMSCWMNIYYIVILAWAIFYFFMSLRADVPWRTCNNYWNTRFCINPYDRKALNCWEKYSVNNTVTKVCQISSYNISADDLTDPVKEFWERRALQITEGIEHVGSIRWELAGTLLVVWFVCXFCIWKGG

SEQ ID NO: 22652 - protein, 359 aa, Diabrotica virgifera
  misc_feature: Coding regions on vcDNA: vcDNA=SeqID_2349; Strand=+; Position=6-1082
  misc_feature: Homolog annotation: Hit_ID=XP_391943.1; Match level="QueryCoverage =89%, HitCoverage=56%, E-value=5e-52, Identity=36%"; Hit description =similar to RE16761p [Apis mellifera]
  misc_feature: Gene Ontology Annotation: Molecular function=carboxylesterase activity; Cellular component=synaptic junction
  misc_feature: Pfam annotation: Pfam_ID=COesterase; Match level="Score=132.4, E -value=1.1e-36, Copies=1"; Pfam description=Carboxylesterase
MHLKLAVLAFLLYFANKRAIASPLSATHYEDDDLIVELENLGKIRGHILQSNEGKDFYAFQDVHYAESTAGNNRFRPPKPRAPWEGILNATENKVVCPQADNPDASEDCLVLNVYTPVKPNSARGRPVFFFIPGGAFVTFSAQISNLDPKYLVDYDIVIVTINYRLGSFGFLTTLDETIPGNLGLKDQLLALKWTHEHIHKFGGDANKLTLGGQSAGGMSTGFHLLSRASKGLFRSVIQQSGSSISSVFYPINDRKLAFEFGKALNSSFTSTHSRDLLELLQQASFSDLLALNTKFTSGVTTGFMDGLTFRPVIEDDHEDAIVTEPMQAALSNGRFNRVPVLIGFNSEESLAFLGLIGE

SEQ ID NO: 22653 - protein, 102 aa, Diabrotica virgifera
  misc_feature: Coding regions on vcDNA: vcDNA=SeqID_2350; Strand=+; Position=346-654
FFSQEIKISNFYLHLNNHHLYLISNHLFSSSNLIISNHLPPGIVALKNQNLSSQNFNSSQIKNSRIQKIFSSFSKYRLSHLHFLIIINLIFSSFHQIFLIKI

SEQ ID NO: 22654 - protein, 540 aa, Diabrotica virgifera
  misc_feature: Coding regions on vcDNA: vcDNA=SeqID_2351; Strand=+; Position=105-1724
  misc_feature: Homolog annotation: Hit_ID=CAF94659.1; Match level="QueryCoverage =85%, HitCoverage=20%, E-value=2e-63, Identity=28%"; Hit description =unnamed protein product [Tetraodon nigroviridis]
  misc_feature: Gene Ontology Annotation: Molecular function=molecular_function unknown; Cellular component=mitochondrion; Biological process=polar body extrusion after meiotic divisions
  misc_feature: Pfam annotation: Pfam_ID=ADH_zinc_N; Match level="Score=59.2, E-value= 1.2e-14, Copies=1"; Pfam description=Zinc-binding dehydrogenase
MENVRIFYNLDKTPDRVNEVVKRDISLMILNKGQWWTYMPLDLGNQNEKLIDRQSDAPILENNSISYLGVNLKDEALTPNNKDKNEIGNIDYAGLAKNGERVMGLAYLDKENSKLIVDDDFTWNIPAGWNFESAATAPHAYTSAYYMLVIKGRVKHGDTVLIHSGCSPVGFAAMNIAFSYGCQVFVTVNSERQKAFIKKHFVYMQARNILNYTSTKFETDLMTITGGKGAEVILNCLSGILLKSSLNCIANFGRFIQYGKYDMEEGGSIGMYCFLRNVSFYCVDLNKIFFKEKDIKVELHKLIEEGLANYTVRPLKREVIKKDDVADVMSRLQNHETIGKIVVETGNTMNINKINFKDPNRFICNAKDSYLIWGGSANHWSHIAEWLVHRGARKIVIASESKPKDHHLNRRLQFLQTYYGADLIMAPSRIQTKEHAQNLVSDVQNFGNLHAVFALSQSMSISATESESVELLEKALERIAPKAILINFVKSASGLCYIRGPEYPTYNINVESEEDVKDAIVFLDKVLCYQISNLSLRRDT

SEQ ID NO: 22655 - protein, 421 aa, Diabrotica virgifera
  misc_feature: Coding regions on vcDNA: vcDNA=SeqID_2352; Strand=+; Position=2-1267
  misc_feature: Homolog annotation: Hit_ID=XP_392189.1; Match level="QueryCoverage =96%, HitCoverage=34%, E-value=1e-68, Identity=40%"; Hit description =similar to ENSANGP00000019902 [Apis mellifera]
  misc_feature: Gene Ontology Annotation: Molecular function=hydrolase activity, acting on glycosyl bonds; Cellular component=nucleus; Biological process=protein targeting
  misc_feature: Pfam annotation: Pfam_ID=AT_hook; Match level="Score=33.1, E-value =8.3e-07, Copies=2"; Pfam description=AT hook motif
KKFRPKIAVFNGKLIYEVFSGKKDFKFGRQPDVVEGTNTHMWVMPSSSARCAQLPRAADKVPFYAALKKFRDYLNGLITEIDENEMVFSEPSLKSCYEAEPKPDAFSPELTDISNAVIQNEDGTIIPCKKKRGRPKKIKVEGEESPPKPVVRKPPSTQNSNCDFPKKKRGRPKKVKVENMDLNPPDNNTSTNLSQCYSNPSPIQSPNNFYQMGPAMTPPNGVGNLYAPQPPQSYSQSPRPPYSQSPRPAYTNSPRPQYSQSPRPQYSQSPRPQYSQSPRPPYSQSPRPPYSQSPRPHSQPFTHSDLSSEISAAISSEQLGSPASPIGPPDFEPPTSMADEAECRLGSPAPSSNSEQTHYHYQSYNMEPQHQTDQYASPRQTQDIATKSLSGLESLVDQIPSITEGEAPLGEAPDQICGSVQ

SEQ ID NO: 22656 - protein, 289 aa, Diabrotica virgifera
  misc_feature: Coding regions on vcDNA: vcDNA=SeqID_2353; Strand=+; Position=28-895
  misc_feature: Homolog annotation: Hit_ID=AAF70178.1; Match level="QueryCoverage =93%, HitCoverage=53%, E-value=3e-60, Identity=47%"; Hit description =cytochrome P450 monooxigenase CYP4Q4 [Tribolium castaneum]
  misc_feature: Gene Ontology Annotation: Molecular function=monooxygenase activity; Biological process=leukotriene metabolism
  misc_feature: Pfam annotation: Pfam_ID=p450; Match level="Score=-179.4, E-value =0.0055, Copies=1"; Pfam description=Cytochrome P450
  misc_feature (145)..(145): Xaa can be any naturally occurring amino acid
  misc_feature (199)..(199): Xaa can be any naturally occurring amino acid
  misc_feature (223)..(223): Xaa can be any naturally occurring amino acid
MILLVLLVLLLPLLISYYFKKKKRYEELWKYLDVIPEPKSYPILGTNYKIHTRESLFVRERLRAIDLFPIYKLWSFDIAAVIVMHPEDVELVVNNSKHNDKSLIYSFLHDWLGTGLLTSGGTKWNKRRKILTPAFHFNILQEFFXMLNKETQILVDNLMKLSDAPHIDVTKYITEFTLYSIGETSLGVSLREDPNSQTXYKQAVYDFGEYYCLQTCSPLIVHXLIYRLSSVYKKTKNTINILHDFFTNVINERKKTFVPNDNLSYSDRKKVGLLQWCHGVGNAWTPFPH

SEQ ID NO: 22657 - protein, 278 aa, Diabrotica virgifera
  misc_feature: Coding regions on vcDNA: vcDNA=SeqID_2354; Strand=+; Position=44-880
  misc_feature: Homolog annotation: Hit_ID=XP_396605.1; Match level="QueryCoverage =96%, HitCoverage=39%, E-value=2e-65, Identity=46%"; Hit description =similar to Hypothetical protein MGC25529 [Apis mellifera]
  misc_feature: Pfam annotation: Pfam_ID=SWIM; Match level="Score=11.9, E-value =0.096, Copies=1"; Pfam description=SWIM zinc finger
MSEDFTEYPQKLLSGLGKSTKRGIKKCPRCGTFNGTRSTVCKNKNCNVVNVDAVKLLTNTEKQLYSVKIWDMGPNYRAFVQLPLLQSSSNEDPHVYSDVALCFVDSCKNSFDNSILKCHEEGTDSNSKKLLFCTHIRSALKSQSKASPMELKPSVLTSLNVTDDIKEKLCSFNSEKEGVFVQRVSKSVMAVKCQASAKHPLGYLHFTFIKGKGRDVYEKFYCSCSEFSVSELSGEGFESVKYKCIHYYACIWALASDQKLSEGFTNILRNEFFICRVQ

SEQ ID NO: 22658 - protein, 216 aa, Diabrotica virgifera
  misc_feature: Coding regions on vcDNA: vcDNA=SeqID_2355; Strand=+; Position=95-741
  misc_feature: Homolog annotation: Hit_ID=AAC47830.1; Match level="QueryCoverage =100%, HitCoverage=60%, E-value=1e-104, Identity=82%"; Hit description=arginine kinase [Schistocerca americana] sp|P91798|KARG _SCHAM ARGININE KINASE (AK)
  misc_feature: Gene Ontology Annotation: Molecular function=creatine kinase activity; Cellular component=cytoplasm; Biological process =phosphocreatine metabolism
  misc_feature: Pfam annotation: Pfam_ID=ATP-gua_PtransN; Match level="Score=132.1, E- value=1.3e-36, Copies=1"; Pfam description=ATP:guanido phosphotransferase, N-ter
  misc_feature (207)..(207): Xaa can be any naturally occurring amino acid
MVDAAVLDKLESGFAKIKDSNSKSLLKKHLTQEIFDNLKTKKTPTFGCTLLDVIQSGLENHDSGVGIYAPDAESYTVFADIFDPIIEDYHGGFKKTDKHPPKNWGDVSVFGDLDPTGEFVVSTRVRCGRSMEGYPFNPCLTEEQYKEMEQKVSSTLSGLEGELKGTFYPLTGMSKDVQQKLIDDHFLFKEGDRFLQAANACRFWPSXRGIYPHEKQ

SEQ ID NO: 22659 - protein, 201 aa, Diabrotica virgifera
  misc_feature: Coding regions on vcDNA: vcDNA=SeqID_2356; Strand=+; Position=429-1035
  misc_feature: Homolog annotation: Hit_ID=NP_729448.1; Match level="QueryCoverage =99%, HitCoverage=55%, E-value=6e-85, Identity=71%"; Hit description =CG32031-PC, isoform C [Drosophila melanogaster] gb|AAF50326.2| CG32031-PC, isoform C [Drosophila
  misc_feature: Gene Ontology Annotation: Molecular function=creatine kinase activity; Cellular component=cytoplasm; Biological process =phosphocreatine metabolism
  misc_feature: Pfam annotation: Pfam_ID=ATP-gua_PtransN; Match level="Score=132.1, E- value=1.3e-36, Copies=1"; Pfam description=ATP:guanido phosphotransferase, N-ter
  misc_feature (187)..(187): Xaa can be any naturally occurring amino acid
MGGCASKENKKEIQDDSGKATMVDAAVLDKLESGFAKIKDSNSKSLLKKHLTQEIFDNLKTKKTPTFGCTLLDVIQSGLENHDSGVGIYAPDAESYTVFADIFDPIIEDYHGGFKKTDKHPPKNWGDVSVFGDLDPTGEFVVSTRVRCGRSMEGYPFNPCLTEEQYKEMEQKVSSTLSGLEGELKGXFYPLTGMSKDVQQS

SEQ ID NO: 22660 - protein, 271 aa, Diabrotica virgifera
  misc_feature: Coding regions on vcDNA: vcDNA=SeqID_2357; Strand=+; Position=431-1242
  misc_feature: Homolog annotation: Hit_ID=AAC47830.1; Match level="QueryCoverage =100%, HitCoverage=76%, E-value=1e-131, Identity=81%"; Hit description=arginine kinase [Schistocerca americana] sp|P91798|KARG _SCHAM ARGININE KINASE (AK)
  misc_feature: Gene Ontology Annotation: Molecular function=creatine kinase activity; Cellular component=cytoplasm; Biological process =phosphocreatine metabolism
  misc_feature: Pfam annotation: Pfam_ID=ATP-gua_Ptrans; Match level="Score=211.7, E -value=1.4e-60, Copies=1"; Pfam description=ATP:guanido phosphotransferase, C-ter
  misc_feature (264)..(264): Xaa can be any naturally occurring amino acid
MVDAAVLDKLESGFAKIKDSNSKSLLKKHLTQEIFDNLKTKKTPTFGCTLLDVIQSGLENHDSGVGIYAPDAESYTVFADIFDPIIEDYHGGFKKTDKHPPKNWGDVSVSGDLDPTGEFVVSTRVRCGRSMEGYPFNPCLTEEQYKEMEQKVSSTLSGLEGELKGTFYPLTGMSKDVQQKLIDDHFLFKEGDRFLQAANACRFWPSGRGIYHNENKTFLVWCNEEDHLRLISMQKGGNLGEVYRRLVTAVMTSRKEFILSHEQXLGFPTFC

SEQ ID NO: 22661 - protein, 130 aa, Diabrotica virgifera
  misc_feature: Coding regions on vcDNA: vcDNA=SeqID_2358; Strand=+; Position=67-460
  misc_feature: Homolog annotation: Hit_ID=AAC47830.1; Match level="QueryCoverage =86%, HitCoverage=31%, E-value=2e-47, Identity=79%"; Hit description =arginine kinase [Schistocerca americana] sp|P91798|KARG_SCHAM ARGININE KINASE (AK)
  misc_feature: Gene Ontology Annotation: Molecular function=creatine kinase activity; Cellular component=cytoplasm; Biological process =phosphocreatine metabolism
  misc_feature: Pfam annotation: Pfam_ID=ATP-gua_PtransN; Match level="Score=129.9, E- value=6e-36, Copies=1"; Pfam description=ATP:guanido phosphotransferase, N-ter
  misc_feature (102)..(102): Xaa can be any naturally occurring amino acid
MVDAAVLDKLESGFAKIKDSNSKSLLKKHLTQEIFDNLKTKKTPTFGCTLLDVIQSGLENHDSGVGIYAPDAESYTVFADIFDPIIEDYHDGFKKTDKHPPXNWGDVSVLHELYTSSANHIMLHKLLLGF

SEQ ID NO: 22662 - protein, 388 aa, Diabrotica virgifera
  misc_feature: Coding regions on vcDNA: vcDNA=SeqID_2359; Strand=+; Position=23-1189
  misc_feature: Homolog annotation: Hit_ID=XP_395683.1; Match level="QueryCoverage =100%, HitCoverage=100%, E-value=1e-158, Identity=70%"; Hit description=similar to CG10576-PA [Apis mellifera]
  misc_feature: Gene Ontology Annotation: Molecular function=molecular_function unknown; Cellular component=nucleolus; Biological process=cell cycle
  misc_feature: Pfam annotation: Pfam_ID=Peptidase_M24; Match level="Score=201.2, E -value=2e-57, Copies=1"; Pfam description=metallopeptidase family M24
MADEKDVVEKTIAEDLVVTKYKMAGEIVNRVLKQVIDKCIPGASIREICEYGDQLLLDETNKVFKKEKELKKGIAFPTCVSVNNCICHFSPVPSESDLVLKEEDVAKVDLGAQIDGFIAVVAHTIIVGSSNNKKVTGRKADVILAAHYASQAALRLLKPGNETYAITEAVQKVAESYKCKPVEGMLSHQLKQFKIDGEKTIIQNPNDAQKKEHEKFELDKHEVYAMDVLISTGEGVGKEADTRVSVYKKTDEIYQLKLKASRMFYTEVRTKYGNMPFNLRNFQDETKAKMGVVECVKNKLIEPFQVLYEKPGEIVAHFKFTVLLMPNGPHKITGLPLDPELYKSEHSIVDPELKSILNSSANPKAAKKKKKKSESSSDPQPMEVEAAA

SEQ ID NO: 22663 - protein, 356 aa, Diabrotica virgifera
  misc_feature: Coding regions on vcDNA: vcDNA=SeqID_2360; Strand=+; Position=437-1507
  misc_feature: Homolog annotation: Hit_ID=AAT01074.1; Match level="QueryCoverage =100%, HitCoverage=100%, E-value=0.0, Identity=87%"; Hit description =putative arginine kinase [Homalodisca coagulata]
  misc_feature: Gene Ontology Annotation: Molecular function=creatine kinase activity; Cellular component=cytoplasm; Biological process =phosphocreatine metabolism
  misc_feature: Pfam annotation: Pfam_ID=ATP-gua_Ptrans; Match level="Score=580.3, E -value=1.6e-171, Copies=1"; Pfam description=ATP:guanido phosphotransferase, C-ter
MVDAAVLDKLESGFAKIKDSNSKSLLKKHLTQEIFDNLKTKKTPTFGCTLLDVIQSGLENHDSGVGIYAPDAESYTVFADIFDPIIEDYHGGFKKTDKHPPKNWGDVSVFGDLDPTGEFVVSTRVRCGRSMEGYPFNPCLTEEQYKEMEQKVSSTLSGLEGELKGTFYPLTGMSKDVQQKLIDDHFLFKEGDRFLQAANACRFWPSGRGIYHNENKTFLVWCNEEDHLRLISMQMGGNLGEVYRRLVTAVNDIEKRIPFSHNDRLGFLTFCPTNLGTTVRASVHIKVPKLAANMAKLEEIAGKYNLQVRGTRGEHTEAEGGVYDISNKRRMGLTEYDAVKEMYDGIQELIKIEKEL

SEQ ID NO: 22664 - protein, 268 aa, Diabrotica virgifera
  misc_feature: Coding regions on vcDNA: vcDNA=SeqID_2361; Strand=+; Position=105-911
  misc_feature: Homolog annotation: Hit_ID=XP_393034.1; Match level="QueryCoverage =100%, HitCoverage=100%, E-value=1e-131, Identity=86%"; Hit description=similar to 60S ribosomal protein L7a (Surfeit locus protein 3) (PLA-X polypeptide) [Apis
  misc_feature: Gene Ontology Annotation: Molecular function=structural constituent of ribosome; Cellular component=cytosolic ribosome (sensu Eukarya); Biological process=protein biosynthesis
  misc_feature: Pfam annotation: Pfam_ID=Ribosomal_L7Ae; Match level="Score=109.9, E -value=6.4e-30, Copies=1"; Pfam description=Ribosomal protein L7Ae/L30e/S12e/Gadd
MVQKKPKKKVGKKVAAAPLAVKKIEQKKEINPLFEKRPRNFGIGQDIQPPRDLSRFVKWPKYIRIQRQKAVLQKRLKVPPPINQFSQTIDKQTATQLFKVLEKYRPETALQKKNRLKAKAEAKVAKKEEAPAKKPNTLKAGTNTVTKLIEQKKAQLVVIAHDVDPIELVLFLPALCRKMGVPYCIVKGKARLGLLVRRKTCSSVALTQVDSGDRSNFNKLLEVIKTNFNDRVDEIRRHWGGGLLGSKSAARIAKLERAKAKELAQKQG

SEQ ID NO: 22665 - protein, 339 aa, Diabrotica virgifera
  misc_feature: Coding regions on vcDNA: vcDNA=SeqID_2362; Strand=+; Position=2-1018
  misc_feature: Homolog annotation: Hit_ID=CAA09492.1; Match level="QueryCoverage =99%, HitCoverage=27%, E-value=2e-96, Identity=53%"; Hit description =coatomer alpha subunit [Drosophila melanogaster]
  misc_feature: Gene Ontology Annotation: Molecular function=transporter activity; Cellular component=secretory vesicle; Biological process=ER to Golgi transport
  misc_feature: Pfam annotation: Pfam_ID=COPI_C; Match level="Score=382.5, E-value =5.6e-112, Copies=1"; Pfam description=Coatomer (COPI) alpha subunit C-termi
  misc_feature (215)..(215): Xaa can be any naturally occurring amino acid
  misc_feature (259)..(259): Xaa can be any naturally occurring amino acid
  misc_feature (281)..(281): Xaa can be any naturally occurring amino acid
  misc_feature (300)..(300): Xaa can be any naturally occurring amino acid
DELELDPEEKKAEAAAGGGDGEGGWDVEDEGLEIPDLGPSVPVEAEGNFVHLPTQGPSPLVTWTKNSQLVADHIAAGSFESAARLLHDQLGVVDFKPYESLFISLYSSSRTVYSWQQNIPPSFSYPLRNWKDANVKNQLPASGVKLNELVAKLQACYQLTTGGKFTEAIEKFQTLLLSVTLVVVENKQEISEAQQLLRICSEYICGLQMETLRKXLPKASHEEQKRQCEMAAYFTHCKLQPIHQILTLRTALNMFFKLXKNYKTAASFAKRLLELGPEPEXTQQAKKIFQAWGTNLAHDXKMEDDELIPFHPGGPFLSPILKEKPKKKGPWGGNFFFPK

SEQ ID NO: 22666 - protein, 204 aa, Diabrotica virgifera
  misc_feature: Coding regions on vcDNA: vcDNA=SeqID_2363; Strand=+; Position=42-656
  misc_feature: Homolog annotation: Hit_ID=AAV34827.1; Match level="QueryCoverage =100%, HitCoverage=100%, E-value=1e-105, Identity=87%"; Hit description=ribosomal protein L15 [Bombyx mori]
  misc_feature: Gene Ontology Annotation: Molecular function=structural constituent of ribosome; Cellular component=cytosolic large ribosomal subunit (sensu Eukarya); Biological process=protein biosynthesis
  misc_feature: Pfam annotation: Pfam_ID=Ribosomal_L15e; Match level="Score=452.6, E -value=4.4e-133, Copies=1"; Pfam description=Ribosomal L15
MGAYKYIQELYRKKQSDVLRFLLRVRVWQYRQLTKLHRTPRPSRPDKARRMGYRAKQGFVIYRIRVRRGGRKRPVPKGATYGKPKSHGVNELKPVRNLQAIAEERVGRRCGGLRVLNSYWVAQDSTYKYFEIILVDPSHNAIRKDPKINWIVNSVHKHRELRGKTSSGKSSRGLGKGHRYSQTKGGSRRAAWLRRNSLQLRRKR

SEQ ID NO: 22667 - protein, 72 aa, Diabrotica virgifera
  misc_feature: Coding regions on vcDNA: vcDNA=SeqID_2364; Strand=-; Position=2-217
  misc_feature (53)..(53): Xaa can be any naturally occurring amino acid
IPYVLTSTTTTTCQFITFSASSMSLSLSSLLIPSLKLFLVYLVSLSFCYFLMXSLVIIFLLDLPAALLKNPF

SEQ ID NO: 22668 - protein, 84 aa, Diabrotica virgifera
  misc_feature: Coding regions on vcDNA: vcDNA=SeqID_2365; Strand=-; Position=443-697
EVSPITHMTHVEIQNKTHKRDCSGLKSYLGYVRLIGIKSLIIVHISIDKHRKTQNRYRTSAQRLSISQKSKVSRKRRLKFVLQH

SEQ ID NO: 22669 - protein, 316 aa, Diabrotica virgifera
  misc_feature: Coding regions on vcDNA: vcDNA=SeqID_2366; Strand=-; Position=2152 -3102
  misc_feature: Homolog annotation: Hit_ID=BAB78534.1; Match level="QueryCoverage =99%, HitCoverage=97%, E-value=1e-114, Identity=62%"; Hit description= annexin B13b [Bombyx mori]
  misc_feature: Gene Ontology Annotation: Molecular function=protein binding; Cellular component=nuclear membrane
  misc_feature: Pfam annotation: Pfam_ID=Annexin; Match level="Score=436.2, E-value =3.9e-128, Copies=4"; Pfam description=Annexin
MRTPTVRPAQPFNPNDDAQVLRTAMKGFGTDEKAIINCLARRTNEQRLHIAAAFKTMYGKDLIKDLKSELSGNFENCIVAMMTPLPEYYAKELHDAMSGVGTDEDVLIEVMCTMSNREIMVIREAYHKLYYRSLESDLKGDTAGTFKRLMVSLCNASRDESNVTDPQRALQDAQALLQAGELRLGTDESTFNMVLCQRNYAQLQLVFQEYQKITGHDIEKAVKNEFSGDSEDALLAIIRSIKNQAAFFAKYLNKSIKGLGTNDRQLIRLVVTRSEIDMVEIKSEYQAKYGESLADAIKGDCSGHYKKCLLALIGEY

SEQ ID NO: 22670 - protein, 263 aa, Diabrotica virgifera
  misc_feature: Coding regions on vcDNA: vcDNA=SeqID_2367; Strand=+; Position=158-946
MLSEPSRRPIRDQELAIDSVVATQSELGPSIPDGGYGWVVFIATLFFQALIPSLRVSFGIFLAMSRLQLYTKDDQDPKLWDDGFMYAPVLFAAVWAIFDPTSRFLISNSTWPRLVATAGTCLTCAGLLFLWMGLAEYSGGILFPLAGIVCGIGASIEIAQCEILLAQYFRVKHAILANVCQGMASFGFVIVPVVIGHNVLSSSLLHVVLWYQAIILQGLICNMVFKKPAYLKSRQRETYNYITSNPDDQKDFLSKNSRELQIK

SEQ ID NO: 22671 - protein, 298 aa, Diabrotica virgifera
  misc_feature: Coding regions on vcDNA: vcDNA=SeqID_2368; Strand=+; Position=1-894
  misc_feature: Homolog annotation: Hit_ID=XP_318119.1; Match level="QueryCoverage =99%, HitCoverage=47%, E-value=1e-117, Identity=71%"; Hit description= ENSANGP00000017692 [Anopheles gambiae]
  misc_feature: Gene Ontology Annotation: Molecular function=arginine-tRNA ligase activity; Cellular component=soluble fraction; Biological process =arginyl-tRNA aminoacylation
  misc_feature: Pfam annotation: Pfam_ID=tRNA-synt_1d; Match level="Score=195.0, E -value=1.6e-55, Copies=1"; Pfam description=tRNA synthetases class I (R)
EFYKESKLRFDSDEDFKKRAYASVVKLQSFEPKHKKAWELICDVSRQEFQKIYDRLDVSIIERGESFYQSRMEKVVKELDERGLLELDEGRKVMWGGTTIPLTVVKSDGGFTYDTSDMACIKQRLEEEKAEWVIYVTDAGQATHFETLVGCAEKAGILNRAVHRVYHVGFGVVLGEDKKKFKTRSGDTVKLSALLDEGLSRALDKLKEKERDKVLTPEELRKAQESVAYGCIKYADLSHNRNHEYVFSFDKMLDDKGNTAVYLLYAFTRIRSIARTHFTSEKDQELSKTNSIVDPRKE

SEQ ID NO: 22672 - protein, 478 aa, Diabrotica virgifera
  misc_feature: Coding regions on vcDNA: vcDNA=SeqID_2369; Strand=+; Position=102-1534
  misc_feature: Homolog annotation: Hit_ID=XP_318119.1; Match level="QueryCoverage =98%, HitCoverage=70%, E-value=1e-129, Identity=54%"; Hit description= ENSANGP00000017692 [Anopheles gambiae]
  misc_feature: Gene Ontology Annotation: Molecular function=arginine-tRNA ligase activity; Cellular component=soluble fraction; Biological process =arginyl-tRNA aminoacylation
  misc_feature: Pfam annotation: Pfam_ID=tRNA-synt_1d; Match level="Score=254.0, E -value=2.6e-73, Copies=1"; Pfam description=tRNA synthetases class I (R)
  misc_feature (396)..(396): Xaa can be any naturally occurring amino acid
  misc_feature (428)..(428): Xaa can be any naturally occurring amino acid
  misc_feature (436)..(436): Xaa can be any naturally occurring amino acid
MDQDLVRYNLEADTALEQINLMKESLKGIKSSIDGVSLQPTTSDGQLNKLITENIKLKHRLSILNRAIAAQSAKKAPNLPMDQTRLQSITDILTYIFSNAISTAFPDITDAPVVIALSGANPKFGDYQCNSAMPIANIYKQLGKKVVPRDIGQKIVENVPSHDLIAKMEVAGPGFINIFLNKSFAVKNLSRIFEHGVKSPEVPKKMRVLVDFSAPNIAKEMHVGHLRSTIIGESYCRLLEYLGHDVIRINHVGDWGTQFGMLIAHLEDKFPDFYIKSPPISDLQEFYKESKLRFDSDEDFKKRAYASVVKLQSFEPKHKKAWELICDVSRQEFQKIYDRLDVSIIERGESFYQSRMEKVVKELDERGLLELDEGRKVMWGGTTIPLTVVKSDGGFXYHTSDMACIKQASPKKKGWMGIYVTNARQATXFETLFGCXPKKPEFLTKRFFGVVYVGFLEFVLGGKKKKKFKTQKKGETVK

SEQ ID NO: 22673 - protein, 313 aa, Diabrotica virgifera
  misc_feature: Coding regions on vcDNA: vcDNA=SeqID_2370; Strand=+; Position=1-942
  misc_feature: Homolog annotation: Hit_ID=XP_315391.1; Match level="QueryCoverage =90%, HitCoverage=40%, E-value=3e-99, Identity=57%"; Hit description =ENSANGP00000021081 [Anopheles gambiae]
  misc_feature: Gene Ontology Annotation: Molecular function=beta-N -acetylhexosaminidase activity; Cellular component=extracellular space
  misc_feature: Pfam annotation: Pfam_ID=Glyco_hydro_20; Match level="Score=82.1, E -value=1.4e-21, Copies=1"; Pfam description=Glycosyl hydrolase family 20, catalyti
TTRPPTRPPTRRQDSGFVVCLNAQPWQNYCVEPPCGQFDPTQDKLYDVIEDLYGDMLAQFEPELFHMGGDEVAFQCWKSTPKIVEWIKSKNWETTTDEGYFKLWEYFQNNALERLYKKAGKKIPAIMWTSHLTEPQNLRILPKEKYIIQVWTLGNDSQIKNLLEKGYNIILSNYDALYFDCGFAGWVQDGNNWCSPYIGWQKVYENKPEKLAGNKVSQVLGAEAALWTEQADSASVDTRLWPRAAAMAEVLWSNPATGWKEAEHRFLVHRERLISLGIDADAIEPEWCLQNPEQCKIGAAFIVQKLTLNVLFV

SEQ ID NO: 22674 - protein, 258 aa, Diabrotica virgifera
  misc_feature: Coding regions on vcDNA: vcDNA=SeqID_2371; Strand=+; Position=99-875
  misc_feature: Homolog annotation: Hit_ID=NP_732527.1; Match level="QueryCoverage =84%, HitCoverage=78%, E-value=2e-27, Identity=30%"; Hit description =CG4217-PB, isoform B [Drosophila melanogaster] gb|AAF55779.2| CG4217- PB, isoform B [Drosophila
  misc_feature: Gene Ontology Annotation: Molecular function=RNA polymerase I transcription factor activity; Cellular component=mitochondrion; Biological process=regulation of transcription from Pol I promoter
  misc_feature: Pfam annotation: Pfam_ID=HMG_box; Match level="Score=86.1, E-value =9.4e-23, Copies=2"; Pfam description=HMG (high mobility group) box
MAGQGFLFKTFNVFNSRIISANRLNVANFQTPTRTIKTETKERLKSLNIPEKPKKPLTPYLQYVNQKRSTIVKENPNILPKDVLRKLSEEWKQVTEEEKEKLKEKYQKEAEIYDKDILKFNTALTAEQREILQIANNEKKEDRKKRKITKLLKETHKPKKPQGPYLLYLQEQSKIRNVPLNILIKTVKNDWAQVSDSQKEKYRAQYAKEHEKYEIELENWEKKMISEGHPELVRVKHRVPEERPSRILDLKGKKPSKQ

SEQ ID NO: 22675 - protein, 304 aa, Diabrotica virgifera
  misc_feature: Coding regions on vcDNA: vcDNA=SeqID_2372; Strand=+; Position=14-1016
  misc_feature: Homolog annotation: Hit_ID=XP_316424.1; Match level="QueryCoverage =69%, HitCoverage=45%, E-value=6e-36, Identity=45%"; Hit description =ENSANGP00000020442 [Anopheles gambiae]
MVSIFSNYFENTSILDVIQVYYSSIILYVSDFFEVARDKEVFTYLEIVGNIFDDFQWKFLQILFGLILFNLISILIVWKYFGDSIYERFMSNPTLREIEELKASKKADAKFKLAGPGHKLTESSSTASNQSKPSKGAYVPPKVEPTEAARQAAEAALFRLQGQRKDTAFNTSFAAIQAKVRKELEAETKNQNQPQVPGSPTKSTDDYECSHHMAVKGVYFKCPLISDEVLPKEECEVKIKEFFVNTLEEERGMTSVLLIYSLHYSNTKVTEASDVLSYLIVYILLYFVWLNRYPRPKKLSPCDL

SEQ ID NO: 22676 - protein, 117 aa, Diabrotica virgifera
  misc_feature: Coding regions on vcDNA: vcDNA=SeqID_2373; Strand=+; Position=976-1326
FCVLLIPLTIYPWFQLITCLNPIFSPPTKTPPKKTLKIQGGGFLFFKKNLFVLKGFIFFFYFNSFVRLSYVPRLFVSPFHGTPSSLFSLLLFFIITPRTNSLFSFLFPQQNLYTRPP

SEQ ID NO: 22677 - protein, 318 aa, Diabrotica virgifera
  misc_feature: Coding regions on vcDNA: vcDNA=SeqID_2374; Strand=+; Position=1-957
  misc_feature: Homolog annotation: Hit_ID=NP_524494.1; Match level="QueryCoverage =94%, HitCoverage=38%, E-value=1e-142, Identity=78%"; Hit description= CG7748-PA [Drosophila melanogaster] gb|AAF56391.1| CG7748-PA [Drosophila melanogaster]
  misc_feature: Gene Ontology Annotation: Molecular function=dolichyl-diphospho -oligosaccharide-protein glycosyltransferase activity; Cellular component=integral to plasma membrane; Biological process=N-linked glycosylation
NTRVRPRVRPRVRMKHEQSKEPDSIGPNLRSIVTVVILLLLMLFAVHCTWVTSNAYSSPSIVLASYGSDGSRQILDDFREAYFWLSQNTADDARVMSWWDYGYQIAGMANRTTLVDNNTWNNSHIALVGKAMSSNESAAYEIMTALDVDYVLVIFGGVIGYSGDDINKFLWMVRIAEGEHPKDIRESDYFTEHGEFRIDAEGSPTLLNCLMYKLSYYRFGELKLDYRSPAGFDRTRNAVIGNKDFQLNYLEEAYTTEHWLVRVYRVKKPDEFNRPRIPVANRVVKTSNYVSKKNTKRKKGSIKNKPIIVKGKRLSTKQ

SEQ ID NO: 22678 - protein, 362 aa, Diabrotica virgifera
  misc_feature: Coding regions on vcDNA: vcDNA=SeqID_2375; Strand=+; Position=2-1089
  misc_feature: Homolog annotation: Hit_ID=BAB16696.1; Match level="QueryCoverage =92%, HitCoverage=99%, E-value=1e-155, Identity=80%"; Hit description= similar to elF3p40 [Bombyx mori]
  misc_feature: Gene Ontology Annotation: Molecular function=translation factor activity, nucleic acid binding; Cellular component=eukaryotic translation initiation factor 3 complex; Biological process =regulation of translational initiation
  misc_feature: Pfam annotation: Pfam_ID=Mov34; Match level="Score=49.5, E-value=9.8e- 12, Copies=1"; Pfam description=Mov34/MPN/PAD-1 family
  misc_feature (307)..(307): Xaa can be any naturally occurring amino acid
LVLDRERPPAIKFLFQVDFIKISAKMAGRSANPRRIPENESTIQYVQADGLAVMKMVKHCHEESTTNMDIAQGALLGLGVDNRLEITNCFPFPKQTDENTDEDEYQLAMMRRLRRVNVDHFHVGWYQSADVGNFLSLPLLESQFHYQTSIEESVVVIYDTQKSSRGFLTLKAYRLTPQAIEMCKEGESTPEALLKMKVGFENLFVEVPFIIKNSPLSNIMMSELADLVPEEEGSKFLDLGTASVLEGQLRCLMDRVDELNQEAIKFNRYQQLVSRQQDKHRYLQKRAQENAARVAKDEPPLPEEDIXKLFRPHPVPPRLNPLIIAGQVNTYSKAISQFCSQSLAKLYITQALQNGKEANSNL

SEQ ID NO: 22679 - protein, 235 aa, Diabrotica virgifera
  misc_feature: Coding regions on vcDNA: vcDNA=SeqID_2376; Strand=+; Position=90-797
  misc_feature: Homolog annotation: Hit_ID=EAL31233.1; Match level="QueryCoverage =71%, HitCoverage=66%, E-value=4e-46, Identity=51%"; Hit description =GA10052-PA [Drosophila pseudoobscura]
  misc_feature: Gene Ontology Annotation: Molecular function=molecular_function unknown; Cellular component=mitochondrial membrane; Biological process=protein complex assembly
  misc_feature: Pfam annotation: Pfam_ID=Ubiq_cyt_C_chap; Match level="Score=152.2, E- value=1.2e-42, Copies=1"; Pfam description=Ubiquinol-cytochrome C chaperone
MNITRFIGYNVILKPATVAKLQNNGLKICLNSKLPSNKETSYLRQSHVKFVSTYEVKNEQKGESFLKKALKKIPFINVDRVKIKGRGYILYEEIADKIDYLEFFKEFELLDTFYSWFTVTELHIWMLSLRAMAEGENGKDLRNAIVEALWTDVAQRVKRLGSGSPSMLRNQIVELSEQMQAAFISYDEGIQSDDIVLAGAIWRRFYKMEHADPSNLDKLVKHIRKQVCVLDNMSF

SEQ ID NO: 22680 - protein, 126 aa, Diabrotica virgifera
  misc_feature: Coding regions on vcDNA: vcDNA=SeqID_2377; Strand=+; Position=2-382
ATKLTSNMKQIVCAFFCLFVAFQLADAFAQFQLREGNCLNAVAADLVHQEHVHKSRVPFVTRSTTAKYYGDKKIYCIIATSQKDASKGSTVEIKDGGVNHNFVNFEFNSSKNHGLEYNVQVYARYF

SEQ ID NO: 22681 - protein, 83 aa, Diabrotica virgifera
  misc_feature: Coding regions on vcDNA: vcDNA=SeqID_2378; Strand=+; Position=308-556
RKMSFLKKIVFPLYVGFVILNVYSLRLQLALNEVSERPNGEMFSHLKVYHYFFLTNWNFMLQIFFISLAGLYELSKFLSLPLK

SEQ ID NO: 22682 - protein, 196 aa, Diabrotica virgifera
  misc_feature: Coding regions on vcDNA: vcDNA=SeqID_2379; Strand=+; Position=2-592
  misc_feature: Homolog annotation: Hit_ID=NP_788492.2; Match level="QueryCoverage =97%, HitCoverage=46%, E-value=9e-40, Identity=46%"; Hit description =CG33205-PD, isoform D [Drosophila melanogaster] gb|AAO41262.2| CG33205-PD, isoform D [Drosophila
QQQYQPPQNQYQPPQSQNQFSRPTAQAVPFQYPSEQQYQTQSTQQYQYSQQYQSSEQSYQSQPQGYQSVPQSSQVHSVPIQVQRQTSKPVEPPPSTITLRPQAPVSQAPPPVYTSQPATATLKGGKHLRGDMKWPPENVKVQAEEENRLRLELAKGPVCRPRKVHRDYTEFFDQHALNSSYPGYKIPPGTQFYRAE

SEQ ID NO: 22683 - protein, 247 aa, Diabrotica virgifera
  misc_feature: Coding regions on vcDNA: vcDNA=SeqID_2380; Strand=+; Position=237-980
  misc_feature: Homolog annotation: Hit_ID=XP_319412.1; Match level="QueryCoverage =73%, HitCoverage=85%, E-value=3e-25, Identity=35%"; Hit description =ENSANGP00000014488 [Anopheles gambiae] ref|XP_307101.1| ENSANGP00000012108 [Anopheles gambiae]
  misc_feature: Gene Ontology Annotation: Molecular function=KDEL sequence binding; Cellular component=integral to membrane; Biological process =intracellular protein transport
  misc_feature: Pfam annotation: Pfam_ID=ER_lumen_recept; Match level="Score=13.1, E -value=1.9e-15, Copies=1"; Pfam description=ER lumen protein retaining receptor
CKKEVKMHLLLIAGDLSLFLGTVYFVLSIFVEKSYNGISAKTQLLYMIVCTTRYFDDSSLFVWVINFFSSFAFFLSFRMKETYEKKYDSFWTESLLIPLLILAVFVNYDHSPFGILNAFSDYLESVALVPQLYMIWNKTKITKHIKIYLYYMYAYICLKMLYWFHVYYVYGTFNIISQVALAVEFIILSVSIVTLHCKSMMRTSYEVKVTKSQNIFLVNSGLLSLTTAKADEVPLITDEVTLVNEES

SEQ ID NO: 22684 - protein, 267 aa, Diabrotica virgifera
  misc_feature: Coding regions on vcDNA: vcDNA=SeqID_2381; Strand=+; Position=215-1015
  misc_feature: Homolog annotation: Hit_ID=XP_310453.1; Match level="QueryCoverage =100%, HitCoverage=61%, E-value=1e-122, Identity=81%"; Hit description=ENSANGP00000019192 [Anopheles gambiae]
  misc_feature: Gene Ontology Annotation: Molecular function=ATPase activity; Cellular component=endosome; Biological process=endosome transport
  misc_feature: Pfam annotation: Pfam_ID=AAA; Match level="Score=48.0, E-value=2.7e -11, Copies=1"; Pfam description=ATPase family associated with various
MATGTTLQKAIELVTKATEEDRNKNYEEALRLYEHGVEYFLHAIKYEAQGDKAKESIRAKCVQYLERAEKIKESVRKGKKKPVLDGGSSKEDKKSDSDEGDEDDPDKKKLQSKLEGAIVVEKPHVKWSDVAGLEAAKEALKEAVILPIRFPHLFSGKRVPWKGILLFGPPGTGKSYLAKAVATEANNSTFFSVSSSDLVSKWLGESEKLVKNLFELARAHKPSIIFIDEIDSLCSSRSDTNQSQPGEIKPEFFGQMQSVGHDTEGIL

SEQ ID NO: 22685 - protein, 310 aa, Diabrotica virgifera
  misc_feature: Coding regions on vcDNA: vcDNA=SeqID_2382; Strand=+; Position=125-1057
  misc_feature: Homolog annotation: Hit_ID=CAG02360.1; Match level="QueryCoverage =92%, HitCoverage=84%, E-value=2e-62, Identity=45%"; Hit description =unnamed protein product [Tetraodon nigroviridis]
  misc_feature: Gene Ontology Annotation: Molecular function=electron transporter activity; Cellular component=nucleus; Biological process=induction of apoptosis
  misc_feature: Pfam annotation: Pfam_ID=adh_short; Match level="Score=86.8, E-value =5.6e-23, Copies=1"; Pfam description=short chain dehydrogenase
  misc_feature (297)..(297): Xaa can be any naturally occurring amino acid
MGSIFSASCDSEARLDGKNAVITGANTGIGKETAKDFYVRGGRVILACRNIKRANEAIEKIKAECIGQQDLGELLAVCLDLSSLKSVRSCAEELLKTEKQIHILVNNAGLFGIPYGKSKENYELNFATNHLGHFLFTLLLLPIIIKSGPARIVTVSSRLHTSASSLDFSDLHYERRTYGAIKAYSESKLANILFMNELARKLKEKNINNVNVYSLHPGLVRSEVGRNLDDAWFPGSYWIWSNVLGLFAKSPKQGAQTSIYCSVDEKCANETGLYYAECAPVSPSQAARNETAAKELXGGQLEIGWFKRRL

SEQ ID NO: 22686 - protein, 198 aa, Diabrotica virgifera
  misc_feature: Coding regions on vcDNA: vcDNA=SeqID_2383; Strand=+; Position=225-818
  misc_feature: Homolog annotation: Hit_ID=NP_650348.1; Match level="QueryCoverage =100%, HitCoverage=33%, E-value=9e-48, Identity=48%"; Hit description= CG31322-PA [Drosophila melanogaster] gb|AAF55037.2| CG31322-PA [Drosophila melanogaster]
  misc_feature: Gene Ontology Annotation: Molecular function=methionine-tRNA ligase activity; Cellular component=mitochondrion; Biological process=tRNA modification
  misc_feature (178)..(178): Xaa can be any naturally occurring amino acid
  misc_feature (186)..(186): Xaa can be any naturally occurring amino acid
MCSRGILSIRRFTTDAKSIHFFTTPIYYVNASPHIGHLYSSLIADAAQRWQQMYRKGSLIKFSTGTDEHGSKIQQAANKNGTSAKVYCDKISSQFEKLVSEFDIGCTNYIRTSEDSHKNTVGKFWKILDESQFIYKSKYEGWYCVSDETFLTESQLNEITKQDGTKVLVSSESNHPVXWSSEENYXVQLSQFRDDLNY

SEQ ID NO: 22687 - protein, 57 aa, Diabrotica virgifera
  misc_feature: Coding regions on vcDNA: vcDNA=SeqID_2384; Strand=-; Position=230-403
LVFKSYNYCSQNIKQHSNILYLLILYSVFNCFKSINKQLSNNHNILQPRNHEMSMPH

SEQ ID NO: 22688 - protein, 291 aa, Diabrotica virgifera
  misc_feature: Coding regions on vcDNA: vcDNA=SeqID_2385; Strand=+; Position=245-1117
  misc_feature: Homolog annotation: Hit_ID=NP_498916.1; Match level="QueryCoverage =71%, HitCoverage=34%, E-value=1e-10, Identity=24%"; Hit description =ubiquitin domain containing protein (70.1 kD) (3J781) [Caenorhabditis elegans] gb|AAA27898.3|
  misc_feature: Pfam annotation: Pfam_ID=ubiquitin; Match level="Score=23.9, E-value =0.0005, Copies=1"; Pfam description=Ubiquitin family
MTIIEGIGDEVTHFFIALFVIVIGTVAWWTTNISEQRYIRTVVLLERRRHRAHRRLTNHTESVTITEGSSSTSQTEESTPDLSAETDAALERARAPNGNKPPEPRSEEDLIAPDIPSTILEDSRGEEEESIIETMDADANIVRQRRLAFYTGFSNENQEPTSSHTESFRQNTSSPQDSSTSSEDVEPSAPPTEESVPPKNEDTTSNRITVKLKYINDDLKLVEGNLNESLGEFKKRNFVPELSSNKLIRLIFNGQVLQPDTQTLKNCGLFDNCVVHCLIHQESPNRSSGTE

SEQ ID NO: 22689 - protein, 142 aa, Diabrotica virgifera
  misc_feature: Coding regions on vcDNA: vcDNA=SeqID_2386; Strand=+; Position=147-575
  misc_feature: Homolog annotation: Hit_ID=AAR09991.1; Match level="QueryCoverage =100%, HitCoverage=100%, E-value=3e-75, Identity=97%"; Hit description=similar to Drosophila melanogaster AP-2sigma [Drosophila yakuba] ref|NP_650961.2| CG6056-PA [Drosophila
  misc_feature: Gene Ontology Annotation: Molecular function=transporter activity; Cellular component=cellular_component unknown; Biological process =biological_process unknown
  misc_feature: Pfam annotation: Pfam_ID=Clat_adaptor_s; Match level="Score=323.4, E -value=3.3e-94, Copies=1"; Pfam description=Clathrin adaptor complex small chain
MIRFILIQNRAGKTRLAKWYMNFDDDEKQKLIEEVHAVVTVRDAKHTNFVEFRNFKIVYRRYAGLYFCICVDVNDNNLSYLEAIHNFVEVLNEYFHNVCELDLVFNFYKVYTVVDEMFLAGGIRETSQTKVLKQLLMLNSLE

SEQ ID NO: 22690 - protein, 302 aa, Diabrotica virgifera
  misc_feature: Coding regions on vcDNA: vcDNA=SeqID_2387; Strand=+; Position=389-1296
  misc_feature: Homolog annotation: Hit_ID=NP_650138.1; Match level="QueryCoverage =98%, HitCoverage=86%, E-value=7e-88, Identity=51%"; Hit description =CG18547-PA [Drosophila melanogaster] gb|AAF54729.1| CG18547-PA [Drosophila melanogaster]
  misc_feature: Gene Ontology Annotation: Molecular function=molecular_function unknown; Cellular component=cellular_component unknown; Biological process=biological_process unknown
  misc_feature: Pfam annotation: Pfam_ID=Aldo_ket_red; Match level="Score=2.1, E -value=1.5e-09, Copies=1"; Pfam description=Aldo/keto reductase family
  misc_feature (269)..(269): Xaa can be any naturally occurring amino acid
  misc_feature (278)..(279): Xaa can be any naturally occurring amino acid
  misc_feature (287)..(287): Xaa can be any naturally occurring amino acid
MALPETFVPGFHDEAAVRKMQYTKLGNTDMHVSKLSLGTGGFSYFYGDYDIEECKKTVHEAIKRGINYIDTGPWYGHGTSETILGKCLEGIPRKAYYLATKIGRYEQDPKLMFNFSAQKTRESINTSLKRLKVDYVDVLQVHDVEFSPSMDTILNETLPTLEELKKEGKTRYIGITGYPVSTLVEVIEKSKISINMILSYCRLTMIDDTLRSFIPTLQSKHVGIVNAAANSMGLLSNFGPQNWHPASEHIKDICTEARNLCKENDVELXKLAIYYSLXXESTETIMXGMNTPKLVDINLEVV

SEQ ID NO: 22691 - protein, 314 aa, Diabrotica virgifera
  misc_feature: Coding regions on vcDNA: vcDNA=SeqID_2388; Strand=-; Position=2-941
  misc_feature: Homolog annotation: Hit_ID=XP_392800.1; Match level="QueryCoverage =98%, HitCoverage=39%, E-value=1e-121, Identity=69%"; Hit description= similar to ENSANGP00000021534 [Apis mellifera]
  misc_feature: Gene Ontology Annotation: Molecular function=molecular_function unknown; Cellular component=cellular_component unknown; Biological process=cell cycle
  misc_feature: Pfam annotation: Pfam_ID=Cullin; Match level="Score=370.3, E-value =2.6e-108, Copies=1"; Pfam description=Cullin family
  misc_feature (211)..(211): Xaa can be any naturally occurring amino acid
IVQELLDFKDSLDNVVIVCFDKSDKFMNALKEAFEYFVNQRTNKLAELTAKFVDSKLRAGNKAATEEELDHLLDKTMVLFRFIHGKDVFEAFYKKDLAKRLLVGKSASVDAEKSMLSKLKQECGGAFTSKLEGMFKDMELSNDINSSFKFYLKSSDLQLAPIDMTVNILTMGFWPTYLTMDVIFPEQFTKFQDTFNNYYLSRYSGRKLQWXQPALHHCILKATFKTGKKELVVSLFQTLVILLFNEYEEISFGDIKTATNIEDGELRRTLQSLACGKVRILNKIPKGRNIENSDKFRLNKEFYNKLFKITRTRN

SEQ ID NO: 22692 - protein, 201 aa, Diabrotica virgifera
  misc_feature: Coding regions on vcDNA: vcDNA=SeqID_2389; Strand=+; Position=280-885
GEHSMYFSMEQSISEKIICISRGKYNISDIWSLVLSNLLVTERTVHHVMDQGDSIPKRDPKDTVEWQRLFQKMILQNMSTNGVHRLQCSYDSPGKNGREPHYNLKHFRSHSGTHRLQRTTFGGILQQCDETVCRCAPHSEVRAFPHLCKLLALLSVFILIMFKVGMYCEAVRRQTGCDQYRHFVYFLGGEQSHCLLQRLGR

SEQ ID NO: 22693 - protein, 304 aa, Diabrotica virgifera
  misc_feature: Coding regions on vcDNA: vcDNA=SeqID_2390; Strand=+; Position=166-1080
  misc_feature: Homolog annotation: Hit_ID=XP_314349.1; Match level="QueryCoverage =79%, HitCoverage=74%, E-value=6e-63, Identity=49%"; Hit description =ENSANGP00000025105 [Anopheles gambiae]
  misc_feature: Gene Ontology Annotation: Molecular function=molecular_function unknown; Cellular component=cellular_component unknown; Biological process=biological_process unknown
MSFIIIPLNRRIGVRNSSCIWSTIRLFSSETTSSDEQGDDKNYEEDIRNKILEASLPHVPELGWSKEAIAKGAQAVGYPGVTHGMFSRGGGDLLHYFQTSSNSKLVQFLKKYKEDMKENPIPPADFAERAIQERLKMVGPYVGKWPQALAIMALPPNVPNSLATLLTMVDDICYYAGDRSVDHNWYLRRIGIAGVYKASELYMIQDKSEEFKNTWVFLNKRLLEAVQLADLLLKSENGTQMAKDTVQSVFVTAPQYIKDSIGINRNMGGRVHPTRKDLGRLIIFFIGFSSEKKLKLENLGIFLI

SEQ ID NO: 22694 - protein, 241 aa, Diabrotica virgifera
  misc_feature: Coding regions on vcDNA: vcDNA=SeqID_2391; Strand=+; Position=106-831
  misc_feature: Homolog annotation: Hit_ID=NP_648234.1; Match level="QueryCoverage =94%, HitCoverage=95%, E-value=1e-45, Identity=42%"; Hit description =CG6776-PA [Drosophila melanogaster] gb|AAF50406.1| CG6776-PA [Drosophila melanogaster]
  misc_feature: Gene Ontology Annotation: Molecular function=monodehydroascorbate reductase (NADH) activity; Cellular component=cytoplasm; Biological process=biological_process unknown
  misc_feature: Pfam annotation: Pfam_ID=GST_N; Match level="Score=55.1, E-value=2e -13, Copies=1"; Pfam description=Glutathione S-transferase, N-terminal
MSTKHLSVGSVEPPRTEGLLRVYSMKFCPFAQRALLVLKAKNIPHDVVNLNLIRKPEWYSKINPKTLVPAILDGDKIVIESLDIADYLDEKYPENPLYPADPAAKQQIKDIINKAGVAQGVQQKLLASKEEHTAEEWAKLLLEALQPLEEALSQRGTPFFGGDKPGMADYMIWPWAERAGCIEIKLQQKLPLKDSDIPLLRKWRKDMMHEPVCKELYISGDRFWKIAKAKIDGVEPAYDEV

SEQ ID NO: 22695 - protein, 290 aa, Diabrotica virgifera
  misc_feature: Coding regions on vcDNA: vcDNA=SeqID_2392; Strand=+; Position=48-920
  misc_feature: Homolog annotation: Hit_ID=XP_396250.1; Match level="QueryCoverage =95%, HitCoverage=58%, E-value=4e-34, Identity=30%"; Hit description =similar to ENSANGP00000009437 [Apis mellifera]
  misc_feature: Gene Ontology Annotation: Molecular function=glucose transporter activity; Cellular component=membrane; Biological process=signal transduction
  misc_feature: Pfam annotation: Pfam_ID=MFS_1; Match level="Score=-3.6, E-value =0.005, Copies=1"; Pfam description=Major Facilitator Superfamily
MENNGLIHLIKNTYPQIIAAVSGTLFAISDGMTYGWSAPYIPYLISDISHIQTTKREADFLETAFLLGSFCGLPFTVYLVNKIGRKKSLLLASFVVLLAWLAIGLGNQMVYIFVARFFCGMSGNMAFVAAPCFIAEIADPQIRGFLSSIIYVMMLLGCLIVYSVGPFLPFYVPCIIGGTVAIIEILVFSRVPESALYLLSKDKPEAALQSIKFYKPYIDPIKELEQISKSIEEQRHEKGRFLDLFVVPSNRKGILIMTGGKWWATFFAANSVILMDFTSNFFENGGNKLI

SEQ ID NO: 22696 - protein, 131 aa, Diabrotica virgifera
  misc_feature: Coding regions on vcDNA: vcDNA=SeqID_2393; Strand=+; Position=69-461
  misc_feature: Homolog annotation: Hit_ID=XP_313013.1; Match level="QueryCoverage =100%, HitCoverage=53%, E-value=6e-25, Identity=42%"; Hit description= ENSANGP00000011258 [Anopheles gambiae]
  misc_feature: Pfam annotation: Pfam_ID=DUF1676; Match level="Score=39.8, E-value =7.9e-09, Copies=1"; Pfam description=Protein of unknown function (DUF1676)
MRKLVLVLFFVICAYAQDNFENTGVRLALKIYDDCTKADGLSPCLKRKAITFLDRLSRMDKFALTDGVTVQKASDAVAEGPALTEEQLDNTLPRSSDAKDAALTNMLFEKVGSFIGSRSLEVTLPKIQASD

SEQ ID NO: 22697 - protein, 154 aa, Diabrotica virgifera
  misc_feature: Coding regions on vcDNA: vcDNA=SeqID_2394; Strand=+; Position=75-539
  misc_feature: Homolog annotation: Hit_ID=XP_392901.1; Match level="QueryCoverage =90%, HitCoverage=92%, E-value=5e-59, Identity=73%"; Hit description =similar to ENSANGP00000010475 [Apis mellifera]
  misc_feature: Gene Ontology Annotation: Molecular function=ubiquitin conjugating enzyme activity; Cellular component=nucleus; Biological process =flight behavior
  misc_feature: Pfam annotation: Pfam_ID=UQ_con; Match level="Score=233.5, E-value=4e- 67, Copies=1"; Pfam description=Ubiquitin-conjugating enzyme
SIQWLLDRKSVLSVETKNLSKDPPPGISATPDESNCRYFHVVMAGPSGSPYEGGLFKLELFLPENYPMSPPNVRFLTKIYHPNIDKLGRICLDILKDQWSPALQVRTVLLSVQALLSSPNPDDPLANDVANMWKSREQDAVLKAKEWTRLDAME

SEQ ID NO: 22698 - protein, 287 aa, Diabrotica virgifera
  misc_feature: Coding regions on vcDNA: vcDNA=SeqID_2395; Strand=+; Position=23-886
  misc_feature: Homolog annotation: Hit_ID=EAK90848.1; Match level="QueryCoverage =94%, HitCoverage=15%, E-value=3e-09, Identity=23%"; Hit description =likely vesicular transport factor Uso1p [Candida albicans SC5314]
MLEGKVDLCSTDQKTTSDELNKAERALSTRISSSANDIKQLKDSLYNYVNMSISSLTNANNKDFSKELGDLKRSLSGRLSNDESRLSDVEKNVQKLRSDFNQKSNSLDATIQGIRKDILVLQGPNDELALTVEAGVLAKVIPLLNPTLITKNVSRELDVLKDEVAAQFANSSKTIKDLKTEVDSCKRVSGTKFKENEKKIGQIENNLSSTQMNLNDLSEKLNNGVLNEVNTRVTSALNKSAKCETKVKQLQDEINKLRNDFETTVAMLREEHKEFRKKLEAEDVQVV

SEQ ID NO: 22699 - protein, 283 aa, Diabrotica virgifera
  misc_feature: Coding regions on vcDNA: vcDNA=SeqID_2396; Strand=+; Position=12-863
  misc_feature: Homolog annotation: Hit_ID=NP_497925.1; Match level="QueryCoverage =62%, HitCoverage=30%, E-value=2e-10, Identity=27%"; Hit description =insulin-like growth factor binding protein acid labile, P-granule Associated Novel protein
  misc_feature: Pfam annotation: Pfam_ID=LRR_1; Match level="Score=19.5, E-value =0.01, Copies=5"; Pfam description=Leucine Rich Repeat
MYCGASSHHIHCENFEFKSGEKLLFFGRDEVDNTTTWLDLNNCTGIITSETFNLFPALDYVNFKGCTLEFSAKSFAAIKNIRAIDIRESKVSISKEIFEDCETLESMHLKDLKLPDQDCFSPLKKLNMLTIEECQFENSNSNIFRELFSLQYLIIERCELPIFGDVYQDFKNLEMLILMHNKIGELNCDGIFNLQKLKDIAIFNNETISVIDYERFQTMPLLETILFENNVYKTLDLRAFPSLKLVKIGTLTDIPTPTDEELFKKFDDMNITYQFTFLGENPN

SEQ ID NO: 22700 - protein, 271 aa, Diabrotica virgifera
  misc_feature: Coding regions on vcDNA: vcDNA=SeqID_2397; Strand=+; Position=112-923
  misc_feature: Homolog annotation: Hit_ID=XP_220013.2; Match level="QueryCoverage =97%, HitCoverage=45%, E-value=1e-117, Identity=72%"; Hit description= similar to transmembrane protein TM9SF3 [Rattus norvegicus] ref|NP _579930.1| transmembrane
  misc_feature: Gene Ontology Annotation: Molecular function=transporter activity; Cellular component=integral to plasma membrane; Biological process =transport
  misc_feature: Pfam annotation: Pfam_ID=EMP70; Match level="Score=-58.9, E-value =6.4e-15, Copies=1"; Pfam description=Endomembrane protein 70
  misc_feature (221)..(221): Xaa can be any naturally occurring amino acid
  misc_feature (246)..(246): Xaa can be any naturally occurring amino acid
MYLLYKVLVLSFVVGAFTDEHNHIYEDNEEVVLWMNTVGPYHNRQETYAYFSLPFCIGSKDTISHYHETLSEALQGVELEFSGIEIEFKINMSRGDYCAVQLDEEKYKAFVYAVKNHYWYQMYIDDLPIWGVVGEMKDNSYYIWTHKKFEIGYNGKQIIDVNLTSEEKVELKPTTQLKFTYEVIWKKTNIKFEDRFDKYLDHNFFQHRIHWFSIFNSFMMXIFLVGLVSMILMRTLRKDYARYSRXEDIDDMERDLGDEYGWKQNHGGCFP

SEQ ID NO: 22701 - protein, 63 aa, Diabrotica virgifera
  misc_feature: Coding regions on vcDNA: vcDNA=SeqID_2398; Strand=-; Position=394-585
PPYYEFLDPRLLVTVANNKDFCKCCQKATTAHQDRFIVQTAKLKETQQFLIYSTKGSFWKIQG

SEQ ID NO: 22702 - protein, 192 aa, Diabrotica virgifera
  misc_feature: Coding regions on vcDNA: vcDNA=SeqID_2399; Strand=-; Position=44-622
  misc_feature: Homolog annotation: Hit_ID=BAC58076.2; Match level="QueryCoverage =97%, HitCoverage=79%, E-value=6e-22, Identity=36%"; Hit description =large tegument protein [Cercopithecine herpesvirus 1]
  misc_feature: Gene Ontology Annotation: Molecular function=receptor binding; Cellular component=extracellular space; Biological process=hearing
  misc_feature (86)..(86): Xaa can be any naturally occurring amino acid
RPKCPAPCPHPPSPRPKPACPNPNPKPKAAGARIAPCPLGPVGPTAPCPLTTPAGPTAPAPVTTPEGPAAPAPVTIPEGPTGLRAXPATPNPKPKAPGPARIAPCPLGPVGPTAPCPLTTPAGPTAPAPVTTPEGPAAPAPVTIPEGPIGLRACGLTIPACPNPQPRPRWDAEAVATIAAKVRAIIAFMLSC

SEQ ID NO: 22703 - protein, 284 aa, Diabrotica virgifera
  misc_feature: Coding regions on vcDNA: vcDNA=SeqID_2400; Strand=+; Position=42-893
  misc_feature: Homolog annotation: Hit_ID=XP_313763.1; Match level="QueryCoverage =94%, HitCoverage=83%, E-value=1e-125, Identity=80%"; Hit description= ENSANGP00000016944 [Anopheles gambiae]
  misc_feature: Gene Ontology Annotation: Molecular function=rRNA (adenine-N6N6-) -dimethyltransferase activity; Cellular component=cellular_component unknown; Biological process=rRNA modification
  misc_feature: Pfam annotation: Pfam_ID=RrnaAD; Match level="Score=249.0, E-value =8.7e-72, Copies=1"; Pfam description=Ribosomal RNA adenine dimethylase
TNQIKMPKVKVDKKKKSQNGVVKQGILFNKDFGQHILKNPMVITSMLEKSGLRPTDVVLEVGPGTGNMTVKLLEQVKRVTACEIDHRLVAELQKRVQGTPLQSKLEIQVGDVLKSDLPFFDVCVANVPYQISSPLVFKLLLHRPFFRCAVLMFQLEFAQRLVAKPGDKLYCRLSVNTQLLSRVDMLMKVGKNNFRPPPKVESCVVRIEPRNPPPPINYTEWDGLTRIAFTRKNKTLGSVFRQTAVLAALEKNYKLHCSLNNKGLPDDFSIKKKKKGYYFKRFQL

SEQ ID NO: 22704 - protein, 291 aa, Diabrotica virgifera
  misc_feature: Coding regions on vcDNA: vcDNA=SeqID_2401; Strand=+; Position=210-1086
  misc_feature: Homolog annotation: Hit_ID=XP_391959.1; Match level="QueryCoverage =92%, HitCoverage=99%, E-value=1e-124, Identity=83%"; Hit description= similar to prohibitin protein Wph [Apis mellifera]
  misc_feature: Gene Ontology Annotation: Molecular function=molecular_function unknown; Cellular component=mitochondrion; Biological process =proteolysis and peptidolysis
  misc_feature: Pfam annotation: Pfam_ID=Band_7; Match level="Score=208.9, E-value =9.9e-60, Copies=1"; Pfam description=SPFH domain / Band 7 family
  misc_feature (250)..(250): Xaa can be any naturally occurring amino acid
MSAAQIFNRIGQVGLGIALVGGVVNSALYNVDGGHRAVIFDRFAGIKKQVIGEGTHFFIPWVQKPIIFDVRSRPRNIPVITGSKDLQNVNITLRILFRPVPDELPKIYTILGQDYEERVLPSITNEVLKAVVAQFDASELITQRDVVSQKVSEDLTERATQFGVILDDISLTHLTFGREFTQAVELKQVAQQEAEKARFLVEKAEQTKKATVISAEGDAQAAVLLAKAFGDAGEGLVELRRIEAAEDIAXQLSRSRQVSYLPGGKNLLLNGPTPREIKWDKVTKKNWGVVD

SEQ ID NO: 22705 - protein, 234 aa, Diabrotica virgifera
  misc_feature: Coding regions on vcDNA: vcDNA=SeqID_2402; Strand=+; Position=73-777
FYIVSRNVSSIEHTRPVTFNNSATYIFFGNIKQIEEFIKFQEYSESDEVDAIFVPLDGSVPTGLPESSFVIIPPHHPASTKYKTRENILPSPMFLSTAKSILTFSKNIEKYVEKNCNDTSYKVNCLRSKFNRKYRPVLMSPNGILDILKIEPLTSNFVYDIYRVENDTSNISVLALRNNFLQPYTKIFSYNIFYDNITLVDQSFEDRSPNVSINEASSNCLNYFKEKRFTFLHR

SEQ ID NO: 22706 - protein, 59 aa, Diabrotica virgifera
  misc_feature: Coding regions on vcDNA: vcDNA=SeqID_2403; Strand=-; Position=672-851
LNGIQPTSENYPDLAYKIIDLIITNIVYGCQYITYRSVLFELITLHCRTGGFLKRVKYY

SEQ ID NO: 22707 - protein, 221 aa, Diabrotica virgifera
  misc_feature: Coding regions on vcDNA: vcDNA=SeqID_2404; Strand=+; Position=200-865
  misc_feature (209)..(209): Xaa can be any naturally occurring amino acid
  misc_feature (221)..(221): Xaa can be any naturally occurring amino acid
IFTPKIEMMNESTIDILNETEYESDQFASVPAIEGQFPKSLNGLGYYLLVITIIKLFVVLAVLIINIFLVIVILRFRRLHAIRSNIYILNMSIMNIIFYLCTPLFYIICHLVSAHEQQSVLILQTQSTLLILYLTFAVAMSVDWILTVSKPQLMKRFEHRCKYLIFGIYILFFMEWIVAFIYSEVEHIARANSFTIFYVIYAAILTALXVFKNRVEIRHEX

SEQ ID NO: 22708 - protein, 425 aa, Diabrotica virgifera
  misc_feature: Coding regions on vcDNA: vcDNA=SeqID_2405; Strand=+; Position=115-1388
  misc_feature: Homolog annotation: Hit_ID=NP_608987.1; Match level="QueryCoverage =99%, HitCoverage=89%, E-value=0.0, Identity=86%"; Hit description =CG9140-PA [Drosophila melanogaster] gb|AAF52334.1| CG9140-PA [Drosophila melanogaster]
  misc_feature: Gene Ontology Annotation: Molecular function=NADH dehydrogenase (ubiquinone) activity; Cellular component=mitochondrial inner membrane; Biological process=energy pathways
  misc_feature: Pfam annotation: Pfam_ID=Complex1_51K; Match level="Score=616.1, E -value=2.6e-182, Copies=1"; Pfam description=Respiratory-chain NADH dehydrogenase
  misc_feature (403)..(403): Xaa can be any naturally occurring amino acid
  misc_feature (410)..(410): Xaa can be any naturally occurring amino acid
MAAALGRITNLTKTQVGQFLPAICNNQIVFYSGPPPGTPPPQTKTKFGPLADEDRIFTNLYGRHDWRLKGSMKRGDWYKTKEILLKGSDWIINEVKVSGLRGRGGAGFPSGMKWSFMNKPGDGRPKYLVVNADEGEPGTCKDREIMRHDPHKLVEGCLIAGRAMGAKAAYIYIRGEFYNEASNMQVAIAEAYQAGFLGKNACGSGYDFDVFMHRGAGAYICGEETALIESIEGKQGKPRLKPPFPADVGVFGCPTTVTNVETVAVAPTICRRGGTWFASFGRTRNSGTKLFNISGHVNRPCTVEEEMSIPLKELIEIHAGGVTGGWDNLLAIIPGGSSTPLIPKKVCEDVLMDFDGLVAAQTSLGTAAIIVMNKQTDIVKAIARLIMFYKHESCGQCTPCREXVNWMNKXIYRFVDGNAKPDEID

SEQ ID NO: 22709 - protein, 101 aa, Diabrotica virgifera
  misc_feature: Coding regions on vcDNA: vcDNA=SeqID_2406; Strand=-; Position=3-305
FDYQQNFYHSSSNIPIVFLLYVLLYFNILIPFVNTHTNKNQTNLIKFRTVRVKRSVSLPSHMTSMCKWSRRMTGVCKWILCLSTRVRIPNASFYFFYTFYD

SEQ ID NO: 22710 - protein, 289 aa, Diabrotica virgifera
  misc_feature: Coding regions on vcDNA: vcDNA=SeqID_2407; Strand=+; Position=78-943
  misc_feature: Homolog annotation: Hit_ID=NP_572148.2; Match level="QueryCoverage =89%, HitCoverage=33%, E-value=2e-53, Identity=43%"; Hit description =CG6379-PA [Drosophila melanogaster] gb|AAF45915.1| CG6379-PA [Drosophila melanogaster]
  misc_feature: Pfam annotation: Pfam_ID=G-patch; Match level="Score=53.4, E-value =6.3e-13, Copies=1"; Pfam description=G-patch domain
  misc_feature (264)..(264): Xaa can be any naturally occurring amino acid
MISETVNESDTNISMQYQNLSIYDNGPPFEVFQNEETTKSPNIDEKALRMMQKMGYKEGSGLGKSEQGITKIIDINYQHGKRGLGLKLKRIEDTLKTWNFSIEEVNIKENLIWLKNEAASDYTEEELLTWIKEGEHVTDIKTQTEFCDEEILNNVVNAKDIFEEMDIIELCQARAKSNPFETIRSAFFMNRAALKMANIDAVTNYMFTDVDKNENFQNHEGPYYFADVCAGPGGFSEYILWRKQWNFKGFGLTLKDENDFKLGXFNLRCPASFQALYGNDDGRKCLLSG

SEQ ID NO: 22711 - protein, 55 aa, Diabrotica virgifera
  misc_feature: Coding regions on vcDNA: vcDNA=SeqID_2408; Strand=-; Position=10-177
QTLWEQYTINFDVKDGNMSSFFLFIILFIDDHTAAMPQVHKQLFNNINKVIKTSD

SEQ ID NO: 22712 - protein, 198 aa, Diabrotica virgifera
  misc_feature: Coding regions on vcDNA: vcDNA=SeqID_2409; Strand=+; Position=54-650
  misc_feature: Homolog annotation: Hit_ID=XP_397536.1; Match level="QueryCoverage =97%, HitCoverage=92%, E-value=7e-40, Identity=46%"; Hit description =hypothetical protein XP_397536 [Apis mellifera]
MSFIGSSILLALALGLANAGYEHGHQDLGSHDLGGGHDLGGGHELGGQDYSGYGGGHGGWQPHVQEHHQHIPTNTIEHTQAVAVPVVKKVGVPVPHPVGVPVPQVVKVPVPQPYAVHVPVPQPIAVPIYKLVPQEIEKKVPITVEKLVPVYVDKPYKIEIEKHHPVYVNQPYPVHVPVYKHVLHTSKHGGGEEQHGWH

SEQ ID NO: 22713 - protein, 294 aa, Diabrotica virgifera
  misc_feature: Coding regions on vcDNA: vcDNA=SeqID_2410; Strand=+; Position=153-1034
  misc_feature: Homolog annotation: Hit_ID=XP_394566.1; Match level="QueryCoverage =98%, HitCoverage=62%, E-value=2e-65, Identity=44%"; Hit description =similar to ENSANGP00000015808 [Apis mellifera]
  misc_feature: Gene Ontology Annotation: Cellular component=CCR4-NOT core complex; Biological process=regulation of transcription, DNA-dependent
  misc_feature: Pfam annotation: Pfam_ID=GCV_T; Match level="Score=84.7, E-value=2.5e- 22, Copies=1"; Pfam description=Glycine cleavage T-protein (aminometh
FKYCPVMLKLSKIFNITNIRFCSNAATRTILEPLKNRSLIHVSGNDSTEFLQGLVTNDINHLSQNFHSMYAMFLNTKGRVLYDSIIYKFETDNSYFIECDLEIEKQLEKHLKMYRVRKKVDVTNACDKYQIYVLFKNNCLKTEDVQLEKNIVDSTAAQESAPLQTTKKMFIFKDPRVADLGYRIIAKNDVDIEKEISSSVITESPTPEENYKYLRYSLGIGEGVNDLPVGNCFPLESNCDYLHGVSFHKGCYIGQELTARTHHTGVVRKRLMPLFVIEPSLTSDSKSDQVNLGK

SEQ ID NO: 22714 - protein, 218 aa, Diabrotica virgifera
  misc_feature: Coding regions on vcDNA: vcDNA=SeqID_2411; Strand=+; Position=66-722
  misc_feature: Homolog annotation: Hit_ID=NP_788616.1; Match level="QueryCoverage =97%, HitCoverage=98%, E-value=5e-99, Identity=80%"; Hit description =CG33104-PA [Drosophila melanogaster] gb|AAG22137.2| CG33104-PA [Drosophila melanogaster]
  misc_feature: Gene Ontology Annotation: Molecular function=molecular_function unknown; Cellular component=integral to membrane; Biological process= secretory pathway
  misc_feature: Pfam annotation: Pfam_ID=EMP24_GP25L; Match level="Score=58.9, E -value=1.4e-14, Copies=1"; Pfam description=emp24/gp25L/p24 family
MGKSVPYFSIAIFFILFEISSALYFHIGETERKCFIEEIPDETNVIVNYKVELYDPRSGGFMPSSTGIGMHVEVRDPDDKIILSRVYSAEGKISFTSHLPGEHVICMFSNSTAWFSGSQLRVHLDIQVGEHAINYGEIVQREKLSELQLRVRQLIDQVEQITKEQNYQRYREERFRHTSESTNSRVLWWSITQTAVLLVMGTWQMRHLKTFFEAKKLV

SEQ ID NO: 22715 - protein, 311 aa, Diabrotica virgifera
  misc_feature: Coding regions on vcDNA: vcDNA=SeqID_2412; Strand=+; Position=17-952
  misc_feature: Homolog annotation: Hit_ID=NP_610769.1; Match level="QueryCoverage =70%, HitCoverage=83%, E-value=5e-26, Identity=36%"; Hit description =CG30042-PA [Drosophila melanogaster] gb|AAF58524.2| CG30042-PA [Drosophila melanogaster]
  misc_feature: Pfam annotation: Pfam_ID=Chitin_bind_4; Match level="Score=82.4, E -value=1.2e-21, Copies=1"; Pfam description=Insect cuticle protein
CKMNYLIICAILAVAFAAPQGVNEDDGQYHPDNSGQYAADGAGAYRGIPTSALGSLVSQYRPQPKAVNYYPGVPTQYNNGQNGQYRSDSQDDGQYHPDHSGDYNGDGSGAYSGDNSGAYSGIQGGAYSGNQGGAYSGNQGVGARNYRYQGAGQGQVTRPVVQPTVRAQPVSRYQGNAAQAGAQSAYRNNGQYSNNGQYSNGQHNVQHKSQDGYNNNGQYRIIRKSEEILEDGYHYFYETENGITAEEEGHLVERGTEHEHMYVKGFYTYPAPNGEKYTVEYTSDGVTGFVPVGAHLPTAPEAQQRSVVQQQ

SEQ ID NO: 22716 - protein, 317 aa, Diabrotica virgifera
  misc_feature: Coding regions on vcDNA: vcDNA=SeqID_2413; Strand=+; Position=66-1019
  misc_feature: Homolog annotation: Hit_ID=NP_610769.1; Match level="QueryCoverage =71%, HitCoverage=83%, E-value=2e-27, Identity=37%"; Hit description =CG30042-PA [Drosophila melanogaster] gb|AAF58524.2| CG30042-PA [Drosophila melanogaster]
  misc_feature: Gene Ontology Annotation: Molecular function=RNA polymerase II transcription factor activity; Cellular component=transcription factor TFIID complex
  misc_feature: Pfam annotation: Pfam_ID=Chitin_bind_4; Match level="Score=82.4, E -value=1.2e-21, Copies=1"; Pfam description=Insect cuticle protein
MNYLIICAILAVAFAAPQRVDEDDGQYHPENSGQYAADGAGAYRGVPTSALGSLVSQYRPQPKAVNYYPGVPTQYNNGQNGQYRSDSQDDGQYHPDHSGDYNGDGSGAYSGDNSGAYSGIQGGAYSGNQGGAYSGNQGGAYSGNQGVGARNYRYQGAGQGQVTRPVVQPTVRAQPVSRYQGNAAQAGAQSAYRNNGQYSNNGQYSNGQHNVQHKSQDGYNNNGQYRIIRKSEEILEDGYHYFYETENGITAEEEGHLVERGTEHEHMYVKGFYTYPAPNGEKYTVEYTSDGVTGFVPVGAHLPTAPEAQQRSVVQQQ

SEQ ID NO: 22717 - protein, 130 aa, Diabrotica virgifera
  misc_feature: Coding regions on vcDNA: vcDNA=SeqID_2414; Strand=-; Position=148-540
CVYKNGRNEYKNRTFAGIWNRSIYVVHPFFKKWNKNYLLQKICQKYALQSINIIANQLDFEYSLNQYFKITEIIYVGMFQDFCLLAQKGIHFWDTMLTIFFLFFLYYFLFLSLFTNTTQNIRFLWRTNCC

SEQ ID NO: 22718 - protein, 492 aa, Diabrotica virgifera
  misc_feature: Coding regions on vcDNA: vcDNA=SeqID_2415; Strand=+; Position=110-1586
  misc_feature: Homolog annotation: Hit_ID=XP_320236.1; Match level="QueryCoverage =100%, HitCoverage=98%, E-value=0.0, Identity=66%"; Hit description =ENSANGP00000020045 [Anopheles gambiae]
  misc_feature: Gene Ontology Annotation: Molecular function=molecular_function unknown; Cellular component=nucleus; Biological process=cell differentiation
  misc_feature: Pfam annotation: Pfam_ID=LIM; Match level="Score=241.1, E-value=2e -69, Copies=5"; Pfam description=LIM domain
  misc_feature (463)..(463): Xaa can be any naturally occurring amino acid
MPFKPADNPKCPKCGKSVYAAEEKVAGGYKYHKSCFKCGMCNKMLDSTNVTEHEAELYCKNCHGRKYGPKGYGFGGGAGCLSMDDGAQFKGDEDFVKSRAPLLPRAIAKAPDGEGCPRCGGYVYAAEQMLARGRAFHKTCFKCADCNKGLDSVNVAEGPDKDIYCKVCYGKRFGPKGYGYGQGGGTLQSDCFAVSDQAPKTTLIDTTSIKAKPGQGCPRCGGVVFAAEEVLAKGRPWHRKCFKCRDCTKTLDSINACDGPDKDVYCKTCYGKKWGPHGYGFACGSGFLQTDGLTEEEISQSRPFYNPDTTSIKAPPGQGCPRCGGMVFAAEQQLAKGTMWHKKCFNCAECHRPLDSVLACDGPDKEIHCRACYGKLFGPKGFGFGHAPTLVCADGTAPAVHDPRPNSGPKAAPGKGCRRCGYAVYAAEQMISKHGQWHKRCFSCADCNRSLDSTILNDGPNGXEIYCRGCYGRNFGPRGVGFGMGAGTLTMA

SEQ ID NO: 22719 - protein, 93 aa, Diabrotica virgifera
  misc_feature: Coding regions on vcDNA: vcDNA=SeqID_2416; Strand=+; Position=282-563
  misc_feature: Homolog annotation: Hit_ID=XP_320236.1; Match level="QueryCoverage =97%, HitCoverage=98%, E-value=1e-46, Identity=55%"; Hit description =ENSANGP00000020045 [Anopheles gambiae]
  misc_feature: Gene Ontology Annotation: Molecular function=molecular_function unknown; Cellular component=nucleus; Biological process=myogenesis
  misc_feature: Pfam annotation: Pfam_ID=LIM; Match level="Score=65.6, E-value=1.4e -16, Copies=1"; Pfam description=LIM domain
MPFKPADNPKCPKCGKSVYAAEEKVAGGYKYHKSCFKCGMCNKMLDSTNVTEHEAELYCKNCHGRKYGPKGYGFGGGAGCLSMDDGAQFKGTQ

SEQ ID NO: 22720 - protein, 201 aa, Diabrotica virgifera
  misc_feature: Coding regions on vcDNA: vcDNA=SeqID_2417; Strand=+; Position=335-937
  misc_feature: Homolog annotation: Hit_ID=XP_311323.1; Match level="QueryCoverage =86%, HitCoverage=49%, E-value=4e-54, Identity=55%"; Hit description =ENSANGP00000017492 [Anopheles gambiae]
  misc_feature: Gene Ontology Annotation: Molecular function=molecular_function unknown; Cellular component=cellular_component unknown; Biological process=biological_process unknown
  misc_feature (191)..(191): Xaa can be any naturally occurring amino acid
MEMETEQVESELINGGKNGCWTKFSEKRLAQVEKTILNVLKTAYRTWFVPIGSQLGKEDKIWTIALNEQSKKTPLVMLHGFAAGLCFWILNFDELSKDRPVYAIDLLGFGRSSRPKFSGDPEEAEKQMVDSLEAWRKQMKLENMILLGHSFGGYLATSYAINYPDRVKHLILADPWGFTERPAKVEAPFWXKLIIFAAYPF

SEQ ID NO: 22721 - protein, 161 aa, Diabrotica virgifera
  misc_feature: Coding regions on vcDNA: vcDNA=SeqID_2418; Strand=+; Position=61-546
  misc_feature: Homolog annotation: Hit_ID=XP_313702.1; Match level="QueryCoverage =97%, HitCoverage=48%, E-value=3e-12, Identity=26%"; Hit description =ENSANGP00000016941 [Anopheles gambiae]
  misc_feature: Pfam annotation: Pfam_ID=WD40; Match level="Score=31.5, E-value=2.6e -06, Copies=3"; Pfam description=WD domain, G-beta repeat
ASAEKMPLRIDSRADDVDKHEHDINCLLFNEGKLYSGADDGTIKCWLPDLTKKSEIKANSCSVYSLAGDNNCIYSCSNEGSVDSYALDTLEKKSVLLHNSEVEYWRVRSVNGVLYSGDNEGFVKVWKNGTLYGSINICEPVKDMVIFKNLLITANHGDCCN

SEQ ID NO: 22722 - protein, 50 aa, Diabrotica virgifera
  misc_feature: Coding regions on vcDNA: vcDNA=SeqID_2419; Strand=-; Position=214-366
QLFSFVHHLESFLDSYFIILRYLCVKCLRFILALIVSVHASTLYNNTEKI

SEQ ID NO: 22723 - protein, 273 aa, Diabrotica virgifera
  misc_feature: Coding regions on vcDNA: vcDNA=SeqID_2420; Strand=+; Position=126-946
  misc_feature: Homolog annotation: Hit_ID=AAQ97863.1; Match level="QueryCoverage =97%, HitCoverage=50%, E-value=1e-128, Identity=83%"; Hit description= tyrosyl-tRNA synthetase [Danio rerio] ref|NP_958473.1| tyrosyl-tRNA synthetase [Danio rerio]
  misc_feature: Gene Ontology Annotation: Molecular function=interleukin-8 receptor binding; Cellular component=soluble fraction; Biological process =apoptosis
  misc_feature: Pfam annotation: Pfam_ID=tRNA-synt_1b; Match level="Score=142.2, E -value=1.2e-39, Copies=1"; Pfam description=tRNA synthetases class I (W and Y)
  misc_feature (260)..(260): Xaa can be any naturally occurring amino acid
MVENSTLTIDEKFHLISRNLQEILGEDRIKAVLKERDLKLYWGTATTGKPHIAYFVPMSKVADFLRAGVEVTILFADLHAYLDNMKAPWELLALRVQYYEHCIKAMLQSIGVPLDKLKFVKGTDYELSKEYTLDVYKMTSVVTEHDAKKAGAEVVKQVENPLLSGLLYPSLQALDEEYLKVDAQFGGIDQRKIFTFAEKYLPQLGYKKRAHLMNPMVPGLTGTKMSSSEEDSKIDLLDSPANVKKKLKKAFCEPGNIENXGLLSFAKHVYFLY

SEQ ID NO: 22724 - protein, 359 aa, Diabrotica virgifera
  misc_feature: Coding regions on vcDNA: vcDNA=SeqID_2421; Strand=+; Position=1-1080
  misc_feature: Homolog annotation: Hit_ID=XP_309276.1; Match level="QueryCoverage =98%, HitCoverage=39%, E-value=8e-87, Identity=44%"; Hit description =ENSANGP00000011407 [Anopheles gambiae]
  misc_feature: Gene Ontology Annotation: Molecular function=kainate selective glutamate receptor activity; Cellular component=integral to plasma membrane; Biological process=synaptic transmission
  misc_feature: Pfam annotation: Pfam_ID=Lig_chan; Match level="Score=189.3, E-value =8.1e-54, Copies=1"; Pfam description=Ligand-gated ion channel
  misc_feature (5)..(5): Xaa can be any naturally occurring amino acid
  misc_feature (8)..(8): Xaa can be any naturally occurring amino acid
  misc_feature (11)..(11): Xaa can be any naturally occurring amino acid
  misc_feature (186)..(186): Xaa can be any naturally occurring amino acid
  misc_feature (300)..(300): Xaa can be any naturally occurring amino acid
  misc_feature (319)..(319): Xaa can be any naturally occurring amino acid
LKAGXARXEGXSRDLISSIAKIVGFEFEIYVVEDNHYGFYHEETDTWNGLIGDVINQKAHLGIADLTITQERQEVVDFSLPFMTLGISVLYRIPDYGETRTFAVLNPFSRSVWMSIVYAYIFISLGLYIILRLSPEDWEVSHPCDELDDTMKNYWNLKNCLTVAFKGLTSQSNDILPKGQSARLAXLWWMFSLLISSMYIANLALMVNQANMEPSIESVEDLATQTKVKYGCLHGGATQNFLKTANSTIYQRMDATLEQSPSLLVNTNEEGMERVLESENGLYAFLMESTQIEYQIQRHXELRQVGGWLDNRAFGIAMXPTDANYRGAINRAILKLQEDGSLNDLKLKWWVEKNENGGR

SEQ ID NO: 22725 - protein, 241 aa, Diabrotica virgifera
  misc_feature: Coding regions on vcDNA: vcDNA=SeqID_2422; Strand=+; Position=79-804
  misc_feature: Homolog annotation: Hit_ID=XP_315212.1; Match level="QueryCoverage =100%, HitCoverage=47%, E-value=1e-123, Identity=90%"; Hit description=ENSANGP00000020889 [Anopheles gambiae]
  misc_feature: Gene Ontology Annotation: Molecular function=signal sequence binding; Cellular component=signal recognition particle; Biological process =signal transduction
  misc_feature: Pfam annotation: Pfam_ID=SRP54; Match level="Score=171.9, E-value =1.3e-48, Copies=1"; Pfam description=SRP54-type protein, GTPase domain
  misc_feature (224)..(224): Xaa can be any naturally occurring amino acid
IKMVLADLGRKITTALQSLSKATIINEEVLNGMLNDICRALIEADVNIKLVKSLRENVKSVIDFDEMAGGLNKRRMIQSAVFKELVKLVDPGVKPYQPVKGKPNVIMFVGLQGSGKTTTCTKLAYHYQKKNWKSCLVCADTFRAGAYDQVKQNCTKARIPFYGSYTEVDPVVIAQDGVDMFKKEGFEIIIVDTSGRHKQEESLFEEMLAVSNAVRPDNIIFVMXATIGQACEAQAKAFKEK

SEQ ID NO: 22726 - protein, 93 aa, Diabrotica virgifera
  misc_feature: Coding regions on vcDNA: vcDNA=SeqID_2423; Strand=+; Position=86-367
HKMINPMVWSPKCFHKGTKLNSKTSHKFFQSLFFIIRYQKNNLQKNLKWNIKAEVCPLHNIQGKGYFESVLINVAHVPQVVFLKKKSVNSLLI

SEQ ID NO: 22727 - protein, 204 aa, Diabrotica virgifera
  misc_feature: Coding regions on vcDNA: vcDNA=SeqID_2424; Strand=+; Position=115-729
MKFIIGTVVFIAIFQKAFSLRCWRCSSDIDSSCRDPFNDYNSRSGSNSYVSQQSYQQRPYENQRQYDYNNRQYDNNNYNRQYDPNYNRQYDQNYNNGGYNGGYRNDLNSRPNYETCDDNEARNRRMKNVCLKEIVRGSNYVSVVRRCELVPYEQTVGTCSQSVSRGLTLDFCEYCDWDGCNSATGHKTNLLVGMISLIAVFLYH

SEQ ID NO: 22728 - protein, 51 aa, Diabrotica virgifera
  misc_feature: Coding regions on vcDNA: vcDNA=SeqID_2425; Strand=+; Position=13-168
  misc_feature: Homolog annotation: Hit_ID=AAV34853.1; Match level="QueryCoverage =100%, HitCoverage=100%, E-value=3e-23, Identity=100%"; Hit description=ribosomal protein L39 [Bombyx mori] gb|AAK92174.1| ribosomal protein L39 [Spodoptera frugiperda] dbj|BA
  misc_feature: Pfam annotation: Pfam_ID=Ribosomal_L39; Match level="Score=100.3, E -value=4.8e-27, Copies=1"; Pfam description=Ribosomal L39 protein
MSAHKTFIIKRKLAKKLKQNRPIPQWVRMRTGNTIRYNAKRRHWRRTKLKL

SEQ ID NO: 22729 - protein, 938 aa, Diabrotica virgifera
  misc_feature: Coding regions on vcDNA: vcDNA=SeqID_2426; Strand=+; Position=41-2857
  misc_feature: Homolog annotation: Hit_ID=XP_312083.1; Match level="QueryCoverage =99%, HitCoverage=92%, E-value=0.0, Identity=68%"; Hit description =ENSANGP00000016878 [Anopheles gambiae]
  misc_feature: Gene Ontology Annotation: Molecular function=formate-tetrahydrofolate ligase activity; Cellular component=cytoplasm; Biological process =coenzymes and prosthetic group metabolism
  misc_feature: Pfam annotation: Pfam_ID=FTHFS; Match level="Score=1257.3, E-value=0, Copies=1"; Pfam description=Formate--tetrahydrofolate ligase
MASPTGQGKILSGTQISKEINEQLKNVVNEIKTRLPNFQPGLAIVQVGDREDSNVYIRMKIQSASNIGIKAQHIKLPRSITELEVLNKIEELNNDPNIHGIIVQMPLESDNKINSNLVTDTVSPDKDVDGLNTINEGRTAIGELTSFLPCTPNGVIELIKRSGLPIAGANAVVLGRSKILGTPSAELLKWNHATVTVCHSKTRDLPAVCRQADILVVGIGQPELVKGSWVKPGAVVIDCGINAIPDPTKKSGQRLVGDVDYAEASKVASYITPVPGGVGPMTVAMLMKNTVQSAQKAAEKLLNRSWNLTPLPLKLQAPVPSDIRIARAQVPKNITHLAEEIGVFPNELSQYGPKKAKVSISVLERLKDQKNGKYVVVAGMTPTPLGEGKSTTLLGLVQALSTHLKKNTFATMRQPSQGPTFGIKGGAAGGGYSQVIPMEDVNLHLTGDIHAITAANNLLAAQLDARIFHEATQKDAALYDRLVPKIKGARTFSKIQLRRLKRLGINKTDPESLTPEERTKFARLNIDTNNIVWNRVLDINDRFLREITIGESPTEKGMTRKEGFQISVASEIMAILALARDMADFKERLANMVVAFDKNGKPVTADDLGATGALLVLLKDTIEPTLLQSLEGSPVFMHAGPFANIAHGSNSIIADKVALKLVGEDGIVVTEAGFSSDVGMEKFFNIKCRASGDVPNAVVLVSTIRALKMHGGGPAVTPGAPLAPQYTEENLDLLRKGLPNILKHVSNAVKYGIPAVVAINHRETDTEAELELLRQACKNSGAFDAVVSKHWSQGGQGALDLAKAVVAATSQPSNFKFLYQLNRPIKEKIEIISREMYGAAGVSYSEIAEKKIKQYEEQGYGNLPICMAKTPLSLTADPSIKGAPSGFVIPVRDMSISVGAQFIIPFTGEITRMPGLPTRPAIYDIDLNIETGEIEGLF

SEQ ID NO: 22730 - protein, 587 aa, Diabrotica virgifera
  misc_feature: Coding regions on vcDNA: vcDNA=SeqID_2427; Strand=+; Position=13-1777
  misc_feature: Homolog annotation: Hit_ID=XP_312083.1; Match level="QueryCoverage =93%, HitCoverage=54%, E-value=0.0, Identity=63%"; Hit description =ENSANGP00000016878 [Anopheles gambiae]
  misc_feature: Gene Ontology Annotation: Molecular function=formate-tetrahydrofolate ligase activity; Cellular component=cytoplasm; Biological process =purine base biosynthesis
  misc_feature: Pfam annotation: Pfam_ID=THF_DHG_CYH_C; Match level="Score=246.6, E -value=4.4e-71, Copies=1"; Pfam description=Tetrahydrofolate dehydrogenase/cycloh
  misc_feature (236)..(236): Xaa can be any naturally occurring amino acid
  misc_feature (525)..(525): Xaa can be any naturally occurring amino acid
MASPTGQGKILSGTQISKEINEQLKNVVNEIKTRLPNFQPGLAIVQVGDREDSNVYIRMKIQSASNIGIKAQHIKLPRSITELEVLNKIEELNNDPNIHGIIVQMPLKSDNKINSNLVTDTESADKDVDGLNTINEGRTAIGELTSFLPCTPNGVIELIKRSGLPIAGANAVVLGRSKILGTPSAELLKWNHATVTVCHSKTKDLPAVCRQADILVVRIPTRPVYSLDQYCHETIXLNIQLFYCKDPTKKSGQRLVGDVDYAEASKVASYITPVPGGVGPMTVAMLMKNTVQSAQKAAEKLLNRSWNLTPLPLKLQAPVPSDIRIARAQVPKNITHLAEEIGVFPNELSQYGPKKAKVSISVLERLKDQKNGKYVVVAGMTPTPLGEGKSTTLLGLVQALSTHLKKNTFATMRQPSQGPTFGIKGGAAGGGYSQVIPMEDVNLHLTGDIHAITAANNLLAAQLDARIFHEATQKDAALYDRLVPKIKGARTFSKIQLRRLKRLGINKTDPQSLTPEKKTKFARVXFDPNNLFGKKFLEITPKIPPRKHPLGEFPTQKRIEPKRKGSQTPLQRKFMAFLFLPKKRAWL

SEQ ID NO: 22731 - protein, 563 aa, Diabrotica virgifera
  misc_feature: Coding regions on vcDNA: vcDNA=SeqID_2428; Strand=+; Position=32-1723
  misc_feature: Homolog annotation: Hit_ID=XP_314876.1; Match level="QueryCoverage =62%, HitCoverage=51%, E-value=2e-29, Identity=33%"; Hit description =ENSANGP00000012968 [Anopheles gambiae]
  misc_feature: Gene Ontology Annotation: Molecular function=structural molecule activity; Cellular component=intermediate filament; Biological process=epidermal differentiation
MKAFLVFVACLGLAVASTADAKNKKVEVEEKKISKRHHDHYSTLNTYGGDLASQSLSSYGGDLSSHSSGLSGYGSGLSGYSSGVSGYDSGLSGYSSEGGYSSGSSSEYSSGSQGYGSDFSGYSSGSHGYGGDLSGYSSGSHGYGGDLSSYSSGSYGYGGDASGYSSGLNGGLLGDSGSVSYGYHSVAPVVHNVHSTHEVRRITQKVPVPVPQPYPVTVTKTVQVPQPVPVEVPKPYPVPVKVPVPYEVPKPYEVKVPQPVAVPVKVHVPVEVPKPYPVHITKTIPVPVEKKIYIKQLVQVPHPVPQPYPVTVTKYEQVKVPTPVYVKERKVVHTYSNSYQNLPEKHIVLKPQVSAQVPQYSNAGYDASSYSSSLGSYGSGYGSNYGSSYGSGYGYGGHGSSSYNLGSYGDSYNSGVSGLGYNNLGGSSSSGLGYGSYGGSSSSGLGYGSLGGSSSSGLGYGSYGGSSSSGLGYGSLGGSSGSYSSWGSSSLSGLGGSSGHLGGHGSSGHGLYGHGSHSYGLGDSSSQYSHSYGHSQAFGHGDDYSGLLKSYVPSKLGGYNNKW

SEQ ID NO: 22732 - protein, 295 aa, Diabrotica virgifera
  misc_feature: Coding regions on vcDNA: vcDNA=SeqID_2429; Strand=+; Position=121-1005
  misc_feature: Pfam annotation: Pfam_ID=LRR_1; Match level="Score=35.7, E-value=1.4e- 07, Copies=5"; Pfam description=Leucine Rich Repeat
MLFRSAIKLLIVLCLVVKNVTTFNPNDDYYDPPKYNAEVFLPVPQYIGEDQSGCICREVPNVFTLCFGITKCNALPITLNISTPVLSIIGTHVSEIHAGDLSNLCFLKDFKLEGNFNLTYIAPGIFGESFDRLENLSISYNRNLKTLQPDTFIGLINLKQVFLIKNGFTNLYDITVNLSPNILPSLRKLSLNENTFTTIFENSFSQMENSSLEELDLILCNLQYVHPNFLLPLKHLQALRIGENFLNESVISDSLVPVIKHKLPLKLLNLYSTGFRVHLPKQLLEIIASSNITNL

SEQ ID NO: 22733 - protein, 225 aa, Diabrotica virgifera
  misc_feature: Coding regions on vcDNA: vcDNA=SeqID_2430; Strand=+; Position=185-859
  misc_feature: Homolog annotation: Hit_ID=EAL34191.1; Match level="QueryCoverage =96%, HitCoverage=46%, E-value=1e-20, Identity=30%"; Hit description =GA19176-PA [Drosophila pseudoobscura]
  misc_feature: Pfam annotation: Pfam_ID=Ank; Match level="Score=30.0, E-value=7.1e -06, Copies=2"; Pfam description=Ankyrin repeat
MSKQQNFPDTSASSASEDKKAIYYESSKTDSGFISGEISEEILDSGLIEDVDKPLNTTASFTEEEEKKVEPMLLDSGVCLTESFSKISIKEIESGVNDLNNPTKKPTAPVDSFTKKQVKPAEAIPWKIYYEQDEEGDTHLHMAIAQGFLEVAVALIRAVPHPKLLDTANDDNQTPLHLAVESGQWRIVRSLIVAPAIPFSRGPHGDSTLLVAARKNDSRSVRAII

SEQ ID NO: 22734 - protein, 94 aa, Diabrotica virgifera
  misc_feature: Coding regions on vcDNA: vcDNA=SeqID_2431; Strand=-; Position=354-638
CIFLQYVKIKSQIFLMSSGTLPTLDLVYEGKNQLHNTSDFGKAPSIFMKIGEWVDDTSRNKSDNKYSCLNHGKNDAFYNTYFVNQYHKLSEHVF

SEQ ID NO: 22735 - protein, 72 aa, Diabrotica virgifera
  misc_feature: Coding regions on vcDNA: vcDNA=SeqID_2432; Strand=-; Position=560-778
LRSWCSNGVETSRYITIVSPENEKGNAQRGRTYSSLILFLVVGTSRYIMVGEQSMLNVQSLERFGELLGCDY

SEQ ID NO: 22736 - protein, 82 aa, Diabrotica virgifera
  misc_feature: Coding regions on vcDNA: vcDNA=SeqID_2433; Strand=-; Position=1304 -1552
SFILHLNFSKTFIVVLGFEKMKTMSEVIFSKSIFVIQRTESNRVLSEYCQSDSDDKMPMVGEQNMLNLQSLERYGDLLGCDY

SEQ ID NO: 22737 - protein, 84 aa, Diabrotica virgifera
  misc_feature: Coding regions on vcDNA: vcDNA=SeqID_2434; Strand=+; Position=404-658
YVLSIFGRNPLLVSSTGLYPILSSSIQFQSYLMVGELKRGFLQLLKRVRSSYGEKPSTLQMYLYQILALNTGEFVKGGPKKIYP

SEQ ID NO: 22738 - protein, 123 aa, Diabrotica virgifera
  misc_feature: Coding regions on vcDNA: vcDNA=SeqID_2435; Strand=+; Position=1273 -1641
  misc_feature (75)..(75): Xaa can be any naturally occurring amino acid
  misc_feature (93)..(94): Xaa can be any naturally occurring amino acid
  misc_feature (97)..(97): Xaa can be any naturally occurring amino acid
LFFVLNILMTYSLRFESRSIFSHLFNGRNIFLLKYVCFVRGGGGVLKIIISSYFFLIFFKSVGSIYFIFTINTIXRCLIFSMFFLCIFFNIPXXYTXICFSLFKYKINFILSYFKKIFTKICL

SEQ ID NO: 22739 - protein, 281 aa, Diabrotica virgifera
  misc_feature: Coding regions on vcDNA: vcDNA=SeqID_2436; Strand=+; Position=103-948
  misc_feature: Homolog annotation: Hit_ID=EAA08646.2; Match level="QueryCoverage =91%, HitCoverage=85%, E-value=1e-37, Identity=41%"; Hit description =ENSANGP00000020364 [Anopheles gambiae str. PEST] ref|XP_562636.1| ENSANGP00000020364 [Anopheles gambiae st
  misc_feature: Pfam annotation: Pfam_ID=DUF1676; Match level="Score=71.4, E-value =2.4e-18, Copies=1"; Pfam description=Protein of unknown function (DUF1676)
MNCKVICVVLSGLFLFEAALASPVVDDSTNNHINSVHPEKSTIEESLFKKLNVKCSNQDISSCMMLKLVNYFNRLLKKSYIELGDIEITQTSTETVNVESSRGLNEVEKMGEEEQLYEVLMNKAFNFIKTRSLKWKVLDGADLVLAGGSDKDGSLNLGLSLKPNTAGIEEGRKKKNKDGGMNALMAAAVMKIGLLKALAFKALVLLVGKALLVSKLALVLASIIGLKKLLSGGEKHVTYEVVAQPHHEHHVEHSHFRGRIRRPWWRRRNGEGTSMPKLLRT

SEQ ID NO: 22740 - protein, 117 aa, Diabrotica virgifera
  misc_feature: Coding regions on vcDNA: vcDNA=SeqID_2437; Strand=+; Position=548-901
LSVVSVMVFLFCVPIRDEYGDHNGNIYLICRRAEKLHRCYVEPDSKVLHLGCSSSSWTSLSKYFPCRTACRRAHLDIINKEEQRVHLADSHQIRKVAGCKFLERVGKKTNEDEVRNI

SEQ ID NO: 22741 - protein, 349 aa, Diabrotica virgifera
  misc_feature: Coding regions on vcDNA: vcDNA=SeqID_2438; Strand=+; Position=92-1138
  misc_feature: Homolog annotation: Hit_ID=BAB62890.1; Match level="QueryCoverage =92%, HitCoverage=60%, E-value=2e-35, Identity=31%"; Hit description =aspartic proteinase 1 [Glycine max]
  misc_feature: Gene Ontology Annotation: Molecular function=aspartic-type endopeptidase activity; Cellular component=extracellular space; Biological process=induction of non-apoptotic programmed cell death
  misc_feature: Pfam annotation: Pfam_ID=Asp; Match level="Score=-37.1, E-value=9.5e -11, Copies=1"; Pfam description=Eukaryotic aspartyl protease
  misc_feature (343)..(343): Xaa can be any naturally occurring amino acid
SIQEVLEVLNCNYLICKLRITCSFFKMNHLKLLLILSTIIVFKLSMVYASKNDGTMSIELRRKKSPRQELLENEPTLRKYGYRLEFLKNRRIKEPRTNDSIALYRYLDNEFYGTIVIGHPGKTFDVSFDTAWGLSWLLSSRCDTSLTPGCRGHNLYDRYKSSTFKKNGTQYFIQDGAFNFTGVYSYDDIHIAHSNVTSFLFVEMSIVPDSMQFDKADGVLGLGPKSGDYEPFFYTLYREKKIKNPIFSIYLNRDRNSNRGGNVMLGFFDPKHVHKTSYPNGSIIQDTIVYLNADTAEYWQFNVEKMIYTKDPKHVSTFCQSGCKAIADTSTNEINGPSKEVNXIHEIIN

SEQ ID NO: 22742 - protein, 286 aa, Diabrotica virgifera
  misc_feature: Coding regions on vcDNA: vcDNA=SeqID_2439; Strand=+; Position=26-886
  misc_feature: Homolog annotation: Hit_ID=AAL48178.1; Match level="QueryCoverage =81%, HitCoverage=58%, E-value=1e-35, Identity=36%"; Hit description =RH60875p [Drosophila melanogaster]
  misc_feature: Gene Ontology Annotation: Molecular function=serine-type endopeptidase activity; Cellular component=extracellular; Biological process=Tl signaling pathway
  misc_feature: Pfam annotation: Pfam_ID=Trypsin; Match level="Score=128.6, E-value =1.5e-35, Copies=1"; Pfam description=Trypsin
MNQRNFSIILTLFLCACVGHTLQSEFARNPLIPDVECGRSVEGPSSSLVGNKEFPWAVRISFSKRPDLFACDGVLINQRYILTAGLCVEDKTLTRQGNIDKIRLGDHNCLPGEENCDSKDYVDVEIENVILHPAYGSQNQVNHDDIGLIRLKEDVKFTDNISPVCLPKPNEAAKPGEKVFEVGWSRRSIDKLKAEITISDQQKCFENYSKNFNFNLTASHLCAGGYPDGKCASSSGGGLVRLRQPEEKWLLEGITSFGPSVCSTDVPSIFTKVEPYSYWIHENVKN

SEQ ID NO: 22743 - protein, 368 aa, Diabrotica virgifera
  misc_feature: Coding regions on vcDNA: vcDNA=SeqID_2440; Strand=+; Position=60-1166
  misc_feature: Homolog annotation: Hit_ID=NP_572298.1; Match level="QueryCoverage =67%, HitCoverage=47%, E-value=5e-25, Identity=33%"; Hit description =CG3599-PA [Drosophila melanogaster] gb|AAF46130.1| CG3599-PA [Drosophila melanogaster]
  misc_feature: Gene Ontology Annotation: Molecular function=hydrolase activity; Cellular component=extrinsic to membrane; Biological process =biological_process unknown
  misc_feature: Pfam annotation: Pfam_ID=CN_hydrolase; Match level="Score=31.1, E -value=3.2e-07, Copies=1"; Pfam description=Carbon-nitrogen hydrolase
MASANLYLCTFIVISISQICVGDYRAAVVEYQPAESANPNTTMETNTNQYRSFVEQAKKEGAVIIVFPDYGITGYNPNVTAYALEIPDVGTKPNSTNGLILEKLADLSRSFDMYVVLNLLEKKTNNNNKTLYYSTNLAFNPNGEIVAKSRKTHLFNEANLTPGKPSENNNTFETTFGVTFQLFSTYDLISEKPNTNVKDIVYPSSWISTLPFYHSLSMQHGYAVANKVNLLAANLNNPSVALGGSGIFGSNGTAYQSYISGTTASKILIATVVDTVINASATRHFTNKFFKGGLGSFDFDDDKPEILKYQSNRLFENKKYTIKTLDFSQHNIKEKICHKIFFWGKFKFKRDKQNSHPRGVLSKLVCAE

SEQ ID NO: 22744 - protein, 293 aa, Diabrotica virgifera
  misc_feature: Coding regions on vcDNA: vcDNA=SeqID_2441; Strand=+; Position=63-941
  misc_feature: Homolog annotation: Hit_ID=BAA75470.1; Match level="QueryCoverage =98%, HitCoverage=41%, E-value=1e-109, Identity=65%"; Hit description= prophenoloxidase [Tenebrio molitor]
  misc_feature: Gene Ontology Annotation: Cellular component=larval serum protein complex
  misc_feature: Pfam annotation: Pfam_ID=Hemocyanin_M; Match level="Score=-25.5, E -value=5.5e-07, Copies=1"; Pfam description=Hemocyanin, copper containing domain
  misc_feature (224)..(224): Xaa can be any naturally occurring amino acid
  misc_feature (264)..(264): Xaa can be any naturally occurring amino acid
  misc_feature (266)..(266): Xaa can be any naturally occurring amino acid
  misc_feature (285)..(285): Xaa can be any naturally occurring amino acid
MSKKQNLLLLFDRPTEPMILPKGSEGVNFKVPNQYLKDEYQDLGPQLVTTFANRVGGDDNDVTVKDISLPSLGEITDLGRDENFSLFIPKHRRLAGKLINIFMGMKDPDDLMAVAIYARERVNPVLFNYAFSVALMHRHDTRDLELPSVLFSFPDRYMDSKVFSRMREVANVVPEPQRTPVLIPRDYTASDLEDEHRLAYFREDIGINLHHWHWHLVYPFEGPXEVVNKNRRGELFYYMHQQIVARYNFERLSNGMKRVERFTXFXDPMPEGYFPKLDSLVANRXYPCQSPQH

SEQ ID NO: 22745 - protein, 101 aa, Diabrotica virgifera
  misc_feature: Coding regions on vcDNA: vcDNA=SeqID_2442; Strand=-; Position=647-952
  misc_feature (29)..(29): Xaa can be any naturally occurring amino acid
KYGNKKTYYRRRHQHFLLDVLTVNNRFSXYLENLAEIIMLNKTVERRRGRPNLRYYDDTEKDLKKYCIGDGEDTLLTGKYYLRQTNANKRLHCHLMMMKRK

SEQ ID NO: 22746 - protein, 138 aa, Diabrotica virgifera
  misc_feature: Coding regions on vcDNA: vcDNA=SeqID_2443; Strand=+; Position=24-437
  misc_feature: Homolog annotation: Hit_ID=XP_315346.1; Match level="QueryCoverage =67%, HitCoverage=60%, E-value=4e-09, Identity=35%"; Hit description =ENSANGP00000020938 [Anopheles gambiae]
  misc_feature: Pfam annotation: Pfam_ID=Lectin_C; Match level="Score=0.3, E-value =0.00048, Copies=1"; Pfam description=Lectin C-type domain
MTTKVSVILFLCLIIWKENAVEANKNLPGNLITYGDSQYYIDDKFNHCWWEAWRHCKSLNMDLVSIETQAENNFLYQKLKERYGNGPEYSFWTAGAKEGNGWVWKNTNGFVNYFNWAPGQPDNAGLTRIEMRYNWAAG

SEQ ID NO: 22747 - protein, 171 aa, Diabrotica virgifera
  misc_feature: Coding regions on vcDNA: vcDNA=SeqID_2444; Strand=+; Position=1-517
  misc_feature: Homolog annotation: Hit_ID=AAG42838.1; Match level="QueryCoverage =98%, HitCoverage=30%, E-value=4e-60, Identity=67%"; Hit description =inducible heat shock 70 kDa protein [Leptinotarsa decemlineata]
  misc_feature: Gene Ontology Annotation: Molecular function=heat shock protein activity; Cellular component=vacuolar membrane (sensu Fungi); Biological process=reproduction
  misc_feature (72)..(72): Xaa can be any naturally occurring amino acid
AKGILNVSAKDTSSGKSRNITIKNDKGRSTQQEIDRTLSEAEKYKEEDERQKEKITTRNQLEGYIFQLKQAXQESGDKLSAEDKAAVERECDSCLKWLDRNTLADKEEYEDKQKGGSMGCSPIMSKLHQSGGQGNTPYGGGMPGGCTGQTAGDGYGGKQGDGSGPTIEEVD

SEQ ID NO: 22748 - protein, 300 aa, Diabrotica virgifera
  misc_feature: Coding regions on vcDNA: vcDNA=SeqID_2445; Strand=+; Position=57-956
  misc_feature: Homolog annotation: Hit_ID=EAL31429.1; Match level="QueryCoverage =87%, HitCoverage=59%, E-value=7e-19, Identity=31%"; Hit description =GA13845-PA [Drosophila pseudoobscura]
  misc_feature: Gene Ontology Annotation: Molecular function=molecular_function unknown
  misc_feature: Pfam annotation: Pfam_ID=DUF227; Match level="Score=52.7, E-value =1.1e-12, Copies=1"; Pfam description=Domain of unknown function (DUF227)
  misc_feature (286)..(286): Xaa can be any naturally occurring amino acid
MANTLPQHIQVILQKIFNDSIENLTIDEQEGNKKGDGYLGDLVFLTVAYKKDNVPHNLVIKQCVAGVYPEEFVTATYLNEINFYTKRWPAMTEFQKKHLGEEDPNFVKHIAKCYYTDITKGAEKIVLDNLKFKGFELHPKSIPLNFRQYASIFKLYAKYHAISFAMKQLEPEKFEEFTKDVPNNWERFFITNPGPVGMTTAKIKMTFNPTTDQKLAEAFGPYHDNGNDILIAGMQYDGPYKVYLHADCWSNNIMFKYNDYLEIDDLRIIDFQMCFVGTPVYDLPYXLFSGAGKEALDRTD

SEQ ID NO: 22749 - protein, 108 aa, Diabrotica virgifera
  misc_feature: Coding regions on vcDNA: vcDNA=SeqID_2446; Strand=+; Position=132-455
  misc_feature: Homolog annotation: Hit_ID=XP_396626.1; Match level="QueryCoverage =98%, HitCoverage=61%, E-value=1e-44, Identity=82%"; Hit description =similar to CG5454-PA [Apis mellifera]
  misc_feature: Gene Ontology Annotation: Cellular component=nucleoplasm; Biological process=cell organization and biogenesis
  misc_feature: Pfam annotation: Pfam_ID=zf-U1; Match level="Score=89.5, E-value=8.5e- 24, Copies=1"; Pfam description=U1 zinc finger
MPKYYCDYCDTYLTHDSPSVRKTHCTGRKHKDNVKFFYQKWMEEQAQHLIDATTAAFKAGKIANNPFAQPGKGVAIPPPAQLTMGQRPPGAPGGPGMMPPAGMGPGPG

SEQ ID NO: 22750 - protein, 88 aa, Diabrotica virgifera
  misc_feature: Coding regions on vcDNA: vcDNA=SeqID_2447; Strand=+; Position=3-269
HASATPSNHLIRCRFLLLIPKCVPVVSFLTSVLSGIRIMCPAHLSHCFNERYDIWFIKELVHHESRVYPICKVYSSFNFFACFVKGSP

SEQ ID NO: 22751 - protein, 339 aa, Diabrotica virgifera
  misc_feature: Coding regions on vcDNA: vcDNA=SeqID_2448; Strand=+; Position=75-1091
  misc_feature: Homolog annotation: Hit_ID=AAO15491.1; Match level="QueryCoverage =89%, HitCoverage=90%, E-value=1e-143, Identity=86%"; Hit description= eIF2 alpha subunit [Spodoptera frugiperda]
  misc_feature: Gene Ontology Annotation: Molecular function=translation initiation factor activity; Cellular component=ribosome; Biological process =translational initiation
  misc_feature: Pfam annotation: Pfam_ID=EIF_2_alpha; Match level="Score=224.8, E -value=1.6e-64, Copies=1"; Pfam description=Eukaryotic translation initiation fac
  misc_feature (246)..(246): Xaa can be any naturally occurring amino acid
  misc_feature (264)..(264): Xaa can be any naturally occurring amino acid
MPLSCRFYKEKYPEVEDVVMVNVRAIAEMGAYVHLLEYNNIEGMILLSELSRRRIRSINKLIRVGKTEPVVVIRVDKEKGYIDLSKRRVSAEDVEKCTERFAKAKAVNSILRHVAELLKYESDEQLEELYQKTAWYFEEKYKKNKASAYDFFKQAVLDPSILAECELDDKTKEVLLSNIKRKLTSQAVKIRADIECACYGYEGIDAVKTALKAGLALSTEELPIKINLIAPPLYVMTTSTPEKQDXVLKVLGDAIEKVKATITXCGGVFNIQMAPKVVTATDELELVKHMERAELKNQQVAGDEDHQKIRVPSTANMTPTITKILVKRKMRNNIFLCDS

SEQ ID NO: 22752 - protein, 129 aa, Diabrotica virgifera
  misc_feature: Coding regions on vcDNA: vcDNA=SeqID_2449; Strand=+; Position=131-517
LYFISSSKLGTKISHNDENFLSWNFLYDLLIFCLLNYFLFLFICSGSIYLDIGIKLVKYLAALDDTITPTPYSCALITFSRLRITISRDHFVIFHFLSPESGHLISAILMISTCILFISCIALGIFPAL

SEQ ID NO: 22753 - protein, 281 aa, Diabrotica virgifera
  misc_feature: Coding regions on vcDNA: vcDNA=SeqID_2450; Strand=+; Position=171-1011
  misc_feature: Homolog annotation: Hit_ID=XP_394767.1; Match level="QueryCoverage =85%, HitCoverage=65%, E-value=2e-75, Identity=52%"; Hit description =similar to ENSANGP00000017678 [Apis mellifera]
  misc_feature: Gene Ontology Annotation: Molecular function=molecular_function unknown; Cellular component=cellular_component unknown; Biological process=embryogenesis and morphogenesis
  misc_feature: Pfam annotation: Pfam_ID=zf-C2H2; Match level="Score=28.0, E-value =2.8e-05, Copies=3"; Pfam description=Zinc finger, C2H2 type
  misc_feature (198)..(198): Xaa can be any naturally occurring amino acid
  misc_feature (233)..(233): Xaa can be any naturally occurring amino acid
MSAVNPSKDSFTCISCRVAFKDAELQRKHYTTDWHRYNLKRKVAELPPVTAEEFQIRVLNQRKADEIATQDKSVYCSVCRKSFGNQNAYDNHLNSKKHKDNEESRKIESTDENIEIIPTNKPTIDVEDEDMETEEVDSDEWDDVSENPIDNNDCLFCSHHSGNFYKNLDHMTIVHSFFIPDIEYCSDLQGLLRYLGEXISEGFMCLWCNEKGKTFHTAEAAKQHMVDRGHCKXMIHEGGSSLLNMQIFYDIFQHPILDENEKNIGCWRKKVTRSHNLQWLK

SEQ ID NO: 22754 - protein, 502 aa, Diabrotica virgifera
  misc_feature: Coding regions on vcDNA: vcDNA=SeqID_2451; Strand=+; Position=3-1513
  misc_feature: Homolog annotation: Hit_ID=EAL29533.1; Match level="QueryCoverage =100%, HitCoverage=60%, E-value=1e-154, Identity=52%"; Hit description=GA17751-PA [Drosophila pseudoobscura]
  misc_feature: Gene Ontology Annotation: Cellular component=exocyst; Biological process=synaptic vesicle docking
  misc_feature (21)..(21): Xaa can be any naturally occurring amino acid
  misc_feature (36)..(36): Xaa can be any naturally occurring amino acid
  misc_feature (55)..(55): Xaa can be any naturally occurring amino acid
  misc_feature (73)..(73): Xaa can be any naturally occurring amino acid
QRKQFNKLKDKFSRNISQTIXNTPFIHFGNHKGEAXKSADSLVLPQHSGVHKELXPYTELIHRIKVMDKQMYXSLKEIYTSSLGKLYDRDLKNLFSVGREKIAVYGNVVSPTTIIGVDRDQWTLETSTKDRERYDLVLEQVLTQLEPVFMQEQQFCFKFFQLDVISSPKALDYSIESDAVTARKIEKQIDEDIKNMMSSLFACLKPELDMLIDYIKKQDNFYCMYVLVRLNQHVMSAQSSFLSNTFGSLLIEVKRSLDQFMQQQIESIKECRMSKKSKCGILPYVLNLEIFAKNANCLLKSDRAADLEKWYTRLVDTMLEYIAVHAIDHKTPPQVIKMENYHHLYSLLSQLKISVLDSQRKEAKQKYNDALTAYVTLYFGRPLEKLNTFFDGVQARVASGIKASEVSYQLAFSKQELRKVINQYPGSQVKKGLESLYKKVEKHLSEEENLLQVVWRAMQEEFIRQYKTLEDIIHQCYPGSMISLEFTIEDILMFFSDIAQSH

SEQ ID NO: 22755 - protein, 286 aa, Diabrotica virgifera
  misc_feature: Coding regions on vcDNA: vcDNA=SeqID_2452; Strand=+; Position=56-913
  misc_feature: Homolog annotation: Hit_ID=XP_307906.1; Match level="QueryCoverage =95%, HitCoverage=17%, E-value=3e-25, Identity=38%"; Hit description =ENSANGP00000021735 [Anopheles gambiae]
MRKGVSASDTSSSSSNLKPDRKSGVEFEAYSSSGESHYHSFEIDSSKSRPCSSDVEGLVAAGSSEYESALTSQDYSARSHITSTEYQTAVSSMSSKESMKSLDSESSGNLASVEASEHSETLVPSTSDLDDILDSVDQQLLDDIEQSPAWTTHPPTMRQSTEVSDSEILSYTGVGESVDISEEEEIKAPDTQSKMKRSHEMTFQPEPRVLVPDSPQGEGEERLGTSIDEGSLLSVSVSSTSSTGAQRTVIELSRADSRGSLTVSGTSEHLSLDDVENFYEGSRESL

SEQ ID NO: 22756 - protein, 454 aa, Diabrotica virgifera
  misc_feature: Coding regions on vcDNA: vcDNA=SeqID_2453; Strand=+; Position=1-1366
  misc_feature: Homolog annotation: Hit_ID=AAH44026.1; Match level="QueryCoverage =99%, HitCoverage=77%, E-value=1e-123, Identity=45%"; Hit description= LOC398445 protein [Xenopus laevis]
  misc_feature: Gene Ontology Annotation: Molecular function=translation initiation factor activity; Cellular component=cytosolic small ribosomal subunit (sensu Eukarya); Biological process=protein biosynthesis
  misc_feature (197)..(197): Xaa can be any naturally occurring amino acid
ACRTMLFDQDGKYLAYVNGQTLCVLQTENWQTLATIENVKAYQLAFSPKGTFLMSWEPFTVSNANPQGTPNLKIYKTANGELVKTFVHKKQANWEPQWSHDEKLFSRIVNTDVVFYEDLNFERIVARINSSKVSSYKISPNVGVYFVLCHTLGSPGQPSLARLFKYPSFDTTQAIANRSFFQADKVDIMWNAKGNSXLLTSTEVDKTGGSYYGKQGLYFVGLNGETSIITLSKEGPIYSVEWSPKNNEFCVIYGFMPAKATIFNIKCEPVFELGSGPKNAIHYNPQGNILLLGGFGNLRGQVELWDTANWKKISSCEAPDTTLLHWAADGEHFLTATTAPRLRISNGYKIWHYTGVLIFEHPHKEPEELYDVAWKNVPKGVFRDPVISAKKVEGIAPSQPQASAQVYRPPSARNRPTVNFNLHEDEETAHKPGKDSAPSKASLKQNKKREAKEG

SEQ ID NO: 22757 - protein, 256 aa, Diabrotica virgifera
  misc_feature: Coding regions on vcDNA: vcDNA=SeqID_2454; Strand=+; Position=204-974
  misc_feature: Homolog annotation: Hit_ID=XP_534306.1; Match level="QueryCoverage =97%, HitCoverage=39%, E-value=1e-50, Identity=39%"; Hit description =PREDICTED: similar to CDA02 protein [Canis familiaris]
  misc_feature: Gene Ontology Annotation: Molecular function=translation initiation factor activity; Cellular component=cytosolic small ribosomal subunit (sensu Eukarya); Biological process=protein biosynthesis
MAIPIAARSSSGITLYEGLPTPGNKPTCPPIQSKACRTMLFDQDGKYLAYVNGQTLCVLQTENWQTLATIENVKAYQLAFSPKGTFLMSWEPFTVSNANPQGTPNLKIYKTANGELVKTFVHKKQANWEPQWSHDEKLFSRIVNTDVVFYEDLNFERIVARINSSKVSSYKISPNVGVYFVLCHTLGSPGQPSLARLFKYPSFDTTQAIANRSFFQADKVDIMWNAKGNSALLLTSTEVDKTGGSYYGKQGYISGV

SEQ ID NO: 22758 - protein, 313 aa, Diabrotica virgifera
  misc_feature: Coding regions on vcDNA: vcDNA=SeqID_2455; Strand=+; Position=198-1134
  misc_feature: Homolog annotation: Hit_ID=XP_318627.1; Match level="QueryCoverage =93%, HitCoverage=26%, E-value=1e-123, Identity=75%"; Hit description= ENSANGP00000020973 [Anopheles gambiae]
  misc_feature: Gene Ontology Annotation: Molecular function=ATP dependent RNA helicase activity; Cellular component=nucleolus; Biological process =RNA localization
  misc_feature: Pfam annotation: Pfam_ID=DEAD; Match level="Score=102.4, E-value=1.1e- 27, Copies=1"; Pfam description=DEAD/DEAH box helicase
  misc_feature (209)..(209): Xaa can be any naturally occurring amino acid
  misc_feature (226)..(226): Xaa can be any naturally occurring amino acid
  misc_feature (237)..(237): Xaa can be any naturally occurring amino acid
  misc_feature (257)..(257): Xaa can be any naturally occurring amino acid
  misc_feature (264)..(265): Xaa can be any naturally occurring amino acid
  misc_feature (291)..(291): Xaa can be any naturally occurring amino acid
  misc_feature (299)..(299): Xaa can be any naturally occurring amino acid
MKRRSPRVRPKRVKNDEIVIDINFEELKNRIVVHTIDTVDSCTHEVACPPGHDYIPLQPARGEPVKQYPFKLDPFQKESILCVENNQSVLVSAHTSAGKTVIAEYAIATSLKNKQRVIYTTPIKALSNQKYREFFDEFKDVGLVTGDVTINPSASCLIMTTEILRNMLYRGSEIMREVGWVIFDEIHYMRDKERGVVWEETLILLPHNXYILVFLSATIPNARQFXEWVSHLHQQPXHVVYTDYRPTPLQHFIYPAXGGNGINXXVDETGTFKDDSYNVAMAVLQNSGDAXAKGDQKEXKRGGSPTRTPLLIF

SEQ ID NO: 22759 - protein, 46 aa, Diabrotica virgifera
  misc_feature: Coding regions on vcDNA: vcDNA=SeqID_2456; Strand=+; Position=444-584
IRNERCYVFLLLHYGLESWTLKQEHIHKLQSFEMLCYRRILRIAWT

SEQ ID NO: 22760 - protein, 204 aa, Diabrotica virgifera
  misc_feature: Coding regions on vcDNA: vcDNA=SeqID_2457; Strand=+; Position=1-615
  misc_feature: Homolog annotation: Hit_ID=CAE47502.1; Match level="QueryCoverage =100%, HitCoverage=61%, E-value=1e-94, Identity=79%"; Hit description= cathepsin B-like proteinase [Diabrotica virgifera virgifera]
  misc_feature: Gene Ontology Annotation: Molecular function=peroxidase activity; Cellular component=extracellular space; Biological process=protein targeting
  misc_feature: Pfam annotation: Pfam_ID=Peptidase_C1; Match level="Score=7.7, E -value=1.9e-11, Copies=1"; Pfam description=Papain family cysteine protease
  misc_feature (195)..(195): Xaa can be any naturally occurring amino acid
VELSYEGSPNPLSNELINYINSKQSTWVAGKNFDENLSIQEIKNLLRAKTERLGVAKEFLHSENIQVPDSFDARENWKECSDVISTVADQSSCGSCWAVAATSAMSDRRCIASEGRRQVPVSAENLLSCCGTCGDGCNGGYPIMAWVYWQQNGISTGGLYGSNQGCQTYSLQPCEHHSNGTKVQCSTLHYDAASXKKQCDDPTL

SEQ ID NO: 22761 - protein, 99 aa, Diabrotica virgifera
  misc_feature: Coding regions on vcDNA: vcDNA=SeqID_2458; Strand=-; Position=175-474
  misc_feature: Homolog annotation: Hit_ID=EAA05393.2; Match level="QueryCoverage =95%, HitCoverage=23%, E-value=6e-16, Identity=44%"; Hit description =ENSANGP00000003881 [Anopheles gambiae str. PEST] ref|XP_559999.1| ENSANGP00000003881 [Anopheles gambiae st
  misc_feature: Gene Ontology Annotation: Molecular function=lipase activity; Cellular component=extracellular; Biological process=digestion
VSRKYDLGKIKNKKLYNGSEVPPDYNLFNVKAPVHLIYSSNDWLAHETDVENLYQHLKSVREKFWVPIPTWNHMDYLFGKDAPKLIYEKIMSILNKYED

SEQ ID NO: 22762 - protein, 79 aa, Diabrotica virgifera
  misc_feature: Coding regions on vcDNA: vcDNA=SeqID_2459; Strand=+; Position=60-298
  misc_feature: Homolog annotation: Hit_ID=CAE47502.1; Match level="QueryCoverage =96%, HitCoverage=22%, E-value=5e-24, Identity=71%"; Hit description =cathepsin B-like proteinase [Diabrotica virgifera virgifera]
  misc_feature: Gene Ontology Annotation: Molecular function=peroxidase activity; Cellular component=extracellular space; Biological process=protein targeting
  misc_feature (49)..(49): Xaa can be any naturally occurring amino acid
LSVGSSHCFKSVANIQKEIVKNGPVEATFDVYSDFLNYKSGVYQHVAGXYVGGHAVRILSWGENDGVTLARSKYSWNSN

SEQ ID NO: 22763 - protein, 226 aa, Diabrotica virgifera
  misc_feature: Coding regions on vcDNA: vcDNA=SeqID_2460; Strand=+; Position=1-680
  misc_feature: Homolog annotation: Hit_ID=CAE47502.1; Match level="QueryCoverage =100%, HitCoverage=98%, E-value=5e-49, Identity=74%"; Hit description= cathepsin B-like proteinase [Diabrotica virgifera virgifera]
  misc_feature: Gene Ontology Annotation: Molecular function=peroxidase activity; Cellular component=extracellular space; Biological process=protein targeting
  misc_feature: Pfam annotation: Pfam_ID=Peptidase_C1; Match level="Score=47.3, E -value=3.9e-14, Copies=1"; Pfam description=Papain family cysteine protease
  misc_feature (105)..(105): Xaa can be any naturally occurring amino acid
AFIITLLLPVVLSYKGSPNPLSNEFINYINSKQSTWVAGKNFDENLSIQEIKNLLGAKTERLGVAKEFLHSENIQVPDSFDARENWKECSDVISTVADQSCCGSXKQCHWSTLNYNQKLTFASGPAHYFKSVANIQKEIVKNGPVEATFDVYSDFLNYKSGVYQHVAGSYVGGHAVRILGWGEENGVAYWLVANSWNEDWGDKGLFKILRGESEWGFEDGVVGSRA

SEQ ID NO: 22764 - protein, 58 aa, Diabrotica virgifera
  misc_feature: Coding regions on vcDNA: vcDNA=SeqID_2461; Strand=+; Position=2-178
  misc_feature: Homolog annotation: Hit_ID=XP_318822.1; Match level="QueryCoverage =96%, HitCoverage=7%, E-value=8e-19, Identity=76%"; Hit description =ENSANGP00000010217 [Anopheles gambiae]
  misc_feature: Gene Ontology Annotation: Molecular function=translation elongation factor activity; Cellular component=mitochondrion; Biological process=translational elongation
DMFGYAGELRSSTQGKGEFTMEYSRYSPCLPEVQEKLIVEYEKAMGILPDKDKKKKKN

SEQ ID NO: 22765 - protein, 90 aa, Diabrotica virgifera
  misc_feature: Coding regions on vcDNA: vcDNA=SeqID_2462; Strand=+; Position=896-1165
SGTSATLCCIFVIRRCRATQNYKKNTGCPILNIWDAFCWALPVYRVWPVATLLVDTDGIAQLLFELFFVFPKLRRVRGGQNIMRSPVQFP

SEQ ID NO: 22766 - protein, 145 aa, Diabrotica virgifera
  misc_feature: Coding regions on vcDNA: vcDNA=SeqID_2463; Strand=+; Position=437-874
  misc_feature: Homolog annotation: Hit_ID=XP_320591.1; Match level="QueryCoverage =79%, HitCoverage=14%, E-value=3e-39, Identity=60%"; Hit description =ENSANGP00000015216 [Anopheles gambiae]
  misc_feature: Gene Ontology Annotation: Molecular function=sphingomyelin phosphodiesterase activity; Cellular component=extracellular; Biological process=ceramide biosynthesis
NKILFIFIYYYFYLREANLYGYPIWFKLYSARQAFGLEALRPTDWDELVTKMTNDPKLFELFYKYYYKASSVRPSCDTACRKKILCDLHSGRSHDRKNLCETIESRIDSTSNVSWKDWLYNTISVSMSVLMSIPRLTTKYVLGLG

SEQ ID NO: 22767 - protein, 213 aa, Diabrotica virgifera
  misc_feature: Coding regions on vcDNA: vcDNA=SeqID_2464; Strand=-; Position=608-1249
  misc_feature: Homolog annotation: Hit_ID=XP_309657.1; Match level="QueryCoverage =84%, HitCoverage=76%, E-value=8e-57, Identity=57%"; Hit description =ENSANGP00000003881 [Anopheles gambiae]
  misc_feature: Gene Ontology Annotation: Molecular function=lipase activity; Cellular component=extracellular; Biological process=digestion
  misc_feature: Pfam annotation: Pfam_ID=Abhydro_lipase; Match level="Score=87.9, E -value=2.7e-23, Copies=1"; Pfam description=ab-hydrolase associated lipase region
MNNVFSFDSPPKRTPIPEFIKEAGYESESHYVTTPDGYILNMHRIPHGNTNKTKKNIPVYLQHGLLCSSADWVILGPNKSLSFLLADEGYDVWLGNVRGNTYSRNHTTLNPDKDADAFWDFSWNEIGIYDIPTMIDYILKTTGKSQVFHVGHSQGTTSFYVMTSEKPEYNRKVKAHISLAPVAFMQHLVSPLVRALAYGNLPFGGIAAIYWKN

SEQ ID NO: 22768 - protein, 197 aa, Diabrotica virgifera
  misc_feature: Coding regions on vcDNA: vcDNA=SeqID_2465; Strand=-; Position=1180 -1773
  misc_feature: Homolog annotation: Hit_ID=XP_312606.1; Match level="QueryCoverage =97%, HitCoverage=44%, E-value=1e-38, Identity=44%"; Hit description =ENSANGP00000014953 [Anopheles gambiae]
  misc_feature: Gene Ontology Annotation: Molecular function=lipase activity; Cellular component=extracellular; Biological process=digestion
  misc_feature (23)..(23): Xaa can be any naturally occurring amino acid
INSGIGASDIPTMIDYILKSTGXSQVFHVGHSQGTTSLYVMTSEKPEYNRKVKAHISLAPVAFMQHLVSPLVRALAYGNLPFGNQQTFIGKNEFFPSTAFLVLLNDAICGVGVGAVYCKISIFALAGFSPNEMDAKDTAVIYAHYPAGAATRQILHYTQEVVSGHFRKYDFGKIKNKKLYNGSEVPPDYNLFNVKAP

SEQ ID NO: 22769 - protein, 94 aa, Diabrotica virgifera
  misc_feature: Coding regions on vcDNA: vcDNA=SeqID_2466; Strand=+; Position=575-859
KEMQQTSPLRSCRQEARKVGSLYVNIYLYVFTSFKRTFYVNVTLPVARAAARDLELVSELSYTANLVPLTYRYINYIYSKPVFVTAVTFVFEYR

SEQ ID NO: 22770 - protein, 70 aa, Diabrotica virgifera
  misc_feature: Coding regions on vcDNA: vcDNA=SeqID_2467; Strand=-; Position=760-972
ERHRRSSERIGCELVRRGDIYKFANASSDKFVNVYRKFDINVKVIKLKLKLKTLIIKNISWSKLWYIFLL

SEQ ID NO: 22771 - protein, 45 aa, Diabrotica virgifera
  misc_feature: Coding regions on vcDNA: vcDNA=SeqID_2468; Strand=+; Position=7-144
  misc_feature: Homolog annotation: Hit_ID=CAE47502.1; Match level="QueryCoverage =93%, HitCoverage=12%, E-value=8e-13, Identity=83%"; Hit description =cathepsin B-like proteinase [Diabrotica virgifera virgifera]
MKAAFIITLLLPVVLSYTANLNPLSNEFINYINSKQSSWVAGIKL

SEQ ID NO: 22772 - protein, 135 aa, Diabrotica virgifera
  misc_feature: Coding regions on vcDNA: vcDNA=SeqID_2469; Strand=+; Position=3-410
  misc_feature: Homolog annotation: Hit_ID=XP_396434.1; Match level="QueryCoverage =93%, HitCoverage=38%, E-value=7e-14, Identity=33%"; Hit description =similar to fibroblast growth factor 1; fibroblast growth factor 1 (acidic) [Apis mellifera]
  misc_feature: Gene Ontology Annotation: Molecular function=growth factor activity; Cellular component=extracellular space; Biological process=cell-cell signaling
  misc_feature: Pfam annotation: Pfam_ID=FGF; Match level="Score=71.6, E-value=2.2e -18, Copies=1"; Pfam description=Fibroblast growth factor
NEPRWSTIFLHVRLWCQNGYNLTIRSNGEVLGTGDDSDPDSMIEISSGGDVSLVRLLGINSQLYLCFDDNGQLYGEKDPLNPGTIFVEAFSASYSTFQSTLDSKSWFIGIQRNGKPKPGKKTGETQKATRFLPRR

SEQ ID NO: 22773 - protein, 63 aa, Diabrotica virgifera
  misc_feature: Coding regions on vcDNA: vcDNA=SeqID_2470; Strand=-; Position=1-189
NIKKKNAFFFGGWGKKKKKKKKKKNFYLIKKKIKKKKKNNPPPPPPHNKKLHIKNKLKKNNNN

SEQ ID NO: 22774 - protein, 299 aa, Diabrotica virgifera
  misc_feature: Coding regions on vcDNA: vcDNA=SeqID_2471; Strand=+; Position=23-922
  misc_feature: Homolog annotation: Hit_ID=CAE47502.1; Match level="QueryCoverage =99%, HitCoverage=90%, E-value=1e-123, Identity=69%"; Hit description= cathepsin B-like proteinase [Diabrotica virgifera virgifera]
  misc_feature: Gene Ontology Annotation: Molecular function=peroxidase activity; Cellular component=extracellular space; Biological process=protein targeting
  misc_feature: Pfam annotation: Pfam_ID=Peptidase_C1; Match level="Score=155.1, E -value=1.6e-43, Copies=1"; Pfam description=Papain family cysteine protease
MKAAFIITLLLPVVLSYTANLNPLSNEFINYINSKQSSWVAGRNFDENLSTQELKKLLGTKKRNLGDVKGFIHSENIQIPDSFDARENWKECSDVINTIVDQSACAAGWALAAASAMSDRRCIASQGKLKVPVSAENVVACSRNSLGCKIGYMEDGWWYWLKNGIPTGGLYGSKQGCQPYSLQSCEHHTNGTKVDCSTLKLDTPTCRTQCNDPALNYKSELTYAAGPPDWYTRVADMQREIMTNGPVETTFRLYTDFWNYKSGVYHNVGGDYAGDHCVRVLGWGVENGVPYWLAANSWE

SEQ ID NO: 22775 - protein, 155 aa, Diabrotica virgifera
  misc_feature: Coding regions on vcDNA: vcDNA=SeqID_2472; Strand=-; Position=666-1133
  misc_feature: Homolog annotation: Hit_ID=AAH80500.1; Match level="QueryCoverage =92%, HitCoverage=94%, E-value=4e-25, Identity=38%"; Hit description =Npc2-prov protein [Xenopus tropicalis] ref|NP_001007988.1| npc2-prov protein [Xenopus tropicalis]
  misc_feature: Gene Ontology Annotation: Cellular component=extracellular space
  misc_feature: Pfam annotation: Pfam_ID=E1_DerP2_DerF2; Match level="Score=105.6, E -value=1.2e-28, Copies=1"; Pfam description=ML domain
MGSKKVVISAMCLILVLGISSCLADTDDIEDCGSVTGQIVKVELAGCEGEDRCPLKRGTNASMVATFKSNTNSKTLKTLVIGKLGLLKQKFNLPNPNACEMGVTCPISSGDTYTYTVSMPVKKNYPRVTVDIELHLIDENDKDVICALIPAKIVA

SEQ ID NO: 22776 - protein, 301 aa, Diabrotica virgifera
  misc_feature: Coding regions on vcDNA: vcDNA=SeqID_2473; Strand=-; Position=778-1683
  misc_feature: Homolog annotation: Hit_ID=XP_309657.1; Match level="QueryCoverage =77%, HitCoverage=83%, E-value=2e-60, Identity=50%"; Hit description =ENSANGP00000003881 [Anopheles gambiae]
  misc_feature: Gene Ontology Annotation: Molecular function=lipase activity; Cellular component=extracellular; Biological process=digestion
  misc_feature: Pfam annotation: Pfam_ID=Abhydro_lipase; Match level="Score=87.9, E -value=2.7e-23, Copies=1"; Pfam description=ab-hydrolase associated lipase region
IPSPRVVVNMKYKVIFLLCVWCVYSTSGINILDSAKNLIHGGSDFVKDSMNNVFSFDSPPKRTPIPEFIKEAGYESESHYVTTPDGYILNMHRIPHGNTNKTKKNIPVYLQHGLLCSSADWVILGPNKSLSFLLADEGYDVWLGNVRGNTYSRNHTTLNPDKDADAFWDFSWNEIGIYDIPTMIDYILKTTGKSQVFHVGHSQGTTSFYVMTSEKPEYNRKVKAHISLAPVAFMQHLVSPLVRALAYGNLPFGNQQTFIGKNEFFPSTAFLVLLNDAICGVGVGAVYCKISIFALAGFQSK

SEQ ID NO: 22777 - protein, 328 aa, Diabrotica virgifera
  misc_feature: Coding regions on vcDNA: vcDNA=SeqID_2474; Strand=+; Position=705-1691
  misc_feature: Homolog annotation: Hit_ID=CAE47502.1; Match level="QueryCoverage =100%, HitCoverage=100%, E-value=1e-137, Identity=71%"; Hit description=cathepsin B-like proteinase [Diabrotica virgifera virgifera]
  misc_feature: Gene Ontology Annotation: Molecular function=peroxidase activity; Cellular component=extracellular space; Biological process=protein targeting
  misc_feature: Pfam annotation: Pfam_ID=Peptidase_C1; Match level="Score=235.6, E -value=9.2e-68, Copies=1"; Pfam description=Papain family cysteine protease
MKAAFIITLLLPVVLSYTANLNPLSNEFINYINSKQSSWVAGRNFDENLSIQEMKKLLGTKKRNLGDVKGFIHSENIQVPDSFDARENWKVCSDVINTIADQSACLAGWAVAAASAMSDRRCIASQGKLKVPVSAENLMACIAFGCDGGYLEDGWWLWEANGIPTGGLYGSNQGCQPYSLPPCEHNTTGTKVQCSTLKLDTPTCRTQCNDPALNYKSELTFASGPSYSFTTVANMQKEILTNGPVETTFHLYSDFWSYKSGVYQHVAGDDLGYHSVKVLGWGVENGVPYWLAANSWNEDWGDKGLFKILRGKNEVEFEYQMMAARPKV

SEQ ID NO: 22778 - protein, 331 aa, Diabrotica virgifera
  misc_feature: Coding regions on vcDNA: vcDNA=SeqID_2475; Strand=+; Position=27-1022
  misc_feature: Homolog annotation: Hit_ID=CAE47502.1; Match level="QueryCoverage =100%, HitCoverage=100%, E-value=0.0, Identity=99%"; Hit description =cathepsin B-like proteinase [Diabrotica virgifera virgifera]
  misc_feature: Gene Ontology Annotation: Molecular function=peroxidase activity; Cellular component=extracellular space; Biological process=protein targeting
  misc_feature: Pfam annotation: Pfam_ID=Peptidase_C1; Match level="Score=308.2, E -value=1.3e-89, Copies=1"; Pfam description=Papain family cysteine protease
MKAAFIITLLLPIVLSYKGNPNPLSNDFINYINSKQSTWVAGKNFDENLSIQEIKNLLGAKKGKLGVAKEFTHSEDIQVPNSFDARENWKECSDVISTVVDQSDCGSCWAVAAASAMSDRRCIASQGKLKVPVSAENLLSCCDSCGYGCEGGYPTMAWSYWIDTGITTGGLYGSKQGCQPYSLQPCEHHTEGNKVQCSTLDYDTPSCKHKCDDSALNYKSELTFGSGSVRNFYSVANIQKEILTNGPVEAAFDVYSDFVNYKSGVYQHVAGEYLGGHAVRILGWGEESGVPYWLVANSWNEDWGDKGLFKIRRGNNESGFEDSIVAAPAQV

SEQ ID NO: 22779 - protein, 335 aa, Diabrotica virgifera
  misc_feature: Coding regions on vcDNA: vcDNA=SeqID_2476; Strand=+; Position=45-1053
  misc_feature: Homolog annotation: Hit_ID=CAE47502.1; Match level="QueryCoverage =99%, HitCoverage=100%, E-value=1e-155, Identity=77%"; Hit description=cathepsin B-like proteinase [Diabrotica virgifera virgifera]
  misc_feature: Gene Ontology Annotation: Molecular function=peroxidase activity; Cellular component=extracellular space; Biological process=protein targeting
  misc_feature: Pfam annotation: Pfam_ID=Peptidase_C1; Match level="Score=280.6, E -value=2.7e-81, Copies=1"; Pfam description=Papain family cysteine protease
  misc_feature (323)..(323): Xaa can be any naturally occurring amino acid
MKAACIITLLLPVVLSYKANLNPLSNEFINYINSKQNTWVAGKNFDEKLSIQEIKNLLGARKRSLGDVKGFMHSEDIQVPDSFDARENWKDCSDVISTIVDQSACGSCWAMSAASAMSDRRCIVTQGKLKVPVSAENLLSCCDDCGFGCAGGYIDDAWSFWQENGITTGGLYGSNQGCQSYSLQPCEHHTNGTKVQCSTLNYGTPSCRSDQCDDTALNYKSELTYASGPVNYYTTVPNMQKEILTNGPIQTRFDVYSDFFSYKSGVYQHVAGDYVGGHAVRVLGWGVENGVAYWLAANSWNEDWGDKGLFKIIRGTNECSFEXGVVAAPAYVNPT

SEQ ID NO: 22780 - protein, 200 aa, Diabrotica virgifera
  misc_feature: Coding regions on vcDNA: vcDNA=SeqID_2477; Strand=+; Position=2106 -2705
  misc_feature: Homolog annotation: Hit_ID=XP_307274.1; Match level="QueryCoverage =93%, HitCoverage=37%, E-value=1e-31, Identity=42%"; Hit description =ENSANGP00000023005 [Anopheles gambiae]
SFKVFVTLIRYFDPSEEFLIDTGLRQGDPLAPLLFNFALEHAVRKAQPQLTNGFAVQGSKILLAFADDVDTIAQSTRDAKEVFTLFENGAKEVGLKVNEDKTKYMVVTKNPRPRVRQNVTINEYNYEVVKEFKYLGAIITSENNYEQDVAARIIAGKRAYYSLRTLLKSKILSRPAKIRVYKTIIRPHIKVRSETWTLNQ

SEQ ID NO: 22781 - protein, 254 aa, Diabrotica virgifera
  misc_feature: Coding regions on vcDNA: vcDNA=SeqID_2478; Strand=+; Position=9-773
SRVFFFFFKGPKTQISVAKILYFLIKTISATHLKKKKNKKKKKKQKKKKKEKGSTFRNMKLIVVILAAVCLYDVSAKQDDYVQWVSYDGTIPANVVEGTTSIDGRQLYIARAFVSLDESDLYNDNQGYIVGPVEAGVLQLNASFPDLTYHITDNIEILTVVDGAKVEWVSTNQTFLPKWFDSDDYHPVHSNWHQIVNINSTIYIGRIHDSDIGGTFGHIPVSTELYEDEDVAYYAFGDDVRESNVYDILLYYFK

SEQ ID NO: 22782 - protein, 242 aa, Diabrotica virgifera
  misc_feature: Coding regions on vcDNA: vcDNA=SeqID_2479; Strand=+; Position=168-895
  misc_feature: Homolog annotation: Hit_ID=EAL41373.1; Match level="QueryCoverage =99%, HitCoverage=41%, E-value=3e-37, Identity=36%"; Hit description =ENSANGP00000029312 [Anopheles gambiae str. PEST] ref|XP_559710.1| ENSANGP00000029312 [Anopheles gambiae st
  misc_feature (231)..(231): Xaa can be any naturally occurring amino acid
MTVTKETFVQLEEKYAKVIKLLEEDSKFDPETEPYLSKYSARQILIGMKAQIENLLRGQGLEESCQKKLNAMLGTVYLYLGMISVETGEVSNGKSHLEKCKEIIEKFQMEPDFILIALNMYNQFGIMLSVTEPESSKLYLDIAENLYADFKSKDVNPIDISDLFQLNNKSHDVEIGLKNLEKIHTLTLYYLAQIFGAMQDALKSSVYCHLTLKKQLEMSDYDPIEWALNAXTLSQFFIGKNV

SEQ ID NO: 22783 - protein, 133 aa, Diabrotica virgifera
  misc_feature: Coding regions on vcDNA: vcDNA=SeqID_2480; Strand=+; Position=20-418
YNYSNEPCSRCLLLKTMRSTIYIRAKTLNKLVINRFNVTSKVNILGNCNCYNEPFYQTYSCLTPRSVIFNSPALYQSCRFQGTDIKEAAKDDSKRSEKEIPEKIVLKETLSRKEKLKKAVKEYGSTVIVFHIG

SEQ ID NO: 22784 - protein, 292 aa, Diabrotica virgifera
  misc_feature: Coding regions on vcDNA: vcDNA=SeqID_2481; Strand=+; Position=3-878
  misc_feature: Homolog annotation: Hit_ID=XP_396281.1; Match level="QueryCoverage =89%, HitCoverage=69%, E-value=5e-77, Identity=52%"; Hit description =similar to ENSANGP00000018435 [Apis mellifera]
  misc_feature: Gene Ontology Annotation: Molecular function=arylsulfatase activity; Cellular component=lysosome; Biological process=skeletal development
  misc_feature: Pfam annotation: Pfam_ID=Sulfatase; Match level="Score=-27.4, E-value= 1.2e-05, Copies=1"; Pfam description=Sulfatase
  misc_feature (275)..(275): Xaa can be any naturally occurring amino acid
FRVRRQVKKIAHKVLVPLTLFTLLICSVIIGSVSSAEQPNVIVIVADDLGWNDVGFHGSNQIPTPNIDALAYNGIILNSHYVHSTSSPTRTALLTGKYPMKLGLQGTSFLPADKRSLPEGKLLPEYFKELGYATYLVGKWHLGYSKWNDTPQFKGFDHHFGFYNSFTSYYDYLTTYKFDNKEYTGFDLRKDGKSAHEESGKYATDLFTDYTVKTIMEQDSSKPFFIMLTHLAVHAGNDGKLLEAPQETINKFSHIVDSNRRTYAAMVSKLDDSVXAIVEALDNKNIMTNTIV

SEQ ID NO: 22785 - protein, 1100 aa, Diabrotica virgifera
  misc_feature: Coding regions on vcDNA: vcDNA=SeqID_2482; Strand=+; Position=114-3416
  misc_feature: Homolog annotation: Hit_ID=XP_320939.1; Match level="QueryCoverage =99%, HitCoverage=88%, E-value=0.0, Identity=63%"; Hit description =ENSANGP00000017588 [Anopheles gambiae]
  misc_feature: Gene Ontology Annotation: Molecular function=isoleucine-tRNA ligase activity; Cellular component=cytosol; Biological process=protein biosynthesis
  misc_feature: Pfam annotation: Pfam_ID=tRNA-synt_1; Match level="Score=1032.3, E -value=0, Copies=1"; Pfam description=tRNA synthetases class I (I, L, M and
  misc_feature (1062)..(1062): Xaa can be any naturally occurring amino acid
  misc_feature (1065)..(1065): Xaa can be any naturally occurring amino acid
  misc_feature (1077)..(1077): Xaa can be any naturally occurring amino acid
IIFIQDTNLKMTEKKLQQIPRVPESVNFPDEEVKILAYWKQIDAFKSCLKQSKGKPKYTFYDGPPFATGLPHYGHILAGTIKDVVTRYAHQQGFHVERRFGWDTHGLPVEYEIDKKLGIKGPDDVMKMGIAKYNEECRKIVMRYSGDWEKIVSRIGRWIDFKNDYKTLYPWFMETVCRVFKQLYVKGLVYKGNKVMPYSTTCNTPLSNFETGQNYKDVVDPAVTVSLPILDDKEGAALLVWTTTPWTLPSNMAACVHPDLIYARFQQVSTQKIYVMMECRIESIFAADDVKVIKTFPGKELEGLRYEPIFNYFTHLKDKAFRVFVDDYVTSESGTGIVHQAPYFGEDDNRVCLANGAITRDQEPICPIDANGCFVEPVKEFLGQYVKDADKNIIAKLKETGRLIHQSQIKHSYPFCWRSDTPLIYRAIPSWFIRVEHMRDQLQEVISDTYWVPEFVRDKRFANWLKEARDWAVSRNRYWGTPIPIWMSADGSEVVCIGSIAELEELSGKKVADLHRETVDTIEIPSRIPGNPPLKRISEVFDCWFESGSMPYAQVHYPFENVKEFEDNFPANFIAEGIDQTRGWFYTLTVISTALFGKAPFKNLVCNGLVLAADGFKMSKSKKNYPDPMDIVNKFGADALRLYLINSPVVRAENLRFKEEGVRDVIKDVFLPWYNAFRFLLQNIEIYVQNYNKDFIYDENNVKSDNIMDKWVLSFTQSLLLYIRKEMELYHLYNVIPRLTKFFDYLTNWYVRMNRKRLKGENGEEDCYAALTTLFNILLNIIKMMAPFSPFLTETMYQYLKQLLDTKADSIHYLMLPQPNQTLIHVDIERAVARMQSVIELGRVIRDRKTIPIKYPLPEIIVVHRDQQYLDDIIQLQGYILSELNVRKISTTTDKSKFGITLRAEPDHKVLGARLKQEFKAVTQGLKSLTDAEINEMVEKGHRDIAGQRIDISEVRLIFKSESLNSDQYEVNSDNDVLVLMDVTPDSSMQDEGIAREIINRVQKLRKKAHLVPTDEIAVFYKTSGDLSRVATEYTEFIENTLKTPFKCLQSKKASDETIIEXKQXLKDFDIQILLTXNSNIQLPGCKWVNLSLVGLKSKY

SEQ ID NO: 22786 - protein, 145 aa, Diabrotica virgifera
  misc_feature: Coding regions on vcDNA: vcDNA=SeqID_2483; Strand=-; Position=510-947
  misc_feature: Homolog annotation: Hit_ID=AAO67558.1; Match level="QueryCoverage =75%, HitCoverage=10%, E-value=1e-25, Identity=47%"; Hit description =Gag protein [Drosophila virilis] gb|AAO67563.1| Gag protein [Drosophila virilis]
  misc_feature: Pfam annotation: Pfam_ID=zf-CCHC; Match level="Score=11.6, E-value =0.016, Copies=1"; Pfam description=Zinc knuckle
  misc_feature (68)..(68): Xaa can be any naturally occurring amino acid
DPKKNHQPPFIPWISIANRKFSFYPPPRKKNIPQCQRCQRYGHTKAYCTRPYACVKCGGSHPTPECTXPRNTPAKCALCNGEHTANYKGCVIYKDLQNVRNNRQRGNQSTHNNHNPHQNVNPAPTSQYQSQQSQYQQQNGTQSYA

SEQ ID NO: 22787 - protein, 56 aa, Diabrotica virgifera
  misc_feature: Coding regions on vcDNA: vcDNA=SeqID_2484; Strand=-; Position=423-593
LSYEKSAVSAMLCDVHCYLNVFNVSSSAIGDVRQYTRRGAMFHYNFTLGQDLLTKM

SEQ ID NO: 22788 - protein, 431 aa, Diabrotica virgifera
  misc_feature: Coding regions on vcDNA: vcDNA=SeqID_2485; Strand=+; Position=139-1431
  misc_feature: Pfam annotation: Pfam_ID=KE2; Match level="Score=0.4, E-value=0.067, Copies=1"; Pfam description=KE2 family protein
MRSLLFLLLFYTWQISFAQKCSSPEVSRKLSFIYRTVPSSQIEVVECFYTDGNSKNDYYDITKNCVTAARTRIFIDKYGDDHRVNEGGSKVSLKTYYTNADLSQNVVFLKSGKKCRYDAGFCYDPSQGNNYAVVWAVNPVPKVVCPNQLEQIFYGYVDYWTFTAENRKYLIYSVPLKDESFSLSLSNTTVCHGKQAWYVDEQGFLVSFTSLLPRVTATPVLNRNLFPTFKSKGDISDSIIRDCTLKSYNLNFDTKIDTDYLSDSENLKIILRFYQQNIDNNKNAINKLAKDIQDDNRDKKPSENVLSEINQIKSSLSTNFNNINKLFKDINQLKTVDTDIYSIITNLANSIKQLKIDIKNITKNDEYLEKYLKEFKNDVYKKLNNYNTDIKIQLDKVKQSSGSNVINTPNPTIQSLNHSSTTCINKVNSLK

SEQ ID NO: 22789 - protein, 109 aa, Diabrotica virgifera
  misc_feature: Coding regions on vcDNA: vcDNA=SeqID_2486; Strand=+; Position=150-479
LKKIMTDSTRLTWVFREQTPFTANEEINFFKKKLVPLFFQIQGKNVCAFATLSSFFDENEISRIRDVVADIIYHLDRNFFKKVLINISLKIIPNLTESEIVLQEAHQIS

SEQ ID NO: 22790 - protein, 125 aa, Diabrotica virgifera
  misc_feature: Coding regions on vcDNA: vcDNA=SeqID_2487; Strand=+; Position=401-779
  misc_feature: Homolog annotation: Hit_ID=Q26492; Match level="QueryCoverage=99%, HitCoverage=98%, E-value=5e-24, Identity=39%"; Hit description=Ion transport peptide-like precursor gb|AAB16823.1| ion transport-like protein
  misc_feature: Gene Ontology Annotation: Molecular function=neuropeptide hormone activity; Biological process=neuropeptide signaling pathway
  misc_feature: Pfam annotation: Pfam_ID=Crust_neurohorm; Match level="Score=30.2, E -value=6.1e-07, Copies=1"; Pfam description=Crustacean CHH/MIH/GIH neurohormone f
  misc_feature (98)..(98): Xaa can be any naturally occurring amino acid
MNHRSSQSVRYTQVGWVCLAIGLFLQIVSGNLVNRSPNLLNHHRVTKRSFYELQCKGVYSPSIYARLDKICEECLSLFKEPSIYTLCSANCFSTKYFXGCCETLLCDDIETIQDMIKQLNGGDPI

SEQ ID NO: 22791 - protein, 280 aa, Diabrotica virgifera
  misc_feature: Coding regions on vcDNA: vcDNA=SeqID_2488; Strand=+; Position=80-922
  misc_feature: Homolog annotation: Hit_ID=AAT38514.1; Match level="QueryCoverage =96%, HitCoverage=54%, E-value=4e-37, Identity=30%"; Hit description =antennae-rich cytochrome P450 [Phyllopertha diversa]
  misc_feature: Gene Ontology Annotation: Cellular component=membrane; Biological process=electron transport
MLLTSSWITDITILIALIGLLIYKYLTRHFDYWEKRNVPYLKPTLLFGNFKDVFTCKLTIQEHLKNLYDKIDAPYFGVFLMDEPLLILKDPKLFKDVLIKDADVFANRRPPTPTHRLMENSVIFMKYPHWKSVRTRLTPVFTPVMLKNMHVEISEITKSMVQYLFKNKKTIDGRGLGKLFSDELIFKCFFGVNLDGFNEKPTPIGSLVKNMNEFSLRNALVQNLSFIKPSWATLLKLDFFSDSSLRFFEDIFQKGMEARNHYDGKPLNYVDFAHKGGQKN

SEQ ID NO: 22792 - protein, 366 aa, Diabrotica virgifera
  misc_feature: Coding regions on vcDNA: vcDNA=SeqID_2489; Strand=+; Position=24-1121
  misc_feature: Homolog annotation: Hit_ID=XP_397016.1; Match level="QueryCoverage =96%, HitCoverage=65%, E-value=7e-64, Identity=38%"; Hit description =similar to ENSANGP00000024113 [Apis mellifera]
  misc_feature: Gene Ontology Annotation: Molecular function=glucose transporter activity; Cellular component=membrane; Biological process=signal transduction
  misc_feature: Pfam annotation: Pfam_ID=Sugar_tr; Match level="Score=84.3, E-value =3.2e-22, Copies=1"; Pfam description=Sugar (and other) transporter
MGASGPNRTYLYLVAIAANISVFVCGTAFGWSSPVIPRLKNLDASPLDHVISTSEEGLIASFLPLAAVLGPVLGGILASKIGKKLTLIIAVTPFIIAFIIFTIATKIELFYFGRFLCGLACGMTYVNIPTYIAEIADNEVRGSLGSYLQLFCTIGILFPYSLGPYVTLKLFNIILLFPPTICIVLFIVFLPESPYYLLQRGKIEQALQVLSKLSGKPTSIAEKDLADMQVQIRQESEQKGGFGLIMKTPGLRRALILSLCLVIFQQFTGINVVFFFTQTLFEDAGVALAPEICTIIVGIIQILASTLSPLFVEKSGKRRLLMISGIGSAVSVAVLAIYFYIKDVLKSDTSSISWLPIASLLAFIIA

SEQ ID NO: 22793 - protein, 486 aa, Diabrotica virgifera
  misc_feature: Coding regions on vcDNA: vcDNA=SeqID_2490; Strand=+; Position=124-1580
  misc_feature: Homolog annotation: Hit_ID=XP_392981.1; Match level="QueryCoverage =100%, HitCoverage=98%, E-value=0.0, Identity=44%"; Hit description =similar to Hypothetical protein MGC76072 [Apis mellifera]
  misc_feature: Gene Ontology Annotation: Molecular function=protein phosphatase type 2A activity; Cellular component=bud neck; Biological process=cell organization and biogenesis
  misc_feature: Pfam annotation: Pfam_ID=HEAT; Match level="Score=231.4, E-value=1.6e- 66, Copies=11"; Pfam description=HEAT repeat
  misc_feature (469)..(469): Xaa can be any naturally occurring amino acid
MAASDSAGDDSLYPIAVLIDELKNEDVQLRLNSIKKLSTIALALGVERTRTELIPFLTETIYDEDEVLLALAEQLGTFINLVGGSEYAYCLLPPLESLATVEETVVRDKAVESLRAVAQQHSPADLETHFVPLVQRLAAGDWFTTRTSACGLFSVCYPRVSALVKGELRAHFRALCQDDTPMVRRAAATKLGELAQVVELEYLKSDLIPMFVNLAQDEQDSVRLLAVEACVSIATLLQQEDVEQLVMPTLRQCTGDTSWRVRYMVAERFTELQKAVGPEITRTDLVNAFQSLLKDTEAEVRAAAANKVKDFCQNLDKAHQENIIMTNILPCVKELVADPNQHVKSALASVIMGLSPILGRHNTIEHLLPLFLTQLKDECPEVRLNIISNLDCVNEVIGIQQLSQSLLPAIVELAEDSKWRVRSAIIEYMPLLAGQLGREFFDEKLNALCMTWLMDHVFAIRESCTFKLXKLGDQFGAEWAESTIIP

SEQ ID NO: 22794 - protein, 500 aa, Diabrotica virgifera
  misc_feature: Coding regions on vcDNA: vcDNA=SeqID_2491; Strand=+; Position=101-1604
  misc_feature: Homolog annotation: Hit_ID=XP_315515.1; Match level="QueryCoverage =97%, HitCoverage=97%, E-value=1e-122, Identity=41%"; Hit description= ENSANGP00000021191 [Anopheles gambiae]
  misc_feature: Pfam annotation: Pfam_ID=Sterile; Match level="Score=101.1, E-value =2.9e-27, Copies=1"; Pfam description=Male sterility protein
  misc_feature (428)..(428): Xaa can be any naturally occurring amino acid
MTPDVPDRIAEVFKGSTIFLTGATGLVGKALIEKILKLCDVNKIYLLIRDKKGKTPNERIKDIFSNPLYQTVLARKPDCQKKCIPIPGDVSLVNLGISDENRKMLMDEVDFIIHSAATVRFDDSLKYAVTVNTRGTKFMLDLAEGCSKLKLFIHVSTAYAFPNNKDGITFEKEYPPPANPHEVLSSINWLKEDDLTDALTKKLLGDIPNTYTFSKALSESLVYEKAKKLPIIICRPAIVIPAFKDPIPGWTNNLQGPAGIFVGAGKGVIRTVYMNCDSYANFAPIDCTVSAIMMYAWHYLTTKDPQYIYNLCMPQSDLQVTWVEVLDTARDVIYNEVPFNLMLWYPDGSITQSRLYNKINTVLFQLLPALIIDLILLIAGQKPQFLAIQNRILKGIEMYEFYITKKWNFETTSLEQIRTGLNATERKXQVQSDEKDVRKFLRDCMFYLRRHFFKETDDMLPAARRNMKILYCLDRFVKALVIGFIVYYLYKTFFLRSLHA

SEQ ID NO: 22795 - protein, 469 aa, Diabrotica virgifera
  misc_feature: Coding regions on vcDNA: vcDNA=SeqID_2492; Strand=+; Position=2-1408
  misc_feature: Homolog annotation: Hit_ID=BAA19488.1; Match level="QueryCoverage =93%, HitCoverage=48%, E-value=1e-156, Identity=62%"; Hit description= myosin light chain kinase isoform-I [Drosophila melanogaster]
  misc_feature: Gene Ontology Annotation: Molecular function=calcium/calmodulin -dependent protein kinase activity; Cellular component=cytoskeleton; Biological process=regulation of striated muscle contraction
  misc_feature: Pfam annotation: Pfam_ID=Pkinase; Match level="Score=302.6, E-value =6.4e-88, Copies=1"; Pfam description=Protein kinase domain
  misc_feature (44)..(44): Xaa can be any naturally occurring amino acid
  misc_feature (61)..(61): Xaa can be any naturally occurring amino acid
  misc_feature (71)..(71): Xaa can be any naturally occurring amino acid
KHHNRRQREVRCIALGTRIGEDSNSRLSWLVEGPPDPPSGTPSXTTSLDSVTLTWSSSPYXDGGKIVNGYXVDYSMVGSDIWTTAVEECHSLSYVVRGLQPGGRYVFRVRALNVHGYSKPSLESDIVQLEEHNESSYFEPRVVSVEPGPEFKTRYDVLEELGKGRYGVVHKVIDKVSNQKLAAKFIKCRTSKDRDKVQDEIDIMNLLRHQKLLQLAAAFENPRDMIMIMEYISGGELFERVVADDFTLTEKDCILFMRQICEGVAYMHSQSIVHLDLKPENIMCHTRTSHEIKIIDFGLAQKLDPKEPIRVLFGTPEFIPPEIISYEPIGVESDMWSIGVICYVLLSGLSPFMGDNDSETFTNITRADYDFDDEAFNTVSQNARDFIGALLIKRKEERLSAEQCLKHVWLDPETHQQTVVLSTDKLKKFIIRRKCQKTGNAIRALGRMPTLSGSRRNSANSVPSTPRPF

SEQ ID NO: 22796 - protein, 164 aa, Diabrotica virgifera
  misc_feature: Coding regions on vcDNA: vcDNA=SeqID_2493; Strand=+; Position=187-681
  misc_feature: Homolog annotation: Hit_ID=EAL33487.1; Match level="QueryCoverage =92%, HitCoverage=86%, E-value=4e-38, Identity=48%"; Hit description =GA15462-PA [Drosophila pseudoobscura]
  misc_feature: Gene Ontology Annotation: Molecular function=benzodiazepine receptor activity; Cellular component=mitochondrial outer membrane; Biological process=mitochondrial translocation
  misc_feature: Pfam annotation: Pfam_ID=TspO_MBR; Match level="Score=167.6, E-value =2.7e-47, Copies=1"; Pfam description=TspO/MBR family
MQEINWFAVAFIVLPHTGGLAGGIITKKNIFWYNGLKKPFGTPPSWSFSPIWTILYSSMGYASYMVYRDGHGFDGPAGLPLIIYGINLLANWTWTPMFFARKNMKLALYNMQLINATALCMAYLFYKINTTAGLLIIPYLTWLVISTYLNYSFMIKNPPKTATN

SEQ ID NO: 22797 - protein, 179 aa, Diabrotica virgifera
  misc_feature: Coding regions on vcDNA: vcDNA=SeqID_2494; Strand=-; Position=885-1424
MDLNVKKVSNSQQYSPMKAISLPDCDYKTENLTTQNAFQYVCGYLIKKALNIHVCHICNKYSREIDELDSSLLLTHFKAYSTDKCDYGGLRTPSKDFIQYIYKLEIIFSASYEDILTKGGISHSYFRVMKEVPFKHPCDSFPYTYILKLFIRVRLFYSLKYFNADLKSKKVKKRGEIEN

SEQ ID NO: 22798 - protein, 256 aa, Diabrotica virgifera
  misc_feature: Coding regions on vcDNA: vcDNA=SeqID_2495; Strand=+; Position=176-946
MVDNPEASSTPKKVMGRKSIRNYQVVSPIENQKNISQTDHYNDKVQREDARECFSSGTESYSDGEGQVDSAEENSLNPEPNVSKTQFSVNGNMIYILFIIPVLVGLYMYNPQAEPIESIHSDFADLISDHPQTDDFWINVRVALHDIKRLKQPKSIIFLYEDDTTMAKVLNSISRYSSYDICKSKQVIQLPGRYLKNSNFLEDYGTFISEIRDDLAEKCVVIITNLDEAPGTSAQAFHSLCDEYNPVKEQVLFLFM

SEQ ID NO: 22799 - protein, 274 aa, Diabrotica virgifera
  misc_feature: Coding regions on vcDNA: vcDNA=SeqID_2496; Strand=+; Position=107-926
  misc_feature: Homolog annotation: Hit_ID=EAL41742.1; Match level="QueryCoverage =98%, HitCoverage=97%, E-value=2e-90, Identity=49%"; Hit description =ENSANGP00000025955 [Anopheles gambiae str. PEST] ref|XP_564611.1| ENSANGP00000025955 [Anopheles gambiae st
  misc_feature: Gene Ontology Annotation: Molecular function=transcription factor activity; Cellular component=nucleoplasm; Biological process=cell organization and biogenesis
  misc_feature: Pfam annotation: Pfam_ID=WD40; Match level="Score=132.8, E-value=8.1e- 37, Copies=5"; Pfam description=WD domain, G-beta repeat
  misc_feature (259)..(259): Xaa can be any naturally occurring amino acid
YINMYSVLHKNENAHEECIWSCFWGRYAPEKKKKSEDDNQGDDEKSRDSILSDEPPIDYIVTGGVDDLVKVWELQDDRLVLKHNLEGHSLGVVSVAVSHNGKLCASSSLDSSMRIWDLEKGEKIANVDVGPVDLWTVAFSPDDKYIISGSGKITAYSVETAKAEQTFETRGKFTLSIAYSPDGKYIASGAIEGIINIFDVAANKLLHTLEGHAMPIRSLCFSPDSQLLLTGSDDGYMKLYDVRDQKTRLIGTLSGHASXWVLSVAFSPDGKNFV

SEQ ID NO: 22800 - protein, 57 aa, Diabrotica virgifera
  misc_feature: Coding regions on vcDNA: vcDNA=SeqID_2497; Strand=+; Position=212-385
SLVSESSELVTELGPNYSDIVSLGFIYFFFETVVDTFVDFSFKTEAGALNCVSYNKI

SEQ ID NO: 22801 - protein, 158 aa, Diabrotica virgifera
  misc_feature: Coding regions on vcDNA: vcDNA=SeqID_2498; Strand=+; Position=110-586
  misc_feature: Homolog annotation: Hit_ID=NP_572610.1; Match level="QueryCoverage =95%, HitCoverage=96%, E-value=4e-48, Identity=64%"; Hit description =CG2968-PA [Drosophila melanogaster] gb|AAF46561.1| CG2968-PA [Drosophila melanogaster]
  misc_feature: Gene Ontology Annotation: Molecular function=hydrogen-transporting ATP synthase activity, rotational mechanism; Cellular component =proton-transporting ATP synthase, central stalk (sensu Eukarya); Biological process=ATP synthesis
  misc_feature: Pfam annotation: Pfam_ID=ATP-synt_DE_N; Match level="Score=92.5, E -value=1.1e-24, Copies=1"; Pfam description=ATP synthase, Delta/Epsilon chain, bet
MAAIRSMSRLLINRSLQTTAKRTYADQMNFTFAAGNQVYYTATSVKQVDVPSFSGSFGILPAHVPTLAVLKPGVVTVYEDGGNVKKIFVSSGTVTINDDSSVQILAEEAHPVENIDVNAARDILTKAQSQLSSASTDEAKAEASIAVEVGEALVKAAE

SEQ ID NO: 22802 - protein, 312 aa, Diabrotica virgifera
  misc_feature: Coding regions on vcDNA: vcDNA=SeqID_2499; Strand=-; Position=2-937
  misc_feature: Homolog annotation: Hit_ID=CAA37130.1; Match level="QueryCoverage =85%, HitCoverage=15%, E-value=1e-20, Identity=33%"; Hit description =RNA polymerase II [Arabidopsis thaliana]
  misc_feature: Gene Ontology Annotation: Molecular function=DNA-directed RNA polymerase II activity; Cellular component=DNA-directed RNA polymerase II, core complex; Biological process=regulation of transcription, DNA-dependent
LILISQTITIQGGGGVLILISQTITIQGRGGGRSSSHSSSHSYSHSSSHSYSHPSYHYSSPSYSHPSYHPSPSYSHPSPSYSHPSPSYSHPSPSYSHPSPSYSHPSAVSHPSAPIPAYHPLPAAPVYRPIGWNVGGSHPDSHASSGPIGPPKHVSGVGSSNTNHGPEITRPIGFATGGSTGHNTGSQPIGPPKTIAGVGNSGAHYGEKPPAYNPNYNPAGYGHPPAYNPAGYGSAPVHNSPQAGGGFNFPPPAYSPAGHPGYSSGGYHAPPAYSANPSGGHVTIINNNNHHYSYPAYVPTYHYTTADTGSSH

SEQ ID NO: 22803 - protein, 335 aa, Diabrotica virgifera
  misc_feature: Coding regions on vcDNA: vcDNA=SeqID_2500; Strand=-; Position=100-1107
  misc_feature: Homolog annotation: Hit_ID=S14181; Match level="QueryCoverage=90%, HitCoverage=44%, E-value=3e-28, Identity=39%"; Hit description=DNA -directed RNA polymerase (EC 2.7.7.6) largest chain  (isoform B1) - soybean (fragment)
  misc_feature: Gene Ontology Annotation: Molecular function=DNA-directed RNA polymerase II activity; Cellular component=DNA-directed RNA polymerase II, core complex; Biological process=regulation of transcription, DNA-dependent
MSRILGICVLILISQTITIQGRGGGRSSSHSSSHSYSHSSSHSYSHPSYHYSSPSYSHPSYHPSPSYSHPSPSYSHPSPSYSHPSPSYSHPSPSYSHPSPSYSHPSPSYSHPSPSYSHPSAVSHPSAPIPAYHPLPAAPVYRPIGWNVGGSHPDSHASSGPIGPPKHVSGVGSSNTNHGPEITRPIGFATGGSTGHNTGSQPIGPPKTIAGVGNSGAHYGEKPPAYNPNYNPAGYGHPPAYNPAGYGSAPVHNSPQAGGGFNFPPPAYSPAGHPGYSSGGYHAPPAYSANPSGGHVTIINNNNHHYSYPAYVPTYHYTTADTGSSHLGFFLGYSL

SEQ ID NO: 22804 - protein, 551 aa, Diabrotica virgifera
  misc_feature: Coding regions on vcDNA: vcDNA=SeqID_2501; Strand=+; Position=72-1727
  misc_feature: Homolog annotation: Hit_ID=EAA44524.2; Match level="QueryCoverage =99%, HitCoverage=99%, E-value=0.0, Identity=88%"; Hit description =ENSANGP00000024604 [Anopheles gambiae str. PEST] ref|XP_558522.1| ENSANGP00000024604 [Anopheles gambiae str.
  misc_feature: Gene Ontology Annotation: Molecular function=hydrogen-transporting ATP synthase activity, rotational mechanism; Cellular component =extracellular space; Biological process=morphogenesis
  misc_feature: Pfam annotation: Pfam_ID=ATP-synt_ab; Match level="Score=385.2, E -value=8.7e-113, Copies=1"; Pfam description=ATP synthase alpha/beta family, nucle
MSLLSARLAASLARNAPKNVTQIAGAVFPAASVAARNFHATPQNKGAEISSILEERILGAAPKANLDETGRVLSIGDGIARVYGLNNIQADEMVEFSSGLKGMALNLEPDNVGVVVFGNDKLIKEGDIVKRTGAIVDVPVGDQILGRVVDALGNPIDGKGPLNTKQRFRVGIKAPGIIPRISVREPMQSGIKAVDSLVPIGRGQRELIIGDRQTGKTALAIDTIINQKRFNDAEDEKKKLYCIYVAIGQKRSTVAQILKRLTDTGAINYTIIVSATASDAAPLQYLAPYSGCAMGEFFRDNGKHALIIYDDLSKQAVAYRQMSLLLRRPPGREAYPGDVFYLHSRLLERAAKMSEAHGGGSLTALPVIETQAGDVSAYIPTNVISITDGQIFLETELFYKGIRPAINVGLSVSRVGSAAQTKAMKQVAGSMKLELAQYREVAAFAQFGSDLDAATQQLLNRGVRLTELLKQGQYVPMAIEEQVAIIYCGVRGHLDKVDPSKITVFEKQFSEHIKTSHKNILQSIAKEGKITDDTDAQLKKVVQDFLASFSG

SEQ ID NO: 22805 - protein, 88 aa, Diabrotica virgifera
  misc_feature: Coding regions on vcDNA: vcDNA=SeqID_2502; Strand=-; Position=297-563
SVYFQLLRNAFPLKCLLNKQFWNHEICDFENFDTLDFGSAPTETHCTRNFFFVISTAKTTVIRLQGNPPETGFQPYFKTVTSWELDLM

SEQ ID NO: 22806 - protein, 133 aa, Diabrotica virgifera
  misc_feature: Coding regions on vcDNA: vcDNA=SeqID_2503; Strand=+; Position=1-402
LAGRYKTLNDFNEINIPINFKQFLKIFFFSGDSIEGKIVHISARLRTQTACSSLLIFQDRYVCICNRANKSLKECISVFGKCIICYNSCVFGFVFLCSKIMKYYVGITFLHYLSPCCVIISETYTSITRTSLE

SEQ ID NO: 22807 - protein, 97 aa, Diabrotica virgifera
  misc_feature: Coding regions on vcDNA: vcDNA=SeqID_2504; Strand=+; Position=127-420
  misc_feature: Homolog annotation: Hit_ID=XP_393139.1; Match level="QueryCoverage =97%, HitCoverage=100%, E-value=5e-36, Identity=77%"; Hit description= similar to transport protein Sec61 beta subunit [Apis mellifera]
  misc_feature: Pfam annotation: Pfam_ID=Sec61_beta; Match level="Score=100.7, E -value=3.8e-27, Copies=1"; Pfam description=Sec61beta family
MPASPSSTNVGSGGRSPPKAVAPRSSMGSSVRQRKTTTTTTTARRNTGAGTGGMWRFYTDDSPGIKVGPVPVLVMSLLFIASVFMLHIWGKYTRSSS

SEQ ID NO: 22808 - protein, 57 aa, Diabrotica virgifera
  misc_feature: Coding regions on vcDNA: vcDNA=SeqID_2505; Strand=+; Position=102-275
MFVKVYLSSHFCSLWKNFNRKLMQLYESFSSEEKKEYGIEANNKERCCPNVTPKRNQ

SEQ ID NO: 22809 - protein, 236 aa, Diabrotica virgifera
  misc_feature: Coding regions on vcDNA: vcDNA=SeqID_2506; Strand=+; Position=1-711
  misc_feature: Homolog annotation: Hit_ID=AAP93583.1; Match level="QueryCoverage =80%, HitCoverage=39%, E-value=8e-82, Identity=76%"; Hit description =thioredoxin reductase [Apis mellifera ligustica]
  misc_feature: Gene Ontology Annotation: Molecular function=thioredoxin reductase (NADPH) activity; Cellular component=mitochondrion; Biological process=thioredoxin pathway
  misc_feature: Pfam annotation: Pfam_ID=Pyr_redox; Match level="Score=-36.5, E-value= 6e-05, Copies=1"; Pfam description=Pyridine nucleotide-disulphide oxidore
TVFCFRHVNFRGVVKGVLWASDTVPNLRVNFARKFSTSRCRYQTAEYDLIVIGGGSGGLAAKEASNLGAKVAVLDYVTPSPKGTKWGLGGTCVNVGCIPKKLMHQAALLGEAVHDAQTYGWQLPQPENISHNWEALKDAVQGHIKSVNWVTRVELRDKSVEYINGLGTFVDPHTIHAQTKKGDKTLTGKNIIIAVGGRPRYPDIPGAVEYGISSDDIFSLEKPPGKTLVVGAGYIG

SEQ ID NO: 22810 - protein, 64 aa, Diabrotica virgifera
  misc_feature: Coding regions on vcDNA: vcDNA=SeqID_2507; Strand=-; Position=460-654
YIPYSRADTASSPRCLTRIGFQKLKNLSELLAQQIGICLNSKHLASFTGHSATVLQKEDLDNAV

SEQ ID NO: 22811 - protein, 165 aa, Diabrotica virgifera
  misc_feature: Coding regions on vcDNA: vcDNA=SeqID_2508; Strand=+; Position=89-586
  misc_feature: Homolog annotation: Hit_ID=EAL25466.1; Match level="QueryCoverage =100%, HitCoverage=100%, E-value=2e-76, Identity=84%"; Hit description=GA16582-PA [Drosophila pseudoobscura]
  misc_feature: Gene Ontology Annotation: Molecular function=structural constituent of ribosome; Cellular component=cytosolic large ribosomal subunit (sensu Eukarya)
  misc_feature: Pfam annotation: Pfam_ID=Ribosomal_L11; Match level="Score=93.0, E -value=7.8e-25, Copies=1"; Pfam description=Ribosomal protein L11, RNA binding do
MPPKFDPTEIKYVYMRCVGGEVGATSSLAPKIGPLGLSPKKVGDDIAKGTADWKGLKITVQLKIQNRQATISVVPSASSLIIRALKEPPRDRKKQKNIKHTGNITFDEIIAIARQMRPRSMAKQLSGTVKEVLGTAQSVGCTIDGKAAHDVIDEVNEGTIEVPDE

SEQ ID NO: 22812 - protein, 340 aa, Diabrotica virgifera
  misc_feature: Coding regions on vcDNA: vcDNA=SeqID_2509; Strand=+; Position=128-1147
  misc_feature: Homolog annotation: Hit_ID=XP_393517.1; Match level="QueryCoverage =98%, HitCoverage=64%, E-value=1e-131, Identity=68%"; Hit description= similar to thioredoxin reductase [Apis mellifera]
  misc_feature: Gene Ontology Annotation: Molecular function=thioredoxin reductase (NADPH) activity; Cellular component=mitochondrion; Biological process=thioredoxin pathway
  misc_feature: Pfam annotation: Pfam_ID=Pyr_redox; Match level="Score=269.7, E-value= 5.1e-78, Copies=1"; Pfam description=Pyridine nucleotide-disulphide oxidor
MAPIDQTAEYDLIVIGGGSGGLAAAKEASNLGAKVAVLDYVTPSPKGTKWGLGGTCVNVGCIPKKLMHQAALLGEAVHDAQTYGWQLPQPENISHNWEALKDAVQGHIKSVNWVTRVELRDKSVEYINGLGTFVDPHTIHAQTKKGDKTLTGKNIIIAVGGRPRYPDIPGAVEYGISSDDIFSLEKPPGKTLVVGAGYIGLECAGFLNGLGYDATIMVRSIILRGFDQQMANVIQAEMKEKGVKFLPRTVPTEIKKGDDGRLHVAYKNDKGETASDIFDTVLFAIGRRALTKELHLENAGVKVAGDGEKIDVVNEQTNVPNIYAVKEMFYIKSQNLTPVA

SEQ ID NO: 22813 - protein, 308 aa, Diabrotica virgifera
  misc_feature: Coding regions on vcDNA: vcDNA=SeqID_2510; Strand=+; Position=103-1026
  misc_feature: Homolog annotation: Hit_ID=XP_393517.1; Match level="QueryCoverage =95%, HitCoverage=56%, E-value=1e-118, Identity=70%"; Hit description= similar to thioredoxin reductase [Apis mellifera]
  misc_feature: Gene Ontology Annotation: Molecular function=thioredoxin reductase (NADPH) activity; Cellular component=mitochondrion; Biological process=thioredoxin pathway
  misc_feature: Pfam annotation: Pfam_ID=Pyr_redox; Match level="Score=229.3, E-value= 7.3e-66, Copies=1"; Pfam description=Pyridine nucleotide-disulphide oxidor
MAPIDQTAEYDLIVIGGGSGGLAAAKEASNLGAKVAVLDYVTPSPKGTKWGLGGTCVNVGCIPKKLMHQAALLGEAVHDAQTYGWQLPQPENISHNWEALKDAVQGHIKSVNWVTRVELRDKSVEYINGLGTFVDPHTIHAQTKKGDKTLTGKNIIIAVGGRPRYPDIPGAVEYGISSDDIFSLEKPPGKTLVVGAGYIGLECAGFLNGLGYDATIMVRSIILRGFDQQMANVIQAEMKEKGVKFLPRTVPTEIKKGDDGRLHVAYKNDKGETASDIFDTVLFAIGRRALTKELHLEKRRRQSCWRWR

SEQ ID NO: 22814 - protein, 305 aa, Diabrotica virgifera
  misc_feature: Coding regions on vcDNA: vcDNA=SeqID_2511; Strand=+; Position=20-937
  misc_feature: Homolog annotation: Hit_ID=AAP93583.1; Match level="QueryCoverage =81%, HitCoverage=51%, E-value=1e-106, Identity=73%"; Hit description= thioredoxin reductase [Apis mellifera ligustica]
  misc_feature: Gene Ontology Annotation: Molecular function=thioredoxin reductase (NADPH) activity; Cellular component=mitochondrion; Biological process=thioredoxin pathway
  misc_feature: Pfam annotation: Pfam_ID=Pyr_redox; Match level="Score=142.4, E-value= 1.1e-39, Copies=1"; Pfam description=Pyridine nucleotide-disulphide oxidor
MATVFCFRHVNFRGVVKGVLWASDTVPNLRVNFARKFSTSRCRYQTAEYDLIVIGGGSGGLAAAKEASNLGAKVAVLDYVTPSPKGTKWGLGGTCVNVGCIPKKLMHQAALLGEAVHDAQTYGWQLPQPENISHNWEALKDAVQGHIKSVNWVTRVELRDKSVEYINGLGTFVDPHTIHAQTKKGDKTLTGKNIIIAVGGRPRYPDIPGAVEYGISSDDIFSLEKPPGKTLVVGAGYIGLECAGFLNGLGYDATIMVRSIILRGFDQQMANVIQAEMKEKGVKFLPRTVPTKKKKKGPQPPCLEK

SEQ ID NO: 22815 - protein, 165 aa, Diabrotica virgifera; identical to SEQ ID NO: 22811
  misc_feature: Coding regions on vcDNA: vcDNA=SeqID_2512; Strand=+; Position=111-608
  misc_feature: Homolog annotation: Hit_ID=EAL25466.1; Match level="QueryCoverage =100%, HitCoverage=100%, E-value=2e-76, Identity=84%"; Hit description=GA16582-PA [Drosophila pseudoobscura]
  misc_feature: Gene Ontology Annotation: Molecular function=structural constituent of ribosome; Cellular component=cytosolic large ribosomal subunit (sensu Eukarya)
  misc_feature: Pfam annotation: Pfam_ID=Ribosomal_L11; Match level="Score=93.0, E -value=7.8e-25, Copies=1"; Pfam description=Ribosomal protein L11, RNA binding do

SEQ ID NO: 22816 - protein, 105 aa, Diabrotica virgifera
  misc_feature: Coding regions on vcDNA: vcDNA=SeqID_2513; Strand=+; Position=116-433
  misc_feature: Homolog annotation: Hit_ID=AAF16695.1; Match level="QueryCoverage =93%, HitCoverage=93%, E-value=2e-32, Identity=63%"; Hit description =thioredoxin-like protein [Manduca sexta]
  misc_feature: Gene Ontology Annotation: Molecular function=thiol-disulfide exchange intermediate activity; Cellular component=flagellum (sensu Eukarya); Biological process=protein thiol-disulfide exchange
  misc_feature: Pfam annotation: Pfam_ID=Thioredoxin; Match level="Score=144.7, E -value=2.1e-40, Copies=1"; Pfam description=Thioredoxin
MVHHIKDKDDLEAKFKEAGTNLVVLDFSAAWCGPCKMISPKLDELAAEYPNVVIVKIDVDECEDLAMEYNIKSMPTFIFLKNGQEIANFSGANYERLKQTIEDNK

SEQ ID NO: 22817 - protein, 209 aa, Diabrotica virgifera
  misc_feature: Coding regions on vcDNA: vcDNA=SeqID_2514; Strand=+; Position=265-894
  misc_feature: Homolog annotation: Hit_ID=XP_393517.1; Match level="QueryCoverage =98%, HitCoverage=39%, E-value=7e-87, Identity=74%"; Hit description =similar to thioredoxin reductase [Apis mellifera]
  misc_feature: Gene Ontology Annotation: Molecular function=thioredoxin reductase (NADPH) activity; Cellular component=mitochondrion; Biological process=thioredoxin pathway
  misc_feature: Pfam annotation: Pfam_ID=Pyr_redox; Match level="Score=6.9, E-value =8.5e-08, Copies=1"; Pfam description=Pyridine nucleotide-disulphide oxidor
MAPIDQTAEYDLIVIGGGSGGLAAAKEASNLGAKVAVLDYVTPSPKGTKWGLGGTCVNVGCIPKKLMHQAALLGEAVHDAQTYGWQLPQPENISHNWEALKDAVQGHIKSVNWVTRVELRDKSVEYINGLGTFVDPHTIHAQTKKGDKTLTGKNIIIAVGGRPRYPDIPGAVEYGISSDDIFSLEKPPGKTLVVGAGYIGLECGRVFRG

SEQ ID NO: 22818 - protein, 128 aa, Diabrotica virgifera
  misc_feature: Coding regions on vcDNA: vcDNA=SeqID_2515; Strand=-; Position=667-1053
  misc_feature (118)..(118): Xaa can be any naturally occurring amino acid
YRNLVLSHTPYTWAYKHKQILKLGSYIYSIYMGLQTQINIEIWFLYELTQIKPFLLRLLMGVFPDNCKTLPHHEYYTCDMPDTRKHTSFLINKWRGLATVSLFTSSWGYFFKDDFSNXTCGNNIPKYR

SEQ ID NO: 22819 - protein, 181 aa, Diabrotica virgifera
  misc_feature: Coding regions on vcDNA: vcDNA=SeqID_2516; Strand=+; Position=9-554
  misc_feature: Homolog annotation: Hit_ID=AAL90009.1; Match level="QueryCoverage =91%, HitCoverage=35%, E-value=9e-17, Identity=34%"; Hit description =AT07338p [Drosophila melanogaster]
MYIKDHVDWDKNLAKIRQAINTAKHEVTGYTPAFLNYGRHVPLSGNYYGVDQNDQRKQDLEIIPGNRDMYASEVKGLSQVFEKVRANLRKGYERNARSYNLRRREVQFQVGDRVWKRNKVLSNAANKFMSKLAPRYIEATVREKLSPVVYRLSDLNGSDLGKWHVKDLKPFVSDGDNMSSP

SEQ ID NO: 22820 - protein, 492 aa, Diabrotica virgifera
  misc_feature: Coding regions on vcDNA: vcDNA=SeqID_2517; Strand=+; Position=193-1671
  misc_feature: Homolog annotation: Hit_ID=XP_393517.1; Match level="QueryCoverage =99%, HitCoverage=94%, E-value=0.0, Identity=71%"; Hit description =similar to thioredoxin reductase [Apis mellifera]
  misc_feature: Gene Ontology Annotation: Molecular function=thioredoxin reductase (NADPH) activity; Cellular component=mitochondrion; Biological process=thioredoxin pathway
  misc_feature: Pfam annotation: Pfam_ID=Pyr_redox; Match level="Score=294.5, E-value= 1.7e-85, Copies=1"; Pfam description=Pyridine nucleotide-disulphide oxidor
MAPIDQTAEYDLIVIGGGSGGLAAAKEASNLGAKVAVLDYVTPSPKGTKWGLGGTCVNVGCIPKKLMHQAALLGEAVHDAQTYGWQLPQPENISHNWEALKDAVQGHIKSVNWVTRVELRDKSVEYINGLGTFVDPHTIHAQTKKGDKTLTGKNIIIAVGGRPRYPDIPGAVEYGISSDDIFSLEKPPGKTLVVGAGYIGLECAGFLNGLGYDATIMVRSIILRGFDQQMANVIQAEMKEKGVKFLPRTVPTEIKKGDDGRLHVAYKNDKGETASDIFDTVLFAIGRRALTKELHLENAGVKVAGDGEKIDVVNEQTNVPNIYAVGDVLYKKPELTPVAILAGRFLARRLFGGASQVMDYENVATTVFSPLEYGCVGLSEETAIERFGEDNIEVYHGYYKPTEFFIPQKSIANCYLKVVAHREGNQKVVGLHFIGPNAGEIIQGFATAIKLNLTVKDLMETVGIHPTIAEEFTRINVTKRSGKDPHPASCCS

SEQ ID NO: 22821 - protein, 105 aa, Diabrotica virgifera; identical to SEQ ID NO: 22816
  misc_feature: Coding regions on vcDNA: vcDNA=SeqID_2518; Strand=+; Position=1248 -1565
  misc_feature: Homolog annotation: Hit_ID=AAF16695.1; Match level="QueryCoverage =93%, HitCoverage=93%, E-value=2e-32, Identity=63%"; Hit description =thioredoxin-like protein [Manduca sexta]
  misc_feature: Gene Ontology Annotation: Molecular function=thiol-disulfide exchange intermediate activity; Cellular component=flagellum (sensu Eukarya); Biological process=protein thiol-disulfide exchange
  misc_feature: Pfam annotation: Pfam_ID=Thioredoxin; Match level="Score=144.7, E -value=2.1e-40, Copies=1"; Pfam description=Thioredoxin

SEQ ID NO: 22822 - protein, 171 aa, Diabrotica virgifera
  misc_feature: Coding regions on vcDNA: vcDNA=SeqID_2519; Strand=+; Position=581-1096
  misc_feature: Homolog annotation: Hit_ID=EAL25466.1; Match level="QueryCoverage =85%, HitCoverage=87%, E-value=7e-58, Identity=77%"; Hit description =GA16582-PA [Drosophila pseudoobscura]
  misc_feature: Gene Ontology Annotation: Molecular function=structural constituent of ribosome; Cellular component=cytosolic large ribosomal subunit (sensu Eukarya)
  misc_feature: Pfam annotation: Pfam_ID=Ribosomal_L11_N; Match level="Score=82.8, E -value=9e-22, Copies=1"; Pfam description=Ribosomal protein L11, N -terminal dom
MPPKFDPTEIKYVYMRCVGGEVGATSSLAPKIGPLGLSPKKVGDDIAKGTADWKGLKITVQLKIQNRQATISVVPSASSLIIRALKEPPRDRKKQKNIKHTGNITFDEIIAIGRQMKAQSMGQQFIRNCKKKVLGQPQSVGMYNEGSVVQLSVNTFISSRSKKCLIPCELI

SEQ ID NO: 22823 - protein, 300 aa, Diabrotica virgifera
  misc_feature: Coding regions on vcDNA: vcDNA=SeqID_2520; Strand=+; Position=237-1139
  misc_feature: Homolog annotation: Hit_ID=XP_393517.1; Match level="QueryCoverage =98%, HitCoverage=56%, E-value=1e-118, Identity=70%"; Hit description= similar to thioredoxin reductase [Apis mellifera]
  misc_feature: Gene Ontology Annotation: Molecular function=thioredoxin reductase (NADPH) activity; Cellular component=mitochondrion; Biological process=thioredoxin pathway
  misc_feature: Pfam annotation: Pfam_ID=Pyr_redox; Match level="Score=218.2, E-value= 1.6e-62, Copies=1"; Pfam description=Pyridine nucleotide-disulphide oxidor
MAPIDQTAEYDLIVIGGGSGGLAAAKEASNLGAKVAVLDYVTPSPKGTKWGLGGTCVNVGCIPKKLMHQAALLGEAVHDAQTYGWQLPQPENISHNWEALKDAVQGHIKSVNWVTRVELRDKSVEYINGLGTFVDPHTIHAQTKKGDKTLTGKNIIIAVGGRPRYPDIPGAVEYGISSDDIFSLEKPPGKTLVVGAGYIGLECAGFLNGLGYDATIMVRSIILRGFDQQMANVIQAEMKEKGVKFLPRTVPTEIKKGDDGRLHVAYKNDKGETASDIFDTVLFAIGRRALTKELHLKNPP

SEQ ID NO: 22824 - protein, 183 aa, Diabrotica virgifera
  misc_feature: Coding regions on vcDNA: vcDNA=SeqID_2521; Strand=-; Position=191-742
YREHYIITFSINSPIQDIRTFHERSLDNSLIFKSQAGERLHFQNRATLHFSKQGIDFIFQDRGVGLYFSKLGIDLLFKTGGISFLKTGGGLYFSKRGATFSKQGVKATRKGKTKGTLESMTVLTNNRFHLSTESKLHLYSTRPDPNLTSLVTASALGLLSINKEKRGQLTIRQKKSNSSTDTG

SEQ ID NO: 22825 - protein, 77 aa, Diabrotica virgifera
  misc_feature: Coding regions on vcDNA: vcDNA=SeqID_2522; Strand=+; Position=3901 -4131
  misc_feature: Homolog annotation: Hit_ID=XP_393337.1; Match level="QueryCoverage =90%, HitCoverage=27%, E-value=1e-12, Identity=47%"; Hit description =similar to ENSANGP00000013280 [Apis mellifera]
  misc_feature: Gene Ontology Annotation: Molecular function=electron transporter activity; Cellular component=cellular_component unknown; Biological process=biological_process unknown
  misc_feature (31)..(31): Xaa can be any naturally occurring amino acid
ESPQVCGVTLADVDPSAGAKALEELEKEFGXNKAIFVQTDVRDRQQFEDAFKKTVETFKYIDILFNNAGILNDSTWD

SEQ ID NO: 22826 - protein, 310 aa, Diabrotica virgifera
  misc_feature: Coding regions on vcDNA: vcDNA=SeqID_2523; Strand=+; Position=54-983
YTTIVTNDGNEVKSAADYNFSACNITYVHPYLTVDEWCLISERISNFGEISCKQLLYKLFIQKVRALYIFEQKVNEEILQDLSRYITRDLEENWKYILQNKFLTNNLVPLMDSSSINLLADKLVANITDLDDTQLNQYIFNNSCVLNAVAYSIIVKSDKIISKRKRKHDEDLVDAKKLSTKVSNMVTVDTFCNDGHNEDLIKKLKKVYESYKVDHNVEVKFNEAKLLELLEVLKKFPVVFCKESVQKCFLVYLFSLHKELRQDFSKGRYVDVQSSLENIILGMLQQHKYRLDDIFNMETICPEVLTKFNE

SEQ ID NO: 22827 - protein, 898 aa, Diabrotica virgifera
  misc_feature: Coding regions on vcDNA: vcDNA=SeqID_2524; Strand=+; Position=11-2708
  misc_feature: Homolog annotation: Hit_ID=EAL29990.1; Match level="QueryCoverage =98%, HitCoverage=97%, E-value=0.0, Identity=57%"; Hit description =GA20026-PA [Drosophila pseudoobscura]
  misc_feature: Gene Ontology Annotation: Cellular component=transcription factor complex; Biological process=regulation of transcription, DNA -dependent
  misc_feature: Pfam annotation: Pfam_ID=SNase; Match level="Score=201.3, E-value =1.9e-57, Copies=4"; Pfam description=Staphylococcal nuclease homologue
  misc_feature (480)..(480): Xaa can be any naturally occurring amino acid
MTTQQPTPAPPKRGIIKQILSGDSVIIRAPSGAPPPEKQINFSSITAPKLARRAAESGETTKDEPWAWEAREFLRKKLIGEEVFFTSEKPPNAVREYGVVYLGKDFNTAENITESLVSEGLVTVREAVRPTPEITRLLELQDAAKSAGKGIWSGAPSSEHVRDIKWTIEKSKELVDQLQFKPVKAVIEHVRDGSTVRAFLLPDFYYVTLMLSGIRCPGFKLDANGKRDPNAKVEFAEEARYFVEVRLLQRDVEIVLEAVNNNNFIGTVIHPKGNIAELLLKEGLGKCVDWSIMLMKSNPDKLRAAEKQAKEGRRRLWKDFVPTAPKITGKEKEFSATVSEVNNGDALVLKMANGDSKKIFLASIRAPKEPGRANDDEGKPIPRPKGFRPLYDIPYMFEAREYLRKKLIGKKVHVVVDYIQEARDGFPEKVCATVTVGGKNVAEALVSKGLATVVKYRQDDDQRSCRYDELLTAETKANKXQVGVHSKKDAPPLRVTEIDAARAKLELPALQRAQRIDGIVEFVASGSRLRLYIPKSNSLCTFLLGGINCPRATRQATDTPGEPYGDEALLFTKERCMQREVSIQVDTHDKAGNFIGWLWVDNVNMSVALVKEGFASVHFTGEKSQYASLLKSAEDSAKSEKLRIWKNYVEEEKEEKHEEEKVPVERQVNFEEVVVTEVTPEGSFYIQKISEGPKAEALFAKLRQEFQANPPLPGAFTPKRGDICAAKFTVDDEWYRVKVEKVQGGKASVHYIDYGNKETLPTTRLASLPAAYVSERPFATEYVLPFIVLPKDEEFSSLAIKYLKEDTAVSKLYMNVEYRQPGSPAAASLHSDKTSDADIVKNLVKEGLLIVDNIKGRRNNKLLESYREAQETAKKQHANIWEYGDITEVDAKEFGLGV

SEQ ID NO: 22828 - protein, 216 aa, Diabrotica virgifera
  misc_feature: Coding regions on vcDNA: vcDNA=SeqID_2525; Strand=+; Position=48-698
  misc_feature: Homolog annotation: Hit_ID=AAM21563.1; Match level="QueryCoverage =98%, HitCoverage=100%, E-value=1e-72, Identity=62%"; Hit description= glutathione S-transferase [Nilaparvata lugens]
  misc_feature: Gene Ontology Annotation: Molecular function=glutathione transferase activity; Cellular component=cellular_component unknown; Biological process=glutathione conjugation reaction
  misc_feature: Pfam annotation: Pfam_ID=GST_N; Match level="Score=62.8, E-value=9.7e- 16, Copies=1"; Pfam description=Glutathione S-transferase, N-terminal
MPIDCYYVPGGAPSRNVLLAAKACGVELNLKYMDLMSGEQMSPEFLKLNPLHTVPTINDNGFVLFESRAIMTYLADQYGKDDNLYPKDPKKRAIVDQRLYFDMSTMYGRLADYYYPVIFGGASYDPDKLEKIKEAFSFLDQLIDNNDFAAGSNLTLADLALASSVSTYELLGFDFSSYKNVVRWFEKAKATIPGYEEANAEPLQQFKALMEKLAKK

SEQ ID NO: 22829 - protein, 250 aa, Diabrotica virgifera
  misc_feature: Coding regions on vcDNA: vcDNA=SeqID_2526; Strand=-; Position=40-792
  misc_feature: Homolog annotation: Hit_ID=P12261; Match level="QueryCoverage=99%, HitCoverage=58%, E-value=6e-75, Identity=57%"; Hit description =Elongation factor 1-gamma (EF-1-gamma) (eEF-1B gamma) gb|AAC83401.1| elongation factor
  misc_feature: Gene Ontology Annotation: Molecular function=translation elongation factor activity; Cellular component=intracellular; Biological process=translational elongation
  misc_feature: Pfam annotation: Pfam_ID=GST_C; Match level="Score=91.5, E-value=2.2e- 24, Copies=1"; Pfam description=Glutathione S-transferase, C-terminal
RVPAFESNDGKYLQDSNAIAYYVSNEQLRGKNEYDRAQILQWIGFAEGEIVPAACAWVFPILGIVKNNSGNDETFQRAKEDLKSSLSILNSHLLAHTYLVGERITLADIVVACNLLNAYKYVLDPNFRKSFGNVNRWFNTLINQPQFIAVLGEVKLCSAVAQPGTLTAAAATPGKGKKKEEKKQEKKPQTPKEKKEKEQPEELDAAEAALAEEPKSKDPFSELPKGTFVMDDFKRVYSNEEESKSIAYFK

SEQ ID NO: 22830 - protein, 85 aa, Diabrotica virgifera
  misc_feature: Coding regions on vcDNA: vcDNA=SeqID_2527; Strand=+; Position=55-312
IPSSKPPHCWGQIDGLKFSFCNGHSVTVGTTSSDKHEYHLQNHHIVGFFLANDFDPLEGQAANIFVSFQLCQVDGSSNDKCVISR

SEQ ID NO: 22831 - protein, 98 aa, Diabrotica virgifera
  misc_feature: Coding regions on vcDNA: vcDNA=SeqID_2528; Strand=+; Position=879-1175
  misc_feature: Homolog annotation: Hit_ID=UQWO7A; Match level="QueryCoverage=90%, HitCoverage=57%, E-value=2e-37, Identity=86%"; Hit description =ubiquitin / ribosomal protein S27a - tobacco hornworm emb|CAA37599.1| unnamed protein product
  misc_feature: Gene Ontology Annotation: Biological process=cell cycle
  misc_feature: Pfam annotation: Pfam_ID=ubiquitin; Match level="Score=84.2, E-value =3.4e-22, Copies=1"; Pfam description=Ubiquitin family
GFNEDLHFGVQPSDTIENVKANIHDKQGIPPDQQRHIFAGKQLEDGRTVSDYNIHNESTLHLVLRLRGGAKKRMKKNYSTPKKIKHKKNNVKLAVLNF

SEQ ID NO: 22832 - protein, 277 aa, Diabrotica virgifera
  misc_feature: Coding regions on vcDNA: vcDNA=SeqID_2529; Strand=-; Position=24-857
  misc_feature: Homolog annotation: Hit_ID=AAL78751.1; Match level="QueryCoverage =100%, HitCoverage=58%, E-value=4e-84, Identity=57%"; Hit description= translation elongation factor-1 gamma [Locusta migratoria]
  misc_feature: Gene Ontology Annotation: Molecular function=translation elongation factor activity; Cellular component=intracellular; Biological process=translational elongation
  misc_feature: Pfam annotation: Pfam_ID=GST_C; Match level="Score=91.5, E-value=2.2e- 24, Copies=1"; Pfam description=Glutathione S-transferase, C-terminal
MAAGTLSTYPENFRAAKTLIAAQYAKANVKVAPNFVFGETNKTKEFTKKFPSGKVPAFESNDGKYLQDSNAIAYYVSNEQLRGKNEYDRAQILQWIGFAEGEIVPAACAWVFPILGIVKNNSGNDETFQRAKEDLKSSLSILNSHLLAHTYLVGERITLADIVVACNLLNAYKYVLDPNFRKSFGNVNRWFNTLINQPQFIAVLGEVKLCSAVAQPGTLTAAAATPAAHNKAKPNGDAEIVEKTNKKKSKGKKKEEKKQEKKPQTPKEKKEKEQPEE

SEQ ID NO: 22833 - protein, 157 aa, Diabrotica virgifera
  misc_feature: Coding regions on vcDNA: vcDNA=SeqID_2530; Strand=+; Position=289-762
  misc_feature: Homolog annotation: Hit_ID=CAH04348.1; Match level="QueryCoverage =99%, HitCoverage=100%, E-value=2e-84, Identity=98%"; Hit description= ubiquitin/S27Ae ribosomal protein [Biphyllus lunatus] emb|CAH04347.1| ubiquitin/S27Ae ribosomal protein [
  misc_feature: Gene Ontology Annotation: Biological process=cell cycle
  misc_feature: Pfam annotation: Pfam_ID=ubiquitin; Match level="Score=154.3, E-value= 2.7e-43, Copies=1"; Pfam description=Ubiquitin family
MQIFVKTLTGKTITLEVEPSDTIENVKAKIQDKEGIPPDQQRLIFAGKQLEDGRTLSDYNIQKESTLHLVLRLRGGAKKRKKKNYSTPKKIKHKKKKVKLAVLKFYKVDENGKIHRLRRECPAEQCGAGVFMAAMEDRHYCGKCGYTLVFSKPGDEK

SEQ ID NO: 22834 - protein, 238 aa, Diabrotica virgifera
  misc_feature: Coding regions on vcDNA: vcDNA=SeqID_2531; Strand=-; Position=1292 -2008
  misc_feature (231)..(231): Xaa can be any naturally occurring amino acid
SVKQSETLIIPSLNLANPADNLVNGCEYEIIIETHDLLENLEQTLIYQIPDCVQDKCKCAKSSPYQLSSIIPVHDDVYFLKWDKLSNEELTLLDVYYIRDDNSTAPSQVKQCNVSDDGAEITLPDLKESVSYRITARFYYDGCNYPSFITFTVPEERNPLTVIFVLVLAVIFVLMFLYTLVMSSNRLKAKLASYKKYISCWDEEIGDLQATSPLSHTILKEEVTNSQYTPXGICNECT

SEQ ID NO: 22835 - protein, 426 aa, Diabrotica virgifera
  misc_feature: Coding regions on vcDNA: vcDNA=SeqID_2532; Strand=-; Position=241-1522
  misc_feature: Homolog annotation: Hit_ID=XP_393200.1; Match level="QueryCoverage =88%, HitCoverage=31%, E-value=6e-22, Identity=27%"; Hit description =similar to testis spermatogenesis apoptosis-related protein 6 [Apis mellifera]
  misc_feature (379)..(379): Xaa can be any naturally occurring amino acid
MANKNNFLKSKKKNDCFYGNEQYWENLNLYSSNRIRILLFKECRLRDRELIFDSYRETKDQNGPTKEEKNKPEEFSHLTEMIFGSTAMKYHDTYFKIHDVSFPDRLIFTQVFSTPLVKKLSNSKSSLNNSNIDFSNNSFTESCNSFANSGSEPSFGSNSDSFSLIRNVNWISPNSTSTTIDSGFSESSFSRNSSFTQYSGGFSTRRSSTSCTSLDTFGSFLSEADSARNFRMNVSYSKLGLALIVPKPIVEYNEENIYLQHIPLIESILWRVRQYVEIALNSPRLFLSTMLEISLLSAKWLSHELNFWSKPGNEPQSKFHLNFAISLRNSLNKLTFPSNIFRSNVREERFENFCQVLEKLETKETKFFMSTLLTAILTXHTGWIAACHPLERISLDDSYHAIWNQLTNLFGATGYLKKHQKLVYNG

SEQ ID NO: 22836 - protein, 428 aa, Diabrotica virgifera
  misc_feature: Coding regions on vcDNA: vcDNA=SeqID_2533; Strand=-; Position=1435 -2721
  misc_feature: Homolog annotation: Hit_ID=AAL78751.1; Match level="QueryCoverage =100%, HitCoverage=100%, E-value=1e-168, Identity=67%"; Hit description=translation elongation factor-1 gamma [Locusta migratoria]
  misc_feature: Gene Ontology Annotation: Molecular function=translation elongation factor activity; Cellular component=intracellular; Biological process=translational elongation
  misc_feature: Pfam annotation: Pfam_ID=EF1G; Match level="Score=273.6, E-value=3.2e- 79, Copies=1"; Pfam description=Elongation factor 1 gamma, conserved
MAAGTLYTYPENFRAAKTLIAAQYAKANVKVAPNFVFGETNKTKEFTKKFPSGKVPAFESNDGKYLQDSNAIAYYVSNEQLRGKNEYDRAQILQWIGFAEGEIVPAACAWVFPILGIVKNNSGNDETFQRAKEDLKSSLSILNSHLLAHTYLVGERITLADIVVACNLLNAYKYVLDPNFRKSFGNVNRWFNTLINQPQFIAVLGEVKLCSAVAQPGTLTAAAATPGKGKKKEEKKQEKKPQTPKEKKEKEQPEELDAAEAALAEEPKSKDPFSELPKGTFVMDDFKRVYSNEEESKSIAYFWEKFDPENYSIWYGEYKYPEELSKVFMSCNLITGMQQRLDKMRKQAFASVCLFGEDNNSTISGIWVWRGQELAFTLSPDWQIDYESYEWKKLDAKSEETKKLVEQYFSWTGTDKQGRKFNQGKIFK

SEQ ID NO: 22837 - protein, 525 aa, Diabrotica virgifera
  misc_feature: Coding regions on vcDNA: vcDNA=SeqID_2534; Strand=+; Position=831-2408
  misc_feature: Homolog annotation: Hit_ID=AAC63217.1; Match level="QueryCoverage =96%, HitCoverage=98%, E-value=1e-88, Identity=35%"; Hit description =juvenile hormone esterase-related protein [Leptinotarsa decemlineata]
  misc_feature: Pfam annotation: Pfam_ID=Endotoxin_N; Match level="Score=-108.9, E -value=0.081, Copies=1"; Pfam description=delta endotoxin, N-terminal domain
MQKYNCNIFTLNPKATRLVSQQDTGLILPMCHTNYYVYNVGKTSVKVTVKAGTRIMWIRNVKTLTLEPGQDAYLDMSKTKCLVSGVDLTNTEDIRGYVHCCQVTGYPFYDNSDSSIPIDINMVSKILTSVGPAAIPKAADDLSKIIHIFWPENQESLWEKINSVILHLLDTSRQELVQSVISKLAQIAERLRTVMHELEEGKPTVQQKFLSILEDLVDFQNKFRLERRETQENLRPSYKLLPYYSAVVNLRLKINQFAIINRDKLSLDEAAVKHIQVWSDNLINDPESGAIGYITSLSKDRLEMEYKTCYAELLYDGLVTVRGYCILSGLQFFPLWKSIVDYPNSTEEPYNDVIIYSTYWGRATPRLHRQMVTEDHVPPVKPALVNGKRNQPTSIVVYTLKDKVSGDPVISGLTVQYENGEKSVTGKVSPDFQIIEFDGNHVTSVSAYGWGQIDGLKFSFCNGHSVTVGTTSSDKHEYHLQNHHIVGFFLANDFDPLEGQAANIFVSFQLCQVDGSSNDKCVISR

SEQ ID NO: 22838 - protein, 263 aa, Diabrotica virgifera
  misc_feature: Coding regions on vcDNA: vcDNA=SeqID_2535; Strand=+; Position=130-918
  misc_feature: Homolog annotation: Hit_ID=NP_573109.1; Match level="QueryCoverage =98%, HitCoverage=43%, E-value=1e-108, Identity=74%"; Hit description= CG3415-PA [Drosophila melanogaster] gb|AAF48572.1| CG3415-PA [Drosophila melanogaster]
  misc_feature: Gene Ontology Annotation: Molecular function=sterol transporter activity; Cellular component=peroxisome; Biological process=protein targeting
  misc_feature: Pfam annotation: Pfam_ID=adh_short; Match level="Score=193.8, E-value= 3.5e-55, Copies=1"; Pfam description=short chain dehydrogenase
MSDLRFDGRVVVVTGAGAGLGRAYALLFASRGAKVVVNDLGGGRHGDGSSSKAADTVVEEIKRNGGTAVADYNSVVEGEKIVKTAIDNFGRIDVLINNAGILRDKSFAKISDQDWDLVHNVHLKGSFKATQAAFPYFKKQNYGRIIMTSSNSGIYGNFGQANYSAAKLGLVGLANTIAIEGAKNNVYCNVIVPTAASRLTEDILPPDVFAQLKPELIAPVVAYLCHDSCQDNGSIIESAAGCAGRCTIVRSDGALLRKNLADG

SEQ ID NO: 22839 - protein, 387 aa, Diabrotica virgifera
  misc_feature: Coding regions on vcDNA: vcDNA=SeqID_2536; Strand=+; Position=98-1257
  misc_feature: Homolog annotation: Hit_ID=NP_573109.1; Match level="QueryCoverage =98%, HitCoverage=64%, E-value=1e-135, Identity=62%"; Hit description= CG3415-PA [Drosophila melanogaster] gb|AAF48572.1| CG3415-PA [Drosophila melanogaster]
  misc_feature: Gene Ontology Annotation: Molecular function=sterol transporter activity; Cellular component=peroxisome; Biological process=protein targeting
  misc_feature: Pfam annotation: Pfam_ID=adh_short; Match level="Score=197.4, E-value= 2.9e-56, Copies=1"; Pfam description=short chain dehydrogenase
  misc_feature (343)..(343): Xaa can be any naturally occurring amino acid
  misc_feature (366)..(366): Xaa can be any naturally occurring amino acid
MSDLRFDGRVVVVTGAGAGLGRAYALLFASRGAKVVVNDLGGGRHGDGSSSKAADTVVEEIKRNGGTAVADYNSVVEGEKIVKTAIDNFGRIDVLINNAGILRDKSFAKISDQDWDLVHNVHLKGSFKATQAAFPYFKKQNYGRIIMTSSNSGIYGNFGQANYSAAKLGLVGLANTIAIEGAKNNVYCNVIVPTAASRLTEDILPPDVFAQLKPELIAPVVAYLCHESCQENGSIIESAAGWAGRCTIVRSDGALLRKNLADGVSLENVRDNWEAVRDISNAKRLENMQEVTMALVTSFTNEESGGNAEVSDVFNYCSKDTILYALGVGASVATKDELRYLYXNHEDFSVLPTFFIMPAMQVLFTXPFGDIIPGKQVSLENISHATV

SEQ ID NO: 22840 - protein, 542 aa, Diabrotica virgifera
  misc_feature: Coding regions on vcDNA: vcDNA=SeqID_2537; Strand=+; Position=108-1732
  misc_feature: Homolog annotation: Hit_ID=XP_312591.1; Match level="QueryCoverage =95%, HitCoverage=69%, E-value=8e-58, Identity=27%"; Hit description =ENSANGP00000014306 [Anopheles gambiae]
  misc_feature: Gene Ontology Annotation: Molecular function=molecular_function unknown; Cellular component=mitochondrial inner membrane; Biological process=biological_process unknown
  misc_feature (224)..(224): Xaa can be any naturally occurring amino acid
  misc_feature (511)..(511): Xaa can be any naturally occurring amino acid
  misc_feature (517)..(517): Xaa can be any naturally occurring amino acid
  misc_feature (530)..(532): Xaa can be any naturally occurring amino acid
MLRFIKRIPNKKNWKNCTPALTVYRSINYNYNNNANYTTSGRSYSQGSKHSEQGGGGGGKGFFLTVGALITAGGATLAYAKYDPDFRKTLVGFVPFTDDVIKTIWQEDNLYSSNSNILSSYYESSKKAIFDLFTGKPTTESKYISSKEISELPSSEVYKAPPPILPVIEKEMKKPPPPSYAEIRLEKIESGKLEPVVELAGEPKPKPITVATDSPTTENLAKPXVATDSPTTENLAKLEENIRVSAEEAVNAFNKAVFIIKSYNSDIEYIIEEAGNEVKPETWDTLKSKTRSKHECVRRATEKAEIAVRDINKLKEIVSKPSFDADPITKQTIQSNISRVQEDIEHARREFEHEQKMGSVAEKYWDKVEKARQNFSEELESLFPTIDLSKKHLCINEEDLDLFVLHTYAHVLYYQKELAKMETIVQERLRNATEVARLGGGEVLNNAQICEAVEQEKRRLTLCFQQQVLKLRKQHEIELREALKRQSQTFTDHLEEAVRRRAEEIERELTXKYDELXEEERVQAKFHWQXXXGRLKGLDEAI

SEQ ID NO: 22841 - protein, 374 aa, Diabrotica virgifera
  misc_feature: Coding regions on vcDNA: vcDNA=SeqID_2538; Strand=+; Position=329-1453
  misc_feature: Homolog annotation: Hit_ID=XP_312591.1; Match level="QueryCoverage =94%, HitCoverage=50%, E-value=2e-26, Identity=23%"; Hit description =ENSANGP00000014306 [Anopheles gambiae]
KKLEDCTPALTVYRSINYNYNNNANYTTSGRSYSQGSKHSEQGGGGGGKGFFLTVGALITAGGATLAYAKYDPDFRKTLVGFVPFTDDVIKTIWQEDNLYSSNSNILSSYYESSKKAIFDLFTGKPTTESKYISSKEISELPSSEVYKAPPPILPVIEKEMKKPPPPSYAEIRLEKIESGKLEPVVELAGEPKPKPITVATDSPTTENLAKLEENIRVSAEEAVNAFNKAVFIIKSYNSDIEYIIEEAVNEVKPETWDTLKSKTRSKHECVRRATEKAEIAVRDINKLKEIVSKPSFDADPITKQTIQSNISRVQEDIEHARREFKHEQKMGSVAEKNWEKGKKAKKNFSEKLEKLFLKKKNSFKKKNLNGKNF

SEQ ID NO: 22842 - protein, 179 aa, Diabrotica virgifera
  misc_feature: Coding regions on vcDNA: vcDNA=SeqID_2539; Strand=+; Position=164-698
  misc_feature: Homolog annotation: Hit_ID=XP_396320.1; Match level="QueryCoverage =99%, HitCoverage=59%, E-value=1e-73, Identity=74%"; Hit description =similar to ENSANGP00000020956 [Apis mellifera]
  misc_feature: Gene Ontology Annotation: Molecular function=ubiquitin-specific protease activity; Cellular component=endoplasmic reticulum; Biological process=skeletal development
  misc_feature: Pfam annotation: Pfam_ID=UFD1; Match level="Score=319.7, E-value=4.4e- 93, Copies=1"; Pfam description=Ubiquitin fusion degradation protein
  misc_feature (142)..(142): Xaa can be any naturally occurring amino acid
MFQFGFNMFPEVPRPFNMTYKCYSVAMFPGNEREDVERGGKIIMPPSALEQLTRLNINYPMLFKLVNKKTHRTTHCGVLEFVADEGKVYLPLWMMNNLVLTEGDLVQMESVSLPVGTFSKFQPLNPDFLDITNPKAVLENGXLRSFAFLTTRDVIAVKYNQKAYELCVPETKPGDAISI

SEQ ID NO: 22843 - protein, 126 aa, Diabrotica virgifera
  misc_feature: Coding regions on vcDNA: vcDNA=SeqID_2540; Strand=-; Position=411-791
  misc_feature: Homolog annotation: Hit_ID=ZP_00357698.1; Match level="QueryCoverage =79%, HitCoverage=33%, E-value=3e-19, Identity=67%"; Hit description =hypothetical protein Chlo02002738 [Chloroflexus aurantiacus]
NPPGGPFPPKTPFPQTGTLFLNKKGHFFFPPGGGVFFFFFKKFKKKNFFKTPPQNSFPKKTKKRGGGFKSGGPPPFFFFFFFFFFFFFFFFFFFFFFFFFFFFFFFFFFFFFFFFFFFFLIVQKLY

SEQ ID NO: 22844 - protein, 286 aa, Diabrotica virgifera
  misc_feature: Coding regions on vcDNA: vcDNA=SeqID_2541; Strand=+; Position=52-912
  misc_feature: Homolog annotation: Hit_ID=EAA07010.3; Match level="QueryCoverage =60%, HitCoverage=13%, E-value=3e-16, Identity=30%"; Hit description =ENSANGP00000000514 [Anopheles gambiae str. PEST] ref|XP_559158.1| ENSANGP00000000514 [Anopheles gambiae st
  misc_feature: Gene Ontology Annotation: Molecular function=transcription co -activator activity; Biological process=transcription from Pol II promoter
EIQEPGHIIDLGNKLREEQKKRAELVQEIHNLKVQLMQCKSNEMTTSVDEIADQLKRELDNSIKIDSNIMSAVSDQSLSSISEVQDVEAYKKSLAKEKACKKQLLELVNTLQDRITTLQNDLEKERATLVCNSTEDAQCIEQLRIQLDAALEANEALKRAISERESENEQLEKDLESLKRKNISSASRSESTKYKELPSKESIALNKLQKDHDVLLGEQSKLIGELAGLRQTHLDMTTDYKCTKDLLALEMQRKKNLGGEGLQFADARKGTDREAYADNTGKRKEL

SEQ ID NO: 22845 - protein, 176 aa, Diabrotica virgifera
  misc_feature: Coding regions on vcDNA: vcDNA=SeqID_2542; Strand=-; Position=395-924
  misc_feature: Homolog annotation: Hit_ID=XP_317949.1; Match level="QueryCoverage =94%, HitCoverage=35%, E-value=2e-28, Identity=40%"; Hit description =ENSANGP00000020548 [Anopheles gambiae]
  misc_feature (77)..(77): Xaa can be any naturally occurring amino acid
  misc_feature (129)..(129): Xaa can be any naturally occurring amino acid
FTITKGTQKYGMLRSLMKSKFVSRKTKERIYKTVIRATVVYGAELWVLRKADEERLERWERKILRSIYGGINTQMGXRRRTNKELEELYTEPKITAIIKAHRIRILGHVQRLENHRMTRMILNRKPVGXKRKGRPRKRWFNSVQADLGEIKIDNWRHKVLDRKEWRGVVRRAQEKL

SEQ ID NO: 22846 - protein, 349 aa, Diabrotica virgifera
  misc_feature: Coding regions on vcDNA: vcDNA=SeqID_2543; Strand=+; Position=2-1051
  misc_feature: Homolog annotation: Hit_ID=XP_392838.1; Match level="QueryCoverage =93%, HitCoverage=45%, E-value=1e-129, Identity=73%"; Hit description= similar to ENSANGP00000022650 [Apis mellifera]
  misc_feature: Gene Ontology Annotation: Molecular function=transcription cofactor activity; Cellular component=nucleus; Biological process=SMAD protein heteromerization
  misc_feature: Pfam annotation: Pfam_ID=MH2; Match level="Score=458.0, E-value=1.1e -134, Copies=1"; Pfam description=MH2 domain
PTSQNPVQQPIPPEPIPQNLTNNSPVSPHIQQNEFTNTNNTTVVASNNNGTVSSTQSTNTIGQNFTGASGTWNGSNTLTYTQSMQPPDNRSHTAYWISSPNQINSEVSIGGLLSTQPAPEYWCSVAYFELDTQVGETFKVPSNCPNVTVDGYVDPSGGNRFCLGALSNVHRTEHSERARLHIGKGVQLDLRGEGDVWLRCLSDHSVFVQSYYLDREAGRQPGDAVHKIYPGAYIKVFDLRQCHHQMTTQAATAQAAAAAQAAAVAGHIPGPHSVGGIAPAIRLSAATGIGVDDLRRLCILRLSFVKGWGPDYPRQSIKETPCWIEVHLHRALQLLDEVLHTMPIDGPRQ

SEQ ID NO: 22847 - protein, 282 aa, Diabrotica virgifera
  misc_feature: Coding regions on vcDNA: vcDNA=SeqID_2544; Strand=+; Position=40-888
MDILLTLPKDIDTEVLLRRIEKQNENVDTSKWNLTSKKTEEGAELKIVDSVPNTSKDISKVIVPKNYPLEFFNTEQLDKLQSDILKEIDNIPDGSFMPQFLSCLKERGALKFNCNNLASAEWLRTTVPTLENWKDEDVSILDPETVPVRSTLQLWIPGAVEEPEQVLERLERQNKGLDTLNWQVLNKKVEEGGQKLFVTVQDHVLDALKKIDYNPFLNFTRVKVKRPRRRPRGEKKDEKNEDPDTAYIETKEDPMAGDIGEFTAIDEIKEEEEDKAVPAANA

SEQ ID NO: 22848 - protein, 304 aa, Diabrotica virgifera
  misc_feature: Coding regions on vcDNA: vcDNA=SeqID_2545; Strand=+; Position=392-1306
  misc_feature: Homolog annotation: Hit_ID=AAL92314.2; Match level="QueryCoverage =58%, HitCoverage=17%, E-value=5e-14, Identity=32%"; Hit description =hypothetical protein [Dictyostelium discoideum]
  misc_feature: Gene Ontology Annotation: Molecular function=molecular_function unknown; Cellular component=cellular_component unknown; Biological process=regulation of protein activity, epigenetic
VAPDLQYLQQPQATNSLMHMINQMQQGNKIPGQGLVEKQPNLPGTLDPHIQMQMNNLLSMQNRLPTTSHPTNIPAGLSNTLPVNLPQPEGLSSSMPSLQTPTLNTAAMPIPGMQSNIPVSIGGSINLPRPTSRSSVEQISSTQASDPITSLLKQLQQQQQQQQQQQQQQQKQSTPPQVDSLWQQNTFTANNGTSQWQPQNEVPMSMWDLQNNPVPAVPSPPLTQSEKLQQALQPKTSKADKEKEQKQKEEAAAKELKKKKELEEKLAKKEAEEKKKLELQRQEAEKKALEEKRRKEDERIKREL

SEQ ID NO: 22849 - protein, 544 aa, Diabrotica virgifera
  misc_feature: Coding regions on vcDNA: vcDNA=SeqID_2546; Strand=+; Position=103-1735
  misc_feature: Homolog annotation: Hit_ID=XP_318645.1; Match level="QueryCoverage =99%, HitCoverage=69%, E-value=1e-135, Identity=44%"; Hit description= ENSANGP00000020999 [Anopheles gambiae]
  misc_feature: Gene Ontology Annotation: Molecular function=receptor signaling protein activity; Cellular component=small nucleolar ribonucleoprotein complex; Biological process=G-protein signaling, coupled to cGMP nucleotide second messenger
  misc_feature: Pfam annotation: Pfam_ID=WD40; Match level="Score=232.1, E-value=1.1e- 66, Copies=9"; Pfam description=WD domain, G-beta repeat
  misc_feature (507)..(507): Xaa can be any naturally occurring amino acid
  misc_feature (520)..(520): Xaa can be any naturally occurring amino acid
  misc_feature (536)..(536): Xaa can be any naturally occurring amino acid
MTSTVKLKEAFEVESKHGAFYTGGNLEWIEDTIYCQTNANINVLNVETGLIDKVIGEQGAEEEDTIQTFTTDGNRTVTSHKSGLLKSWNQNGELEKMWKYIHKGPIARLTLKAEKLASGGCDGVVRIWDLQNQVCSLSLKGCQGVVNVVEFHPGEDVLFASGDDGKINSYELTKGEVKTIYAGHYSKVTGFVFARENYFVSCGRDKVIILWEVGKSEGIKVIPQFEAIETITGLPLKFKVPGFKSEADGIYVAAAGEKGVVCVWDVKKAKQVYVQDNSLVSKASEEGGLSVVLLRCNLKDKALAVVTTDHNIIIHHLKSFVCLKQFVGFSDDILDITFVGEEDSHLAIATNSSDIKLYCNATMNCQILKGHTDIVMSLATCPADPTNMLSSGKDNTVRLWKLDGNIMNCIATGFRHTGSVSSVAFSQTNCNFGVSVSQDMCLKLWEIPTKSKIASLNCMHTVLAHQKDINSVAVAPNDKIIATASQDKTAKLWTPTLELLGTLRGHXRALWCVKFSPVDXVVVTASSDSTIKLWSXADLSCLRH

SEQ ID NO: 22850 - protein, 219 aa, Diabrotica virgifera
  misc_feature: Coding regions on vcDNA: vcDNA=SeqID_2547; Strand=+; Position=44-701
  misc_feature: Homolog annotation: Hit_ID=XP_312009.1; Match level="QueryCoverage =97%, HitCoverage=81%, E-value=1e-106, Identity=84%"; Hit description= ENSANGP00000018719 [Anopheles gambiae]
  misc_feature: Gene Ontology Annotation: Molecular function=maleylacetoacetate isomerase activity; Cellular component=cellular_component unknown; Biological process=tyrosine catabolism
  misc_feature: Pfam annotation: Pfam_ID=GST_N; Match level="Score=64.8, E-value=2.5e- 16, Copies=1"; Pfam description=Glutathione S-transferase, N-terminal
  misc_feature (175)..(175): Xaa can be any naturally occurring amino acid
MSSVLIKPILYSYWRSSCAWRVRIALNLKEIPYDIKPVSLIKAGGEQHSNDYRDVNPMEQVPALHIDGTTLIESLNIMHYLEETRPHRPLMPNDCIKRAKVREICEVIASGIQPLQNLTVLIHVGEEKKDEWAKHWIKRGFKAVEKLLAASAGKYCVGDEITLADCCLIPQVFNXARRFHVDLRPYPTILRIDRELEAHPAIRAAHPSNQPDCPPEAIK

SEQ ID NO: 22851 - protein, 362 aa, Diabrotica virgifera
  misc_feature: Coding regions on vcDNA: vcDNA=SeqID_2548; Strand=+; Position=177-1265
  misc_feature: Homolog annotation: Hit_ID=XP_309809.1; Match level="QueryCoverage =97%, HitCoverage=94%, E-value=2e-98, Identity=48%"; Hit description =ENSANGP00000018221 [Anopheles gambiae]
  misc_feature: Gene Ontology Annotation: Molecular function=(S)-2-hydroxy-acid oxidase activity; Cellular component=peroxisome; Biological process =fatty acid alpha-oxidation
  misc_feature: Pfam annotation: Pfam_ID=FMN_dh; Match level="Score=441.2, E-value =1.2e-129, Copies=1"; Pfam description=FMN-dependent dehydrogenase
MSNSVSNLVCVNDYEEYAKEKLKNGSFDFYNGGAGQQRTLEWNKTDFSKYRIRPKYMRNVSNRNLSTNILGKPVAVPIGISPSAFQKIAHPDGECATAKAAQESDTILILSSHSNCTFEEVAKAAPHGRKWLQLYIFRSREITKDFVKEAEKNGFEALVVTVDFALYGIHLGDLRSQFKTPPHLESINFKKYRDGDNTINFVDFTDPEVEWSYITWLKTITNLPIVVKGVLTGEDAIAAADAGASAILVSNHGGRQLDSLPSAIEALPEVSKAVGHRIEVYMDGGIRDGTDVYKALGLGARMVFIGRPALWGLTHDGEKGVKKILEILKKELDNAMGITGCSKLTDINQDRVVHESYYARQW

SEQ ID NO: 22852 - protein, 362 aa, Diabrotica virgifera
  misc_feature: Coding regions on vcDNA: vcDNA=SeqID_2549; Strand=+; Position=246-1334
  misc_feature: Homolog annotation: Hit_ID=XP_309809.1; Match level="QueryCoverage =98%, HitCoverage=96%, E-value=1e-100, Identity=48%"; Hit description= ENSANGP00000018221 [Anopheles gambiae]
  misc_feature: Gene Ontology Annotation: Molecular function=(S)-2-hydroxy-acid oxidase activity; Cellular component=peroxisome; Biological process =fatty acid alpha-oxidation
  misc_feature: Pfam annotation: Pfam_ID=FMN_dh; Match level="Score=438.8, E-value =6.4e-129, Copies=1"; Pfam description=FMN-dependent dehydrogenase
MSNSASNLVCVNDYEEYAKEELKNGSFEFYNGGAGQQRTLEWNKTDFNKYRIRPKYMRNVSNRNLSTNILGKPVAVPIGISPSAYQKIAHPDGECATAKAAQESDTILILSSHSNCTFEEVAKAAPHGRKWLQLYIFQNREITKDFVKRAEKNGFEALVVTVDFALYGIHLGDLRSQFKTPPHLQSINFNQYTEGENAINFYEFTDPEVEWSYITWLKTITNLPIVVKGVLTGEDAIAAADAGASAILVSNHGGRQLDSLPSAIEALPEVSKAVGHRIELYMDGGIRDGTDVYKALGLGARMVFIGRPALWGLTHDGEKGVKNILDILKKELDNAMGITGCSKITDINKDRVVHESYYARQW

SEQ ID NO: 22853 - protein, 52 aa, Diabrotica virgifera
  misc_feature: Coding regions on vcDNA: vcDNA=SeqID_2550; Strand=-; Position=367-525
CFEKTANFRTQSTLTHLQIFKRDFGRLSRQIITDRSQKVEKSVKYNLCVLYN

SEQ ID NO: 22854 - protein, 89 aa, Diabrotica virgifera
  misc_feature: Coding regions on vcDNA: vcDNA=SeqID_2551; Strand=+; Position=183-452
  misc_feature: Homolog annotation: Hit_ID=NP_956393.1; Match level="QueryCoverage =100%, HitCoverage=100%, E-value=3e-46, Identity=97%"; Hit description=dynein light chain (10.3 kD) (dlc-1) [Danio rerio] gb|AAH56312.1| Dynein light chain (10.3 kD)
  misc_feature: Gene Ontology Annotation: Molecular function=axonemal motor activity; Cellular component=axonemal dynein complex; Biological process =microtubule-based movement
  misc_feature: Pfam annotation: Pfam_ID=Dynein_light; Match level="Score=231.7, E -value=1.4e-66, Copies=1"; Pfam description=Dynein light chain type 1
MTDRKAVIKNADMSEDMQQDAVDCATQAIEKYNIEKDIAAYIKKEFDKKYNPTWHCIVGRNFGSYVTHETRHFIYFYLGQVAILLFKSG

SEQ ID NO: 22855 - protein, 134 aa, Diabrotica virgifera
  misc_feature: Coding regions on vcDNA: vcDNA=SeqID_2552; Strand=+; Position=1-405
  misc_feature: Homolog annotation: Hit_ID=XP_318716.1; Match level="QueryCoverage =80%, HitCoverage=30%, E-value=1e-14, Identity=41%"; Hit description =ENSANGP00000010270 [Anopheles gambiae]
ATTKKFELESIKASVNVTLSNGTSSILNVTHEKPEFSTSLDHSYKCAKVQTLNLTVAGGNDTIALLHISHVQFQAFSNVTAHKFYDAIDCEASAITSDVVPIVVGCVLALLVVVVLVAYLVGRRYCQARGYTSM

SEQ ID NO: 22856 - protein, 550 aa, Diabrotica virgifera
  misc_feature: Coding regions on vcDNA: vcDNA=SeqID_2553; Strand=+; Position=214-1866
  misc_feature: Homolog annotation: Hit_ID=XP_395039.1; Match level="QueryCoverage =98%, HitCoverage=98%, E-value=1e-129, Identity=42%"; Hit description= similar to chromosome 14 open reading frame 169; NO66 [Apis mellifera]
MNTPISAFSVYRKKPNPKIVKRQIVVKKQVKKKMTISLKKCVNKIKQKNTNPNPQKLKDTVKPRAVITHNLNQNFKKVDNKIKKTTSPLSTKLKKGTVFHNKDPVSESLKLFKWLIAPLSPTKFFEQYWEVKALHIQHNSPHYFSDILTTARLDSIFREFPLYYTKNIDVVSYENGVKEVHNEQGKVVASALYDYYSNGCSIRLLNPQTYDQKVHLLVSTLQEYFGTLVGANTYLTPPNSQGFAPHYDDIEAFVIQLEGRKHWKLYKPRGSDVLARESSPNLKHHDIGEPFMSVTLNAGDILYFPRGTIHEGRTDPDCHSFHITVSVYQHNSFADLLEHALPEALKKASLDNIRFRKGLPLNYLKHTGYVNRNIISEERLNIKAEIEKLFDSLRDYIDIDKAADQLGRRFMYDSMPPTLSKQEVCHTSKYDGDIMKDGKIFNRAEIDMDTEVRLLRYFCLRLVTDEKCSKLYYNTENAKIYHGEEEQVLEIDSDLIPTIEMLQSTYPKFTNVQRLVENNNSNMATIQLVSDLWEHGLLITNNSLTTGTDD

SEQ ID NO: 22857 - protein, 49 aa, Diabrotica virgifera
  misc_feature: Coding regions on vcDNA: vcDNA=SeqID_2554; Strand=+; Position=120-269
HNFYIFYCCRALASIIYSNRHILTTPALFLSTRCDRINISNVINNYSAQ

SEQ ID NO: 22858 - protein, 137 aa, Diabrotica virgifera
  misc_feature: Coding regions on vcDNA: vcDNA=SeqID_2555; Strand=+; Position=67-476
  misc_feature: Homolog annotation: Hit_ID=AAO86688.1; Match level="QueryCoverage =95%, HitCoverage=21%, E-value=3e-26, Identity=40%"; Hit description =long flagella protein LF4 [Chlamydomonas reinhardtii] gb|AAO86687.1| long flagella protein LF4 [Chlamydomo
  misc_feature: Gene Ontology Annotation: Molecular function=protein serine/threonine kinase activity; Cellular component=cytoplasm; Biological process =signal transduction
  misc_feature: Pfam annotation: Pfam_ID=Pkinase; Match level="Score=-68.5, E-value =0.00014, Copies=1"; Pfam description=Protein kinase domain
  misc_feature (47)..(47): Xaa can be any naturally occurring amino acid
  misc_feature (125)..(125): Xaa can be any naturally occurring amino acid
MNHFQSKYKVLEKIGEGSFSDVLKCENRETKVCYAAKRLKTHIDLRXSIQACAEIVAAQKIPNHPNVVNMLEYHYDIYTGKLTFIFELMDMSMHDYLKTKRRGLSEHRVKFYLFQILKGLVHLHXHGLFHRDIKPEN

SEQ ID NO: 22859 - protein, 508 aa, Diabrotica virgifera
  misc_feature: Coding regions on vcDNA: vcDNA=SeqID_2556; Strand=+; Position=168-1694
  misc_feature: Homolog annotation: Hit_ID=AAO21506.1; Match level="QueryCoverage =73%, HitCoverage=81%, E-value=1e-67, Identity=37%"; Hit description =serpin 3b [Manduca sexta] gb|AAO21505.1| serpin 3a [Manduca sexta]
  misc_feature: Gene Ontology Annotation: Molecular function=serpin; Cellular component=cytoplasm; Biological process=cell motility
  misc_feature: Pfam annotation: Pfam_ID=Serpin; Match level="Score=229.2, E-value =7.9e-66, Copies=1"; Pfam description=Serpin (serine protease inhibitor)
MALFLLGLLFCLSSRISASGFYEISNIDFYNSVFTDSLDWRLLQELSNQYKNVVISPISLKIILSLLYQGSTGQTEREFQTLLNYQNKEYVRNNYSQIVAALYNADRTEYMLNIGTSMFVDEGLYVLSKFEDLARKSFKTDIIKTNFDKQEKASKDINSWVEQLTHGKVKKIVNADDLSQALMIITNAIYFKGTWTRKFDKNRSTLGNFYTSPDNIRSSRNLKLVQYMTTTDEFLYYEDRSLDAKIVRLEYKGSDYAMYIVLPNTLGGLSSLIKNVDINKIGTIKFQMTQQVVEVTIPKFKFNFDIKLGKILQKFGLREAFQNTASFTGIVQTNRTLRRSLYVSDIVQKSGIEVDEEGSEIFSASAVNVGNKFAENTMIFNASHPFMFFVDGPNGTILFVGQYENPDAVDPSEVPNRWSQEVEEKNPTEAVQFQNTRPSRPNNEIDQSNNVQFQQPRPNRPSVESQRPDNVQFQQNRPNRPNTENEQPSNVQGLKLNPIWTPTTHLQM

SEQ ID NO: 22860 - protein, 468 aa, Diabrotica virgifera
  misc_feature: Coding regions on vcDNA: vcDNA=SeqID_2557; Strand=+; Position=144-1550
  misc_feature: Homolog annotation: Hit_ID=BAD85971.1; Match level="QueryCoverage =76%, HitCoverage=84%, E-value=1e-44, Identity=33%"; Hit description =serine protease inhibitor Serpin homolog [Thermococcus kodakaraensis] ref|YP_184195.1| serine protease inh
  misc_feature: Gene Ontology Annotation: Molecular function=serine protease inhibitor activity; Cellular component=cytoplasm; Biological process= regulation of proteolysis and peptidolysis
  misc_feature: Pfam annotation: Pfam_ID=Serpin; Match level="Score=246.5, E-value =4.7e-71, Copies=1"; Pfam description=Serpin (serine protease inhibitor)
MLLVLFLCIAGLAATEAVQFQNTRPSRPNNEIDQSNNVQFQQPRPNRPSVESQRPDNVQFQQNRPNRPNTENEQPSNVQGLNLNPNLDPDYYQPPDVEMDEIAYRFNLFDIDLLYSFSDLSTNVLISPASIKTTLAMILEGAEGTCAEEISEALRIPDINQKGVRSVLVELLNNLNERSTPNSVLESHNAIFVSEKHRLVDNYKNVVIKYYNAYLKSLDFSNSDYAARVINGWISDSTHGEITDVISPQGIVPDCYVVLSNALFFKAQWKYAFDKRSVRKCFHTPRGCVYVDMMHISHNFNYNYITRLRANVVDIPYQDKFSMLLILPSSDSNVRSVIRDLPHFRLSSILESLNQSEIVLELPTFSFEYSADLVEFLKPLKIREIFGSRANLTKMIEGHHGMINNLLHKTKITVDEKGTTAAASSSAMIIPLMQPVTVAADRPFVFMIYHRDTKNIIFEGIVQNPLEK

SEQ ID NO: 22861 - protein, 297 aa, Diabrotica virgifera
  misc_feature: Coding regions on vcDNA: vcDNA=SeqID_2558; Strand=+; Position=53-942
  misc_feature: Homolog annotation: Hit_ID=XP_308350.1; Match level="QueryCoverage =92%, HitCoverage=69%, E-value=1e-117, Identity=72%"; Hit description= ENSANGP00000019119 [Anopheles gambiae]
  misc_feature: Gene Ontology Annotation: Cellular component=mitochondrion
  misc_feature: Pfam annotation: Pfam_ID=Transket_pyr; Match level="Score=257.4, E -value=2.5e-74, Copies=1"; Pfam description=Transketolase, pyridine binding domai
  misc_feature (261)..(261): Xaa can be any naturally occurring amino acid
  misc_feature (271)..(271): Xaa can be any naturally occurring amino acid
  misc_feature (275)..(275): Xaa can be any naturally occurring amino acid
  misc_feature (277)..(277): Xaa can be any naturally occurring amino acid
  misc_feature (282)..(282): Xaa can be any naturally occurring amino acid
  misc_feature (287)..(287): Xaa can be any naturally occurring amino acid
  misc_feature (294)..(294): Xaa can be any naturally occurring amino acid
MSLNKLCVKCLGPLKTEIRVLNGLVNKRNHFVYTPDTNSPVKGETTKMNMFQAINNALDTALKTDDSALIFGEDIGFGGVFRCTMGLRDKYGKDRVFNTPLCEQGIAGFAIGAAVMGSTTIAEIQFADYIFPAFDQLVNEAAKYRYRSGGTFDCGKLTVRAPCGAVGHGALYHSQSPEAYFAHTPGLKVVIPRGPIKAKGLLLSCIRDPDPCLVFEPKILYRQAVEEVPVDDYQLPIGKADILVEGNDVTLIGWGTQVHVXQEVAQLGKEXLKVXCXSIDLXSILPXDTETVFXVVK

SEQ ID NO: 22862 - protein, 91 aa, Diabrotica virgifera
  misc_feature: Coding regions on vcDNA: vcDNA=SeqID_2559; Strand=-; Position=495-770
  misc_feature: Homolog annotation: Hit_ID=XP_315808.1; Match level="QueryCoverage =68%, HitCoverage=30%, E-value=1e-12, Identity=56%"; Hit description =ENSANGP00000004436 [Anopheles gambiae]
MCKEYEIINPIKIRKLQYLDYLTSTTWRRRPHVLKKKVLFHHDNALAHTSAVVITKLVEFGYELLPHPQYSPYLAPCDFFPIREIFINLIM

SEQ ID NO: 22863 - protein, 167 aa, Diabrotica virgifera
  misc_feature: Coding regions on vcDNA: vcDNA=SeqID_2560; Strand=+; Position=1-505
  misc_feature: Homolog annotation: Hit_ID=XP_309825.1; Match level="QueryCoverage =100%, HitCoverage=25%, E-value=4e-64, Identity=73%"; Hit description= ENSANGP00000022995 [Anopheles gambiae]
  misc_feature: Gene Ontology Annotation: Molecular function=enzyme regulator activity; Cellular component=mitochondrion; Biological process =mitochondrial translocation
  misc_feature (8)..(8): Xaa can be any naturally occurring amino acid
VTFDIDAXGIVHVSARDKGTEKKQQICNQSSGGVSKDEIENMVKNAEQYAQQDKVKRDRVEAVNQAEGILHETETKMEEYKDQLPKEECDKLKEEITKVRDLLTKKDETDPEEIRKATTTLQQSSLKLFEMAYKKMAAERESSSSSSSNQQQDQQQQSEQQKKEKEN

SEQ ID NO: 22864 - protein, 692 aa, Diabrotica virgifera
  misc_feature: Coding regions on vcDNA: vcDNA=SeqID_2561; Strand=+; Position=62-2140
  misc_feature: Homolog annotation: Hit_ID=XP_309825.1; Match level="QueryCoverage =92%, HitCoverage=100%, E-value=0.0, Identity=85%"; Hit description =ENSANGP00000022995 [Anopheles gambiae]
  misc_feature: Gene Ontology Annotation: Molecular function=enzyme regulator activity; Cellular component=mitochondrion; Biological process =mitochondrial translocation
  misc_feature: Pfam annotation: Pfam_ID=HSP70; Match level="Score=1388.3, E-value=0, Copies=1"; Pfam description=Hsp70 protein
MLSAARALSRKALDCSKITFEKAGNRNFNHLSNNRSSLYALNPKYDIQLRHKSEGIKGAVIGIDLGTTNSCVAVMEGKQAKVIENAEGSRTTPSVVAFSKDNERLVGMPAKRQAVTNSANTFYATKRLIGRRFEDEEVKKDMKTVSYKIVKASNGDAWVQGSDGKMYSPSQIGAFVLVKMKETAEAYLNTKVKNAVITVPAYFNDSQRQATKDAGQISGLNVLRVINEPTAAALAYGMDKTEDKVIAVYDLGGGTFDISILEIQKGVFEVKSTNGDTFLGGEDFDNVLVNHLVSEFKKEQGIDITKDPMAMQRLKEAAEKAKIELSSALQTDINLPYLTMDASGPKHMNLKLSRSKFESLVGDLIKRTIQPCQKALKDAEVSKTDIGEVLLVGGMTRMPKVQSTVQDIFGKQPSRAVNPDEAVAVGAAVQGGVLAGDVTDVLLLDVTPLSLGIETLGGVFTRLINRNTTIPTKKSQVFSTAADGQTQVEIKVHQGEREMASDNKILGQFSLIGIPPAPRGVPQIEVTFDIDANGIVHVSARDKGTGKEQQIVIQSSGGLSKDEIENMVKNAEQYAQQDKVKRDRVEAVNQAEGILHETETKMEEYKDQLPKEECDKLKEEITKVRDLLTKKDETDPEEIRKATTTLQQSSLKLFEMAYKKMAAERESSSSSSSNQQQDQQQQSEQQKKEKEN

SEQ ID NO: 22865 - protein, 283 aa, Diabrotica virgifera
  misc_feature: Coding regions on vcDNA: vcDNA=SeqID_2562; Strand=+; Position=112-963
  misc_feature: Homolog annotation: Hit_ID=AAO51130.1; Match level="QueryCoverage =86%, HitCoverage=97%, E-value=1e-18, Identity=27%"; Hit description =hypothetical protein [Dictyostelium discoideum]
  misc_feature: Pfam annotation: Pfam_ID=Keratin_B2; Match level="Score=-58.0, E -value=0.0048, Copies=1"; Pfam description=Keratin, high sulfur B2 protein
MKYFVLCALVLYCPSEVLGNPKCDGVKCEPVQCGFGANAKVKEGDCCPTCVGFGNPLLPKDNPCEGKQCTVAVATDCPPGSILKMKDGNCCPTCQPFGNPACAGANCATPQCGLGSRLQLKEGDCCASCVGFGNPKCDGVKCEPVKCGFGANLKLKEGDCCPSCEGFGNPKCDGVKCEPVQCGLGANLKLKDGDCCPSCEGFGNPLLPKDNPCKGKQCTVAVATDCPPGSILKMKDGNCCPTCEPFGNHCQSLKTEEWIFVCHLPSYFITNNKSRTYFNYQKK

SEQ ID NO: 22866 - protein, 254 aa, Diabrotica virgifera
  misc_feature: Coding regions on vcDNA: vcDNA=SeqID_2563; Strand=+; Position=163-927
  misc_feature: Homolog annotation: Hit_ID=XP_393778.1; Match level="QueryCoverage =63%, HitCoverage=65%, E-value=3e-45, Identity=57%"; Hit description =similar to ENSANGP00000018862 [Apis mellifera]
  misc_feature: Gene Ontology Annotation: Molecular function=apoptosis inhibitor activity; Cellular component=cytoplasmic vesicle; Biological process= anti-apoptosis
  misc_feature: Pfam annotation: Pfam_ID=PX; Match level="Score=81.9, E-value=1.7e -21, Copies=1"; Pfam description=PX domain
MCDSSTSANPISSEYTSTPSRRDRENKFSEKTEDAATTDSEEYLSEPLRYRNFQYSAQSSISNITLSVQNSRIEEENGNCFPQIPNGPISFNNIQIPIVGYEIMEERARFTVYKLKVENKETGDFWYVFRRYTDFVRLCTRLRTNHPNIVQHLPRKRWLKNNFDPIFLEERVNGLQTLVNAILSVPELIASQEIQDFFCLNEPPVYSETSEETKAIFEALEETISYLKQQVREKDASLDSLEENYIPYQQKMKI

SEQ ID NO: 22867 - protein, 454 aa, Diabrotica virgifera
  misc_feature: Coding regions on vcDNA: vcDNA=SeqID_2564; Strand=+; Position=275-1635
  misc_feature: Homolog annotation: Hit_ID=S27163; Match level="QueryCoverage=99%, HitCoverage=81%, E-value=1e-131, Identity=50%"; Hit description =alpha,alpha-trehalase (EC 3.2.1.28) - yellow mealworm dbj|BAA01951.1| trehalase precursor
  misc_feature: Gene Ontology Annotation: Molecular function=alpha,alpha-trehalase activity; Cellular component=extrinsic to plasma membrane, GPI -anchored; Biological process=trehalose catabolism
  misc_feature: Pfam annotation: Pfam_ID=Trehalase; Match level="Score=455.1, E-value= 7.9e-134, Copies=1"; Pfam description=Trehalase
  misc_feature (421)..(421): Xaa can be any naturally occurring amino acid
MKCYIVYASAVLFSYISAETVQSCDSLIYCQGELLDTVQSARIFSDSKTFVDLSQRQSPDETLGNFKKFMAKYNDNPTKDEVIKFVEDNFKDNKELVEWTPPDFNDNPSFLDGIKDPIVLEFAKILVNIWPNLARKVDESVSKHQDQHSLIYLPHGFIIPGGRFKEIYYWDTYWIIKGLLLSEMTETVKGILENFLSLVDRYGFIPNGSRVYYLNRSQPPLLSLMVGLYIDATNNKEWLATNVNILEKELTWFLTNRMVSVHGHKMARYAGPSGTPRPESYYEDTITCQSFKDKDKEQCYKNLKGGAESGWDFSSRWILKEDGTSGSDLPDIDTFRVIPVDLNAFLCKAFKELSRFYSILGNVDKTQEWNGRADKLERAIQKFLYSEEDGVWYDFDIKSGQSRKSFYPSNLTPLWTGVFDXNPKTGEKVVQYLKNNNIDDFKGGIPSSLLDSGE

SEQ ID NO: 22868 - protein, 261 aa, Diabrotica virgifera
  misc_feature: Coding regions on vcDNA: vcDNA=SeqID_2565; Strand=+; Position=131-912
  misc_feature: Homolog annotation: Hit_ID=NP_648847.3; Match level="QueryCoverage =98%, HitCoverage=61%, E-value=4e-60, Identity=41%"; Hit description =CG5027-PA [Drosophila melanogaster] gb|AAF49525.3| CG5027-PA [Drosophila melanogaster]
  misc_feature: Gene Ontology Annotation: Molecular function=protein disulfide isomerase activity; Cellular component=mitochondrion; Biological process=protein folding
  misc_feature: Pfam annotation: Pfam_ID=Thioredoxin; Match level="Score=105.0, E -value=1.9e-28, Copies=1"; Pfam description=Thioredoxin
  misc_feature (202)..(202): Xaa can be any naturally occurring amino acid
  misc_feature (250)..(250): Xaa can be any naturally occurring amino acid
MFFNTFNLLLIGLCATCCSSFILELGNNFSELRNNGGDWLIKFYAPWCGHCQRLEPVWAEVSEALDDSNIRVGRVDCSHYPAIATEFGIRGYPTIKFISPKSDVTFSGDRNKDDIVQFALRMAGPPVHIISSSNDLSKVKSSGDVFFMYNGALKGELWNIFYDVSKRFRAHSQFFAFNENAGDATNTPSIYVYKDSKAHFFXVDNLSNELNDSLSQWVNEERFGTFQKVTHGNFNDLIQLNRFVVLVVVXEKKLREILTCW

SEQ ID NO: 22869 - protein, 264 aa, Diabrotica virgifera
  misc_feature: Coding regions on vcDNA: vcDNA=SeqID_2566; Strand=+; Position=247-1038
  misc_feature: Homolog annotation: Hit_ID=AAG00554.1; Match level="QueryCoverage =90%, HitCoverage=68%, E-value=1e-17, Identity=25%"; Hit description =retinitis pigmentosa GTPase regulator-like protein [Takifugu rubripes]
  misc_feature: Gene Ontology Annotation: Molecular function=chaperone activity; Cellular component=nucleolus; Biological process=protein folding
MQQLGLKGGARFQRPPKSFRYRLGLYGGGGVDDVDEEMKPSTTTAEADSTQATVNEIAPSSSNAEIIKMDWESDSTPKQSEESLSVEAKSDSETKSEAEAKPEETTQIEAESEADIGTDVDMRLETEEQSGSKDNLEPETSKNTLEPETSKNTLEPETSKNTLEPETSKNALEPETSKNALEPETSKNTLEPETSKNTLELEEKSESENNLEADKKPETDDKSEAEEKSEQSSQIESDITKSPEENQAKSESGPEETKSEMETD

SEQ ID NO: 22870 - protein, 283 aa, Diabrotica virgifera
  misc_feature: Coding regions on vcDNA: vcDNA=SeqID_2567; Strand=+; Position=157-1008
  misc_feature: Homolog annotation: Hit_ID=XP_392002.1; Match level="QueryCoverage =98%, HitCoverage=44%, E-value=3e-61, Identity=43%"; Hit description =similar to ENSANGP00000024998 [Apis mellifera]
  misc_feature (216)..(216): Xaa can be any naturally occurring amino acid
MLLTVVLVVAGLAVALCFFVRKRWHYWKDLNVEQADINYIFKNIYILFSKKTSFAEMTVIGYNKFPKSRYIGTYQLLKPMMLIKDPELLKDITVKSFDHFMDHTNQVSENSDPLWTKNLVALRGQQWRDMRSVLSPSFTSSKMKVMFTLMTECAQNFSKHFQKKKEDVVELELKETFTRFTNDVIATTAFGIKVDSLEDRDNEFYLMGRDVTNFTXTLKMLKFMIAAAFPRLANLLKITFFDNKTRNFFTKFIDKTVQVREDKGIVRPDMIHLLMEARKGVQI

SEQ ID NO: 22871 - protein, 297 aa, Diabrotica virgifera
  misc_feature: Coding regions on vcDNA: vcDNA=SeqID_2568; Strand=+; Position=3-893
  misc_feature: Homolog annotation: Hit_ID=EAL24934.1; Match level="QueryCoverage =98%, HitCoverage=16%, E-value=4e-77, Identity=46%"; Hit description =GA21372-PA [Drosophila pseudoobscura]
  misc_feature: Gene Ontology Annotation: Molecular function=molecular_function unknown; Cellular component=cellular_component unknown; Biological process=cell wall organization and biogenesis
  misc_feature: Pfam annotation: Pfam_ID=HEAT; Match level="Score=32.8, E-value=1.1e -06, Copies=5"; Pfam description=HEAT repeat
  misc_feature (255)..(255): Xaa can be any naturally occurring amino acid
QADDSLEWLLGELLSLAQQSHPNSKQASAIWLLAVIKCCGEREPITKRLKQLQNIFMGFLSENNDIIQDVASKGLCVVYDTYKSEELLQALVKQLTSGSRQVAAVTSDTKLFEEGQLGQSPTGGNLTTYKELCSLASDLNKPDLIYQFMHLANHNAIWNSKKGAAFGFSTIAEKCGEDLKAFLPTIIPKLYRYQYDPTPNIQASMHNIWRVLVPEPGKIIDEYYHEILVDLLANINSHQYRVRQSCCLALQDFLXGSSNRSIHDAVDHMDDLWSKLFRVMDDHHEQTRITAHRTARI

SEQ ID NO: 22872 - protein, 260 aa, Diabrotica virgifera
  misc_feature: Coding regions on vcDNA: vcDNA=SeqID_2569; Strand=+; Position=452-1234
  misc_feature: Homolog annotation: Hit_ID=EAK95170.1; Match level="QueryCoverage =88%, HitCoverage=21%, E-value=9e-09, Identity=24%"; Hit description =hypothetical protein CaO19.4072 [Candida albicans SC5314]
MKELQKKIVKKESPNVTSPQSNTSESATTSEKTQNSKSSSRSEGKSSDADFSKELEAALQLIQDLESPNTIETPSDAKSLDGHARPLAVWRNSDASESSEKTLSAVGSLAEITSPLTECQPELYTFKPSTNGKGAKVIVHYPDSQSTSGYSSPTHGPNWSTASSISGGSPDTKPTLYSIHNTKSTTVISLYSSPNNTKGKSVTLVKITGDEPVNTTKIKVSPYTDTIDNSSFLSDYNSTNNTHSPVDNRLRDQQNQRETF

SEQ ID NO: 22873 - protein, 512 aa, Diabrotica virgifera
  misc_feature: Coding regions on vcDNA: vcDNA=SeqID_2570; Strand=+; Position=151-1689
  misc_feature: Pfam annotation: Pfam_ID=Ku_N; Match level="Score=-14.8, E-value =0.0046, Copies=1"; Pfam description=Ku70/Ku80 N-terminal alpha/beta domai
MYEGDEYGSDYEEGDSEIFSSSFKPSYVVVAIDTHPCMFKKKSEKEQMPFRICLEALAEVMETLIFKKDTRMWSPFAVVLAGAATPLISFNQSVLDTVKFLQVKCRQTDAELTSQHQRKTALNVSSFFLTCKKLFHEIKSVFHKRTLLYLSNDDKPVTDKNARFTAFNEIKTFAASQIEFQIIPTIQDFQYKLFYNELFSIIGNPKREEICTDKEGLAEKLSSLLMVSIMETRILFYPFPDDTERYLKCKRFAYTTNIQLYNQYMTKDGKKVINTDAPPDDQEYFRLKSEDPNQEHMRFDALEKERLMDSVTPKGLTLAFVGDRQIGYGHTFFNTQILKVDPTETLPYFNKFWDHCVNSKKVLVCLSKLRQPDRPRYVELIPVLCNGQQMFLEKRLPFGNEIVMPFKYPFPLPEEEVDDKRKLVIEQLVEKLTFDFNLKMLPDVNLQKKKAYIKAKLLDIFPEPVNNVEIDSTALDGVLEEVVAEIQAKFQLTDTFKRKAPQHYNRRNKRGK

SEQ ID NO: 22874 - protein, 119 aa, Diabrotica virgifera
  misc_feature: Coding regions on vcDNA: vcDNA=SeqID_2571; Strand=+; Position=892-1251
  misc_feature: Homolog annotation: Hit_ID=NP_727447.1; Match level="QueryCoverage =97%, HitCoverage=95%, E-value=2e-60, Identity=94%"; Hit description =CG32672-PA [Drosophila melanogaster] gb|AAF46617.1| CG32672-PA [Drosophila melanogaster]
  misc_feature: Gene Ontology Annotation: Molecular function=tubulin binding; Cellular component=plasma membrane; Biological process=synaptic transmission
  misc_feature: Pfam annotation: Pfam_ID=MAP1_LC3; Match level="Score=258.4, E-value =1.3e-74, Copies=1"; Pfam description=Microtubule associated protein 1A/1B,
MKFQYKEEHPFEKRKSEGEKIRRKYPDRVPVIVEKAPKARIGDVDKKKYLVPSDLTVGQFYFLIRKRIHLRPEDALFFFVNNVIPPTSATMGSLYQEHHEEDFFLYIAYSDENVYGGDL

SEQ ID NO: 22875 - protein, 189 aa, Diabrotica virgifera
  misc_feature: Coding regions on vcDNA: vcDNA=SeqID_2572; Strand=+; Position=115-681
  misc_feature: Homolog annotation: Hit_ID=XP_318802.1; Match level="QueryCoverage =100%, HitCoverage=36%, E-value=4e-47, Identity=46%"; Hit description= ENSANGP00000010176 [Anopheles gambiae]
  misc_feature: Gene Ontology Annotation: Molecular function=protein farnesyltransferase activity; Cellular component=protein farnesyltransferase complex; Biological process=lipid metabolism
  misc_feature: Pfam annotation: Pfam_ID=PPTA; Match level="Score=91.0, E-value=3e -24, Copies=3"; Pfam description=Protein prenyltransferase alpha subun
MHGRLKVRTSEEQKAIKHKEQQKKLAAYHWGMKRILSTRNKDSYEPESFQISSQILIANPDVYTLWNYRKEIILMEIEKSEKDEIEQEDNLMPFLEDEIKFTEQCLPANPKSYGVWHHRYWILLYHPKPNWNQEFSLCTRYLTIDDRNFHVWDYRRLLVNKIGITLDHQLKFSNERLNVNFSNYSSWHY

SEQ ID NO: 22876 - protein, 142 aa, Diabrotica virgifera
  misc_feature: Coding regions on vcDNA: vcDNA=SeqID_2573; Strand=+; Position=1-426
RTRGENSYFSSFNNENMNKFLVTKDTFKKIRKFGLQGRTLEFKIRDVPQSEEPVGWVKKAIEGIVLKGTEGLEPTDQVGFTFCSKDFARGQGWMRFKPASEVTVDDIWNKISSRYQSNSTGLNTETFCLGITTVKLPAGKSG

SEQ ID NO: 22877 - protein, 185 aa, Diabrotica virgifera
  misc_feature: Coding regions on vcDNA: vcDNA=SeqID_2574; Strand=+; Position=203-763
  misc_feature: Homolog annotation: Hit_ID=NP_610298.2; Match level="QueryCoverage =95%, HitCoverage=76%, E-value=2e-46, Identity=59%"; Hit description =CG30499-PA [Drosophila melanogaster] gb|AAM71098.1| CG30499-PA [Drosophila melanogaster]
  misc_feature: Gene Ontology Annotation: Molecular function=ribulose-phosphate 3 -epimerase activity; Cellular component=cytosol; Biological process =pentose-phosphate shunt
  misc_feature: Pfam annotation: Pfam_ID=Ribul_P_3_epim; Match level="Score=-28.2, E -value=3.1e-09, Copies=1"; Pfam description=Ribulose-phosphate 3 epimerase family
  misc_feature (15)..(15): Xaa can be any naturally occurring amino acid
  misc_feature (19)..(19): Xaa can be any naturally occurring amino acid
  misc_feature (52)..(52): Xaa can be any naturally occurring amino acid
  misc_feature (67)..(67): Xaa can be any naturally occurring amino acid
  misc_feature (78)..(78): Xaa can be any naturally occurring amino acid
  misc_feature (88)..(88): Xaa can be any naturally occurring amino acid
  misc_feature (113)..(113): Xaa can be any naturally occurring amino acid
  misc_feature (120)..(120): Xaa can be any naturally occurring amino acid
  misc_feature (138)..(138): Xaa can be any naturally occurring amino acid
LFGHPVVKRLRKKIXTAFXETHNRSVANPEKWIEPTAEANVNLYTFHIEPVXIDVIKVCRKVKEAGXKVGLALKPGTXEFEDVRQYIXIADIIFGNRLVEPRLSEAKGSSSDXMPKVQWXLRHNYPLLDIEVDGGVGXSTITRLRAEAGANMIVSGTAIIESIDQAAVIASLRETVESSIHKCNV

SEQ ID NO: 22878 - protein, 155 aa, Diabrotica virgifera
  misc_feature: Coding regions on vcDNA: vcDNA=SeqID_2575; Strand=+; Position=43-510
  misc_feature: Homolog annotation: Hit_ID=XP_397536.1; Match level="QueryCoverage =85%, HitCoverage=65%, E-value=3e-36, Identity=53%"; Hit description =hypothetical protein XP_397536 [Apis mellifera]
MNYFLYVSFLVALATVNAGYAGSYGGHEGYGGDHGGHDISHTVEITKHVPIPVYKHEAVPIPHTIPVPVPKPVAVPVPQPYPVHIKVPQPIAVPVIKTITIPVEKPVPYKVEKEIPYHVEKPVPVPVEKHVPIRIPKPVPVKVPVYKVVYHHSKH

SEQ ID NO: 22879 - protein, 147 aa, Diabrotica virgifera
  misc_feature: Coding regions on vcDNA: vcDNA=SeqID_2576; Strand=-; Position=28-471
  misc_feature: Homolog annotation: Hit_ID=CAB62280.1; Match level="QueryCoverage =87%, HitCoverage=91%, E-value=1e-17, Identity=37%"; Hit description =hydroxyproline-rich glycoprotein DZ-HRGP [Volvox carteri f. nagariensis]
  misc_feature: Gene Ontology Annotation: Cellular component=extracellular space; Biological process=cell proliferation
  misc_feature (99)..(99): Xaa can be any naturally occurring amino acid
TVGHTAPCPVTIPEGPTAPAPVTTPDGPAAPAPVTTPEASTTLTAGTGTAATLTPCPSPSPKPRGAPTPRAGTPRPRPTGPARPTGPAKPTGPAKPIPXPPSPRPSPPTPRPSPPTPSPRGPIPPALAATAKVAKMATKRVFMLLLI

SEQ ID NO: 22880 - protein, 234 aa, Diabrotica virgifera
  misc_feature: Coding regions on vcDNA: vcDNA=SeqID_2577; Strand=+; Position=85-789
MKWIVLTVVVLLGLASAEEVYEKRAVLRRTTRQALGSMGGSFLAQTERNIINNCKKNGLSDQGADDLQVTYAKMKSCMSGTKIFETPRNEFISKMEDCSRDAIKETKSCLANNQKYFPEFVLDLAKSMVKYMYDDKDLFRDSEIVGCINNLGRYTVQVEYIRCLTTVSQKTGDDENIPTSRAEFCRKFVPATECFPDTIKRHCVNTAKVNKFFSDYSNAIETPCQDSVKESNYL

SEQ ID NO: 22881 - protein, 347 aa, Diabrotica virgifera
  misc_feature: Coding regions on vcDNA: vcDNA=SeqID_2578; Strand=+; Position=78-1119
  misc_feature: Homolog annotation: Hit_ID=XP_315764.1; Match level="QueryCoverage =93%, HitCoverage=66%, E-value=2e-44, Identity=32%"; Hit description =ENSANGP00000022831 [Anopheles gambiae]
  misc_feature: Gene Ontology Annotation: Cellular component=membrane fraction; Biological process=lipid metabolism
  misc_feature (316)..(316): Xaa can be any naturally occurring amino acid
  misc_feature (331)..(331): Xaa can be any naturally occurring amino acid
MKFVLIFLILVVNYVPSFALNILYAYDVPSPSHEIWNYELAAALVAKGHNVTMFSPLPKQGQGQKNYHTIQIEGLLDRVKEVFNLNDIIENNDFENLLLYHHWGTFTCEHTVQSKGFSKLLSYPRDSFDLILVQYSLSPCLLYLIQAFNYPPTVVTTPFLLPAFLAETFGSDVQPAYIASYVLNHNGKFTFFDRLRNFALLKMDTLLRHFYLNDKIKEYATKGFGKDLAPLDSLINHVSLVLCNTIPGFHHAQPLAPNIVPVGGLHITPAKKLPEEFMHIMDNTKDGVILMSFGTNIHSANLKTIKRTVLLRHWVXLKQNSLWKFDKDLDXPFPKCIIRKWVPQKEF

SEQ ID NO: 22882 - protein, 292 aa, Diabrotica virgifera
  misc_feature: Coding regions on vcDNA: vcDNA=SeqID_2579; Strand=+; Position=133-1008
FFIMKIILLILLAICTILSAAEYPRYKGRPPPPRQRRVPTNQQFSKKWHQGGPLIQNLPQGIPQGFPQGMQGVPPGHGQFGLRGPPLRQRPVNHIPVLMVPNNVPQIKHHKIPQPNGLGHQLPQRQATLPVRSFWKNPVAPVKLQQEVVFKTPLPTPPPEKPFRSAPSIPTSQEFDYHIQTNQIPTAHINPIKQIGEKGPIHTIPAPNLSLKDKPLHIEEVRNDISFPHPSHHNAHLSTQVTIQKSHEYPVTEPPEHNQKLFRAQQNTKSKSSGRSRNKSNRCISRLFNKSC

SEQ ID NO: 22883 - protein, 93 aa, Diabrotica virgifera
  misc_feature: Coding regions on vcDNA: vcDNA=SeqID_2580; Strand=-; Position=572-853
FSYNNFLYFYRCSVFSRNFFNVTISRDYILLSLHSIIIINGVTLLYFPLCHSHFLQILYNLILPTFSRPSDRPSLIWSLKKTLFIRRLSLLRI

SEQ ID NO: 22884 - protein, 117 aa, Diabrotica virgifera
  misc_feature: Coding regions on vcDNA: vcDNA=SeqID_2581; Strand=+; Position=781-1134
YLTTKDSFTYYKKAVTSLDNKTFKKVLKGSSCGMTKLNIRYFNILLANYQNTRKNYLPAILLLESYLMIVYVNNIGMQSPQTACYFLYKQNGARNSYFFQFLLYNSKDFNFTPKTPK

SEQ ID NO: 22885 - protein, 273 aa, Diabrotica virgifera
  misc_feature: Coding regions on vcDNA: vcDNA=SeqID_2582; Strand=+; Position=83-901
  misc_feature: Homolog annotation: Hit_ID=XP_392959.1; Match level="QueryCoverage =90%, HitCoverage=23%, E-value=5e-72, Identity=52%"; Hit description =similar to RAD54-like protein; RAD54 homolog [Apis mellifera]
  misc_feature: Gene Ontology Annotation: Molecular function=molecular_function unknown; Cellular component=cellular_component unknown; Biological process=RNA processing
  misc_feature: Pfam annotation: Pfam_ID=Dus; Match level="Score=74.6, E-value=2.8e -19, Copies=1"; Pfam description=Dihydrouridine synthase (Dus)
  misc_feature (248)..(248): Xaa can be any naturally occurring amino acid
  misc_feature (250)..(250): Xaa can be any naturally occurring amino acid
  misc_feature (254)..(254): Xaa can be any naturally occurring amino acid
  misc_feature (258)..(258): Xaa can be any naturally occurring amino acid
MCAMVSKNDIPIDILDLFRDKKLVKICAPMVRYSKLQFRNLVKLYNCDLTFTSMILADSFCQSAKARSNAFTTNSLDTPVVVQFASNTVHDFVGAAYLASPHCNGADLNCCCPQRWAREQELGCDMLKKPELIYDMVRQCRNHVLKPFTVSVKMRLLCGEKHMVNICKQLEMCGVSFLTIHGRTSYQNVGDINKDTLKLINDTCSLPVIANGCVTTLDDCYKLQEYTGCKGVMVANGILTNPTIFTWXLXNTLXCIQXWLDICYNSSLTMSYL

SEQ ID NO: 22886 - protein, 275 aa, Diabrotica virgifera
  misc_feature: Coding regions on vcDNA: vcDNA=SeqID_2583; Strand=-; Position=1-825
  misc_feature: Homolog annotation: Hit_ID=AAA92147.1; Match level="QueryCoverage =98%, HitCoverage=40%, E-value=2e-72, Identity=46%"; Hit description =reverse transcriptase
EIHEFWGNQLSTPAVFNNNAGWIEDTTHNCHHYVTANYEPFTTEEVSNVIKELHNWKSPGPDGVQNFWLKKFWSIHECLSTLINHVISNPQELPSFLTQGTTYLIPKDQNNTQDPSKYRPITCLPTLYKLVTSCVTRRIYQHCALNNIIERQQKGCAKGSMGCKEQLIIDSVISKQAYSKKRNLFTAFINYKKAFDSVPHEWLIDILRIYKVDDNIVTFLQHIMTEWKTRIHLQIPGENNIETENIAISRGLFQGYSLSPLWFCLAMNPLSQVLN

SEQ ID NO: 22887 - protein, 75 aa, Diabrotica virgifera
  misc_feature: Coding regions on vcDNA: vcDNA=SeqID_2584; Strand=-; Position=638-865
VQICAVSGFVYSCGCQSVEIFAILFEIFLYYNNSFFLQLILYWSLKFYGKCILFCHSFLQHTKLISFTPLRNGCV

SEQ ID NO: 22888 - protein, 289 aa, Diabrotica virgifera
  misc_feature: Coding regions on vcDNA: vcDNA=SeqID_2585; Strand=+; Position=93-957
  misc_feature: Homolog annotation: Hit_ID=XP_315022.1; Match level="QueryCoverage =99%, HitCoverage=67%, E-value=6e-78, Identity=48%"; Hit description =ENSANGP00000022262 [Anopheles gambiae]
  misc_feature: Gene Ontology Annotation: Molecular function=protein binding; Cellular component=chromosome, telomeric region; Biological process =telomerase-dependent telomere maintenance
  misc_feature: Pfam annotation: Pfam_ID=Ank; Match level="Score=58.1, E-value=2.5e -14, Copies=3"; Pfam description=Ankyrin repeat
  misc_feature (270)..(270): Xaa can be any naturally occurring amino acid
  misc_feature (282)..(282): Xaa can be any naturally occurring amino acid
MSDNKEPALSETDQQIFKAIENNDVVLLKTLLAETKNVNILDENSMTPLQHAAYKGNKDLVQVLLDQGADVNYCEHQHTYTALHFAGLSGNSDVCLALLLAGAKSNITNTVGRTPSQMAAFVGHHNCVSVINSYIPKSDIDYYTTGTANRGPYLPPFLSESFHKFVMQVNIHPIKVVLNVQNFVGLSEHLPEVKKVLELMCEREIKRGADKNEVMSFKFHYLGYIVGEVLKVRQRQTAKKDEGEDDKKLDMTELFTRKLLKPGTDGQLEXMDAFLKQCIREXPYRDCTL

SEQ ID NO: 22889 - protein, 236 aa, Diabrotica virgifera
  misc_feature: Coding regions on vcDNA: vcDNA=SeqID_2586; Strand=+; Position=3-713
PTRPPTRPHQVGRYSRRPMYPAGHRKLQHVVVRRLKHHPPTRPGRFARKPAVSRPRKQSGSPAGLGRRPFRRPSCRPMIRPAHLSGQGGQHPAQQEHHQAQQQHHQAQQQHQQGPQARQCRPARRPRIVMRPAAQRKSVAHDRYTVANHGTHAFTAQIVHVKGGKQEIVRSQVVQPNETKELLLKDVNGSSLKIVNENETDYAIFSAEGGEVVDGFRYMVRPLRRCPGARKMFYGF

SEQ ID NO: 22890 - protein, 203 aa, Diabrotica virgifera
  misc_feature: Coding regions on vcDNA: vcDNA=SeqID_2587; Strand=+; Position=3-614
  misc_feature (203)..(203): Xaa can be any naturally occurring amino acid
PTETVKLEHKKDAGVALLNILNRHYTDAAIITAKGGRVVRDIERKIKQLISDEKSIMMVNDYHLAPASSVVVMHQVGRYSRRPMYPAGHRKLQHVVVRRLKHHPGHTSGRLAGKPAAPRPSKQSGSPAGSGRRPFRRPSCRPMIRPAHLSSQGGQHPAQQTQEQHRPAQQQQHQSPQVGQCRPARRPRIVMRPAALRKPIAHX

SEQ ID NO: 22891 - protein, 163 aa, Diabrotica virgifera
  misc_feature: Coding regions on vcDNA: vcDNA=SeqID_2588; Strand=+; Position=59-547
MKRSQQVTVTETTPGYSVEKMYYKEYKYETAFSISQLSKLENFVLPPRTTILALSQNGGDKEEDKKYVVKNHGKADLFVEVIHLNNQDDAPQWFVVQPDQTTEIDIEDNLEQSVLKVSNNSYEQEVSFSAKGGHVIDDLENNMEELLDSDEPETEMVVLENFS

SEQ ID NO: 22892 - protein, 183 aa, Diabrotica virgifera
  misc_feature: Coding regions on vcDNA: vcDNA=SeqID_2589; Strand=+; Position=47-598
MKRSQQVTVTKTTTTYEEYEYETTFSVSKLSKLENFVLPPRTTILAVSQSGGDKEEDKKYVVTNHGKADLFVEVIHLNNQDDAPQWFVVQPDQTTEIDIEDNLEQSVLKVSNNSYEQEVSFSAKGGHVIDDLENNMEELLDSDETETEMTVLENFSLSPRTAVTVLSQNVEGSNEHPGKVHCN

SEQ ID NO: 22893 - protein, 224 aa, Diabrotica virgifera
  misc_feature: Coding regions on vcDNA: vcDNA=SeqID_2590; Strand=+; Position=82-756
  misc_feature: Homolog annotation: Hit_ID=YP_031668.1; Match level="QueryCoverage =64%, HitCoverage=35%, E-value=8e-12, Identity=35%"; Hit description =unknown [Frog virus 3] gb|AAT09749.1| unknown [Frog virus 3]
MMVNDFHLAPASSVVVMNQVGRYNRRPVYPAGHRKLQHVVVRRLKHHPGLTSGRFARKPAVSRPRKQSGSPAGLGRRPFRRPSCRPMIRPGHLSGQGGHHAQQRHRPAQGGHHPAQQQHHPAQQQHHPAQQQHHQGQQQHHQGQQQHHPAQQNRPQVGQCRPMRRPRVVMRPAMLRKPIVHDRYTVVNHGTHAFTAQIVHINGKKPRGGPHSSRPTQRNPSAFT

SEQ ID NO: 22894 - protein, 339 aa, Diabrotica virgifera
  misc_feature: Coding regions on vcDNA: vcDNA=SeqID_2591; Strand=+; Position=1-1020
  misc_feature: Homolog annotation: Hit_ID=YP_031668.1; Match level="QueryCoverage =48%, HitCoverage=35%, E-value=6e-15, Identity=43%"; Hit description =unknown [Frog virus 3] gb|AAT09749.1| unknown [Frog virus 3]
  misc_feature: Gene Ontology Annotation: Molecular function=ligand-dependent nuclear receptor activity
  misc_feature (19)..(19): Xaa can be any naturally occurring amino acid
GRARVRPQVRPRVRAIITXQGGRVVRDIERKIKQLVSDEKSIMMVNDFHLAPASSVVVMNQVGRYNRRPVYPAGHRKLQHVVVRRLKHHPGLTSGRFARKPAVSRPRKQSGSLTGPGRRPFRRPACRPMVRPAYHPGQGGHPAQGGHRPAQGGHHPAQQGHHPAQQQHHPAQQQHHPAQQQHHPAQQQHHPAQQQHHPAQQQHHQGQQQHHPAQQNRPQVGQCRPMRRPRVVMRPAMLRKPIVHDRYTVVNHGTHAFTAQIVHVNGRNQEVVRTQVVQPNETQVLLLEGINGSSLKIVNENETDYAIFSVEGGEVVYGFRYMVRPLRRRPGARRMFWGF

SEQ ID NO: 22895 - protein, 190 aa, Diabrotica virgifera
  misc_feature: Coding regions on vcDNA: vcDNA=SeqID_2592; Strand=+; Position=139-711
  misc_feature: Homolog annotation: Hit_ID=YP_031668.1; Match level="QueryCoverage =45%, HitCoverage=22%, E-value=2e-10, Identity=45%"; Hit description =unknown [Frog virus 3] gb|AAT09749.1| unknown [Frog virus 3]
MIRPGHLPGQGGHPAQGGHRPAQGGHHPAQQQHHPAQQQHHPAQQQHHQGQQQHHQGQQQHHPAQQNRPQVGQCRPMRRPRVVMRPAMLRKPIVHDRYTVVNHGTHAFTAQIVHINGRNQEVVRTQVVQPNETQVLLLEGLNGSSLKIVNENETDYAIFSVEGGEVVYGFRYMVRPLRRRPGARRMFWGF

SEQ ID NO: 22896 - protein, 360 aa, Diabrotica virgifera
  misc_feature: Coding regions on vcDNA: vcDNA=SeqID_2593; Strand=+; Position=80-1162
AQFQSTVLEVINTSHTEDAVFRAEGGDVIEDLEDLVRNIDEQKETVVTHILTTLESFHLVSRSSVTALMYDPNDVTLSEHHNFTVTNNGQSEIEVEVTYTDSDDRANDQYRVVKPNETVVIEHNKDAGVALLNILNRHYTEVAIITATGGRVVRDIERKIKQLVSDEHSVMLVNNFHLAPASSVVVMHQVGRYRRRPMYPAGHRKPQQQHHPAQQQHHQGQQQHHQGQQQHHPAQQNRPQVGQCRPMRRPRVVMRPAMLRKPIVHDRYTVVNHGTHAFTAQIVHINGRNQEVVRTQVVQPNETQVLLLEGLNGSSLKIVNENETDYAIFSVEGGEVVYGFRYMVRPLRRRPGARRMFWGF

SEQ ID NO: 22897 - protein, 313 aa, Diabrotica virgifera
  misc_feature: Coding regions on vcDNA: vcDNA=SeqID_2594; Strand=+; Position=82-1023
VNVEPYRQCFGTYKRSPISSLHSFILTRLNPENTAFKMLRVQSQEVSTQEYSVETTTYETYEYETTFSVSETSKLDHFVLPPRTTILALSQSGGDKEEDKKYVVTNHGKADLFVEVVHLNNQDDAPQWFVVQPDQTSEIAIEDNLEQSVLKVSNNSYDQEVSFSAEGGLVIDDLENNIEELLDSDETEVEIVVLENFSLSPRTAVTVLSQNVEGSDEHPGKYTVTNLGKAAFDIELKRTSPVQTLELHRKTVEPNTSESFELTAQFQSTVLEVINTSHTEDAVFRAEGGDVIEDLEDLVRNIDEQKETVVLIF

SEQ ID NO: 22898 - protein, 82 aa, Diabrotica virgifera
  misc_feature: Coding regions on vcDNA: vcDNA=SeqID_2595; Strand=+; Position=256-504
LTIFILLILHICRDELTNKILLIFIFYILVRIKNFHILKYVIIYFYISLFLFFINFLLKYKFKLFKFSTDDNISITKLYIYH

SEQ ID NO: 22899 - protein, 187 aa, Diabrotica virgifera
  misc_feature: Coding regions on vcDNA: vcDNA=SeqID_2596; Strand=+; Position=390-953
  misc_feature: Homolog annotation: Hit_ID=YP_031668.1; Match level="QueryCoverage =45%, HitCoverage=20%, E-value=4e-10, Identity=48%"; Hit description =unknown [Frog virus 3] gb|AAT09749.1| unknown [Frog virus 3]
ATTVTTRRYHPAQGGHRPAQGGHHPAQQQHHPAQQQHHPAQQQHHQGQQQHHQGQQQHHPAQQNRPQVGQCRPMRRPRVVMRPAMLRKPIVHDRYTVVNHGTHAFTAQIVHINGRNQEVVRTQVVQPNETQVLLLEGLNGSSLKIVNENETDYAIFSVEGGEVVYGFRYMVRPLRRRPGARRMFWGF

SEQ ID NO: 22900 - protein, 78 aa, Diabrotica virgifera
  misc_feature: Coding regions on vcDNA: vcDNA=SeqID_2597; Strand=+; Position=376-612
CYNKFYLKWAELEKINVNAVRNLYLPISVNFLWYIVGTVAPERVLLFLKNLSINNICIVFEMRLFNYNKHKNELCTLF

SEQ ID NO: 22901 - protein, 322 aa, Diabrotica virgifera
  misc_feature: Coding regions on vcDNA: vcDNA=SeqID_2598; Strand=+; Position=162-1130
  misc_feature: Homolog annotation: Hit_ID=YP_031668.1; Match level="QueryCoverage =31%, HitCoverage=22%, E-value=9e-15, Identity=51%"; Hit description =unknown [Frog virus 3] gb|AAT09749.1| unknown [Frog virus 3]
  misc_feature: Gene Ontology Annotation: Cellular component=small nuclear ribonucleoprotein complex; Biological process=mRNA splicing
QWTNKGQSEIEVEVTYTDSDDRANDQYRVVKPNETVVIEHNKDAGVALLNILNRNYTEVAIITATGGRVVRDIERKIKQLVSDENSVMLVNNFHLAPASSVVVMHQVGRYTRRPMYPAGHRKPQHVMVRRPQYHPGRRPACKPAVARPCKPVGSLTGPGRRPFRRPACRPMIRPAYHPGQGGHPAQGGHRPAQGGHHPAQQGHHPAQPQHHPAQQQHHPAQQQHHPAQQQHHPAQQQHHPAQQQHHPAQQQHHPAQQNRPQVRQCRPMRRPRVVMRPAMLRKPIVHDRYTVVNHGTHAFTAQIVHVNGRNQEVVRTQVVQPN

SEQ ID NO: 22902 - protein, 66 aa, Diabrotica virgifera
  misc_feature: Coding regions on vcDNA: vcDNA=SeqID_2599; Strand=+; Position=396-596
CYNKFYLKWAELEKINVNAVRNLYLPISVNFLWYIVGTVAPERVLLFLKNLYINNMYCFRNETIQL

SEQ ID NO: 22903 - protein, 705 aa, Diabrotica virgifera
  misc_feature: Coding regions on vcDNA: vcDNA=SeqID_2600; Strand=+; Position=1528 -3645
  misc_feature: Homolog annotation: Hit_ID=YP_031668.1; Match level="QueryCoverage =12%, HitCoverage=22%, E-value=2e-09, Identity=45%"; Hit description =unknown [Frog virus 3] gb|AAT09749.1| unknown [Frog virus 3]
YISYSSRNFPHASAIFTMKRTHGSPRRNTANTGFKMAYRPRSMQESTQEYSVETTTYETYEYETTFSVSETSKLDHFVLPPRTTILALSQSGGDKEEDKKYVVTNHGKADLFVEVVHLNNQDDAPQWFVVQPDQTTEIAIEDSLEQSVLKVSNNSYDQEVSFSAEGGLVIDDLENNIEELLDSDETEVEIVVLENFSLSPRTAVTVLSQNVEGSDEHPGKYTVTNLGKAAFDIELKRTSPVQTLELHRKTVEPNTSESFELTAQFQSTVLEVINTSHTEDAVFRAEGGDVIEDLEDLVRNIDEQKETVVTHILTTLESFHLVSRSSVTALMYDPNDVTLSEHHNFTVTNNGQSEIEVEVTYTDSDDRANDQYRVVKPNETVVIEHNKDAGVALLNILNRHYTEVAIITATGGRVVRDIERKIKQLVSDEHSVMLVNNFHLAPASSVVVMHQVGRYSRRPMYPAGHRKPQHVMVRRPQYHPGRRPACKPAVARPCKPAGSPTGPGRRPFRRPACRPMIRPGHLPGQGGHPAQGGHRPAQGGHHPAQQQHHPAQQQHHPAQQQHHQGQQQHHQGQQQHHPAQQNRPQVGQCRPMRRPRVVMRPAMLRKPIVHDRYTVVNHGTHAFTAQIVHINGRNQEVVRTQVVQPNETQVLLLEGLNGSSLKIVNENETDYAIFSVEGGEVVYGFRYMVRPLRRRPGARRMFWGF

SEQ ID NO: 22904 - protein, 275 aa, Diabrotica virgifera
  misc_feature: Coding regions on vcDNA: vcDNA=SeqID_2601; Strand=+; Position=98-922
  misc_feature: Homolog annotation: Hit_ID=AAC60521.1; Match level="QueryCoverage =95%, HitCoverage=44%, E-value=4e-60, Identity=45%"; Hit description =chitooligosaccharidolytic beta-N-acetylglucosaminidase; beta -GlcNAcase [Bombyx mori]
  misc_feature: Gene Ontology Annotation: Molecular function=beta-N -acetylhexosaminidase activity; Cellular component=extracellular space
  misc_feature: Pfam annotation: Pfam_ID=Glyco_hydro_20b; Match level="Score=70.5, E -value=4.7e-18, Copies=1"; Pfam description=Glycosyl hydrolase family 20, domain
  misc_feature (250)..(250): Xaa can be any naturally occurring amino acid
  misc_feature (263)..(263): Xaa can be any naturally occurring amino acid
MAYLNLAHFIWIGLLIYSSSALNSSWRWECENNVCQRKRITNATISTALSLPACRLFCTDSAGIWPKSTGEFSMGSLLTKINAYSIDVVSNSSGTAIASLIKGAIKEFKSDIQASITSPIESGGKSVLVSIRVTNSSINQLTLQTDESYSLYISETNYGLIEVLIISNNFFGARHGLQTLSQIIIFDNLRNELQMPMEASITDKPNFPHRGILLDTSRNFVNVDTIKKTIKAMGASKLNTFHWHITDSHXLPYVSRSHPELSXVGAYSPSKHTLL

SEQ ID NO: 22905 - protein, 319 aa, Diabrotica virgifera
  misc_feature: Coding regions on vcDNA: vcDNA=SeqID_2602; Strand=+; Position=218-1177
  misc_feature: Homolog annotation: Hit_ID=AAC60521.1; Match level="QueryCoverage =97%, HitCoverage=52%, E-value=2e-81, Identity=48%"; Hit description =chitooligosaccharidolytic beta-N-acetylglucosaminidase; beta -GlcNAcase [Bombyx mori]
  misc_feature: Gene Ontology Annotation: Molecular function=beta-N -acetylhexosaminidase activity; Cellular component=extracellular space
  misc_feature: Pfam annotation: Pfam_ID=Glyco_hydro_20b; Match level="Score=70.5, E -value=4.7e-18, Copies=1"; Pfam description=Glycosyl hydrolase family 20, domain
  misc_feature (276)..(276): Xaa can be any naturally occurring amino acid
  misc_feature (279)..(279): Xaa can be any naturally occurring amino acid
  misc_feature (302)..(302): Xaa can be any naturally occurring amino acid
MAYLNLAHFIWIGLLIYSSSALNSSWRWECENNVCQRKRITNATISTALSLPACRLFCTDSAGIWPKSTGEFSMGSLLTKINAYSIDVVSNSSGTAIASLIKGAIKEFKSDIQASITSPIESGGKSVLVSIRVTNSSINQLTLQTDESYSLYISETNYGLIEVLIISNNFFGARHGLQTLSQIIIFDNLRNELQMPMEASITDKPNFPHRGILLDTSRNFVNVDTIKKTIKAMGASKLNTFHWHITDSHSFPYVSRSHPELSKLGAYSPSKTYTAXDIXEIVHYGKIRGVKIIPDFDAPAHXGEGWQDRGFVVCQIAPP

SEQ ID NO: 22906 - protein, 363 aa, Diabrotica virgifera
  misc_feature: Coding regions on vcDNA: vcDNA=SeqID_2603; Strand=+; Position=119-1207
  misc_feature: Homolog annotation: Hit_ID=AAG26008.1; Match level="QueryCoverage =99%, HitCoverage=72%, E-value=1e-109, Identity=51%"; Hit description= beta-glucosidase precursor [Tenebrio molitor]
  misc_feature: Gene Ontology Annotation: Cellular component=endoplasmic reticulum; Biological process=aging
  misc_feature: Pfam annotation: Pfam_ID=Glyco_hydro_1; Match level="Score=357.8, E -value=1.5e-104, Copies=1"; Pfam description=Glycosyl hydrolase family 1
IVCTSKLVEPLNNRRFPAHFMIGAATASYQVEGAWNKDGKGENIWDRLTHSPNSPVLGNQNGNIACDSYHKYKEDVAMLKHLGVNHYRFSISWSRILPTGFTNRINQAGITYYKNLIKELKDNGIEPFVTIFHWDTPQPLEDIGGWTNELIVDKFRDYAKVLFDNFGNDVKYWVTFNEPKQTCQEGYGSGQKAPAIKSHGIGEYLCAHNVIKSHAKVWHLYDRYYRKEQRGMVGIVLDTMWMEPDTESELDKVAAERKLQFIFGWYANPIINGDYPAQMKQFIAKRSIAQGFKQSRLPQFTPEEVKYIKGSIDFLGVNQYTSMLVRNMDDKYKTEVAWEADSETYLYQPDNWESTATDWLKVT

SEQ ID NO: 22907 - protein, 466 aa, Diabrotica virgifera
  misc_feature: Coding regions on vcDNA: vcDNA=SeqID_2604; Strand=-; Position=1-1399
  misc_feature: Homolog annotation: Hit_ID=XP_394395.1; Match level="QueryCoverage =100%, HitCoverage=97%, E-value=1e-117, Identity=47%"; Hit description=similar to CG4749-PA [Apis mellifera]
  misc_feature: Gene Ontology Annotation: Molecular function=tRNA (cytosine-5-) -methyltransferase activity; Cellular component=nucleus; Biological process=tRNA methylation
  misc_feature: Pfam annotation: Pfam_ID=Nol1_Nop2_Fmu; Match level="Score=-33.7, E -value=8.3e-06, Copies=1"; Pfam description=NOL1/NOP2/sun family
  misc_feature (108)..(108): Xaa can be any naturally occurring amino acid
LKKQKKFVRYKHPAHHWSVVRKKVNPVDKALNHFDDFYQQVFDTKWLSIRKALLGKHKYVAVLNCFGDIQETKYDLELKGALNMRTLFNLEKGYLKEEIEQKKEKPTXDEVFKMDEQLTEKTDEAVQEDPTPKKFEAKDFSLKSSLEKAEIDMRRMVDTENALSMEVLHEYIPATKIKGKEDFILESSHYNLYDQNTQFGVQIEKEFDFHFPDHLEVYCYEEGNKSDFESPKRSITDVYNYYLMDGGSVLPVLALDIKPGHKVLDMCSAPGGKSLLALQTLYPSCIVSNDVSNSRVNRIDSVYNQFLFDFEEKWLKTGKIRLSNVDGRYMEEYDFDRILVDVPCTTDRHSLHENDNNIFKPSRVKERLQLPELQRQLLFQALKLVKIGGVVVYSTCSLSPIQNDGVVHMALKQIWEETNMEIVVKDLSPALLQTRRVYKYADKGLLRYGHLVIPHMNQNYGPMYFC

SEQ ID NO: 22908 - protein, 284 aa, Diabrotica virgifera
  misc_feature: Coding regions on vcDNA: vcDNA=SeqID_2605; Strand=+; Position=83-933
  misc_feature: Homolog annotation: Hit_ID=XP_391850.1; Match level="QueryCoverage =87%, HitCoverage=27%, E-value=1e-105, Identity=66%"; Hit description= similar to CG7152-PB [Apis mellifera]
  misc_feature: Gene Ontology Annotation: Molecular function=purine-nucleoside phosphorylase activity; Cellular component=cellular_component unknown; Biological process=DNA modification
  misc_feature: Pfam annotation: Pfam_ID=Mtap_PNP; Match level="Score=341.5, E-value =1.3e-99, Copies=1"; Pfam description=Phosphorylase family 2
  misc_feature (263)..(263): Xaa can be any naturally occurring amino acid
MNTIFNGNILMNGNGALNGKTNGTNVENGDNGVYTYETLNETAEFLKNLVPIKPKIGIICGSGLGTLADALDQKIAVPYEKIPNFPESTVKGHTGALVFGYIGGVAVVCMKGRFHYYEGYPLWKCAMPVRVMKLLGITHLIATNAAGGLNPRYKVGDIMLIKDHINLMGFAGNNPLQGPNDERFGPRFPPMNNSYDRQLIREAKRIAKGLGLEKDIHEGVYTCLGGPNFETVAELRMLKMWGADTVGMSTVHEVITARHCDLXVLAFSLVTNECLVEYDNTEFL

SEQ ID NO: 22909 - protein, 325 aa, Diabrotica virgifera
  misc_feature: Coding regions on vcDNA: vcDNA=SeqID_2606; Strand=+; Position=69-1046
  misc_feature: Homolog annotation: Hit_ID=XP_391850.1; Match level="QueryCoverage =86%, HitCoverage=30%, E-value=1e-112, Identity=65%"; Hit description= similar to CG7152-PB [Apis mellifera]
  misc_feature: Gene Ontology Annotation: Molecular function=purine-nucleoside phosphorylase activity; Cellular component=cellular_component unknown; Biological process=DNA modification
  misc_feature: Pfam annotation: Pfam_ID=Mtap_PNP; Match level="Score=376.6, E-value =3.3e-110, Copies=1"; Pfam description=Phosphorylase family 2
MNTIFNGNILMNGNGALNGKTNGTNVENGDNGVYTYETLNETAEFLKNLVPIKPKIGIICGSGLGAYWNEGTLADALDQKIAVPYEKIPNFPESTVKGHTGALVFGYIGGVAVVCMKGRFHYYEGYPLWKCAMPVRVMKLLGITHLIATNAAGGLNPRYKVGDIMLIKDHINLMGFAGNNPLQGPNDERFGPRFPPMNNSYDRQLIREAKRIAKGLGLEKDIHEGVYTCLGGPNFETVAELRMLKMWGADTVGMSTVHEVITARHCDLTVLAFSLVTNECLVEYDNTEFPNHEEVLDVGKVRQEVLQKFVKQIIEFIATTKEFKQ

SEQ ID NO: 22910 - protein, 104 aa, Diabrotica virgifera
  misc_feature: Coding regions on vcDNA: vcDNA=SeqID_2607; Strand=+; Position=68-382
  misc_feature: Homolog annotation: Hit_ID=XP_392616.1; Match level="QueryCoverage =89%, HitCoverage=56%, E-value=2e-33, Identity=70%"; Hit description =similar to Hypothetical protein CBG21048 [Apis mellifera]
  misc_feature: Pfam annotation: Pfam_ID=IATP; Match level="Score=92.7, E-value=9.3e -25, Copies=1"; Pfam description=Mitochondrial ATPase inhibitor, IATP
MFVTRILRPAVVQNVRFMSQLGDLGSGAGKGGGGGGSIREAGGAFGKQEAAREEEYFYKKQREQLQKLKTDLKDEISFHEEQIKRHQEAISRHKNRVTELDKKE

SEQ ID NO: 22911 - protein, 273 aa, Diabrotica virgifera
  misc_feature: Coding regions on vcDNA: vcDNA=SeqID_2608; Strand=+; Position=36-857
  misc_feature: Homolog annotation: Hit_ID=XP_392138.1; Match level="QueryCoverage =95%, HitCoverage=77%, E-value=1e-94, Identity=63%"; Hit description =similar to ENSANGP00000013517 [Apis mellifera]
  misc_feature: Gene Ontology Annotation: Molecular function=binding; Cellular component=soluble fraction; Biological process=vitamin A metabolism
  misc_feature: Pfam annotation: Pfam_ID=CRAL_TRIO_N; Match level="Score=15.7, E -value=0.00058, Copies=1"; Pfam description=CRAL/TRIO, N-terminus
MSVSKGLAEPDVYVCTLSPETQRIAKEELREDEHTRQTALASMREWIMQNPKIKLCRLDGKFLLRFLRFKKFHVTLAQECLERYILLRQTFGVAFNCLDITIPMMNDLTDLGYMFACPKRDRLGRRVIFYRPGVFDLYSFSNADMCRIHGVVYETLLEDEENQVRGFVHVADGQGVGFPYLTLFSIREAVRIVKNGEKTLPMRHKEVHGMHVLPTMKFAVDFGMSLISEKIRNRVRVYSNVQDMISSGHIEVDILPKEYGGTMPMGRMIALWA

SEQ ID NO: 22912 - protein, 533 aa, Diabrotica virgifera
  misc_feature: Coding regions on vcDNA: vcDNA=SeqID_2609; Strand=+; Position=171-1768
  misc_feature: Homolog annotation: Hit_ID=XP_316062.1; Match level="QueryCoverage =99%, HitCoverage=99%, E-value=0.0, Identity=71%"; Hit description =ENSANGP00000022791 [Anopheles gambiae] gb|EAA44132.2| ENSANGP00000023205 [Anopheles gambiae
  misc_feature: Gene Ontology Annotation: Molecular function=tyrosine 3-monooxygenase activity; Cellular component=cellular_component unknown; Biological process=courtship behavior
  misc_feature: Pfam annotation: Pfam_ID=Biopterin_H; Match level="Score=836.3, E -value=1.3e-248, Copies=1"; Pfam description=Biopterin-dependent aromatic amino ac
  misc_feature (484)..(484): Xaa can be any naturally occurring amino acid
  misc_feature (495)..(495): Xaa can be any naturally occurring amino acid
  misc_feature (525)..(525): Xaa can be any naturally occurring amino acid
MAAVAAAQKNREMFAIKKSYSIENGYPARRRSLVDDARFETLVVKQTKQTVLDEARQRANDTLEPEVDETPIQKQPAPNTEDDTGLTEEEIVLANAITEGLEAEKAIQKAALILRLREGMNSLSRVLKAIEKYQGVVLHLETRPNQRDNGQLDALIKIEMTRVNLLQLLKGLRQSGTLEHTTLIGEDNISAKNPWFPRHASELDSCNHLMTKYEPDLDMNHPGFSDKEYRARRKEIAEIAFSYKYGEPVPFIEYTETENKTWNAVFTTVCELMHKHACAEYRTVFRILQDEGIFNPHKVPQLEEMSCFMKKRTGFTLRPAAGLLTARDFLASLAFRIFQSTQYVRHTKTPFHTPEPDCIHEILGHMPLLADPSFAQFSQEIGLASLGASDEEIEKLSTIYWFTVEFGLCKENGETRAYGAGLLSAYGELLHALSDKPEHRPFDPAKTALQPYQDQEYQPVYYVAESIEDMKDKFRRWVSQMSRXPFEVRFNPHTXERVEVLDSVEKLESLAHQLNTEIMHLYDAXHKMRAPVI

SEQ ID NO: 22913 - protein, 207 aa, Diabrotica virgifera
  misc_feature: Coding regions on vcDNA: vcDNA=SeqID_2610; Strand=+; Position=86-709
  misc_feature: Homolog annotation: Hit_ID=NP_650875.2; Match level="QueryCoverage =93%, HitCoverage=89%, E-value=5e-50, Identity=47%"; Hit description =CG4367-PA [Drosophila melanogaster] gb|AAF55752.2| CG4367-PA [Drosophila melanogaster]
  misc_feature: Pfam annotation: Pfam_ID=Chitin_bind_3; Match level="Score=5.6, E -value=5.7e-08, Copies=1"; Pfam description=Chitin binding domain
MTLKVVLYFGMYLIAEISGHGMMLNPPGRSSFWRFNDTAPRNFDDNQVFCGGAYVQNELNDGKCGVCGDPYTDPHPQRNENTGFYGIGIVVKTYEPGSVIDVKIMLTANHLGNFTYSLCELEDFDAPEPENCFEDLLLEDGSANYNVEWEDEVVFNKVRLPNFQCERCVLRWTYKAGNNWGLCEDGKWRRGCGPQEHFISCADIALL

SEQ ID NO: 22914 - protein, 267 aa, Diabrotica virgifera
  misc_feature: Coding regions on vcDNA: vcDNA=SeqID_2611; Strand=+; Position=80-883
  misc_feature: Homolog annotation: Hit_ID=EAL26993.1; Match level="QueryCoverage =94%, HitCoverage=82%, E-value=6e-56, Identity=40%"; Hit description =GA18780-PA [Drosophila pseudoobscura]
  misc_feature: Gene Ontology Annotation: Molecular function=G-protein coupled photoreceptor activity; Cellular component=cellular_component unknown; Biological process=fatty acid biosynthesis
  misc_feature: Pfam annotation: Pfam_ID=ELO; Match level="Score=-60.8, E-value=6e -08, Copies=1"; Pfam description=GNS1/SUR4 family
MALVLKRAILGYRWLFDELGDSRPLEQNLFLMSSPFQALAVIVAYFYFIYRLGPRLMQNREPFDLKRILLAYNLAQIAVNAFIVYVAFDEVWFNINWHCEKISYGRDPHSIYILKMYHLFFLTKLADLLETIFFVLRKRQRQITFLHVYHHFGMFLIIWITVRFVAGGYNTWVGLVNSAVHTVMYTYYFLSSLDEKWKQNLAFKKFITQIQLVQFTFFVILFGRQLFVECGYPKLLCMFFVPQNFFMMILFSDFYRRAYLKKPKHVA

SEQ ID NO: 22915 - protein, 153 aa, Diabrotica virgifera
  misc_feature: Coding regions on vcDNA: vcDNA=SeqID_2612; Strand=+; Position=139-600
  misc_feature: Homolog annotation: Hit_ID=AAR97568.1; Match level="QueryCoverage =100%, HitCoverage=100%, E-value=4e-65, Identity=74%"; Hit description=Cu/Zn SOD [Bombyx mori] sp|P82205|SODC_BOMMO Superoxide dismutase [Cu-Zn]
  misc_feature: Gene Ontology Annotation: Molecular function=copper, zinc superoxide dismutase activity; Cellular component=cytoplasm; Biological process= neurogenesis
  misc_feature: Pfam annotation: Pfam_ID=Sod_Cu; Match level="Score=331.3, E-value =1.4e-96, Copies=1"; Pfam description=Copper/zinc superoxide dismutase (SOD
MPAKAVCVLKGEVTGTVFFDQASGSSPVQVSGEISGLTQGQHGFHIHEFGDNTNGCISAGAHFNPHGKDHGGPDASVRHVGDLGNVVADASGVAKINISDKYISLEGEHNIVGRTVVVHADPDDLGVGGHELSKTTGNAGGRLACGVIGLAKI

SEQ ID NO: 22916 - protein, 232 aa, Diabrotica virgifera
  misc_feature: Coding regions on vcDNA: vcDNA=SeqID_2613; Strand=+; Position=167-862
  misc_feature: Homolog annotation: Hit_ID=EAL27352.1; Match level="QueryCoverage =94%, HitCoverage=37%, E-value=1e-76, Identity=49%"; Hit description =GA19448-PA [Drosophila pseudoobscura]
  misc_feature: Gene Ontology Annotation: Cellular component=nuclear lamina; Biological process=torso signaling pathway
  misc_feature (117)..(117): Xaa can be any naturally occurring amino acid
  misc_feature (153)..(153): Xaa can be any naturally occurring amino acid
MRTVIVLVSLCIFGFQVYCQEEDGPYRGKYLGKLNSYHHQVSGDIYAVDDWTLLLTSFSYDGNGADTFFWAGAANRPGPQGFIVPDMYGKTNVLERFFNKDFTLVLPDKKKITDIKXRAIYDIWSENTFGDIYIHEYIPPPTVQRVSENFRNXIGMTTESEEMLTPERITEHQCAYDGKAKKAYFWVGVGAQPVSKGFKVPDEYGYLDPLRAYKNLTITLEIPSDSTVFDID

SEQ ID NO: 22917 - protein, 214 aa, Diabrotica virgifera
  misc_feature: Coding regions on vcDNA: vcDNA=SeqID_2614; Strand=+; Position=1-645
  misc_feature: Homolog annotation: Hit_ID=AAV91413.1; Match level="QueryCoverage =94%, HitCoverage=100%, E-value=5e-71, Identity=70%"; Hit description= myosin 3 light chain [Lonomia obliqua]
  misc_feature: Gene Ontology Annotation: Molecular function=calcium ion binding; Cellular component=myosin; Biological process=smooth muscle contraction
  misc_feature: Pfam annotation: Pfam_ID=efhand; Match level="Score=43.2, E-value =7.8e-10, Copies=2"; Pfam description=EF hand
RCYLEKLTSLTTMADKEKKVKKKKKEEGEAPAAAPAPAETRSSSKSSSKKAKRSGSNVFSMFSQSQVAEFKEAFQLMDHDKDGIISKSDLRATFDAVGKLASEKELDEMINEAPGPINFTQLLGLFGTRMADSGGTDDDEVVVKAFRSFDENGTIDGDRFRHALMTWGEKFTGKECDDAFDAMDIDDNNRIDTQALITLLTAAEKEEGEEGEAA

SEQ ID NO: 22918 - protein, 229 aa, Diabrotica virgifera
  misc_feature: Coding regions on vcDNA: vcDNA=SeqID_2615; Strand=+; Position=89-778
  misc_feature: Homolog annotation: Hit_ID=AAV91413.1; Match level="QueryCoverage =88%, HitCoverage=100%, E-value=6e-71, Identity=70%"; Hit description= myosin 3 light chain [Lonomia obliqua]
  misc_feature: Gene Ontology Annotation: Molecular function=calcium ion binding; Cellular component=myosin; Biological process=smooth muscle contraction
  misc_feature: Pfam annotation: Pfam_ID=efhand; Match level="Score=43.2, E-value =7.8e-10, Copies=2"; Pfam description=EF hand
EYRTSSRSRAAARDLGCYLEKLTSLTTMADKEKKVKKKKKEEGEAPAAAPAPAETRSSSKSSSKKAKRSGSNVFSMFSQSQVAEFKEAFQLMDHDKDGIISKSDLRATFDAVGKLASEKELDEMINEAPGPINFTQLLGLFGTRMADSGGTDDDEVVVKAFRSFDENGTIDGDRFRHALMTWGEKFTGKECDDAFDAMDIDDNNRIDTQALITLLTAAEKEEGEEGEAA

SEQ ID NO: 22919 - protein, 217 aa, Diabrotica virgifera
  misc_feature: Coding regions on vcDNA: vcDNA=SeqID_2616; Strand=+; Position=673-1326
  misc_feature: Homolog annotation: Hit_ID=AAV91413.1; Match level="QueryCoverage =93%, HitCoverage=100%, E-value=6e-71, Identity=70%"; Hit description= myosin 3 light chain [Lonomia obliqua]
  misc_feature: Gene Ontology Annotation: Molecular function=calcium ion binding; Cellular component=myosin; Biological process=smooth muscle contraction
  misc_feature: Pfam annotation: Pfam_ID=efhand; Match level="Score=43.2, E-value =7.8e-10, Copies=2"; Pfam description=EF hand
VWKKKNLEKLTSLTTMADKEKKVKKKKKEEGEAPAAAPAPAETRSSSKSSSKKAKRSGSNVFSMFSQSQVAEFKEAFQLMDHDKDGIISKSDLRATFDAVGKLASEKELDEMINEAPGPINFTQLLGLFGTRMADSGGTDDDEVVVKAFRSFDENGTIDGDRFRHALMTWGEKFTGKECDDAFDAMDIDDNNRIDTQALITLLTAAEKEEGEEGEAA

SEQ ID NO: 22920 - protein, 369 aa, Diabrotica virgifera
  misc_feature: Coding regions on vcDNA: vcDNA=SeqID_2617; Strand=+; Position=39-2111
  misc_feature: Homolog annotation: Hit_ID=AAV91413.1; Match level="QueryCoverage =100%, HitCoverage=100%, E-value=1e-123, Identity=65%"; Hit description=myosin 3 light chain [Lonomia obliqua]
  misc_feature: Gene Ontology Annotation: Molecular function=calcium ion binding; Cellular component=myosin; Biological process=smooth muscle contraction
  misc_feature: Pfam annotation: Pfam_ID=efhand; Match level="Score=69.9, E-value =6.8e-18, Copies=3"; Pfam description=EF hand
MADKEKKVKKKKKEEGEAPAAAPAPAETRSSSKSSSKKAKRSGSNVFSMFSQSQVAEFKEAFQLMDHDKDGIISKSDLRATFDAVGKLASEKELDEMINEAPGPINFTQLLGLFGTRMADSGGTDDDEVVVKAFRSFDENGTIDGDRFLPPRVRGRVYLEKLTSLTTMADKEKKVKKKKKEEGEAPAAAPAPAETRSSSKSSSKKAKRSGSNVFSMFSQSQVAEFKEAFQLMDHDKDGIISKSDLRATFDAVGKLASEKELDEMINEAPGPINFTQLLGLFGTRMADSGGTDDDEVVVKAFRSFDENGTIDGDRFRHALMTWGEKFTGKECDDAFDAMDIDDNNRIDTQALITLLTAAEKEEGEEGEAA

SEQ ID NO: 22921 - protein, 194 aa, Diabrotica virgifera
  misc_feature: Coding regions on vcDNA: vcDNA=SeqID_2618; Strand=+; Position=654-1235
CSPRIKKKSYEKEKGLKYAISRLSLFHTWKLRSKPPNTTDFKNLINMNGTRVFGMLIIILLHIGVASNTSFISDPEVYEKVYYTLVDSILGCLPVLIVLYFFLISSWLLTIQVHNIYERGQLSLKNVGILILNRYFRLNLVIIVLMIISRSSWVTMIPGPANFYTVMANQKHAVKTGSLQYFYTHIYRGVHIWN

SEQ ID NO: 22922 - protein, 58 aa, Diabrotica virgifera
  misc_feature: Coding regions on vcDNA: vcDNA=SeqID_2619; Strand=+; Position=191-367
LVFPKSASFLGYFTLKYLICNLTNKDVFFMSCNFDFAGSIDFTSSHFFSFFYIMLHFC

SEQ ID NO: 22923 - protein, 86 aa, Diabrotica virgifera
  misc_feature: Coding regions on vcDNA: vcDNA=SeqID_2620; Strand=+; Position=784-1044
RSTYSNNHHLVSRLILLIKLLPVYAPMEHIKFLIACQKMHDNYLLKPIKFHLHISTGFRAINKSPVCKKKFNIPYLGNEACVDLCL

SEQ ID NO: 22924 - protein, 81 aa, Diabrotica virgifera
  misc_feature: Coding regions on vcDNA: vcDNA=SeqID_2621; Strand=+; Position=249-494
  misc_feature: Pfam annotation: Pfam_ID=TIL; Match level="Score=10.1, E-value =0.0031, Copies=1"; Pfam description=Trypsin Inhibitor like cysteine rich
MKILKNASRKKTRPPACKPGEEKRCIPCLCHEATCQNPKPFCRKDMICSEDCRPFCVCKQGYLRDNSTGTCVPQDNCPSAA

SEQ ID NO: 22925 - protein, 340 aa, Diabrotica virgifera
  misc_feature: Coding regions on vcDNA: vcDNA=SeqID_2622; Strand=+; Position=1-1020
  misc_feature: Homolog annotation: Hit_ID=XP_393330.1; Match level="QueryCoverage =100%, HitCoverage=30%, E-value=0.0, Identity=94%"; Hit description =similar to ENSANGP00000004153 [Apis mellifera]
  misc_feature: Gene Ontology Annotation: Molecular function=RNA binding; Cellular component=cytoplasm; Biological process=mRNA catabolism, nonsense -mediated
GPVLVCAPSNTAVDQLTEKIHKTNLKVVRLCAKSREAIDSPVSFLALHNQIRKMEGNTELQKLQQLKDETGELSSVDEKRYRMLKKMAEKELLEAADVICCTCVGAGDPRLVRLKFHSILIDESMQATEPECMVPVVLGVKQLILVGDHCQLGPVVMCKKAARAGLSQSLFERLVVLGIRPFRLEVQYRMHPELSRFPSNFFYEGSLQNGVSAEERKLAKIDFPWPIQDRPMFFLVTQGQEEIAGSGTSYLNRTEASNVEKIATRFLRSGVKPEQIGVITPYEGQRAYLVQYMQYQGSLHSKLYQEIEIASVDAFQGREKDIIIMSCVRSNEHQGIGFLD

SEQ ID NO: 22926 - protein, 286 aa, Diabrotica virgifera
  misc_feature: Coding regions on vcDNA: vcDNA=SeqID_2623; Strand=+; Position=226-1086
MCVSNMKDIACVIIYLYLPVLILCRPNTGEIIEIELPNRSGFDVDLSAVTRLLNTEGAQNVIKGAQQFLTQVNGKPVTIEIIDAGQMPNHQTSNSQTYWSQQNFNRQQWPQRTHQRPQSMGENVYITKDTRYSNDPNIEVYDVYTGEQPIHQRYPNRRYPNGQLIPVGPIRTYPDPNVYPPNHNRYPYDGRNPWNTNIYDNSRLNPTQPTNKPRPHMMHHHHHSSPRPAPKDTSSDESIIEDSTINIDLSKDQNTSEKPKKPDSNNVDGYIDKFPVILLNENEIRK

SEQ ID NO: 22927 - protein, 194 aa, Diabrotica virgifera
  misc_feature: Coding regions on vcDNA: vcDNA=SeqID_2624; Strand=+; Position=8-592
  misc_feature: Homolog annotation: Hit_ID=NP_728587.1; Match level="QueryCoverage =91%, HitCoverage=95%, E-value=3e-23, Identity=34%"; Hit description =CG9134-PC, isoform C [Drosophila melanogaster] ref|NP_728586.1| CG9134-PA, isoform A [Drosophila
  misc_feature: Gene Ontology Annotation: Molecular function=galactose binding
  misc_feature: Pfam annotation: Pfam_ID=Lectin_C; Match level="Score=97.2, E-value =4.3e-26, Copies=1"; Pfam description=Lectin C-type domain
MALFNSVILLSVLTLIGSTLVTSCKDYPTLPPIRPVPCRVDKWEDVFRDRQSPVIPLKHWGNKSYWIGTTFQATWFEAIDFCHQMHMQLLTINSAEENEVIYGYIKQANKGFEYWTAGTRLVDDIKYVWFPYGDLVRYTNWSKGQPDFLTGEQCLQLWKADEQLQWNDRPCDVRFYFICERYDCQNTGRGPPRL

SEQ ID NO: 22928 - protein, 161 aa, Diabrotica virgifera
  misc_feature: Coding regions on vcDNA: vcDNA=SeqID_2625; Strand=-; Position=518-1003
  misc_feature: Homolog annotation: Hit_ID=NP_493808.1; Match level="QueryCoverage =81%, HitCoverage=39%, E-value=6e-13, Identity=33%"; Hit description =transposable element transposase (2B77) [Caenorhabditis elegans] gb|AAD12818.1| Hypothetical
CLYKTVRSQLRHEEKLSFEAHTDLVLIERGTLTAHRNIRNILQHHNVIPYARSIGNGFLLIQVNPRPHTAMIITQYLEDVHIAKLDWPSQSPDLNSIEYIWSLLKRRVKRRMPTPTTCEEVRMPLIEEWITFPQRDIQNVISSMPNRMMSVIQNLGGNTHY

SEQ ID NO: 22929 - protein, 366 aa, Diabrotica virgifera
  misc_feature: Coding regions on vcDNA: vcDNA=SeqID_2626; Strand=+; Position=60-1161
  misc_feature: Homolog annotation: Hit_ID=XP_395004.1; Match level="QueryCoverage =98%, HitCoverage=59%, E-value=3e-90, Identity=49%"; Hit description =similar to ENSANGP00000010987 [Apis mellifera]
  misc_feature: Gene Ontology Annotation: Molecular function=asialoglycoprotein receptor activity; Cellular component=plasma membrane; Biological process=vesicle-mediated transport
  misc_feature: Pfam annotation: Pfam_ID=Alpha-2-MRAP_C; Match level="Score=176.2, E -value=6.9e-50, Copies=1"; Pfam description=Alpha-2-macroglobulin RAP, C-terminal
  misc_feature (329)..(329): Xaa can be any naturally occurring amino acid
MKGLNVICVIILSVFVINTTCYNKYTKEANLETNDVNKNKDDVDEPVDLRPITLKHLDRPFRMAKLNLLWSKAVLRLSDIKLKSIFGDLKLHDKEEITWKHLRAEGKDKDGTIEAQLRKKLLQIMENFGLLDQADDISDVEKAKRWKPLNEVSDKHINKSIFKDKKLNKLWEKAEKAGFTTEELLALREEFGHHQDKIDQYYSLLHDVKGQPEDYEGNAVEDSLDKYNKIEIQEEKEPNKDYLDKVNLLREKHKEVNDGFDHLHLLSAKGPASKEFVEPKVQGLWKVAIESNFTPSELHSLKTELLHYENRLLKLRHLQVEHALNEEKXRRNKKLELQAVKLDTHSLMADNIKKHARKVEKIHLDL

SEQ ID NO: 22930 - protein, 98 aa, Diabrotica virgifera
  misc_feature: Coding regions on vcDNA: vcDNA=SeqID_2627; Strand=-; Position=82-378
KNLKIMSIENIVKLLICYNFPNRGRRIMKCQRSNLMYLLISSRIIYRVFISKLCTILVSSTVFYFVISGIAQLWISLTSPFNIKENTFANSSRIIIFI

SEQ ID NO: 22931 - protein, 48 aa, Diabrotica virgifera
  misc_feature: Coding regions on vcDNA: vcDNA=SeqID_2628; Strand=-; Position=3-146
MMQDALRCPKNSVVKSIIFNTHVFFTLGYHTSILTHLFYITIIYKKCK

SEQ ID NO: 22932 - protein, 100 aa, Diabrotica virgifera
  misc_feature: Coding regions on vcDNA: vcDNA=SeqID_2629; Strand=-; Position=34-336
IWLSLQLLTYLSIIVKVAMLKLDKIFGRPGIVFDRDRGLLVKICKLGRRNTLRGITAHSVAIVPRSNYICQPSKHVQSLCHHARAINPHAEVYIIGKIIN

SEQ ID NO: 22933 - protein, 318 aa, Diabrotica virgifera
  misc_feature: Coding regions on vcDNA: vcDNA=SeqID_2630; Strand=+; Position=127-1083
  misc_feature: Homolog annotation: Hit_ID=XP_320497.1; Match level="QueryCoverage =92%, HitCoverage=58%, E-value=1e-31, Identity=34%"; Hit description =ENSANGP00000015762 [Anopheles gambiae]
  misc_feature: Gene Ontology Annotation: Molecular function=transcription co -repressor activity; Cellular component=nucleus; Biological process =regulation of transcription, DNA-dependent
  misc_feature: Pfam annotation: Pfam_ID=zf-C2H2; Match level="Score=110.2, E-value =5.2e-30, Copies=4"; Pfam description=Zinc finger, C2H2 type
MDMTMYLTAPLQIDKICRACLSEKGDMRPLFGACLDEMLNTFASLQVSENDGFPHLMCVQCVLQCSRAYTFKQQCEKSDNILRQYLSPEFQKQLSDTLAEKQREQVKQELQEQLQFSEHLGTVIIEEDIPEFVTYTDDDQVVVKEGLYTIETTTVTDAISEELSEGIVLQLEEKQPEDTGNKQKYSCKKCDLSFPLKVDLKVHMMSHPKDLDFECHVCDKAFSEARILKRHLKIHLEQKPHQCDQCDMSFAESSNLTKHKKKHTGELRNIKGKPHLCSVCGRAFKWASSLSKHMKYHTGHKLLTREYLRNTVMVRCKN

SEQ ID NO: 22934 - protein, 72 aa, Diabrotica virgifera
  misc_feature: Coding regions on vcDNA: vcDNA=SeqID_2631; Strand=-; Position=645-863
ISNFLPITHIMLVNNLYGWLKRLLGRMCRSFISWEIEVKKIVERIYIPERNCFRIYQDRHGRLESSHAGMRD

SEQ ID NO: 22935 - protein, 326 aa, Diabrotica virgifera
  misc_feature: Coding regions on vcDNA: vcDNA=SeqID_2632; Strand=+; Position=372-1349
  misc_feature: Homolog annotation: Hit_ID=XP_311872.1; Match level="QueryCoverage =98%, HitCoverage=85%, E-value=1e-166, Identity=92%"; Hit description= ENSANGP00000017585 [Anopheles gambiae]
  misc_feature: Gene Ontology Annotation: Molecular function=proteasome endopeptidase activity; Cellular component=proteasome regulatory particle (sensu Eukarya); Biological process=proteolysis and peptidolysis
  misc_feature: Pfam annotation: Pfam_ID=AAA; Match level="Score=148.3, E-value=1.7e -41, Copies=1"; Pfam description=ATPase family associated with various
MEAMDIVIPEKEEGSPSEVKQVLQDVDTEDLYTKYKKLQQQLEFLEVQEEYIKDEQRNLKKEYLHAQEEVKRIQSVPLVIGQFLEAVDQNTGIVGSTTGSNYYVRILSTIDRELLKPSASVALHKHSNALVDVLPPEADSSISMLQADEKPDVQYSDIGGMDMQKQEIREAVELPLTHFELYKQIGIDPPRGVLMYGPPGCGKTMLAKAVAHHTTAAFIRVVGSEFVQKYLGEGPRMVRDVFRLAKENSPAIIFIDEIDAIATKRFDAQTGADREVQRILLELLNQMDGFDQTTNGKVIMATNRADTLDPALLRPGRLDRKIEFPF

SEQ ID NO: 22936 - protein, 603 aa, Diabrotica virgifera
  misc_feature: Coding regions on vcDNA: vcDNA=SeqID_2633; Strand=+; Position=83-1889
  misc_feature: Homolog annotation: Hit_ID=XP_397439.1; Match level="QueryCoverage =98%, HitCoverage=55%, E-value=0.0, Identity=82%"; Hit description =similar to ENSANGP00000015381 [Apis mellifera]
  misc_feature: Gene Ontology Annotation: Molecular function=translation initiation factor activity; Cellular component=incipient bud site; Biological process=protein biosynthesis
  misc_feature: Pfam annotation: Pfam_ID=PCI; Match level="Score=29.2, E-value=1.2e -05, Copies=1"; Pfam description=PCI domain
  misc_feature (576)..(576): Xaa can be any naturally occurring amino acid
  misc_feature (578)..(578): Xaa can be any naturally occurring amino acid
  misc_feature (584)..(585): Xaa can be any naturally occurring amino acid
MARYGQRPENALKRANEFIEVGKPARALDTLQEVFRNKKWAYNWSESVLEPIMFKYLDLCVELKKSHIAKEGLFQYRNMFQSVNVGSLENVIRGYLRMAEERTENAREQSAQAVIDIDDLDNLATPESILLSAVSGEDAQDRSDRTILTPWVKFLWESYCQCLELLRTNAHVENLYHDIARMAFQFCLKYNRKTEFRKLCDKLRKHLEDICKLPTQMANVSMSKPETQQLNLETRLHQLDFAIQMELWQEAYKAIEDIHNLMNLSKKSPVPKTMANYYQKLAMVFWKAGNYLFHAAALFKFFQLSKEMKKNITPEELQRMACRVLIATLAIPLPSAHPEFDRFIETDKSPLEKAQRLAVLLGLIQPPTRASLLRDLVRVNVVNLASPQLQDLYNWLEVEFHPLLLCQRVHEVIKSLESEENAALQQYVPALQDVTLVRLVRQIAQVYQTIEFARLIQIAKFTTPFHLERLLVDCVRHNDMQIRIDHGKDCIHFGMDLSESQREDKPEGPTLQVMPSEQVRNQLINMSTVLNQAIQVINPNKKKLEREKLRAVMVQNYHETKVREHQKILLRHKIIXDXKDTLSXXDTVREEESRKDGRMHGRP

SEQ ID NO: 22937 - protein, 578 aa, Diabrotica virgifera
  misc_feature: Coding regions on vcDNA: vcDNA=SeqID_2634; Strand=+; Position=1-1737
  misc_feature: Homolog annotation: Hit_ID=XP_397439.1; Match level="QueryCoverage =77%, HitCoverage=42%, E-value=1e-116, Identity=50%"; Hit description= similar to ENSANGP00000015381 [Apis mellifera]
  misc_feature: Gene Ontology Annotation: Molecular function=cytoskeletal protein binding; Cellular component=cell-cell adherens junction; Biological process=protein biosynthesis
EHQKILQRHKITEDRKEYIERLNTVREEEEQKRLEEMQRQHLLAEQKRLDQEREERERKRALNEIQQVKDRHLKEKLQQIRQTGHGQKILKKMDEDDIKKLDADQIAVKEAEELQKERRELQAKLKSQEKKVDYFERAKRLEEIPLLQANMQERQLQDQNFWEQQEKERIAAAIEERKLAVATRDRLLRMKVDKDEFISKLKKERNIVYEDNLKEFEKMLSEERKKRLLERKIQRKEERRATYIKEKEEEAERRANEKRRREEEERERLEEIARKEQEQQERALKEEQERKKKEHQESLDRAWTMQKAKEEEIEKKLAMEKESSDKGKDSWRKDPKNSSSWRRDEKPADEPKNEPWRASRFRSNAEEPPKGDNTTTSSWRNDDKREDRRDDRQGERRGGDGGRFGNRDSGRFGDRDREGGVRFTRDNRDNRGDRRDDRERRDDRDNRDRRDDRDRRDDRDRRDDRERRDDRERRDDRGGRDDNRDRRDDRDRRDDRDRRGGDEGTWRRKTDDDRRSTPMRREAAPESAWRSANRETDRRDDSKRDDRRGTPMTREKPAREQQSQPEGEEGWSQVGRRR

SEQ ID NO: 22938 - protein, 272 aa, Diabrotica virgifera
  misc_feature: Coding regions on vcDNA: vcDNA=SeqID_2635; Strand=+; Position=86-905
  misc_feature: Homolog annotation: Hit_ID=XP_317147.1; Match level="QueryCoverage =98%, HitCoverage=88%, E-value=2e-52, Identity=43%"; Hit description =ENSANGP00000006703 [Anopheles gambiae]
  misc_feature: Gene Ontology Annotation: Cellular component=outer dense fiber
  misc_feature: Pfam annotation: Pfam_ID=DUF1309; Match level="Score=97.0, E-value=5e- 26, Copies=6"; Pfam description=Protein of unknown function (DUF1309)
  misc_feature (169)..(169): Xaa can be any naturally occurring amino acid
  misc_feature (249)..(249): Xaa can be any naturally occurring amino acid
MGGMTQRPWTPTKRRGPIAAEFKGPGPACVALPSYIGRRTTESRSERAPAFSFGSRQNGKLESIGPGPGQYNITGMSAKGKDTPPALSLHSRPKDQKPENFPAPGDYNPDKAEKVIHDSAPKYTFGLKTNVDKPLDTPAPNVYKIAETLTADAPKYTFGTKVNVEKPDXSAPNVYNIPSAVGDRGSPAYTISGRTKELLDERVKNPAPGQYNNVDPEFYKSHSPAYTMSGRINVPKDDKIPGPGVYSPXKVTLDAPPAHSFGIRHSPFSEHY

SEQ ID NO: 22939 - protein, 301 aa, Diabrotica virgifera
  misc_feature: Coding regions on vcDNA: vcDNA=SeqID_2636; Strand=+; Position=95-1000
  misc_feature: Homolog annotation: Hit_ID=BAA75470.1; Match level="QueryCoverage =98%, HitCoverage=43%, E-value=1e-124, Identity=71%"; Hit description= prophenoloxidase [Tenebrio molitor]
  misc_feature: Gene Ontology Annotation: Cellular component=larval serum protein complex
  misc_feature: Pfam annotation: Pfam_ID=Hemocyanin_M; Match level="Score=-26.0, E -value=5.8e-07, Copies=1"; Pfam description=Hemocyanin, copper containing domain
MSTSAKNNVVKLFDRPKELVIMPKGNDQTVFDVPSDYIPDQYKSVGNQIVSRFGEEAQGGKIPVNTISIPPLGEILELRRDENFSLFLPKHRKIAGQLINIFIGMRNVDDLLSVAVYTRDRVNPYLFNYALSVALLHRADTQDVDLPSFIRSFPDKYVDSKVFAKAREEANIVPTNSRTPIEIPRDFTASNLEPEHRLAYFREDLGINLHHWHWHLVYPFEAAFDVVNKNRRGELFYYMHQQIVARYNYERLCHGLQRVERFIDWRKAIPEAYFPKLDSLVSSKSWPSRVAKPKLSTLKKN

SEQ ID NO: 22940 - protein, 390 aa, Diabrotica virgifera
  misc_feature: Coding regions on vcDNA: vcDNA=SeqID_2637; Strand=+; Position=2-1173
  misc_feature: Homolog annotation: Hit_ID=BAA75470.1; Match level="QueryCoverage =98%, HitCoverage=55%, E-value=1e-168, Identity=71%"; Hit description= prophenoloxidase [Tenebrio molitor]
  misc_feature: Gene Ontology Annotation: Cellular component=larval serum protein complex
  misc_feature: Pfam annotation: Pfam_ID=Hemocyanin_C; Match level="Score=197.0, E -value=3.8e-56, Copies=1"; Pfam description=Hemocyanin, ig-like domain
  misc_feature (361)..(361): Xaa can be any naturally occurring amino acid
YHASGETDQITQDIDDLERWRDRIFDAIHSGNARRPDGTNVALTENEGIDILGNMIESSILSPNREFYGDMHNMGHVFISYIHDPDHRHLESFGVMGDSATAMRDPVFYRWHSYIDDIFQQFKSTLPRYTEAQLSNPGVTVESVSIESGGTRNALNTFWQQSDVDLSRGMDFQPRGPVFIRFTHLNHQAYNYRVVVNNSGAAKQATCRIFMAPKFDERGNPWLFRDQKNMFIELDRFRVNLRQGSNTITRASTDSSVTIPFDRTFRDLDTSRPDGGNNLAQFNFCGCGWPQHMLIPMGNTDNPGFRCELFVMISNIDDDRIDQDITGICNDADSFCGVKDRLYPDRRSMGFPFDRQPKGKXLITLQQFLTPNMRVQDVVINFSHRTFRPN

SEQ ID NO: 22941 - protein, 278 aa, Diabrotica virgifera
  misc_feature: Coding regions on vcDNA: vcDNA=SeqID_2638; Strand=+; Position=91-927
  misc_feature: Homolog annotation: Hit_ID=EAL30343.1; Match level="QueryCoverage =94%, HitCoverage=64%, E-value=4e-89, Identity=64%"; Hit description =GA10073-PA [Drosophila pseudoobscura]
  misc_feature: Gene Ontology Annotation: Molecular function=molecular_function unknown; Cellular component=cellular_component unknown; Biological process=biological_process unknown
  misc_feature: Pfam annotation: Pfam_ID=DUF292; Match level="Score=216.6, E-value =4.9e-62, Copies=1"; Pfam description=Eukaryotic protein of unknown functio
MFSSGPNYPKLKTNLRLSISRLKLLQKKKSELTEKSRKEIADYIVAGKIERAKIRVEYIIREDYLVEALEVVEMYCDLLLARFGLISNMKELDDGIAEAVSSLIWVAPRLMSDVQELKVIADLLATKYGPQYAEACRIESVESISAKLKHKLSIQAPPKLLVEKYMIEIAKSYNVPYEPDAQIMATEKGHDALLIDLSTNNLGGGGMPQPPGFFGYPQPPPLPQFVNPMPPQPFTYPDQKGKELNIGPTAPPTPPFPYNIPTNGEKEVILTSGEDLPT

SEQ ID NO: 22942 - protein, 528 aa, Diabrotica virgifera
  misc_feature: Coding regions on vcDNA: vcDNA=SeqID_2639; Strand=+; Position=79-1666
  misc_feature: Homolog annotation: Hit_ID=BAA75470.1; Match level="QueryCoverage =99%, HitCoverage=76%, E-value=0.0, Identity=73%"; Hit description =prophenoloxidase [Tenebrio molitor]
  misc_feature: Gene Ontology Annotation: Cellular component=larval serum protein complex
  misc_feature: Pfam annotation: Pfam_ID=Hemocyanin_M; Match level="Score=274.2, E -value=2.2e-79, Copies=1"; Pfam description=Hemocyanin, copper containing domain
  misc_feature (507)..(507): Xaa can be any naturally occurring amino acid
MSTSAKRNVVKLFDRPKELVIMPKGDDKTVFDVPKEYITDQYKNVGNQIVSRFGEEAEGGKIPVNTISIPPLGEILELRRDENFSLFLPKHRKIAGQLINIYIGMRNVDDLLSVAVYTRDRVNPYLFNYALSVALLHRTDTQDVDLPSFIRSFPDKYVDSKVFAKAREEANIVPTNSRTPIEIPRDFTASNLEPEHRLAYFREDLGINLHHWHWHLVYPFEAAFDVVNKNRRGELFYYMHQQIVARYNFERLCHGLKRVERFIDWRKAIPEAYFPKLDSLVSSRSWPSRVANQKLSNLRRETDQITQDIDDLERWRDRIFDAIHSGNARRPDGTNVALTENEGIDILGNMIESSILSPNREFYGDMHNMGHVFISYIHDPDHRHLESFGVMGDSATAMRDPVFYRWHSYIDDIFQQFKSTLPRYTEAQLSNPGVTVESVSIESGGTRNTLNTFWQQSDVDLSRGMDFQPRGAVFVRFTHLNHQEYNYRIVVNNSGAAKQGTCRIFMXPDERGNPWLFKDQSTFSLDWI

SEQ ID NO: 22943 - protein, 786 aa, Diabrotica virgifera
  misc_feature: Coding regions on vcDNA: vcDNA=SeqID_2640; Strand=-; Position=3-2360
  misc_feature: Homolog annotation: Hit_ID=YP_111446.1; Match level="QueryCoverage =97%, HitCoverage=76%, E-value=4e-39, Identity=32%"; Hit description =putative membrane-anchored cell surface protein [Burkholderia pseudomallei K96243]
  misc_feature: Gene Ontology Annotation: Molecular function=signal transducer activity; Cellular component=plasma membrane; Biological process =invasive growth
LFFWEWGGHKERGVVDVGRSKRGLSLPLITTVASLSLDVGRSNVGRSRTTGLSLPPRTTVASLSLDVGRSRRGLSLPPITTVASLSLDVGRSNVGRSRTTGLSLPPRTTVASLSLDVGRSRTGVSLPPRTTVASLSLDVGRSRRGLSLPPTTTVASLSLDVGRSNVGRSRTTGLSLPPRTTVASLSLDVGRSRTGLSLPPRTTVASLSLDVGRSRRGLSLPPMTTVASLSLDVGRSRRGLSLPPITTVASLSLDVGRSNVGRSRTTGLSLPPRTTVASLSLDVGRSRTGVSLPPRTTVASLSLDVGRSRRGLSLPPITTVASLSLDVGRSNVGRSRTTGLSLPPRTTVASLSLDVGRSRTGLSLPPRTTVASLSLDVGRSRRGLSLPPMTTVASLSLDVGRSRRGLSLPPTTTVASLSLDVGRSNVGRSRTTGLSLPPRTTVASLSLDVGRSRRGLSLPPITTVASLSLDVGRSRRGLSLPPTTTVASLSLDVGRSNVGRSRTTCLSLPPRTTVASLSLDVGRSRTGLSLPPRTTVASLSLDVGRSRRGLSLPPMTTVASLSLDVGRSNVGRSRTTGLSLPPRTTVASLSLDVGRSRRGLSLPPITTVASLSLDVGRLNVGRSRTTGLSLPPTTTVASLSLDVGRSRRGLSLPPITTVASLSLDVGRSNVGRSRTTGLSLPLTTTVASLSLDVGRSRRGLSLPPTTTVASLSLDVGRSNVGRSRTTGLSLPPRTTVASLSLDVGRSRRGLSLPPITTVASLSLDVGRSNVGRSRTTGLSLPPRTTV

SEQ ID NO: 22944 - protein, 769 aa, Diabrotica virgifera
  misc_feature: Coding regions on vcDNA: vcDNA=SeqID_2641; Strand=+; Position=2-2311
  misc_feature: Homolog annotation: Hit_ID=XP_522258.1; Match level="QueryCoverage =37%, HitCoverage=9%, E-value=9e-21, Identity=38%"; Hit description =PREDICTED: similar to hypothetical protein BC008326 [Pan troglodytes]
ATVVLGGNDRPVVLDRPTFDLPTSRDRDATVVVGGNDRPLLDLPTSRDRDATVVLGGNDTPVLDRPTSRDRDATVVLGGNDRPVVLDRPTFDLPTSRDRDATVVVGGNDRPLLDLPTSRDRDATVVIGGNDRPLLDRPTSRDRDATVVLGGNDRPVVLDRPTFDLPTSRDRDATVVVGGNGRPLLDLPTSRDRDATVVIGGNDRPLLDRPTSRDRDATVVLGGNDRPVLDRPTSRDRDATVVLGGNDRPVVLDRPTFDLPTSRDRDATVVISGNDRPLFERPTSRDRDASVVLDLGKNVLNNIKNGADKTVQVVDNVLNHATSRDRDSSVVIELPVSKDRDSSVILNGRTLPTTNIEIDPGFAGPLRNILNIKKVQPVDWQKWLIQQKQKNNIDITVIENWINNQHEVLKLDQSIIEAWIMQQQNSNPSFLYNWMIRKQVPNMLNENGPMVESPLNGKGPMMEPTGKLNVEKATPEVWQRWVIQQKQQNNVDLNVIENWINQQHQVLKQDVGDLEGWIIQQQKRNPSFLYNWIIRKEVPQISSQWFVQSKEVEEPEVSQLYVNGQMVESVEPSVWQQWLIAQKQKYNIDISVIENWINQQHQQMKLDVGYLEGWIMQQQNANANFLVNWIIKRQVPSFSYQWKMVRMVSQPQNSGTFHVWINNRSVEKVSPEVWKQWVSEQQRNGMDMSLVERNINQWHESLKVDLAYLEAWVMQEQQADSKFLYRWTVERKIPAISYKWKMESQRVQPVVTSSSSHTYTWKVQKQTQQ

SEQ ID NO: 22945 - protein, 705 aa, Diabrotica virgifera
  misc_feature: Coding regions on vcDNA: vcDNA=SeqID_2642; Strand=-; Position=132-2249
  misc_feature: Homolog annotation: Hit_ID=YP_111446.1; Match level="QueryCoverage =99%, HitCoverage=84%, E-value=5e-33, Identity=31%"; Hit description =putative membrane-anchored cell surface protein [Burkholderia pseudomallei K96243]
  misc_feature: Gene Ontology Annotation: Molecular function=signal transducer activity; Cellular component=plasma membrane; Biological process =invasive growth
LHVASLSLDVGRSRRGLSLPPITTVASLSLDVGRSNVGRSRTTGLSLPPRTTVASLSLDVGRSRTGVSLPPRTTVASLSLDVGRSRRGLSLPPTTTVASLSLDVGRSNVGRSRTTGLSLPPRTTVASLSLDVGRSRTGLSLPPRTTVASLSLDVGRSRRGLSLPPMTTVASLSLDVGRSRRGLSLPPTTTVASLSLDVGRSNVGRSRTTGLSLPPRTTVASLSLDVGRSRRGLSLPPITTVASLSLDVGRSRRGLSLPPTTTVASLSLDVGRSNVGRSRTTGLSLPPRTTVASLSLDVGRSRTGLSLPPRTTVASLSLDVGRSRRGLSLPPMTTVASLSLDVGRSRRGLSLPPTTTVASLSLDVGRSNVGRSRTTGLSLPPRTTVASLSLDVGRSRRGLSLPPITTVASLSLDVGRSNVGRSRTTGLSLPPTTTVASLSLDVGRSRRGLSLPPTTTVASLSLDVGKSRRGLSLPPITTVASLSLDVGRSNVGRSRTTGLSLPLTTTVASLSLDVGRSRRGLSLPPTTTVASLSLDVGRSNVGRSRTTGLSLPPRTTVASLSLDVGRSRRGLSLPPITTVASLSLDVGRSNVGRSRTTGLSLPPRTTVASLSLDVGRSRSGLSLPPITTVASLSLKVGRSRIGLSLPPRTTVASLSLDVGRSNVGRSTRTGRSLPPRTTVASLSLDVGRVKTSLITSTVLSAPFFT

SEQ ID NO: 22946 - protein, 246 aa, Diabrotica virgifera
  misc_feature: Coding regions on vcDNA: vcDNA=SeqID_2643; Strand=+; Position=237-973
  misc_feature: Homolog annotation: Hit_ID=XP_312380.1; Match level="QueryCoverage =86%, HitCoverage=65%, E-value=3e-18, Identity=28%"; Hit description =ENSANGP00000012173 [Anopheles gambiae]
  misc_feature (189)..(189): Xaa can be any naturally occurring amino acid
  misc_feature (194)..(194): Xaa can be any naturally occurring amino acid
  misc_feature (204)..(204): Xaa can be any naturally occurring amino acid
  misc_feature (209)..(209): Xaa can be any naturally occurring amino acid
MKSKIIDAENLDSPPLLVINREGVRKYWGKSESDVCEIVKDLQEWIKEQNFPEMPTNHMIEFFLTNCKYKIDATKDVLNTYYTIRKQVPEIYEDSNPRLAEMGNSWNMGCYCPLPQLTDDLCRISIVKLTSNTSNFVASSYFANIMNIYELRIYEDLCLTEIIICDYSALSWGHVFKMDIFTVRKWHIXMNSLXNRVKQLHIVXSPSCXNIIISFSKKLLNKKIADRIVVHKSYDSLYEHVPKDLL

SEQ ID NO: 22947 - protein, 77 aa, Diabrotica virgifera
  misc_feature: Coding regions on vcDNA: vcDNA=SeqID_2644; Strand=-; Position=116-349
HFRASMHFPTFVVNKFVSVEFNKQAHKINVLLIIYRNECVSRSEVHFDASEYMRLYVKGLTNPRGKNFLYTIYYKKP

SEQ ID NO: 22948 - protein, 238 aa, Diabrotica virgifera
  misc_feature: Coding regions on vcDNA: vcDNA=SeqID_2645; Strand=+; Position=1-717
  misc_feature: Homolog annotation: Hit_ID=XP_315544.1; Match level="QueryCoverage =87%, HitCoverage=38%, E-value=1e-65, Identity=55%"; Hit description =ENSANGP00000021228 [Anopheles gambiae]
  misc_feature: Gene Ontology Annotation: Molecular function=SUMO activating enzyme activity; Cellular component=cytoplasm; Biological process=signal transduction
  misc_feature: Pfam annotation: Pfam_ID=ThiF; Match level="Score=91.9, E-value=1.7e -24, Copies=1"; Pfam description=ThiF family
  misc_feature (158)..(158): Xaa can be any naturally occurring amino acid
  misc_feature (164)..(164): Xaa can be any naturally occurring amino acid
  misc_feature (168)..(168): Xaa can be any naturally occurring amino acid
  misc_feature (221)..(221): Xaa can be any naturally occurring amino acid
LKIIEFYQNSLFLGLNILKMSSPAPKSPEQSDKSKKYDRQLRLWGDHGQKLLEHSKVCLINATALGTEILKSLILPGIGSFTIVDGEKVTEEDIGSNFFLESDSIGTSRAQVSTQCLLELNPDVRGDFIDESPEHVMSHTQDFFNKFTVVIATALPEXVLIPLXKHLXESDVPLIVCRSIGFLGYIRLQVKEHTVIESHPDSENHDLRLLSPWRSLREHLXSIDVSMLDSKQEVILRL

SEQ ID NO: 22949 - protein, 258 aa, Diabrotica virgifera
  misc_feature: Coding regions on vcDNA: vcDNA=SeqID_2646; Strand=+; Position=31-807
  misc_feature: Homolog annotation: Hit_ID=AAT09850.1; Match level="QueryCoverage =94%, HitCoverage=89%, E-value=3e-60, Identity=50%"; Hit description =trypsin-like serine proteinase [Anthonomus grandis]
  misc_feature: Gene Ontology Annotation: Molecular function=serine-type endopeptidase activity; Cellular component=integral to membrane; Biological process=spermatogenesis
  misc_feature: Pfam annotation: Pfam_ID=Trypsin; Match level="Score=251.9, E-value =1.1e-72, Copies=1"; Pfam description=Trypsin
MRILSTLCFVFALFIVEGYSAALNRTKSALRIVGGQDALIQDYPYQVSILFYGKHGCGGSIINRYYILTAAHCTYDVTKSVLTVRVNSSFRDEQGTVYEVDQIFVHDGFDDSTYDNDISILRLATPLTFGNGVSPIALATAGTQIKDGLEAYATGWGRLGEHMPASHQLQVVMLPVISTETCAEYYPPGWVTRRMFCAGYYEQGGKDTCEGDSGGPLVVSGIQIGLVSWGTICAAPKRPGAFTKIPEFVDYINSIIYN

SEQ ID NO: 22950 - protein, 216 aa, Diabrotica virgifera
  misc_feature: Coding regions on vcDNA: vcDNA=SeqID_2647; Strand=+; Position=42-692
  misc_feature: Homolog annotation: Hit_ID=EAL25433.1; Match level="QueryCoverage =97%, HitCoverage=96%, E-value=2e-36, Identity=40%"; Hit description =GA21130-PA [Drosophila pseudoobscura]
  misc_feature: Pfam annotation: Pfam_ID=Chitin_bind_4; Match level="Score=94.4, E -value=2.8e-25, Copies=1"; Pfam description=Insect cuticle protein
MKFLIVAALVFGACSAEPQRRPHSYYDNQAEQDTNVPQNYQDNSDQYQQNSVQQNPPQHQEKSQYEPRVKETIKFIPIIRFDKEQGEAGNYKAAYETGNNIIAEEEGYLKELGPDPDQQGQVIKSQVQQGHFTYTSPEGVVIETKYTADENGFHVEGDHLPTPPPVSAEVQKGLDLIFAGIRAQQEALEQRLKDHPEERDRPENYDDGQYRPAQQE

SEQ ID NO: 22951 - protein, 56 aa, Diabrotica virgifera
  misc_feature: Coding regions on vcDNA: vcDNA=SeqID_2648; Strand=+; Position=927-1094
FINSFKKVYTSIRPPLYDKWTVPFAMKLKYGRFAELDTTGQVILVGNFFVFCEFCQ

SEQ ID NO: 22952 - protein, 65 aa, Diabrotica virgifera
  misc_feature: Coding regions on vcDNA: vcDNA=SeqID_2649; Strand=+; Position=68-265
NTGIFFNENFSFINLQKSVCYCVAAPAILRAGVSMDSYVVLPSESKSENGISIYLTVFEIIDLKV

SEQ ID NO: 22953 - protein, 93 aa, Diabrotica virgifera
  misc_feature: Coding regions on vcDNA: vcDNA=SeqID_2650; Strand=+; Position=19-300
NNIVWYKKLWSDICNYILLMEKIFEDFSQIMDTNNIFIYNSFIFNVTKKKLFFIKISSCSKIYDVTIYKILLILYEVYKKYEFRSRVNYLYSS

SEQ ID NO: 22954 - protein, 211 aa, Diabrotica virgifera
  misc_feature: Coding regions on vcDNA: vcDNA=SeqID_2651; Strand=+; Position=75-710
  misc_feature: Homolog annotation: Hit_ID=NP_788026.1; Match level="QueryCoverage =99%, HitCoverage=87%, E-value=5e-13, Identity=28%"; Hit description =CG33129-PC, isoform C [Drosophila melanogaster] ref|NP_788025.1| CG33129-PB, isoform B [Drosophila
DMASKKKIQEKLAIKKKGGFPYKLLILLTLAVGGAISYDIKQHGSWNDSLTRKTLKEYKVCEYSHLAIDRVKSGLHWTSEKIEEQFPGLQQNVAVFSEPYVELLVNLGKIGRNVAFNVKDVIVEKYPVVVESVEAYLPGLVENSQKAISEVYITSVLYFNRGVDYLKNEVFVGQLSPENMQRVVVEAFNTTQQKAVEYYHWIYKKVQTSIK

SEQ ID NO: 22955 - protein, 116 aa, Diabrotica virgifera
  misc_feature: Coding regions on vcDNA: vcDNA=SeqID_2652; Strand=+; Position=223-573
KIFQIHAQFWTGFSPGDRYCFPFAKIIFRVQKCNFSIYVQRRLSRKLCILRKNLSDQFLLRMTQKIQKKCFVCEKSLLCNPSSSLFITILSASGSTVTQQIRVYGSRYIKNLGKTI

SEQ ID NO: 22956 - protein, 166 aa, Diabrotica virgifera
  misc_feature: Coding regions on vcDNA: vcDNA=SeqID_2653; Strand=+; Position=364-864
SRNIGTRLLLPVARYCSLLRVCLGYLKSTPINIIQAEAVEPPLKLRRQLLSRKFMIKTISKKTSYLNSIQSLTVQVLTHRYWHFKKTPLIVETFSEIADITDIVYSNQLPPVLIYSPEQIFSREIRTYYFESQEGACINQTKFNETKNKYCPNYDSIFTDGSKSKE

SEQ ID NO: 22957 - protein, 72 aa, Diabrotica virgifera
  misc_feature: Coding regions on vcDNA: vcDNA=SeqID_2654; Strand=-; Position=542-760
KNIKKPYLYKIIENHILVSIFLKCSFFDVLVKLSLKMVDRRHFVSYEKQYISMFRDLVSSSIFPRIGCCPRL

SEQ ID NO: 22958 - protein, 410 aa, Diabrotica virgifera
  misc_feature: Coding regions on vcDNA: vcDNA=SeqID_2655; Strand=+; Position=72-1304
  misc_feature: Homolog annotation: Hit_ID=XP_418135.1; Match level="QueryCoverage =100%, HitCoverage=98%, E-value=1e-102, Identity=47%"; Hit description=PREDICTED: similar to Hypothetical protein MGC11770 [Gallus gallus]
  misc_feature: Gene Ontology Annotation: Molecular function=molecular_function unknown; Cellular component=cytoplasm; Biological process=biological_ process unknown
MVFKCQEDSFLKEFTSKVVTCDKVQIQEVVNGTTRTVDSYEVILEDTILFPEGGGQPCDYGFLNNLPVKKILRKEDKAVHYVSQELQVGTTVEQKIDWERRFDHMQQHSGQHLLSAVLEQHFKANTVSWWLGEEDSYVELDIASFLEKDIQIAEEMVNVFIRQGKPVTVTIFPEKTPEELLEKVRSVKGLPDDHKGDIRVINITDIDSNMCCGTHVTNLSQLQAIKLLHTEKSKRKDKILLHFLVGNRVLKRFATCIEREKKLTAILNNGPQQHVELVEKLQKNVKIINKNLQSVLKDVAIFNAGKLKAMQPPPKYFSLHKKEAEPDFMNIFIRELGTTEIFLFLSVGDEKKDGSVVIQGKEDDVAVLGPKVCEILEGKGSGKGNTYRAKVTNMSKKKEAENCIKEYFDK

SEQ ID NO: 22959 - protein, 276 aa, Diabrotica virgifera
  misc_feature: Coding regions on vcDNA: vcDNA=SeqID_2656; Strand=+; Position=85-912
  misc_feature: Homolog annotation: Hit_ID=XP_311451.1; Match level="QueryCoverage =96%, HitCoverage=41%, E-value=7e-76, Identity=53%"; Hit description =ENSANGP00000018454 [Anopheles gambiae]
  misc_feature: Gene Ontology Annotation: Molecular function=GPI-anchor transamidase activity; Cellular component=plasma membrane; Biological process =protein modification
  misc_feature (209)..(209): Xaa can be any naturally occurring amino acid
  misc_feature (216)..(216): Xaa can be any naturally occurring amino acid
MGLLTDPTTGQGKYVKWLLKYYSKLCFLLYISGVIWFCTLAYPTMNASTYFSENALLPGLVKSQFHEDREALRYNEELQDEMKKYEDSIPYPWIIAKFKQIGLDAYIHNFTLTSPFNRNEKFSGKNIYGILRAPRGASTEALVLSTPYRPSTSVHPPTGPSIAIMLAFAKYANREKYWAKDIIFLITEHEQLGIQAWLEAYYGVSCGVXEVLDHGXLRGRGGAIQAAINLELHSEKIGQMDIKIEGLNAQLPNLDLFNLPQNGAKKRWLSTFKIKD

SEQ ID NO: 22960 - protein, 296 aa, Diabrotica virgifera
  misc_feature: Coding regions on vcDNA: vcDNA=SeqID_2657; Strand=+; Position=23-911
  misc_feature: Homolog annotation: Hit_ID=AAL15466.1; Match level="QueryCoverage =100%, HitCoverage=76%, E-value=1e-129, Identity=77%"; Hit description=tryptophan oxygenase [Tribolium castaneum] gb|AAL15464.1| tryptophan oxygenase [Tribolium castaneum]
  misc_feature: Gene Ontology Annotation: Molecular function=tryptophan 23 dioxygenase activity; Biological process=ommochrome biosynthesis
  misc_feature: Pfam annotation: Pfam_ID=Trp_dioxygenase; Match level="Score=415.3, E- value=7.6e-122, Copies=1"; Pfam description=Tryptophan 2,3-dioxygenase
  misc_feature (252)..(252): Xaa can be any naturally occurring amino acid
MSCPLASHDYSQDGDQLGDEAGMLYGEYLMLDKILGAQRPLSETNSDLVHDEHLFIITHQAYELWFKQVIWELDSIRHIFSSILEESKTLEILRRLNRVVLILKVLVDQVMILETMTPVDFMEFRHYLRPASGFQSLQFRLLENKLGVTQENRVKYNKNYAKVFGHDEEAIKKIEQSEAEPSLKDLVESWLERTPGLEIEGFNFWGKYHKSVEAILNEEQEKANKEKVESLRNYKLSELENRIEVYESIFQXEVHKALLARGERRLSHKALQGAIMITFYRDEPRFSQPHQNLTLL

SEQ ID NO: 22961 - protein, 500 aa, Diabrotica virgifera
  misc_feature: Coding regions on vcDNA: vcDNA=SeqID_2658; Strand=+; Position=99-1600
  misc_feature: Homolog annotation: Hit_ID=XP_321179.1; Match level="QueryCoverage =92%, HitCoverage=89%, E-value=0.0, Identity=77%"; Hit description =ENSANGP00000020828 [Anopheles gambiae]
  misc_feature: Gene Ontology Annotation: Molecular function=fumarate hydratase activity; Cellular component=mitochondrion; Biological process =fumarate metabolism
  misc_feature: Pfam annotation: Pfam_ID=Lyase_1; Match level="Score=520.5, E-value =1.6e-153, Copies=1"; Pfam description=Lyase
  misc_feature (324)..(324): Xaa can be any naturally occurring amino acid
  misc_feature (378)..(378): Xaa can be any naturally occurring amino acid
MALSRLYSPSRRLGARITFLFRNYRESFTPQIANMADYRVEKDTFGELKVPVDKYYGAQTVRSIMNFPIGGEFERMPYPVITAMGVLKKAAAIVNKDYGLDPKVADAISQAADEVISGKLYSEHFPLVIWQTGSGTQTNMNTNEVISNRAIEIMGGKLGSKTPVHPNDHVNKSQSSNDTYPTAMHIAVAVEIEHTLLPNLKMLHEALDKKAKEFKDIIKIGRTHTQDATPLTLGQEFSGYAQQVAFAIDRINATLPRVRMLALGGTAVGTGLNTRKGFAEKCAAKISELTGLPFTSAPNKFEALAAHDAMGEGSGSLNGIAVSXMKIAHDIRFLTFWSRCGLGDIPFPKNKPGSSIMPGQGNPTQCEAITMVAAQVMXGNHVAVTIGGSNGHFELNVFKPMIVSNVLRSIRLLGDSSKCFTKNCVDGIVANKERIHKLLHESLMLVTALNPHIGYDNAALIAKTAHKENSTLKETAIRLGLLTEEQFAKWVKPEDMLGPK

SEQ ID NO: 22962 - protein, 636 aa, Diabrotica virgifera
  misc_feature: Coding regions on vcDNA: vcDNA=SeqID_2659; Strand=+; Position=91-1999
  misc_feature: Homolog annotation: Hit_ID=NP_524836.2; Match level="QueryCoverage =100%, HitCoverage=69%, E-value=0.0, Identity=73%"; Hit description =CG6699-PA [Drosophila melanogaster] gb|AAF53294.2| CG6699-PA [Drosophila melanogaster]
  misc_feature: Gene Ontology Annotation: Molecular function=transporter activity; Cellular component=COPI vesicle coat; Biological process=ER to Golgi transport
  misc_feature: Pfam annotation: Pfam_ID=Coatomer_WDAD; Match level="Score=276.4, E -value=4.7e-80, Copies=1"; Pfam description=Coatomer WD associated region
  misc_feature (574)..(574): Xaa can be any naturally occurring amino acid
MPLRLDIKRKLTARSDRVKCVDLHPTEPWMLCSLYSGNINVWNTENQQLVKTFEVCDVPVRTAKFLPRKNWIVSGSDDMQIRVFNYNTLDRVHSFEAHSDYVRCIVVHPTQPYILTSSDDMLIKLWNWEKAWACQQVFEGHTHYIMQIAINPKDNNTFASASLDRTLKVWQLGASTANFTLEGHEKGVNCVDYYHGGDKPYLISGADDRLVKIWDYQNKTCVQTLEGHAQNVTAACFHPELPVALTGSEDGTVRVWHANTHRLESSLNYGFERVWTIFCLKGSNNVALGYDEGSILVKVGREEPAVSMDASGGKIIWARHSELQQANLKALAEGAEIRDGERLPVSVKDMGACEIYPQTIQHNPNGRFVVVCGDGEYIIYTAMALRNKAFGSAQEFVWAQDSSEYAIRESGSTIRIFKNFKEKKNFKSDFGAEGIYGGYLLGVKSVSGLTFYDWETLDLVRRIEIQPKAVYWSDSGKLVCLATEDSYFILSYDSDEVQKARDNNQVADDGVESAFNLLGEINESVRTGLWVGDCFIYTNSVNRINYFVGGELVTIAHLDRPLYVLGYVPKDDKXTSENKELRVVKYQLLLSVLEYKTARMKRRLSNRQKEVLSVPFPKEPQKRKSGNIFFKKKKGF

SEQ ID NO: 22963 - protein, 283 aa, Diabrotica virgifera
  misc_feature: Coding regions on vcDNA: vcDNA=SeqID_2660; Strand=+; Position=100-951
YFKFLKHKLKSKMSVIDDETRIFQNSIRYLHNISTLPETNVPTLRSFICLKRRLMELRRSSFLPTSATKPSMHCQKCFLNYFEGPATYNVISKPTRYTFEDKVKAKQKNGLPLTRYQEKYLKRMKKFTGNILVTKCKFCNHENQTKLDKPRRKPIPKISLISSPLIKKKKKNKRDKFCGLNQSIVASVSLNNSYVIDKTPDWSKTFIPLGNSINNNTSMATKKKNKNKRDKLYGLNQSVFASSSLNNNHGNHVNQSPPDLSKTFIPLTNSNKNNTGKLYGSQH

SEQ ID NO: 22964 - protein, 307 aa, Diabrotica virgifera
  misc_feature: Coding regions on vcDNA: vcDNA=SeqID_2661; Strand=+; Position=123-1043
  misc_feature: Homolog annotation: Hit_ID=XP_308209.1; Match level="QueryCoverage =97%, HitCoverage=44%, E-value=1e-115, Identity=67%"; Hit description= ENSANGP00000020779 [Anopheles gambiae]
  misc_feature: Gene Ontology Annotation: Molecular function=molecular_function unknown
  misc_feature: Pfam annotation: Pfam_ID=GIDA; Match level="Score=279.8, E-value=4.5e- 81, Copies=1"; Pfam description=Glucose inhibited division protein A
  misc_feature (211)..(211): Xaa can be any naturally occurring amino acid
  misc_feature (267)..(267): Xaa can be any naturally occurring amino acid
  misc_feature (279)..(279): Xaa can be any naturally occurring amino acid
  misc_feature (297)..(298): Xaa can be any naturally occurring amino acid
FAHSKRVVITTGTFLNGQINMGLKVYPAGRIGDEPAIGLAKTLESLNLRMGRLKTGTPPRLKADTINYDVCEVQYGDNPPLPFSFMNNKVWIKPEDQLKCYLTKTTLGIEKIVRDNLHVNRHVMEEIAGPRYCPSIESKVLKFSGREHQVWLEPEGLTSDVIYPNGLSCTLPEEFQWDLIRNIRGLENAVIVRPGYGVEYDFVDPRELMPXLEVKRVVGLFLAGQINGTTGYEEAAAQGVVAGINAGAKALKRDPLIVSRTEGYLGXVMIDDPNTLGTXNPYRMFTSRAEFRLTLRXXNADNRLTPQ

SEQ ID NO: 22965 - protein, 379 aa, Diabrotica virgifera
  misc_feature: Coding regions on vcDNA: vcDNA=SeqID_2662; Strand=+; Position=130-1267
  misc_feature: Homolog annotation: Hit_ID=AAQ94878.1; Match level="QueryCoverage =99%, HitCoverage=58%, E-value=0.0, Identity=87%"; Hit description =heat shock protein 68 [Drosophila lummei] gb|AAQ94877.1| heat shock protein 68 [Drosophila lummei]
  misc_feature: Gene Ontology Annotation: Biological process=reproduction
  misc_feature: Pfam annotation: Pfam_ID=HSP70; Match level="Score=544.6, E-value =8.6e-161, Copies=1"; Pfam description=Hsp70 protein
  misc_feature (348)..(348): Xaa can be any naturally occurring amino acid
MVKVPAIGIDLGTTYSCVGVWQHGKVEIIANDQGNRTTPSYVAFTDTERLLGDAAKNQVAMNPSNTVFDAKRLIGRKFDDPKIQQDIQHWSFKVINHCGKPKIQVDCKGEQKVFSPEEISSMVLTKMKETAEAYLGTTVKDAVITVPAYFNDSQRQATKDAGAIAGLNVLRIINEPTAAALAYGLDKNLKGEKNVLIFDLGGGTFDVSILTIDEGSLFEVRSTAGDTHLGGEDFDNRLVNHFADEFKRKYKKDLKNNPRALRRLRTAAERAKRTLSSSSEATIEIDALFEGIDFYTKISRARFEELWSDLFRGTLQPVEEALNDAKLDKGQIHDIVLVGGSTRIPKIXNFLANYFSGQTINLFINPDEGVAYGAAVQAA

SEQ ID NO: 22966 - protein, 747 aa, Diabrotica virgifera
  misc_feature: Coding regions on vcDNA: vcDNA=SeqID_2663; Strand=+; Position=88-2331
  misc_feature: Homolog annotation: Hit_ID=EAL30732.1; Match level="QueryCoverage =99%, HitCoverage=99%, E-value=0.0, Identity=61%"; Hit description =GA21179-PA [Drosophila pseudoobscura]
  misc_feature: Gene Ontology Annotation: Molecular function=protein transporter activity; Cellular component=signal recognition particle; Biological process=intracellular protein transport
  misc_feature: Pfam annotation: Pfam_ID=Sec63; Match level="Score=404.5, E-value =1.3e-118, Copies=1"; Pfam description=Sec63 domain
MGQKFQYDESGGTFFYFLLSFLALILIPATFYYWPKKKKRDVQEEIKECTCTGCILKREHLKKSEPWRGPKNFLIKLIIVVGWVILFLLAYKVSQFDYEMSNFDPYEILGIPLGASQGEIKKAYRKLSLILHPDKDTGNEKEFMKLTKAYQALTDDEARRNWEKYGNPDGPGAMSFGIALPSWIVEKENSVWVLGLYALVFMVALPIIVGTWWYRSIKYTGDQVLLDTTQLYYYFFNKTPNMALKRVIMILAASLEFDKKHNSEIVERQSDNEEVPQLIKKLPNLSEKNKERPLCYLYSIKARAIIHAHLSRIPLNNFTLEQDRRYIVGKCPFLVNEQVNCVNQLIIMAYTRRIPKLPPIETIENCMKLSPMIVQGLWEFKSPLLQLPYINDDNLKYFMSKKRQIKTLQQYAQLKGEERRNLLRNLTDDEYENVMKVLGAMPYVDFQIQVEVMDDENPNEVTAGAIVTVTVTLIRQDMSILFGDESAKDATEITENGTEEVKEGTGDENVVKRPAWLKQKKSGKKTKKSKPVNKTSITSKPKTEDSPKPAAPVKKKDTSKVKKELDDEETDETDESDTENIENDKSSGEDEVENTKSNDDDEEWEKFQKIHDREKSLEGKSKTSHSVHCPYYPYDKQEYWWTYICDRKSRTLLTAPYHITSLVDREVIHLKFTAPNWPAVYTFTVCLRSDSYIGFDQQKDIKLDVKEAPAEIKEHPQWEFEDSEEEDPAETNDRESEYATDEDLPDD

SEQ ID NO: 22967 - protein, 364 aa, Diabrotica virgifera
  misc_feature: Coding regions on vcDNA: vcDNA=SeqID_2664; Strand=+; Position=226-1320
  misc_feature: Homolog annotation: Hit_ID=AAH84924.1; Match level="QueryCoverage =97%, HitCoverage=97%, E-value=7e-69, Identity=38%"; Hit description =Unknown (protein for MGC:80888) [Xenopus laevis]
  misc_feature: Gene Ontology Annotation: Molecular function=molecular_function unknown; Cellular component=cell wall (sensu Fungi); Biological process=biological_process unknown
  misc_feature: Pfam annotation: Pfam_ID=SCP; Match level="Score=184.7, E-value=2e -52, Copies=2"; Pfam description=SCP-like extracellular protein
MDFQQECLQAHNEYRHKHGVPPLKLNKEMCRVSQDWANNLIKKSVLKHSNSRDYGENLFCIQSSNPNFTIDGKKAVENWYEEIKCHTFGVEPSSLASGHFTQVVWKESRELGVAFAKSGGKIVVVANYAPAGNVIGHFAENVPPVGGFRSNNNHIDLSESVGKLSIASSRSIPQKLNQNATEGNFEEDFLEAHNNYRKRHGVPLLKLDKKLCKYSQEWAAYLAQRNILEHRPGSNYGENIYCLYSSDPNFTVNGHTPVDTWYEEVSHHPFGREPSNLKSGHFSQVIWKSSESLGVGVAKNSQGSIYVVANYSPAGNFVGHYVENVPPVKTFADSSPKEDPSPRSSSKSLASPFSQSGNFSDFAL

SEQ ID NO: 22968 - protein, 298 aa, Diabrotica virgifera
  misc_feature: Coding regions on vcDNA: vcDNA=SeqID_2665; Strand=+; Position=14-907
  misc_feature: Homolog annotation: Hit_ID=EAL29078.1; Match level="QueryCoverage =97%, HitCoverage=58%, E-value=1e-33, Identity=30%"; Hit description =GA18395-PA [Drosophila pseudoobscura]
  misc_feature: Gene Ontology Annotation: Cellular component=membrane fraction; Biological process=steroid metabolism
  misc_feature (278)..(278): Xaa can be any naturally occurring amino acid
  misc_feature (282)..(282): Xaa can be any naturally occurring amino acid
MKLVIFVVFTILDYVCGARILCVFQMPAFSHQRVFQPIWRELSLRGHEVVVVTPIPLKDPLLTNLTEIDVSAPNSELIRRHGFQFFMNKEYAVHTKIPKIFAMHYDFAEVILKNEEFSKIYNNSNQKFDVVIAQTYISPILYSIAAKFKAPLIGISSMGAYIGTHFAMGNPNPPSLYSEMFLPYNGKLTLYERIKSTTYYLFVRFYRTFVILPEADALARKYLGNDIPYIEDIERNMSLLLITTNPFMYTPRPTIPTIVSLESIHVKPTEPLPQDLKXFFGXSKRGVIYFQLGSNVQS

SEQ ID NO: 22969 - protein, 297 aa, Diabrotica virgifera
  misc_feature: Coding regions on vcDNA: vcDNA=SeqID_2666; Strand=+; Position=118-1008
  misc_feature: Homolog annotation: Hit_ID=AAV38734.1; Match level="QueryCoverage =100%, HitCoverage=65%, E-value=1e-144, Identity=83%"; Hit description=tubulin, gamma 1 [Homo sapiens] ref|NP_001061.2| tubulin, gamma 1 [Homo sapiens] gb|AAH00619.1| Tubulin,
  misc_feature: Gene Ontology Annotation: Molecular function=structural molecule activity; Cellular component=microtubule cytoskeleton; Biological process=cell organization and biogenesis
  misc_feature: Pfam annotation: Pfam_ID=Tubulin; Match level="Score=331.6, E-value =1.2e-96, Copies=1"; Pfam description=Tubulin/FtsZ family, GTPase domain
MPCEMITLQLGQCGNQIGFEFWKRLCAEHGINPEGILEDFATENIDRKDVFFYQADDEHYIPRAVLLDLEPRVINTILNSPYSKLYNQENVFLSKNGGGAGNNWASGFSQGEKLNEEIFDIIDREAEGSDSLEGFVLCHSIAGGTGSGMGSNILEKLSDRFPKKLVQTYSVFPNLDEISDVVVQPYNSLLTLKRLTESADSVVVLDNTALNRIAADRLKIQNPTFTQINSLVSTIMSVSTTTLRYPSYMNNDLTELLGPLIPTPRLHFLMTGYTPLSTDNDGANVRKTTVLDVMRRL

SEQ ID NO: 22970 - protein, 223 aa, Diabrotica virgifera
  misc_feature: Coding regions on vcDNA: vcDNA=SeqID_2667; Strand=+; Position=500-1171
  misc_feature: Homolog annotation: Hit_ID=XP_312563.1; Match level="QueryCoverage =99%, HitCoverage=85%, E-value=6e-58, Identity=47%"; Hit description =ENSANGP00000014852 [Anopheles gambiae]
MADERNFRSAYYEKVGFRSVEEKKSLEILLKEKPLDRGKLRQFCVRFSVPATYRNLVWKLLLGVIPVHIDSHNFIMDQRKQEYHELHRALTVMRVIDTNTPKPQVFLAMWLLQTGNFTIDTSLATERGFTNIVQSFMQFFEDDADVFWLSRNFYENVKKFDADLGKVVEKTYVILEKEDAAYYKHLSKTGLLDNLPLAKWFDCGFAGILYKSALERFWDKLRM

SEQ ID NO: 22971 - protein, 303 aa, Diabrotica virgifera
  misc_feature: Coding regions on vcDNA: vcDNA=SeqID_2668; Strand=+; Position=54-961
  misc_feature: Homolog annotation: Hit_ID=XP_317180.1; Match level="QueryCoverage =97%, HitCoverage=62%, E-value=1e-71, Identity=45%"; Hit description =ENSANGP00000018332 [Anopheles gambiae]
  misc_feature: Gene Ontology Annotation: Molecular function=pre-mRNA splicing factor activity; Cellular component=snRNP U5; Biological process=mRNA splicing
  misc_feature: Pfam annotation: Pfam_ID=WD40; Match level="Score=66.1, E-value=9.8e -17, Copies=3"; Pfam description=WD domain, G-beta repeat
  misc_feature (272)..(272): Xaa can be any naturally occurring amino acid
  misc_feature (288)..(288): Xaa can be any naturally occurring amino acid
MCHRKHIKESAEESIVEMEDSSDSSDVSMTDSDSENQISETDNGDGVDVSNLNTDSDVELQEDDEEEEEDETIKAIKNESKKERDRPPNIQCEDFITDISFHPHEDLLAIANIVGDVLIYKYSNETNELVNTIELHTKACRDIEFSCDGKLLFSTSKDKSIMITDVSSGQLVKFYENSHDVPVYCLTVIDENLFATGDDDGMIKLWDMREKSDKQIYKTKKNEDYISDMVTNDAKNYLVCSSGDGSIISIDLQNRKIHMQSEEYEEELTCLXTFRTETKLVSGSSKGXTVCLHWGEFGLHSDI

SEQ ID NO: 22972 - protein, 253 aa, Diabrotica virgifera
  misc_feature: Coding regions on vcDNA: vcDNA=SeqID_2669; Strand=+; Position=267-1028
  misc_feature: Homolog annotation: Hit_ID=XP_397350.1; Match level="QueryCoverage =69%, HitCoverage=17%, E-value=8e-12, Identity=28%"; Hit description =similar to CG30443-PA [Apis mellifera]
  misc_feature: Pfam annotation: Pfam_ID=zf-C2H2; Match level="Score=23.2, E-value =0.0008, Copies=2"; Pfam description=Zinc finger, C2H2 type
MGTQLLKCPLCCNEHFSSRQDLKYHISELLNSLSCPVCTLAFNSVIELAEHLDTECELSEECNQNETDPEIQIQEPSDPLLIPVDESQEEPTDEHVEMVNDDTQQIEFIESEDIAEEVEENGNVIYECEVCKVQFSSIKDHLKEYHAGEDVVLQTDVFDENDLPQEMQVEEDQVTEYSQEEESFELSQESGNDENERPVIQKNNKRVDWVSRKDNGIPLPENYAIENGKVRKITEEEAAEKIIESPYSKSPMP

SEQ ID NO: 22973 - protein, 78 aa, Diabrotica virgifera
  misc_feature: Coding regions on vcDNA: vcDNA=SeqID_2670; Strand=-; Position=143-379
KPLKSGCTGESYEYNSVRNKVVLQRMEKVTKVVRTFQNRKLEYFGHVRRHPMRYNILHLIIQGNVEGRGPGVKKNVMA

SEQ ID NO: 22974 - protein, 243 aa, Diabrotica virgifera
  misc_feature: Coding regions on vcDNA: vcDNA=SeqID_2671; Strand=+; Position=2-730
  misc_feature: Homolog annotation: Hit_ID=BAD81026.1; Match level="QueryCoverage =78%, HitCoverage=34%, E-value=1e-61, Identity=62%"; Hit description =cytochrome P450 CYP4G25 [Antheraea yamamai]
  misc_feature: Gene Ontology Annotation: Molecular function=cytochrome P450 activity; Cellular component=extracellular space; Biological process= leukotriene metabolism
KRADFEKGIRGSTAEVPEDAKTQKYEKNVASKTVVEGLSYGQSAGLKDDLDVDEDVGEKKRMAFLDLLIEASQNGVVINDEEIKEQVDTIMFEGHDTTAAGSSFFLSLMGIHPEIQDRVIQEIDEIFGDSDRPATFADTLEMKYLERCMMETLRMYPPVPIIARQQLVEQNQPISQEIYVQQYGLNKQVDQLIQSLVYHQNVISQQVEQFIQQGQRLPQDLLSQQVLVYQQVRQLIKVLSTQQ

SEQ ID NO: 22975 - protein, 126 aa, Diabrotica virgifera
  misc_feature: Coding regions on vcDNA: vcDNA=SeqID_2672; Strand=+; Position=386-766
  misc_feature: Homolog annotation: Hit_ID=EAL36082.1; Match level="QueryCoverage =67%, HitCoverage=9%, E-value=3e-15, Identity=49%"; Hit description =asparagine-rich protein [Cryptosporidium hominis]
ATTKQPLQRLTLQCATNILTDAPSTVCTLNKQHPQQQHPQQLHHTQMHPQQLHPQQLHPQQLHPQQLHLQQLHHTQMHPQQLHHRQMHPQQRHHTLMQHQPFFKQRINLKNNQEYIFLQLCNDRIQ

SEQ ID NO: 22976 - protein, 173 aa, Diabrotica virgifera
  misc_feature: Coding regions on vcDNA: vcDNA=SeqID_2673; Strand=+; Position=16-537
MLAAKVVLFLGLALFVSAGEDLDKGYEIVECANYVMRAGVPELGVPQHDPYVKLRDLQWSGNLGVAKAHIELHDNRWYGLADWEIQAYQISADTDNEAVFDYTTSWSNGFQLSMNYNATIKELFLSQHYSGTINAKSLVWDYLETLMLSLFKKVLKVPSTMVLSEIPLETSLK

SEQ ID NO: 22977 - protein, 87 aa, Diabrotica virgifera
  misc_feature: Coding regions on vcDNA: vcDNA=SeqID_2674; Strand=-; Position=405-668
  misc_feature: Homolog annotation: Hit_ID=AAH62504.1; Match level="QueryCoverage =88%, HitCoverage=31%, E-value=2e-23, Identity=61%"; Hit description =Diacetyl/L-xylulose reductase [Xenopus tropicalis] ref|NP_989100.1| diacetyl/L-xylulose reductase [Xenopus
  misc_feature: Gene Ontology Annotation: Molecular function=protein binding; Cellular component=microvillus; Biological process=xylulose metabolism
MVEGTFNTFLNSESISVNAVNPTVIMTDMGRLGWSDPAVAKPMLEKIPLRRFGEVHEVVDAVTYLLSDKASMITGTCLPIDGGYVAS

SEQ ID NO: 22978 - protein, 156 aa, Diabrotica virgifera
  misc_feature: Coding regions on vcDNA: vcDNA=SeqID_2675; Strand=+; Position=329-799
NRIHYLLEKKKKKKKKPTRPPTRPRTRGRTRGGQGSAYRVNRYVVSQRQVNGQQRLTVPEQFVNQEVLNQVYSEQSLINQRAQQLVEQNQPISQEIYVQQYGLNKQVDQLIQSLVYHQNVISQQVEQFIQQGQRLPQDLLSQQVLVYKQVRQLIKV

SEQ ID NO: 22979 - protein, 411 aa, Diabrotica virgifera
  misc_feature: Coding regions on vcDNA: vcDNA=SeqID_2676; Strand=+; Position=4-1239
  misc_feature: Homolog annotation: Hit_ID=NP_729947.2; Match level="QueryCoverage =83%, HitCoverage=37%, E-value=7e-16, Identity=26%"; Hit description =CG32133-PA [Drosophila melanogaster] gb|AAF49771.3| CG32133-PA [Drosophila melanogaster]
  misc_feature: Gene Ontology Annotation: Biological process=regulation of protein activity, epigenetic
  misc_feature (279)..(279): Xaa can be any naturally occurring amino acid
  misc_feature (336)..(336): Xaa can be any naturally occurring amino acid
MKCLVLLSLVTLSVAAYYPSTGRQVTVGVAGNVKLVGSQGSQIDIRRSPYNPRTVDVTLRSPNAPTRTLQIDEARNGQQLGYSNLQGVNNQGVQGVSDIVSLQGLSGYGNFQGQSRVYSPLKEILKNRVQGRSFNQQWLNNSPVQSLQTILQQIQQQRGLQQELLGQYQNLPQQYLNAEYLQNQDIGTNQILNLIYKQQLGQGSAYPLNQYLVSQRQVNGQQRLTVPEQFVNQEVLNQVYSEQSLINQRAQQLVEQNQPISQEIYRPTVWFEQTSRSAXSNHWYITKMVISQQVEQFIQQGQRLPQDLLSQQVLVYQQVRQWIKGLSTQQLNMDQXIQYLVEQGNQVDQQLYAVQRNFYQQVQRLVQQVVLQQSQIKEQIQVLIQQEQTGSTRTSFISTIGLPTSLNIHSI

SEQ ID NO: 22980 - protein, 314 aa, Diabrotica virgifera
  misc_feature: Coding regions on vcDNA: vcDNA=SeqID_2677; Strand=+; Position=431-1372
  misc_feature: Homolog annotation: Hit_ID=EAA16908.1; Match level="QueryCoverage =88%, HitCoverage=17%, E-value=2e-12, Identity=28%"; Hit description =Drosophila melanogaster CG8797 gene product-related [Plasmodium yoelii yoelii]
  misc_feature: Gene Ontology Annotation: Biological process=regulation of protein activity, epigenetic
ETGISKVSAITRESLQRDNVTNTLYTLQGLSGYGNFQGQSRVYSPLKEILKNRVQGRSFNQQWLNNSPVQSLQTILQQIQQQRGLQQELLGQYQNLPQQYLNAEYLQNQDIGTNQILNLIYRQQQQLGQGRPVPLNQYQDIDTNQILNLIYKQQLGQGSAYPLNQYLVSQRQVNGQQRLTVPEQFVNQEVLNQVYSEQSLINQRAQQLVEQNQPISQEIYVQQYGLNKQVDQLIQSLVYHQNVISQQVEQFIQQGQRLPQDLLSQQVLVYQQVRQLIVLSTQQLNMHFIHYLVETGNQVDQQLYAVQRNFYQQS

SEQ ID NO: 22981 - protein, 300 aa, Diabrotica virgifera
  misc_feature: Coding regions on vcDNA: vcDNA=SeqID_2678; Strand=+; Position=5-907
  misc_feature: Homolog annotation: Hit_ID=BAA78480.1; Match level="QueryCoverage =64%, HitCoverage=37%, E-value=2e-09, Identity=26%"; Hit description =56 kDa early-staged encapsulation-inducing protein [Tenebrio molitor]
MKCLVLLSLVTLSVAAYYPSTGRQVTVGVAGNVKLVGSQGSQIDIRRSPYNPRTVDVTLRSPNAPTRTLQIDEARNGQQLGYSNLQGVNNQGVNQADVLADLFSQYEGIVDDQTFYSLLNKLQHLVQAGVINRVVLDVVRNWDQQGVQGVRSFNQQWLNNSPVQSLQTILQQIQQQRGLQQELLGQYQNLPQQYLNAEYLQNQDIGTNQILNLIYRQQQQLGQGRPVPLNQYQDIDTNQILNLIYKQQLGQGSAYPLNQYLVSQRQVNGQQRLTVPEQFVFQEVLNQVYSEQSLINQRAQ

SEQ ID NO: 22982 - protein, 257 aa, Diabrotica virgifera
  misc_feature: Coding regions on vcDNA: vcDNA=SeqID_2679; Strand=+; Position=199-969
  misc_feature: Homolog annotation: Hit_ID=AAS38603.1; Match level="QueryCoverage =94%, HitCoverage=17%, E-value=6e-10, Identity=29%"; Hit description =hypothetical protein [Dictyostelium discoideum]
  misc_feature (222)..(222): Xaa can be any naturally occurring amino acid
MLQPELSGYGNFQGQSRVYSPLKEILKNRVQGRSFNQQWLNNSPVQSLQTILQQIQQQRGLQQELLGQYQNLPQQYLNAEYLQNQDIGTNQILNLIYRQQQQLGQGRPVPLNQYQDIDTNQILNLIYKQQLGQGSAYPLNQYLVSQRQVNGQQRLTVPEQFVNQEVLNQVYSEQSLINQRAQQLVEQNQPISQEIYVQQYGLNKQVDQLIQSLVYHQNVISXQVEQFIQQGQRLPPDLLFPPVLVYQQFANYIKFVS

SEQ ID NO: 22983 - protein, 244 aa, Diabrotica virgifera
  misc_feature: Coding regions on vcDNA: vcDNA=SeqID_2680; Strand=-; Position=134-868
  misc_feature: Homolog annotation: Hit_ID=AAH62504.1; Match level="QueryCoverage =99%, HitCoverage=99%, E-value=6e-76, Identity=55%"; Hit description =Diacetyl/L-xylulose reductase [Xenopus tropicalis] ref|NP_989100.1| diacetyl/L-xylulose reductase [Xenopus
  misc_feature: Gene Ontology Annotation: Molecular function=protein binding; Cellular component=microvillus; Biological process=xylulose metabolism
  misc_feature: Pfam annotation: Pfam_ID=adh_short; Match level="Score=257.3, E-value= 2.7e-74, Copies=1"; Pfam description=short chain dehydrogenase
MEVTFKGKTALVTGASQGIGRELVKQLVKCQANVIAVARNADHLASLKKEIPSIRIIPLDLSDWNATENALTNVGPIDLLVNNAGLAILGPLTEVKEDDVDRLFGINVKAIIHVSKIVVNNLLTRKAPGSIVNISSQASLVGLNNHTVYCASKAAVDGFTRAAALEYGRNNIRVNAVNPTVIMTDMGRLGWSDPAVAKPMLEKIPLRRFGEVHEVVDAVTYLLSDKASMITGTCLPIDGGYVAS

SEQ ID NO: 22984 - protein, 245 aa, Diabrotica virgifera
  misc_feature: Coding regions on vcDNA: vcDNA=SeqID_2681; Strand=+; Position=38-775
MLAAKVVLFLGLALFVSAGEDLDKGYEIVECANYVMRAGVPELGVPQHDPYVKLRDLQWSGNLGVAKAHIELHDNRWYGLADWEIQAYQISADTDNEAVFDYTTSWSNGFQLSMNYNATIKELFLSQHYSGTIKITMKQPVWTGRISAQKTPTELKPNTTVDSFTVDWHVADVKCKITGMGLLGDTYALAIQEGIEGALNHGLIGNTVGDFLKMRFNTVWYPTGKVWQMLDYCNSLVSTPDTPQA

SEQ ID NO: 22985 - protein, 255 aa, Diabrotica virgifera
  misc_feature: Coding regions on vcDNA: vcDNA=SeqID_2682; Strand=+; Position=85-852
MLAAKVVLLLGLALFVSAGQDLDKGMEIVKCAQRAISVGVPELGVPSHNPFVVIRNVSWTGSIGVASTHIELNTNKWYGLADWDISAKQINDDEDFEAVFDYTTYWPSFRIVGNYEATVKELFLTQHYKGTYNITMIKPKWTGRISAQKVPTVLTPKPIVDSFTVDWQVADVKCKITGMGIIGDTYALAIQEGIETALNHGLIGNTVGDFLKMRFNTVWYPTGKVWQMMDWCNGGSTDAPTTAAPYTNAPSTAAP

SEQ ID NO: 22986 - protein, 398 aa, Diabrotica virgifera
  misc_feature: Coding regions on vcDNA: vcDNA=SeqID_2683; Strand=+; Position=111-1307
  misc_feature: Homolog annotation: Hit_ID=XP_314511.1; Match level="QueryCoverage =95%, HitCoverage=85%, E-value=5e-82, Identity=42%"; Hit description =ENSANGP00000016302 [Anopheles gambiae]
  misc_feature: Gene Ontology Annotation: Biological process=courtship behavior
  misc_feature: Pfam annotation: Pfam_ID=MRJP; Match level="Score=144.1, E-value=3.2e- 40, Copies=1"; Pfam description=Major royal jelly protein
MRRYYSHYSLLLLSLFFAAANSERFRVIREWKYINFTWPNADVYDNALSRGFYVPENIIISGIKFFEDYYYITLPRMKDGVPATLARIPAGPTAVTAPAFEPFPSWEMNAEGDCNAFQNVQNIEIDPKGQMWIIDSGRTETLTSPSSRCPPKLVIFDIKKNMTTTAYTFPDNVASLNSNFLYDIVVDDTDSGFAYITDNSAKDPGIIIFSVKDHHSWKIRHSESMRADPTATTFRVNGVIINSPLNLASISLSPRVLTTSEGKLVVDDDREVFYSPISSLKMYSINTTVLKNEQNGANNGEYQGNVNTIGIKGSQSAGMLMDNKGILYYTLLGTSSIAKWDIQTPFMSKQRIIARDEKYLQWPNSFTFDNSVYLTILVNQLNKFIYDRFDINHFYYRL

SEQ ID NO: 22987 - protein, 152 aa, Diabrotica virgifera
  misc_feature: Coding regions on vcDNA: vcDNA=SeqID_2684; Strand=+; Position=1442 -1897
  misc_feature: Homolog annotation: Hit_ID=XP_395390.1; Match level="QueryCoverage =87%, HitCoverage=28%, E-value=1e-22, Identity=42%"; Hit description =similar to ENSANGP00000016302 [Apis mellifera]
MTTTAYTFPDNVASLNSNFLYDIVVDDTDSGFAYITDNSAKDPGIIIFSVKDHHSWKIRHSESMRADPTATTFRVNGVIINSPLNLASISLSPRVLTTSEGKLVVHDDREVFYSPISSLKMYSINTTVLKNEQNGANNVGYPGKCYYNWYQR

SEQ ID NO: 22988 - protein, 209 aa, Diabrotica virgifera
  misc_feature: Coding regions on vcDNA: vcDNA=SeqID_2685; Strand=+; Position=1430 -2059
  misc_feature: Homolog annotation: Hit_ID=CAA45211.1; Match level="QueryCoverage =82%, HitCoverage=11%, E-value=2e-10, Identity=33%"; Hit description =polyhomeotic [Drosophila melanogaster]
ADLLVCSNHTVGQLIKVLSTQQLNMINFIQYLVEQGNQVDQQLYAVQRNFYQQVQRLVQQVVLQQSQIKEQIQVLIQQEQTVPQELVLFQQLAYQQVEQFIQVLIKQFIYQQASLRQLVQVFVQQGRVVPQQLVSSYFLIYKQLVQLVQQGDLVPQELIAQQQLIHQQVVLLLQRGVLPQQSALNQLVSQEQQLSLRQPQIYQRVPRVY

SEQ ID NO: 22989 - protein, 257 aa, Diabrotica virgifera
  misc_feature: Coding regions on vcDNA: vcDNA=SeqID_2686; Strand=+; Position=83-856
MRAFSSRQVITTMLAAKVVLFLGLALFVSAGEDLDKGYEIVECANYVMRAGVPELGVPQHDPYVKLRDLQWSGNLGVANAHIELHDNRWYGLADWEIQAYQISADTDNEAVFDYTTSWSNGFQLSMNYNATIKELFLSQHYSGTIKITMKQPVWTGRISAQKTPTDLKPNTTVDSFTVDWHVADVKCKITGMGLLGDTYALAIQEGIEGALNHGLIGNTVGDFLKMRFNTVWYPTGKVWQMLDYCNSLVSTPDARQA

SEQ ID NO: 22990 - protein, 175 aa, Diabrotica virgifera
  misc_feature: Coding regions on vcDNA: vcDNA=SeqID_2687; Strand=+; Position=1218 -1745
  misc_feature: Homolog annotation: Hit_ID=XP_396216.1; Match level="QueryCoverage =85%, HitCoverage=11%, E-value=2e-30, Identity=47%"; Hit description =similar to ENSANGP00000007871 [Apis mellifera]
  misc_feature: Gene Ontology Annotation: Cellular component=integral to membrane; Biological process=hormone secretion
YQPLGTIVLYHRIQEEKVIFTAKPTITTFNPSTTKKQEELVHQHPNPDEILEHKSEPAVSPEPTAEPIATIVPKPAPEPQAEPEPTAQPEPKAEPKPKAEPEPKAEPEPKAEPEPKAEPEPKAEPEPKAEPEPQAESTQTNQTVTTEENTKDKSSASTTVSTILGFVLACSLFVI

SEQ ID NO: 22991 - protein, 255 aa, Diabrotica virgifera; identical to SEQ ID NO: 22985
  misc_feature: Coding regions on vcDNA: vcDNA=SeqID_2688; Strand=+; Position=38-805

SEQ ID NO: 22992 - protein, 86 aa, Diabrotica virgifera
  misc_feature: Coding regions on vcDNA: vcDNA=SeqID_2689; Strand=+; Position=851-1111
IESDTVFSKEAIGTNFIIYSLGKRRAIAHLCVLMIIKSIKTLLFRSFLNHSLKKLVKFSISQQKNHSTTARALRFIRIFIHTKRHI

SEQ ID NO: 22993 - protein, 603 aa, Diabrotica virgifera
  misc_feature: Coding regions on vcDNA: vcDNA=SeqID_2690; Strand=+; Position=998-2809
  misc_feature: Homolog annotation: Hit_ID=EAA16908.1; Match level="QueryCoverage =86%, HitCoverage=22%, E-value=5e-22, Identity=28%"; Hit description =Drosophila melanogaster CG8797 gene product-related [Plasmodium yoelii yoelii]
  misc_feature: Gene Ontology Annotation: Biological process=regulation of protein activity, epigenetic
TTYPQPSAHASAHASGLVLLSLVTLSVAAYYPSTGRQVTVGVAGNVKLVGSQGSQIDIRRSPYNPRTVDVTLRSPNAPTRTLQIDEARNGQQLGYSNLQGVNNQGVNQADVLADLFSQYEGIVDDQTFYSLLNKLQHLVQAGVINRVVLDVVRNWDQQGVQGVSDIVSLQGLSGYGNFQGQSKRMEYKEGAQSTMVEQFPSPIFADHLQQIQQQRGLQQELLGQYQNLPQQYLNSEYLQNQDIGTNQILNLIYRQQQQLGQGRPVPLNQYQDIDTNQILNLIYKQQLGQGSAYPLNQYLVSQRQVNGQQRFTVPEQFVNQEVLNQVYSEQSLINQRAQQLVEQNQPISQEIYVQQYGLNKQVDQLIQSLVYHQNVISQQVEQFIQQGQRLPQDLLSQQVLVYQQVRQLIKVLSTQQLNMINFIQYLVEQGNQVDQQLYAVQRNFYQQVQRLVQQVVLQQSQIKEQIQILIQQEQTVPQELVLFQQLAYQQVEQFIQVLIKQFIYQQASLRQLVQVFVQQGRVVPQQLVSSYFLIYKQLVQLVQQGDLVPQELIAQQQLIHQQVVLLLQRGVLPQQSALNQLVSQEQQLSLRQPQIYQRVPRVY

SEQ ID NO: 22994 - protein, 614 aa, Diabrotica virgifera
  misc_feature: Coding regions on vcDNA: vcDNA=SeqID_2691; Strand=+; Position=2-1846
  misc_feature: Homolog annotation: Hit_ID=EAA16908.1; Match level="QueryCoverage =86%, HitCoverage=45%, E-value=2e-22, Identity=27%"; Hit description =Drosophila melanogaster CG8797 gene product-related [Plasmodium yoelii yoelii]
  misc_feature: Gene Ontology Annotation: Biological process=regulation of protein activity, epigenetic
EEPARAPLFLTLYKMKCLVLLSLVTLSVAAYYPSTGRQVTVGVAGNVKLVGSQGSQIDIRRSPYNPRTVDVTLRSPNAPTRTLQIDEARNGQQLGYSNLQGVNNQGVNQADVLADLFSQYEGIVDDQTFYSLLNKLQHLVQAGVINRVVLDVVRNWDQQGVQGVSDIVSLQGLSGYGNFQGQSRVYSPLKEILKNRVQGRSFNQQWLNNSPVQSLQTILQQIQQQRGLQQELLGQYQNLPQQYLNAEYLQNQDIGTNQILNLIYRQQQQLGQGRPVPLNQYQDIDTNQILNLIYKQQLGQGSAYPLNQYLVSQRQVNGQQRLTVPEQFVNQEVLNQVYSEQSLINQRAQQLVEQNQPISQEIYVQQYGLNKQVDQLIQSLVYHQNVISQQVEQFIQQGQRLPQDLLSQQVLVYQQVRQLIKVLSTQQLNMINFIQYLVEQGNQVDQQLYAVQRNFYQQVQRLVQQVVLQQSQIKEQIQVLIQQEQTVPQELVLFQQLAYQQVEQFIQVLIKQFIYQQASLRQLVQVFVQQGRVVPQQLVSSYFLIYKQLVQLVQQGDLVPQELIAQQQLIHQQVVLLLQRGVLPQQSALNQLVSQEQQLSLRQPQIYQRVPRVY

SEQ ID NO: 22995 - protein, 468 aa, Diabrotica virgifera
  misc_feature: Coding regions on vcDNA: vcDNA=SeqID_2692; Strand=+; Position=191-1594
  misc_feature: Homolog annotation: Hit_ID=AAF14544.1; Match level="QueryCoverage =94%, HitCoverage=57%, E-value=1e-104, Identity=45%"; Hit description= DEAD box RNA helicase Gemin3 [Homo sapiens]
  misc_feature: Gene Ontology Annotation: Molecular function=translation initiation factor activity; Cellular component=eukaryotic translation initiation factor 4 complex; Biological process=RNA localization
  misc_feature: Pfam annotation: Pfam_ID=DEAD; Match level="Score=151.3, E-value=2.1e- 42, Copies=1"; Pfam description=DEAD/DEAH box helicase
MLAHQIENDSRSQDVVVVENVTFDSLLLSGKVAQGLTKNGFKKPSPVQLKSIPLGRCGFDLIVKSKSGTGKTLVFSLIALESLNSTKLKKLEVLILAPTREIAVQSHDFIKQIGCFFEGLKVESFIGGLPLAEDKQKCQNCNIAVGTPGRIKHLILDKTLNVNSVKLFVLDEADKLMESSFRNDINEIYNSLPTKKQIITTSATYPNQLEEFLSKYMLSPTHITAELESPLLLGLKQFVVVTKPYSNVAQQLKAKTDALVDIFNNISFTQCLVFSNFQTKAESLSNILNQKGWPSTYISAAQTQEQRLEAVSVLKEFKCRIMLSTDLTARGIDAANVDLVINFDIPIDSMTYLHRMGRAGRYGSSGVCINLTSQGKELTHLQEILGQIGGNTLTIPKLPKINGSISDLLKIEVPLTDHIASKVKNELDESITKTKMYENKTKQKSPNKDNDDPARSEGCHDDQEAISQ

SEQ ID NO: 22996 - protein, 147 aa, Diabrotica virgifera
  misc_feature: Coding regions on vcDNA: vcDNA=SeqID_2693; Strand=+; Position=23-466
  misc_feature: Homolog annotation: Hit_ID=EAA12330.3; Match level="QueryCoverage =100%, HitCoverage=94%, E-value=7e-63, Identity=79%"; Hit description= ENSANGP00000010348 [Anopheles gambiae str. PEST] ref|XP_555720.1| ENSANGP00000010348 [Anopheles gambiae s
  misc_feature: Gene Ontology Annotation: Molecular function=structural constituent of muscle; Cellular component=muscle myosin; Biological process =muscle development
  misc_feature: Pfam annotation: Pfam_ID=efhand; Match level="Score=54.2, E-value =3.7e-13, Copies=2"; Pfam description=EF hand
MANYSEDQMAEFQEAFQLFDNRGDGKIHVAQIGDALRALGQNPTESDVKKYTQQHKPDERVSFEVFLPIYQQISKTRSADTAEDFIEGLRHFDKDGNGYISSAELRHLLTSLGEKLGDDEVEQLLMGHEDSHGNVNYEDFVKAIMSG

SEQ ID NO: 22997 - protein, 147 aa, Diabrotica virgifera; identical to SEQ ID NO: 22996
  misc_feature: Coding regions on vcDNA: vcDNA=SeqID_2694; Strand=+; Position=307-750
  misc_feature: Homolog annotation: Hit_ID=EAA12330.3; Match level="QueryCoverage =100%, HitCoverage=94%, E-value=7e-63, Identity=79%"; Hit description= ENSANGP00000010348 [Anopheles gambiae str. PEST] ref|XP_555720.1| ENSANGP00000010348 [Anopheles gambiae s
  misc_feature: Gene Ontology Annotation: Molecular function=structural constituent of muscle; Cellular component=muscle myosin; Biological process =muscle development
  misc_feature: Pfam annotation: Pfam_ID=efhand; Match level="Score=54.2, E-value =3.7e-13, Copies=2"; Pfam description=EF hand

SEQ ID NO: 22998 - protein, 105 aa, Diabrotica virgifera
  misc_feature: Coding regions on vcDNA: vcDNA=SeqID_2695; Strand=-; Position=220-537
LFRWYLLLATPPFKMARLTSFVNCLLSYHVCFYVIVLWFSVLSCDVYTVYLYCIICHVIHSVAVLRSCHLRHLCYYLVLVLSLCSFKSFFQIFFLNVPFHSFLRF

SEQ ID NO: 22999 - protein, 113 aa, Diabrotica virgifera
  misc_feature: Coding regions on vcDNA: vcDNA=SeqID_2696; Strand=+; Position=617-955
  misc_feature: Homolog annotation: Hit_ID=XP_419709.1; Match level="QueryCoverage =92%, HitCoverage=61%, E-value=6e-25, Identity=51%"; Hit description =PREDICTED: similar to dJ20N2.1.1 (novel protein similar to yeast and bacterial cytosine deaminase,
  misc_feature: Gene Ontology Annotation: Molecular function=tRNA specific adenosine deaminase activity; Cellular component=cellular_component unknown; Biological process=tRNA modification
  misc_feature: Pfam annotation: Pfam_ID=dCMP_cyt_deam; Match level="Score=56.8, E -value=6.3e-14, Copies=1"; Pfam description=Cytidine and deoxycytidylate deaminase
  misc_feature (76)..(76): Xaa can be any naturally occurring amino acid
  misc_feature (86)..(86): Xaa can be any naturally occurring amino acid
MSQNEILSEKECLFMDKAFFFAKEALSVQEVPVGCVFVYNDKIIALGRNTVNETRNATRHAEINCIEYIVEYSKTXNLDYNQVFSXTSVYVTVEPCIMCAAALYDLKIKQIIF

SEQ ID NO: 23000 - protein, 711 aa, Diabrotica virgifera
  misc_feature: Coding regions on vcDNA: vcDNA=SeqID_2697; Strand=+; Position=118-2253
  misc_feature: Homolog annotation: Hit_ID=XP_315285.1; Match level="QueryCoverage =98%, HitCoverage=78%, E-value=0.0, Identity=57%"; Hit description =ENSANGP00000015293 [Anopheles gambiae]
  misc_feature: Gene Ontology Annotation: Molecular function=heat shock protein activity; Cellular component=cytoplasm; Biological process=response to stress
  misc_feature: Pfam annotation: Pfam_ID=HSP70; Match level="Score=697.6, E-value =7.5e-207, Copies=1"; Pfam description=Hsp70 protein
MAAMSVIGIDLGNESCYVAVAKAGGIETIANDYSLRATPSCVAFSGKNRILGVAAKNQQVTNMKNTVYGLKRLLGRKFRDPHVKKEIQFLPYTVVEEKNGGIGIRVNYLNEEHKFSPEQCLAMLLTKLKDSAMTALQTPINDCVISVPSYFTNNERKALLDSAAIAGLNTLRLFNETTATALSYGIYKQDLPAVEEKPRNIIFVDCGHSSLQVFAVAFNKGKLKMLTTAADPNLGGRDFDLIIAEHFCKQFQTKYNMDAKSNPRAFLRLLTEVEKLKKQMSANSTTLPLNIECFMNDKDVSSDMKRADMETLCAHLFERVEVSLKQCLKQSGLSLDDIYAVEIVGGSSRVPAIKQLIEKVFHKVPSTTLNQDEAVSRGCALQCAMLSPAIRVRDFSVTDVQAYPISVAWDASPGGESAGEIEAFPLNHPVPFSRMLTFYRQEPFTIRAKYSGNIPYPDHDIGTWVIKDIKPNSEGKPQKVKVKVRVNLHGIMSISSASLYEAKESVEPESPEEQQKEAQVNSNDQQNGGVQTNESGESMETTNEGTGANSGEGAVPEVGSGTSWTKKISAWFSGEGSDKKKKQSVKSIELPIESLTTGFSQVEINHFTEQEFKMIASDRQEKERADARNAFEEYVYELRNKVSSDGDFAPFMLENDRNTLVSQLDDMENWLYEDGEDCNKQVYIDKLQQLKSIGEPVPTRKIEYELRTCGY

SEQ ID NO: 23001 - protein, 130 aa, Diabrotica virgifera
  misc_feature: Coding regions on vcDNA: vcDNA=SeqID_2698; Strand=+; Position=118-510
  misc_feature: Homolog annotation: Hit_ID=XP_308748.1; Match level="QueryCoverage =100%, HitCoverage=99%, E-value=5e-53, Identity=77%"; Hit description= ENSANGP00000015184 [Anopheles gambiae]
  misc_feature: Gene Ontology Annotation: Molecular function=RAN protein binding; Cellular component=nuclear membrane; Biological process=protein -nucleus import
  misc_feature: Pfam annotation: Pfam_ID=NTF2; Match level="Score=132.9, E-value=7.3e- 37, Copies=1"; Pfam description=Nuclear transport factor 2 (NTF2) dom
MAINLQYDAIGKSFVQQYYMLFDDPNQRPNLVNMYNVEHSFMTFEGKQLQGSAKIMEKLNSLGFQNINRQLTEVDSQPMFDGGVLINVLGRLQVDNDPPHAYTQVFVLKPLNGSFFVQHDIFRLNIHNSA

SEQ ID NO: 23002 - protein, 338 aa, Diabrotica virgifera
  misc_feature: Coding regions on vcDNA: vcDNA=SeqID_2699; Strand=+; Position=603-1619
  misc_feature: Homolog annotation: Hit_ID=NP_649757.1; Match level="QueryCoverage =86%, HitCoverage=90%, E-value=2e-73, Identity=47%"; Hit description =CG2767-PA [Drosophila melanogaster] gb|AAF54175.1| CG2767-PA [Drosophila melanogaster]
  misc_feature: Gene Ontology Annotation: Molecular function=aldo-keto reductase activity; Cellular component=cytoplasm; Biological process =xenobiotic metabolism
  misc_feature: Pfam annotation: Pfam_ID=Aldo_ket_red; Match level="Score=380.0, E -value=3.2e-111, Copies=1"; Pfam description=Aldo/keto reductase family
MSLTMIGGVKIPIVGLGTWQATNEEELEAAVEAALETGYRHIDTASAYQNEHVIGKVLNKWLTSGKLKREDIFITTKLPMTHIHPDLVETALKESLQKLQLDYVDLYLVHSPIYMKFVEAGKPMEPLPTDHLAVWKKMEEQVDAKRTRTIGLSNFNVNQIDRIVKNCRIQPANTQVELHVYYQQKKLRDYCKKHNIVVVSYGSLGSPGLNVFMKRLGKEVQIPSLLADPVVTKIAEKHNKATSHVLLRYLTQNDIVVIPKSVKPERVKQNFNFLDFTLDAEDLKALEALDKDVDGRLFRMDVFNPKIKNTQSIHTKVISMTKKKPRKTVRRLVVSSCL

SEQ ID NO: 23003 - protein, 64 aa, Diabrotica virgifera
  misc_feature: Coding regions on vcDNA: vcDNA=SeqID_2700; Strand=+; Position=487-681
FKIYEGMVDIDIEFVGVFGAKICICFLPTPLLSSILPCIMSYRCRIFIHSLFSRSWSFLSSIVL

SEQ ID NO: 23004 - protein, 55 aa, Diabrotica virgifera
  misc_feature: Coding regions on vcDNA: vcDNA=SeqID_2701; Strand=-; Position=1913 -2080
SVTKTRCKKILFKKIILNLPNISFYFQSCGIKLNKSLLQNCICMQLCICNRYNNK

SEQ ID NO: 23005 - protein, 165 aa, Diabrotica virgifera
  misc_feature: Coding regions on vcDNA: vcDNA=SeqID_2702; Strand=+; Position=480-974
  misc_feature: Homolog annotation: Hit_ID=NP_084066.2; Match level="QueryCoverage =81%, HitCoverage=33%, E-value=2e-37, Identity=52%"; Hit description =RIKEN cDNA 0610027B03 [Mus musculus] dbj|BAB22281.2| unnamed protein product [Mus musculus]
  misc_feature: Pfam annotation: Pfam_ID=Methyltransf_5; Match level="Score=-112.3, E- value=1.7e-05, Copies=1"; Pfam description=MraW methylase family
  misc_feature (128)..(128): Xaa can be any naturally occurring amino acid
MLARYSKIFRNIRYMSTLAEQCSDVKKVPHVPVMAEEVLHYLKPKKGELIIDMTFGAGGHSRKLLECSPDIKLIALDRDPVAYGYADSLAEEFPGQVIPLLGRFSELPKLLQAKDILPSTVDCILFDXRCSSMQFDDGNRGFALSQNGPLDMRMDGCRFPDRPQL

SEQ ID NO: 23006 - protein, 236 aa, Diabrotica virgifera
  misc_feature: Coding regions on vcDNA: vcDNA=SeqID_2703; Strand=+; Position=2-709
  misc_feature: Homolog annotation: Hit_ID=XP_313655.1; Match level="QueryCoverage =90%, HitCoverage=55%, E-value=4e-95, Identity=71%"; Hit description =ENSANGP00000024436 [Anopheles gambiae]
  misc_feature: Gene Ontology Annotation: Molecular function=G-protein coupled photoreceptor activity; Cellular component=cellular_component unknown; Biological process=fatty acid biosynthesis
  misc_feature: Pfam annotation: Pfam_ID=ELO; Match level="Score=-127.7, E-value =0.00022, Copies=1"; Pfam description=GNS1/SUR4 family
TWTEVHTFLTISASKTVFTAPQTNDTNMSHLVTSVVEKYNDILEHGDPRVEGWWMMDSPLPTLFICMFYAVFSKVIGPKLMENKKPFDLRDVLIVYNFLQTLFSIWLMYEYLMSGWWGSYSFQCQPVDYSNNPVALRMARTCWWYYFSKFTEFFDTLFFILRKKNSHVSTLHVIHHGCMPFSVWMGVKFAPGGHSTFFALLNTFVHIIMYFYYMGAAMGPEYQKYIWWKKYLTRLQ

SEQ ID NO: 23007 - protein, 225 aa, Diabrotica virgifera
  misc_feature: Coding regions on vcDNA: vcDNA=SeqID_2704; Strand=+; Position=89-766
  misc_feature: Homolog annotation: Hit_ID=XP_310375.1; Match level="QueryCoverage =95%, HitCoverage=81%, E-value=1e-64, Identity=55%"; Hit description =ENSANGP00000018910 [Anopheles gambiae]
  misc_feature: Gene Ontology Annotation: Molecular function=molecular_function unknown; Cellular component=cellular_component unknown; Biological process=biological_process unknown
  misc_feature: Pfam annotation: Pfam_ID=PTPLA; Match level="Score=268.6, E-value =1.1e-77, Copies=1"; Pfam description=Protein tyrosine phosphatase -like pro
MAKESASKKGNGAVTTYLLLYNGIQTLGWSYLLFQVIIYYLFGSTKSLYDTVQWTVNIFQNLAVLEVLHAAIGIVKSNPIITAVQVSSRVVVVVGVLIATQAPRESIGLTLCLLAWSITEIIRYSMYALSLVNAVPYFLTWLRYSLFVVLYPIGITGELLCLFWAQKEVGENSLYSVTMPHKYNFIFNYQHVLVFIMLMYIPFFPQLYGHMFAQRKKVLGGKKKE

SEQ ID NO: 23008 - protein, 255 aa, Diabrotica virgifera
  misc_feature: Coding regions on vcDNA: vcDNA=SeqID_2705; Strand=+; Position=77-844
  misc_feature: Homolog annotation: Hit_ID=XP_309011.1; Match level="QueryCoverage =99%, HitCoverage=83%, E-value=1e-72, Identity=59%"; Hit description =ENSANGP00000020298 [Anopheles gambiae]
  misc_feature: Gene Ontology Annotation: Molecular function=single-stranded DNA binding; Cellular component=transcription export complex; Biological process=mRNA-nucleus export
  misc_feature: Pfam annotation: Pfam_ID=RRM_1; Match level="Score=59.1, E-value=1.3e- 14, Copies=1"; Pfam description=RNA recognition motif. (a.k.a. RRM, R
YPKMVDKIEMSLDDIIKSNRTQRVRGGRGGGRGRGGGGNRSSGGGGQRRGGNFRSSGRPGGNVQRSRGRGGISRNYTRGDVNSAWKHDLFEGYGPRKVAAARATVQATMGPTKLLVSNLDFGVSDSDIQELFAEFGVLKGAAVHYDRSGRSLGTADVIFERRSDAIKAMKQYNGVPLDGRAMNIQLATSEIPAPLRRPASSSVDRKFQSRSPRGGSRGRLPRGGGRGRNPRNQQAKQPTAEELDAELDAYTKEAK

SEQ ID NO: 23009 - protein, 250 aa, Diabrotica virgifera
  misc_feature: Coding regions on vcDNA: vcDNA=SeqID_2706; Strand=+; Position=276-1025
  misc_feature: Homolog annotation: Hit_ID=NP_572979.1; Match level="QueryCoverage =67%, HitCoverage=24%, E-value=3e-44, Identity=49%"; Hit description =CG9518-PA [Drosophila melanogaster] gb|AAF48398.1| CG9518-PA [Drosophila melanogaster]
  misc_feature: Pfam annotation: Pfam_ID=GMC_oxred_N; Match level="Score=56.5, E -value=3.6e-15, Copies=1"; Pfam description=GMC oxidoreductase
MDTLSAYIPDIVSLENIQGAVGYLFLASMLRLFSLKSNLGNEQHYPEDYGPKLRDGDEFDFIVIGAGSAGSVVANKLSENAGWRVLVLEAGGYPSFLSDIPAFLFSLQGTDEDWQYKTEPSETSCLAFKDGQCRWPRGKVLGGTSTINAMLYMRGDKRDYDHWAELGNVGWDWNSVLEHYKQLENMKYLHASEQYGRDGLLELTKYDSGHPITQAITEANELLGYPVLAEENPERPSSIIGVDDYLRRVQ

SEQ ID NO: 23010 - protein, 52 aa, Diabrotica virgifera
  misc_feature: Coding regions on vcDNA: vcDNA=SeqID_2707; Strand=-; Position=524-682
GIPRLLTFITPLGGKLPNIIFVYICTTLCFLSFFTFNNVLVVFFKHFVVNFV

SEQ ID NO: 23011 - protein, 211 aa, Diabrotica virgifera
  misc_feature: Coding regions on vcDNA: vcDNA=SeqID_2708; Strand=+; Position=159-794
  misc_feature: Homolog annotation: Hit_ID=CAA69718.1; Match level="QueryCoverage =83%, HitCoverage=70%, E-value=9e-26, Identity=36%"; Hit description =swelling dependent chloride channel, ICln [Danio rerio]
  misc_feature: Gene Ontology Annotation: Molecular function=auxiliary transport protein activity; Cellular component=plasma membrane; Biological process=transport
  misc_feature: Pfam annotation: Pfam_ID=ICln_channel; Match level="Score=65.0, E -value=2.1e-16, Copies=1"; Pfam description=Nucleotide-sensitive chloride conduct
MVIINSFKHPESPIRYQQDDVQVYLDKKDLGLGTLFVSESTLCWQQEENNGFAIEYSSISLHAISKDLNIHSTECVYLVTDGHITMPGDSPPVINEDDDSDAESTEDISEILFIPRNSESIPQIYEAIKVCQELNPDPMDEVGEDELSDDNDDNLYEDAEDDMEGEYNIGEEGGGDADVDDLSRRILRNNLNIQINYTNGTAEEDDFQDAD

SEQ ID NO: 23012 - protein, 47 aa, Diabrotica virgifera
  misc_feature: Coding regions on vcDNA: vcDNA=SeqID_2709; Strand=-; Position=374-517
IYALYVYLYELLAKTSVLHKKLYYYATKCRKLTACENLAKWQKLPPA

SEQ ID NO: 23013 - protein, 60 aa, Diabrotica virgifera
  misc_feature: Coding regions on vcDNA: vcDNA=SeqID_2710; Strand=+; Position=482-664
FWQTTHTDKHTRRIFIHSQFRFVLQERNLLKFQGLQFRKFSFFNIRTANEVICGPKFLPI

SEQ ID NO: 23014 - protein, 250 aa, Diabrotica virgifera
  misc_feature: Coding regions on vcDNA: vcDNA=SeqID_2711; Strand=+; Position=127-876
  misc_feature: Homolog annotation: Hit_ID=NP_723438.1; Match level="QueryCoverage =100%, HitCoverage=55%, E-value=1e-126, Identity=89%"; Hit description=CG9556-PA, isoform A [Drosophila melanogaster] ref|NP _523517.1| CG9556-PB, isoform B [Drosophila
  misc_feature: Gene Ontology Annotation: Molecular function=signal transducer activity; Cellular component=signalosome complex; Biological process= signal transduction
MSDNEDDFMCDDEEDYGLEYSEDSNSEPDVDLENQYYNSKALKEDEPSAALASFQKVLDLESGEKGEWGFKALKQMIKINFKLGNFEEMMTRYKQLLTYIKSAVTRNHSEKSINSILDYISTSRNVSMELLQNFYETTLEALKDAKNDRLWFKTNTKLGKLYYDREDFIKLAKILKQLHQSWPTDDGEDDLKKGTQLLEIYALENQMYTAQKNNKKLKMLYEQSLHIKSAIPHPLIMGSIRECGGKMHLR

SEQ ID NO: 23015 - protein, 172 aa, Diabrotica virgifera
  misc_feature: Coding regions on vcDNA: vcDNA=SeqID_2712; Strand=+; Position=124-642
  misc_feature: Homolog annotation: Hit_ID=BAC99978.1; Match level="QueryCoverage =100%, HitCoverage=100%, E-value=7e-79, Identity=80%"; Hit description=translationally controlled tumor protein [Bombyx mori]
  misc_feature: Gene Ontology Annotation: Molecular function=molecular_function unknown; Cellular component=cellular_component unknown; Biological process=biological_process unknown
  misc_feature: Pfam annotation: Pfam_ID=TCTP; Match level="Score=300.5, E-value=2.7e- 87, Copies=1"; Pfam description=Translationally controlled tumour prot
MRIYKDIFTGDEMFSDTYKMKLVDEVIYEVYGKLIQRKQGDIQLDGANPSAEEADEGTEAGVESGVDIVLNHRLCETYAFGDKKSYTAYLKEYMKKLVEKLQERSPDQVDVFKSNMNKVMKDILGRFKELQFFTGESMEIDGMVGLMEYREIDGQSVPVMMFFKHGLDEEKF

SEQ ID NO: 23016 - protein, 90 aa, Diabrotica virgifera
  misc_feature: Coding regions on vcDNA: vcDNA=SeqID_2713; Strand=+; Position=206-478
FFRSVVLYKTTELSDIAKVSRSKTLRTRGRQSGRNSKIFLFFICYLFHNKISFYVFLPAYILKQCILNKQLFDDFIWQCRETTDFVHNAF

SEQ ID NO: 23017 - protein, 83 aa, Diabrotica virgifera
  misc_feature: Coding regions on vcDNA: vcDNA=SeqID_2714; Strand=-; Position=795-1046
TKIHRNRLVKVVVNPKKASHDKRDCSSLTILNFEWFACFGLLAQNLNLYRPSTGKKAIYCHRLVSQRCFFFYMYMHWHCLKSA

SEQ ID NO: 23018 - protein, 428 aa, Diabrotica virgifera
  misc_feature: Coding regions on vcDNA: vcDNA=SeqID_2715; Strand=+; Position=1-1287
  misc_feature: Homolog annotation: Hit_ID=XP_393472.1; Match level="QueryCoverage =100%, HitCoverage=19%, E-value=3e-59, Identity=36%"; Hit description= similar to Probable phenylalanyl-tRNA synthetase beta chain (Phenylalanine--tRNA
  misc_feature: Gene Ontology Annotation: Molecular function=signal transducer activity; Cellular component=plasma membrane; Biological process =invasive growth
EVEKQSKGQGERIITIKGSADATKQAHNLIATLIKDPDVDILSMLPKSTKSTTIATTLWDKTQIGTKKNVGKTVVVSSSTTSVTHAKVTQTTATATIATNRFSTTTAAKPRTTNTTVQVRATAPRLVAQAEKNAAAQAQNQSVRTSISHPTSVSSRLPMTSKVITSSINQTFAAKLTETSSSGQLMINTSHSVPSKVSRVLVVPQSIPGPVSPQLPSSSSANTQSSPNRNARPPPTASAPPNMQHFQSPGKVAPMFSATAHNNTAPQMEPMPNNIRSSTPNGALHLSNAAVPQQLVQEEAPNLQATSEYSLFFAGGDHWNRREQESQKPVNFAAVTGGSNSQSTAQHKFIDQEPPPQVDASKAPGYRGAAVCSPVSSKASSNSTTPPNISANNYNYQEQTKAQNPLPPIGSNVAHNRPPVSQNNPGDL

SEQ ID NO: 23019 - protein, 244 aa, Diabrotica virgifera
  misc_feature: Coding regions on vcDNA: vcDNA=SeqID_2716; Strand=+; Position=78-812
  misc_feature: Homolog annotation: Hit_ID=XP_313383.1; Match level="QueryCoverage =88%, HitCoverage=29%, E-value=6e-64, Identity=52%"; Hit description =ENSANGP00000011356 [Anopheles gambiae]
  misc_feature: Gene Ontology Annotation: Molecular function=long-chain-fatty-acid -CoA-ligase activity; Cellular component=lipid particle; Biological process=learning and/or memory
  misc_feature (228)..(228): Xaa can be any naturally occurring amino acid
SVLLEILTDTTSCKNHYLFSVIYAVLYIIVFIYDILTFPIYLLFQNPIKRVQLAKIERATIVEKGDKYITYKTTKKPYPTHYEIDTEHIDTMAKLLEHAAKKHTDKRCLGTREILREEDEKQPNGRIFKKYDLGDYKWLSFTEVNNLATSFGKGLRKLGAEPTHNIIILAETQTKWMIASHSAFKQNFSLVTIYATLGDDAIAHAINKTEADIVITSFSLLPQFKHDXHMTANVKKLVYMEDQI

SEQ ID NO: 23020 - protein, 253 aa, Diabrotica virgifera
  misc_feature: Coding regions on vcDNA: vcDNA=SeqID_2717; Strand=+; Position=118-879
  misc_feature: Homolog annotation: Hit_ID=BAB21109.1; Match level="QueryCoverage =96%, HitCoverage=96%, E-value=1e-67, Identity=54%"; Hit description =elongation factor 1 delta [Bombyx mori]
  misc_feature: Gene Ontology Annotation: Molecular function=guanyl-nucleotide exchange factor activity; Cellular component=eukaryotic translation elongation factor 1 complex; Biological process=translational elongation
  misc_feature: Pfam annotation: Pfam_ID=EF1_GNE; Match level="Score=165.0, E-value =1.6e-46, Copies=1"; Pfam description=EF-1 guanine nucleotide exchange doma
MHPEEVSSVWLNRRYYEDAEIAHYENLTKAALTPLAGEVAKARQRLIESRDTFTSNVDSIDTGAIKFMEKKIVEYEKTITSLVTQLKALELRVAALEKTDSQTKPVHQINIQSVPSAKPAVNDDDDDDVDLFGSDSDEDDEAAAKVREDRLKAYEAKKSKKPVLIAKSNVILDVKPWDDETDMKLMEQHVRKVEADGLLWGAAKLVPLAYGIHKLQISCVVEDDKVSIDWLTEQLLEIEDFIQSVDIAAFNKI

SEQ ID NO: 23021 - protein, 228 aa, Diabrotica virgifera
  misc_feature: Coding regions on vcDNA: vcDNA=SeqID_2718; Strand=+; Position=99-785
  misc_feature: Homolog annotation: Hit_ID=BAB21109.1; Match level="QueryCoverage =96%, HitCoverage=96%, E-value=9e-62, Identity=51%"; Hit description =elongation factor 1 delta [Bombyx mori]
  misc_feature: Gene Ontology Annotation: Molecular function=guanyl-nucleotide exchange factor activity; Cellular component=eukaryotic translation elongation factor 1 complex; Biological process=translational elongation
  misc_feature: Pfam annotation: Pfam_ID=EF1_GNE; Match level="Score=165.0, E-value =1.6e-46, Copies=1"; Pfam description=EF-1 guanine nucleotide exchange doma
MHPEEVSSVWLNRRYYEDAEIAHYENLTKSNVDSIDTGAIKFMEKKIVEYEKTITSLVTQLKALELRVAALEKTDSQTKPVHQINIQSVPSAKPAVNDDDDDDVDLFGSDSDEDDEAAAKVREDRLKAYEAKKSKKPVLIAKSNVILDVKPWDDETDMKLMEQHVRKVEADGLLWGAAKLVPLAYGIHKLQISCVVEDDKVSIDWLTEQLLEIEDFIQSVDIAAFNKI

SEQ ID NO: 23022 - protein, 206 aa, Diabrotica virgifera
  misc_feature: Coding regions on vcDNA: vcDNA=SeqID_2719; Strand=+; Position=91-711
  misc_feature: Homolog annotation: Hit_ID=O18598; Match level="QueryCoverage=99%, HitCoverage=99%, E-value=5e-63, Identity=58%"; Hit description =Glutathione S-transferase (GST class-sigma) (Major allergen Bla g 5)
  misc_feature: Gene Ontology Annotation: Molecular function=glutathione peroxidase activity; Cellular component=cellular_component unknown; Biological process=glutathione conjugation reaction
  misc_feature: Pfam annotation: Pfam_ID=GST_N; Match level="Score=59.2, E-value=1.2e- 14, Copies=1"; Pfam description=Glutathione S-transferase, N-terminal
MAPKYKVTYFDITALGEPIRFLLSYGQLDFEDRRLGVDGIEWSSVKPTTPFGQAPLLEHDGKVAHQSIAISRYLAKQVKLVGTNDWEDLEIDAAVDTINDLRAKIAAYHYENDPAVKETKKKPLFEDVLPFYLEKLEAQVQKNNGYLATGKLTWADLFFVALLQYFQFMLGKDLVENSPNLQKLKEKVLALPNIKAWVEKRPETKF

SEQ ID NO: 23023 - protein, 497 aa, Diabrotica virgifera
  misc_feature: Coding regions on vcDNA: vcDNA=SeqID_2720; Strand=+; Position=167-1660
  misc_feature: Homolog annotation: Hit_ID=EAL38666.1; Match level="QueryCoverage =98%, HitCoverage=81%, E-value=1e-178, Identity=62%"; Hit description= ENSANGP00000026077 [Anopheles gambiae str. PEST] ref|XP_551775.1| ENSANGP00000026077 [Anopheles gambiae s
  misc_feature: Gene Ontology Annotation: Molecular function=protein disulfide isomerase activity; Cellular component=endoplasmic reticulum; Biological process=protein folding
  misc_feature: Pfam annotation: Pfam_ID=Thioredoxin; Match level="Score=334.1, E -value=2.1e-97, Copies=2"; Pfam description=Thioredoxin
MFRTGFLLVFFLNAVFAAEDIKTEDGVLVLTKDNFQGVLNDNEFVLVEFYAPWCGHCKALAPEYAKAAQQLEQQGSNIKLGKVDATEEGSLAEQFNIRGYPTLKFFRNGSPIEYSGGRQADDIVNWLAKKTGPPAKDLSSVEAAKEFIEGHNVVVVGFFSEQTTSNEVAKNFLKVASGLDDIPFGISADQAVRDEFEAADNSIVLFKKFDERKVAYEGDADEDALKKFIQSNALPLLVEFNHETAQKIFGGEIKSHLLLFLNREDKDVYETISEAARSVAKPFKEEVLFVSIDAEQEDNQRIMEFFGIKKNTVPAARLIKLEEDMAKYKPASDDLTADNIKNFVQDFLDGKLKQHLLNQELPEDWDKNPVKVLVSSNFDSVALDSSKDVLVEFYAPWCGHCKNLAPIYDKLGEHFKDNSDVVIAKMDSTANELEHTKVVNYPTIKLYTKGSNEAVEYLGPRTFEGLSKFVESGGKDDSEDSAEEDAEDDDASKKDEL

SEQ ID NO: 23024 - protein, 718 aa, Diabrotica virgifera
  misc_feature: Coding regions on vcDNA: vcDNA=SeqID_2721; Strand=+; Position=1303 -3459
  misc_feature: Homolog annotation: Hit_ID=AAG44630.1; Match level="QueryCoverage =100%, HitCoverage=100%, E-value=0.0, Identity=89%"; Hit description =90-kDa heat shock protein HSP83 [Spodoptera frugiperda]
  misc_feature: Gene Ontology Annotation: Molecular function=chaperonin ATPase activity; Cellular component=centrosome; Biological process =regulation of sleep
  misc_feature: Pfam annotation: Pfam_ID=HSP90; Match level="Score=1300.8, E-value=0, Copies=1"; Pfam description=Hsp90 protein
MPEETQSADVETFAFQAEIAQLMSLIINTFYSNKEIFLRELISNSSDALDKIRYQSLTNPSCLDSGKDLHIKIVPNKSEGTLTIIDTGIGMTKADLVNNLGTIAKSGTKAFMEALQAGADISMIGQFGVGFYSAYLVADRVVVVSKNNDDEQYIWESSAGGSFTIRPDVGEPLGRGTKIVLYIKEDQTEFLEENKIKEIVKKHSQFIGYPIKLLVEKEREKELSDDEAEEEKKEEEEDKDKPKIEDVGEDEDEDKKDEKKKKKKTIKEKYTEDEELNKTKPIWTRNADDITQEEYGEFYKSLTNDWEDHLAVKHFSVEGQLEFRALLFVPRRVPFDLFENKKKKNNIKLYVRRVFIMDNCEDLIPEYLNFIKGVVDSEDLPLNISREMLQQNKILKVIRKNLVKKCLELFEELTEDKDGWKKFYEQFSKNIKLGIHEDSQNRAKLADLLRYHTSASGDEACSLKDYVSRMKENQKHIYYITGENKEQVAHSAFVERVKKRGFEVVYMTEPIDEYVVQQLKEYDGKTLVSVTKEGLELPEDEEEKKKREDDKAKYEGLCKVMKSILDNKVEKVVVSNRLVESPCCIVTSQYGWTANMERIMKAQALRDTSTMGYMAAKKHLEINPDHSIIENLRQKTEVDKNDKAVKDLVILLFETALLSSGFTLDEPQVHASRIYRMIKLGLGIDEEESMLTEETPSGEAPAAEAGDGEDASRMEEVD

SEQ ID NO: 23025 - protein, 248 aa, Diabrotica virgifera
  misc_feature: Coding regions on vcDNA: vcDNA=SeqID_2722; Strand=+; Position=262-1008
  misc_feature: Homolog annotation: Hit_ID=EAL38765.1; Match level="QueryCoverage =38%, HitCoverage=46%, E-value=2e-10, Identity=34%"; Hit description =ENSANGP00000026520 [Anopheles gambiae str. PEST] ref|XP_552131.1| ENSANGP00000026520 [Anopheles gambiae st
MMAQWPDDKCIELIDLYHNKRILWDPKDRDHFQKSLKDDAWREIGETMDTPAEDCKWKMINLLASFRREKRKVSRGTCGIGKGRDEAYESRWFAYAAMRFLEDRDPPRRRKTTKKDNLHTEEQRDVLADEMHLEEAVHQEEETATSSSSLIPRPDPSRSPLATANEDTPAVKKRLHKKDTSDSEMMSSAFLILKNAAESLNQDSTELDEIDALCKYLSAKVHKYSPATQIGVQHAMDVIMKADRGFFD

SEQ ID NO: 23026 - protein, 111 aa, Diabrotica virgifera
  misc_feature: Coding regions on vcDNA: vcDNA=SeqID_2723; Strand=+; Position=532-867
KCRYILHPLFYFRFFPDVILSTMQKVASLYRCCIYIDLFFPKCTGLINSNMLFQPFLCLSYSIMFHIIAGRPYISRNLYGIKKLKTWKQFNIFKNLSNDVNYDHPSESLKS

SEQ ID NO: 23027 - protein, 396 aa, Diabrotica virgifera
  misc_feature: Coding regions on vcDNA: vcDNA=SeqID_2724; Strand=-; Position=362-1552
  misc_feature: Homolog annotation: Hit_ID=NP_503166.1; Match level="QueryCoverage =68%, HitCoverage=37%, E-value=2e-42, Identity=37%"; Hit description =predicted CDS, reverse transcriptase family member (5A739) [Caenorhabditis elegans]
  misc_feature (130)..(130): Xaa can be any naturally occurring amino acid
  misc_feature (141)..(141): Xaa can be any naturally occurring amino acid
  misc_feature (242)..(242): Xaa can be any naturally occurring amino acid
MQRGVRQGDTISPKLFTTLLEHTFKEADLNEYGININVEKLSHLRFADDIVLIANRMDDAIIMLNKLYHASLEVGLKININKTQIMTNLVLNRNIVVDGMDIEQTASYKYLGHEIRLGRDNQTCELPRRXRIIYSLAFSDXKVSYVFKSDLPICLKRKIFDQCVLPVLTYGAETLTLTKKVLNKIRITQRATERQMLGVSLRDRIPNEEIRRRTKTTDAVDRIASLKWNWSEHVARLSDNRXTKRIVEWRPQEEALRSRGRPPTRWADDLKRIVGNWMQAAQNRKMERAEGELCPAVDEYGLMMMMNSLGNDRNYSILCAFLILTIIGSTTHGGSWPVPESASIPSYPSPWFSNFALLTLASVFHLVLKPCSGPASSPHSIRSLAINVFRRLIHSL

SEQ ID NO: 23028 - protein, 101 aa, Diabrotica virgifera
  misc_feature: Coding regions on vcDNA: vcDNA=SeqID_2725; Strand=-; Position=1-303
CNRRVHIRMPGFKTRLIQTIYQIVIIHDTILTYIYIMDTYRNRKLEKTFMTCEHRSIKKFYQRTVSAPREEGRKILKVRLNQAAQSHHSVRMMGTICAKKV

SEQ ID NO: 23029 - protein, 456 aa, Diabrotica virgifera
  misc_feature: Coding regions on vcDNA: vcDNA=SeqID_2726; Strand=+; Position=1-1368
  misc_feature: Homolog annotation: Hit_ID=Q16992; Match level="QueryCoverage=97%, HitCoverage=82%, E-value=2e-25, Identity=36%"; Hit description =LWamide neuropeptides precursor [Contains: LWamide I; Metamorphosin A (LWamide II) (MMA); LWamide
GLIGRSLDSIGGNRLLGRSIDPIDHGLIGRSLDSIGGSRLLGRSIDPIDNGLIGRSIDPIDGGSLIGRSLDSIGGNRLLGRSIDPIDHGLIGRSLDSIGGNRLLGRSIDPIDHGLIGRSLDSIGGNRLLGKSIDPIDNGLIGRSIDPIEGGSLIGRSLDSIGGSRLLGRSIDPIDHGLIGRSLDSIGGNRLLGRSIDPIDHGLIGRSLDSIGGNRLLGKSIDPIDNGLIGRSIDPIDGGSLIGRSLDSIGGNRLLGRSIDPIDHGLIGKSLDSIGGNRLLGRSIDPIDHGLIGRSLDSIGGNRLLGRSIDPIDNGLIGRSIDPIDGGSLIGRSLDSIGGNRLLGRSIDPIDHGLIGRSLDSIGGNRLLGRSIDPIDHGLIGRSLDSIGGNRLLGKSIDPIDNGLIGRSIDPIDGGSLIGRSLDSIGGNRLLKSIDPIDHGLIGKSLDSIGGNRLLG

SEQ ID NO: 23030 - protein, 250 aa, Diabrotica virgifera
  misc_feature: Coding regions on vcDNA: vcDNA=SeqID_2727; Strand=+; Position=85-834
  misc_feature: Homolog annotation: Hit_ID=EAA12654.3; Match level="QueryCoverage =98%, HitCoverage=33%, E-value=6e-57, Identity=48%"; Hit description =ENSANGP00000018513 [Anopheles gambiae str. PEST] ref|XP_555699.1| ENSANGP00000018513 [Anopheles gambiae st
  misc_feature: Gene Ontology Annotation: Molecular function=DNA binding; Cellular component=nucleolus; Biological process=histogenesis and organogenesis
MGSDKKRRSRSRDKDKRKRSRSRSKERSDREKIRDSDRHKRHRSRSREKDYPSSSKHDKFDKEKYKSDRDKYDDKDKKYKDAKKEEEEELEKVKVETKTEVKQEPAKKEPLSLEELLTKKKAEEAAKSKPVFLTKEQRAAEALKRRQEEIAKVRKQQDEERKIVEAVQAGREVEVKRDDRDYRRNRDRDREEEKQKDKDKEKEQDAIKERYLGLIKKKRRVRRLNDRKFVFDWDAAEDPSLDYYNLYKER

SEQ ID NO: 23031 - protein, 471 aa, Diabrotica virgifera
  misc_feature: Coding regions on vcDNA: vcDNA=SeqID_2728; Strand=+; Position=36-1452
  misc_feature: Homolog annotation: Hit_ID=EAL34424.1; Match level="QueryCoverage =92%, HitCoverage=98%, E-value=2e-80, Identity=32%"; Hit description =GA18010-PA [Drosophila pseudoobscura]
  misc_feature: Gene Ontology Annotation: Biological process=courtship behavior
  misc_feature: Pfam annotation: Pfam_ID=MRJP; Match level="Score=367.9, E-value=1.4e- 107, Copies=1"; Pfam description=Major royal jelly protein
  misc_feature (319)..(319): Xaa can be any naturally occurring amino acid
MRTLTVCILSLLAIFVSGTGLKEEFTWHRITYAWPRGQGNGPRNRVQRYAQYAGAGGSSSPIIYEDPNLPNSGWNPSEGIDYNHVTNIPMGANVWRNKLFITVPRRRLGVPSTLNYVPLDSPRRHNVPLIPYPDWDTNIYPDPKNSGDNFVSVYRVAVDPCDRLWFVDTGLVEVLGNVSRVRPTTLVMMDLTTDKIIRSFQIPADQIRPTSGLASVTVDVTKDTCDDAYAYIPDLGGYGLIVYSLREDRSWRITHNYFYLEPLAGEFDISGHRFQWNDGIFSVELTNVKPDGNRDLYFHSMAGTHMYRVPTNIVKNHTXKLRGHTMGEDFQNLGDRGAGSQTSSADIHKPSGIMFLGLVNQNALGCWNTKKPLSTISVVQKDDAKMIYPCDVKVSNDKVYVLTNAMPEFLYGALNYDQINFRIWSNTISKAVAGTQCASGDSASITYAGPANYAQGGSYGGNKQRGPYKGY

SEQ ID NO: 23032 - protein, 305 aa, Diabrotica virgifera
  misc_feature: Coding regions on vcDNA: vcDNA=SeqID_2729; Strand=+; Position=90-1004
  misc_feature: Homolog annotation: Hit_ID=AAD21841.1; Match level="QueryCoverage =94%, HitCoverage=72%, E-value=2e-55, Identity=42%"; Hit description =trypsin-like serine protease [Ctenocephalides felis]
  misc_feature: Gene Ontology Annotation: Molecular function=plasma kallikrein activity; Cellular component=membrane; Biological process=antifungal polypeptide induction
  misc_feature: Pfam annotation: Pfam_ID=Trypsin; Match level="Score=67.8, E-value=3e- 17, Copies=1"; Pfam description=Trypsin
MKHKLIFLFVYFVFYNDVYAQVGDRCTFKGTTKRGVCKEITKCPAAEAQAKQGTDDVTLCGFANDLITAIVCCEVTVEPNDNLLPADFDTNGETSPPGKMTERKCQEYSKAITSEVQVLSLVSDATPMSYRTPKCDYNTVPLIVGGTPAEAGEFPFMVAIGFNTTSDRWRCGGTLISTRFVVTAAHCCYTRDAGKPSVVRVGELDLASDQDGSVYADYLISRVIVHPGYSAPYKYNDIALLETQQPVVFTNFTRPACLNLNHNVAQSQAIATGWGKTDFAGDASDRLLKVTLNLYDNQRCQRTFP

SEQ ID NO: 23033 - protein, 293 aa, Diabrotica virgifera
  misc_feature: Coding regions on vcDNA: vcDNA=SeqID_2730; Strand=+; Position=8-886
  misc_feature: Homolog annotation: Hit_ID=XP_308889.1; Match level="QueryCoverage =94%, HitCoverage=90%, E-value=1e-36, Identity=38%"; Hit description =ENSANGP00000012804 [Anopheles gambiae]
  misc_feature: Pfam annotation: Pfam_ID=Chitin_bind_4; Match level="Score=117.5, E -value=3.2e-32, Copies=1"; Pfam description=Insect cuticle protein
MAFKFLAFAAFVSVARAGVIGEAYSSPLAYAAPAVAKVAYSPAPAVSYSSISAPVAYAAAPAIAKIAAPAVSYAAPAVSYGAPALSYAAPVAKVAYSSAPAVSYSSVSAPVAYAAAPAIAKVAAPVSYAAPALSYAAPVAKVAYSSAPAVSYSSVSAPVAYGAAPAYAKVAAPVSYAAPAVSYAAPALSYAAPALKVAAPVAYATPVAKAVYAEPSAPAHYDFGYAVSDPHTGDSKSQQESRRGDVVQGSYSLIDSDGTKRTVDYTADPHNGFNAVVHREPPWCRCQSCSCSQ

SEQ ID NO: 23034 - protein, 251 aa, Diabrotica virgifera
  misc_feature: Coding regions on vcDNA: vcDNA=SeqID_2731; Strand=+; Position=8-763
  misc_feature: Homolog annotation: Hit_ID=NP_647875.1; Match level="QueryCoverage =95%, HitCoverage=89%, E-value=6e-38, Identity=48%"; Hit description =CG1259-PB [Drosophila melanogaster] gb|AAF47864.2| CG1259-PB [Drosophila melanogaster]
  misc_feature: Gene Ontology Annotation: Molecular function=structural constituent of eye lens
  misc_feature: Pfam annotation: Pfam_ID=Chitin_bind_4; Match level="Score=113.8, E -value=4.1e-31, Copies=1"; Pfam description=Insect cuticle protein
MAFKLVAFAALVAVARAGVIGEAYSAPLAYAAPAVAKVAYSAAPAVSYSSVSSPVAYAAPAVAKLAAPVSYAAPALSYAAPVAKVAYSSAPAVSYSSVSAPVAYAAAPAYAKVAAPVSYAAPAVSYAAPALSYAAPALKVAAPVAYAAPVAKAVYAEPSAPANYDFGYAVNDPHTGDSKSQQESRHGDVVHGSYSLIEADGSKRTVDYTADEHNGFNAVVHKEPATVAVKAVAPVVAKIAAPIAYAHQPSK

SEQ ID NO: 23035 - protein, 268 aa, Diabrotica virgifera
  misc_feature: Coding regions on vcDNA: vcDNA=SeqID_2732; Strand=+; Position=111-914
  misc_feature: Homolog annotation: Hit_ID=XP_393336.1; Match level="QueryCoverage =92%, HitCoverage=34%, E-value=1e-109, Identity=76%"; Hit description= similar to GMP synthase [glutamine-hydrolyzing] (Glutamine amidotransferase) (GMP
  misc_feature: Gene Ontology Annotation: Molecular function=GMP synthase activity; Cellular component=cellular_component unknown; Biological process =purine base biosynthesis
  misc_feature: Pfam annotation: Pfam_ID=GATase; Match level="Score=163.4, E-value =4.9e-46, Copies=1"; Pfam description=Glutamine amidotransferase class-I
MHNLNPDGPYVNVNGATNTERVCILDAGAQYGKVIDRKVRELCVESQIIPLDTPAFNIKEAGYKAIIISGGPNSVYAEDAPRYDADIFRIGLPVLGICYGMQMMNKEFGGTVIRKETREDGIYNIEVNSKCLLFKGLDKIQPVLLTHGDAIDKIAENFKPIAQSSSFCAGICNEKLQLYGVQFHPEVDLTANGKTMLKNFLFDIAGLTGNYTMDGRESECVRYIKETVGNNKVLLLLSGGVDSTVCAALLHKALNPAQIIAIHIDNGF

SEQ ID NO: 23036 - protein, 423 aa, Diabrotica virgifera
  misc_feature: Coding regions on vcDNA: vcDNA=SeqID_2733; Strand=+; Position=85-1353
  misc_feature: Homolog annotation: Hit_ID=XP_393336.1; Match level="QueryCoverage =95%, HitCoverage=58%, E-value=1e-166, Identity=68%"; Hit description= similar to GMP synthase [glutamine-hydrolyzing] (Glutamine amidotransferase) (GMP
  misc_feature: Gene Ontology Annotation: Molecular function=GMP synthase activity; Cellular component=cellular_component unknown; Biological process =purine base biosynthesis
  misc_feature: Pfam annotation: Pfam_ID=GATase; Match level="Score=163.4, E-value =4.9e-46, Copies=1"; Pfam description=Glutamine amidotransferase class-I
  misc_feature (404)..(404): Xaa can be any naturally occurring amino acid
MHNLNPDGPYVNVNGATNTERVCILDAGAQYGKVIDRKVRELCVESQIIPLDTPAFNIKEAGYKAIIISGGPNSVYAEDAPRYDADIFRIGLPVLGICYGMQMMNKEFGGTVIRKETREDGIYNIEVNSKCLLFKGLDKIQPVLLTHGDAIDKIAENFKPIAQSSSFCAGICNEKLQLYGVQFHPEVDLTANGKTMLKNFLFDIAGLTGNYTMDGRESECVRYIKETVGNNKVLLLLSGGVDSTVCAALLHKALNPAQIIAIHIDNGFMRKNESSKVHNSLLKIGLDVKVIKAASTFMEGTTIIPVDKQESSRTMITKMLCHTTNPEEKRKIIGDIFVKIADEIVADLNLKADEVFLAQGTLRPDLIESASKLVSSKADTIKTHHNDSELIRKLRNEGRVVEPXQDFHKDEVRSIGRDLGLPP

SEQ ID NO: 23037 - protein, 87 aa, Diabrotica virgifera
  misc_feature: Coding regions on vcDNA: vcDNA=SeqID_2734; Strand=+; Position=227-490
VFAHQSVGMKVISYRTHWMYHFYLYRKRGSWVFLQKQFLKRDQYCLTLGPLTTLYIFSIIHYHNITYIETNDAKNNLHFQIYKYIRT

SEQ ID NO: 23038 - protein, 333 aa, Diabrotica virgifera
  misc_feature: Coding regions on vcDNA: vcDNA=SeqID_2735; Strand=+; Position=44-1045
  misc_feature: Homolog annotation: Hit_ID=NP_649876.1; Match level="QueryCoverage =100%, HitCoverage=100%, E-value=1e-42, Identity=34%"; Hit description=CG8444-PA [Drosophila melanogaster] gb|AAF54350.1| CG8444-PA [Drosophila melanogaster]
  misc_feature: Pfam annotation: Pfam_ID=Renin_r; Match level="Score=161.8, E-value =1.5e-45, Copies=1"; Pfam description=Renin receptor-like protein
MIFYLTLTTLLISTALGAGEFSVLHHAPSLTFRGHDALKESTLKDVYAAALGFSTEHFSNWKGMFLSDPFGVAQAIVTVYVDGVSDIDQQKGHHFPLKTDIGESKVYRSIERRIEEHYPNEDTNLVRVRLANGLEDIHKYKIFEDIASGDSKQLNHKSLKLDVDEDRKFIKEITILNEIAQRIEEGEIKRDNIPDLYWFEVSSLHAVSDLYGENSTQVLEAKQLLNECILRLNSAFNKLYNGYVLVTVVTSDASHTRRGRSILAADEPTDDKTKYNLASYYSKDYPVIFNLILWFGVVMLFSLIAICMAIGTMDPGRDSIIYRMTSTRMKKDN

SEQ ID NO: 23039 - protein, 319 aa, Diabrotica virgifera
  misc_feature: Coding regions on vcDNA: vcDNA=SeqID_2736; Strand=+; Position=1-957
  misc_feature: Homolog annotation: Hit_ID=NP_652705.1; Match level="QueryCoverage =99%, HitCoverage=95%, E-value=1e-113, Identity=28%"; Hit description= CG1915-PC, isoform C [Drosophila melanogaster] gb|AAG22226.2| CG1915 -PC, isoform C [Drosophila
  misc_feature: Gene Ontology Annotation: Molecular function=structural constituent of muscle; Cellular component=sarcomere; Biological process=mitotic chromosome condensation
  misc_feature: Pfam annotation: Pfam_ID=I-set; Match level="Score=177.9, E-value =2.2e-50, Copies=3"; Pfam description=Immunoglobulin I-set domain
EEQYAQYVQQKLNEKIDKLPVFEKPKSKDKASAPKFIKKLKPIITPDGYTVQFECKVEGFPRPQITWFRQTHIIKTSKDFQIYYDEDNVATLIIREVFPEDAGTFTCVAKNSAGFASSTTELIVEGPLSSHGSELTSISRKSLSRTSSLADILEGIPPTFAKKPLPQCVPEETDVVVESTLVGVPQPEIKWFCNGRRVTENVSIVSTSELYTYKTTLKIKKIKKTQEGKFKIVARNREGEASVTFTLKVITSEKEAPEVLSPLESITVRKGEPVTLSTTIFGNPEPTIEWLKDGKPLTRPKFKKDGNTYTLTNPKTSTD

SEQ ID NO: 23040 - protein, 465 aa, Diabrotica virgifera
  misc_feature: Coding regions on vcDNA: vcDNA=SeqID_2737; Strand=+; Position=89-1483
  misc_feature: Homolog annotation: Hit_ID=XP_394668.1; Match level="QueryCoverage =83%, HitCoverage=49%, E-value=1e-175, Identity=79%"; Hit description= similar to ENSANGP00000009739 [Apis mellifera]
  misc_feature (445)..(446): Xaa can be any naturally occurring amino acid
  misc_feature (451)..(451): Xaa can be any naturally occurring amino acid
MASSQDAWYLSLLGLAEYFRTSSPPMIKTCIQCLQAVFNFKPPQRVEARTHLQLGNILLTHTKNIDLAKNYLEQAWLLSQAINSFDDVKFEAASVLAELYEQQDQISLSKPILRKAIELSQHNVYWHCRLIFQLAQIHATEKDYTLASSLLGVGVDYAHISNASYTRVLFLLSKGMLLLIDKKLQEVQQVLNQAGHLIETWTGAVYQKEYVKVYYLVLQVCLYLMAGQVKSVKPCLKQLQQSIQTIMATDDVFMGPSAGDMFLWMPKEHLYVLVYLVTVMHSMQAGYMEKAQKYTDKALMQIEKLKIVDNKPILSVFQLMLLEHIIMCRLVMGNKTQALQEISSAATLCKQCPKLLETHGPQLHTLLGLYSMSMNCMEAAEAQFIAALNTSRERELWTFANLNLAIVYLRGKREADFNALHERINPESLPSHSHSLRAAAYYVQXXAAFFXGDVHEAKRYLRETL

SEQ ID NO: 23041 - protein, 201 aa, Diabrotica virgifera
  misc_feature: Coding regions on vcDNA: vcDNA=SeqID_2738; Strand=+; Position=29-634
MFKVTSLVLIISILAPFAIAGQDSAVEWRPYNGVPDDHAIIIQVQTEYSPAVYIGLAHVIDNAAQSEAYLPVNIVEGFNYANVTLNDKNYMADNLQILCFKNPDALGWQYTKAANFDDLLNDSKIAPIVAGWEAHSVVYNATVYMGVGYIPALGGNNVGKVYHGLPQTQNRRDGSLYIDRSGVSAEYYLAGGSFNVPVYYK

SEQ ID NO: 23042 - protein, 117 aa, Diabrotica virgifera
  misc_feature: Coding regions on vcDNA: vcDNA=SeqID_2739; Strand=+; Position=61-411
  misc_feature: Homolog annotation: Hit_ID=EAL29277.1; Match level="QueryCoverage =82%, HitCoverage=6%, E-value=9e-15, Identity=45%"; Hit description =GA14323-PA [Drosophila pseudoobscura]
  misc_feature: Gene Ontology Annotation: Molecular function=transcription factor activity; Biological process=transcription from Pol II promoter
MVPEVKKGILALDDDPLAALATAALAENNSHDPEVPLKDTWYTVGFIRGNSCDVKSYFLLNEDTENLTLDTLPSTVNYPAGFNLEPGTAYKFRVAAINSLGRSDWSEVSAFKTCLPG

SEQ ID NO: 23043 - protein, 380 aa, Diabrotica virgifera
  misc_feature: Coding regions on vcDNA: vcDNA=SeqID_2740; Strand=+; Position=95-1235
  misc_feature: Homolog annotation: Hit_ID=NP_510594.1; Match level="QueryCoverage =97%, HitCoverage=68%, E-value=1e-120, Identity=58%"; Hit description= 24-dehydrocholesterol reductase (61.7 kD) (XQ386) [Caenorhabditis elegans] emb|CAA22461.1|
  misc_feature: Pfam annotation: Pfam_ID=FAD_binding_4; Match level="Score=44.6, E -value=2.8e-10, Copies=1"; Pfam description=FAD binding domain
  misc_feature (333)..(333): Xaa can be any naturally occurring amino acid
  misc_feature (361)..(361): Xaa can be any naturally occurring amino acid
  misc_feature (364)..(364): Xaa can be any naturally occurring amino acid
  misc_feature (375)..(375): Xaa can be any naturally occurring amino acid
MGDQTTQDRSWKDKSIDLLEKNRGLVVLFFCLPASFIFDLLLNLRKQIYRYLFSGDQDHDKGNGAVQQQVQQWNKLPKQDRKLLCTSRPNWQSLSLTFFRKDLCHQVNVDLYNVLELDEKNLTVKVEPMMSVGEITKYLVPKGYTLAVTLEIADATVGGLAMGTGMTTHSHKVGLYHENIVSYDVVLGDGSLVTASSEEHEDLYKCLPWSHGSLGFLVALTLKIVKIKPYIKMSYIPVKGEDNYCDMIRLVSGDNGADYPVADYVETTIFSRNEAVIMTGDYSDYDPNLPINTVTSWYKPWFYKYVESFLKKGKHTELIPLREYLLRHNRAIXWVVESMIPFGNNPLFRVVFGWLLRLTSXLEXYTTPGIRKFTXMKQVF

SEQ ID NO: 23044 - protein, 151 aa, Diabrotica virgifera
  misc_feature: Coding regions on vcDNA: vcDNA=SeqID_2741; Strand=+; Position=79-530
  misc_feature: Homolog annotation: Hit_ID=EAL25136.1; Match level="QueryCoverage =99%, HitCoverage=61%, E-value=1e-64, Identity=83%"; Hit description =GA10654-PA [Drosophila pseudoobscura]
  misc_feature: Gene Ontology Annotation: Molecular function=endopeptidase activity; Cellular component=cytosol; Biological process=proteolysis and peptidolysis
  misc_feature: Pfam annotation: Pfam_ID=Proteasome; Match level="Score=17.9, E-value= 9.9e-07, Copies=1"; Pfam description=Proteasome A-type and B-type
  misc_feature (12)..(12): Xaa can be any naturally occurring amino acid
  misc_feature (136)..(136): Xaa can be any naturally occurring amino acid
MFPTRSEYDRGXVNTFSPEGRLFQVEYAIEAIKLGSTAIGICTSGGVVLAVEKRITSPLMEPTTIEKIVEVDKHIGCAVSGLMADSRTMIDRARVECQNHWFVYNENISVESCAQGVSNLAIQFGDSDEDGAAMSXPFGVAIWFAGIDEKG

SEQ ID NO: 23045 - protein, 224 aa, Diabrotica virgifera
  misc_feature: Coding regions on vcDNA: vcDNA=SeqID_2742; Strand=+; Position=66-740
  misc_feature: Homolog annotation: Hit_ID=XP_394508.1; Match level="QueryCoverage =93%, HitCoverage=38%, E-value=1e-32, Identity=35%"; Hit description =similar to zinc finger protein 62 homolog [Apis mellifera]
  misc_feature: Pfam annotation: Pfam_ID=zf-AD; Match level="Score=78.5, E-value=1.7e- 20, Copies=1"; Pfam description=Zinc-finger associated domain (zf-AD)
MNHNNNMLQLCRLCLVKDEVNIPIFEEQGDIRQIFLKISSCLPVKVSRDDQLPKKICDGCSYKLDMLYEFWNTSANAEKQLLTWLGEAGMTSQMTDGTISAVAQQIKPADAFVKQETIDPPDILKDDDDEDEEDKDYMKQEESSNNVEEPPPKRARRTAAVKAAIALDQNSDDDDDSGEPMTKVEDDTDDSDNDDGPPFVDVPSTSADDQPGPSGVGKDGVEAP

SEQ ID NO: 23046 - protein, 439 aa, Diabrotica virgifera
  misc_feature: Coding regions on vcDNA: vcDNA=SeqID_2743; Strand=+; Position=105-1421
  misc_feature: Homolog annotation: Hit_ID=XP_394508.1; Match level="QueryCoverage =47%, HitCoverage=38%, E-value=3e-32, Identity=35%"; Hit description =similar to zinc finger protein 62 homolog [Apis mellifera]
  misc_feature: Pfam annotation: Pfam_ID=zf-AD; Match level="Score=78.5, E-value=1.7e- 20, Copies=1"; Pfam description=Zinc-finger associated domain (zf-AD)
MNHNNNMLQLCRLCLVKDEVNIPIFEEQGDIRQIFLKISSCLPVKVSRDDQLPKKICDGCSYKLDMLYEFWNTSANAEKQLLTWLGEAGMTSQMTDGTISAVAQQIKPADAFVKQETIDPPDILKDDDDEDEEDKDYMKQEESSNNVEEPPPKRARRTAAVKAAIALDQNSDDDDDSGEPMTKVEDDTDDSDNDDGPPFVDVPSTSADDQPGPSGVGKDGVEAPILNTPTFLFDTLSSSKSASLQNLQALPRLLRVKGAPKYYIILPKDSVSAAVPLQSQLVTSKTAPRARKVEPSQNQLLVKTKCPSSVFKVIPKHMMPSITVGSGSPTPLKVIASKDILKQPTILSNVRPKPKVVTKSRYASSTYLNPFDYTPYIKNTVSSSRRQKIEKNLTQAMVFPWDCKICTKVFHDKELLMEHYDMHKNGTDELGDIDENNDA

SEQ ID NO: 23047 - protein, 544 aa, Diabrotica virgifera
  misc_feature: Coding regions on vcDNA: vcDNA=SeqID_2744; Strand=+; Position=3-1635
  misc_feature: Homolog annotation: Hit_ID=XP_320419.1; Match level="QueryCoverage =99%, HitCoverage=90%, E-value=0.0, Identity=79%"; Hit description =ENSANGP00000016796 [Anopheles gambiae]
  misc_feature: Pfam annotation: Pfam_ID=COBRA1; Match level="Score=1123.8, E-value =0, Copies=1"; Pfam description=Cofactor of BRCA1 (COBRA1)
  misc_feature (107)..(107): Xaa can be any naturally occurring amino acid
  misc_feature (442)..(442): Xaa can be any naturally occurring amino acid
NGILLPSLRPMLPLLDLHGVRRLDFHMSVVEELREKLINHINEIGKQEGKERDHKLKELLVKSFPVIRVKAMRPIVMAILKNIPQIEDHYLKVLVRDRELYLDTDTXRQIWKDNQSLFGDEVSPLLSQYISEKENVLFDHSNLATQFFGPSPKVRRQGEVVQKLAHMIGNSVKLYDMVLQFLRTLFLRTRIVHYCTLRAELLMALHDLEVQDIISIDPCHKFTWCLDACIREKNVDIKRSRELQGFLDNVKRGQEQVLGDLSMTLCDPYAINFLATSAIKILQHLIHMEGMARDNTILILLLRMLALGLSAWVMIDSQDFKEPKLDAQVVTKFLPALMSLMVDDQVRQLSGKLPHDEREAAITVIEHSGPLPDAVEAYLQDSTVASILAMYYTLHAARLKDRVGLLRILTVLANCKDDRAFEDPFLHSFVCLLIHNSDEFKXEDFCTALFDEFFFAGLSRDNVTRHLLKLLWYVHQKLPTSRLHSLMKALQPTHQHSEKVHLLYKLLQDKIVSQEETVIPPEMDIDINSPLMSVPTPAPYHHTL

SEQ ID NO: 23048 - protein, 389 aa, Diabrotica virgifera
  misc_feature: Coding regions on vcDNA: vcDNA=SeqID_2745; Strand=+; Position=170-1336
  misc_feature: Homolog annotation: Hit_ID=XP_313810.1; Match level="QueryCoverage =99%, HitCoverage=96%, E-value=1e-167, Identity=71%"; Hit description= ENSANGP00000011692 [Anopheles gambiae]
  misc_feature: Gene Ontology Annotation: Biological process=jump response
  misc_feature: Pfam annotation: Pfam_ID=Innexin; Match level="Score=246.2, E-value =5.8e-71, Copies=1"; Pfam description=Innexin
MSVLGMVSAVAGFVKVRYLVDKALIDNMVFRAHYRVTSAILFLCCIIVTANNLIGDPIQCINDRGVPGHVINTFCWITHTFTLPHEQGKRVGTEVAHPGLGNENQDKRYHSYYQWVPFVLFFQGVLFYIPHWLWKNWEQGKIRMITEGMRGSMVGVGEKAEREHRQNRLVQYLIETMHMHTSYAFGYFICEALNFVNVMVNIFMTDKFLGGAFLTYGTDVVSFSNMNQENRTDPMVAIFPRVTKCTFHKFGPSGSIQKHDALCVLALNILNEKIYIFLWFWFIILAILSGLAIVYSAAVVLLPSTRETILKRRFRFKVPNAVETIVRKTQVGDFLLIHLLGQNTNQLVFGEILDEFVRRLNFGSNSNLPSAPSTLELSPMYPEIVKYKE

SEQ ID NO: 23049 - protein, 246 aa, Diabrotica virgifera
  misc_feature: Coding regions on vcDNA: vcDNA=SeqID_2746; Strand=+; Position=147-887
  misc_feature: Homolog annotation: Hit_ID=EAA12691.3; Match level="QueryCoverage =70%, HitCoverage=96%, E-value=1e-70, Identity=70%"; Hit description =ENSANGP00000006936 [Anopheles gambiae str. PEST] ref|XP_555384.1| ENSANGP00000006936 [Anopheles gambiae st
  misc_feature: Gene Ontology Annotation: Molecular function=general RNA polymerase II transcription factor activity; Cellular component=transcription factor TFIID complex; Biological process=transcription initiation from Pol II promoter
  misc_feature: Pfam annotation: Pfam_ID=TBP; Match level="Score=261.1, E-value=1.9e -75, Copies=2"; Pfam description=Transcription factor TFIID (or TATA-b
MEGKQQTDIHLKAMLSNPSRFTPAVPVPDWNTPSTSTNPTTPSQVPLIKPNLCLMTVAMPGSAVGEPHTNIMLQNCLSTVDLQVNLDLETINARTRNSEFNPSRFHGVIMRLREPRTTALIFRSGKIVCTGARNEYDGLLASKKFARIIQKLGYNIKFCNFKIQNLVATCDLRFPIKLENLNMMHGQFSSYEPELFPGLVYRMIKPRLVILIFVNGKVVFTGAKSREDIKEALNNIYPILRSFRKN

SEQ ID NO: 23050 - protein, 131 aa, Diabrotica virgifera
  misc_feature: Coding regions on vcDNA: vcDNA=SeqID_2747; Strand=+; Position=36-428
  misc_feature: Homolog annotation: Hit_ID=XP_317051.1; Match level="QueryCoverage =82%, HitCoverage=18%, E-value=5e-23, Identity=44%"; Hit description =ENSANGP00000019510 [Anopheles gambiae]
MYFFVHRKQQAMAVAKFPHCANDNFSNNVSLAFLNAHESVTQAVPLVPNMINIGGFHIDPPKELPEDLKEMLDGAKEGVIYLSLGSNIKSTDIKPEIKQALIRSLGKLKQKVLWKYEDEDFKTPKNVEIRK

SEQ ID NO: 23051 - protein, 42 aa, Diabrotica virgifera
  misc_feature: Coding regions on vcDNA: vcDNA=SeqID_2748; Strand=-; Position=231-359
AREAKDITTVLLLVQVMRSFPLRKMFRCLCGFMLKNMPFNQI

SEQ ID NO: 23052 - protein, 298 aa, Diabrotica virgifera
  misc_feature: Coding regions on vcDNA: vcDNA=SeqID_2749; Strand=+; Position=140-1035
  misc_feature: Homolog annotation: Hit_ID=NP_608902.1; Match level="QueryCoverage =99%, HitCoverage=82%, E-value=1e-97, Identity=57%"; Hit description =CG14040-PA [Drosophila melanogaster] gb|AAF52211.2| CG14040-PA [Drosophila melanogaster]
  misc_feature: Gene Ontology Annotation: Molecular function=CMP-sialic acid transporter activity; Cellular component=integral to plasma membrane; Biological process=CMP-sialic acid transport
  misc_feature: Pfam annotation: Pfam_ID=Nuc_sug_transp; Match level="Score=-35.9, E -value=2.3e-09, Copies=1"; Pfam description=Nucleotide-sugar transporter
  misc_feature (250)..(250): Xaa can be any naturally occurring amino acid
  misc_feature (268)..(268): Xaa can be any naturally occurring amino acid
  misc_feature (273)..(273): Xaa can be any naturally occurring amino acid
MSSLNWKELFPTKLSLIIFIGYILLFVNQGILVTASQRSDNNYNYNIVTVVLLTEVLKLVISSVLYCKDNSTGQLISEVVKHKHVLLLYFVPAFLYCLYNNLAFLNLSSFDPTTYFLLLQLRVVVTGVLFQAIFKKILSKRQWISLVILTFGCMLKQINLTQTTSNTSSSNNTKAASVSLGIDAIFIFIQIICSCLAGVYNEYLLKDKGASINIFVQNVFMYLDSIVCNVLLLILNGNILEAFVYENILXVYIISLISDVQYAAIGLXSSFLXSDSILKTFASALELVFTALLSYLFF

SEQ ID NO: 23053 - protein, 183 aa, Diabrotica virgifera
  misc_feature: Coding regions on vcDNA: vcDNA=SeqID_2750; Strand=-; Position=460-1009
  misc_feature: Homolog annotation: Hit_ID=AAT79489.1; Match level="QueryCoverage =86%, HitCoverage=47%, E-value=2e-38, Identity=50%"; Hit description =mariner transposase C9 mutant [Mutagenesis vector pCAM45]
  misc_feature: Gene Ontology Annotation: Molecular function=transposase activity; Cellular component=cellular_component unknown; Biological process =DNA transposition
  misc_feature: Pfam annotation: Pfam_ID=Transposase_1; Match level="Score=28.0, E -value=6.8e-07, Copies=1"; Pfam description=Transposase
  misc_feature (16)..(16): Xaa can be any naturally occurring amino acid
  misc_feature (26)..(26): Xaa can be any naturally occurring amino acid
  misc_feature (61)..(61): Xaa can be any naturally occurring amino acid
  misc_feature (68)..(68): Xaa can be any naturally occurring amino acid
  misc_feature (94)..(94): Xaa can be any naturally occurring amino acid
  misc_feature (102)..(102): Xaa can be any naturally occurring amino acid
  misc_feature (127)..(127): Xaa can be any naturally occurring amino acid
  misc_feature (139)..(139): Xaa can be any naturally occurring amino acid
GRLTYDDESRHCLEIXNLNRSEFLHXVTTDKAWIHNFTPESNWQSSECLALQESCPKRPKXNKPSNKXLASVFWTPQGIIFIEYLKHGETLNRXGSINLLEXLKAEIAKNGCHLLNKEFLFYQDNAXTCHKSMKTMAKXDELGFELLLHTTYTPDLVPGDYHHQRRHYWLGCDFLKKLIIFIQ

SEQ ID NO: 23054 - protein, 312 aa, Diabrotica virgifera
  misc_feature: Coding regions on vcDNA: vcDNA=SeqID_2751; Strand=+; Position=322-1260
  misc_feature: Homolog annotation: Hit_ID=AAQ75548.1; Match level="QueryCoverage =97%, HitCoverage=81%, E-value=2e-33, Identity=38%"; Hit description =HMW glutenin subunit [Triticum aestivum]
  misc_feature: Gene Ontology Annotation: Molecular function=molecular_function unknown; Cellular component=nucleus; Biological process=regulation of protein activity, epigenetic
MFENQPQGQYYQQPSSSSGVYQQNGQYQPAGQYQQTGQYQQTGQYQQPGQYHQSGQIKQVQQPGPLQQGQYYQSSKSQSSGQHQQPGQYQPTGQYQQTGQYQQPGQQGSVQQLTNPNQIDYTGAYSESQNSYANPTPNKPSGQYTPVASSSNQYSQQGGYQQPGQHQQGAYQQSGTNQQPGSYQQGAYQQSGANQQPGSYQQGGQYHQSGQYQPSDNSKSNQVDNSGDYDKSWDNEGQYDKKYDEEEGSTGPPKGFFYKFDYPVGKIVQKGEIARVGDLKNAYSQNKAAYESQVSSGHSGSAASQSSYSYGS

SEQ ID NO: 23055 - protein, 93 aa, Diabrotica virgifera
  misc_feature: Coding regions on vcDNA: vcDNA=SeqID_2752; Strand=+; Position=295-575
  misc_feature: Homolog annotation: Hit_ID=NP_611251.2; Match level="QueryCoverage =98%, HitCoverage=24%, E-value=1e-25, Identity=66%"; Hit description =CG10933-PA [Drosophila melanogaster] gb|AAF57808.2| CG10933-PA [Drosophila melanogaster]
  misc_feature (85)..(85): Xaa can be any naturally occurring amino acid
MAFLCPVRIRRGKKKKASNIDLEKELTRSNNGATPGMGRITGSASIETLVRVGIEKEHEISPDSKMVVLHDYTPCDDYDLELKKXMISNILYL

SEQ ID NO: 23056 - protein, 146 aa, Diabrotica virgifera
  misc_feature: Coding regions on vcDNA: vcDNA=SeqID_2753; Strand=+; Position=249-689
EGSDSIIQILRKIVHSSDVVSLVSKTLDTRLQQVADHFKLKKIFITNLAAACFRSIIEYDVLTYNKAVFLYNLDDYNCLVTVTIGQKYPIEKPTVVLSSVYCPESKACSTTLTKYPYNPTLKPEVNVEHLIEFLHDAVLMFKNHRH

SEQ ID NO: 23057 - protein, 459 aa, Diabrotica virgifera
  misc_feature: Coding regions on vcDNA: vcDNA=SeqID_2754; Strand=+; Position=319-1695
  misc_feature: Homolog annotation: Hit_ID=NP_694093.1; Match level="QueryCoverage =90%, HitCoverage=97%, E-value=5e-26, Identity=24%"; Hit description =serine proteinase inhibitor [Oceanobacillus iheyensis HTE831] dbj|BAC15127.1| serine
  misc_feature: Gene Ontology Annotation: Molecular function=serine protease inhibitor activity; Cellular component=cellular_component unknown; Biological process=regulation of proteolysis and peptidolysis
  misc_feature: Pfam annotation: Pfam_ID=Serpin; Match level="Score=65.9, E-value =1.1e-16, Copies=1"; Pfam description=Serpin (serine protease inhibitor)
  misc_feature (428)..(428): Xaa can be any naturally occurring amino acid
MKILAALVLLCTLNYHSSLASDDGFKGIISPTNQKMYGQALEAIFTMGFRLQDILNMSTEQNLVVSPLSTAAIIGQLMIGADGEFREELHELLGLPPSLASFNVTHFSKERNESQILPYATFHLQLAILIKNLRQRKPGEEFVLNVANAMFYNSDIDLRTVFTSSLNKMYDTDITPLDFSKDTTRIINQWAADRTNGLIKSFLTSPPPRNTASMFLNSIYFYADWETPFSDSLNHMDTFTVSPTHNVSVLYMVGKMEDVPYIETKNYKLVCLPYKNRELGMYVFLPSIHHEHKYDIKKFFASLDPKEVVHSLLNMKNKSVDVKMPKLHLTNTISLLKPLQKYATYKKIQDNKTHVRQGNILDNLVNQLRQYQNFTDPKYTDIYLDNAARGVNLQVSDIYQQTIFSVNEKGTEAASVTAGTTFYEGGSXSLFLGRPFSFFIRHEETQAAIYWGTISNPDK

SEQ ID NO: 23058 - protein, 552 aa, Diabrotica virgifera
  misc_feature: Coding regions on vcDNA: vcDNA=SeqID_2755; Strand=+; Position=52-1707
  misc_feature: Homolog annotation: Hit_ID=EAL33869.1; Match level="QueryCoverage =91%, HitCoverage=84%, E-value=1e-123, Identity=46%"; Hit description= GA14221-PA [Drosophila pseudoobscura]
  misc_feature: Gene Ontology Annotation: Molecular function=double-stranded DNA binding; Cellular component=nucleoplasm; Biological process =regulation of mitotic recombination
  misc_feature: Pfam annotation: Pfam_ID=Mre11_DNA_bind; Match level="Score=155.6, E -value=1.1e-43, Copies=1"; Pfam description=Mre11 DNA-binding presumed domain
MGSYVMSTQDQDSSQNNISDDDVFKILVATDIHLGYAEENPVRGHDTFDTFEEILQHAVKNEVDFILLGGDLFHHAQPSPYCIQKCLELMKKYCLGDRPVSIEFLSNPSQNFTQHANETVNYEDPNLNVSLPVFSIHGNHDDPTGKKHISALDIISTSGLVNYFGRWENLDKVDITPILLQKGKSKLALYGLSHIRDERLGRLFIDQKVEMLSPKDKDDWFHLLVWHQNRATRGSKNFIPDDCLPDFLNLVIWGHEHDCRIEPERKLNDVFISQPGSSVATSLIEGESVTKKVGILKIHETNFKMEPVELQTVRPFKYAEMNLSNEELLVIDKKSLSEQAMQVVGAKVDEMIQEAKNLKHTKKVSEKPLIRLIVKYKDEDVVFNSIRFGQMYADRVANSDNMIKFQLIKECSTRRRLNQNQGADEILEGPVLVDRVEDMVSDYFTEHKVLGLFPLNILNEGVKRFIDSNDTNAIADLKDNVIKEMMTKLELDLPEVEDTLAAIAAIRDSMEADSLAFVNRVLGDPKRKKKKKASEDNDDEDDGSIEEEAEIT

SEQ ID NO: 23059 - protein, 196 aa, Diabrotica virgifera
  misc_feature: Coding regions on vcDNA: vcDNA=SeqID_2756; Strand=+; Position=161-751
  misc_feature: Homolog annotation: Hit_ID=EAL33116.1; Match level="QueryCoverage =100%, HitCoverage=66%, E-value=2e-63, Identity=59%"; Hit description= GA19597-PA [Drosophila pseudoobscura]
  misc_feature: Gene Ontology Annotation: Biological process=body morphogenesis (sensu Nematoda)
  misc_feature: Pfam annotation: Pfam_ID=DUF602; Match level="Score=280.7, E-value =2.4e-81, Copies=1"; Pfam description=Protein of unknown function, DUF602
MGCDGGTIPRRDELVKVKKKPEAKDKNAELAFKWRCCFITQEVLQQPIVVCHLGKLYNKMSLIEALLDRSSLPESIKYIKSLKDVKDLKLTPNPEFLKDEGKKEGSLDNRAAPYICPVLGLEMSGKFRFVAVWSCGCVFSERALKEIGTKNCHKCTKPFEDDDIVIINGNEEDLELMRQRMEKKDVRIRRKIKKRK

SEQ ID NO: 23060 - protein, 84 aa, Diabrotica virgifera
  misc_feature: Coding regions on vcDNA: vcDNA=SeqID_2757; Strand=-; Position=444-698
IPVTKSYSFFICLSVDKILYETVREVLFANLREVYHSLRCRSCSKHRVRSQKAYFPNCFINNYFSFMHAHQYCRGRKSRGLEKK

SEQ ID NO: 23061 - protein, 72 aa, Diabrotica virgifera
  misc_feature: Coding regions on vcDNA: vcDNA=SeqID_2758; Strand=-; Position=753-971
  misc_feature (51)..(51): Xaa can be any naturally occurring amino acid
DILRWSAHTPCKKSTVYQLRPIDVEKPVMTICQYALSAIGILIALPNHWDXTKKTRFFCTKCKMYICISPEP

SEQ ID NO: 23062 - protein, 70 aa, Diabrotica virgifera
  misc_feature: Coding regions on vcDNA: vcDNA=SeqID_2759; Strand=-; Position=853-1065
SHLLSYFLCFTNTVVTYIVVNFIFGVLKTPSFNIVQKFLGFFANLRNSFSWLGILAVESISLLIHGIKLG

SEQ ID NO: 23063 - protein, 405 aa, Diabrotica virgifera
  misc_feature: Coding regions on vcDNA: vcDNA=SeqID_2760; Strand=+; Position=128-1345
  misc_feature: Homolog annotation: Hit_ID=EAA04709.2; Match level="QueryCoverage =95%, HitCoverage=92%, E-value=1e-148, Identity=68%"; Hit description= ENSANGP00000020311 [Anopheles gambiae str. PEST] ref|XP_565447.1| ENSANGP00000020311 [Anopheles gambiae s
  misc_feature: Gene Ontology Annotation: Molecular function=pre-mRNA splicing factor activity; Cellular component=nucleus; Biological process=mRNA splicing
  misc_feature: Pfam annotation: Pfam_ID=RRM_1; Match level="Score=84.8, E-value=2.3e- 22, Copies=1"; Pfam description=RNA recognition motif. (a.k.a. RRM, R
MTQFLPPNLLALFAPRDPIPYLPPVTKLPHEKKNRGYLGVGQFLDDFEDPKDTPPPTRVETREERLERRRRERAEQVAYKLEQEIAMWNPTAAPNNTTDPFKTLFIARINYDTSESKLRREFEVYGPIKKIVLIHNSINGKPRGYAFIEYEHERDMHSAYKHADGKKIDGRRVLVDVERARTVKGWLPRRLGGGLGGTRRGGPDVNIKHSGREDNERERERYRLEREREERGLVRERDRDRDRVRDREFERRRSRSRERRRRSRSRSPRREKRRRSKDKNRDEITIEDDGYDRRDRERDRDRDKDRKRRRSRSRDKDREARKRERRERREKDKIERVEFIKTDDGGEMIRVKEEPVDDYDYANYQPPAYDSAKVKYEDEDEHKYEPLDTNGARRYEDEYEEGEYN

SEQ ID NO: 23064 - protein, 51 aa, Diabrotica virgifera
  misc_feature: Coding regions on vcDNA: vcDNA=SeqID_2761; Strand=-; Position=68-223
GPLMLRLCRLQVFFEIMLVSVCPKYLNCGYLINRNCLVVICKFFIFSPPPD

SEQ ID NO: 23065 - protein, 183 aa, Diabrotica virgifera
  misc_feature: Coding regions on vcDNA: vcDNA=SeqID_2762; Strand=+; Position=95-646
  misc_feature: Homolog annotation: Hit_ID=XP_395127.1; Match level="QueryCoverage =90%, HitCoverage=53%, E-value=2e-73, Identity=79%"; Hit description =similar to CG5885-PA [Apis mellifera]
  misc_feature: Pfam annotation: Pfam_ID=TRAP-gamma; Match level="Score=378.3, E -value=9.9e-111, Copies=1"; Pfam description=Translocon-associated protein, gamma
MSKAQNKGFTKEEELLLQDFSRNVSTKSSALFYGNALIVSAVPIWLFWRIHMIDIYSSLILFAVITAISTYLLAMAYRNTKFTLKHKIAVKREEAVTRDLSKKLAEDKKMSKKEKDERILWKKNEVADFEATTFSIFYNNALFLAIVILASFYLLPAFTPAVNYTLSIGSTSALLALLSTGSH

SEQ ID NO: 23066 - protein, 206 aa, Diabrotica virgifera
  misc_feature: Coding regions on vcDNA: vcDNA=SeqID_2763; Strand=+; Position=46-663
  misc_feature: Homolog annotation: Hit_ID=NP_996107.1; Match level="QueryCoverage =88%, HitCoverage=52%, E-value=3e-23, Identity=37%"; Hit description =CG33257-PA [Drosophila melanogaster] gb|AAS64984.1| CG33257-PA [Drosophila melanogaster]
  misc_feature: Pfam annotation: Pfam_ID=DUF745; Match level="Score=-68.3, E-value =0.00017, Copies=1"; Pfam description=Protein of unknown function (DUF745)
MFGIFVFAIFSVAVASAGVPKHQHVKVVVPEQQAQSSHTLEIAEGYESGGYAPGELEAHAAAEAGAGGSGKGSSGAELTSLAHNSAVQAKNAVRNQHTAGSQAAFGVKSSLASAAVGAAQTAQAALVGKQAIVQNLKKQAIEAQQQLLAEISQYHQLEAVSQVAAHASQDGHAQLNTLTAALASAQDGASHSEQVAAEAANAAAAQ

SEQ ID NO: 23067 - protein, 61 aa, Diabrotica virgifera
  misc_feature: Coding regions on vcDNA: vcDNA=SeqID_2764; Strand=+; Position=26-211
KKSNKRKVIKKRNKKKSNRKKVIKKSKYYQGIYLPNFKIFGSNLECFNNKKPIFCTIFYII

SEQ ID NO: 23068 - protein, 291 aa, Diabrotica virgifera
  misc_feature: Coding regions on vcDNA: vcDNA=SeqID_2765; Strand=+; Position=18-893
  misc_feature: Homolog annotation: Hit_ID=AAK93225.1; Match level="QueryCoverage =96%, HitCoverage=49%, E-value=3e-25, Identity=28%"; Hit description =LD31582p [Drosophila melanogaster]
MGTNLLTLEQIHIYLLENGGKVKNRDIVRYFKSYLTDPVTKDENRSRFKSYINKLAVTKAEGDEKVILLNLKYSSYDTLPSPASHNSVFYSPQHDPRNSVGLPLSPAGLGVVDSSVSSPSTPSRQPPPYRAPPPPPSSASMNSLDTMSLGSTTSLNDLQKTPQPPPREKRKDSENRNFQEDGTPQKTDVDDPNVEDKTISVKERTQKFNRLASVDDELSPRPPKSAEKKSRGADEDDGVSLTPIDPKKCVEWYVTASRGDYQELLKLANTEPRLVNKKDPFTAVSIIDLNI

SEQ ID NO: 23069 - protein, 303 aa, Diabrotica virgifera
  misc_feature: Coding regions on vcDNA: vcDNA=SeqID_2766; Strand=+; Position=109-1017
  misc_feature: Homolog annotation: Hit_ID=XP_392713.1; Match level="QueryCoverage =97%, HitCoverage=88%, E-value=6e-90, Identity=53%"; Hit description =similar to ENSANGP00000014774 [Apis mellifera]
  misc_feature: Pfam annotation: Pfam_ID=UPF0005; Match level="Score=-51.3, E-value =0.0029, Copies=1"; Pfam description=Uncharacterised protein family UPF000
  misc_feature (254)..(254): Xaa can be any naturally occurring amino acid
  misc_feature (264)..(264): Xaa can be any naturally occurring amino acid
  misc_feature (276)..(276): Xaa can be any naturally occurring amino acid
MALMLASRVCRASTLAKTTVFVKQPNTITVYRAFSEGKDAAARTARQQVGIKEKLMQPAGDTAFRMGRGALAGASALGIGALAFYGLGLSSEASALEKQHLWPQYVKDRIKTTYMYFGSSIAITAASALAAVRSPAIMRLVMANGFMGFAISLAAIMGTGILCQSIPYSEGFGSKQLAWMLHAGTMGAMIAPLCFLGGPLLIRAAWYTAGVVGGLSTIAVCAPSEKFLYMGGPLAMGLGVGGFGSSIGSVFLPXTTALGAGLYXISLYGGLILFSXFLFYGLQRIIAQVEKFLAIPQALEIGL

SEQ ID NO: 23070 - protein, 91 aa, Diabrotica virgifera
  misc_feature: Coding regions on vcDNA: vcDNA=SeqID_2767; Strand=+; Position=1-276
APCNIQRVLGCLFLVHFFYNFSMGYSTNIRLSWIIATTNILVCNIRSAKVNGSTNCSNKQQCILQFTFILYNLHSKIFVVEIIHNSRMFVE

SEQ ID NO: 23071 - protein, 165 aa, Diabrotica virgifera
  misc_feature: Coding regions on vcDNA: vcDNA=SeqID_2768; Strand=+; Position=3-500
  misc_feature: Homolog annotation: Hit_ID=XP_392229.1; Match level="QueryCoverage =85%, HitCoverage=18%, E-value=4e-40, Identity=55%"; Hit description =similar to CG4276-PA [Apis mellifera]
  misc_feature: Pfam annotation: Pfam_ID=SH3_1; Match level="Score=26.9, E-value=3.6e- 05, Copies=1"; Pfam description=SH3 domain
GRVGHHQPDKDIAALGESTRSDISIDSIERNGGEERGFGRNQESFLEDLQNRGATIVQVTYPRTANNEKELTVVRGEYLEILDDSRKWWKARNSRGQIAHVPHTIVTPYIFNNPLHATQNYRRNDSPVERFNRDHSNQDHSPQSKSTTDWIRNERTGKKGEFRYF

SEQ ID NO: 23072 - protein, 177 aa, Diabrotica virgifera
  misc_feature: Coding regions on vcDNA: vcDNA=SeqID_2769; Strand=-; Position=1-531
  misc_feature: Homolog annotation: Hit_ID=EAL26687.1; Match level="QueryCoverage =96%, HitCoverage=36%, E-value=3e-26, Identity=31%"; Hit description =GA21065-PA [Drosophila pseudoobscura]
PIFFTGSKKVRKGDPKAESDFNLNDILSLAGSFLGQSGQDGKKGGSNFLSLLPTILQTMNAFVGPEARSREKSHAGHSSLMPPFLDKLHLMFDHFIHSEMGKNTIAALGAEKSFKVFLDDKGRFSYNKFAELMENHSYRRQWIRILTDRIAEFLQYASDPKVYKSYFVTAQVFSNST

SEQ ID NO: 23073 - protein, 126 aa, Diabrotica virgifera
  misc_feature: Coding regions on vcDNA: vcDNA=SeqID_2770; Strand=-; Position=1188 -1568
VSLIVSFLILYFQYIYYCRVFYVYIVFALQSVNGHIPHINLRFYICPNTVADTKNQSSAALDTSASGTPQTSSLPKPSYPPTSEMVNNVHLNVSRKEVVLLFAIKKYIAKNYKVNAEKLHRLSKNI

SEQ ID NO: 23074 - protein, 795 aa, Diabrotica virgifera
  misc_feature: Coding regions on vcDNA: vcDNA=SeqID_2771; Strand=+; Position=120-2507
  misc_feature: Homolog annotation: Hit_ID=EAA03989.2; Match level="QueryCoverage =42%, HitCoverage=87%, E-value=1e-139, Identity=70%"; Hit description= ENSANGP00000021528 [Anopheles gambiae str. PEST] ref|XP_564496.1| ENSANGP00000021528 [Anopheles gambiae s
  misc_feature: Gene Ontology Annotation: Molecular function=glycogenin glucosyltransferase activity; Cellular component=soluble fraction; Biological process=glycogen biosynthesis
  misc_feature: Pfam annotation: Pfam_ID=Glyco_transf_8; Match level="Score=233.7, E -value=3.4e-67, Copies=1"; Pfam description=Glycosyl transferase family 8
MGGGYAWVTLATNDSYSLGSLVLAHSLKQVGTKQQLAVLITPGVTNSMRSKLNEVFNVVKEVNILDSKDEANLRLLKRPELGITFTKLHCWRLTQFEKCVFLDADTLILENCDELFEREELSAAPDIGWPDCFNSGVFVYRPSNETYEKLIQFALDKGSFDGGDQGLLNLYFSDWAHKDISKHLPFIYNLASTACYSYLPAFKQFGKNAKIIHFIGASKPWLQYFNTETRKVHPSEGLQHLAIILQHWWDIFCNLIHPALTPDMRKIAGLAGAFANLTLGQPRTPEQQALDDHLRRQGWEVGNIDYLGRDSFDNIWSKICETLALAPDAAPTVEQPQEAAPVVLSAAVEVSDSPQSKIESPTAVIPPPQTPQSVPSESKAPEPTEAAPKIPPVQSVPDQPESQQPVVEILSAGVAPPATGATPQPAGAAPPAAGAAPPAAVAVPPAAVAAPPAAVAIQQESPKSETPIQQPTLPGQESQQVPVETSQVVQPSEVKEPSTGAPSPATQTVEPVSTELPKVEPTVVPESPKQVPETQADLPKAVDSSKESTGTVTAQSVSEKPLTEPQTVVSQSPEKPEEQKPTTEDLKSPEVVSDSPQAATQEPVKEAPKDSTQEVQQETPKSPEEAKKVTPAESPKESQKEVLTQAPTEAPKEVPQVQPKAVVEAPKEPPKEAPKEAPKESPKEAPKESPKEAPKESPKDAPKETPAQKEAPKETPAQKEVRVSKESPKAAQKDAPKQSPKETQKDSPKESPKEPEKPAPKASTPKQSPASKKGKKDTPKEESKQKETAELPSSK

SEQ ID NO: 23075 - protein, 258 aa, Diabrotica virgifera
  misc_feature: Coding regions on vcDNA: vcDNA=SeqID_2772; Strand=+; Position=256-1032
  misc_feature: Homolog annotation: Hit_ID=XP_319419.1; Match level="QueryCoverage =93%, HitCoverage=59%, E-value=1e-80, Identity=60%"; Hit description =ENSANGP00000014422 [Anopheles gambiae]
  misc_feature: Gene Ontology Annotation: Cellular component=mitochondrion; Biological process=embryogenesis and morphogenesis
  misc_feature: Pfam annotation: Pfam_ID=adh_short; Match level="Score=93.8, E-value =4.3e-25, Copies=1"; Pfam description=short chain dehydrogenase
TSTSKMATEKHSPSGNQIVITVIEVIGFLLYSLALIVTAIYKACLPSAYQHRKNINGKISLITGGGGGLGRLLALRLARLGSTVVLWDVNEKAVEETVGLVKGVGGKAYGYKCDLADKEDVYRVAKKTQEEVGDVSVLINNAGVVSGHTLLNTPDHLIKRTFDVNVVAHFWTVKAFLPKMIEKDNGHIITIASLAGHIGVPKLVDYCSSKYAAIGFDESLKIELENQGIKGVKTTVVCPYFIHQTGMFEDVILYSFED

SEQ ID NO: 23076 - protein, 111 aa, Diabrotica virgifera
  misc_feature: Coding regions on vcDNA: vcDNA=SeqID_2773; Strand=-; Position=2-334
  misc_feature: Homolog annotation: Hit_ID=CAA10770.1; Match level="QueryCoverage =98%, HitCoverage=32%, E-value=3e-17, Identity=33%"; Hit description =reverse transcriptase-like [Bos taurus]
IIKAKAAFVRMRPIFNSLDISLKTKYRLLKCYMFTVLLYGMEAWTLTVASMNRSEAFEMWCYRRILRISWVDRITNVEVLRKMGKECEILVTIVTKKLEYLGRVMRNQECY

SEQ ID NO: 23077 - protein, 466 aa, Diabrotica virgifera
  misc_feature: Coding regions on vcDNA: vcDNA=SeqID_2774; Strand=+; Position=172-1572
  misc_feature: Homolog annotation: Hit_ID=XP_310812.1; Match level="QueryCoverage =93%, HitCoverage=99%, E-value=1e-115, Identity=49%"; Hit description= ENSANGP00000015572 [Anopheles gambiae]
  misc_feature: Gene Ontology Annotation: Molecular function=molecular_function unknown; Cellular component=cellular_component unknown; Biological process=biological_process unknown
  misc_feature: Pfam annotation: Pfam_ID=DUF895; Match level="Score=193.9, E-value =3.3e-55, Copies=1"; Pfam description=Eukaryotic protein of unknown functio
LLIVLVCVDRNYLFIMDRSLRNVMLLGLAFMLVFTAFQTMSNIQQTITDSIVKDDPTYDGDAYYSQAIIYGFFSLFNWSAPSVVSIIGPKFSMFLGGTVYVAFILQFLAPKAWGMYLCSALLGIGAAMIWTGQGNYLTLNSTKKYITRNSGIFWALLQLSMFVGNTFVFFAFKGKTEVDKSTRTFVIITLAAVGAVGLIVLFVLPKAFKEEEDEEEEVEEAKPQGPVEAFLGSVRLFFTMRMFLLNFAFLYTGLELGFFSAIYSSCLGFTKNFENRKELVGISGIFMGLGEVLGGGIFGIFGHKTVKWGRDPVVSTGFLLHILAFVLIFLNLPNNSPFADTDDSAIITSNAILAIFCSFLLGLGDSIYNTQIFSLLGTVYADNSAPAFAIFKFSQSLGAVITFVSAKSLGLHYQLAILLVMSVLGTLCFIKVEWYAKKKAALLSSRKEREERRSVDRSRMRQIEDF

SEQ ID NO: 23078 - protein, 266 aa, Diabrotica virgifera
  misc_feature: Coding regions on vcDNA: vcDNA=SeqID_2775; Strand=+; Position=62-863
  misc_feature: Homolog annotation: Hit_ID=EAA14856.3; Match level="QueryCoverage =92%, HitCoverage=47%, E-value=1e-51, Identity=43%"; Hit description =ENSANGP00000013878 [Anopheles gambiae str. PEST] ref|XP_552795.1| ENSANGP00000013878 [Anopheles gambiae st
  misc_feature: Gene Ontology Annotation: Molecular function=gamma-glutamyl transferase activity; Cellular component=integral to plasma membrane; Biological process=spermatogenesis
  misc_feature: Pfam annotation: Pfam_ID=G_glu_transpept; Match level="Score=-132.6, E-value=7.1e-08, Copies=1"; Pfam description=Gamma -glutamyltranspeptidase
  misc_feature (239)..(239): Xaa can be any naturally occurring amino acid
KICTVQSKPIKIATFFKMKTSTKRLTIGAAIVTVIVIVIVVVVLVINKRNEGKRVGAVGSSGHGCAEIGVSILKKGGNAIDSTIATLFCEGVMLSESMGLGGGFFLVLYNKTTGETWALDARETAPAASREDMYLGQPSNASLRGGKSVAVPGELRGYWELYKRFGGGLPWKDLIQPTIDICKNGQYVTKHLHSRFIMRKQLLWNDPIMRDTFFDKKTNDTYKIGQYFKRPRMAKTLEXIAKEGGDALHNGSLTAAFVKDIADKGG

SEQ ID NO: 23079 - protein, 197 aa, Diabrotica virgifera
  misc_feature: Coding regions on vcDNA: vcDNA=SeqID_2776; Strand=+; Position=373-965
  misc_feature: Homolog annotation: Hit_ID=EAL29855.1; Match level="QueryCoverage =60%, HitCoverage=32%, E-value=2e-35, Identity=52%"; Hit description =GA20164-PA [Drosophila pseudoobscura]
  misc_feature: Gene Ontology Annotation: Molecular function=molecular_function unknown; Cellular component=cellular_component unknown; Biological process=biological_process unknown
  misc_feature: Pfam annotation: Pfam_ID=zf-C3HC4; Match level="Score=12.7, E-value =0.0016, Copies=1"; Pfam description=Zinc finger, C3HC4 type (RING finger)
  misc_feature (156)..(156): Xaa can be any naturally occurring amino acid
MNIGINGNRTICKFNLKGMCRFGTRCWNVHEIPEKSPHKIIEKYEPNEEDGACALPLIKETELSPKNYGPGTSTTETAINLVKKVSESEEKVCGICFDIVLKKSRSQQTFGILPNCNHCFCFTCIRKWRQSKEFEFEVSKACPECRITSDFVYPSXMWIETKEEKLNFIDGQRHKMKKQDCKNFRQGQEKVPFGILG

SEQ ID NO: 23080 - protein, 300 aa, Diabrotica virgifera
  misc_feature: Coding regions on vcDNA: vcDNA=SeqID_2777; Strand=+; Position=92-994
  misc_feature: Homolog annotation: Hit_ID=XP_319444.1; Match level="QueryCoverage =93%, HitCoverage=100%, E-value=1e-105, Identity=68%"; Hit description=ENSANGP00000014428 [Anopheles gambiae]
  misc_feature: Gene Ontology Annotation: Molecular function=RNA binding; Cellular component=nucleus; Biological process=proteolysis and peptidolysis
  misc_feature: Pfam annotation: Pfam_ID=Proteasome; Match level="Score=221.9, E -value=1.2e-63, Copies=1"; Pfam description=Proteasome A-type and B -type
MFRNQYDSDVTVWSPQGRLHQVEYAMEAVNLGSATVGLKSKTHAVLIALKRASSELSAYQKKIINIDDHIGITISGLTADARILSRYMRNECLNYKYSLDTYMPLNRLISILGNKMQTCTQRYDRRPFGVGLLVAGYDESGSHIYQTCPSANFYDCKAMSIGARSQSARTYLEKHLDELPSSSLEELIKHGLRALRDTLPPEVDLTTKNVSIGYTGKGQTFKILEEEETSPYLSLIEGEERRGGGAAAAAIEDLPADPLRDDAGDEPRDAVPAVETFCMDTQNRRIRYSIKAPGDQESGY

SEQ ID NO: 23081 - protein, 233 aa, Diabrotica virgifera
  misc_feature: Coding regions on vcDNA: vcDNA=SeqID_2778; Strand=+; Position=85-786
  misc_feature: Homolog annotation: Hit_ID=XP_311229.1; Match level="QueryCoverage =94%, HitCoverage=55%, E-value=1e-16, Identity=28%"; Hit description =ENSANGP00000011906 [Anopheles gambiae]
  misc_feature: Pfam annotation: Pfam_ID=MOSC_N; Match level="Score=52.8, E-value =9.8e-13, Copies=1"; Pfam description=MOSC N-terminal beta barrel domain
MINNQVVATSTTLVAGAAVLAYLGFHFFQKRKAVKIPTKWEEIGSVSGLYLYPLKSGHRKELSQAECTRLGLKQTEEDEKVLQLRDRGLVVYTEKDKEFRTARTYPQLLQIDISVHDENHFALDAPTMRTLYVKIPSKETNKSVTITLHVKEPCRAIDCGDEAATWLSRLILQKPTGLRLGFHDGIYKRDIEKAHKEDISFYTSVSNFSAGLYPDLTSMSLINQRSIDDLVKR

SEQ ID NO: 23082 - protein, 63 aa, Diabrotica virgifera
  misc_feature: Coding regions on vcDNA: vcDNA=SeqID_2779; Strand=-; Position=234-425
VFPLLFFCMEQSPFRFLGSFQTEKVSSDSSLKLIASDIQAIKNRKIAKSAISNPQKPREKLKI

SEQ ID NO: 23083 - protein, 408 aa, Diabrotica virgifera
  misc_feature: Coding regions on vcDNA: vcDNA=SeqID_2780; Strand=+; Position=153-1380
  misc_feature: Homolog annotation: Hit_ID=NP_728384.1; Match level="QueryCoverage =92%, HitCoverage=71%, E-value=1e-133, Identity=61%"; Hit description= CG1753-PB, isoform B [Drosophila melanogaster] ref|NP_608424.1| CG1753-PA, isoform A [Drosophila
  misc_feature: Gene Ontology Annotation: Molecular function=cystathione beta -synthase activity; Cellular component=cytoplasm; Biological process =cysteine metabolism
  misc_feature: Pfam annotation: Pfam_ID=PALP; Match level="Score=384.9, E-value=1e -112, Copies=1"; Pfam description=Pyridoxal-phosphate dependent enzyme
  misc_feature (395)..(395): Xaa can be any naturally occurring amino acid
MSNVNIEDTIKKSKSNLSFWSPLNDSFNPPNKKSRCSWHKNASRESTPHTTQDWKRTTKILPNALEAIGNTPLIKLNRIPQAEGLKCDVYVKCEFFNPGGSVKDRIGKRLIEDAEKQGLLKPGYTIIEPSSGNTGIGLALAAAIKGYRCIIVMSEKMSNEKVSVLSALGAEIVRTPVNADSNSAEGMFGVTHRLRKEIPNSIILDQYSNPGNPLAHYDTTAEEIYFQCDKNVDMIVIGAGTGGTIAGIGRKFKEISPQTTIVGADPVGSILAQPESLNNTDAGFYEVEGIGYDFIPTVLDRDVVDVWVKTTDQESLPLARRLIKEEGLLVGSSCGAAIAATIKAAKNLEAGKKVVVIMPDSIRNYITKFASDQWMEARDLMTPVNTMNHWWWDKXILELDLPTLHVAT

SEQ ID NO: 23084 - protein, 208 aa, Diabrotica virgifera
  misc_feature: Coding regions on vcDNA: vcDNA=SeqID_2781; Strand=+; Position=1-627
  misc_feature: Homolog annotation: Hit_ID=XP_395236.1; Match level="QueryCoverage =81%, HitCoverage=15%, E-value=7e-78, Identity=88%"; Hit description =similar to ENSANGP00000022750 [Apis mellifera]
  misc_feature: Gene Ontology Annotation: Molecular function=motor activity; Cellular component=kinesin complex; Biological process=regulation of pole plasm oskar mRNA localization
PGRPTSPPTRLRTRGREQARKDLKGLEDTVAKELQTLHNLRKLFVQDLQARMKKNLSSEDNEEDGGSLAQKQKISFLENNLDQLTKVHKQLVRDNADLRCELPKLEKRLRATMERVKALETALKEAKEGAMRDRKRYQYEVDRIKEAVRQKNLARRGPAATIAKPIRAGQHNTVNVAGNPVIRTGGINMANRSTDDQKRRSVIGGDKD

SEQ ID NO: 23085 - protein, 84 aa, Diabrotica virgifera
  misc_feature: Coding regions on vcDNA: vcDNA=SeqID_2782; Strand=+; Position=3-257
  misc_feature: Homolog annotation: Hit_ID=XP_318286.1; Match level="QueryCoverage =100%, HitCoverage=11%, E-value=8e-13, Identity=45%"; Hit description= ENSANGP00000001755 [Anopheles gambiae]
HIISSNQYLSLPRLSSQAVLEALCPEEFNKPRKRLCVVLVTTSSSYYLPYRQSYLYFAQQSPYSVKKVKLVNINYNKQSELVNS

SEQ ID NO: 23086 - protein, 292 aa, Diabrotica virgifera
  misc_feature: Coding regions on vcDNA: vcDNA=SeqID_2783; Strand=+; Position=1-876
  misc_feature: Homolog annotation: Hit_ID=AAN87269.1; Match level="QueryCoverage =97%, HitCoverage=12%, E-value=4e-74, Identity=47%"; Hit description =ORF [Drosophila melanogaster]
  misc_feature: Pfam annotation: Pfam_ID=rve; Match level="Score=32.7, E-value=1.1e -06, Copies=1"; Pfam description=Integrase core domain
EKYWILDARNLVRRIIHNCIVCFKYSCVPLQPLMGELPPERVTPTRPFYNTGVDYAGPFLIRDRITKPYKSVKAYICLFVCMATKAVHLELVGDLTTHSFLSALRRFSSRRGKPSVIFSDNGTNFVGAYKELGSFLKQANKTINIKLSLEGISWKFIPAKAPHFGGLWERGIKSVKFHLKRVVGTNVLSYEQFLTVLIQIEGILNSRPLHPLSSDPNDTAPLTPSHFLIGEAITSIPDQNYLNVPSNRLKHFQLIQAITQKFWSQWSRDYISQLQTRVKWKTNAPNLLQPGA

SEQ ID NO: 23087 - protein, 173 aa, Diabrotica virgifera
  misc_feature: Coding regions on vcDNA: vcDNA=SeqID_2784; Strand=+; Position=202-723
  misc_feature: Homolog annotation: Hit_ID=XP_395902.1; Match level="QueryCoverage =90%, HitCoverage=75%, E-value=6e-46, Identity=57%"; Hit description =similar to CG9471-PA [Apis mellifera]
MARIIIFGCTGMTGICAVEAAVKKGLNVKAFVRDPARLPEHLRNSVEVVTGNVLDYKSVLDGIKGVSGVVVALGTNNDLKPTTDLSTGLQNIIKAMKELNVDTISVCLSAFLFYEAGKVPPRFQDLNAEHQRMYDVLKVSGLKYIAGFPPHIADEPLGEDATNTMLFQEPEVF

SEQ ID NO: 23088 - protein, 214 aa, Diabrotica virgifera
  misc_feature: Coding regions on vcDNA: vcDNA=SeqID_2785; Strand=+; Position=65-706
  misc_feature: Homolog annotation: Hit_ID=EAL26809.1; Match level="QueryCoverage =91%, HitCoverage=31%, E-value=4e-32, Identity=35%"; Hit description =GA13791-PA [Drosophila pseudoobscura]
  misc_feature: Gene Ontology Annotation: Molecular function=sphingomyelin phosphodiesterase activity; Cellular component=extracellular; Biological process=ceramide biosynthesis
KNVNFQNHLVNFGNQISGQKERICEGLIKLNAPILLYVIDNTPELTGQDICGISLQDYGCNGSKRLEWSIDIPPKTNIKQNETPATENTTSFNILHISDIHYDPRYTTNKTTKCGEPICCQDDQADGTTEKDTCGYWGSYTNSDIPWRTAINALEQTKLHKYDYVYFTGDIVAHRIWNTSLEENTRVISQVLDTFADIYNVPVFPPFGYYRTHP

SEQ ID NO: 23089 - protein, 199 aa, Diabrotica virgifera
  misc_feature: Coding regions on vcDNA: vcDNA=SeqID_2786; Strand=+; Position=33-632
  misc_feature: Homolog annotation: Hit_ID=XP_394931.1; Match level="QueryCoverage =99%, HitCoverage=81%, E-value=1e-98, Identity=90%"; Hit description =similar to CG2746-PA [Apis mellifera]
  misc_feature: Gene Ontology Annotation: Cellular component=cytosolic ribosome (sensu Eukarya); Biological process=protein biosynthesis
  misc_feature: Pfam annotation: Pfam_ID=Ribosomal_L19e; Match level="Score=361.2, E -value=1.4e-105, Copies=1"; Pfam description=Ribosomal protein L19e
MSSLKLQKRLAASVMRCGKKKVWLDPNEINEIANTNSRQNIRKLIKDGLIIKKPVAVHSRARVRKNTEARRKGRHCGFGKRKGTANARTPQKELWIQRMRVLRRLLKKYREAKKIDRHLYHSLYMKAKGNVFKNKRVLMEYIHKKKAEKARAKMLADQANARRMKVKQARERREERIATKKQEVLQNYMREDEAAATKK

SEQ ID NO: 23090 - protein, 144 aa, Diabrotica virgifera
  misc_feature: Coding regions on vcDNA: vcDNA=SeqID_2787; Strand=+; Position=43-477
  misc_feature: Homolog annotation: Hit_ID=XP_394931.1; Match level="QueryCoverage =98%, HitCoverage=58%, E-value=1e-74, Identity=96%"; Hit description =similar to CG2746-PA [Apis mellifera]
  misc_feature: Gene Ontology Annotation: Cellular component=cytosolic ribosome (sensu Eukarya); Biological process=protein biosynthesis
  misc_feature: Pfam annotation: Pfam_ID=Ribosomal_L19e; Match level="Score=339.5, E -value=4.8e-99, Copies=1"; Pfam description=Ribosomal protein L19e
MSSLKLQKRLAASVMRCGKKKVWLDPNEINEIANTNSRQNIRKLIKDGLIIKKPVAVHSRARVRKNTEARRKGRHCGFGKRKGTANARTPQKELWIQRMRVLRRLLKKYREAKKIDRHLYHSLYMKAKGNVFKNKRVLMEYIHM

SEQ ID NO: 23091 - protein, 146 aa, Diabrotica virgifera
  misc_feature: Coding regions on vcDNA: vcDNA=SeqID_2788; Strand=+; Position=333-773
  misc_feature: Homolog annotation: Hit_ID=XP_394931.1; Match level="QueryCoverage =87%, HitCoverage=52%, E-value=6e-59, Identity=86%"; Hit description =similar to CG2746-PA [Apis mellifera]
  misc_feature: Gene Ontology Annotation: Cellular component=cytosolic ribosome (sensu Eukarya); Biological process=protein biosynthesis
  misc_feature: Pfam annotation: Pfam_ID=Ribosomal_L19e; Match level="Score=93.7, E -value=4.8e-25, Copies=1"; Pfam description=Ribosomal protein L19e
RGIRVRFRRGSLRNGYHIQGRHCGFGKRKGTANARTPQKELWIQRMRVLRRLLKKYREAKKIDRHLYHSLYMKAKGNVFKNKRVLMEYIHKKKAEKARAKMLADQANARRMKVKQARERREERIATKKQEVLQNYMREDEAAATKK

SEQ ID NO: 23092 - protein, 163 aa, Diabrotica virgifera
  misc_feature: Coding regions on vcDNA: vcDNA=SeqID_2789; Strand=-; Position=1150 -1641
NTSLFFFFFHTTKRARRKRRKKYPLIKKKKKKKRGGEKGGGGCFFPPVWEQKRSPYLKKGGVPPATKREKKPFFRGEGAPPTGTPPPPKKNFLGGGGGGKKQKKKGPPKRGAPPFFNLSGEKNPPTWEKKKKEKKKKKRGGFRGPQKYNRVPLWLKPPPPPRL

SEQ ID NO: 23093 - protein, 161 aa, Diabrotica virgifera
  misc_feature: Coding regions on vcDNA: vcDNA=SeqID_2790; Strand=+; Position=410-895
  misc_feature: Homolog annotation: Hit_ID=XP_393352.1; Match level="QueryCoverage =96%, HitCoverage=75%, E-value=9e-67, Identity=78%"; Hit description =similar to ENSANGP00000010223 [Apis mellifera]
  misc_feature: Gene Ontology Annotation: Molecular function=pre-mRNA splicing factor activity; Cellular component=nuclear speck; Biological process =spliceosome assembly
  misc_feature: Pfam annotation: Pfam_ID=RRM_1; Match level="Score=98.2, E-value=2.2e- 26, Copies=1"; Pfam description=RNA recognition motif. (a.k.a. RRM, R
MSYGRPPPRIDGMVSLKVDNLTYRTTPDDLRRVFERCGEVGDIYIPRDRFTRESRGFAFVRFYDKRDAEDALDAMDGRMLDGRELRVQMARYGRPTSPHRRYGRRRSRGSRRSRSRSHRRSFSRSRSRSDSKSSRGRSRSISKDEKERSKSLSKSRSRSRS

SEQ ID NO: 23094 - protein, 293 aa, Diabrotica virgifera
  misc_feature: Coding regions on vcDNA: vcDNA=SeqID_2791; Strand=+; Position=60-938
  misc_feature: Homolog annotation: Hit_ID=XP_317806.1; Match level="QueryCoverage =92%, HitCoverage=87%, E-value=6e-65, Identity=45%"; Hit description =ENSANGP00000004803 [Anopheles gambiae]
  misc_feature: Gene Ontology Annotation: Molecular function=molecular_function unknown; Cellular component=cellular_component unknown; Biological process=biological_process unknown
  misc_feature (108)..(108): Xaa can be any naturally occurring amino acid
MSKRNYDSAFSDTKFTTKDTGRQTNKKHTLDSDEEDDEIEEDNVLNTDDIEGEEDGIARQDGEQKMTAFNMNEEMEEGHFDKDGHFIWNNEKEIKDSWLDNIDWQKIXENAGNDKKYKVYEEGLGAESDSETDDEHFDEIGSYKKMLNYMNPKETVNKALKRLGGADMKLSSVERLKRKKAGTLTSSKDVTDLTELANEILTKLGNMDIYQETYEHIKSKVDASENKKQKVVKEAELDMYADDFDEKEKGKIVTTSSNKEEHDDTDVPKATAPLMWEFKWKNEDEDVQGTYST

SEQ ID NO: 23095 - protein, 62 aa, Diabrotica virgifera
  misc_feature: Coding regions on vcDNA: vcDNA=SeqID_2792; Strand=-; Position=279-467
RNITYERTKHHENHQVHRLLSGLLNNYLRYDRYDHFIDKILDGKRRRHQMILRSIMNYQHST

SEQ ID NO: 23096 - protein, 805 aa, Diabrotica virgifera
  misc_feature: Coding regions on vcDNA: vcDNA=SeqID_2793; Strand=+; Position=198-2608
  misc_feature: Homolog annotation: Hit_ID=EAA09206.3; Match level="QueryCoverage =94%, HitCoverage=88%, E-value=0.0, Identity=34%"; Hit description =ENSANGP00000003616 [Anopheles gambiae str. PEST] ref|XP_562076.1| ENSANGP00000003616 [Anopheles gambiae str.
  misc_feature: Gene Ontology Annotation: Molecular function=actin cross-linking activity; Cellular component=actin cytoskeleton; Biological process =cell surface receptor linked signal transduction
  misc_feature: Pfam annotation: Pfam_ID=Filamin; Match level="Score=498.6, E-value =6.2e-147, Copies=7"; Pfam description=Filamin/ABP280 repeat
  misc_feature (681)..(681): Xaa can be any naturally occurring amino acid
  misc_feature (696)..(696): Xaa can be any naturally occurring amino acid
  misc_feature (729)..(729): Xaa can be any naturally occurring amino acid
  misc_feature (735)..(735): Xaa can be any naturally occurring amino acid
  misc_feature (744)..(744): Xaa can be any naturally occurring amino acid
  misc_feature (753)..(753): Xaa can be any naturally occurring amino acid
TLLARICKAEKTSEVITHSEVHEKVTSTQTTKQQVFRPVELSKIPLLSTGGNVTAEIKMPSGNIDKPIIEDNRDGTVTIKYDPREEGVHELAVKFNGEHVQGSPYKIHVDSISSGYVTAYGPGLTHGVTGEPSNFTISTKGAGAGGLSMAVEGPSKAEISCHDNKDGTVSVSYLPTAPGEYKISVRFGDKHIKGSPFNAKITGEGRKRNQISVGSCSEVSLPGGKISDADIRSLNASIQAPSGLEEPCFLKRLPTGNIGISFTPREIGEHVVSVKKMGNHITNSPFKINVCEREVGDARKVKVTGSALKDGKTHQDNTFTVDTRNAGFGGLSLSIEGPSKAEIQCNDNTDGTLNISYKPTEPGYYIVNLKFADHHLDGSPFTVKVTGEGSNRQREKIQRQREAVPVTEVGSQCKLTFKMPGITSFDLSATVTSPGGVTEDAEINEVKDGLYAVHFVPKELGVHTVSVRYKDIHIPGSPFQFTVGPYRDHGAHLVKAGGAGLERGEQGELNEFNVWTREAGSGQLAISVEGPSKAEINFSDRKDGSCDVSYKVSEPGEYRIGLKFNDEHVPDSPFKVYISPAVGDAHLLEVAQFPEGCIQADKPSQFIVRRNGAKGDLDAKIIGPSGHEDDCFVQIIDMEEYSIRFMPRENGIHKIHANLNGVHIPGSPFSVKVGKDTADPXAAVHASGNGLKEVKXGVKTHFIVDTVNGGSGTLSGNIDGPSKEPMDCXEVEEGXYKVKYPPLXPGDYYFSIXKITIHHIVGSPLSKKQSKRRKKGQHIFGGQEIIFHGGEKTDTPNRKKTNNKP

SEQ ID NO: 23097 - protein, 458 aa, Diabrotica virgifera
  misc_feature: Coding regions on vcDNA: vcDNA=SeqID_2794; Strand=+; Position=3-1378
  misc_feature: Homolog annotation: Hit_ID=XP_396425.1; Match level="QueryCoverage =99%, HitCoverage=57%, E-value=1e-102, Identity=44%"; Hit description= similar to Acylpeptide hydrolase [Apis mellifera]
  misc_feature: Gene Ontology Annotation: Cellular component=mitochondrion
  misc_feature: Pfam annotation: Pfam_ID=Peptidase_S9; Match level="Score=63.0, E -value=8.1e-16, Copies=1"; Pfam description=Prolyl oligopeptidase family
  misc_feature (437)..(437): Xaa can be any naturally occurring amino acid
  misc_feature (446)..(446): Xaa can be any naturally occurring amino acid
QLEPRKLGIMFCANRPSTIFSLDFDGNFVSLPLPGKAVKSPIFSPKGDYILWLQRNSGGPHASAMELVKASVPLNENTVSKVVIDIVDTEKKIEGGKLFYGLYNTGFFRRPWASNDRLILNTNQKYTINSYVVNINTGSLTQLEYNEGSLRVLDVHEDTILAVNRHFLKPDKIILGKLPAPNQEATIVWEELTTSETVPGLENSKYEYLDLKAPEGDFKDFNAIYIGPKSGSNHSVPLIVWPHGGPHSVFGNYLFLEEAMYLLSGFAVLLINFRGSLGSGQKSVDYLPKKVGTADVKDCIQATDEALARYPWLNPKQLALAGGSHGGFLVAHLSGQYPDKYKVVVARNPVIDVASMSINSDIPDWCFVEGGKEYTQKGEIDNDALTFMRQVSPIVHMHKVKAPTLLQIGSKDLRVPPQQGIEYHLRLKANVVVTRMXLYDDNHPLXKCPNEFDTLINR

SEQ ID NO: 23098 - protein, 114 aa, Diabrotica virgifera
  misc_feature: Coding regions on vcDNA: vcDNA=SeqID_2795; Strand=+; Position=29-373
MKIYFILPIVAITFFEVQAWVGTLRSDPGTEHLGDCYSSSEGVGAMKFGEEKRLEGECVQLVCSKNRDIQEIGCGSVGIAPPCKIMPGDLSKPYPDCCYEISCPATIPLPKGKA

SEQ ID NO: 23099 - protein, 271 aa, Diabrotica virgifera
  misc_feature: Coding regions on vcDNA: vcDNA=SeqID_2796; Strand=+; Position=43-856
  misc_feature: Homolog annotation: Hit_ID=XP_321282.1; Match level="QueryCoverage =69%, HitCoverage=82%, E-value=1e-31, Identity=44%"; Hit description =ENSANGP00000018555 [Anopheles gambiae]
  misc_feature: Pfam annotation: Pfam_ID=DUF745; Match level="Score=21.4, E-value =1.3e-09, Copies=1"; Pfam description=Protein of unknown function (DUF745)
  misc_feature (142)..(142): Xaa can be any naturally occurring amino acid
  misc_feature (241)..(241): Xaa can be any naturally occurring amino acid
MFRFFVLATALTTISASGSKQQKNEPVVLEPFPDGSYVSYSHFDENSVGGHGHGGGDYDTGKATGAELASLAHSSAVQANNAVQSQHTAGSQAAFGIKSSLASAAYGAAQAAQAALVGKQALAGSIKRQLAEAQQQLQGEIXQYQQTQATAQAAENTAHQAQSQLSALTAAVTAAQAGAQQASQAAAEAAQAAAAQHAMVVEAKQRISQLSAQLQNCLADLHQTEAAAQKAAAAAHLAQSXGCQLVQLPLDMVDMVVKDMEDSVPIIIISG

SEQ ID NO: 23100 - protein, 269 aa, Diabrotica virgifera
  misc_feature: Coding regions on vcDNA: vcDNA=SeqID_2797; Strand=+; Position=1-806
  misc_feature: Homolog annotation: Hit_ID=XP_394242.1; Match level="QueryCoverage =80%, HitCoverage=36%, E-value=7e-75, Identity=62%"; Hit description =similar to CG8368-PA [Apis mellifera]
  misc_feature: Gene Ontology Annotation: Molecular function=ribonuclease H activity; Cellular component=nucleus; Biological process=nucleobase, nucleoside, nucleotide and nucleic acid metabolism
  misc_feature: Pfam annotation: Pfam_ID=Exonuc_X-T; Match level="Score=102.1, E -value=1.4e-27, Copies=1"; Pfam description=Exonuclease
  misc_feature (224)..(224): Xaa can be any naturally occurring amino acid
  misc_feature (227)..(227): Xaa can be any naturally occurring amino acid
LAGRYKPLHRRRINASAKTDKFSRTDLLLSGWQMVEENFPLPIKGLMERKYQGYVLTKEKYKDATSFSPMFAVDCEMCRTSTGDLELTRISCVNEKLEVFYDTLVKPDNEIIDYLTKWSGINKSMMKNVSKKLKDVQEDLQKALPPDAILIGQSLANDLHALKMMHPYIIDTSVIYNLMGDRTRKTKLQTLAREYLKEDIQVSRKGHCSSEDSLACMKLVQLRXGNXLFFGDAVMGGVKKDVRTYPEMGTAQYATSMLRQSVKVDKTAN

SEQ ID NO: 23101 - protein, 244 aa, Diabrotica virgifera
  misc_feature: Coding regions on vcDNA: vcDNA=SeqID_2798; Strand=+; Position=148-880
  misc_feature: Homolog annotation: Hit_ID=NP_443006.1; Match level="QueryCoverage =100%, HitCoverage=87%, E-value=2e-30, Identity=32%"; Hit description= transposase [Synechocystis sp. PCC 6803] ref|NP_440247.1| transposase [Synechocystis sp. PCC
  misc_feature: Pfam annotation: Pfam_ID=Transposase_14; Match level="Score=32.1, E -value=6.3e-08, Copies=1"; Pfam description=Transposase
  misc_feature (108)..(108): Xaa can be any naturally occurring amino acid
MGYSLDFRRRVLAYKDKHALTFEQTRDHFEVSIRTLFRWCNKIEPCMTRDKPPTKISDETLIADVKNYPDDYQWERAKRLGVSQSAIHYALKRLKITVKKNAQTSRRXDEHARQVFGERIRHHEQAGKQIVYLDESGFEQSMPRTHGYSLKGSRCFGLHDWQHKGRINAIGAIIKNTFVTLSLFAGTLNANVFHAWLTRDLLPKLPKGTVIVMDNAPFHRRGDTRQAITDHGCQLRWIPPYSPD

SEQ ID NO: 23102 - protein, 293 aa, Diabrotica virgifera
  misc_feature: Coding regions on vcDNA: vcDNA=SeqID_2799; Strand=+; Position=128-1005
  misc_feature: Homolog annotation: Hit_ID=XP_320403.1; Match level="QueryCoverage =95%, HitCoverage=67%, E-value=1e-85, Identity=56%"; Hit description =ENSANGP00000009174 [Anopheles gambiae]
  misc_feature: Pfam annotation: Pfam_ID=RrnaAD; Match level="Score=-19.1, E-value =3.6e-06, Copies=1"; Pfam description=Ribosomal RNA adenine dimethylase
  misc_feature (82)..(82): Xaa can be any naturally occurring amino acid
MSDRMPKIDLSKIKKTDLDFIKEIEKRNQERVLKLKKLRRTNLLTAGFLTAGILGIYGYSMYAVRQESFLDDFDEPAKTTQXMAANVQHVRLPPLPTIRDLVKLYRLRALRQLSQNFLMDERITDKIVRAAGPLKNHYVCEIGPGPGGITRSIIKKNPRKLIVVEKDPRFLPTLELLQLCCKDVTDMKIEIADIRTYDLKQCFQGAPEMEWQHAPPPVHLIGNLPFSVSTNLIIKYLQSISEKTSAWHYGRSSMTLTFQKEVGERMVAPIMDKQRCRLSVICQMWCDVQYKFT

SEQ ID NO: 23103 - protein, 188 aa, Diabrotica virgifera
  misc_feature: Coding regions on vcDNA: vcDNA=SeqID_2800; Strand=+; Position=147-713
  misc_feature: Homolog annotation: Hit_ID=AAR22385.1; Match level="QueryCoverage =98%, HitCoverage=77%, E-value=2e-61, Identity=57%"; Hit description =cellulase II [Apriona germari]
  misc_feature: Pfam annotation: Pfam_ID=Glyco_hydro_45; Match level="Score=286.1, E -value=5.8e-83, Copies=1"; Pfam description=Glycosyl hydrolase family 45
CRNVHTPSGVPVASCDRSGVNRVDDNAKSGCEGGGSAYMCNSQQPWAVNSTLAYGFGAASFSNGIDVSLCCACFLLSFKDQISNKKMIVQVTNTGSDLSHNHFDIALPGGGVGIFTQGCHDQWNAPWNGWGDQYGGVHNRGECATLPQALQSGCYFRFDFYQNANNPRMHFDQVQCPAEIVARSGCSL

SEQ ID NO: 23104 - protein, 239 aa, Diabrotica virgifera
  misc_feature: Coding regions on vcDNA: vcDNA=SeqID_2801; Strand=+; Position=42-761
  misc_feature: Homolog annotation: Hit_ID=AAR22385.1; Match level="QueryCoverage =99%, HitCoverage=99%, E-value=4e-76, Identity=54%"; Hit description =cellulase II [Apriona germari]
  misc_feature: Pfam annotation: Pfam_ID=Glyco_hydro_45; Match level="Score=376.7, E -value=3.1e-110, Copies=1"; Pfam description=Glycosyl hydrolase family 45
MKIAILVSALVALAVATPLEQSPEIKFIEKGISGEGTTTRYWDCCKPSCSWRGNVHTPSGVPVASCDRSGVNRVDANAKSGCEGGGSAYMCNSQQPWAVNSTLAYGFGAASFSNGVDVSLCCACFLLSFKDQISNKKMIVQVTNTGSDLSHNHFDIALPGGGVGIFTQGCHDQWNAPWNGWGDQYGGVHNRGECATLPQALQSGCYFRFDFYQNANNPRMHFDQVQCPAEIVARSGCSL

SEQ ID NO: 23105 - protein, 285 aa, Diabrotica virgifera
  misc_feature: Coding regions on vcDNA: vcDNA=SeqID_2802; Strand=-; Position=161-1018
  misc_feature: Homolog annotation: Hit_ID=XP_396168.1; Match level="QueryCoverage =82%, HitCoverage=13%, E-value=5e-13, Identity=23%"; Hit description =similar to RE58116p [Apis mellifera]
MSSARGKWSSQDTISFLEMYEQHRCLWDVHSEGYKDRNTRINAYEAMATAMEIDGFLVEDVKAKIRSLRNAYTLELAKILRSKKLAAGPDDVYKPKLPWFPVADRILNGVVQLREIQPTEIGVADSETQSSVNDVVETVMVDPTPPTAVPGVSTEAIPSTSKRTFTSDTAEPARKKAKTSATNYQRCLDRTLSELKNISASLSKKIAPKEEDEFDMFGKLIACQLKKLPIIVALEAQQYIFSYLIQKRIEHIRRTNRQYDAASPDSAMESSHSDADIPSQRSWFC

SEQ ID NO: 23106 - protein, 224 aa, Diabrotica virgifera
  misc_feature: Coding regions on vcDNA: vcDNA=SeqID_2803; Strand=+; Position=144-818
  misc_feature: Homolog annotation: Hit_ID=CAG08390.1; Match level="QueryCoverage =97%, HitCoverage=41%, E-value=2e-38, Identity=40%"; Hit description =unnamed protein product [Tetraodon nigroviridis]
  misc_feature: Gene Ontology Annotation: Molecular function=transcription factor activity; Cellular component=proteasome regulatory particle (sensu Eukarya); Biological process=regulation of transcription, DNA -dependent
  misc_feature: Pfam annotation: Pfam_ID=Ank; Match level="Score=136.0, E-value=8.8e -38, Copies=5"; Pfam description=Ankyrin repeat
MASGSIYDAAHKGDFEYVSQKIEEDPLIIKAPDSSKRLLIHWAVLSGNVKLVTHLLELGSSVNPSDDTDMTPLILASSAGHTEVVKLLLKKCDDVNHKNAQGHSSLQYAASKGWTEICALLLEKGADVNIKDERGSTPLHRAASKGLLSILGLLLSISDIKVNVKDIYGNTPLHYACEEDRKEAAVMLGDHRADVEIKNREDKSCLDLCTPVLARLLKRTQSVT

SEQ ID NO: 23107 - protein, 289 aa, Diabrotica virgifera
  misc_feature: Coding regions on vcDNA: vcDNA=SeqID_2804; Strand=+; Position=207-1076
ELLHPVYLFWNVIYQIENMATKDRSLGSGISIPQWMKTKSSKFDLDPSTFSPTELDDSFMLYYRRPKPESNFSTTTTITTTNLPENITVATVTKKKQDFSQHPVPCQKYLRSGQDVPPQTSSEMKIKSPGTDDGFKGEAAKCGSSIIKVASQMISNQGLGLRICYPVEPMEEKYDGTRRRNSKSLPASPLTSPGSSPKAHRRVNKYFTGAFTDVDNLKVVGYCRVYTPNEKSKNFPNLVGQKKRKKSKKKIFQTPPPLNKGSLTRKKKNKKPKLKKKLPPLVFRDSKPL

SEQ ID NO: 23108 - protein, 383 aa, Diabrotica virgifera
  misc_feature: Coding regions on vcDNA: vcDNA=SeqID_2805; Strand=+; Position=93-1244
VKMYSVIEFKQEEDGGGLSIVNSTWLTPRKTEVRWPPIKDNLQFKKVLRKLEPEIDETWKIYGVQKIFYSTDDFEKATNKLKRAEITSDLQTDLEDDNTRPRRKILKRKFSSDEDSNDQVSLFKPGKKSKQILPWPPPVGINKLYTNPRGSSQELESGTDESDPGIPSGSQFMKSISTPRDKLSFQISTPKSSSSFGRQEATEIQTPTLNESLNFDNSLQDTNGLKVLLKHILTIREQNRKILNILEKSKPFENSDLPDDFKIKLPIESLQDLEELEIYLTEEENFNTFKSYCASISNLKDVTQKNNRILRSLLTDNIAKHFNYFGNNRGQDRVSNKRPFNQLRLNKVVLDAVKQGTDFTTHEVENAIKRWLKHAPNRNKKNY

SEQ ID NO: 23109 - protein, 159 aa, Diabrotica virgifera
  misc_feature: Coding regions on vcDNA: vcDNA=SeqID_2806; Strand=+; Position=3-482
  misc_feature: Homolog annotation: Hit_ID=NP_927654.1; Match level="QueryCoverage =100%, HitCoverage=83%, E-value=5e-65, Identity=73%"; Hit description= DNA-3-methyladenine glycosylase I (3-methyladenine-DNA glycosylase I, constitutive) (TAG I)
  misc_feature: Pfam annotation: Pfam_ID=Adenine_glyco; Match level="Score=287.3, E -value=2.5e-83, Copies=1"; Pfam description=Methyladenine glycosylase
LRDSRQLFELICLEWQQAGLSWFTILKKREGYRKSFHQFDPASIARMDETDVEKLMKEPAIVRHRAKIKAIIHNAHAYLDMAEQGEDFSTFIWRFVNDIPLVNHWETPKEVPAQTDMSDALSTALKKRGFKFIGSTTCYAFMQAAGLVNDHIANCVCRK

SEQ ID NO: 23110 - protein, 244 aa, Diabrotica virgifera
  misc_feature: Coding regions on vcDNA: vcDNA=SeqID_2807; Strand=-; Position=3-734
  misc_feature: Homolog annotation: Hit_ID=NP_931482.1; Match level="QueryCoverage =98%, HitCoverage=40%, E-value=1e-109, Identity=78%"; Hit description= hypothetical protein plu4306 [Photorhabdus luminescens subsp. laumondii TTO1] emb|CAE16678.1|
  misc_feature: Gene Ontology Annotation: Molecular function=pyruvate carboxylase activity; Cellular component=cytosol; Biological process =gluconeogenesis
  misc_feature: Pfam annotation: Pfam_ID=CPSase_L_D2; Match level="Score=363.6, E -value=2.7e-106, Copies=1"; Pfam description=Carbamoyl-phosphate synthase L chain,
CGIMWIGQHPETIDELGDKIKARRIAQKVGAPLVIGTAEPVKDVQEVVAFAETHGLPIAIKAAFGGGGRGLKVAWRLDEVAELYHSAVREATAAFGRGECFIEQFLNNPRHIEAQVIADKQGNVVVLGTRDCSLQRRNQKLVEEAPAPFLTQEQRDRIHQSAKAICVEANYVGAGTVEFLLSADGALSFLEVNTRLQVEHPVTEETTGIDLVIEQLRVAEGYPLSIQETPVAKGHSFEFRINQK

SEQ ID NO: 23111 - protein, 214 aa, Diabrotica virgifera
  misc_feature: Coding regions on vcDNA: vcDNA=SeqID_2808; Strand=-; Position=2-645
  misc_feature: Homolog annotation: Hit_ID=BAD86656.1; Match level="QueryCoverage =92%, HitCoverage=38%, E-value=2e-23, Identity=32%"; Hit description =reverse transcriptase [Bombyx mori]
  misc_feature: Pfam annotation: Pfam_ID=zf-CCHC; Match level="Score=17.7, E-value =0.0017, Copies=1"; Pfam description=Zinc knuckle
  misc_feature (82)..(82): Xaa can be any naturally occurring amino acid
  misc_feature (117)..(117): Xaa can be any naturally occurring amino acid
HASAFNFVTCKGIVRQIDTDIDEKELLRCCDTGNDIEILHIKRLNRRVIKDGVTSYEPTGTTLFTFRGVLMPKTVFLWHTKXVDTYIAPVTQCYNCLRFGHTKTNCKGKVKMFFKDXNKHEDVCMTKCFYCKDSHKSIDKSCPEYTRQKNIKELMAYENLTFFEASEAIPKSYISNNKFIYNPRDFPNFKNNSRPLENTPSTSTNNSNTIEPSH

SEQ ID NO: 23112 - protein, 451 aa, Diabrotica virgifera
  misc_feature: Coding regions on vcDNA: vcDNA=SeqID_2809; Strand=+; Position=2-1357
  misc_feature: Homolog annotation: Hit_ID=AAS13459.1; Match level="QueryCoverage =95%, HitCoverage=47%, E-value=1e-106, Identity=47%"; Hit description= putative reverse transcriptase [Drosophila simulans]
  misc_feature: Pfam annotation: Pfam_ID=RVT_1; Match level="Score=160.5, E-value =3.8e-45, Copies=1"; Pfam description=Reverse transcriptase (RNA -dependent
  misc_feature (14)..(14): Xaa can be any naturally occurring amino acid
  misc_feature (104)..(104): Xaa can be any naturally occurring amino acid
  misc_feature (177)..(177): Xaa can be any naturally occurring amino acid
  misc_feature (259)..(259): Xaa can be any naturally occurring amino acid
PERNDRKSPVYDLXLLKELPVKCLKLITFIFNAILNLGYFPDQWKVSQVITILKLGKPQEETTSYMPISLLPITSKVFEKLLVRKLEPWIKNLIPDHQFGFRPXHSIIQRVRKVVKHINADFEAKRYCSAVFLDVRQAFDKVWHGCPLYKLKRTLPHRFYILLESNLSDRCYFIKYXRCNFQLYSIKAGVPQGSVLGPTLYLLFTADIPPTLQKPLEERPPTEEMMLGTFDDDTAILASHTDPIYASHLLQAYLDRVQXWFLEWKIKVNEGKSIHVTFTTRRGTCSPVSLNNHQITSANEVKYLGIHLDRSLTWRKHIRTKRKQLGLQFRNMYWLMGRSSRLSLDNKLLLYKAILMPICTYGLELWGTASHSNIEIIQRFQSKTLRTSTNAPWYINNRIIHRDLKTDMVQEVITKRSAAYIAKLEDHEDQFALLRRLKRFKPLELPFRVNF

SEQ ID NO: 23113 - protein, 346 aa, Diabrotica virgifera
  misc_feature: Coding regions on vcDNA: vcDNA=SeqID_2810; Strand=+; Position=3-1043
  misc_feature: Homolog annotation: Hit_ID=XP_317275.1; Match level="QueryCoverage =93%, HitCoverage=33%, E-value=1e-54, Identity=31%"; Hit description =ENSANGP00000021850 [Anopheles gambiae]
  misc_feature: Gene Ontology Annotation: Molecular function=receptor activity; Cellular component=membrane; Biological process=vitamin B12 transport
  misc_feature: Pfam annotation: Pfam_ID=EGF; Match level="Score=51.4, E-value=2.6e -12, Copies=5"; Pfam description=EGF-like domain
  misc_feature (281)..(281): Xaa can be any naturally occurring amino acid
RCLEIETTTPEPTTTETVEYTEPGNQEILQTCNSDGCYCPSGYVIETGTPYCVLETTTLPTTVPHPTERLPGSCSVVNNCHANASCLYSDILRDYECICNEGFEGNGYSCEPEVISCTIVDNCDPQATCAYDETLGKSKCICNPGYVGDGYYCTISVGCTSNQDCTVTEECVITPSQKYECICREGYTRDTQNQCVLIAGSCGGGTCVDNAECIYDEEYETFFCHCKNGFIGDGITECKKKVIGCDTLNNCGEHATCKYVEEELAYKCFCIDGFFDNVFDXYAERNCHIHPTMCHHQAVCLTYASRQFLCQCEPVYDVHVTMCKAISKHEGIYLLLNHEMILYNFP

SEQ ID NO: 23114 - protein, 208 aa, Diabrotica virgifera
  misc_feature: Coding regions on vcDNA: vcDNA=SeqID_2811; Strand=+; Position=26-649
  misc_feature: Homolog annotation: Hit_ID=XP_312115.1; Match level="QueryCoverage =97%, HitCoverage=53%, E-value=3e-60, Identity=52%"; Hit description =ENSANGP00000017017 [Anopheles gambiae] gb|EAA07707.1| ENSANGP00000017017 [Anopheles gambiae
MKVLLVFVLVAVCKVNSYCIRSVTTASGPFAPKNICSGDLIFEDNFDCLNLDKWKHEDTLAGGGNNEFEWYTNSRNNSYTSNGILHIKPTFVADELGEQFLQSATVDLGNKCTNPHNSGCKRTGSPGEILNPVKSARLRTLDTFSFIYGKVEVRAKVPTGDWLWPAIWLLPNKWIENGDWISSGEIDIMETRGNKELIKPNGQNIGTP

SEQ ID NO: 23115 - protein, 435 aa, Diabrotica virgifera
  misc_feature: Coding regions on vcDNA: vcDNA=SeqID_2812; Strand=+; Position=82-1389
  misc_feature: Homolog annotation: Hit_ID=EAL29937.1; Match level="QueryCoverage =97%, HitCoverage=96%, E-value=1e-172, Identity=69%"; Hit description= GA21959-PA [Drosophila pseudoobscura]
  misc_feature: Pfam annotation: Pfam_ID=PCI; Match level="Score=95.0, E-value=2e-25, Copies=1"; Pfam description=PCI domain
MAKFDLTSKMGQYLDRHLVFPLLEFLSAKGIYNETELLKAKLDILSKTNMIDYAIDIRKQLYPDQEIPEDLKQRRNHVVQQLAELQEEVKPILKIMESEEVMKNMENMRDSKTLITYLSKEFKFEIELIDSLHKLAKYRYDCGNYTVSTSYLYFCMLVLPPNDRNYLSALWGKFASEILYQNWDSALEDLNKLREYIDSSPNQFSGNSLQLLQQRTWLIHWSLFVFFNHVMGRELIIEMFLYRPHYLNAIQTMCPHILRYLATAVIINRGRRSALKDLVKVIQQESYTYRDPITEFVEHLYVNFDFDGARQKLHECQTVLLNDFFLISCLDEFVENARLMIFETFCRIHQCISIGMLAEKLNMNPDEAECWIVNLIRNARLDAKIDSKLGHVVMGAQPLSPYQQLIEKIDSLSVRSETLCALIDRKLRARTDVSF

SEQ ID NO: 23116 - protein, 304 aa, Diabrotica virgifera
  misc_feature: Coding regions on vcDNA: vcDNA=SeqID_2813; Strand=+; Position=17-931
  misc_feature: Homolog annotation: Hit_ID=CAA10770.1; Match level="QueryCoverage =100%, HitCoverage=89%, E-value=6e-66, Identity=43%"; Hit description= reverse transcriptase-like [Bos taurus]
  misc_feature (11)..(11): Xaa can be any naturally occurring amino acid
  misc_feature (231)..(231): Xaa can be any naturally occurring amino acid
MGAPMHLVTLXKNLYQSNVATVRLDQKFLNQFKTDRGVRQGCVLSPDLFNIYVEHVMRMVLEGWAGGVTVAGRKISNLRLADDTTLIAANKQEMFDLLRKVEYESNKVGLKINKAETKIMVVDRFDTIQLTNILQEYQIVNTFVYLGSSITNDGNCEAEVRRRIGMAKNAMSRLTKLWKDRSLSQNITMRLVNALVFSIFLYGAETWTLRACERQKIDAFEMWCWRRMLRXPWTAHRTNISILNQLNIKKRLSTLCLQRILQFFGHVVRRGDDSLERLIVSGNVSGRRSRGRSPTRWSDQIRSS

SEQ ID NO: 23117 - protein, 184 aa, Diabrotica virgifera
  misc_feature: Coding regions on vcDNA: vcDNA=SeqID_2814; Strand=+; Position=726-1275
  misc_feature: Homolog annotation: Hit_ID=CAA10770.1; Match level="QueryCoverage =93%, HitCoverage=51%, E-value=9e-23, Identity=36%"; Hit description =reverse transcriptase-like [Bos taurus]
  misc_feature (53)..(53): Xaa can be any naturally occurring amino acid
  misc_feature (90)..(90): Xaa can be any naturally occurring amino acid
  misc_feature (99)..(99): Xaa can be any naturally occurring amino acid
  misc_feature (112)..(112): Xaa can be any naturally occurring amino acid
  misc_feature (132)..(132): Xaa can be any naturally occurring amino acid
  misc_feature (147)..(147): Xaa can be any naturally occurring amino acid
MATVAGRKISSLRFADGTTLIAINEQEMFDLLRRVEYESNKVGLKINKAETKXMVVDIFHTIKLTKMLQEYQIVDGFVYLGSSITNDRNXEAEVRRRTXYGKNAMSRLTKDXKDRSISQNIKMRLVNAPVFXNILIGGRYLDLRQKXDTFEMCWRRMLRIPWTAHRTNVSILNQLEIKKRLPTI

SEQ ID NO: 23118 - protein, 549 aa, Diabrotica virgifera
  misc_feature: Coding regions on vcDNA: vcDNA=SeqID_2815; Strand=+; Position=38-1686
  misc_feature: Homolog annotation: Hit_ID=AAC24982.2; Match level="QueryCoverage =97%, HitCoverage=53%, E-value=2e-62, Identity=29%"; Hit description =reverse transcriptase [synthetic construct]
  misc_feature: Gene Ontology Annotation: Molecular function=molecular_function unknown; Cellular component=cellular_component unknown; Biological process=biological_process unknown
  misc_feature: Pfam annotation: Pfam_ID=RVT_1; Match level="Score=138.8, E-value =1.3e-38, Copies=1"; Pfam description=Reverse transcriptase (RNA -dependent
  misc_feature (319)..(319): Xaa can be any naturally occurring amino acid
DKVIEAAKDCEAAVSTGRKPWISDNTWTVIQRRKEHKSRYGTNDEYRALSKEIRKQCRKDKADYISQICREIEEHGCRNEPRDLFQKIKLLTREFKPQTWSVIDKEGNLKTDTDEILETWRNYCGELYKNNEVSAENQWPSDYPREPTVLLAEVKDAIKSLKRNKSPGIDSIPCKILQLLGNKGLHIIHSICVAVWNSGKWPSDWCTSIYIPLHKKGTTTRCENYRTLSLITHASKILLHIIKNRLKTYLHYQIPQEQAGFVKGKGTREQILNLRQLIEKSREFQVPMIICFVDYQKAFDCVSWINLWSILIEMGAPMXLVTLIKNLYQSNIATVRLDQKFSNQFKTERGVRQGCVLSPDLFNIYGEHVMRMVLEGWAGGVTVAGRKISNLRFADDTTLIAANEQEMFDLLRRVEYESNKVGLKINKAKTKIMVVDRFDTIQLTNILQEYQIVNTFVYLGSSITNDGNCEAEVRRRIGMAKNAMSRLTKLWKDRSLSQNIKMRLVNALVFSIFLYGAESWTLRACERQKIDAFEMWCWEKNAAHTLDSS

SEQ ID NO: 23119 - protein, 236 aa, Diabrotica virgifera
  misc_feature: Coding regions on vcDNA: vcDNA=SeqID_2816; Strand=-; Position=1070 -1780
  misc_feature: Homolog annotation: Hit_ID=NP_501121.1; Match level="QueryCoverage =88%, HitCoverage=33%, E-value=5e-25, Identity=31%"; Hit description =predicted CDS, reverse transcriptase family member (4H911) [Caenorhabditis elegans]
  misc_feature: Gene Ontology Annotation: Molecular function=molecular_function unknown; Cellular component=cellular_component unknown; Biological process=biological_process unknown
  misc_feature: Pfam annotation: Pfam_ID=RVT_1; Match level="Score=85.5, E-value=1.5e- 22, Copies=1"; Pfam description=Reverse transcriptase (RNA-dependent
  misc_feature (67)..(67): Xaa can be any naturally occurring amino acid
  misc_feature (88)..(88): Xaa can be any naturally occurring amino acid
  misc_feature (197)..(197): Xaa can be any naturally occurring amino acid
TIYAKYCSDYRTISLISHTLKIFLKVIHGRLYRKLECDMDDTQFGFRKGLGTREALFAFNVLSQRCXDMNLFIYSCFIDFEKAFDRVXHEKLIELLKNRDIDRRDLRIIINLYWNQKANIKIEEQESENIDIKRGVRQGCVLSPLLFNLYSEAIFQEAIAELSDGISINGRIVNNIRLADDTVIMADTLESLQELLXRINDYCIGYGLKINQQKTKVMIFPETAHGRERLKYRPGH

SEQ ID NO: 23120 - protein, 281 aa, Diabrotica virgifera
  misc_feature: Coding regions on vcDNA: vcDNA=SeqID_2817; Strand=-; Position=559-1403
  misc_feature: Homolog annotation: Hit_ID=CAA10770.1; Match level="QueryCoverage =88%, HitCoverage=77%, E-value=4e-28, Identity=30%"; Hit description =reverse transcriptase-like [Bos taurus]
  misc_feature (77)..(77): Xaa can be any naturally occurring amino acid
  misc_feature (105)..(105): Xaa can be any naturally occurring amino acid
  misc_feature (173)..(173): Xaa can be any naturally occurring amino acid
  misc_feature (178)..(178): Xaa can be any naturally occurring amino acid
VRQGCVLSPLLFNLYSEAIFQEAIAELSDRISINGKIVNNTRFADDIVIMADTLGSLQELLNRINDYCIRYGLKINXEKKTKFMIVSKTEHGNERLILEQTRIEXVKTYKYLGTWVDDKNDQSKEIKVRIETARQAFIKMKTLLTNKDLQLPLRLRALRYYIFFILLYGMEAXSLKLXRILKIQWVQRITNVEVLRRLNKELEIMKSIKTRKLEYLGHITRGEKYELLRVIMQEKIQGRRSIGRRRISWLRNLREWFNCSSLQLFRAAANKVTAIMISNLR

SEQ ID NO: 23121 - protein, 64 aa, Diabrotica virgifera
  misc_feature: Coding regions on vcDNA: vcDNA=SeqID_2818; Strand=+; Position=635-829
INQLTKLPKKTIMWQSPEKKKRGRPPQSWNLGVRKAISARNLNEDLTQDRIQWRLGVGQRRKSL

SEQ ID NO: 23122 - protein, 511 aa, Diabrotica virgifera
  misc_feature: Coding regions on vcDNA: vcDNA=SeqID_2819; Strand=+; Position=477-2012
  misc_feature: Homolog annotation: Hit_ID=XP_318329.1; Match level="QueryCoverage =72%, HitCoverage=52%, E-value=7e-35, Identity=26%"; Hit description =ENSANGP00000014151 [Anopheles gambiae]
  misc_feature: Pfam annotation: Pfam_ID=zf-CCHC; Match level="Score=29.1, E-value =1.3e-05, Copies=2"; Pfam description=Zinc knuckle
MDTNITDTTSTTTLPTTAGTNTSSSTTTTIVAPATAPVMSTQVSTFQFSVEPFNQTATKWSRWVKRLEGAYKVFKIPEEMKLPYLLHYMGSEAYDTLCDKLAPEVPEDKSYEDTVKLMDNFYNPAPLEIAEIFRFQSKRQAEGESIQEYLHSLQKLAINCNFSTYLKSAIRNQFVFGLQSKRIQARLLETKGLDLDRAVEIAASMETSEKDSNQFSHNNNYNQASINVLNAKAKSFHKNTNTSKFNDNNTVNNHSSSPNNTFTMSNNRNRACYRCGDTSHLADKCNKKHLICNFCKNVGHIQKVCLKAQQNSHRQVNSVNSAQEVLEVNAGNCKDKFFINLKVNGNILNFEIDSGAAVTIINKNIFEKYFPALQLQKSDVKLTTYCKNNLNVLGLVSVEVEHQELKHTLKLYVVDGDGYSLVGREWIHALEINLHQVIQFYMVEDKVMEELMEESGQPLRPTMLDAILLLILPFPMIFEIATLLDKYKHLFEKSVGEIKRLKAEIYLKPWN

SEQ ID NO: 23123 - protein, 342 aa, Diabrotica virgifera
  misc_feature: Coding regions on vcDNA: vcDNA=SeqID_2820; Strand=+; Position=3-1029
  misc_feature: Homolog annotation: Hit_ID=S08405; Match level="QueryCoverage=87%, HitCoverage=26%, E-value=1e-59, Identity=39%"; Hit description =hypothetical protein 2 - silkworm transposon mag
  misc_feature: Pfam annotation: Pfam_ID=rve; Match level="Score=123.2, E-value=6.4e -34, Copies=1"; Pfam description=Integrase core domain
  misc_feature (290)..(290): Xaa can be any naturally occurring amino acid
GQRVVIPTKLRNKILTELHTAHFGIVRMKSLARSYCWWPHIDQDIESLCKNCLECNKHKNNPIKDNSHIWEPPKFCFERVHADYAGPFNGGYYFILVDSFSKWPEIHFTKNTTTKTTIEICRKIFTTFGIPKVFVTDNGRQFDSHEFRTFMKDNGITQKFTAPYHPATSGQGERYVQILKKCLRAMRSEGNDREFELCKLLMQYRRSPHTVTGKSPSELMLGRQIRNRLDLLKPSCSDRVTYTDMSLRNFDIGTRVSVRDYFHSKWQFGIIVLRLGLLHYLIQLDDGRTXKRHVDQIRQFGEYTPSQNKPTCYIPDTITHLIPREASIPEHSVSHHLPKVIL

SEQ ID NO: 23124 - protein, 216 aa, Diabrotica virgifera
  misc_feature: Coding regions on vcDNA: vcDNA=SeqID_2821; Strand=+; Position=93-743
  misc_feature: Homolog annotation: Hit_ID=XP_309688.1; Match level="QueryCoverage =75%, HitCoverage=88%, E-value=3e-47, Identity=51%"; Hit description =ENSANGP00000023551 [Anopheles gambiae]
  misc_feature: Pfam annotation: Pfam_ID=rve; Match level="Score=114.0, E-value=3.7e -31, Copies=1"; Pfam description=Integrase core domain
MKSLARSYCWWPHIDQDIESLCKNCLECNKHKNNPIKDNSHIWEPPKFCFERVHADYAGPFNGGYYFILVDSFSKWPEIHFTKNTTTKTTIEICRKIFTTFGIPKVFVTDNGRQFDSHEFRTFMKDNGITQKFTAPYHPATNGQGERYVQILKKCLRAMRSEGNDREFELCKLLMQYRRSPHTKSLFKGTTKFTQASKFSKLCSRGLRSKCWKLQR

SEQ ID NO: 23125 - protein, 530 aa, Diabrotica virgifera
  misc_feature: Coding regions on vcDNA: vcDNA=SeqID_2822; Strand=+; Position=2-1593
  misc_feature: Homolog annotation: Hit_ID=XP_309276.1; Match level="QueryCoverage =100%, HitCoverage=59%, E-value=1e-124, Identity=44%"; Hit description=ENSANGP00000011407 [Anopheles gambiae]
  misc_feature: Gene Ontology Annotation: Molecular function=kainate selective glutamate receptor activity; Cellular component=integral to plasma membrane; Biological process=synaptic transmission
  misc_feature: Pfam annotation: Pfam_ID=Lig_chan; Match level="Score=129.5, E-value =8e-36, Copies=1"; Pfam description=Ligand-gated ion channel
  misc_feature (512)..(512): Xaa can be any naturally occurring amino acid
  misc_feature (519)..(519): Xaa can be any naturally occurring amino acid
NVILDCKTENILPILAQAKSLDMVDIRYNYFLTSLDAHTIDFSSLNVTANITTIRIFDSDNENFLSAIQKWNIAAVEFNRKTMTIDPDTLKTETLLFHDALVYLSTTLKDMPYISNAKVNCFGMDIYLDGPDIIRSTKEKNDLATITGPIKFDDSGNREYFNLYVYTQLDDQLIATYIAENETLKLMRTSEETNLAAISSLKKVNVIVSTRVGEPYLMLAESPDGKILEGNDRYEGYTKDLMNEIAAILEFKYEIMITENNVYGKYLADEKRWNGLIGDLLEGNAHLALCDLTINQQRRSIVDFSMPFMTLGISILHKSPQKSDSKPFAFLDPFDTSVWIYSATTYLVVSIILFFIARMTPGDWENPHPCDQEPTMAENIWSLRNCHWATLGTIMNQGCDILPKGISTRLALAMWWFFALIITNSYIANLTAFLTKANLDSPIKSVDDLGKQSKIKYGFLEGGATEQFFRESNNSLYQRMYLNMKSARPSVLETDNLDGVQRVQNTKNELYXFLMESTXIEYHTATKCNL

SEQ ID NO: 23126 - protein, 247 aa, Diabrotica virgifera
  misc_feature: Coding regions on vcDNA: vcDNA=SeqID_2823; Strand=+; Position=179-919
  misc_feature: Homolog annotation: Hit_ID=XP_395580.1; Match level="QueryCoverage =64%, HitCoverage=19%, E-value=2e-16, Identity=32%"; Hit description =similar to CG8830-PA [Apis mellifera]
MAVKQKVVECATPTKEARLQIILRALQGLSANDGLQDKFCAQVVRSLGTVPIPSDPGSYMKFVEDIKKVQNILSKECSEHVFIALKALLDEISNPDPQKQLSPAMSIVLQLIDEATIPNAVKYILNCGYPEQHLEKAFFTLSIWLTQCFWVENLGPLVLAFMKGLEAEHHYEILIEVTLVTIEPLFKLVMFPKIRKSVGVVLYMLSRNQHNNPQIFHKTIPLAKTGCDKLDKERSDSRLRFLQEIVQ

SEQ ID NO: 23127 - protein, 104 aa, Diabrotica virgifera
  misc_feature: Coding regions on vcDNA: vcDNA=SeqID_2824; Strand=-; Position=2-313
CLNVLDIQGTFGEHLIKLLVECYHKTFYEHTTNVLYFKRGHLLFNLRSFSNLPRVYLFGQSKPRDFWLAYKKLEVMYVSNIYFSLFIVVFCLFWISFAVFCELY

SEQ ID NO: 23128 - protein, 183 aa, Diabrotica virgifera
  misc_feature: Coding regions on vcDNA: vcDNA=SeqID_2825; Strand=+; Position=484-1030
  misc_feature: Homolog annotation: Hit_ID=XP_393302.1; Match level="QueryCoverage =74%, HitCoverage=36%, E-value=2e-44, Identity=66%"; Hit description =similar to ENSANGP00000022338 [Apis mellifera]
  misc_feature: Pfam annotation: Pfam_ID=Patatin; Match level="Score=0.9, E-value =1.1e-05, Copies=1"; Pfam description=Patatin-like phospholipase
  misc_feature (150)..(150): Xaa can be any naturally occurring amino acid
  misc_feature (164)..(164): Xaa can be any naturally occurring amino acid
MKIRRIEDLISHLEQYPEAKHNAVKEGGIRSLLKIRDTTKNPQLLSSLNVAITLLGYTDPVPGVGIRILSIDGGGVRGILVIEMLRKLEELSGKPIYEMFDFICGVSTGAIIATLSGLKQKSLDEISEIYKSISTQIFNQSAFFGTSNLXVWSHSYYDTPLWEXLLQEQWQDMLLIETRRNLK

SEQ ID NO: 23129 - protein, 451 aa, Diabrotica virgifera
  misc_feature: Coding regions on vcDNA: vcDNA=SeqID_2826; Strand=+; Position=21-1373
  misc_feature: Homolog annotation: Hit_ID=XP_393302.1; Match level="QueryCoverage =53%, HitCoverage=65%, E-value=5e-94, Identity=69%"; Hit description =similar to ENSANGP00000022338 [Apis mellifera]
  misc_feature: Gene Ontology Annotation: Molecular function=transcription factor activity; Biological process=regulation of transcription, DNA -dependent
  misc_feature: Pfam annotation: Pfam_ID=Patatin; Match level="Score=156.1, E-value =8.1e-44, Copies=1"; Pfam description=Patatin-like phospholipase
  misc_feature (416)..(416): Xaa can be any naturally occurring amino acid
MQAKNIVLNQWRLINELKKYFSKFTNDKTFETALNKEFAQFLQKIDSKTYGKGLVKYFTSQSTDIVKNTPMHETKVEKDVKQEQSIPSRLSLPIQNVLSGLSINIKSKEDEKKEIIPRWKTVTKPIVSQEAIGARTSQILVSISLADNETMKIRRIEDLISHLEQYPEAKHNAVKEGGIRSLLKIRDTTKNPQLLSSLNVAITLLGYTDPVPGVGIRILSIDGGGVRGILVIEMLRKLEELSGKPIYEMFDFICGVSTGAIIATLSGLKQKSLDEISEIYKSISTQIFNQSAFFGTSNLVWSHSYYDTPLWEKLLQEQWQDMLLIETRRNLKVPKFCAVSAVVNQSRLSAYIFRNYSLPCKVQSQYKGGYNHQVWEAVRASAAAPTYFEEFKIGNMLHQDGGILVNNPTAVAIHEXKLLWPNTPIQCVLSFGTGRTVPPVLSWYQDKDATI

SEQ ID NO: 23130 - protein, 133 aa, Diabrotica virgifera
  misc_feature: Coding regions on vcDNA: vcDNA=SeqID_2827; Strand=+; Position=102-503
  misc_feature: Homolog annotation: Hit_ID=XP_392526.1; Match level="QueryCoverage =96%, HitCoverage=93%, E-value=5e-42, Identity=67%"; Hit description =similar to ENSANGP00000011255 [Apis mellifera]
MAFMMPVVKNDWDIYKANRSRRVSECANPTSCRSRKVSECKSEGPSLSTSPGSEFVTSPIRSSVPSNMSSRQYSRASSRTSETSLPSPVRHMSVGSSPPKNDSEPTLNKFHNRLLDKLKKSLRSGSESEKTSS

SEQ ID NO: 23131 - protein, 258 aa, Diabrotica virgifera
  misc_feature: Coding regions on vcDNA: vcDNA=SeqID_2828; Strand=+; Position=20-796
VIVLFTSPFVRFLVILSSVVATVWTLFAAGLYFYHYIIEVVLDLPLTGQQSPCTAHAALKQLIEKLLQEVANLPQLQRPQQGTAIPPDLNNRTYEDLLATAILNKVISNSQNARPSSSAASVSSRISNSSHIKEDKGFFFGEETLDSKWRHPDVETTSVSSIEDWLHTDSSFGSRKYVDRVTLTIKQDIEEVSHASDSDHEGNEDDDNEYFRSKSSFWSDDEPNWFLQKRTFQGTHSPVPVPMLVPNPTIESKVLIRR

SEQ ID NO: 23132 - protein, 463 aa, Diabrotica virgifera
  misc_feature: Coding regions on vcDNA: vcDNA=SeqID_2829; Strand=+; Position=163-1554
  misc_feature: Homolog annotation: Hit_ID=NP_724587.2; Match level="QueryCoverage =89%, HitCoverage=48%, E-value=4e-22, Identity=25%"; Hit description =CG30492-PB, isoform B [Drosophila melanogaster] ref|NP_724586.2| CG30492-PA, isoform A [Drosophila
MRKIFIEWILQEKVFLVREGIWKMPADMVSFAVSTGLGVSVVAGIISGVCYVLAYGSQRKSSRKSKSNLHCDVCGEYFRSIDHILGGDCSVSCSKCQKNVCQKRCANFDEQQNVWTCKNCLRPPESWFQGILYAIQPNKKDFSMDSNNVMESSQLKNKDHVQKSKEQVQDFIEKLVNSMLGQNIDDANITKMYNDEHYLPLTGQQSPCTAHAALKQLIENLQEVALPQLQRPSQTAIPPDLNNRTYEDLLATAILNKVISNSQNARPSSSAASVSSRISNSSHIKEDKGFFFGEETLDSKWRHPDVETTSVSSIEDWLHTDSSFGSRKYVDRVTLTIKQDIEEVSHASDSDHEGNEDDDNEYFRSKSSFWSDDEPNWFLQKRTFQGTHSPVPVPMLVPNPTIEAKVLIGDKEVDDTSDLSDVESEYGDTEIVPARHSLLVNSKTLIGGKNPLQNGSRRCGIRK

SEQ ID NO: 23133 - protein, 536 aa, Diabrotica virgifera
  misc_feature: Coding regions on vcDNA: vcDNA=SeqID_2830; Strand=+; Position=1-1611
  misc_feature: Homolog annotation: Hit_ID=XP_392563.1; Match level="QueryCoverage =97%, HitCoverage=15%, E-value=0.0, Identity=63%"; Hit description =similar to ENSANGP00000021969 [Apis mellifera]
  misc_feature: Gene Ontology Annotation: Molecular function=transketolase activity; Biological process=fertilization (sensu Animalia)
  misc_feature: Pfam annotation: Pfam_ID=Transket_pyr; Match level="Score=186.0, E -value=7.9e-53, Copies=1"; Pfam description=Transketolase, pyridine binding domai
VVAAADLKKLRQLGCDLEGHPTPRLNFIDVGTGSLGQGLAVAAGMAYLGKYIEEAPYRVYCLIGDGESAEGSIWESVNFASHYGLDNLVLILDANRLGQTQPTMVGHQIDIYKRRLEAFDFNTIAVDGHDIGALVQAFDAAASVKGRPTAIIAKTYKGRDFPDIEDKENWHGKPLGGETEKILKHLKGLIRNQGKLKYNIPPPLAEVAPVSINNVRLSSPPNYKQGQMMATRAAYGNALVKLAETNPRVVALDGDMSNSTFSEAMKKFGPKNFIECFIAEQNLVGVAMGISCRDRTIAFVSTFAAFFTRAFDQIRMAAISQSNINICGSHCGVSIGEDGPSQMALEDLAMFRSVPGSTVFYPSDVVSVERAVELAANTKGITFIRTARAPTAVVYPNDQVFEVGKALVPISSNKDQALIIAAGITLHESLIAAKDMAKAGIHVRVMDPFTIKPIDKQGIINNAHQAGNRILVVEDHYPEGGIGEAVLSALAEERNIIVKHVAIPRVPRSGRPADLLNYYKIDAKNIVNHVDELLKK

SEQ ID NO: 23134 - protein, 332 aa, Diabrotica virgifera
  misc_feature: Coding regions on vcDNA: vcDNA=SeqID_2831; Strand=+; Position=56-1054
  misc_feature: Homolog annotation: Hit_ID=XP_392563.1; Match level="QueryCoverage =93%, HitCoverage=9%, E-value=1e-113, Identity=61%"; Hit description =similar to ENSANGP00000021969 [Apis mellifera]
  misc_feature: Gene Ontology Annotation: Molecular function=transketolase activity; Biological process=fertilization (sensu Animalia)
  misc_feature: Pfam annotation: Pfam_ID=Transketolase_N; Match level="Score=227.1, E- value=3.4e-65, Copies=1"; Pfam description=Transketolase, thiamine diphosphate b
MAGTATDLQTLKDLATRIRIHSVESTTLAGSGHPTTSSSIADILSVLFFRTMRYKVSAPRDPSSDRFVLSKGHAAPALYGAWVENGVVAAADLKKLRQLGCDLEGHPTPRLNFIDVGTGSLGQGLAVAAGMAYLGKYIEEAPYRVYCLIGDGESAEGSIWESVNFASHYGLDNLVLILDANRLGQTQPTMVGHQIDIYKRRLEAFDFNTIAVDGHDIGALVQAFDAAASVKGRPTAIIAKTYKGRDFPDIEDKENWHGKPLGGETEKILKHLKGLIRNQGKLKYNIPPPLAEVAPVSINNVRLSSPPTYKQGKKMAHKSSLKKRPPSALFCS

SEQ ID NO: 23135 - protein, 264 aa, Diabrotica virgifera
  misc_feature: Coding regions on vcDNA: vcDNA=SeqID_2832; Strand=+; Position=216-1007
  misc_feature: Homolog annotation: Hit_ID=XP_393163.1; Match level="QueryCoverage =93%, HitCoverage=23%, E-value=6e-69, Identity=46%"; Hit description =similar to LIM domain protein [Apis mellifera]
  misc_feature: Gene Ontology Annotation: Molecular function=molecular_function unknown; Cellular component=actin cytoskeleton; Biological process =biological_process unknown
  misc_feature: Pfam annotation: Pfam_ID=LIM; Match level="Score=63.0, E-value=8.4e -16, Copies=1"; Pfam description=LIM domain
  misc_feature (227)..(227): Xaa can be any naturally occurring amino acid
MEMEGTQIDMTNCKACAKQVFQMEQIKAEKAVWHKNCFRCTECSKQLTVETYASHEGTLYCKPHFKSLFAPKAVEDDTPSSDKPDLGLEELQSLNVKERFQVFQQTQSETQEMDRGPTPVNVKKSPSILSKLARFQAKGMDVGVSDEALNGIPIEESSSEAEEEEEEVPEGEDPTLYRAKRVQKEKPFHFTNLNEVKNKWEQGEQNSKDERREERKQEIQSIRNKLXLGKQGKMKEAYQQAVIQSESCTNLVKSEKIESCDTSL

SEQ ID NO: 23136 - protein, 225 aa, Diabrotica virgifera
  misc_feature: Coding regions on vcDNA: vcDNA=SeqID_2833; Strand=+; Position=90-767
  misc_feature: Homolog annotation: Hit_ID=XP_393163.1; Match level="QueryCoverage =88%, HitCoverage=15%, E-value=2e-49, Identity=50%"; Hit description =similar to LIM domain protein [Apis mellifera]
LVTTMHPEASDKPDLGLEELQSLNVKERFQVFQQTQSETQEMDRGPTPVNVKKSPSILSKLARFQAKGMDVGVSDEALNGIPIEESSSEAEEEEEEVPEGEDPTLYRAKRVQKEKPFHFTNLNEVKNKWEQGEQNSKDERREERKQEIQSIRNKLFLGKQGKMKEAYQQAVIQSESCTNLVKSEKIESCDTKSLKERFEKGELVIEREDSRNGDSDDTEVFQKRN

SEQ ID NO: 23137 - protein, 277 aa, Diabrotica virgifera
  misc_feature: Coding regions on vcDNA: vcDNA=SeqID_2834; Strand=+; Position=192-1023
  misc_feature: Homolog annotation: Hit_ID=NP_608675.1; Match level="QueryCoverage =92%, HitCoverage=76%, E-value=1e-73, Identity=52%"; Hit description =CG3609-PA [Drosophila melanogaster] gb|AAF51262.1| CG3609-PA [Drosophila melanogaster]
  misc_feature: Gene Ontology Annotation: Molecular function=electron transporter activity; Biological process=carbohydrate metabolism
  misc_feature: Pfam annotation: Pfam_ID=GFO_IDH_MocA; Match level="Score=91.4, E -value=2.4e-24, Copies=1"; Pfam description=Oxidoreductase family, NAD-binding Ro
  misc_feature (248)..(248): Xaa can be any naturally occurring amino acid
  misc_feature (250)..(250): Xaa can be any naturally occurring amino acid
  misc_feature (261)..(261): Xaa can be any naturally occurring amino acid
MLLKWGIAAAGKISNDFVTALKALPLTEHKVVAIASRSQSNSDKFAKTHGIPNAYEGYDKLAKDENVNIVYVGVLNPQHYEVVKLMLENGKHVLCEKPFTMNEKQTRKLLDISKEKNLFLMEAVWSRFFPAYDKMIEVIKSGEIGEVVQVTVEFGVPISHVDRIKNKDLGGGVILDLGVYILQFQQYVFNGLKPTKVVASGHLNEEGIDSSVAAILTFPEGKTAVLSASSFTKLACEGVVYGTKGCIXCXKFWCPTTLEVXGVVIEFPDKNEGEFIT

SEQ ID NO: 23138 - protein, 89 aa, Diabrotica virgifera
  misc_feature: Coding regions on vcDNA: vcDNA=SeqID_2835; Strand=+; Position=721-987
QSILSLNLHECVFPDVTPSFYFSLDFSILIFSWQRFHCIYIHVSLLQYTVRCKNIDPRLFVREEEKFGVYFIWQFSTYYYINRLQVSSK

SEQ ID NO: 23139 - protein, 287 aa, Diabrotica virgifera
  misc_feature: Coding regions on vcDNA: vcDNA=SeqID_2836; Strand=+; Position=99-962
  misc_feature: Homolog annotation: Hit_ID=XP_317731.1; Match level="QueryCoverage =99%, HitCoverage=38%, E-value=3e-71, Identity=47%"; Hit description =ENSANGP00000010297 [Anopheles gambiae]
  misc_feature: Gene Ontology Annotation: Molecular function=enoyl-CoA hydratase activity; Cellular component=mitochondrion; Biological process=growth
  misc_feature: Pfam annotation: Pfam_ID=ECH; Match level="Score=177.6, E-value=2.7e -50, Copies=1"; Pfam description=Enoyl-CoA hydratase/isomerase family
MSTIRFLGALSRTSKNYIQAYNLCQTRCMSSLELKHFKLKVVDNVGVITIDSPGVKVNSLNEDVLKEIELLLPKIQNDSQIQAAVIISGKPGVFIAGADVNMLETWNDADEGMQNCLRGHKLLQDIEDSKKPFISAIQGSCFGLGAELALATHYRIGVKDKKTSIALPEIMLGLLPGCGGTQRLPRLLSLPNAMDLILTGKALRADKAKKMGVLDLLVDPLGPGLDTPEANTAKYLETVAIGVAKDLASGKLVPKREKSLTDKILAYALQFYFVKDQAINNDREYVA

SEQ ID NO: 23140 - protein, 302 aa, Diabrotica virgifera
  misc_feature: Coding regions on vcDNA: vcDNA=SeqID_2837; Strand=+; Position=1-909
  misc_feature: Homolog annotation: Hit_ID=XP_392328.1; Match level="QueryCoverage =91%, HitCoverage=21%, E-value=1e-77, Identity=48%"; Hit description =similar to ENSANGP00000021850 [Apis mellifera]
  misc_feature: Gene Ontology Annotation: Molecular function=protein binding; Cellular component=basement membrane; Biological process=cell-matrix adhesion
  misc_feature: Pfam annotation: Pfam_ID=Ldl_recept_b; Match level="Score=131.5, E -value=2e-36, Copies=3"; Pfam description=Low-density lipoprotein receptor repe
VRHDRSSEHRIKVKKPVQVKAYQTAVGLDVDCLEGRIYWSDISGRAISSSALDGTDKEHFIVNDIGSPEGLAIDWVARNVYWTDSTLDTIEVANIESKLRRTLFNTGLVNPRGIAVHPQRGKIFWTDWNRKDPKIEWSNADGSDRRIFLQGSDVSLPNSLTIDFETEQLCYADAGTKKIECVNIDSKQKQTIASNCTYPFGITTTDKEIFWSDWITKKKIERVEKYNLKRLPPLPVPLGGTGNRLFALVAVANKCPSLTNVCEYYKNQCPKDHICLPNGLGGKQCLCGKDSQNNDVTPSCNL

SEQ ID NO: 23141 - protein, 68 aa, Diabrotica virgifera
  misc_feature: Coding regions on vcDNA: vcDNA=SeqID_2838; Strand=+; Position=518-724
KIYFAVVSKSAVASNVVSGRTVNSSRQKVLINIFVENHLCYISCLKHFFYGVQILGKSIYPPPLGERF

SEQ ID NO: 23142 - protein, 165 aa, Diabrotica virgifera
  misc_feature: Coding regions on vcDNA: vcDNA=SeqID_2839; Strand=+; Position=3-497
HTSAHINDKITLPNAQATEIVISKALESIMSAPLAVSDNVPNQICETCKNQIIFIATSRFAFEKANAILQLHSAGRLEKKPINKQNTIERDNTEINNLPQCKVEEIDIFEEPLIDLQSPEQIDYELVDSVNDDLVSDGDSHESDKSVAYVSKVDPVLLRPDISIE

SEQ ID NO: 23143 - protein, 317 aa, Diabrotica virgifera
  misc_feature: Coding regions on vcDNA: vcDNA=SeqID_2840; Strand=+; Position=100-1048
  misc_feature: Homolog annotation: Hit_ID=EAA01744.2; Match level="QueryCoverage =94%, HitCoverage=32%, E-value=1e-146, Identity=88%"; Hit description= ENSANGP00000013886 [Anopheles gambiae str. PEST] ref|XP_551577.1| ENSANGP00000013886 [Anopheles gambiae s
  misc_feature: Gene Ontology Annotation: Molecular function=transporter activity; Cellular component=Golgi trans face; Biological process =neurotransmitter secretion
  misc_feature: Pfam annotation: Pfam_ID=HEAT; Match level="Score=47.9, E-value=3e -11, Copies=2"; Pfam description=HEAT repeat
  misc_feature (244)..(244): Xaa can be any naturally occurring amino acid
MTDSKYFTTTKKGEIFELKSELNNDKKEKKKEAVKKVIASMTVGKDVSALFPDVVNCMQTDNLELKKLVYLYLMNYAKSQPDMAIMAVNTFVKDCEDPNPLIRALAVRTMGCIRVDKITEYLCEPLRKCLKDEDPYVRKTAAVCVAKLYDISSGLVEDQGFLEQLKELLSDSNPMVVANAVAALSEINESSPTGQPLVELSTNTINKLLTALNECTEWGQVFILDSLSNYTPRDEREAQSICEXRITPRLAHANAAVGLSAGKVLIKMMEILAGETDFLHTLSKKKTPPLGNVVYSEPKRGKGGFMKIYFFFSKKTP

SEQ ID NO: 23144 - protein, 286 aa, Diabrotica virgifera
  misc_feature: Coding regions on vcDNA: vcDNA=SeqID_2841; Strand=+; Position=2-860
  misc_feature: Homolog annotation: Hit_ID=XP_396938.1; Match level="QueryCoverage =91%, HitCoverage=32%, E-value=2e-85, Identity=59%"; Hit description =similar to vacuole 14 protein; Vac14 protein; hydin [Apis mellifera]
  misc_feature: Gene Ontology Annotation: Molecular function=receptor activity; Cellular component=cellular_component unknown; Biological process =signal transduction
  misc_feature: Pfam annotation: Pfam_ID=HEAT; Match level="Score=36.4, E-value=8.3e -08, Copies=3"; Pfam description=HEAT repeat
  misc_feature (95)..(95): Xaa can be any naturally occurring amino acid
FIPLLRERIYTKNPFSRQFIISWISVLNSEPGLDLISYLPELLDGLFRILDDSNLEVKKMCETILGEFLRKIKAEPSNVNFGGMINILINHAQEXGDLVQFTAITWIKEFVQLSGPAMLPYMSGIFTAVLPCLSYDTEARRNIKETATAVNFTLMKLISLKADTEEIIRPTAVCDDKMPNELDLHSVLDVLNQYLMHNSIQTKVAVLKWIHDLYTKLPNKMGEYFDILFPALQRTLSDESDQVVQQCLVVIAEVISSPGPEEVNNRGANSYYNFMSLFLFNNEKRL

SEQ ID NO: 23145 - protein, 287 aa, Diabrotica virgifera
  misc_feature: Coding regions on vcDNA: vcDNA=SeqID_2842; Strand=-; Position=367-1230
  misc_feature: Homolog annotation: Hit_ID=XP_311847.1; Match level="QueryCoverage =94%, HitCoverage=35%, E-value=3e-65, Identity=40%"; Hit description =ENSANGP00000017544 [Anopheles gambiae]
  misc_feature: Gene Ontology Annotation: Molecular function=molecular_function unknown; Cellular component=cellular_component unknown; Biological process=regulation of transcription, DNA-dependent
  misc_feature: Pfam annotation: Pfam_ID=PHD; Match level="Score=79.1, E-value=1.2e -20, Copies=2"; Pfam description=PHD-finger
MATVKYDLDTSGGLMNQIQALIAPPKSDDNDENDSKKPEHPYYKRPGKGHNHDSCDACGEGGDLICCDKCPYSFHFGCHDPPLEEKDIPMGEWLCQSCRYYKKQSSSNSEVPQLRSKRSNSTPPSSSVAKCPSKKQKLSPMEVLIEAANAMNPKQFELPRSMSVPCVFPGTDKVEIPYSKVGRKTFKMSKAHEKGPGGTVPLPAKKCSECRRSCRVAPLISCDFCESFYHLDCLDPPLTNPPSGMWMCPQHVEHCLVDPHVLLYIRIFPNPPLWEKDDSFYFILRRP

SEQ ID NO: 23146 - protein, 525 aa, Diabrotica virgifera
  misc_feature: Coding regions on vcDNA: vcDNA=SeqID_2843; Strand=+; Position=142-1719
  misc_feature: Homolog annotation: Hit_ID=AAR97606.1; Match level="QueryCoverage =98%, HitCoverage=97%, E-value=1e-130, Identity=44%"; Hit description= cytochrome P450 9E1 [Diploptera punctata]
  misc_feature: Gene Ontology Annotation: Molecular function=cytochrome P450 activity; Cellular component=membrane; Biological process=electron transport
  misc_feature: Pfam annotation: Pfam_ID=p450; Match level="Score=213.5, E-value=4e -61, Copies=1"; Pfam description=Cytochrome P450
MLQLVLVLAALAVLFYYFAVKPMSYWKERGIKQTKPVWLLGDSWGTVIKKHSLVDFVQYIYDQVPSVRYFGCYQMVTPTLVIRDPDLIKNIAVKDVDHFMDHRQMIPANADPLFGKNLFALKGQVWRDTRPILSPTFTSSKMRAMFVLMSECGENFIKYFQNNNKDIIEMEMKDTFRRFTNDVIATTAFGVKTDSLKDRDNEFFTMGTRAVDFGFWRSLKFFGYFLIPKILAFFKVSIFGKELSDFFIELIDKTVRTREERGIVRPDMIHLLMEAKKGVQQKDEKVIDTGFAVVEEADLGNAKGAIEITNVDIAAHAMVFFFAGFDAVSSLMCFTTYELAVNPDIQNRLREEVEDTLRECNGKLTYEGLLKMKYLDMVVSETLRKWPIGVMADRICTKPYTIPAATPEEKPLVLEKNTVLLFPVWAIHRDPAFYENPERFDPERFNDENKSKINPYTYLPFGIGPRNCIGSRFALLEAKVVLFYLLSNFIVEPSARLTVPLKISRKQINVTAEGGFWFNLKKLKN

SEQ ID NO: 23147 - protein, 78 aa, Diabrotica virgifera
  misc_feature: Coding regions on vcDNA: vcDNA=SeqID_2844; Strand=-; Position=428-664
YTYNHKIYKKNKKRITCLGLEPTSRLPRRTKVDGISNCTTFACTSCGNIHKLNVYTINLYEFNKIISLIFVEIKYNKT

SEQ ID NO: 23148 - protein, 89 aa, Diabrotica virgifera
  misc_feature: Coding regions on vcDNA: vcDNA=SeqID_2845; Strand=-; Position=299-568
YIYNYYVPVAFKNYLNVTTIINIFVSVLTTIKLIYYTFVYLHIEQLFIIDRSFQHPIRPRITTNTILSVCACAQININSPSISIAPKEV

SEQ ID NO: 23149 - protein, 87 aa, Diabrotica virgifera
  misc_feature: Coding regions on vcDNA: vcDNA=SeqID_2846; Strand=-; Position=144-407
FTTDWCFNFHSGSLSTLYKNLSRILGVDAKFLSKIKDANRISNCLRNFLLFLLLTLDTHICCNICVCGIINIYLKRYFVSFYRIKNR

SEQ ID NO: 23150 - protein, 163 aa, Diabrotica virgifera
  misc_feature: Coding regions on vcDNA: vcDNA=SeqID_2847; Strand=-; Position=178-672
  misc_feature: Homolog annotation: Hit_ID=XP_394538.1; Match level="QueryCoverage =98%, HitCoverage=15%, E-value=1e-40, Identity=50%"; Hit description =similar to ENSANGP00000014764 [Apis mellifera]
  misc_feature: Gene Ontology Annotation: Molecular function=monocarboxylic acid transporter activity; Cellular component=integral to plasma membrane; Biological process=ommochrome biosynthesis
  misc_feature (12)..(12): Xaa can be any naturally occurring amino acid
  misc_feature (35)..(35): Xaa can be any naturally occurring amino acid
  misc_feature (48)..(48): Xaa can be any naturally occurring amino acid
FGVTNIVSRLAXGYLADFPAVNNFLVNNCPLIVSXVSTAAMPLFSSFXALAFLSVLFGVGIAGYISLTSIILVEFLGLDKLTNAFGLMILFRGAAALFGTPLAGTIYDLTKSYTIPFFVCAAGFGIASIISMSTPCFNKKVKEVDGEVLAPMNVTEEKDQNIV

SEQ ID NO: 23151 - protein, 314 aa, Diabrotica virgifera
  misc_feature: Coding regions on vcDNA: vcDNA=SeqID_2848; Strand=-; Position=142-1203
  misc_feature: Homolog annotation: Hit_ID=AAQ11973.1; Match level="QueryCoverage =97%, HitCoverage=98%, E-value=3e-43, Identity=33%"; Hit description =putative gut cathepsin L-like cysteine protease [Callosobruchus maculatus]
  misc_feature: Gene Ontology Annotation: Molecular function=cysteine-type peptidase activity; Cellular component=lysosome; Biological process=protein catabolism
  misc_feature: Pfam annotation: Pfam_ID=Peptidase_C1; Match level="Score=83.4, E -value=6.2e-22, Copies=1"; Pfam description=Papain family cysteine protease
  misc_feature (54)..(54): Xaa can be any naturally occurring amino acid
  misc_feature (65)..(65): Xaa can be any naturally occurring amino acid
FVIFDFIFVAANREYQEREKFKTKYSKVYATLVEESQRFAIFQENLKLIKEHNXKYEKHETSFTXEITRFSDKSYKELTRSIYPYRHFENFEDDDDVPESVDLRLKGYVLPPRDMGDLEEHWAFSISSAMEIETAWHNLTYEYLSTQFLIDCTESYQEAYNQMYYDGIPSEIDYPFKNGKGECKPICKGRCLNHNYLSSEDLIKKTIALLAPVTIYFDGGDLPFYKQGIIDGSNCPRSFIPHPSTWRKPWSAVIIGYGNDGSDGSGTDYWILKNSWGDSWGEEGYFKLIRGKEACGMMRLPIWPSLQEPNGSCD

SEQ ID NO: 23152 - protein, 74 aa, Diabrotica virgifera
  misc_feature: Coding regions on vcDNA: vcDNA=SeqID_2849; Strand=-; Position=448-672
RRNTRAKLTEMFFANYKLILTKTGTSFRGSVVREPTFEPNKFESSLGRNFVFTKPNLLSNNPFTQHTLHITPPR

SEQ ID NO: 23153 - protein, 187 aa, Diabrotica virgifera
  misc_feature: Coding regions on vcDNA: vcDNA=SeqID_2850; Strand=-; Position=798-1362
  misc_feature: Homolog annotation: Hit_ID=XP_395927.1; Match level="QueryCoverage =100%, HitCoverage=52%, E-value=3e-43, Identity=43%"; Hit description= similar to ENSANGP00000016547 [Apis mellifera]
  misc_feature: Gene Ontology Annotation: Molecular function=protein kinase activity; Cellular component=nuclear membrane; Biological process=microtubule -based process
  misc_feature (21)..(21): Xaa can be any naturally occurring amino acid
GYPPFYGKCGRDRGRERGDNXNACQELLFQSIQEGRYDFPEPEWTTISDEARDLISSLLVKNASERISAEKVLQHPWLQCASDTAALTTPAVIKKNNSALELSQFAESAMAVNRVVQQHFSMKLDYLERPNVYPDCPVRSGMKTCASAKMFGLSPPSESNLMRRRIKGGSCQFLVPAPTPAIPSPSG

SEQ ID NO: 23154 - protein, 279 aa, Diabrotica virgifera
  misc_feature: Coding regions on vcDNA: vcDNA=SeqID_2851; Strand=+; Position=104-940
  misc_feature: Homolog annotation: Hit_ID=NP_523845.2; Match level="QueryCoverage =100%, HitCoverage=82%, E-value=1e-143, Identity=88%"; Hit description=CG3416-PA [Drosophila melanogaster] gb|AAF47199.1| CG3416-PA [Drosophila melanogaster]
  misc_feature: Gene Ontology Annotation: Molecular function=endopeptidase activity; Cellular component=proteasome regulatory particle (sensu Eukarya); Biological process=embryonic cleavage
  misc_feature: Pfam annotation: Pfam_ID=Mov34; Match level="Score=173.8, E-value =3.8e-49, Copies=1"; Pfam description=Mov34/MPN/PAD-1 family
MPSQELTTNKVIVHPLVLLSVVDHFNRMGKIGNQKRVVGVLLGCWRAKGVLDVSNSFAVPFDEDDKDKSVWFLDHDYLENMYGMFKKVNARERVVGWYHTGPKLHQNDIAINELIRRYCPNSVLVIIDAKPKDLGLPTEAYQAVEEVHDDGSPTSKTFEHVPSEIGAEEAEEVGVEHLLRDIKDTTVGTLSQRITNQLLGLKGLHSQLRDIRDYLVQVCGNQLPINHQIIYQLQDIFNLLPDINQDAFNTSFYVKNNDQMLVVYLAALVRSIVALHNLI

SEQ ID NO: 23155 - protein, 286 aa, Diabrotica virgifera
  misc_feature: Coding regions on vcDNA: vcDNA=SeqID_2852; Strand=-; Position=137-997
  misc_feature: Homolog annotation: Hit_ID=XP_394555.1; Match level="QueryCoverage =99%, HitCoverage=51%, E-value=1e-79, Identity=47%"; Hit description =similar to Zinc finger like protein 1 [Apis mellifera]
  misc_feature: Gene Ontology Annotation: Molecular function=molecular_function unknown; Cellular component=cellular_component unknown; Biological process=biological_process unknown
  misc_feature: Pfam annotation: Pfam_ID=zf-C3HC4; Match level="Score=9.3, E-value =0.0041, Copies=1"; Pfam description=Zinc finger, C3HC4 type (RING finger)
MGLCKCPKRRVTNQFCFEHRVCVCENCMVTNHTICIVQSYLQWLQDSDYNSICELCSKELSSQDCIRLTCYHVFHWSCLDHFSRQLPPTTAPRGYTCPSCKSPLFPPSNLISPVADVLKEKLAGVNWARAGLGLPLLSEEREIKSTINHNMSMPPRITPSPAHSVVSVDEDIGAFNRADSFQHSSNRRIFQDIRDIKPDVFDHDDNKYKRKPISELFGNWFKITFGAPLRARGRKSVCRRYCMLGALVIFIIVMFFFVMSKLSRYSIDDDPNFDVRHNELVKTANL

SEQ ID NO: 23156 - protein, 101 aa, Diabrotica virgifera
  misc_feature: Coding regions on vcDNA: vcDNA=SeqID_2853; Strand=+; Position=246-551
ELFLGSIQIFIILLFIFIFIFIFIFIFVSCFRKIPYMVLFYVLFYMFKLFLITFIVQSRSIFYLLSTSKLTLCRRVLYPEGTHRFLARGNFLLKIIYIIEY

SEQ ID NO: 23157 - protein, 122 aa, Diabrotica virgifera
  misc_feature: Coding regions on vcDNA: vcDNA=SeqID_2854; Strand=-; Position=239-607
HLDQVKAKVLQITAIHAPLIIRFIQSHLFWKHSLMHIRMYSPPFSCFLDDASIHTCNKLMPLIHSSSWSYVEDTPNKSSSCHLRSKIERSIKIAWFMPMGSPAVTSTDHLPYFYIRLKIRYF

SEQ ID NO: 23158 - protein, 137 aa, Diabrotica virgifera
  misc_feature: Coding regions on vcDNA: vcDNA=SeqID_2855; Strand=+; Position=3-413
HQKFYSDNNNICDFIRFVKQITMGLDKVPWRFIRVKGDDNVSGTQIEDSQVSSRTSRETVNSGNALLSKIYTRKIRWREGQYSLIIISAVLTVFGLVQILFPPFDLLLDLRIRMTPGLPAYEWWVVPPKDAIVKIYL

SEQ ID NO: 23159 - protein, 357 aa, Diabrotica virgifera
  misc_feature: Coding regions on vcDNA: vcDNA=SeqID_2856; Strand=+; Position=87-1160
  misc_feature: Homolog annotation: Hit_ID=XP_313710.1; Match level="QueryCoverage =84%, HitCoverage=61%, E-value=7e-21, Identity=26%"; Hit description =ENSANGP00000017007 [Anopheles gambiae]
  misc_feature: Pfam annotation: Pfam_ID=EMI; Match level="Score=4.7, E-value=0.093, Copies=1"; Pfam description=EMI domain
  misc_feature (300)..(300): Xaa can be any naturally occurring amino acid
MLGKAFLFLSALLVVRAAQSDFYSDLSLFHELQQPYRANWNWHNPVVNPRRAIEEELASAEDDSDEREPLAKDYKDPPAASSEQKPVLVPKPKPNLKSIPEKPEISDLPENPERPLTELLPGGVVDVNSDGFGGPFNPFGPEFDFSSSFGVGNSKPFGIGDLFNSFQGSQWWKGKNVCIEREESTDDDEDSDEDQSNEEGKKNSTSSTSKASKALPDLFSTSISLSNCFETASKYECVTKINNHGVFMTFTVRYKCCYGYTTTRGGGCDKKADLKPILETLDDIKASEFINLIITSHLYXKFTDSNCSLFVPTDDALTEYRDKMVEMNIVVTTRRGLGLHLSTRDLVLRHAVEGSLI

SEQ ID NO: 23160 - protein, 284 aa, Diabrotica virgifera
  misc_feature: Coding regions on vcDNA: vcDNA=SeqID_2857; Strand=+; Position=382-1236
  misc_feature: Homolog annotation: Hit_ID=XP_320368.1; Match level="QueryCoverage =88%, HitCoverage=70%, E-value=4e-30, Identity=32%"; Hit description =ENSANGP00000013987 [Anopheles gambiae]
  misc_feature: Gene Ontology Annotation: Molecular function=tocopherol binding; Cellular component=cytosol; Biological process=transport
  misc_feature: Pfam annotation: Pfam_ID=CRAL_TRIO; Match level="Score=-13.1, E-value= 0.0004, Copies=1"; Pfam description=CRAL/TRIO domain
MEENKQEKKCLKLFQTNRDKIRKHWDKTESEVEEVLTKLREWASRKEFPEIPSDSMLEFFVTNNKYNIERTKDNIKSYYAVRKNIPEFFKNAHPRLPKMQECWEMGVYVPLAIPHEGLYRVSVLKLLPYTAKFHANRYHAHVSNLFEIRICEDLSVGEILIVDYRNLAWSHVFKISPFVVHRMAMVVESMSRTRLKEIHFVEPPSSINILLTIAKTFLKKKIADRIRIHNSMETLLEHVPKDILPEDYGGDGKPLSEQVDLVKEKLMEYYERFDMLQEYSTKDS

SEQ ID NO: 23161 - protein, 304 aa, Diabrotica virgifera
  misc_feature: Coding regions on vcDNA: vcDNA=SeqID_2858; Strand=+; Position=371-1282
  misc_feature: Homolog annotation: Hit_ID=XP_395886.1; Match level="QueryCoverage =98%, HitCoverage=95%, E-value=7e-29, Identity=31%"; Hit description =similar to hagoromo [Apis mellifera]
  misc_feature: Pfam annotation: Pfam_ID=F-box; Match level="Score=35.3, E-value=1.8e- 07, Copies=1"; Pfam description=F-box domain
MSHLCLENLSTEILIKIFSYLDLNDLMQLPYVCKRIRQIVLNWDNLLFKRFPTPLVTNQFSDEFLARCNRKLSSFEKVRISRNWIEAKYTESPLLFSKRKFLPYLQLSKKYLWISRGGVIFCYKRRYRNLHAANPHYVLSPPVQRSKADVVNFHVKNNLIVAGMRDGSLWMKDLQDRYSKIFMLKIYHQDDVHSVALNNSCSLLASGARGGDVIVSKVEPSVTPQNINKVLSWSYHDVIWKVGFSVENKLAIGTAGRHYYSYLYIRNVDRIDVEELVLSYQSVKEGIHDIIWDGPHKIWTCGYD

SEQ ID NO: 23162 - protein, 335 aa, Diabrotica virgifera
  misc_feature: Coding regions on vcDNA: vcDNA=SeqID_2859; Strand=+; Position=19-1025
  misc_feature: Homolog annotation: Hit_ID=XP_392875.1; Match level="QueryCoverage =87%, HitCoverage=83%, E-value=1e-115, Identity=64%"; Hit description= similar to CG1998-PA [Apis mellifera]
  misc_feature: Gene Ontology Annotation: Molecular function=C-4 methyl sterol oxidase activity; Cellular component=plasma membrane; Biological process=sterol biosynthesis
  misc_feature: Pfam annotation: Pfam_ID=Sterol_desat; Match level="Score=127.6, E -value=3e-35, Copies=1"; Pfam description=Sterol desaturase
  misc_feature (261)..(261): Xaa can be any naturally occurring amino acid
MQGDYDDESSSSGGELTPTRKNNTNHHQIVQSNPSILSSLRSVLIVLSTALVCFAAARNSITWHCQRFWGASGDFWQAQWDKFLDLVGEDPFNLWVFYSMCITFGVYWLFGGIYTFMDVTNMPGVIRKYKIQPGTNEPVDDKRLRHVIYSVLFNQSVVGIPISFLMYWAMKWRGYPPLRELPTFHWVLFELAVHILTEEVGFYYSHRLLHSKYLYKYIHKQHHEWTAPIAVTAIYCHPIEHIFSNLIPPFLGVFLRGSHVXTAWLWVTLPLLPTLNAHSGYHLPIFAFTHAPAFQPPRFNTIFWGLGGGGGSIPNMIGPPPPFRTKFQPFGRVSF

SEQ ID NO: 23163 - protein, 154 aa, Diabrotica virgifera
  misc_feature: Coding regions on vcDNA: vcDNA=SeqID_2860; Strand=+; Position=49-513
  misc_feature: Homolog annotation: Hit_ID=AAK92161.1; Match level="QueryCoverage =100%, HitCoverage=100%, E-value=7e-71, Identity=86%"; Hit description=ribosomal protein L24 [Spodoptera frugiperda] sp|Q962T5|RL24_SPOFR 60S ribosomal protein L24
  misc_feature: Gene Ontology Annotation: Molecular function=structural constituent of ribosome; Cellular component=cytosolic ribosome (sensu Eukarya); Biological process=reproduction
  misc_feature: Pfam annotation: Pfam_ID=Ribosomal_L24e; Match level="Score=142.2, E -value=1.2e-39, Copies=1"; Pfam description=Ribosomal protein L24e
MKIGLCAYSGYKIYPGHGKTMVKVDGKTFTFLNSKCERAHLMKRNPRKVTWTVLYRRKHKKGQEEEATKKRTRRTQKFQRAIVGASLNDIMAKRNQRPEVRKAQREQAIRAAKEQKKSTKTAKKATAPAKAKPAPKQKVTKNQPKAAPRVGGKR

SEQ ID NO: 23164 - protein, 130 aa, Diabrotica virgifera
  misc_feature: Coding regions on vcDNA: vcDNA=SeqID_2861; Strand=+; Position=3-395
HASGSIILLLLVGQSSALIPGLLKGILDLILGSVSSKIILIPSANISIPKNLQDIIIGDLNLTQFHVYGLDTFKYKDDVYKLDTDRKSFTRNRISVNTTLDKLGLETEYVLDMSLLDAVPLYGNGRFSQK

SEQ ID NO: 23165 - protein, 59 aa, Diabrotica virgifera
  misc_feature: Coding regions on vcDNA: vcDNA=SeqID_2862; Strand=-; Position=170-349
NLPFLRYNDSKSGNRHNMRTRFHTTFEVVYFARFFNVVSPVGLFHGSVMILFNLKLFNN

SEQ ID NO: 23166 - protein, 83 aa, Diabrotica virgifera
  misc_feature: Coding regions on vcDNA: vcDNA=SeqID_2863; Strand=-; Position=90-341
GLHVLKKITVRVFLDFGCYSTIKINFFNDLCLIKCLINKFFPIGRVQSGLDVGKIHVKDCNTSLLKVQTLILLSIYGAFSKGL

SEQ ID NO: 23167 - protein, 340 aa, Diabrotica virgifera
  misc_feature: Coding regions on vcDNA: vcDNA=SeqID_2864; Strand=+; Position=555-1577
  misc_feature: Homolog annotation: Hit_ID=EAA07097.2; Match level="QueryCoverage =97%, HitCoverage=92%, E-value=6e-83, Identity=47%"; Hit description =ENSANGP00000016081 [Anopheles gambiae str. PEST] ref|XP_559070.1| ENSANGP00000016081 [Anopheles gambiae st
  misc_feature: Gene Ontology Annotation: Molecular function=endoplasmic reticulum receptor activity; Cellular component=integral to membrane; Biological process=cotranslational membrane targeting
  misc_feature: Pfam annotation: Pfam_ID=LAG1; Match level="Score=-12.4, E-value=3.2e- 07, Copies=1"; Pfam description=Longevity-assurance protein (LAG1)
MVKPVRKSANKNPPILSHEFVIQNHADIVSCIAMVFVVGLMVQATSPIASIFITLQHNVTEAGEVPLYSPGVKDWACIFFYTLICVVIHAIIQEYILDKVSKKLHLSKSKLAVFTTSGQLTIFYLISTLWGLDIIIKENFVFDIARLWVDYPAPMTFLMKLYIIVQLAYNVHELPELYFQRAKKEEYIGKATQSLAAVSLIFIPYFLNFNRLLVSLLVLHHISELVYHFFQLIQTVDKDEKFSKVTTLVSNSFKLVARLGSIILSILTLWYGLALGEQRELDLTTGYYNTPVVRIAVLAGILGLQMYLTFNVISQEIARSRESKGASVAPKAKPPKKRNL

SEQ ID NO: 23168 - protein, 96 aa, Diabrotica virgifera
  misc_feature: Coding regions on vcDNA: vcDNA=SeqID_2865; Strand=+; Position=2-311
  misc_feature: Homolog annotation: Hit_ID=XP_395392.1; Match level="QueryCoverage =97%, HitCoverage=8%, E-value=1e-29, Identity=64%"; Hit description =similar to CG13391-PA [Apis mellifera]
  misc_feature: Gene Ontology Annotation: Molecular function=tRNA binding; Cellular component=mitochondrion; Biological process=reproduction
  misc_feature (37)..(37): Xaa can be any naturally occurring amino acid
  misc_feature (84)..(84): Xaa can be any naturally occurring amino acid
SCRIRHKMSNHTGTHVLNYALRKVLSTDADQRGSLVXPDKLRFDFTNKGAMTTDQVKKTEENSKELISRNNKVFAKDSSLGVAXTIRGLRAVFEET

SEQ ID NO: 23169 - protein, 67 aa, Diabrotica virgifera
  misc_feature: Coding regions on vcDNA: vcDNA=SeqID_2866; Strand=+; Position=412-615
VIAFCDRRSQGYVLRRILRRAVRYATEKLNAKPGFFSGFVLISLKKDSATKTPMVLVTSDIEMRTMW

SEQ ID NO: 23170 - protein, 93 aa, Diabrotica virgifera
  misc_feature: Coding regions on vcDNA: vcDNA=SeqID_2867; Strand=-; Position=639-920
KRWFKQISVLELKGPPFFFFFENLETFWIYAHQSNVTLKSELDPVYYVVERVRYTGCPRKQCVPNGIGRILKYSCYSTNKQILVCLIFKHGVV

SEQ ID NO: 23171 - protein, 66 aa, Diabrotica virgifera
  misc_feature: Coding regions on vcDNA: vcDNA=SeqID_2868; Strand=-; Position=218-418
HVCLICSISTLSMCGLLRTWSHRNYRCENLLAITLSLRSPITKRNHLKVVIPKYKAHFNILERAIA

SEQ ID NO: 23172 - protein, 685 aa, Diabrotica virgifera
  misc_feature: Coding regions on vcDNA: vcDNA=SeqID_2869; Strand=+; Position=1-2053
  misc_feature: Homolog annotation: Hit_ID=NP_995656.1; Match level="QueryCoverage =93%, HitCoverage=65%, E-value=0.0, Identity=74%"; Hit description =CG13391-PB, isoform B [Drosophila melanogaster] ref|NP_523511.2| CG13391-PA, isoform A [Drosophila
  misc_feature: Gene Ontology Annotation: Molecular function=tRNA binding; Cellular component=soluble fraction; Biological process=tRNA processing
  misc_feature: Pfam annotation: Pfam_ID=tRNA-synt_2c; Match level="Score=1134.1, E -value=0, Copies=1"; Pfam description=tRNA synthetases class II (A)
  misc_feature (67)..(67): Xaa can be any naturally occurring amino acid
  misc_feature (655)..(655): Xaa can be any naturally occurring amino acid
VIVLVKVRRFVLSLRKIRSPSVDLVYRYICALRKCLHINKQRPYQSTAKEVRNAYIDFFKEREHRVXVHSSSTIPLDDPTLLFANGGMNQYKSIFLGTVDPNSDLSKLIRAVNTQKCIRAGGKHNDLDDVGKDVYHHTFFEMMGNWSFGDYFKKEVCSCAWEFLTQKLKLEADRLYVTYFGGDPASGLEPDNECKQIWLNLGVKPSHVLPGSMKDNFWEMGETGPCGPCSELHYDRIGGREVPELVNMDDPDVLEIWNLVFIQYNRETDGSLKSLPKKHIDCGLGLERLVSVIQNKRSNYDTDLFVPLFEAIQKGTGAPSYQGRVGKDDTDGIDMAYRVLADHARTLTIALSDGGNPDNTGRGYVLRRILRRAVRYATEKLNAKPGFFSTLVNTVVEILGDTFPEVRKDPQSVMDTINEEEEQFLKTLSRGRNLLNRTITKLDSSIKVVPGDVAWRLYDTYGFPVDLTTLMAEEKGLTVDMDTYEESKKQAQIASQGKGTGVADTINLDVHAITELQNKGVPPTDDLEKYSYVSTESPDSDYTFKSCEATVIGLRYNKEFVDEVHTGQECGVLLDKTNFYAEQGGQIYDTGYIVKVGDESVEFSVKNVQVRGGYIIHIGNLEGTLIKGDKVSLHIDNNRRRLIMSNHTGTHVLNXALRKVLGTDADQRGSLVAPDKLRFDFTNKG

SEQ ID NO: 23173 - protein, 147 aa, Diabrotica virgifera
  misc_feature: Coding regions on vcDNA: vcDNA=SeqID_2870; Strand=+; Position=157-600
  misc_feature: Homolog annotation: Hit_ID=XP_532978.1; Match level="QueryCoverage =100%, HitCoverage=26%, E-value=3e-30, Identity=45%"; Hit description= PREDICTED: hypothetical protein XP_532978 [Canis familiaris]
  misc_feature: Gene Ontology Annotation: Molecular function=protein binding; Cellular component=transcriptional repressor complex; Biological process=negative regulation of transcription
  misc_feature: Pfam annotation: Pfam_ID=zf-C3HC4; Match level="Score=40.8, E-value =3.9e-09, Copies=1"; Pfam description=Zinc finger, C3HC4 type (RING finger)
MADYFGEMGWTPLEDGQAPDYFLHLARLLRDFNMFEELSVLNGKKLAPPASKDFVAAIPNESIETNDLQCPVCLKEHTKGETAKKLPCGHLFHTECIMPWLSKTNSCPLCRFELPTDDEDYEAWRKEKKRAKEREADIEHLHNSMFS

SEQ ID NO: 23174 - protein, 321 aa, Diabrotica virgifera
  misc_feature: Coding regions on vcDNA: vcDNA=SeqID_2871; Strand=+; Position=203-1168
  misc_feature: Homolog annotation: Hit_ID=A45117; Match level="QueryCoverage=98%, HitCoverage=81%, E-value=2e-88, Identity=52%"; Hit description =aspartic proteinase (EC 3.4.23.-), lysosomal - yellow fever mosquito gb|AAA29350.1|
  misc_feature: Gene Ontology Annotation: Molecular function=aspartic-type endopeptidase activity; Cellular component=extracellular space; Biological process=digestion
  misc_feature: Pfam annotation: Pfam_ID=Asp; Match level="Score=486.9, E-value=2.1e -143, Copies=1"; Pfam description=Eukaryotic aspartyl protease
LDYYGEISIGTPPQTFKVIFDTGSADLWVPSAQCENNTRTPNGCQNHTKYDADKSSTYQENGHSFYIEYGSGSLSGFLSEDSVNVAGVAVEKQTFAEATYETAPAFVDSTFDGILGLGYPELSSQSVTPVFTNMINQGVLDAPVFSFYLSQTANGDQGELVIGGSDPSKYRGDFTYTEVSKKLYWQTKLQGVSVGKQSLCRNGCRSVIDTGTSLIYGPNDDVEAINDAIGAFYDYDLGIYTIECDADLTKLPNVTFTFGGKKFDISPSAYVIRDSGICVSSFVAGDFFLAGFEWLVGDSFLKTVYSEFDFGNNRIGFAELA

SEQ ID NO: 23175 - protein, 366 aa, Diabrotica virgifera
  misc_feature: Coding regions on vcDNA: vcDNA=SeqID_2872; Strand=+; Position=195-1295
  misc_feature: Homolog annotation: Hit_ID=A45117; Match level="QueryCoverage=93%, HitCoverage=89%, E-value=5e-86, Identity=48%"; Hit description =aspartic proteinase (EC 3.4.23.-), lysosomal - yellow fever mosquito gb|AAA29350.1|
  misc_feature: Gene Ontology Annotation: Molecular function=saccharopepsin activity; Cellular component=extracellular space; Biological process=digestion
  misc_feature: Pfam annotation: Pfam_ID=Asp; Match level="Score=419.7, E-value=3.4e -123, Copies=1"; Pfam description=Eukaryotic aspartyl protease
MKISHARSTPRVRMYAKILVLLVIAALASSELIRIPLKKVPANGQKRLRNVAAKGLRSRFGGNGVVPLVNEYDLDYYGEISIGTPPQTFKVIFDTGSADLWVPSAQCENNTRTPNGCQNHTKYDADKSSTYQENGHSFYIEYGSGSLSGFLSEDSVNVAGVAVEKQTFAEATYETAPAFVDSTFDGILGLGYPELSSQSVTPVFTNMINQGVLDAPVFSFYLSQTANGDQGELVIGGSDPSKYRGDFTYTEVSKKLYWQTKLQGVSVGKQSLCRNGCRSVIDTGTSLIYGPNDDVEAINDAIGAFYDYDLGIYTIECDADLTKLPNVTFTFGGKKFDISPSAYVIRDSGICVSSFVAGDFFLPRVF

SEQ ID NO: 23176 - protein, 100 aa, Diabrotica virgifera
  misc_feature: Coding regions on vcDNA: vcDNA=SeqID_2873; Strand=+; Position=571-873
  misc_feature: Pfam annotation: Pfam_ID=zf-MIZ; Match level="Score=-7.2, E-value =0.087, Copies=1"; Pfam description=MIZ zinc finger
MILLMNPYFVPMCLFHLWILSVTKVKNPYKSKKCGHIYEFDSIASYIRSQGKKAKCPYIGCNSEQLRMTDLVRDNELQSQISQYEETHVTEEEEGDSDDD

SEQ ID NO: 23177 - protein, 363 aa, Diabrotica virgifera
  misc_feature: Coding regions on vcDNA: vcDNA=SeqID_2874; Strand=+; Position=1-1092
  misc_feature: Homolog annotation: Hit_ID=XP_310191.1; Match level="QueryCoverage =99%, HitCoverage=66%, E-value=1e-157, Identity=77%"; Hit description= ENSANGP00000011053 [Anopheles gambiae]
  misc_feature: Gene Ontology Annotation: Molecular function=chaperone activity; Cellular component=actin filament; Biological process=cell organization and biogenesis
  misc_feature: Pfam annotation: Pfam_ID=Cpn60_TCP1; Match level="Score=159.6, E -value=7.1e-45, Copies=1"; Pfam description=TCP-1/cpn60 chaperonin family
QHSSFLGPLAVDAVLKIVEPGREQACNLSDIKVIKQLGGTVEDTELVEGICFPQRSANVSGPKRIEKAKIGFIQFCISPPKTDMDHNVIVSDYAAMDRVLKEERAYILNIVKQIKKAGCNVLLVQKSILRDAVSDLALHFLDKIKCMVIKDIEREDVEFVCKSLGCRPIASLDHFVAENLVTADLVEEVGLAGNRMVKITGAQNAGRTVTLLVRGSNKLVLEEADRSLHDALCVIRCLVRKKALIAGGGAPEVEVALKLAAMANKLEGIDAICTRAYANALEIIPFTLSENAGLNPIQTVTELRNRHAKGETSAGINVRKGAITDILEENVVQPLLVSTSALSLATETVRSILKIDDIVNIFT

SEQ ID NO: 23178 - protein, 300 aa, Diabrotica virgifera
  misc_feature: Coding regions on vcDNA: vcDNA=SeqID_2875; Strand=+; Position=120-1022
  misc_feature: Homolog annotation: Hit_ID=XP_310191.1; Match level="QueryCoverage =98%, HitCoverage=52%, E-value=1e-119, Identity=74%"; Hit description= ENSANGP00000011053 [Anopheles gambiae]
  misc_feature: Gene Ontology Annotation: Molecular function=chaperone activity; Cellular component=actin filament; Biological process=cell organization and biogenesis
  misc_feature: Pfam annotation: Pfam_ID=Cpn60_TCP1; Match level="Score=-37.0, E -value=1.7e-14, Copies=1"; Pfam description=TCP-1/cpn60 chaperonin family
KTIIKSNMTAPTAGGDTNRGRTVAYKDKSKPADVRTSNINAAKAVCDAIRTSLGPRGMDKMIQAGNGEVTITNDGATILKQINLIHPAAKMLVELSRAQDIEAGDGTTSVVVIAGALLDAAEKLLQRGIHPTAISESFQRAAQLAVDILSDISTPIEITNRELLIKSASTSLNSKVVSQHSSFLGPLAVDAVLKIVEPGREQACNLSDIKVIKQLGGTVEDTELVEGICFPQRSANVSGPKRIEKAKIGFIQFCISPPKTDMDHNVIVSDYAAMDRVLKEERAYILNIVKQIKKTESSWM

SEQ ID NO: 23179 - protein, 144 aa, Diabrotica virgifera
  misc_feature: Coding regions on vcDNA: vcDNA=SeqID_2876; Strand=+; Position=177-611
  misc_feature: Homolog annotation: Hit_ID=XP_393411.1; Match level="QueryCoverage =100%, HitCoverage=100%, E-value=9e-71, Identity=84%"; Hit description=similar to ENSANGP00000021736 [Apis mellifera]
  misc_feature: Gene Ontology Annotation: Molecular function=ubiquitin conjugating enzyme activity; Cellular component=nucleus; Biological process =regulation of cell cycle
  misc_feature: Pfam annotation: Pfam_ID=UQ_con; Match level="Score=9.9, E-value=1.3e- 06, Copies=1"; Pfam description=Ubiquitin-conjugating enzyme
MATPSTGVVVPRNFRLLEELEAGQKGVSDGTISWGLENDDDMTLTHWMGMIIGPPRTPYENRMYSVKIECGQRYPDDAPTAKFISRININCINSNTGVVDNRQVPILARWQRDYTIKTVLQELRRIMTLKENMKLTQPPEGTCF

SEQ ID NO: 23180 - protein, 202 aa, Diabrotica virgifera
  misc_feature: Coding regions on vcDNA: vcDNA=SeqID_2877; Strand=+; Position=40-648
  misc_feature: Homolog annotation: Hit_ID=NP_573137.1; Match level="QueryCoverage =93%, HitCoverage=72%, E-value=2e-13, Identity=31%"; Hit description =CG9782-PA [Drosophila melanogaster] gb|AAF48630.2| CG9782-PA [Drosophila melanogaster]
MRISCVLFIGLVTFAALCSARPAENDADYDEEPAPPPKKPARPLTSRRNPLSGRTNGKAASSTTTTTQAPVEEEEAAEEEYDEELPPEQEPSSTTEAPKKNFLKTGVVRPFRSNDELLAALKKRREQVVHNKITNPVQSNSEVQSAPPAAAAEKESSKKSSTSSGRRNRFNAKEKSPEPAAEESPAPAATPSRTGRRFGGRS

SEQ ID NO: 23181 - protein, 444 aa, Diabrotica virgifera
  misc_feature: Coding regions on vcDNA: vcDNA=SeqID_2878; Strand=+; Position=62-1395
  misc_feature: Homolog annotation: Hit_ID=XP_309799.1; Match level="QueryCoverage =97%, HitCoverage=58%, E-value=1e-131, Identity=59%"; Hit description= ENSANGP00000012524 [Anopheles gambiae]
  misc_feature: Gene Ontology Annotation: Molecular function=oxysterol binding; Cellular component=cytoplasm; Biological process=protein amino acid phosphorylation
  misc_feature: Pfam annotation: Pfam_ID=PH; Match level="Score=88.6, E-value=1.7e -23, Copies=1"; Pfam description=PH domain
  misc_feature (301)..(301): Xaa can be any naturally occurring amino acid
  misc_feature (383)..(383): Xaa can be any naturally occurring amino acid
  misc_feature (389)..(389): Xaa can be any naturally occurring amino acid
  misc_feature (422)..(422): Xaa can be any naturally occurring amino acid
  misc_feature (434)..(434): Xaa can be any naturally occurring amino acid
  misc_feature (437)..(437): Xaa can be any naturally occurring amino acid
MKMSDSMNIKSNSSQNEPAMKGWLFKWTNYLKGYQRRWFVLQSGHLSYYRNQAEMAHTCRGSISLHGALIYTVDACTFVISNGGTQTFHIKAASEVERQQWVTALELAKAKAIRSMESEEDEEIDESGDFEDWSGVVRKLESQLNDLQTCGDVLAKHWKHLAKSLGEMETNSDHELLQGKNKEVCERATLFRIASNAMVNSCNDYLKFAQNHGHKLVRALQHEKEQRGRLQEMVETLAQQHSKLERAANAHSHLSAIGANDNEDEDDNEFYDALAEEGHSSGQVTDGDKHFHFRIIRTRYXHRRNSSDSSSETEETQTKQVGVVTGKHNNVRRPETPSGFIWLMASPKSNGAKRQRRTRVADKPNYPLNLWSIMKNWIGKDLXSKIPMXVNFNEPLSMMQRITEDLEYADGLDVAAKCTDPXGQLAYIAAFTIXFYXVTSIRTG

SEQ ID NO: 23182 - protein, 220 aa, Diabrotica virgifera
  misc_feature: Coding regions on vcDNA: vcDNA=SeqID_2879; Strand=+; Position=303-962
  misc_feature: Homolog annotation: Hit_ID=XP_309799.1; Match level="QueryCoverage =93%, HitCoverage=28%, E-value=5e-64, Identity=62%"; Hit description =ENSANGP00000012524 [Anopheles gambiae]
  misc_feature: Gene Ontology Annotation: Molecular function=oxysterol binding; Cellular component=cytoplasm; Biological process=vesicle-mediated transport
MKNHLNRNNNLQKIGANDNEDEDDNEFYDALAEEGHSSGQVTDGDKHFTLNIRTATGHRRNSSDSSSETEETQTKQVVVVTGKHNNVRRPETPSGSSANASPKSNGAKRQRRTRVPDKPNYPLNLWSIMKNCIGKDLSKIPMPVNFNEPLSMMQRITEDLEYADVLDVAAKCTDPCEQLAYIAAFTISSYASTSIRTGKPFNPLLGETYELDRTDDLGWR

SEQ ID NO: 23183 - protein, 90 aa, Diabrotica virgifera
  misc_feature: Coding regions on vcDNA: vcDNA=SeqID_2880; Strand=+; Position=73-345
MCYRPVCCSPCSVMACYPLCYPCCQPCCPPSCPPKEVQNRIKLLAPPSEPRPPLKCKRIQPCYYSKPSDPRSKTIKFDEKMQITTNYCKD

SEQ ID NO: 23184 - protein, 327 aa, Diabrotica virgifera
  misc_feature: Coding regions on vcDNA: vcDNA=SeqID_2881; Strand=+; Position=234-1214
  misc_feature: Homolog annotation: Hit_ID=XP_321938.1; Match level="QueryCoverage =98%, HitCoverage=76%, E-value=1e-105, Identity=53%"; Hit description= ENSANGP00000013982 [Anopheles gambiae]
  misc_feature: Gene Ontology Annotation: Biological process=ribonucleoside diphosphate catabolism
  misc_feature: Pfam annotation: Pfam_ID=Apyrase; Match level="Score=396.0, E-value =4.6e-116, Copies=1"; Pfam description=Apyrase
MIPPKDWRKALKSQPAYRIVNRTICCQTFFVYSVGLTGIILLFFLYTHSSTGTSSSYYRRSNYNYTYPITRPIKTKSMHTFRIGIIADLDQSSHSKKETDTWYSYFKTGYLTYNPQTHHIVVNWDQKEADMLKTSYALKGRGLELSELVTFDGKLLTFDDRTGLVFELVNNKIIPWLILMDGNGKTQKGFKSEWATVRDEVLYVGSIGKEWTSAEGEFVNNDPQYIKTITKEGHINHINWVEEYNRLRGIIGIKWPGYMIHESGLWSAVHKRWFFLPRRCSKERYNESLDEHRGCSVLITADANVNDVNVIEIGNAKPTRSFSSFKF

SEQ ID NO: 23185 - protein, 127 aa, Diabrotica virgifera
  misc_feature: Coding regions on vcDNA: vcDNA=SeqID_2882; Strand=+; Position=55-438
  misc_feature: Homolog annotation: Hit_ID=NP_610623.1; Match level="QueryCoverage =95%, HitCoverage=28%, E-value=1e-15, Identity=38%"; Hit description =CG6751-PA [Drosophila melanogaster] gb|AAF58738.1| CG6751-PA [Drosophila melanogaster]
  misc_feature: Gene Ontology Annotation: Cellular component=nucleus; Biological process=transcription
MEYENTQQNINFVPCVRWVKRGVANSSPVKLQLSKNELAQIINDTKIKLQESNENEDEPMEEGETSQTDEFALEDYDKEDENEDTANALGIGSLAELDNDAADNFSESDDSEKEDDKIKPSDNLILV

SEQ ID NO: 23186 - protein, 191 aa, Diabrotica virgifera
  misc_feature: Coding regions on vcDNA: vcDNA=SeqID_2883; Strand=+; Position=1-573
  misc_feature: Homolog annotation: Hit_ID=EAA43070.2; Match level="QueryCoverage =97%, HitCoverage=17%, E-value=2e-85, Identity=79%"; Hit description =ENSANGP00000023601 [Anopheles gambiae str. PEST] ref|XP_550884.1| ENSANGP00000023601 [Anopheles gambiae st
  misc_feature: Gene Ontology Annotation: Molecular function=phospholipase C activity; Cellular component=inaD signaling complex; Biological process=response to abiotic stimulus
  misc_feature (169)..(169): Xaa can be any naturally occurring amino acid
  misc_feature (182)..(182): Xaa can be any naturally occurring amino acid
THLLLKYINNLVTRHGQDVEEKSLTICSGTDYININYQHIVCPNAETAKVWLDGLRKITHNGKANNFCPMTCLKKHWMRLGFSVDHRGQIPVKVIARTFASGKTEKLVYQILSELELPSGKNDSIEPEAFTFDKFYSLYHKICPRNDIEELFRSITTANADYLTLDQFXHFLNEKQRDPRLXRILYPLYDE

SEQ ID NO: 23187 - protein, 52 aa, Diabrotica virgifera
  misc_feature: Coding regions on vcDNA: vcDNA=SeqID_2884; Strand=+; Position=535-693
VSTSYSVSIEKFFASSSMICSHYLHFNNNQDSVPYYIFLVSYTFVNIFIELV

SEQ ID NO: 23188 - protein, 170 aa, Diabrotica virgifera
  misc_feature: Coding regions on vcDNA: vcDNA=SeqID_2885; Strand=+; Position=78-590
  misc_feature: Homolog annotation: Hit_ID=XP_310186.1; Match level="QueryCoverage =98%, HitCoverage=50%, E-value=3e-56, Identity=66%"; Hit description =ENSANGP00000011006 [Anopheles gambiae]
  misc_feature: Gene Ontology Annotation: Molecular function=malic enzyme activity; Cellular component=mitochondrion
  misc_feature: Pfam annotation: Pfam_ID=Ldh_1_C; Match level="Score=111.8, E-value =1.7e-30, Copies=1"; Pfam description=lactate/malate dehydrogenase, alpha/b
ELAQIAAKVGVPIENVSNVIIWGNHSSTQFPDASHAVVVVDNKSVPAVEAVKDGEWLRNVFVSTVQKRGAAVIAARKMSSAMSAAKAAADHMRDWFLGTPDNKFVSMGVLSDGSYGAPKDVVFSFPVNIKNGKWQIVQGLQNDDFAKGLLAVTGKELEEEKTEAITIIGA

SEQ ID NO: 23189 - protein, 294 aa, Diabrotica virgifera
  misc_feature: Coding regions on vcDNA: vcDNA=SeqID_2886; Strand=+; Position=124-1008
  misc_feature: Homolog annotation: Hit_ID=XP_310186.1; Match level="QueryCoverage =89%, HitCoverage=78%, E-value=1e-115, Identity=80%"; Hit description= ENSANGP00000011006 [Anopheles gambiae]
  misc_feature: Gene Ontology Annotation: Molecular function=malic enzyme activity; Cellular component=cytosol
  misc_feature: Pfam annotation: Pfam_ID=Ldh_1_N; Match level="Score=177.0, E-value =4.1e-50, Copies=1"; Pfam description=lactate/malate dehydrogenase, NAD bin
MPQEPIHVVVTGAAGQIAYSLLYMIAKGDVFGPNQTLVLRLLDIPPMMGVLEGVVMELADCALPLLREVIPTADPAVAFKDVSAAFLVGAMPRKEGMERKDLLAANVKIFKVQGEALDKHAKKDVKVLVVGNPANTNALICSKYAPSIPKENFTAMTRLDQNRAQAQIAAKVGVPIENVSNVIIWGNHSSTQFPDASHAVVVVDNKSVPAVEAVKDGEWLRNVFVSTVQKRGAAVIAARKMSSAMSAAKAAADHMRDWFLCTPDNKIMDQNRLDIRRGQSINITYIHIVKKVLF

SEQ ID NO: 23190 - protein, 279 aa, Diabrotica virgifera
  misc_feature: Coding regions on vcDNA: vcDNA=SeqID_2887; Strand=+; Position=89-928
  misc_feature: Homolog annotation: Hit_ID=CAC87273.1; Match level="QueryCoverage =97%, HitCoverage=58%, E-value=1e-101, Identity=68%"; Hit description= Dbp5 protein [Chironomus tentans]
  misc_feature: Gene Ontology Annotation: Molecular function=RNA binding; Cellular component=nuclear pore; Biological process=mRNA-nucleus export
  misc_feature: Pfam annotation: Pfam_ID=DEAD; Match level="Score=131.3, E-value=2.4e- 36, Copies=1"; Pfam description=DEAD/DEAH box helicase
MSEKIDWAKYAAENEKKLQEIEITKTNGDEAKKEDSKEEDDKIDPAEASLLAKIIRKGLVENKNDIEVQRKDPRSPLYSVKTFEALNLNPNLLKGVYEMGFNAPSKIQETALPALLADPPQNLIAQSQSGTGKTAAFVLAMLTRVDPSKKYPQVLCLSPTYELAIQTGEVAAHMAKFCPELELKYAVAGEQAARGSQITEHILIGTPGKVLDWAIKFKVFDLKKIHVFVLDEADVMIATQGHQDQCIRIHKVLDASKCQMMFFSASYTTNYMEHADDID

SEQ ID NO: 23191 - protein, 234 aa, Diabrotica virgifera
  misc_feature: Coding regions on vcDNA: vcDNA=SeqID_2888; Strand=+; Position=1-701
  misc_feature: Homolog annotation: Hit_ID=XP_395168.1; Match level="QueryCoverage =97%, HitCoverage=15%, E-value=4e-47, Identity=41%"; Hit description =similar to 90-kDa heat shock protein [Apis mellifera]
  misc_feature (217)..(217): Xaa can be any naturally occurring amino acid
QKSGQDFLYFFFHPRTVETVKEYQHCNENTPFDAFPLGQSLWKSHQFSEDFTDKIRNYVEECDNFQGFHFLTDCTNAFAGLSSSCLEYIRDEYDRKSVLILPMIPSYFPDNDFSSEEEKNQSLINDSVRVLNMAFGFNEFSVYSSLTVPLSIGSKGWRQPGPPRIFQNLDYNHKLAYHSSAILAAALDTVTLKHRLKNSPFTLKDLSADLTQNGRNXVAASVQMPFRIHEKSDL

SEQ ID NO: 23192 - protein, 606 aa, Diabrotica virgifera
  misc_feature: Coding regions on vcDNA: vcDNA=SeqID_2889; Strand=+; Position=2-1822
  misc_feature: Homolog annotation: Hit_ID=XP_393281.1; Match level="QueryCoverage =99%, HitCoverage=95%, E-value=0.0, Identity=43%"; Hit description =similar to ENSANGP00000013163 [Apis mellifera]
  misc_feature: Gene Ontology Annotation: Molecular function=structural constituent of muscle; Cellular component=muscle myosin; Biological process =striated muscle contraction
  misc_feature: Pfam annotation: Pfam_ID=Myosin_tail_1; Match level="Score=475.7, E -value=4.8e-140, Copies=1"; Pfam description=Myosin tail
QLEEESEARLDLERQLVKSQGEVQVYKSKYETEVVARAEEVEEIRRKFTIRIQEQEEHIEALLVKVNNLEKQKSRLQSEVEVLIIDLEKANNTARELQKRVEQLERINIDLKTRLDETVQLYEQSQRDLRNKVTELQRAVHELDKTRELKDQLARENKKLCDDLSDSKITITELTRRLHELDLEVRRLENERDELTAAYKEAEAGRKAEEQRAQRLAAELGQFRHEAEKRLQEKDEEIEAIRKATSIEIEQLNARVVEAETRLKTEVTRIKKKLQIQITELEMSLDSANKLNIDLQKTIKKQSLQLTEIQAHYDEIQRQLQVTLDQLSVSQRRVQALTAESEEIRSNYEGALRGKRQAEQMYEEAGTRINELTTINVNLSSMKVKIEQELSSVLADYDEITKELRISDERYQRVQAELKHTVEILHEEQERVVKIEAIKKSLEIEVKNLSVRLEEVEANAIVGGKRIISKLEARIRDCEAELDEEKRRHAETIKILRKKERTVKEVMIQCEEDQKNIALLQETLDKANSKITIFKRQLQEVEGVSSQSITRVRRFQRELEAAEDRAETAESNLSLIRAKHRTFVTTSTVPGSQVYLVQEQRASSEI

SEQ ID NO: 23193 - protein, 582 aa, Diabrotica virgifera
  misc_feature: Coding regions on vcDNA: vcDNA=SeqID_2890; Strand=+; Position=151-1896
  misc_feature: Homolog annotation: Hit_ID=XP_393281.1; Match level="QueryCoverage =93%, HitCoverage=94%, E-value=0.0, Identity=44%"; Hit description =similar to ENSANGP00000013163 [Apis mellifera]
  misc_feature: Gene Ontology Annotation: Molecular function=structural constituent of muscle; Cellular component=muscle myosin; Biological process =striated muscle contraction
  misc_feature: Pfam annotation: Pfam_ID=Myosin_tail_1; Match level="Score=329.0, E -value=7.2e-96, Copies=1"; Pfam description=Myosin tail
MASSSVARTSKYSYRSTGAAGGSADVSIEYSADLTALSRLEDKIRLLQDDLEIERELRSRIEREKADLSVQVIQLSERLEEAEGGAESQFEINKKRDTELLKLRKLLEDVHIESEETALILKKKHQEIVVDFQEQIDSLAKAKSRAEKEKGKFQAEIYQLIAQVESVTKERLISIKQCEKLEITVNELNIRIEELNRSVVDITSHKTRLSQENIELIKEVQDLKVNIENAIYLKSQLAGQLEDARRRAEDDERRRSLLEANLHQVEIELESVRVQLEEESEARLDLERQLVKSQGEVQVYKSKYETEVVARAEEVEEIRRKFTIRIQEQEEHIEALLVKVNNLEKQKSRLQSEVEVLIIDLEKANNTARELQKRVEQLERINIDLKTRLDETVQLYEQSQRDLRNKVTELQRAVHELDKTRELKDQLARENKKLCDDLSDSKITITELTRRLHELDLEVRRLENERDELTAAYKEAEAGRKAEEQRAQRLAAELGQFRHEAEKRLQEKDEEIEAIRKATSIEIEQLNARVVEAETRLKTGGPPINKKKKCGEKTPKIPPQGVGKRFLFWGYSPPPQKKKYIK

SEQ ID NO: 23194 - protein, 218 aa, Diabrotica virgifera
  misc_feature: Coding regions on vcDNA: vcDNA=SeqID_2891; Strand=+; Position=219-871
  misc_feature: Homolog annotation: Hit_ID=EAA08647.2; Match level="QueryCoverage =99%, HitCoverage=74%, E-value=1e-63, Identity=55%"; Hit description =ENSANGP00000013329 [Anopheles gambiae str. PEST] ref|XP_562754.1| ENSANGP00000013329 [Anopheles gambiae st
  misc_feature: Pfam annotation: Pfam_ID=Lactamase_B; Match level="Score=104.7, E -value=2.4e-28, Copies=1"; Pfam description=Metallo-beta-lactamase superfamily
  misc_feature (194)..(194): Xaa can be any naturally occurring amino acid
  misc_feature (197)..(197): Xaa can be any naturally occurring amino acid
  misc_feature (201)..(202): Xaa can be any naturally occurring amino acid
  misc_feature (206)..(206): Xaa can be any naturally occurring amino acid
MAAVIPAITKISPRVIRILGCNPGFMTLQGTNTYIVGTGKRRILIDTGDEGIPQYINHLKSVLTYEGIDLAHIFITHWHHDHIGGLNDILTELREKTKHCQVWKYPSLKDDINKNELIESFKDGQEFAVEGATLRVVHTPGHTDDHIVLHLLEDNVIFSADCILLEGTAVFEDLYDYMRSLQDIANLQPATILXRHXNTIXXPAEXISFYIKHRLERE

SEQ ID NO: 23195 - protein, 109 aa, Diabrotica virgifera
  misc_feature: Coding regions on vcDNA: vcDNA=SeqID_2892; Strand=+; Position=1426 -1752
KKKRGKPPEKGETPPIFSLSGIFNPPFSIFVFVYKKEKIFFFFSKKKLAPKKKTTYFCGLKKKKIFLEYFRRKIHKKYIINIFFFLGVFLHHKKTNKRGGNIFFFLHPP

SEQ ID NO: 23196 - protein, 84 aa, Diabrotica virgifera
  misc_feature: Coding regions on vcDNA: vcDNA=SeqID_2893; Strand=+; Position=859-1113
CHIKQLTSHLRSNSVIIQKAKYRENEILKLALKFFRISLKTIIIRKITIFIPLPRVFEALTKIRIKFTWVKYFKKNFFFELGPL

SEQ ID NO: 23197 - protein, 479 aa, Diabrotica virgifera
  misc_feature: Coding regions on vcDNA: vcDNA=SeqID_2894; Strand=+; Position=50-1489
  misc_feature: Homolog annotation: Hit_ID=XP_309120.1; Match level="QueryCoverage =92%, HitCoverage=98%, E-value=0.0, Identity=71%"; Hit description =ENSANGP00000024967 [Anopheles gambiae] gb|EAA04978.2| ENSANGP00000024967 [Anopheles gambiae
  misc_feature: Gene Ontology Annotation: Molecular function=peptidase activity; Cellular component=mitochondrion; Biological process=electron transport
  misc_feature: Pfam annotation: Pfam_ID=Peptidase_M16; Match level="Score=254.7, E -value=1.7e-73, Copies=1"; Pfam description=Insulinase (Peptidase family M16)
MASILKFSRSFAKLPKYETALKACRQNIIRGAATQPDSQTVVLNVPPTKVSTLKNGIRVATEDWGSQTATVGIWIDAGSRYEDDKNNGVAHFMEHMAFKGTSKRTQSQLEIEIEDLGAQLNAYTSREQTVYYSKCLAKDVPKAIEILADIIQNAKLGEAEIERERGVILREMQEVESNLQEVVFDHLHAIAYQGTPLANTILGPTANIRSINSTDLRNYLDNHYKSSRIVVAGAGGIEHQDLVKLAESHLGSLNNTYPGKVPVIAPCRFTGSEIRVRDDSLPLAHIALAVEGAGWSDPDTLTLMVASTLLGAWDRSQASAKQNATNLARASGEGDLCHSYQSFNTCYKDTGLWGVYFVSDPLKIEDMVFNIQQEFMRLCTSVTEGEVERAKALLTANTLLQLDTTSAVCEDIGRQLLCYGRRLPPHELAHRINSITAKNVKDVCYKYLYDRCPAVAGVGPVEQLPDYNIVRSQMYWLRV

SEQ ID NO: 23198 - protein, 210 aa, Diabrotica virgifera
  misc_feature: Coding regions on vcDNA: vcDNA=SeqID_2895; Strand=+; Position=74-706
KMLKKILVLCLVCNACMAYTATISQAAVSNNNNNIGTISAFLKEILKITGIVTANNASILQNATVHVATIFSNVLPPLPPGLPPLNLDEVILSVFKWFQDILIWYATVIKKLEDSLKLPSSQSLPNVPGNFTIDETGKSITDWATVNQKSIQAAIDEALKGVEPFPPYPDIFPKIAKQYVDYLQVIPDSIREVIKNTVKSIGEEINKIKI

SEQ ID NO: 23199 - protein, 238 aa, Diabrotica virgifera
  misc_feature: Coding regions on vcDNA: vcDNA=SeqID_2896; Strand=+; Position=1-717
  misc_feature: Pfam annotation: Pfam_ID=Reticulon; Match level="Score=-75.0, E-value= 0.078, Copies=1"; Pfam description=Reticulon
ANGESRVRNCDYLFTKITMNFLRQKFSDVVIPYFSKRIETNKEQKVGKYGQYFEKIYEVLSWEDTRYSLVVFVVFNYLFWLMVQWQIKIVGLIFFILLILFLFDTFFPHTRQIEQPIKSADMVDNTYIVIMDIFYGLKAFRNENSLTFCVGMSIVFLIINIIARSVSGYLICYLLLLLSFFVPLGIKLLPEEVTSKIANGIKYTFNVKGTLAEEELVPFICDKDFNNRDADLDSLCTG

SEQ ID NO: 23200 - protein, 223 aa, Diabrotica virgifera
  misc_feature: Coding regions on vcDNA: vcDNA=SeqID_2897; Strand=+; Position=38-705
  misc_feature: Homolog annotation: Hit_ID=XP_391877.1; Match level="QueryCoverage =93%, HitCoverage=33%, E-value=6e-49, Identity=47%"; Hit description =similar to ENSANGP00000015372 [Apis mellifera]
  misc_feature: Pfam annotation: Pfam_ID=FG-GAP; Match level="Score=28.8, E-value =1.6e-05, Copies=2"; Pfam description=FG-GAP repeat
  misc_feature (148)..(148): Xaa can be any naturally occurring amino acid
  misc_feature (153)..(153): Xaa can be any naturally occurring amino acid
  misc_feature (155)..(155): Xaa can be any naturally occurring amino acid
  misc_feature (158)..(158): Xaa can be any naturally occurring amino acid
  misc_feature (175)..(175): Xaa can be any naturally occurring amino acid
MSHLKKFTMGTIKNVIVVFLTVQIFIVRCSDITKLAFGQFTHGLPAAFGDFNSDELTDVFVLTNREQTLQILLAYAEEPLLRPAPTLNCTFKNHKITSVVPGDFDGDALMDVLITTIKADTSINNARTSIYILWGGNTTFNCTEIEGXPLIEXVXQPXAIDYNQDMIIDLFGEDXEKKRAFWFLVKTELSLKKVEMHHHNKEPNGVLMKPHAHAFLDLNDDYM

SEQ ID NO: 23201 - protein, 57 aa, Diabrotica virgifera
  misc_feature: Coding regions on vcDNA: vcDNA=SeqID_2898; Strand=-; Position=128-301
FTEVRSTEVNYRREARMSSREVCILFYSQSVSSLWISNTHNLPIIISFQISVSIFIM

SEQ ID NO: 23202 - protein, 324 aa, Diabrotica virgifera
  misc_feature: Coding regions on vcDNA: vcDNA=SeqID_2899; Strand=+; Position=139-1113
  misc_feature: Homolog annotation: Hit_ID=NP_874407.1; Match level="QueryCoverage =72%, HitCoverage=99%, E-value=9e-28, Identity=37%"; Hit description =RNA-binding protein, RRM domain [Prochlorococcus marinus subsp. marinus str. CCMP1375]
  misc_feature: Gene Ontology Annotation: Molecular function=RNA polymerase II transcription factor activity; Cellular component=transcription factor TFIID complex; Biological process=mRNA-nucleus export
  misc_feature: Pfam annotation: Pfam_ID=RRM_1; Match level="Score=69.0, E-value=1.3e- 17, Copies=1"; Pfam description=RNA recognition motif. (a.k.a. RRM, R
MTPGRSSTTTKVFVGSLPPDATPEDLKKLFEPYGNIAECDIANKCGFLHLEDGELAMKAIDELNGMEFMGSKISVEKGRVKPRRSGGGPRGGRERGGPYSRGGGDFRGRNGGFGGGRDGGPYRGGGGFDRSGRGGYGGGDRGYDDRRGGRPAYDDRSTGGFDGYDDRRGGYDRDPYAAGGYGGGYERQGGYDSRGGYEDRRGAAGAYDQRAAAPDGLYSRRDMAPKQSYGGSNGYGASAGYGRDAGGYGAAYGDRADADPYAAADPYRGASAGGGYQDRGDRGYGGRPAEGYGNSYAAASGGATAARSGYDSAYPPLPQQRGMY

SEQ ID NO: 23203 - protein, 74 aa, Diabrotica virgifera
  misc_feature: Coding regions on vcDNA: vcDNA=SeqID_2900; Strand=-; Position=832-1056
QLKMISLFFYFEKNSRLVFLICLAIVSNHTLAYFLTTYSIASFSTEISSWHFYRHLPNSFTFSRWTLGQTENEK

SEQ ID NO: 23204 - protein, 350 aa, Diabrotica virgifera
  misc_feature: Coding regions on vcDNA: vcDNA=SeqID_2901; Strand=+; Position=264-1316
  misc_feature: Homolog annotation: Hit_ID=NP_731712.1; Match level="QueryCoverage =97%, HitCoverage=89%, E-value=1e-145, Identity=67%"; Hit description= CG5887-PE, isoform E [Drosophila melanogaster] ref|NP_731711.1| CG5887-PD, isoform D [Drosophila
  misc_feature: Gene Ontology Annotation: Molecular function=stearoyl-CoA desaturase activity; Cellular component=integral to membrane; Biological process=lipid metabolism
  misc_feature: Pfam annotation: Pfam_ID=FA_desaturase; Match level="Score=284.9, E -value=1.3e-82, Copies=1"; Pfam description=Fatty acid desaturase
MAPNTSMPTGVLHEHDDEVQAKMIPAEIVKPSERKLELVWRNIILFAYLHMVALYGFYLMIAQARVFTSILAVVLYICGGLGITAGAHRLWAHRSYQAKWPLKILLTIFNTLAFENSVIEWSRDHRVHHKFSETDADPHNAKRGFFFAHVGWLLCRKHPEVKSKGKGIDMSDLEQDPILAFQDRHYLMLMPITCFVIPTIIPMYFWNETFFNAFCVNIFRYVFTLNATWLVNSAAHMWGDKPYDKFINPSENVSVSVFALGEGWHNYHHTFPWDYKTSELGKYSTNFSSAFIDFFAKIGWAYDLRTVSIDMIKKRVQRTGDGTHEIWGWGDKDQRKEDYDDATVLYKKDY

SEQ ID NO: 23205 - protein, 85 aa, Diabrotica virgifera
  misc_feature: Coding regions on vcDNA: vcDNA=SeqID_2902; Strand=+; Position=589-846
ELLISPFFLYCHVVYFLKEDRRLPWRSTARTFICNHRIIYDDNYYINLILVLHPFLLKLFGILSLSDTLKLRNFLFYYFFAFSVK

SEQ ID NO: 23206 - protein, 303 aa, Diabrotica virgifera
  misc_feature: Coding regions on vcDNA: vcDNA=SeqID_2903; Strand=+; Position=22-930
  misc_feature: Homolog annotation: Hit_ID=AAM22695.1; Match level="QueryCoverage =99%, HitCoverage=63%, E-value=7e-86, Identity=49%"; Hit description =juvenile hormone epoxide hydrolase II [Ctenocephalides felis]
  misc_feature: Gene Ontology Annotation: Molecular function=epoxide hydrolase activity
  misc_feature: Pfam annotation: Pfam_ID=EHN; Match level="Score=221.9, E-value=1.2e -63, Copies=1"; Pfam description=Epoxide hydrolase N terminus
  misc_feature (264)..(264): Xaa can be any naturally occurring amino acid
  misc_feature (266)..(266): Xaa can be any naturally occurring amino acid
  misc_feature (288)..(288): Xaa can be any naturally occurring amino acid
  misc_feature (295)..(295): Xaa can be any naturally occurring amino acid
MGCCAKVGAVVAVLLAVLVVYSTKSLFQTPKVPDLGEKWWKVAKPAKVDTSIKPFKIQISDEILKDLKDRLDRSLPFQPPLDGVKQHYGMNTNLLNTIVDYWKNKYDWRQREKFFNQYPQFTTNIQGLNIHFLHVKPTETKGLKVFPMLMLHGWPGSVREFYEMIPLLTKPQKGRDFVFELIIPSLPGYGFSEGAEVSGLGAPHVAVIMKNLMTRLGFQKYYLQGGDWGGIIVANLASLFPEKVLGVHSNMCFANSPLSHLKLXLXSLMPSLIVEADKQHLVYPRNEXFWILLLXKWYMHLQA

SEQ ID NO: 23207 - protein, 330 aa, Diabrotica virgifera
  misc_feature: Coding regions on vcDNA: vcDNA=SeqID_2904; Strand=+; Position=83-1072
  misc_feature: Homolog annotation: Hit_ID=AAM22695.1; Match level="QueryCoverage =99%, HitCoverage=69%, E-value=1e-100, Identity=53%"; Hit description= juvenile hormone epoxide hydrolase II [Ctenocephalides felis]
  misc_feature: Gene Ontology Annotation: Molecular function=epoxide hydrolase activity
  misc_feature: Pfam annotation: Pfam_ID=EHN; Match level="Score=225.6, E-value=9.4e -65, Copies=1"; Pfam description=Epoxide hydrolase N terminus
MGCCAKVGALVAVLLAILIVYCSQSLFETPERPDLGEKWWKVVKPAKVDTSVKPFKIQISDEILKDLKDRLDRTLPFQPPLDGVKQHYGMNTNLLKTIVDYWKNKYDWRQREKFFNQYPQFTTNIQGLNIHFLHVKPAETKGLKVFPMLMLHGWPGSIREFYEIIPILTKPQKGRDFVFELIIPSLPGYGFSEAAEVTGLNPAQISVIMKNLMARLGFQKYYLQGGDWGSAIVANLASLFPEKVLGVHSNMCMVNSMLSNLKLALGSFMPSLIVDADKQHLLYPRMKHFGFLILESGYMHLQGSKPDTVGVALRDSPVGLAAYIIEKFHT

SEQ ID NO: 23208 - protein, 116 aa, Diabrotica virgifera
  misc_feature: Coding regions on vcDNA: vcDNA=SeqID_2905; Strand=+; Position=101-451
  misc_feature: Homolog annotation: Hit_ID=EAA44385.2; Match level="QueryCoverage =99%, HitCoverage=100%, E-value=1e-34, Identity=65%"; Hit description= ENSANGP00000023097 [Anopheles gambiae str. PEST] ref|XP_557920.1| ENSANGP00000023097 [Anopheles gambiae s
  misc_feature: Gene Ontology Annotation: Molecular function=transcription factor activity; Cellular component=nucleus; Biological process=signal transduction
  misc_feature: Pfam annotation: Pfam_ID=bZIP_2; Match level="Score=24.3, E-value =0.00038, Copies=1"; Pfam description=Basic region leucine zipper
MNFEEMAVIEEHSVCEGPARKESGKRGRKPGRKSAEKVDMKAKLERSRQSARECRARKKLRYQYLEELVADREKAVIALRKEYEQYIFWAKEIDAGRIPEGIHEALEELSLNQEQK

SEQ ID NO: 23209 - protein, 139 aa, Diabrotica virgifera
  misc_feature: Coding regions on vcDNA: vcDNA=SeqID_2906; Strand=+; Position=2-421
  misc_feature: Homolog annotation: Hit_ID=NP_647918.2; Match level="QueryCoverage =84%, HitCoverage=23%, E-value=4e-47, Identity=79%"; Hit description =CG7471-PA [Drosophila melanogaster] gb|AAF47924.1| CG7471-PA [Drosophila melanogaster]
  misc_feature: Gene Ontology Annotation: Molecular function=histone deacetylase activity; Cellular component=nucleus; Biological process=chromatin silencing
SNMANQNTPEYLEKIKTRLFENLRMLPHAPGVQVQAIPEDAINEESDNEDKVDKDERLPQKDLDKRIVPENEFSDSEDEGEGDRRDNRSYKGRKRPRLDKGGENKEEDKIKDEMKAEKGEEGIMKSSPDDTKKLLGPTP

SEQ ID NO: 23210 - protein, 303 aa, Diabrotica virgifera
  misc_feature: Coding regions on vcDNA: vcDNA=SeqID_2907; Strand=+; Position=17-925
  misc_feature: Homolog annotation: Hit_ID=AAV91432.1; Match level="QueryCoverage =92%, HitCoverage=53%, E-value=5e-27, Identity=27%"; Hit description =serine protease 1 [Lonomia obliqua]
  misc_feature: Gene Ontology Annotation: Molecular function=scavenger receptor activity
  misc_feature: Pfam annotation: Pfam_ID=Sushi; Match level="Score=33.7, E-value=5.6e- 07, Copies=1"; Pfam description=Sushi domain (SCR repeat)
  misc_feature (294)..(294): Xaa can be any naturally occurring amino acid
MEVNGSFSLLCLWFSFIGLVSATLEINSIDTNSIIRKTRQSSLKCTLPPQIENGKWLITEADVQPGDQIEVNTIVRLECNEGYQLYPYNTLMACDSNWDEEDFPVCRKKCPSFYSTATTKLICKDKDENTITCDKATDGTYLTYSCVAFYEVPPGGKNVLYCNDGIWDFPKPLCKPICGKKVTTDTTELTWGGTDVKGYEYPWVIAMFKKLAGKYENVCGGTLVSRRVVVTAAHCVTDNYGNALGRENFQVAAGKLYNAFGDPRDKHAQYRKISQVVVHPGYRGVSQRYVADLXLLITQELFK

SEQ ID NO: 23211 - protein, 104 aa, Diabrotica virgifera
  misc_feature: Coding regions on vcDNA: vcDNA=SeqID_2908; Strand=-; Position=199-513
NLPRSSISIHQSLSDQTPFSFQQIFSSLLTNPLWYAGFRLISTNIQATVSCSCIRYIFNQENNIFVCVSNPTLTIMSLRYFKNISTSFLDLFKQILADKRLSTI

SEQ ID NO: 23212 - protein, 199 aa, Diabrotica virgifera
  misc_feature: Coding regions on vcDNA: vcDNA=SeqID_2909; Strand=-; Position=490-1089
  misc_feature: Homolog annotation: Hit_ID=CAA10770.1; Match level="QueryCoverage =71%, HitCoverage=42%, E-value=7e-25, Identity=37%"; Hit description =reverse transcriptase-like [Bos taurus]
  misc_feature (97)..(97): Xaa can be any naturally occurring amino acid
KLTKFSSKLYCLKLLESTTLFLILQKLNKPNFYQFVLSYISNTGSCETEIRRRIGMAKNAMSRLSKIWKDHFLSKNTKIRLVRALIFPIFNYRFEIXTMKSDDRKTIDAFEMCCWRRIIRISWTEHRTNHSILQELNIQTRLSSICLSIVLKFFGHIARRSDNNLERLIISGNVEGRVTHLLDGRIKYRKPVEKHSLNP

SEQ ID NO: 23213 - protein, 239 aa, Diabrotica virgifera
  misc_feature: Coding regions on vcDNA: vcDNA=SeqID_2910; Strand=+; Position=3-722
PRVRPRVRLLPLICCPCVVPICFKMQKIAFFIFMGFMHHAYIMAPWYSKDTVECVTPKIKTVIKEQIECDQNYTPPFDTMKITHRKNQIRPFYFVTDRCSFRPGIDVCLERSMNLVSDCFNSSNLEGLATWKKIDNEVTEYVCKNNSEVGYDLFENSTAKCYIEQITYALDRCVPLLKLNTTIYDIQGLTQSCKNSEEFSTCFIKDLRKACSEKVIEMASTLIKIVESHLCPKKDDKLV

SEQ ID NO: 23214 - protein, 854 aa, Diabrotica virgifera
  misc_feature: Coding regions on vcDNA: vcDNA=SeqID_2911; Strand=+; Position=255-2819
  misc_feature: Homolog annotation: Hit_ID=XP_321521.1; Match level="QueryCoverage =99%, HitCoverage=99%, E-value=0.0, Identity=65%"; Hit description =ENSANGP00000024503 [Anopheles gambiae] gb|EAA43151.1| ENSANGP00000024503 [Anopheles gambiae
  misc_feature: Gene Ontology Annotation: Molecular function=transporter activity; Cellular component=integral to membrane; Biological process=negative regulation of locomotion
  misc_feature: Pfam annotation: Pfam_ID=V_ATPase_I; Match level="Score=1142.6, E -value=0, Copies=1"; Pfam description=V-type ATPase 116kDa subunit family
MGSMFRSEEMVLAQLFVQPEASYYAISELGETGCVQFRDLNEEVNAFQRKFVNEVRRCDEMERKLRYIEAEVRKDDVNIPDVSELPKAPNPREIIDLEAHLEKTEGDIKELSESAVNLKSNYLELTELKHVLEKTQAFFNEQDEANGLSDSVHKSLIPAEDHNASIRGRLGFVAGVINRERVPAFERMLWRISRGNVFLRQAEIETPMEDPATGIAYNKTVFAAFFQGEQLKTRIKKVCAGFHASLYPCPNTITERNDMLKGVRTRLEDLNLVLNQTRDHRQRVLVSVAKELQNWSIMVSKMKAIYHTLNFFNMDVTKKCLIGECWVPSNDIPVVQKALADGSSASGSSIPSFLNVINTHEAPPTFNRTNKFTRGFQNLIDAYGVASYREVNPALYTIITFPFLFAVMFGDCGHAMIMFLFGLYLVLSEKKINAMKNKSEIFVIFFGGRYIILLMGIFSFYTGFVYNDIFSKSMNIFGSRWYVNITNASTQIHEEMDLLPKMNYMGTPYYIGLDPVWQSAKNKIIFLNSLKMKMSIILGIVHMLFGVICSTFNFVHFKKYYSIVFEFLPQVLLLLFLFMYMVIMMFMKWVLYSGENDGWDKNVTAKDGSSCAPSVLIYFINMMLMSPSTANKGCDIYMYDYQREIQMGLVFCALICIPFMLLGKPLYIMRQRKNQAKNGSVQLVSNNKTNGDVNLGMELEEIENNLQDVAEVAAQAHHEKEEEEEPMSEIFIHSAIHTIEYTLSTISHTASYLRLWALSLAHAQLSEVLWTMLFSKIALRREGFIGVPMIFILFSAWAFFTVAILVLMEGLSAFLHTLRLHWVEFMSKFYSGVGYIFEPFSFKRILEQEAGEED

SEQ ID NO: 23215 - protein, 66 aa, Diabrotica virgifera
  misc_feature: Coding regions on vcDNA: vcDNA=SeqID_2912; Strand=+; Position=713-910
  misc_feature (40)..(40): Xaa can be any naturally occurring amino acid
  misc_feature (52)..(52): Xaa can be any naturally occurring amino acid
TDIENRTVNERIFEPMEIIKSKQTKSLTENVTASRGKRDXTIKPHHRREPEXRSHQLKGGDLDITS

SEQ ID NO: 23216 - protein, 181 aa, Diabrotica virgifera
  misc_feature: Coding regions on vcDNA: vcDNA=SeqID_2913; Strand=+; Position=111-656
  misc_feature: Homolog annotation: Hit_ID=XP_308606.1; Match level="QueryCoverage =88%, HitCoverage=89%, E-value=1e-35, Identity=50%"; Hit description =ENSANGP00000018891 [Anopheles gambiae]
  misc_feature: Gene Ontology Annotation: Molecular function=chaperone activity; Cellular component=cytosol; Biological process=protein folding
  misc_feature: Pfam annotation: Pfam_ID=HSP20; Match level="Score=119.3, E-value =9.2e-33, Copies=1"; Pfam description=Hsp20/alpha crystallin family
MSLIPLPYFFGDGPYSRPSRLFDQHFGQVLEPEDLLQPISRQFLRCPAGYLRNWQSASSGNDSGSTIDLGKDQFSANLDVQQFKPDEISVKVTGDREVTIEGKHEEKEDEHGHVYRHFKRRYVLPKGYDMDKIVSKLSTDGVLSIHAPKIAAGEIEHKKIAIEHTGKPAKSLEGAKGAGEK

SEQ ID NO: 23217 - protein, 87 aa, Diabrotica virgifera
  misc_feature: Coding regions on vcDNA: vcDNA=SeqID_2914; Strand=+; Position=628-888
  misc_feature: Homolog annotation: Hit_ID=XP_328828.1; Match level="QueryCoverage =71%, HitCoverage=89%, E-value=1e-19, Identity=79%"; Hit description =predicted protein [Neurospora crassa] gb|EAA34645.1| predicted protein [Neurospora crassa]
  misc_feature: Gene Ontology Annotation: Molecular function=molecular_function unknown; Cellular component=small nucleolar ribonucleoprotein complex; Biological process=snRNP protein-nucleus import
IYIYCEKKKKKKKKKKKKKKKKKKKKKKKKKKKKKKKKKKKKKKKKKKRGKKKKGGGPLKRSNFKKGGWGSKNFFKGAPKFIFGGGF

SEQ ID NO: 23218 - protein, 447 aa, Diabrotica virgifera
  misc_feature: Coding regions on vcDNA: vcDNA=SeqID_2915; Strand=+; Position=104-1447
  misc_feature: Homolog annotation: Hit_ID=XP_392313.1; Match level="QueryCoverage =100%, HitCoverage=100%, E-value=0.0, Identity=98%"; Hit description =similar to beta-1 tubulin [Apis mellifera]
  misc_feature: Gene Ontology Annotation: Molecular function=structural constituent of cytoskeleton; Cellular component=tubulin; Biological process =microtubule-based process
  misc_feature: Pfam annotation: Pfam_ID=Tubulin; Match level="Score=379.9, E-value =3.4e-111, Copies=1"; Pfam description=Tubulin/FtsZ family, GTPase domain
MREIVHIQAGQCGNQIGAKFWEIISDEHGIDPTGAYHGDSDLQLERINVYYNEASGGKYVPRAILVDLEPGTMDSVRSGPFGQIFRPDNFVFGQSGAGNNWAKGHYTEGAELVDSVLDVVRKEAESCDCLQGFQLTHSLGGGTGSGMGTLLISKIREEYPDRIMNTYSVVPSPKVSDTVVEPYNATLSVHQLVENTDETYCIDNEALYDICFRTLKLTTPTYGDLNHLVSLTMSGVTTCLRFPGQLNADLRKLAVNMVPFPRLHFFMPGFAPLTSRGSQQYRALTVPELTQQMFDAKNMMAACDPRHGRYLTVAAVFRGRMSMKEVDEQMLNIQNKNSSYFVEWIPNNVKTAVCDIPPRGLKMSATFIGNSTAIQELFKRISEQFTAMFRRKAFLHWYTGEGMDEMEFTEAESNMNDLVSEYQQYQEATADEDAEFDEDQEAEVDEN

SEQ ID NO: 23219 - protein, 90 aa, Diabrotica virgifera
  misc_feature: Coding regions on vcDNA: vcDNA=SeqID_2916; Strand=+; Position=910-1182
LHRGLLRVNCRRPETRIWTTHHPRDSFIFFVELFITQISISTLDSGRSISIIRIGDIIFRGYFEGEFISIDVFVPYMCFIPLVFDLIYHM

SEQ ID NO: 23220 - protein, 68 aa, Diabrotica virgifera
  misc_feature: Coding regions on vcDNA: vcDNA=SeqID_2917; Strand=-; Position=316-522
LLKKTPNAQSLWLSRQFLLLLSIALLPSLRFLSYPVYHRCTKLPSPDPSPSRKLSYLILDYCDKYLCR

SEQ ID NO: 23221 - protein, 351 aa, Diabrotica virgifera
  misc_feature: Coding regions on vcDNA: vcDNA=SeqID_2918; Strand=+; Position=117-1169
  misc_feature: Homolog annotation: Hit_ID=BAA86911.1; Match level="QueryCoverage =99%, HitCoverage=65%, E-value=1e-112, Identity=58%"; Hit description= homologue of Sarcophaga 26,29kDa proteinase [Periplaneta americana]
  misc_feature: Gene Ontology Annotation: Molecular function=cathepsin S activity; Cellular component=lysosome; Biological process=proteolysis and peptidolysis
MGSFTIVLLFCFIASSVNGKDQTPTWKQTYSVTGLLSIPYAEIQEPFSAWYDEPSKRSRIDYYGDMVKTYQLGTPGYGVSLKVTPVTTETEENVRSCLMVNGTEEISITPQAILPDLTGFKSDGKEVVNGFETEKWTLVNIVGHKVNRYSMWIKDGGIPVRYEMKGFNSLLGSHYDHYYLDYYTYDPSPISDDTFRVPADLECSAFPGPGDKHIYTFNPMAEFIRPEKTGHLDFEFNKFVNKHRRQYADKNEHENRKYIFSQNIRFIHAVNRQNKGYTLTVNHLADKTDLELKALRGKKYTGVYNGGAPFPYKKNEMDNLPDSYDWRIFGAVSPVKDQSVCGSGWSFGTVG

SEQ ID NO: 23222 - protein, 315 aa, Diabrotica virgifera
  misc_feature: Coding regions on vcDNA: vcDNA=SeqID_2919; Strand=+; Position=39-986
  misc_feature: Homolog annotation: Hit_ID=XP_396489.1; Match level="QueryCoverage =92%, HitCoverage=96%, E-value=4e-23, Identity=27%"; Hit description =similar to ENSANGP00000015774 [Apis mellifera]
  misc_feature: Pfam annotation: Pfam_ID=dsrm; Match level="Score=118.5, E-value=1.7e- 32, Copies=2"; Pfam description=Double-stranded RNA binding motif
MGKMANNRKTPVMALQELAVKKGFPVPQYEIVDSILGTHNDRFDCRVKACGMEAEGTGTSKQISKHEAAYKLLKLLEEGGIYDPKELPVQEFQVEVAGLENGSSVEAPVNWIGPLIEMCAKTKIEDPMFKEISAVGLSHSREFTYECRIGSLKTLAVGRTIKMAKHLAAKEMLEKLKDNDILSILILENPKKDHQQRYNKLMTSVVRNKMAKLKDFITVFHDLMEKYEKNSDVFINDLRERTEESLVRILKQLKLKHDILVVKDESPVIIVLHVNCNVPYAVMGMGATVEQAKEEALDETFLLLDGLIQNSIQRV

SEQ ID NO: 23223 - protein, 184 aa, Diabrotica virgifera
  misc_feature: Coding regions on vcDNA: vcDNA=SeqID_2920; Strand=+; Position=60-614
  misc_feature: Homolog annotation: Hit_ID=XP_392501.1; Match level="QueryCoverage =100%, HitCoverage=100%, E-value=8e-83, Identity=78%"; Hit description=similar to CG4696-PA [Apis mellifera]
  misc_feature: Gene Ontology Annotation: Molecular function=actin binding; Cellular component=cellular_component unknown; Biological process=smooth muscle contraction
  misc_feature: Pfam annotation: Pfam_ID=CH; Match level="Score=73.8, E-value=4.6e -19, Copies=1"; Pfam description=Calponin homology (CH) domain
MSLERQVRNKLAAKRDPQQDKEAQAWIETILGAKFPPGEAYEDVIRDGTVLCQLINKLAPGSVAKINTSGGQFKMMENINNFQAAIKAYGVADIDVFQTVDLWEKKDIAQVTNTLFAIGRQTYKHPEWKGPYLGPKPADENKREFTEEQLKAGETMIGLQAGQNKGASQAGQNMGAGRKIILGK

SEQ ID NO: 23224 - protein, 368 aa, Diabrotica virgifera
  misc_feature: Coding regions on vcDNA: vcDNA=SeqID_2921; Strand=+; Position=90-1193
  misc_feature: Homolog annotation: Hit_ID=NP_701490.1; Match level="QueryCoverage =90%, HitCoverage=31%, E-value=1e-32, Identity=29%"; Hit description =eukaryotic translation initiation factor 3 subunit 10, putative [Plasmodium falciparum 3D7]
MNSLMNYGNGSDDDLDDVADEASVDPYGGSARNFRKPTSAQQTDDTNYDEVQMSCSEDSDAEMRSSSKYRDRDRDDKRSSPRGSRDSRDKDRRDDRSERDRYSGRDRNDDRSSRYRDDDRSRYRDDKDDDRSRHRDDKDDDRSRHRDDKDVDRSRHRDDKDDDKSRHRDDKDDDRSRHRDDKDDRRSKDDDRGRDRSRSRDDDRSRDRRDDRRDRHSRDDRYRSDRDRRRSRSRDRDRRRSRSPRRSRSRERPGRGGFQRRFDRGGRINKPGFDPKTATQTPQEGDSTQNKDRFFMPGITGRFRDQIEKRKMLWQKKDPEPEQAGPAVPIHNPKLQANAPRSTKLWEATTFAQDTDGKVANKFKRLMG

SEQ ID NO: 23225 - protein, 692 aa, Diabrotica virgifera
  misc_feature: Coding regions on vcDNA: vcDNA=SeqID_2922; Strand=+; Position=51-2122
  misc_feature: Homolog annotation: Hit_ID=XP_318103.1; Match level="QueryCoverage =99%, HitCoverage=73%, E-value=0.0, Identity=62%"; Hit description =ENSANGP00000017513 [Anopheles gambiae]
  misc_feature: Gene Ontology Annotation: Molecular function=translation initiation factor activity; Cellular component=eukaryotic translation initiation factor 3 complex; Biological process=regulation of translational initiation
  misc_feature: Pfam annotation: Pfam_ID=eIF-3c_N; Match level="Score=1082.0, E-value= 0, Copies=1"; Pfam description=Eukaryotic translation initiation fac
  misc_feature (651)..(651): Xaa can be any naturally occurring amino acid
  misc_feature (665)..(665): Xaa can be any naturally occurring amino acid
  misc_feature (675)..(675): Xaa can be any naturally occurring amino acid
  misc_feature (683)..(683): Xaa can be any naturally occurring amino acid
GKTVKMSRFFAGSDSDSDSSSEEEIIQRPQVPAYTFSDDEEEVKRVVRSAKEKRYEELTNTIKQIRNFKKIKDMSSMLNSFEELQKAYQKAAPVIVKEENGQTPRFFIRCLAEMEDFINEMWEDRDGRKNMSKNNSKSLTSMRQKLRKYLKDFEDDLAKFKENPEQPDDEEEEEKPEVAEDSENEAPSKNAFLKAPPKQVVDDKDESSDSDDWPSDSESSLSSSDDDEGKYQSIRERFLKRTGPAHEEDEERERRKEEKRKERKEKGRKLKKDEEEDGEGKWETVNRGFAIPSEKPKMFAKDAEIDLNLVIKKLSEIMAARGKKRTDRREQIELLHELQNVSEQHQLGAAIFIKIKLAIISAIFDYNPKVSDAMKPEYWLKLLERMSEMLGMLLNTTNLVVSDGITEEMENLEEPPYRIRGCILTSVERLDDEFTKLLKECDPHSNEYVERLKDECKVSSIIDKTMKYLERSNVSSELCRIYLRKIEHLYYKFDPRVLQQKADPLVVPKDEMNSVQEMEKLCKFIYAKDSTDRLRTRAILSHIYHHALHDNWFQARDLVLMSHLQETIQHSDPSTQILYNRTMAHLGLCAFRHANIKDAHNCLVDLMMTGKPKELLAQGLLPQRQHERSKEQEKIEKQRQMPFHMHINLEXLECVYLVSAMLIEXPYMAAHEFDXRRRMISKXFYQAVRSSD

SEQ ID NO: 23226 - protein, 278 aa, Diabrotica virgifera
  misc_feature: Coding regions on vcDNA: vcDNA=SeqID_2923; Strand=+; Position=112-948
  misc_feature: Homolog annotation: Hit_ID=EAL26929.1; Match level="QueryCoverage =97%, HitCoverage=41%, E-value=8e-62, Identity=47%"; Hit description =GA18879-PA [Drosophila pseudoobscura]
  misc_feature: Pfam annotation: Pfam_ID=TPR_2; Match level="Score=16.6, E-value =0.077, Copies=2"; Pfam description=Tetratricopeptide repeat
MAEKTIKDKTITSLYAELNKFNQNGEYERSLKTSNKILGVAPHEFLAFQCKMVCLIHLSRFEEAISLMNKNPQFLQEVIFEKAYSYYRVNKPEEALKTIELSENELDFRCKELKAQILYRLEQYDNSVSIYRDIIKNMHDDDYDDERYTNLSAAMVHLKNENAMDTINEFVENTYEQCYNKACLLIEYENYLEAEKKLKQCEKMCREMLEEDETTEEEIDIELALIRIQLAYVYQKPGRTKESQLLYTGNLKLKLDDIALMAVASNNIACINKEQKLF

SEQ ID NO: 23227 - protein, 302 aa, Diabrotica virgifera
  misc_feature: Coding regions on vcDNA: vcDNA=SeqID_2924; Strand=+; Position=130-1038
  misc_feature: Homolog annotation: Hit_ID=XP_393499.1; Match level="QueryCoverage =79%, HitCoverage=85%, E-value=2e-77, Identity=57%"; Hit description =similar to CG11009-PA [Apis mellifera]
  misc_feature: Gene Ontology Annotation: Molecular function=protein binding; Cellular component=cellular_component unknown; Biological process =biological_process unknown
  misc_feature: Pfam annotation: Pfam_ID=GRAM; Match level="Score=29.8, E-value=8e -06, Copies=1"; Pfam description=GRAM domain
MSLNTAHLNGGVLIHNGEQILLYSDGVGIEWSGQQGNAFYGVKKGSIYLTTHRVIFLNKSSADEMLSFSFPFVTLSEVEIEQPVFGANYIKGKVRAQPNGNWIGEAKFKMTFKHGGAIEFGQALLRAAHFASRGGGYDAPPPYVPPQTQWYAAPPPSYAAASQGYYGWMPPTNVFPQHPPTDGVFMTDAPPPYPGIVPGYQPNGYGPPQGPPGYSQGPPMYPGPASYGGQSSAGAAGFHNHHNLLVPQMPKLMKLLNRPTIIKIVDHHRGMLLLPHPIFEIHPPTAKLPYRRISKHLQAYWK

SEQ ID NO: 23228 - protein, 92 aa, Diabrotica virgifera
  misc_feature: Coding regions on vcDNA: vcDNA=SeqID_2925; Strand=+; Position=344-622
HLIPFLVMICIFILFRRQIIYPVYELKFLDYFLDIHIFYFAVFFTFVHSIFYRNLIIVIIRHWLWKLYLYSTTKICVLDYSLDITKILESVF

SEQ ID NO: 23229 - protein, 290 aa, Diabrotica virgifera
  misc_feature: Coding regions on vcDNA: vcDNA=SeqID_2926; Strand=+; Position=196-1067
  misc_feature: Homolog annotation: Hit_ID=S50830; Match level="QueryCoverage=91%, HitCoverage=71%, E-value=3e-70, Identity=53%"; Hit description =Machado-Joseph disease MJD1a protein - human gb|AAB33571.1| MJD1 protein [Homo sapiens]
  misc_feature: Gene Ontology Annotation: Cellular component=nucleoplasm; Biological process=synaptic transmission
  misc_feature: Pfam annotation: Pfam_ID=Josephin; Match level="Score=267.3, E-value =2.7e-77, Copies=1"; Pfam description=Josephin
  misc_feature (193)..(193): Xaa can be any naturally occurring amino acid
  misc_feature (204)..(204): Xaa can be any naturally occurring amino acid
MEAIFHEKQEGSLCAQHCLNSLLQGSYFTAVDLSTLAEKLDDEERQRMAECGEESEEYHKFLQQPSGNMDDSGYFSVQVISSALQVWNLELVPYSSTDQRLNSDPSKMTAFICNFRDHWFTIRKISNYWFNLNSLLSRPEPISDTYLALFLAQLKNDSYSIFAVLGELPQCTAEEALKNKSLVNDPPPRPPLXIFLQLKVIPTXRAALELSIADEMNFISQSQESEDNDLPEALKVSNARVFRQLPEEDDEETLLRKAFNMKLQGLVLGYFIGDDMVLKKKKKKNFCWKR

SEQ ID NO: 23230 - protein, 197 aa, Diabrotica virgifera
  misc_feature: Coding regions on vcDNA: vcDNA=SeqID_2927; Strand=+; Position=315-908
  misc_feature: Homolog annotation: Hit_ID=XP_311295.1; Match level="QueryCoverage =96%, HitCoverage=80%, E-value=4e-56, Identity=53%"; Hit description =ENSANGP00000017581 [Anopheles gambiae]
  misc_feature: Gene Ontology Annotation: Molecular function=molecular_function unknown; Cellular component=mitochondrial large ribosomal subunit; Biological process=protein biosynthesis
  misc_feature (180)..(180): Xaa can be any naturally occurring amino acid
  misc_feature (190)..(190): Xaa can be any naturally occurring amino acid
MSATILTRINLAVQNLKHHVLNTFGRGFPPDALCLAGIELNKSPQNLPKFSIKDIIGEGFLWAVPKHRRSVEKRWKRKFGDPYYVLKILLPRKDLRTCNVCGDDHEAGVLCPTCYKKVIDETKAMQEQIQNELKLEPVEKEIVVLYEGEKNDKPAEFFEGKRIVEMNKPRPQWFSKNLLXETTQKNATTXEVKPSDR

SEQ ID NO: 23231 - protein, 202 aa, Diabrotica virgifera
  misc_feature: Coding regions on vcDNA: vcDNA=SeqID_2928; Strand=+; Position=122-730
  misc_feature: Homolog annotation: Hit_ID=XP_393238.1; Match level="QueryCoverage =98%, HitCoverage=97%, E-value=7e-80, Identity=72%"; Hit description =similar to ENSANGP00000014057 [Apis mellifera]
  misc_feature: Gene Ontology Annotation: Molecular function=Rho GDP-dissociation inhibitor activity; Cellular component=cytoplasmic vesicle; Biological process=negative regulation of cell adhesion
  misc_feature: Pfam annotation: Pfam_ID=Rho_GDI; Match level="Score=260.2, E-value =3.7e-75, Copies=1"; Pfam description=RHO protein GDP dissociation inhibito
MSAQDNVTTPEEFVEHENESSYKPPPEKTIEEILQIDQEDESLRKYKEALLGQAQTGPVVVEPDNPKKVIVKRLVLVAADRPELALDLTGDLSKLKKETFTIKEGVSYKIRIEFLVQREIVHGLKYVQKTSKMGITVDKMTHMVGSFAPKTEIQSYTTAAEDAPSGMVARGTYTVHSLFTDDDKNEHLKWEWTFEIKKDWKD

SEQ ID NO: 23232 - protein, 157 aa, Diabrotica virgifera
  misc_feature: Coding regions on vcDNA: vcDNA=SeqID_2929; Strand=+; Position=29-502
MKYLYLFFIAYIFAYVSGSQLKNQQHVCNCQKTLETIYADVLQQEKALNQTLIDISVLEIELRQLDDLLEGQEDKLIDISAELAALTVTKNYINRLLADGSQALQCIIDNLKEVCHDLHDDVDNDVDQQQSQIINILSVVMKVEDCKNGNSCPAAPQ

SEQ ID NO: 23233 - protein, 368 aa, Diabrotica virgifera
  misc_feature: Coding regions on vcDNA: vcDNA=SeqID_2930; Strand=+; Position=351-1454
  misc_feature: Homolog annotation: Hit_ID=XP_308252.1; Match level="QueryCoverage =98%, HitCoverage=72%, E-value=1e-141, Identity=66%"; Hit description= ENSANGP00000010942 [Anopheles gambiae]
  misc_feature: Gene Ontology Annotation: Molecular function=dipeptidase activity; Cellular component=cytosol; Biological process=proteolysis and peptidolysis
  misc_feature: Pfam annotation: Pfam_ID=Peptidase_M20; Match level="Score=61.1, E -value=3e-15, Copies=1"; Pfam description=Peptidase family M20/M25/M40
MALPGPLDKLFKYLDENKAKYIENLRQVVAIQSVSAWPEKRGEITKQMKWALERLQALGASAELRDLGTQTLPNGQTIPLPPVLFGSLGNDPKKKTVLIYGHLDVQPAHKSDGWDSEPFELTERDGKLYGRGASDDKGPVLSWLHAIEGFQAIGEEVPVNLKMVFEGMEESGSEGLDELLHAEKNKFLAGTDYVCISDNYWLGTTKPCITYGLRGISYFFLEVECADKDLHSGVYGGTVHEAMSDLMYLMNQLVDKDGKILIDGIYDDVAPVTDNEHGIYKAIEFDVDEYRQNVGTSKLLHNEVKEKILMHRWRFPSLSLHGIEGAFSEPGSKTVIPRKSIGKFSIRIVPNQSLKQTETLVIEYINKL

SEQ ID NO: 23234 - protein, 248 aa, Diabrotica virgifera
  misc_feature: Coding regions on vcDNA: vcDNA=SeqID_2931; Strand=+; Position=222-965
  misc_feature: Homolog annotation: Hit_ID=XP_319399.1; Match level="QueryCoverage =95%, HitCoverage=82%, E-value=2e-67, Identity=52%"; Hit description =ENSANGP00000012256 [Anopheles gambiae]
  misc_feature: Pfam annotation: Pfam_ID=UPF0121; Match level="Score=357.0, E-value =2.7e-104, Copies=1"; Pfam description=Uncharacterised protein family (UPF01
  misc_feature (237)..(237): Xaa can be any naturally occurring amino acid
MSDPTNPTGLPRSLNYEALKAHIISHKINCGLWLIRVIGILCSIAYFIPIFGNPYNYYYKVLLANAAISALRLHQRIGRVQFTRQFAAELLSEDSCHYLFYSLIFLYVSPVSLVLVPIILFCVLHSASYSLTLLDTLGQNSWWGARLLISLVEFQSLNILKAVAFTEIFLMPYTVLLILLGRASLLTPFIYYHFLTQRYTSRRNPYTRNMFRELRVLFENTAAKPSMPSFVKQFLLXNCHFTHKLAPV

SEQ ID NO: 23235 - protein, 434 aa, Diabrotica virgifera
  misc_feature: Coding regions on vcDNA: vcDNA=SeqID_2932; Strand=+; Position=124-1428
  misc_feature: Homolog annotation: Hit_ID=AAV68692.1; Match level="QueryCoverage =98%, HitCoverage=97%, E-value=1e-135, Identity=55%"; Hit description= putative IDGF [Diaprepes abbreviatus]
  misc_feature: Gene Ontology Annotation: Molecular function=chitinase activity; Cellular component=extracellular; Biological process=response to bacteria
  misc_feature: Pfam annotation: Pfam_ID=Glyco_hydro_18; Match level="Score=293.9, E -value=2.5e-85, Copies=1"; Pfam description=Glycosyl hydrolases family 18
MGSLTLSVIFLSLAAFSVAENIVVCNYESKSHLRDGEGKFDVSNLNEALRYCTHLLYGYAAIDDNTYKLVPMNEQYDVIKENYKHITDLKKTHPKLKVLLSVGGNEDVSGSGDEKNEKYRKILESTAHRLSFVNSAYTLLKAYGFDGLDLAWEFPETKPKKIKSGLKKLWSSIKTTVAGEHVVDENAQQHREQFVALVKELKNALKADNMQLSLTVLPNINSTVYYDPRNLAPYLDFIVLHAFDFYTPLRNEELADFPAPLYELIDRRGDENIDAWVKYWLSNGTPAKKLLLGIPTYGRTWHLKGEAKVDQFPITDLNGPGDAGPLTKEAGLLSYPEICNKVTPRTSTPGGLTKIPDGTKRRGVYAYRYPDKDDKGGIWVGYEDTETASTKAQYAKAKGLGGIAIDDLTLDDFKGVCGHSNNKFAILKAAVAAL

SEQ ID NO: 23236 - protein, 239 aa, Diabrotica virgifera
  misc_feature: Coding regions on vcDNA: vcDNA=SeqID_2933; Strand=+; Position=161-880
  misc_feature: Homolog annotation: Hit_ID=CAG12678.1; Match level="QueryCoverage =95%, HitCoverage=58%, E-value=1e-35, Identity=35%"; Hit description =unnamed protein product [Tetraodon nigroviridis]
  misc_feature: Pfam annotation: Pfam_ID=LANC_like; Match level="Score=-69.9, E-value= 2.6e-11, Copies=1"; Pfam description=Lanthionine synthetase C-like protein
  misc_feature (204)..(204): Xaa can be any naturally occurring amino acid
  misc_feature (207)..(207): Xaa can be any naturally occurring amino acid
MIEMRFFNNPFEDYTPEGLQESKNKVSQSINVKWKSTMENLQTLDFSDYTVYTGTSGVALLKLLQDPDDFQNLKEVLKLLSLHKLKGRRHTFLCGDAGPLAIGIVVHSKLGNHDEVSQLISKLTLLNKDVLDIHSDIANEYMYGRIGYLYAILYVNKNISPPPFDDNYISQIIETILVIGRNISKAGRFKCPIMYDWHDSYYMXAAXRLAGILYLLLQARAYLTEDELNMWSNLPFDIY

SEQ ID NO: 23237 - protein, 73 aa, Diabrotica virgifera
  misc_feature: Coding regions on vcDNA: vcDNA=SeqID_2934; Strand=+; Position=519-740
NGGGEKPGGSPIFSLWQTPPFPPWGKKKKGPPPPPLPKIAHLEGERGPPLKRAFKAGGGGGFLKGCFIFWRGP

SEQ ID NO: 23238 - protein, 250 aa, Diabrotica virgifera
  misc_feature: Coding regions on vcDNA: vcDNA=SeqID_2935; Strand=+; Position=71-823
  misc_feature: Homolog annotation: Hit_ID=XP_318202.1; Match level="QueryCoverage =100%, HitCoverage=93%, E-value=1e-113, Identity=85%"; Hit description=ENSANGP00000010517 [Anopheles gambiae]
  misc_feature: Gene Ontology Annotation: Molecular function=hydrogen-transporting ATPase activity, rotational mechanism; Cellular component=hydrogen -transporting ATPase V1 domain; Biological process=vacuolar acidification
  misc_feature: Pfam annotation: Pfam_ID=ATP-synt_D; Match level="Score=301.8, E -value=1e-87, Copies=1"; Pfam description=ATP synthase subunit D
ISRMASKDRLMIFPSRGAQMMMKSRLKGAQKGHSLLKKKADALQMRFRMILNKIIETKTLMGEVMKEAAFSLAEAKFATGDFNQVVLQNVTKAQIKIRTKKDNVAGVTLPVFECYQDGTDTYELAGLARGGQQLTKLKKNYQSAVKLLVELASLQTSFVTLDDVIKITNRRVNAIEHVIIPRIERTLAYIISELDELEREEFYRLKKIQDKKKISRAKAEKQKQALLQAGLLKESQANMLLDEGDEDLLF

SEQ ID NO: 23239 - protein, 294 aa, Diabrotica virgifera
  misc_feature: Coding regions on vcDNA: vcDNA=SeqID_2936; Strand=+; Position=27-906
  misc_feature: Homolog annotation: Hit_ID=XP_311261.1; Match level="QueryCoverage =94%, HitCoverage=56%, E-value=1e-104, Identity=65%"; Hit description= ENSANGP00000001598 [Anopheles gambiae]
  misc_feature: Gene Ontology Annotation: Cellular component=cytoplasmic dynein complex
  misc_feature: Pfam annotation: Pfam_ID=DLIC; Match level="Score=252.9, E-value=5.5e- 73, Copies=1"; Pfam description=Dynein light intermediate chain (DLIC
  misc_feature (266)..(266): Xaa can be any naturally occurring amino acid
  misc_feature (285)..(285): Xaa can be any naturally occurring amino acid
MPPLVDRSPENVIIDEDKKNLWSQILHDVQKNGNPKLSPHKQILVLGDNESGKTTMVAKLQGIENSSKGSGLEYGYIDVRDDYRDDHTRLSVWVLDGDPAHEDLLRFALNEESFQETLVILTVAMTTPWGILEQLQHWASVLADHLDKLKLDIDLRQARKQLMIKMWLDYIEPGDELDPASPMKRSSRNLGDDDEGYDGTMLPEGTLSNNLGLDIVVVVTKTDYIQNLEKEQDYRDEHLDFMQQWIRRFCLQYGAALFYTSAKEDXNCDLLYKYLTHRIYNFPFXTPALVVEKM

SEQ ID NO: 23240 - protein, 357 aa, Diabrotica virgifera
  misc_feature: Coding regions on vcDNA: vcDNA=SeqID_2937; Strand=+; Position=1-1072
  misc_feature: Homolog annotation: Hit_ID=XP_310255.1; Match level="QueryCoverage =96%, HitCoverage=44%, E-value=1e-77, Identity=44%"; Hit description =ENSANGP00000015103 [Anopheles gambiae]
  misc_feature: Gene Ontology Annotation: Molecular function=phosphatidylinositol 3 -kinase activity; Cellular component=plasma membrane; Biological process=biological_process unknown
  misc_feature: Pfam annotation: Pfam_ID=C2; Match level="Score=140.7, E-value=3.4e -39, Copies=2"; Pfam description=C2 domain
  misc_feature (65)..(65): Xaa can be any naturally occurring amino acid
RNFPGYDPLRPALVTLFLDSCKNLPQARMSTKPDPYATVRVGNDSQQTKVLMRTVNPVWEQGFTXFLVTNPENDTLFLSIMDHKTSSEIGQLHFKIKTLATKPNMVMSKEPFSLIRSGPESKVIWSMHLRILKQGEATDDAQLDNTDKFKRSISNISKSSIESSNAVLPQSKENLDEVEPVLDQDQEAPVEEILEDSSLSALGGAQPLDGNELLYHRTPSVTSSAGDAGLGRIQLTLRYSVQRQRLIVVVHKIMNIPLKDPSSIPDPYVKLYLLPERARDTKRKTQVIKDNVNPIFDESFEYVINQGEVGSKQLEVTACTQKQLIYSSSNVLGQIIIDLGKLNLTQPFTSWFDLQHG

SEQ ID NO: 23241 - protein, 154 aa, Diabrotica virgifera
  misc_feature: Coding regions on vcDNA: vcDNA=SeqID_2938; Strand=+; Position=3-467
  misc_feature: Homolog annotation: Hit_ID=EAL29239.1; Match level="QueryCoverage =90%, HitCoverage=17%, E-value=2e-39, Identity=56%"; Hit description =GA19748-PA [Drosophila pseudoobscura]
  misc_feature: Gene Ontology Annotation: Molecular function=calcium-dependent phospholipid binding; Cellular component=plasma membrane; Biological process=biological_process unknown
  misc_feature: Pfam annotation: Pfam_ID=C2; Match level="Score=73.6, E-value=5.3e -19, Copies=1"; Pfam description=C2 domain
HASAHASTHASGLRFIPITSSAGDAGLGRIQLTLRYSVQRQRLIVVVHKIMNIPLKDPSSIPDPYVKLYLLPERARDTKRKTQVIKDNVNPIFDESFEYVINQGEVGSKQLEVTACTQKQLIYSSSNVLGQIIIDLGKLNLTQPFTSWFDLQHG

SEQ ID NO: 23242 - protein, 71 aa, Diabrotica virgifera
  misc_feature: Coding regions on vcDNA: vcDNA=SeqID_2939; Strand=+; Position=1038 -1253
PTNYFQNLNFKIIISCNLLGCPILSRRWQSSAQYRLCSTEIIQLVLFQTTFASLDSSSGTSLVVSPSLDNL

SEQ ID NO: 23243 - protein, 288 aa, Diabrotica virgifera
  misc_feature: Coding regions on vcDNA: vcDNA=SeqID_2940; Strand=+; Position=91-957
  misc_feature: Homolog annotation: Hit_ID=XP_311684.1; Match level="QueryCoverage =99%, HitCoverage=86%, E-value=1e-120, Identity=71%"; Hit description= ENSANGP00000025314 [Anopheles gambiae] gb|EAL40975.1| ENSANGP00000026746 [Anopheles gambiae
  misc_feature: Gene Ontology Annotation: Molecular function=inorganic diphosphatase activity; Cellular component=mitochondrion; Biological process =energy pathways
  misc_feature: Pfam annotation: Pfam_ID=Pyrophosphatase; Match level="Score=350.5, E- value=2.4e-102, Copies=1"; Pfam description=Inorganic pyrophosphatase
MSYSIVERGSPFSPDYRVYIENQNGPISPLHDIPLLVDGNPKVFNMVVEVPRWTNAKMEITMKEILNPIKQDIKKGKPRFVSNCFPHHGYIWNYGALPQTWENPEHLDDGTGCKGDNDPIDVIEIGYRVAKRGEILNVKILGTLALIDEGETDWKLIAIDVNDPLADQINDIPDVEKHFPGLLKASVEWFKIYKIPDGKPENQFAFNGEAKPAAFALKIVDEVHKFWKGLVAKEVDAKGISCVNTTLEGNSFNISYNDAKEVIEKTPEYGPAQPTDPIVDKWHYIHLK

SEQ ID NO: 23244 - protein, 279 aa, Diabrotica virgifera
  misc_feature: Coding regions on vcDNA: vcDNA=SeqID_2941; Strand=+; Position=28-867
  misc_feature: Homolog annotation: Hit_ID=EAL40866.1; Match level="QueryCoverage =96%, HitCoverage=98%, E-value=3e-72, Identity=50%"; Hit description =ENSANGP00000028166 [Anopheles gambiae str. PEST] ref|XP_563488.1| ENSANGP00000028166 [Anopheles gambiae st
  misc_feature: Gene Ontology Annotation: Molecular function=molecular_function unknown; Cellular component=cytoplasm; Biological process=signal transduction
  misc_feature: Pfam annotation: Pfam_ID=TIP41; Match level="Score=281.0, E-value=2e -81, Copies=1"; Pfam description=TIP41-like family
MCTVNNDKGEIEIYRLPVNAEEYVIHDWTIKYTKSHILHSICANAETCSSKPEERCLLCVYNNELELPHLPEMVFPNNKLNLSHKSGFSVEFNALDALKTVSNGKQSIKVAHSDVWKDSRAPENLEEKIKPFDWTFSSDYRGYMSGESSLEETEERINIEKLKEKEKILFYQELMLYEDELHDNGISSCTIKIRVMPSSFFVLLRFFLRVDNVMVRINDTRVFHDFSTNYLLREYTNKECGVKDLNLPLTVFGDPNALSPHMPLRTSIFEKITIPSVQS

SEQ ID NO: 23245 - protein, 284 aa, Diabrotica virgifera
  misc_feature: Coding regions on vcDNA: vcDNA=SeqID_2942; Strand=+; Position=78-932
  misc_feature: Homolog annotation: Hit_ID=EAA11259.2; Match level="QueryCoverage =58%, HitCoverage=95%, E-value=2e-51, Identity=62%"; Hit description =ENSANGP00000021891 [Anopheles gambiae str. PEST] ref|XP_556292.1| ENSANGP00000021891 [Anopheles gambiae st
  misc_feature: Gene Ontology Annotation: Molecular function=transcription factor activity; Cellular component=nucleus; Biological process=regulation of transcription, DNA-dependent
  misc_feature: Pfam annotation: Pfam_ID=Ank; Match level="Score=105.2, E-value=1.7e -28, Copies=3"; Pfam description=Ankyrin repeat
MPGPVRPRGSNTGSRAQSVAPMSERQQMALLMQMTSGNELGSRSPSSSSSRTRERNERGETPLHLAAIKGDVDQVCKLLAQHTDPNVADFAGWTPLHEACNHGWYEVAFRLVQSGANVNARGLDNDTPLHDAAVNGHLKLVKLLVEKGADIYAKNSKGKTPLDVAPASVKPYLLNSALPLPDSTSNSRVVSRASRDDKKITSSCDPSTSTASTASGGSNAAGGNSGAAASTSGKAQKNEPMEVKTSTASGTFSATAGTSSRNTSGTARASGTTTGDDVYEFKSA

SEQ ID NO: 23246 - protein, 67 aa, Diabrotica virgifera
  misc_feature: Coding regions on vcDNA: vcDNA=SeqID_2943; Strand=+; Position=1-204
PPAGSGPLLRPESKEGKSNMKLSSKSTKMSWQLQVRILKCSKTSVLFFSFIPFGLDSLGYYSPSSEC

SEQ ID NO: 23247 - protein, 561 aa, Diabrotica virgifera
  misc_feature: Coding regions on vcDNA: vcDNA=SeqID_2944; Strand=+; Position=40-1725
  misc_feature: Homolog annotation: Hit_ID=XP_318845.1; Match level="QueryCoverage =44%, HitCoverage=84%, E-value=1e-29, Identity=38%"; Hit description =ENSANGP00000014460 [Anopheles gambiae]
  misc_feature: Gene Ontology Annotation: Molecular function=structural molecule activity; Cellular component=intermediate filament; Biological process=epidermal differentiation
MKAFLVLGFVALAVATSPPAPTSGEKKDNAKPVVAEKSKRHLGGGFYQQSFNSIPQTYSSSWSSGPVVHGYGYKYNYNSGPVGQYSASSYSSPLSYSAGGLSAGGLSGGQYSSGLYSAGLAGGYSSGLSSGNLLSGGLSSGAVSEGFSSGYGSEGLSGLSASAGLGSGGLGGSYGSYGSYGSSYGGQSGLLSGGSSDVYSSGLSGLSSGGLGQGYSSYSYGVKSGLEKVVSSEEVARHTVHNVINKVQVPVPVPQPYPVTKTVQVPRPYPVNVDKPVPVQVRVNVPVPVEKPYPVQVPYQVPYQVKVKVPYTVEKPYPVHVTRTVTVPVEKPVYVKVPEVVRIPVPQPYPVPVQRRVAIKVPHPVVVKVPEVVNVHHAIQTVKQPVEFVQQRVSAPIVSHTSSGVVGGQSGFSSGAFSSGLSTSSGFSSGADVVSSSGLEASSGLLAGGQGFNTDISQGYSSSGIISSGIQSGGQELISGQSGFSGLESAGLQSGLQSSGFQTEFQSGGIQSAGADFSSSSSLSGTSQGVASEYLPPCPLSHGHNISARKAEEKKVDENKH

SEQ ID NO: 23248 - protein, 238 aa, Diabrotica virgifera
  misc_feature: Coding regions on vcDNA: vcDNA=SeqID_2945; Strand=+; Position=98-814
  misc_feature: Homolog annotation: Hit_ID=EAA10808.2; Match level="QueryCoverage =98%, HitCoverage=81%, E-value=4e-62, Identity=52%"; Hit description =ENSANGP00000013042 [Anopheles gambiae str. PEST] ref|XP_557015.1| ENSANGP00000013042 [Anopheles gambiae st
  misc_feature: Pfam annotation: Pfam_ID=Ras; Match level="Score=-40.0, E-value=2.4e -06, Copies=1"; Pfam description=Ras family
MSVIDRVRILVLGDSGVGKTSFVHLAAHNEPLRSPSWTVGCSVDVKLHEYKEGMKDQKTFFVEFWDIGGSHSHRNARPVFYNPFHGAILVHDLTNRKSEKNLHKWVREISVNRRERKDSNSATNPVLPGLLGDDFDQESFIGNMSIPYIVIGTKLDQLDDRKTRIEHMASHLGCDEILMDCRQTRYLAAGTSNAVKLSRFYDKAIEMRSKSHKDSFTERFGDPISPILSTKFYSPHQD

SEQ ID NO: 23249 - protein, 81 aa, Diabrotica virgifera
  misc_feature: Coding regions on vcDNA: vcDNA=SeqID_2946; Strand=-; Position=689-934
  misc_feature (32)..(32): Xaa can be any naturally occurring amino acid
  misc_feature (34)..(34): Xaa can be any naturally occurring amino acid
  misc_feature (37)..(37): Xaa can be any naturally occurring amino acid
  misc_feature (45)..(45): Xaa can be any naturally occurring amino acid
ILFFFVNGRTFFVLILISVHPDLIFYFIAEIXRXLLXHVELEHFXRTYDNQSNKSIERHDCFELYYFFLRPFNNMLIIHYF

SEQ ID NO: 23250 - protein, 93 aa, Diabrotica virgifera
  misc_feature: Coding regions on vcDNA: vcDNA=SeqID_2947; Strand=+; Position=32-313
YQKLLGYTKPIGKNTTSWRASGLANTLCDGQAPPTLISHIRRKTKTIYLIIHKKSTNTSEGIGQPVIFTNKILLYICFLRFWIPPQYHHGAFM

SEQ ID NO: 23251 - protein, 147 aa, Diabrotica virgifera
  misc_feature: Coding regions on vcDNA: vcDNA=SeqID_2948; Strand=+; Position=307-750
  misc_feature: Homolog annotation: Hit_ID=NP_731941.1; Match level="QueryCoverage =100%, HitCoverage=100%, E-value=5e-85, Identity=100%"; Hit description=CG7425-PA [Drosophila melanogaster] gb|EAA06420.3| ENSANGP00000019908 [Anopheles
  misc_feature: Gene Ontology Annotation: Molecular function=ubiquitin conjugating enzyme activity; Cellular component=proteasome complex (sensu Eukarya); Biological process=chromosome organization and biogenesis (sensu Eukarya)
  misc_feature: Pfam annotation: Pfam_ID=UQ_con; Match level="Score=282.6, E-value =6.4e-82, Copies=1"; Pfam description=Ubiquitin-conjugating enzyme
MALKRINKELQDLGRDPPAQCSAGPVGDDLFHWQATIMGPPDSPYQGGVFFLTIHFPTDYPFKPPKVAFTTRIYHPNINSNGSICLDILRSQWSPALTISKVLLSICSLLCDPNPDDPLVPEIARIYKTDREKYNELAREWTRKYAM

SEQ ID NO: 23252 - protein, 347 aa, Diabrotica virgifera
  misc_feature: Coding regions on vcDNA: vcDNA=SeqID_2949; Strand=+; Position=53-1093
  misc_feature: Homolog annotation: Hit_ID=EAL25031.1; Match level="QueryCoverage =87%, HitCoverage=60%, E-value=3e-55, Identity=37%"; Hit description =GA20745-PA [Drosophila pseudoobscura]
  misc_feature: Gene Ontology Annotation: Molecular function=molecular_function unknown; Cellular component=cellular_component unknown; Biological process=biological_process unknown
  misc_feature (311)..(311): Xaa can be any naturally occurring amino acid
  misc_feature (313)..(313): Xaa can be any naturally occurring amino acid
MSKVSNNRKRKHQSKEGEEPEVNRPKAKFRSRDEQAEEEQLSQILFGGATSFLQCLEEAEPEPGPPRSNADSGVGETDTDDEEKERKPAWTDEDDDGIDVGQALDSQRRKLPSGGINDRSNKYSNLLKHKFQSAVGTPKWASLNKRKRTESDSDEEILRSCGFIKTTKAQLPTSILEFKKVKDLNCETYSEGPYINSIEFHPTSSVALVAGNGGIATLYAVDGKRNNKLHSVKFQNYPIVCAKFLQNGNEAILGSRQSHIFSYDLLATKPTRYTLPQGLTQCKNFVVSPDSQFIAIAGKWGEVHLLSATSXEXVALLKAETEVTAFTHPSNLLGHSNTDEITVWHEM

SEQ ID NO: 23253 - protein, 448 aa, Diabrotica virgifera
  misc_feature: Coding regions on vcDNA: vcDNA=SeqID_2950; Strand=+; Position=119-1462
  misc_feature: Homolog annotation: Hit_ID=XP_318067.1; Match level="QueryCoverage =83%, HitCoverage=46%, E-value=1e-106, Identity=49%"; Hit description= ENSANGP00000003468 [Anopheles gambiae]
  misc_feature: Gene Ontology Annotation: Molecular function=translation initiation factor activity; Cellular component=eukaryotic translation initiation factor 4F complex; Biological process=cell death
  misc_feature: Pfam annotation: Pfam_ID=W2; Match level="Score=82.2, E-value=1.4e -21, Copies=1"; Pfam description=eIF4-gamma/eIF5/eIF2-epsilon
MADVELRPNSMLITKASSLKSNNMMNNNKTMEPNFAPSTIKQPPSTLLKDPLPIKQVPAEKPKQSKKDKGPNKEEVLKKFNTLIEEFWKGEVDLKQAINSYKEHKVPDKFAKEMVLSGLSNALEKSDVEQEKLIRFLSNLKEDNLISGNTVQDAFKSLCNVLEERENEINKVTTAASVLFATAICEHLVPLSDVANLTENGAHHPLFLLVLQNIHKKRGKSELSEMFGKSKINLMSQLPDCDKTKERLSEILEERDLTFLYPLLRIQADLARQLQADPNPQAFYKWIKENLEPSNFNDPGFINALMTVLLKYITQEPSACGDEKAIIEKENGLLKRYQPILHAFLRDKSSLQLVALYSLQMHFHSLGFPRGQLLRWFNALYDMEIVDEEAFLNWKEDVTDAYPGKGNALFQVNQWLTWLQEAESEEEEGDDLTNKKIKNISGVISHNS

SEQ ID NO: 23254 - protein, 315 aa, Diabrotica virgifera
  misc_feature: Coding regions on vcDNA: vcDNA=SeqID_2951; Strand=+; Position=21-965
MSAEQSHQTTMIQLGGTTVGMTLQRTSEVHVTTVTTTQIVNNQTGANMNSTVVLTSQHASEVLSKVENVHLPGHSSMLVMSQPPKQGGEKDYFLVSNHGDVKLDAEVIHMEMMVHLGPSHLVTILPGQSHTFDLSGVHFRNALLKVTNHEEGQAVFSAEGGNVLKDFEQNVQKLDNEVQVLQKVENFHLAGHSSVLVMTQPPKQETGETKDQFQVTNNGTVKIEAEVTHVERMVHLGPRHLVTLLPGQSHTFDLSGAHFKMAVLEVRNHEDGEAVFSAEGGNVVQNMGGICTKITFTEQGSQRVENVRLAGRSSM

SEQ ID NO: 23255 - protein, 1164 aa, Diabrotica virgifera
  misc_feature: Coding regions on vcDNA: vcDNA=SeqID_2952; Strand=+; Position=23-3517
  misc_feature: Homolog annotation: Hit_ID=YP_054132.1; Match level="QueryCoverage =78%, HitCoverage=55%, E-value=9e-09, Identity=18%"; Hit description =hypothetical protein PTMB.204c [Paramecium tetraurelia] emb|CAH03401.1| hypothetical protein
MEKSVQKVVPSEQVQQKVENVHLAGHSSMLVMSQPPKQGEEERKDHFLVSNKGTVKIDAEVIHVVRMVHLGPSHRVTILPGESHTFDLSDAHFHNALLKVTNNEQGQAVFSAEGGNVLEDFEQTVQKFEYEVQVMQKVENLHLAGHSSMLVMTSSKQEGAQERHFKVTNNGNVKIDAEVTHAERMAHLGPRHLVTLLPGQSHTFDLSETHFKMAILEVRNHEDGEAVFSAEGGNVVHQMEESVKPEEVPNEHVEHKVENFHLAGHSSVMVMTQPPKQQGEEERKDQFMVSNNGNVKIDAEVTHIERMIHLGPSHQKTLLPGESHTFDLSGAHFRLAVLKITNHEDGEAVFSAEGGNVLNGFENNVQKVEHETEVVHKVENFHLPADSSVLVMTQPPKQGNAERKDYFLVSNNGKVKIEAEVTHVQRILHLEPRHVVTLLPGQGHTFDLSGIHFNMAVLKVRNYEDAEAVFSAEGGNVLPNLEKNVQKLEHVEHKVQNVRLPAHSAVLVLAQPEKENDDHRKDYFRVSNNGNVKIDAEVVQNDLQPPHTKSLLPGESHTFDLSGNQFHLAHLKVSNLEDEEAAFSAEGGNVLHDFLNNIQKVVSEKPQHKLDHFLLPPRRTVLALSQTGVQGEENNKYTITNHGPADLFAEVVHMNHIYDAPHWYVVRPEETTEIPINEHLQRNILRLTNNSYKDEVVVSAEGGHVLQGIEQNIEQLSMTDSTGTVLTKVENFSLPPRTHIVALSQNVEGSNEHPGRFTVTNHGKAPFDIELKRTSPVQTLDLHLRTVQPNATEYFELTAQFQNTVLEVINTSHTETAVFTAEGGDVMHDLQDEIKKLDVQEQSTLDKIIDSLANLRLNARSRVLALVYDPKDITSAGEKGFTITNHGQYDIEAEVVYTDRDDRDKDQLKVIKPNETVLIEHVKDAGKAVLNILNRSYKELGNITVKGGRVIHELERKVKKLASDNEVVLELDRFHLAPNSSVVVMHQIGKYKRRFENFGLTLRSKLGGLQKSIQGVYHKLEGEGEQPQGENQEQEGEHQQDEHHKFVGVQDKQIQRRQVLHDRYTITNCGYNPITVQIVHLTKEDADDEVLRSQVVKPNETQELLLEGIESSSLKVINESSKDIAIFSAEGGEVIPGVEHLIRQLQRGECMKNVLWRSRRERRV

SEQ ID NO: 23256 - protein, 380 aa, Diabrotica virgifera
  misc_feature: Coding regions on vcDNA: vcDNA=SeqID_2953; Strand=+; Position=193-1332
  misc_feature: Homolog annotation: Hit_ID=XP_392883.1; Match level="QueryCoverage =99%, HitCoverage=92%, E-value=5e-97, Identity=47%"; Hit description =similar to CG31694-PA [Apis mellifera]
  misc_feature: Gene Ontology Annotation: Biological process=myoblast cell fate determination
  misc_feature: Pfam annotation: Pfam_ID=IFRD; Match level="Score=323.8, E-value=2.6e- 94, Copies=1"; Pfam description=Interferon-related developmental regu
MPKGKRKGRSDRGRNDGSLNSSDDESFMDNASVVSNYSENKSGEECEDADLLAQEQLEEKLVEILDGLTQKSSQGRINCFDTLTKGFVKKCMPGFIRDRQFTICDSIERSLKKGGGPEKIAAAELATVICVQLGGEDATEDICRLLKPILLSLICDNSVAAPVRAKCCTALGNIIFLSGGEIGDVLLLMQQLEAIYSASYLKGDGTVPTISPDLGVLHAAAIQSWNLLFTLLSPGNIGTMINNSKALPSLEKLSELLESAHLDVRMAAGESLALIYELGREESEDFEEEFALDVTETLKQLATDSHKYRAKKDRKQQRATFRDILQFIESDIVPELQIKFGKETLVLDSWIRRKQYEMLCNILGPSINVHLTENDLLRDI

SEQ ID NO: 23257 - protein, 457 aa, Diabrotica virgifera
  misc_feature: Coding regions on vcDNA: vcDNA=SeqID_2954; Strand=+; Position=111-1482
  misc_feature: Homolog annotation: Hit_ID=NP_477332.1; Match level="QueryCoverage =96%, HitCoverage=84%, E-value=0.0, Identity=68%"; Hit description =CG3460-PA [Drosophila melanogaster] gb|AAF45744.1| CG3460-PA [Drosophila melanogaster]
  misc_feature: Gene Ontology Annotation: Molecular function=RNA binding; Cellular component=cytosolic large ribosomal subunit (sensu Eukarya); Biological process=ribosomal large subunit assembly and maintenance
  misc_feature: Pfam annotation: Pfam_ID=NMD3; Match level="Score=417.7, E-value=1.4e- 122, Copies=1"; Pfam description=NMD3 family
  misc_feature (426)..(426): Xaa can be any naturally occurring amino acid
MEYIQEPVSSEPLKTTILCCECGIAIEPNPANMCVGCLRSQVDITEGIPKQATLHFCRGCERYFQPPGEWVKCTLESRELLTLCLKKLKGLNRVKLIDASFVWTEPHSKRIKIKLTVHGEVAGGAILQQVFVVEYTVAHQMCDECHRSEAQDFWRASVQVRQKSENKKTFYYLEQLILKHKAHENTLGIKPIHGGLDFFYTTEGHARKMVDFLSAVLPCKYQHSKKLISHDIHSNIYNYKFTYSVDIVPVSKDSIICLPKKLTQQLGGISPICLIYRVTNSVHLIDPSTAQIAEISATVFYRYPFGAICNPKQLVEYIVMDIEPIMDKDRKIFPGQGAISHRHVLADIWVVKASELGVNDNTIHTRTHLGHVLKPGDSVLGYNIEDSNINDTNFDKLDRNSVPDVILVKKHYGDRAFRRRQRIWKXKRLAEGDTAFDPDANDYHQVLDDLEENPQLG

SEQ ID NO: 23258 - protein, 467 aa, Diabrotica virgifera
  misc_feature: Coding regions on vcDNA: vcDNA=SeqID_2955; Strand=+; Position=38-1441
  misc_feature: Homolog annotation: Hit_ID=XP_319348.1; Match level="QueryCoverage =97%, HitCoverage=95%, E-value=1e-126, Identity=51%"; Hit description= ENSANGP00000012578 [Anopheles gambiae]
  misc_feature: Gene Ontology Annotation: Molecular function=RNA binding; Cellular component=oligosaccharyl transferase complex; Biological process =protein modification
  misc_feature: Pfam annotation: Pfam_ID=Ribophorin_I; Match level="Score=526.2, E -value=3.1e-155, Copies=1"; Pfam description=Ribophorin I
LNVKFKIMLKLITFIFIIVTVNAAERINNNLIYKNVDRTIDLTSQLVKITSTITLENAGADPIKNFLLAEQPNLVGQIAFKGAKDSAKQDLNVLTAQVENQSDKRFHKVILRQNLEPGRTATVVVEEILIKSLIPYPNSISQKEKQLVRYFGNHYIYTPYTVVKQKTDVTLSSRSIENYSKLKPVTQTDSTVHYGPYGEIAPFAVDELIVHYENNAPFLTVVHLDRTIEISHWGNIAVEEQIEIKHTGATLKGPFSRYDYQRDTSSTHHSIKSYTTVLPATAHSIYYRDSNGNISTSAVKHRKDWIELELRPRFPLFGGWQSSYTLGYSVPSYQYLFKAENGDNVLAMRLIDHVFDDMYVEEVVTNVVLPVGVTDIKIRPPYDVERLSDDVTYKYLDNLGRKVIRLKKRDLIEQHIQDLEITYKWQPRLLLHEPLLLSLALFILFVAVIIWVRLDFSLAVPEHSKRE

SEQ ID NO: 23259 - protein, 56 aa, Diabrotica virgifera
  misc_feature: Coding regions on vcDNA: vcDNA=SeqID_2956; Strand=+; Position=568-738
FHQQNRWLFRLVFNNLGQSLFAFSLELFINLINRIIFLLITMYSVNTIIYILCNTN

SEQ ID NO: 23260 - protein, 280 aa, Diabrotica virgifera
  misc_feature: Coding regions on vcDNA: vcDNA=SeqID_2957; Strand=+; Position=104-945
  misc_feature: Homolog annotation: Hit_ID=XP_310812.1; Match level="QueryCoverage =98%, HitCoverage=63%, E-value=2e-59, Identity=45%"; Hit description =ENSANGP00000015572 [Anopheles gambiae]
  misc_feature: Gene Ontology Annotation: Molecular function=molecular_function unknown; Cellular component=cellular_component unknown; Biological process=biological_process unknown
  misc_feature: Pfam annotation: Pfam_ID=DUF895; Match level="Score=153.5, E-value =4.6e-43, Copies=1"; Pfam description=Eukaryotic protein of unknown functio
  misc_feature (222)..(222): Xaa can be any naturally occurring amino acid
  misc_feature (239)..(239): Xaa can be any naturally occurring amino acid
  misc_feature (257)..(257): Xaa can be any naturally occurring amino acid
  misc_feature (267)..(267): Xaa can be any naturally occurring amino acid
MDTNLRNVFLLGFGFLLLMTGTFTLFNIQKTIVDSIQKEDSSFTENGYYSLALNNAFYALFNWITPSVIHLIGSKYSMCLGVIFNIMFILQFLIPKVWLLYTISALIGLGTSLLWIGEGNYITLNSTEETISRNSGIFTFLSNFSMIFGNILVMFAFSGKEVINEATRTYVILSLAGVCSAGLIIFCLLSQPARKKDPHEEVVKVEGPVEAFVSATKLFITXKKLLLSFSFLYSGLELXFFSGVDSSCVGLQRNLTXRKQLVGISGXLIGVGGVVGAWSS

SEQ ID NO: 23261 - protein, 213 aa, Diabrotica virgifera
  misc_feature: Coding regions on vcDNA: vcDNA=SeqID_2958; Strand=+; Position=1-642
  misc_feature: Homolog annotation: Hit_ID=XP_317949.1; Match level="QueryCoverage =77%, HitCoverage=34%, E-value=9e-42, Identity=48%"; Hit description =ENSANGP00000020548 [Anopheles gambiae]
  misc_feature (156)..(156): Xaa can be any naturally occurring amino acid
ITKENVITFSLVTKTLLIILPCEEVDKFTYLGSLMTKENVMTQEIKRRIILANKCYFGLSRHNMRSRNLSQKTKITIYKTLIQLVLTYGSETWTFSKADKNLLLIFERRILRGIFGGICENGIWRRRYNYEVYHRYKHIFGGKDVVSPIRIGRLRXAGHLARSQHNNPPRRILMSQPVGSRNRGRPKLRWNIVIRLITEALVLTVLLVDYLAE

SEQ ID NO: 23262 - protein, 439 aa, Diabrotica virgifera
  misc_feature: Coding regions on vcDNA: vcDNA=SeqID_2959; Strand=+; Position=105-1424
  misc_feature: Homolog annotation: Hit_ID=XP_394143.1; Match level="QueryCoverage =86%, HitCoverage=50%, E-value=1e-107, Identity=48%"; Hit description= similar to MGC68542 protein [Apis mellifera]
  misc_feature: Gene Ontology Annotation: Molecular function=aromatic amino acid transferase activity; Cellular component=cellular_component unknown; Biological process=nitrogen metabolism
  misc_feature: Pfam annotation: Pfam_ID=Aminotran_1_2; Match level="Score=-49.7, E -value=0.0052, Copies=1"; Pfam description=Aminotransferase class I and II
MSTIIDYSYFINSKSARRRPALTREITKRQYGGPKEQISLAEGVPNEITFPFESITVNLKDGSKFDIVGQELASALQYIPTQGYPALVKSVKTFTQDVHNPPGWQKYETLITNGSQDGMSRVLEMVLEENDSMLVQNPYYAGTEAIIKPLNVNVIGIDEDEFGIVPQKLIDALENCKKYTEEGGGKMPKIIYLNPTASNPSGRTIPTERKKEIYRICCKYNILILEDDAYYFLHFLDEQPVSFLSLDTEGRVIRLDSMSKVLSSGLRLGWVTGPKRLIQNIEIHISSCILHSSVLSQVILQNLFEKWGNSGLLAYFSRVASFYRVRRDYTVSCMEKHLKGLCEWELPSGGMFIWFKVLGVSDVYDMLLTRGLKKHITFIPGQNYMADPTAACSYVRASYSKVGLKQIDKAMQILAELIREEHLLLRRKLDSLDDEMIIR

SEQ ID NO: 23263 - protein, 80 aa, Diabrotica virgifera
  misc_feature: Coding regions on vcDNA: vcDNA=SeqID_2960; Strand=-; Position=886-1128
  misc_feature: Homolog annotation: Hit_ID=CAA10770.1; Match level="QueryCoverage =80%, HitCoverage=19%, E-value=1e-10, Identity=42%"; Hit description =reverse transcriptase-like [Bos taurus]
RWKNHITMDTEIRLANTMVFSMFLYESECWSFEEVDKRTIDAFELFCCQRMLSISWTARRITEYILSQLHMTRRLRNIVT

SEQ ID NO: 23264 - protein, 102 aa, Diabrotica virgifera
  misc_feature: Coding regions on vcDNA: vcDNA=SeqID_2961; Strand=+; Position=405-713
TDTLEVAATRQLPSNKGSCYIRFYQLTLIMKYLLISHQDISGVSHLNRRIQFQCQCQRELLRPGFLTTSAFCKSYKTICRCLIFVRNNLDLVHVTLILVFSK

SEQ ID NO: 23265 - protein, 77 aa, Diabrotica virgifera
  misc_feature: Coding regions on vcDNA: vcDNA=SeqID_2962; Strand=+; Position=529-762
LKLSIQFTKCFSADSIPKALGFDVNIEKQRSASDVDIGMVTKILKSLIVSSNVLFKPSLYNKTDSETAPEVVLNSSR

SEQ ID NO: 23266 - protein, 69 aa, Diabrotica virgifera
  misc_feature: Coding regions on vcDNA: vcDNA=SeqID_2963; Strand=-; Position=210-419
KINLKQKMSFSTFHHIKPNCRYFNKLLTKCYLYNICILPLFPFLRYLPFCVSVDVSTYYFTLSHIFLLL

SEQ ID NO: 23267 - protein, 412 aa, Diabrotica virgifera
  misc_feature: Coding regions on vcDNA: vcDNA=SeqID_2964; Strand=+; Position=3-1238
  misc_feature: Homolog annotation: Hit_ID=CAH64507.1; Match level="QueryCoverage =88%, HitCoverage=71%, E-value=6e-63, Identity=37%"; Hit description =putative esterase [Tribolium castaneum]
  misc_feature: Gene Ontology Annotation: Molecular function=carboxylesterase activity; Cellular component=endoplasmic reticulum; Biological process=acyl-CoA metabolism
  misc_feature: Pfam annotation: Pfam_ID=COesterase; Match level="Score=243.5, E -value=3.8e-70, Copies=1"; Pfam description=Carboxylesterase
ILGIVLRLLAVAYCVESFVISDDYTVTVKTNNGKIKGGFGARSHANKDEILYWFRSIPFAEPPVGDLRFAAPVPKANWSGVLDVRHKAQECIQGSPVAGNEDCLYLKIYSRHRPSKLHKLPVVVWIYGGAFFEGSADFDDHRPDFLLHEDVIVAAVQYRLGYLGFMSLGDTVAPGNNGIKDQILGLKWIKENIRNFGGDPNKITIWGQSAGAASVAYLLQAKQTRGLFSKAILNSGSSLSPWSLAKDLPASTKEVAKKLKVNTGTSSTNILESLRKIDVKELQEAASSVMKQNMLLRNPLQGLVFTPVIEPNHDDAVITEYSHELLKQGKFHHVPILAGYTSLEGYFNQLTAIFRLWVAKFDLYHPQLVPNDMNLLPIIKSIIAESIKSKYFGLLPVALSTEELMRIADTHL

SEQ ID NO: 23268 - protein, 563 aa, Diabrotica virgifera
  misc_feature: Coding regions on vcDNA: vcDNA=SeqID_2965; Strand=+; Position=7-1698
  misc_feature: Homolog annotation: Hit_ID=CAH64509.1; Match level="QueryCoverage =91%, HitCoverage=97%, E-value=3e-73, Identity=32%"; Hit description =putative esterase [Tribolium castaneum]
  misc_feature: Gene Ontology Annotation: Molecular function=carboxylesterase activity; Cellular component=endoplasmic reticulum; Biological process=acyl-CoA metabolism
  misc_feature: Pfam annotation: Pfam_ID=COesterase; Match level="Score=478.4, E -value=7.5e-141, Copies=1"; Pfam description=Carboxylesterase
MTPKMLKILGIVLLLLAGAYCVESSVISEDDNTVIVNTTNGPVMGGFGARSHANRSQILYWFRSIPYAVPPVGDLRFAAPVPITNWSGVLDVRYSPSECIQGSSPVAGSEDCLYVKIYSPHEPNKDLNLPVVVWIYGGAFFEGSADFDDHRPDFILYENVIVAAIQYRLGYLGFMSLGDTVAPGNNGIKDQILGLKWIKENIRNFGGDPDQITVWGQSAGAASVAYLLQTNQTKGLFSKAILNSGSSLSPWSLAKGLPEATRQVAIQLNIFALTSSAILRELRKVDVTKLQDAVNSVNQQLTILRNPLEGLVFAPVMEPDHDGAVITEYSYGLLTEGKFHHVPILAGYNSLEGYFDELEALFRLWIAKYDLYHAQLVPNDMNLLPITETIIAESIKYTYFDIYPVSLSTEKLMRYIADTQFEKPIHEAIRLYSAYTKVYAYHFSYEGPLWGRIDREFHGVGHSEDLGYLFDYNITGSNEDYLTRERMVRLWTNFIKNGDPTPKPELLLQNVTWPANSVVIKPENLKFFEINKDLKVVGLPNADKILLWDSLYMEYGRPPFTTY

SEQ ID NO: 23269 - protein, 440 aa, Diabrotica virgifera
  misc_feature: Coding regions on vcDNA: vcDNA=SeqID_2966; Strand=+; Position=1519 -2841
  misc_feature: Homolog annotation: Hit_ID=XP_319082.1; Match level="QueryCoverage =62%, HitCoverage=69%, E-value=2e-32, Identity=31%"; Hit description =ENSANGP00000013149 [Anopheles gambiae]
  misc_feature: Pfam annotation: Pfam_ID=PWWP; Match level="Score=49.6, E-value=8.9e -12, Copies=1"; Pfam description=PWWP domain
MNMRKREKEDSKYRIKIKQATDRYDQGDGNRPKKRRIKEEKSSDGDVTSSPNKKENAEDDNADNNMEYTEQQIVWAKMVGHPHWPAVIISEVEVDAAMPSSKSNKQYYPVVFLGDFTHAWVEKSHIHPFEKNIEKYSKSSKTQFFAQALGQANEHLRKQKEDSEYKIAFERSPKKRSGDTARRSKSSPKKVERSPKKINILVPPLTGEAFSKKTADKLKIGVVGTGMIGAEIVKVLVEAGYTVNMWNRTLAKCKQLEKELGKGEHLSVLLTARNVLVKSDVVFMCISDRQATKQMVENEFEASIDTENLLKSKGILMMTSIDTNESKEINDSITKKGGKYLELALQGGSEESSKESRVLLTAGDEALFHHCHPYFKAIDCTPLYFGSTIGDAIRINLAMQMIKGVRMAALSEAFNVVERCGIKKDKLIQYSTCQISQAPI

SEQ ID NO: 23270 - protein, 311 aa, Diabrotica virgifera
  misc_feature: Coding regions on vcDNA: vcDNA=SeqID_2967; Strand=+; Position=2-937
  misc_feature: Homolog annotation: Hit_ID=BAC82595.1; Match level="QueryCoverage =99%, HitCoverage=26%, E-value=3e-51, Identity=35%"; Hit description =reverse transcriptase [Anopheles gambiae]
  misc_feature (46)..(46): Xaa can be any naturally occurring amino acid
  misc_feature (120)..(120): Xaa can be any naturally occurring amino acid
  misc_feature (282)..(282): Xaa can be any naturally occurring amino acid
  misc_feature (287)..(287): Xaa can be any naturally occurring amino acid
  misc_feature (299)..(299): Xaa can be any naturally occurring amino acid
KLMASTRNQLDEMLKTVESFSNDISMHFGLDKCRILNIFRRKEHRXMGENDMYKYLGVKQAQKIDRKQMKTEITTEFIRRVKQLLRSHLNRRNLFKALNTYACSALSYSFGIVKWTKTDXLQRKVRTHLTKAQKHYPRSAVERTTLPWNLGGRGLMDIGEQLDKQTANLRTYFQMQAETSTLHRAICAVDDTTPITLREPEMRINHLTKDEKMRTWMGKPLHGRHPNEVSQDYVDNTASNYWLTSGKMFPETEGSLLAIQDQVIPTRNYLKYIVKDPQFQNXQCRYXCQTQETIQHLTXGCQAFAATEYKT

SEQ ID NO: 23271 - protein, 143 aa, Diabrotica virgifera
  misc_feature: Coding regions on vcDNA: vcDNA=SeqID_2968; Strand=-; Position=548-979
FVPKLESHSLGRKFSRIKSSSPHHRHGSLICKPRENVFFSWVKEDEVSLSQRNRANKRLGSEINRHYSKMFVLLLKAKYLLDRPSMHSIRSEKQINIMQMLLLFQDSLSNFATKFTNQHNPAIGESIGNRLRKKSNKIELFVI

SEQ ID NO: 23272 - protein, 150 aa, Diabrotica virgifera
  misc_feature: Coding regions on vcDNA: vcDNA=SeqID_2969; Strand=+; Position=456-906
  misc_feature: Homolog annotation: Hit_ID=NP_609882.1; Match level="QueryCoverage =91%, HitCoverage=25%, E-value=5e-34, Identity=45%"; Hit description =CG10178-PA [Drosophila melanogaster] gb|AAF53673.2| CG10178-PA [Drosophila melanogaster]
  misc_feature: Gene Ontology Annotation: Molecular function=UDP-glycosyltransferase activity; Cellular component=membrane fraction; Biological process =lipid metabolism
  misc_feature: Pfam annotation: Pfam_ID=Glyco_tran_28_C; Match level="Score=-29.8, E- value=0.099, Copies=1"; Pfam description=Glycosyltransferase family 28 C-termi
  misc_feature (114)..(115): Xaa can be any naturally occurring amino acid
MKTFSNNTIESLLRAIQNLPQRFIWKFDALQVPNKPDNLLISKWLPQSDILAHPNVVAFVSHSGLISITEAVHHGVPLVVVPIFGDQHMNALRAVEKGIAVKIEFSKLDGDTLXXGVQKIINDNQYQKNAKEISKMFRDRPVHPWDLAVH

SEQ ID NO: 23273 - protein, 302 aa, Diabrotica virgifera
  misc_feature: Coding regions on vcDNA: vcDNA=SeqID_2970; Strand=+; Position=97-1000
  misc_feature: Homolog annotation: Hit_ID=EAL29079.1; Match level="QueryCoverage =96%, HitCoverage=56%, E-value=1e-35, Identity=30%"; Hit description =GA14998-PA [Drosophila pseudoobscura]
  misc_feature (264)..(264): Xaa can be any naturally occurring amino acid
  misc_feature (269)..(269): Xaa can be any naturally occurring amino acid
MKQVTLIFLFAGLLAAESANILGIFVAQGRSQFLLGERLLGELARRGHNVTLLGKFVPQEKHENLHLIRVNLMEENSFDFLSWETQNDFEHVKAIHDKWLKITEGLFDEQLVKDLINSNSTFDMVIFESFGSEAAMGFAKHFNASLVVFNSLAMNEWCSNLIGNVRIPSITPYSLTQKTSSMTFYERLTNTLLFLYDKYYKEYVYYPQQQKILKQHFGNEMDLHEVMTSTSFLLLNSHPLTTEPSLLTSAAVEIGGFHVSTRKXPNDIXEVLDDAKHGAVLISFGTNIDMKTFSNNTIESLL

SEQ ID NO: 23274 - protein, 193 aa, Diabrotica virgifera
  misc_feature: Coding regions on vcDNA: vcDNA=SeqID_2971; Strand=-; Position=341-922
  misc_feature (136)..(136): Xaa can be any naturally occurring amino acid
MCNFGLTFSQLFRAKGGRVVTLINDRKIVCKINIGSREFEAQTTLNFAGIRYLEERLRTQTEVSEAAVSQAGVTARWINLYFTGKDFGEKYEDFNRFCREESGKLDKTGFYKKTEQTPLTIEEIMNGAEHGFYIAXSEKAKKIASKLLDDDLGTWDGLGFTLGGEDIDLGDHVNEIEHLIDEWVRLPWTEFVG

SEQ ID NO: 23275 - protein, 296 aa, Diabrotica virgifera
  misc_feature: Coding regions on vcDNA: vcDNA=SeqID_2972; Strand=+; Position=47-935
  misc_feature: Homolog annotation: Hit_ID=NP_788639.1; Match level="QueryCoverage =86%, HitCoverage=21%, E-value=2e-71, Identity=52%"; Hit description =CG31116-PD, isoform D [Drosophila melanogaster] gb|AAF54702.3| CG31116-PD, isoform D [Drosophila
  misc_feature: Gene Ontology Annotation: Molecular function=voltage-gated chloride channel activity; Cellular component=integral to plasma membrane; Biological process=transport
  misc_feature: Pfam annotation: Pfam_ID=Voltage_CLC; Match level="Score=-137.1, E -value=4.7e-05, Copies=1"; Pfam description=Voltage gated chloride channel
  misc_feature (251)..(251): Xaa can be any naturally occurring amino acid
  misc_feature (263)..(263): Xaa can be any naturally occurring amino acid
MSFRQNNLPVGQLYDSRYSPVQARYNYTKSIEKIHSELKKKKLEEIKKLKEEEKKRQKELEIYQGKYTRLFWKIWHNTFGHLGEDWVFLAFLGIIVAVISYTVDKAVWLCNNGQKWLYADVASGMFAKWVAWVALPFCLIIWNVGLTHLVAPQAAGSGIPQIKTSLRGVFMKEVLTFRTLLVKWLGTMASIGSGLPLGKEGPLIHMSSIIVTKLSKVMSNFNSIYINESKIIEMLGAAWAVGVACTFNAPXGGVLFSVEITTXYYAVRNYRRGFVAVVWGASSTALTCLDDGAKRY

SEQ ID NO: 23276 - protein, 301 aa, Diabrotica virgifera
  misc_feature: Coding regions on vcDNA: vcDNA=SeqID_2973; Strand=+; Position=105-1010
  misc_feature: Homolog annotation: Hit_ID=XP_312303.1; Match level="QueryCoverage =82%, HitCoverage=68%, E-value=2e-64, Identity=49%"; Hit description =ENSANGP00000010607 [Anopheles gambiae]
  misc_feature: Gene Ontology Annotation: Molecular function=peptidase activity; Cellular component=mitochondrion; Biological process=mitochondrial intermembrane space protein import
  misc_feature: Pfam annotation: Pfam_ID=Rhomboid; Match level="Score=33.9, E-value =4.8e-07, Copies=1"; Pfam description=Rhomboid family
TTMALSRMVRLVHLGSKESIFLQRGGLKSGNGNIRTFRNGRKVNDEPKINPESLATPFTNAHIDCSNLRAGSLFRPFLFTVAFSGSCFVGAAIWEYENMRSRAKMQLRKPMKFFRKSIDQGVHSTNTLIRDFKSWWNRLTEGERIFAPICVLNVLVFLAWRIPRFQPMMLRYFCSNPASPNIYVPMVLSTFSHYSGLHLLANMYVLHSFCTGAVHSLGKEQFLGFYLTAGVVSSFASYTYKVLTRQPGLSLSASGAIMGILGYVCTQYPDTRLGIFYYLCSTFPLELLLNSPGASIPLGVN

SEQ ID NO: 23277 - protein, 263 aa, Diabrotica virgifera
  misc_feature: Coding regions on vcDNA: vcDNA=SeqID_2974; Strand=+; Position=110-901
  misc_feature: Homolog annotation: Hit_ID=NP_573044.1; Match level="QueryCoverage =95%, HitCoverage=75%, E-value=7e-97, Identity=63%"; Hit description =CG7872-PA [Drosophila melanogaster] gb|AAF48476.1| CG7872-PA [Drosophila melanogaster]
  misc_feature: Gene Ontology Annotation: Molecular function=chaperone regulator activity; Cellular component=mitochondrion; Biological process =biological_process unknown
  misc_feature: Pfam annotation: Pfam_ID=DnaJ; Match level="Score=104.0, E-value=3.9e- 28, Copies=1"; Pfam description=DnaJ domain
  misc_feature (193)..(193): Xaa can be any naturally occurring amino acid
  misc_feature (235)..(235): Xaa can be any naturally occurring amino acid
  misc_feature (255)..(255): Xaa can be any naturally occurring amino acid
MLHYLIAVTSILFILCVSASGQLLEGIYCGKENCYDVLEVTRETTKNEISRSYRKLARQYHPDLHRTPEAKEKAEERFKIIANAYEILKDEEARSDYDYMLDNPDEYYAHYYRYYRRRVAPKVDVRIVLIVTISIISIIQYYSGWQKYDLAIKYFMTVPKYRNKALEIAKEDGLLQNDKKQKKNKKELKEETXTIIRKVIEDKMDIKGAYAKPSITDLLWIQLIIFPYTIVKYIXWYVSWYWRHSILKQPYSEEXKLYIIRNI

SEQ ID NO: 23278 - protein, 96 aa, Diabrotica virgifera
  misc_feature: Coding regions on vcDNA: vcDNA=SeqID_2975; Strand=+; Position=187-477
  misc_feature: Homolog annotation: Hit_ID=CAG32105.1; Match level="QueryCoverage =87%, HitCoverage=88%, E-value=3e-16, Identity=47%"; Hit description =hypothetical protein [Gallus gallus]
  misc_feature: Pfam annotation: Pfam_ID=HIG_1_N; Match level="Score=92.8, E-value =8.8e-25, Copies=1"; Pfam description=Hypoxia induced protein conserved reg
MSVTTMNEPPRIYYEEESQSDKLLRKSKETPVFPIAIGICAAAVGYGIYAYKNKGKMSTSVYLMHLRVGAQGAAVGSLTLGLIYTMINRHFLKKPE

SEQ ID NO: 23279 - protein, 264 aa, Diabrotica virgifera
  misc_feature: Coding regions on vcDNA: vcDNA=SeqID_2976; Strand=+; Position=67-861
  misc_feature: Homolog annotation: Hit_ID=AAV34815.1; Match level="QueryCoverage =98%, HitCoverage=96%, E-value=1e-76, Identity=58%"; Hit description =ribosomal protein L6 [Bombyx mori]
  misc_feature: Gene Ontology Annotation: Molecular function=structural constituent of ribosome; Cellular component=cytosolic large ribosomal subunit (sensu Eukarya); Biological process=ribosomal large subunit assembly and maintenance
  misc_feature: Pfam annotation: Pfam_ID=Ribosomal_L6e; Match level="Score=199.2, E -value=8.1e-57, Copies=1"; Pfam description=Ribosomal protein L6e
MVEKKAVQKPAGDAPKKVHKPGKPRNYDLGNGVLRFSRSKMFHKKALYKFVGKKVEATKKPQKPQVIEKPIGGEKNGGKRFVLVKKRRASYPTQDKIKARPARRTFSQHTRSIRNTITPGTVLILLAGSHKGKRVVFLKQLYSGLLLVTGPFGINACPLRRISQRYVIATSTKIDVSGVQLPENLNDEYFARKRQKRSKKEEGDIFQSKKEGYKVSEDRKADQKKVDTQVLAAIKKHSDRKVLLAYLSAMWGLRSSQYPHRLKF

SEQ ID NO: 23280 - protein, 121 aa, Diabrotica virgifera
  misc_feature: Coding regions on vcDNA: vcDNA=SeqID_2977; Strand=+; Position=413-778
  misc_feature: Homolog annotation: Hit_ID=XP_316499.1; Match level="QueryCoverage =98%, HitCoverage=75%, E-value=2e-58, Identity=91%"; Hit description =ENSANGP00000014056 [Anopheles gambiae]
  misc_feature: Gene Ontology Annotation: Molecular function=translation initiation factor activity; Cellular component=ribosome; Biological process =translational initiation
  misc_feature: Pfam annotation: Pfam_ID=SUI1; Match level="Score=159.6, E-value=7e -45, Copies=1"; Pfam description=Translation initiation factor SUI1
FLFSRVFLEYRMSIQNLNTFDPFADASKGADDDVQDGLVHIRIQQRNGRKTLTTVQGLSKEYDLKKIVRACKKEFACNGTVIEHPEYGEVLQLQGDQRENICQWLTKAGLAKPDQLKVHGF

SEQ ID NO: 23281 - protein, 108 aa, Diabrotica virgifera
  misc_feature: Coding regions on vcDNA: vcDNA=SeqID_2978; Strand=+; Position=492-818
TFLLVQRMTLTSHVWSFGHFSIPKTAYLAFLDNRVVFAFFNGLLHLFLHCFDCSLDRYHRTKSFELRFNVVKKFSESNALVCFWLRVIKLGSISLNSSYMLINMFRAS

SEQ ID NO: 23282 - protein, 190 aa, Diabrotica virgifera
  misc_feature: Coding regions on vcDNA: vcDNA=SeqID_2979; Strand=-; Position=580-1152
  misc_feature: Homolog annotation: Hit_ID=NP_599110.1; Match level="QueryCoverage =100%, HitCoverage=67%, E-value=4e-66, Identity=62%"; Hit description= CG6647-PB, isoform B [Drosophila melanogaster] ref|NP_476813.1| CG6647-PA, isoform A [Drosophila
  misc_feature: Gene Ontology Annotation: Molecular function=voltage-dependent anion channel porin activity; Cellular component=extracellular space; Biological process=behavioral fear response
  misc_feature: Pfam annotation: Pfam_ID=Porin_3; Match level="Score=129.0, E-value =1.1e-35, Copies=1"; Pfam description=Eukaryotic porin
GLKVSGNVNFSPQEGYQSGVVKSEYGNERIHLNADVDLNSNGPVVRGSAVVGYQGWLAGYQAAFAVQNSKLAKSNFALGFSTSDFVLHTCVNDGQTFGGSIYQKINPKLETAINLSWAASGEKTDFGLGCKYDLDADASLRAKINNASQIGLGYQQKLRDGVTLTLSTLIDGKNFNQGGHKIGLALDLEA

SEQ ID NO: 23283 - protein, 282 aa, Diabrotica virgifera
  misc_feature: Coding regions on vcDNA: vcDNA=SeqID_2980; Strand=-; Position=517-1365
  misc_feature: Homolog annotation: Hit_ID=NP_599110.1; Match level="QueryCoverage =99%, HitCoverage=99%, E-value=1e-105, Identity=64%"; Hit description= CG6647-PB, isoform B [Drosophila melanogaster] ref|NP_476813.1| CG6647-PA, isoform A [Drosophila
  misc_feature: Gene Ontology Annotation: Molecular function=voltage-dependent anion channel porin activity; Cellular component=extracellular space; Biological process=behavioral fear response
  misc_feature: Pfam annotation: Pfam_ID=Porin_3; Match level="Score=367.0, E-value =2.6e-107, Copies=1"; Pfam description=Eukaryotic porin
MAPPPYADLGKRARDVFGNGYHFGLIKLNCKTKTASGVQFSTGGSSDHESGKVSGSLESKYTVKDYGLTFTEKWNTNNTLGTEIAISDQGIKGLKVSGNVNFSPQEGYQSGVVKSEYGNERIHLNADVDLNSNGPVVRGSAVVGYQGWLAGYQAAFDVQNSKLAKSNFALGFSTSDFVLHTCVNDGQTFGGSIYQKINPKLETAINLSWAASGEKTDFGLGCKYDLDADASLRAKINNASQIGLGYQQKLRDGVTLTLSTLIDGKNFNQGGHKIGLALDLEV

SEQ ID NO: 23284 - protein, 310 aa, Diabrotica virgifera
  misc_feature: Coding regions on vcDNA: vcDNA=SeqID_2981; Strand=+; Position=137-1066
  misc_feature: Homolog annotation: Hit_ID=XP_316718.1; Match level="QueryCoverage =96%, HitCoverage=49%, E-value=2e-53, Identity=38%"; Hit description =ENSANGP00000020865 [Anopheles gambiae]
IKKCHRLELTSSSETNIQEIELRRELERELKNKRQCTYQPYECSQLCLDNYQYCMKHILNDKNAPYKQCSFTYNTNGKKCNLPAPRSDKKDFGYCSEHALKVTLTRNRQNSKHPLPCTAEVLLSSLSHYVYKPRNRNSSSSTQHSDDDRVTPDSELKSAKCLDPFVDIDASVVQGEKCSRILDVCSESESDIEPSTLSSVWPDIQADSSDDESIDSENEDLLKHANVYTAEEITLLARDKLIKLQSLYIEQYRYLQYLLTKKRRKYLHLLKREKETCCNIYNQVRDNPKEQRLYKKLKALYNYQKCHGTD

SEQ ID NO: 23285 - protein, 200 aa, Diabrotica virgifera
  misc_feature: Coding regions on vcDNA: vcDNA=SeqID_2982; Strand=+; Position=251-854
  misc_feature: Homolog annotation: Hit_ID=AAL39439.1; Match level="QueryCoverage =93%, HitCoverage=66%, E-value=5e-23, Identity=35%"; Hit description =GM14611p [Drosophila melanogaster]
  misc_feature: Gene Ontology Annotation: Cellular component=peroxisomal membrane; Biological process=peroxisome organization and biogenesis
  misc_feature (187)..(187): Xaa can be any naturally occurring amino acid
MTDKKEDVPKTNVDEELSNLLDSALEDFTKIEATQKDAKTDTSSKEVSTSNQSANIEGQEWSNDFIQQAANQFEENFANFLAGADPNAQVTPEFIQQKLQQMADAAQQVLENPTQAADNSVDFASSITQAIQSLNAGAEGLQAPLNEEELMKMFTGDKTGQENDLLPFMQGMMQGLLSQEVLGPSLXDFVQRLPEYIEKN

SEQ ID NO: 23286 - protein, 238 aa, Diabrotica virgifera
  misc_feature: Coding regions on vcDNA: vcDNA=SeqID_2983; Strand=+; Position=1-717
  misc_feature: Homolog annotation: Hit_ID=XP_316908.1; Match level="QueryCoverage =99%, HitCoverage=98%, E-value=1e-119, Identity=79%"; Hit description= ENSANGP00000010988 [Anopheles gambiae]
  misc_feature: Gene Ontology Annotation: Molecular function=transcription co -activator activity; Cellular component=focal adhesion; Biological process=integrin-mediated signaling pathway
  misc_feature: Pfam annotation: Pfam_ID=LIM; Match level="Score=265.4, E-value=9.5e -77, Copies=3"; Pfam description=LIM domain
AAVNQGPQHHTVSDSQYARPIKATQTQSAPPPPKQNLDSMLGNLQADMSRQGVNTSQKGCCSACDKPIVGQVITALGKTWHPEHFTCAHCSQELGTRNFFEREGKPYCEPDYHNLFSPRCAYCNGPILDKCVTALEKTWHMDHFFCAQCGKQFGEEGFHEREGKPYCRDDYFDMFAPKCGGCNRAIMENYISALNAQWHPDCFVCRDCKLPVQGKSFYAVEGKPVCPGCIGADEDEDE

SEQ ID NO: 23287 - protein, 229 aa, Diabrotica virgifera
  misc_feature: Coding regions on vcDNA: vcDNA=SeqID_2984; Strand=+; Position=97-786
  misc_feature: Homolog annotation: Hit_ID=EAL33333.1; Match level="QueryCoverage =93%, HitCoverage=41%, E-value=2e-20, Identity=35%"; Hit description =GA16481-PA [Drosophila pseudoobscura]
MDDHLDALLADLQNTVSGSSGIGSNYSGYGQRNVRYSPDSDGHYSKTDSYSVKSGSYGKVPPNSGNRSPSYGLNATAGHSASSTMEKRPFNNNLDELDSLLQDLSNSRQHASENMNGSHYNGAIADYGGRSSANYSRPSSAQSTLNRPSVDSLLDELNSGDVIYTGPKKVVITVKETKTETGYPGETELISSHVTHTAASSATRELDDLMASLSNIKVNQGPQHHTVSD

SEQ ID NO: 23288 - protein, 254 aa, Diabrotica virgifera
  misc_feature: Coding regions on vcDNA: vcDNA=SeqID_2985; Strand=-; Position=330-1094
  misc_feature: Homolog annotation: Hit_ID=AAU84940.1; Match level="QueryCoverage =100%, HitCoverage=100%, E-value=1e-114, Identity=75%"; Hit description=putative phosphoglycerate mutase [Toxoptera citricida]
  misc_feature: Gene Ontology Annotation: Biological process=glycolysis
  misc_feature: Pfam annotation: Pfam_ID=PGAM; Match level="Score=399.7, E-value=3.8e- 117, Copies=1"; Pfam description=Phosphoglycerate mutase family
MAPFKIVMVRHGESEWNEKNLFCGWFDANLSEKGKQEAINAGKALKNAGYKFDIAYTSVLTRAQNTLNSIIKEIGQENLETIKTWRLNERHYGGLTGLNKAETAAKYGDEQVAIWRRSFDIPPPPMEPDHAYYDTIVKDARYADGPAPDQFPKFESLKLTIERTLPFWNETVVPQIKAGKQILIAAHGNSLRGIVKHLDQLTDDQIMQLNLPTGIPFVYTLDENLKPIKSLEFLGDPETVKKAMEAVAAQGKAK

SEQ ID NO: 23289 - protein, 56 aa, Diabrotica virgifera
  misc_feature: Coding regions on vcDNA: vcDNA=SeqID_2986; Strand=+; Position=2-172
LVRQSRENLYFIAPTFQGCWIRRCTIYMFDHEFIVRPSYYAIKNQKNSKTNVLKNF

SEQ ID NO: 23290 - protein, 135 aa, Diabrotica virgifera
  misc_feature: Coding regions on vcDNA: vcDNA=SeqID_2987; Strand=+; Position=1-405
  misc_feature: Homolog annotation: Hit_ID=EAL39193.1; Match level="QueryCoverage =89%, HitCoverage=12%, E-value=2e-23, Identity=50%"; Hit description =ENSANGP00000014170 [Anopheles gambiae str. PEST] ref|XP_553627.1| ENSANGP00000014170 [Anopheles gambiae st
  misc_feature (125)..(125): Xaa can be any naturally occurring amino acid
PEVECSAPEDILCEKNFVENVCRDGSGRYTVALPFRELSPVFPGMFELAVNRFLSLEKRLLKNPSVYQEYCTFMKDYLDLHHMELVSETSRPLSCYYIPHHAVLKPDSLTTKLRVVFNASARIGXQNSLNQCLFT

SEQ ID NO: 23291 - protein, 118 aa, Diabrotica virgifera
  misc_feature: Coding regions on vcDNA: vcDNA=SeqID_2988; Strand=+; Position=20-375
  misc_feature: Homolog annotation: Hit_ID=EAL34170.1; Match level="QueryCoverage =76%, HitCoverage=22%, E-value=2e-11, Identity=35%"; Hit description =GA16592-PA [Drosophila pseudoobscura]
  misc_feature: Gene Ontology Annotation: Molecular function=molecular_function unknown
  misc_feature (71)..(71): Xaa can be any naturally occurring amino acid
MTGHKKNERPVSAFSTIIHHDMWLNNTMQKIVNGVTVKNKVCDFQMCEVNSPTIDLMLFLFSSVELRCLEXNVDNLIKFYHEELVNILKKLNVYSEEYCIKNFWKILRLIVKKVCSTH

SEQ ID NO: 23292 - protein, 41 aa, Diabrotica virgifera
  misc_feature: Coding regions on vcDNA: vcDNA=SeqID_2989; Strand=+; Position=185-307
  misc_feature (10)..(10): Xaa can be any naturally occurring amino acid
  misc_feature (21)..(21): Xaa can be any naturally occurring amino acid
LKITVAIITXIIMMNKNNYDXFIKRHYNYLMYFTELKWDYL

SEQ ID NO: 23293 - protein, 129 aa, Diabrotica virgifera
  misc_feature: Coding regions on vcDNA: vcDNA=SeqID_2990; Strand=+; Position=1-390
THASDFLKLVRTMSKTILILVFVSCFVAHIQCRIFIDCLDPDNPGYLQFDKQIIASFPMSISVHFPATGYQPDSDYSCLKINCDKDTTVTLIDGGVGFRYANIKVDFKSWQTLTCGIQIYTLQPEVSSV

SEQ ID NO: 23294 - protein, 239 aa, Diabrotica virgifera
  misc_feature: Coding regions on vcDNA: vcDNA=SeqID_2991; Strand=+; Position=3-722
  misc_feature: Homolog annotation: Hit_ID=EAA12766.2; Match level="QueryCoverage =94%, HitCoverage=81%, E-value=5e-20, Identity=35%"; Hit description =ENSANGP00000012400 [Anopheles gambiae str. PEST] ref|XP_555454.1| ENSANGP00000012400 [Anopheles gambiae st
QFVFVLFACLVGGILAGYPDHSSGNDIGTANNNGNSYGYGYSGSFSGPGAAPENFQFPQELSNLFKTLNKYQEDIFKNFQAQAASVQNNLQSRGSFADAGDSSYGGGYGGSFSTGNGNGQSFGGSFSSGFPGAGGGPGYQFIPGPSVTGSFTPDANGASAFGVIGPGGIQQGASVFPENANAPNVNVRFSSDQPDGFKSVYTSSSSYTTNVDGKPKTVQKSSTTVNDNGKVTTYEAHNP

SEQ ID NO: 23295 - protein, 723 aa, Diabrotica virgifera
  misc_feature: Coding regions on vcDNA: vcDNA=SeqID_2992; Strand=+; Position=1-2172
  misc_feature: Homolog annotation: Hit_ID=XP_321226.1; Match level="QueryCoverage =94%, HitCoverage=20%, E-value=2e-68, Identity=28%"; Hit description =ENSANGP00000018348 [Anopheles gambiae]
  misc_feature: Gene Ontology Annotation: Molecular function=microtubule binding
DVSYNLAADDASGRNVNADLNVKVSKEGERRVLDTSTKIYGSILKQALKSGLVFKYTVDNGEFEITSSYGPEVNGKLGGKYDVRDEGKPVSGELDIELLLPSQNLKTLRSKLSGSVLLPSEKSTEITLSGAASIYADNRVSSVPLVDFSTDGQVRASDKDGDLKANLKTNKLDPISVVAGYSCKDLGQEKHQVTGNVALQYSKGKNLKLDGTLTKLAKHQYKLEAELDTPFEALKKNHLLVETKGSEDYQQVTSKVVLTNDGKKWQLDSDLKSSEISPLIHLKLRCPEGKLTEVLLKGNKVSDKELAFEYRLLCQKKDFLLEGKLDANVADIDNFYVKGSINSPKLELNKITFEATNKGNKAAKKVQIHVKSADKNLVSGSTTYQAREEHGKYIIEGSGTLKIKEENKAANFKFISQDLTQEKNGEQGFQISFVAGVGNNAFDSELKITNKQFRILDSYCEKNKECAHFELDSKVNENDAERFSHVLEITLDLKKLGLPNEFGLKAVTTRKGYVLDHTVDIHFQSPQNSKYQYSVYLHPDEAGVSLTTPNRIVALESQIRGPRNVRLAGGKVTAEVSFYLDKKNQPNQKASLSGWINVDDKGKGVKSAVSLSHPGLQRPLSITFESTRGGQTRLPEIYTSTVFDIFDQPSQKIVVDYTFTPEVANDNSHAVVYNYLLCKSVGLGINIEATEEIRVDRKAISGVYWSRIKYVGWKFQLRQSDLR

SEQ ID NO: 23296 - protein, 48 aa, Diabrotica virgifera
  misc_feature: Coding regions on vcDNA: vcDNA=SeqID_2993; Strand=+; Position=30-176
KIMTRIQKYRAFRHRFYISSMENFKAKAKVLIIFLLFFSVDSGTSFGW

SEQ ID NO: 23297 - protein, 405 aa, Diabrotica virgifera
  misc_feature: Coding regions on vcDNA: vcDNA=SeqID_2994; Strand=+; Position=25-1239
  misc_feature: Homolog annotation: Hit_ID=XP_319210.1; Match level="QueryCoverage =94%, HitCoverage=63%, E-value=1e-114, Identity=49%"; Hit description= ENSANGP00000019251 [Anopheles gambiae]
  misc_feature: Gene Ontology Annotation: Molecular function=beta-N -acetylhexosaminidase activity; Cellular component=extracellular space
  misc_feature: Pfam annotation: Pfam_ID=Glyco_hydro_20; Match level="Score=157.7, E -value=2.6e-44, Copies=1"; Pfam description=Glycosyl hydrolase family 20, catalyt
MMQKLIILLLTLIYVTFVQCYLEEPGPRYPPTKGELWPKPSYQIKNESFFILDPRTFEIKTTSYTCSLIKDAIVNYEYLITKGGVSEKNKIKAHGKIFDNTWLQDPAYLGIFDKLEVRLDTPCDGNEYPSENMMEAYTIRVSEHEKLINSSSVWGILRGLESFSQMVYIADKGLSLRINRTFVEDVPRFSHRGLLLDTSRHFIPLESILLTINAMSYNKMNVFHWHIVDDHSFPYSSKKFPELSEKGAYTPYQVYSDADIQVIIEHARLKGVRVIPEFDTPGHTRSWGVSHPELLTACGGELTGKYGPIDPTIDATYEFLNDLFIEIHETFADRYIHIGGDEVGFECWGNTSKIVDYMKKKDIRTFEDLESFYIKKVSDMIDSLEYQSIVWEEVFTNGVELPKDT

SEQ ID NO: 23298 - protein, 314 aa, Diabrotica virgifera
  misc_feature: Coding regions on vcDNA: vcDNA=SeqID_2995; Strand=+; Position=213-1157
  misc_feature: Homolog annotation: Hit_ID=XP_317916.1; Match level="QueryCoverage =36%, HitCoverage=31%, E-value=2e-18, Identity=44%"; Hit description =ENSANGP00000019985 [Anopheles gambiae]
  misc_feature (278)..(278): Xaa can be any naturally occurring amino acid
  misc_feature (289)..(290): Xaa can be any naturally occurring amino acid
  misc_feature (301)..(301): Xaa can be any naturally occurring amino acid
MSKFLKFGICGIDISIELSHLIHVQRMFNAFANTGSGKHLTLDKLVVSVDVNKNLSVLYDNKPEKYQDLENISNQIIQLGLNSCDNSQIIIDENNLHYKNQVLRQDTLKNQVNQQYNYNNKVAQRYWSSHYSPSLFSNLYLHSYSSNQLYQKISPSYLLVRQFHTQQVQRKKYKKHKYIDNCAGTNIMSLRLWENTCDNVSRTPGFIFTLMSYNVLAQDLVELHPYLYKEHDSAALSWPTRWKNLFEEISKFKPDILCLQEVQESHIADYYSTLKILXYDGIFKKRTGXXSDGCAIYLQSXQSEMLDYTGALPV

SEQ ID NO: 23299 - protein, 247 aa, Diabrotica virgifera
  misc_feature: Coding regions on vcDNA: vcDNA=SeqID_2996; Strand=+; Position=197-940
  misc_feature: Homolog annotation: Hit_ID=XP_315790.1; Match level="QueryCoverage =97%, HitCoverage=93%, E-value=2e-58, Identity=47%"; Hit description =ENSANGP00000018745 [Anopheles gambiae]
  misc_feature: Pfam annotation: Pfam_ID=UPF0005; Match level="Score=45.2, E-value =1.8e-10, Copies=1"; Pfam description=Uncharacterised protein family UPF000
SIIFIMATEYVRFSPNAFLNSFNAKLEQPVRQHLKNVYACLAMSTMSAALGAAVHLFTNIMQAGFLSAIGALVFFFLLVNTPDDNGKSMTTRVGYLLGFTFLTGVGLGPLLEHVILVEPSIIITAFVATSTVFVSFSAASMLSERGRWLYLGGTLMTMLTTLMVLSLANIFFGAMWIYQTQLYLGLLAMCGFVLYDTQMIIEKRRLGSRDFVAHSLDLFVDFIGIFRRLLVILTQREQEAQRKKRRD

SEQ ID NO: 23300 - protein, 46 aa, Diabrotica virgifera
  misc_feature: Coding regions on vcDNA: vcDNA=SeqID_2997; Strand=+; Position=71-211
KRCVDLPLGKIIFWAYKPRRLFFKSVSSAPIKLAYCRLLQYFFESM

SEQ ID NO: 23301 - protein, 222 aa, Diabrotica virgifera
  misc_feature: Coding regions on vcDNA: vcDNA=SeqID_2998; Strand=+; Position=6-674
MKIAKDKTELTKKALKLALKYSFVTEVTSLVVVKPNSTRPIYADDGYLRSEGQEYSTPAFHAYGRGGRPAGGQHKVAYSAVSSSSFVSNRESVVHVQQIPRPRRPRVQTTTHKPTPLPTPTETSKNATLEDSLKWLSAALSEKKTLTVPSGELKLGDDSLKIAATETCPKTPEGKEGVCSLIKDCPQVFPQLTDFEVYKTFSCVMQKEYAGVCCPKKAEVAA

SEQ ID NO: 23302 - protein, 327 aa, Diabrotica virgifera
  misc_feature: Coding regions on vcDNA: vcDNA=SeqID_2999; Strand=+; Position=116-1164
  misc_feature: Homolog annotation: Hit_ID=XP_392962.1; Match level="QueryCoverage =96%, HitCoverage=98%, E-value=1e-158, Identity=85%"; Hit description= similar to putative activated protein kinase C receptor [Apis mellifera]
  misc_feature: Gene Ontology Annotation: Molecular function=molecular_function unknown; Cellular component=actin filament; Biological process =signal transduction
  misc_feature: Pfam annotation: Pfam_ID=WD40; Match level="Score=214.3, E-value=2.3e- 61, Copies=6"; Pfam description=WD domain, G-beta repeat
  misc_feature (280)..(280): Xaa can be any naturally occurring amino acid
MTETLQLKGTLLGHNGWVTQIATNPKYPDMILSSSRDKTLIVWKLTREDTQYGVPQKRLYGHSHFISDVVLSSDGNYALSGSWDKTLRLWDLAAGKTTRRFEDHTKQEDFFVAFSVDNRQIVSGSRDKTIKLWNTLAECKYTIQDDGHSDWVSCVRFSPNHANPIIVSAGWDRMVKVWNLTNCRLKINHSGHTGYLNTVAVSPDGSLCASGGKDCKAMLWDLNDGKHLHTLDHNDIITALCFSPNRYWLCAAFGPSIKIWDLESREMVEELKPKVVSKTXKTEPPQWLSFALGPKMEQHLFPWKFPKNQLKKWQRSRGSGPFKKVKI

SEQ ID NO: 23303 - protein, 90 aa, Diabrotica virgifera
  misc_feature: Coding regions on vcDNA: vcDNA=SeqID_3000; Strand=+; Position=1176 -1445
  misc_feature: Homolog annotation: Hit_ID=AAT01086.1; Match level="QueryCoverage =98%, HitCoverage=27%, E-value=1e-46, Identity=95%"; Hit description =putative activated protein kinase C receptor [Homalodisca coagulata]
  misc_feature: Gene Ontology Annotation: Molecular function=molecular_function unknown; Cellular component=actin filament; Biological process =signal transduction
  misc_feature: Pfam annotation: Pfam_ID=WD40; Match level="Score=44.0, E-value=4.4e -10, Copies=1"; Pfam description=WD domain, G-beta repeat
NDVLSVAFSVDNRQIVSGSRDKTIKLWNTLAECKYTIQDDGHSDWVSCVRFSPNHANPIIVSAGWDRMVKVWNLTNCRLKINHSGHTGYL

SEQ ID NO: 23304 - protein, 317 aa, Diabrotica virgifera
  misc_feature: Coding regions on vcDNA: vcDNA=SeqID_3001; Strand=+; Position=90-1043
  misc_feature: Homolog annotation: Hit_ID=XP_392962.1; Match level="QueryCoverage =99%, HitCoverage=99%, E-value=1e-179, Identity=93%"; Hit description= similar to putative activated protein kinase C receptor [Apis mellifera]
  misc_feature: Gene Ontology Annotation: Molecular function=molecular_function unknown; Cellular component=actin filament; Biological process =signal transduction
  misc_feature: Pfam annotation: Pfam_ID=WD40; Match level="Score=266.7, E-value=3.9e- 77, Copies=7"; Pfam description=WD domain, G-beta repeat
MTETLQLKGTLLGHNGWVTQIATNPKYPDMILSSSRDKTLIVWKLTREDTQYGVPQKRLYGHSHFISDVVLSSDGNYALSGSWDKTLRLWDLAAGKTTRRFEDHTKDVLSVAFSVDNRQIVSGSRDKTIKLWNTLAECKYTIQDDGHSDWVSCVRFSPNHANPIIVSAGWDRMVKVWNLTNCRLKINHSGHTGYLNTVAVSPDGSLCASGGKDCKAMLWDLNDGKHLHTLDHNDIITALCFSPNRYWLCAAFGPSIKIWDLESKEMVEELKPEVVSQNTKAEPPQCLSLAWSTDGQTLFAGYSDNTIRVWQVSVSAH

SEQ ID NO: 23305 - protein, 54 aa, Diabrotica virgifera
  misc_feature: Coding regions on vcDNA: vcDNA=SeqID_3002; Strand=+; Position=2-166
SICTYNIIIGGNISLIVPRHFLIYSPVFPIHWQLFATISSCRYTIFPRQSCHDI

SEQ ID NO: 23306 - protein, 124 aa, Diabrotica virgifera
  misc_feature: Coding regions on vcDNA: vcDNA=SeqID_3003; Strand=-; Position=574-948
  misc_feature: Pfam annotation: Pfam_ID=GIY-YIG; Match level="Score=8.5, E-value =0.074, Copies=1"; Pfam description=GIY-YIG catalytic domain
NNLSKHIKNNKSRKRKQLQSGVYKLTCGDCPKTYIGQTGRTFDKRIAEHKRAFNNRKTDTSTYALHLLDHNHSFNEEFQILHIQNKGLKLSLLESMEIDKLKNTDIILNDRLETGSSPLLSLFS

SEQ ID NO: 23307 - protein, 92 aa, Diabrotica virgifera
  misc_feature: Coding regions on vcDNA: vcDNA=SeqID_3004; Strand=-; Position=1765 -2043
IEKYRYNSEWPTRDKQLPTPQLLQLKTLKRQTHSNLNHLRKALCRNSCSHIVVISFVEVWKTDVFSVLLLDKMNFHQVTVESINNSRIPWQS

SEQ ID NO: 23308 - protein, 124 aa, Diabrotica virgifera
  misc_feature: Coding regions on vcDNA: vcDNA=SeqID_3005; Strand=-; Position=747-1121
WKFTLSNNKTPKTLVLHTSTKFITTEKTRTIIPPPQKEPSTFCSITYTGKITTIIARYIKKEGITPAFRTNNNLSKYIKNNKSRKRKQLQSGVYKLTCGDCPKTYIGQTGRTFGKRMAEPLANG

SEQ ID NO: 23309 - protein, 243 aa, Diabrotica virgifera
  misc_feature: Coding regions on vcDNA: vcDNA=SeqID_3006; Strand=+; Position=2-733
  misc_feature: Homolog annotation: Hit_ID=XP_311519.1; Match level="QueryCoverage =99%, HitCoverage=34%, E-value=1e-110, Identity=75%"; Hit description= ENSANGP00000010197 [Anopheles gambiae]
  misc_feature: Gene Ontology Annotation: Molecular function=14-alpha-glucan branching enzyme activity; Cellular component=cellular_component unknown; Biological process=glycogen metabolism
SKWVKLLKHKSDDEWDMGNLIHTLTNRRWMEGNVAYAESHDQALVGDKTIAFWLMDKEMYTHMSTLSDQSLIIDRGIALHKLIRYVTHGLGGEAYLNFIGNEFGHPEWLDFPRAGNNSSYHYARRQWNLVDDDILKYKFLNNWDAAMNHLEQKYGWLADNPGYVSTKHQDDKVIVFERAGLVFVFNFHPTKSFADYRVGVEVEGNYRIVLSSDDKAFGGFDRIDKSVTFATTPEGFAGRRNYM

SEQ ID NO: 23310 - protein, 195 aa, Diabrotica virgifera
  misc_feature: Coding regions on vcDNA: vcDNA=SeqID_3007; Strand=+; Position=258-842
  misc_feature: Homolog annotation: Hit_ID=NP_848882.1; Match level="QueryCoverage =76%, HitCoverage=52%, E-value=4e-37, Identity=45%"; Hit description =RIKEN cDNA A530016O06 gene [Mus musculus] dbj|BAC34143.1| unnamed protein product [Mus musculus]
MNSTSFLQNLNGSDTTITSVYIRLLDKDIVDNVPFDRDMLKDFFKGLGRMFYIVHPAETTYQDPQAVPEFFQNAWPYFLLFMLIENIILFMENKPIYRLNDGLTSISHGLIQHSGKLIFRGSESYLYFYIHQHFCLINLPWNNSMTWYLAALGVDFCYYWVHRACHEVHILWAQHQVHHSSEEFNLAVGLRQSLF

SEQ ID NO: 23311 - protein, 133 aa, Diabrotica virgifera
  misc_feature: Coding regions on vcDNA: vcDNA=SeqID_3008; Strand=+; Position=212-613
  misc_feature: Homolog annotation: Hit_ID=XP_393519.1; Match level="QueryCoverage =100%, HitCoverage=67%, E-value=4e-36, Identity=53%"; Hit description= similar to Fatty acid-binding protein, adipocyte (AFABP) (Adipocyte lipid-binding protein)
  misc_feature: Pfam annotation: Pfam_ID=Lipocalin; Match level="Score=38.3, E-value =2.3e-08, Copies=1"; Pfam description=Lipocalin / cytosolic fatty -acid bindi
MVQIEGTYINDRSENLDDYFLEVGVPFIPRKLLCSSKPTLEIKRENDEWTITVSTLLRTNITTFKLGAEYEEHMPGGVLRNITTLENGKLITLSLGPGDVKSKREYEFTDEGCVITYSSEKTSKVAKRYFKRI

SEQ ID NO: 23312 - protein, 242 aa, Diabrotica virgifera
  misc_feature: Coding regions on vcDNA: vcDNA=SeqID_3009; Strand=+; Position=223-948
  misc_feature: Homolog annotation: Hit_ID=AAL68319.1; Match level="QueryCoverage =98%, HitCoverage=76%, E-value=9e-44, Identity=36%"; Hit description =RE63157p [Drosophila melanogaster] gb|AAN71470.1| RE68078p [Drosophila melanogaster]
  misc_feature: Gene Ontology Annotation: Molecular function=oxidoreductase activity; Cellular component=endoplasmic reticulum; Biological process=positive regulation of body size
  misc_feature: Pfam annotation: Pfam_ID=FA_hydroxylase; Match level="Score=1.5, E -value=1.7e-08, Copies=1"; Pfam description=Fatty acid hydroxylase
  misc_feature (222)..(222): Xaa can be any naturally occurring amino acid
MKEDDKFDVKYNAQSYNIYEFLNNHPGGLNYVQPYKEKDVTKPMSLYEHSKAAYYLLEEYTKGKRRAEEDLESLVNWDKPMLGQVGKLGTKYYEWVTSPVDRNLRLFGNPILECMTITPWYLVPMVWIPVCIYFVIEGTRHYIQITKDASPFVPVVLAFVNGVILWTPIEYSLHRWVFHIEPSGHFESHDLFSFYIHGLHHKVPFDSRRLVFPPVPAAGIVXIFYSILKACISESKQFLTLA

SEQ ID NO: 23313 - protein, 314 aa, Diabrotica virgifera
  misc_feature: Coding regions on vcDNA: vcDNA=SeqID_3010; Strand=+; Position=221-1165
  misc_feature: Homolog annotation: Hit_ID=EAL41550.1; Match level="QueryCoverage =99%, HitCoverage=96%, E-value=2e-77, Identity=43%"; Hit description =ENSANGP00000026166 [Anopheles gambiae str. PEST] ref|XP_564216.1| ENSANGP00000026166 [Anopheles gambiae st
  misc_feature: Gene Ontology Annotation: Molecular function=oxidoreductase activity; Cellular component=endoplasmic reticulum; Biological process=positive regulation of body size
  misc_feature: Pfam annotation: Pfam_ID=FA_hydroxylase; Match level="Score=236.9, E -value=3.7e-68, Copies=1"; Pfam description=Fatty acid hydroxylase
MKEDDKFDVKYNAQSYNIYEFLNNHPGGLNYVQPYKEKDVTKPMSLYEHSKAAYYLLEEYTKGKRRAEEDLESLVNWDKPMLGQVGKLGTKYYEWVTSPVDRNLRLFGNPILECMTITPWYLVPMVWIPVCIYFVIEGTRHYIQITKDASPFVPVVLAFVNGVILWTLIEYSLHRWVFHIEPSGHSKAMIYFHFTIHGLHHKVPFDSRRLVFPPVPAAVIVYIFYSILSVVIPESKQFLTLAGGVSGYVVYDMIHFYLHHGAPKENSYFYHLKRYHNQHHFAHHDNGFGISSTIWDKVFGTAIKLRNLKIGIKW

SEQ ID NO: 23314 - protein, 64 aa, Diabrotica virgifera
  misc_feature: Coding regions on vcDNA: vcDNA=SeqID_3011; Strand=+; Position=276-470
RKSCALFFFRISMVNILDIKIMTQKIYIVLSKYCCCKNFFISSLTQFYDLHVHISKSILPGYWK

SEQ ID NO: 23315 - protein, 678 aa, Diabrotica virgifera
  misc_feature: Coding regions on vcDNA: vcDNA=SeqID_3012; Strand=+; Position=2-2038
  misc_feature: Homolog annotation: Hit_ID=NP_651601.1; Match level="QueryCoverage =100%, HitCoverage=86%, E-value=0.0, Identity=71%"; Hit description =CG5520-PA [Drosophila melanogaster] gb|AAF56765.1| CG5520-PA [Drosophila melanogaster]
  misc_feature: Gene Ontology Annotation: Molecular function=binding; Cellular component=endoplasmic reticulum; Biological process=response to stress
  misc_feature: Pfam annotation: Pfam_ID=HSP90; Match level="Score=879.9, E-value =9.9e-262, Copies=1"; Pfam description=Hsp90 protein
ISNASDALDKIRMLSLTEKSVLDSQPEMNIRIKADKESGMLHITDTGIGMTKQDLVNNLGTIAKSGTAEFLSKMQNADTSQDMNDMIGQFGVGFYSAFLVADRVIVSSKHNEDKQYIWESDSASFSIVDDPRGDTLKRGTTVSLELKPEARDFLDHETVRNLVKKYSQFINFPIYLWTSHTETVEEPLDDDASEETSPSADEDDAAVEEEKEEDKPKTKKVEKTVWDWELLNDSKPIWTRKPTEVEDAEYNEFYQALTKDTKDPLTKIHFVAEGEVTFKALLYIPTVQPSESFNRYGTKTDNIKLYVRRVFITDEFNDMMPSYLSFVRGIVDSDDLPLNVSRETLQQHKLIKVIKKKLIRKVLDMLKKLPDDEYDKFWKEFSTNIKLGAIEDPANRTRLAKLLKFLSSNGSGLTNLSDYVKRMKPKQDKIFYIAGSSKDEVSKSPFVERLLRKGYEVLFLVEAVDEYAISAIPEFEGKKFQNVAKEGFSLTETEGGKEQLEQLKKTFEPLTKWLADDALKNEVAKATVSERLSDSPCALVASLFGWTGNMERLALSNAHQKSDDPQRTYYLNQKKTLEINPRHPLMKELLKRVLDDSSDPTAKDMAKMMFRTATLRSGYMLQETLDFADSIEAMMRKTLGVPLDEQIEEEEDLPEDGISEEEQIDADADSKDEDHDEL

SEQ ID NO: 23316 - protein, 367 aa, Diabrotica virgifera
  misc_feature: Coding regions on vcDNA: vcDNA=SeqID_3013; Strand=+; Position=98-1202
  misc_feature: Homolog annotation: Hit_ID=XP_321706.1; Match level="QueryCoverage =84%, HitCoverage=40%, E-value=1e-110, Identity=68%"; Hit description= ENSANGP00000015826 [Anopheles gambiae]
  misc_feature: Gene Ontology Annotation: Molecular function=binding; Cellular component=plasma membrane; Biological process=response to stress
  misc_feature: Pfam annotation: Pfam_ID=HATPase_c; Match level="Score=44.5, E-value =3e-10, Copies=1"; Pfam description=Histidine kinase-, DNA gyrase B-, and
  misc_feature (263)..(263): Xaa can be any naturally occurring amino acid
MKQFLLLTIGLFVLIGTVRGDEIGEPSVETIDLDIGASREGSRTDDEVVKREEEAIKLDGLNVAQLKELREKSEKFAFQTEVNRMMKLIINSLYRNKEIFLRELISNASDALDKIRMLSLTEKSVLDSQPEMNIRIKADKESGMLHITDTGIGMTKQDLVNNLGTIAKSGTAEFLSKMQNADTSQDMNDMIGQFGVGFYSAFLVADRVIVSSKHNEDKQYIWESDSASFSIVDDPRGDTLKRGTTVSLELKPEARDFLDHETXKPVKKYSQFIIFPIYLWTNPPETVEKPLKGQCFKKKLPPPAQERWRRAGKKKKKKKKKTLKIKNKGEKNPVLGMWGICCEVSSQTPISCPPKTPTLKGLGEWQK

SEQ ID NO: 23317 - protein, 105 aa, Diabrotica virgifera
  misc_feature: Coding regions on vcDNA: vcDNA=SeqID_3014; Strand=+; Position=2-319
  misc_feature: Pfam annotation: Pfam_ID=SapB_1; Match level="Score=19.5, E-value =0.0053, Copies=1"; Pfam description=Saposin-like type B, region 1
VNMKTTLVLAVLACVALTAYGENVQVNDFLCDTCVTFASTVKQFVDEELPIEEVAKAAKELCDLLPGDLKDFCEKDLLPEVENIYNDVSKITPQEACQDLGFCDA

SEQ ID NO: 23318 - protein, 239 aa, Diabrotica virgifera
  misc_feature: Coding regions on vcDNA: vcDNA=SeqID_3015; Strand=+; Position=23-742
RVRKLITKMFVPKMLLVLGFALLASAGKDLDYGMEVLRCANKAMRPGVPELGVPQHDPFVAFSKNISWHGDIGVASTSIDIDTLRWYGLADWNVTAKQINDDADNVAVFDWVNRWPVFTISGNYRATVKELFLTQHYKGSFKMVMEKPVWTGKISANKIQPNATVNDFTVKWHVDDVDVDISGLGLIGDATAVAIQTGVKTALNTGLIGNVVGDFLKMRFNTVWYPTGKLWDLMAWCKS

SEQ ID NO: 23319 - protein, 99 aa, Diabrotica virgifera
  misc_feature: Coding regions on vcDNA: vcDNA=SeqID_3016; Strand=+; Position=21-320
  misc_feature: Pfam annotation: Pfam_ID=TIL; Match level="Score=-4.5, E-value=0.073, Copies=1"; Pfam description=Trypsin Inhibitor like cysteine rich
NSSTYFTDTMNKVLLVFVLATVLVQVFAQSSSRVQLGRLECGENAVQGCAPCCPEAEATCSNKVPQPCPGICTRECRIQCRCVQGYLKDTATGKCVKEC

SEQ ID NO: 23320 - protein, 257 aa, Diabrotica virgifera
  misc_feature: Coding regions on vcDNA: vcDNA=SeqID_3017; Strand=+; Position=247-1020
  misc_feature: Homolog annotation: Hit_ID=AAG49365.1; Match level="QueryCoverage =65%, HitCoverage=32%, E-value=2e-18, Identity=30%"; Hit description =sensory neuron membrane protein 2 [Manduca sexta]
  misc_feature: Gene Ontology Annotation: Molecular function=receptor activity; Cellular component=plasma membrane; Biological process=apoptosis
  misc_feature: Pfam annotation: Pfam_ID=CD36; Match level="Score=-225.0, E-value =0.0035, Copies=1"; Pfam description=CD36 family
MKRPCICCSVKILAVITAVLVVVLAGILVLSFYGIPRIVNSQVDASVRLTENSDQWGRFLKLPIPIYIGVYLFTVRNGPAVMNGAVPKLEEVGPYVFREDISKKVLSTNKDDDSVTYQKFTEQSFEQERSGQLTLDDNVTIVNPPLLVLTQITSVVEQLVVVGCLDKIFTPTYRDLFMTTTIRSVMFEGFEFARSSSDVGYACEVIRQQIIEKTKNMKNIRRIYSKEYPGMVEGFRISFLGFKTESPDGTYLLNKRN

SEQ ID NO: 23321 - protein, 320 aa, Diabrotica virgifera
  misc_feature: Coding regions on vcDNA: vcDNA=SeqID_3018; Strand=+; Position=456-1418
  misc_feature: Homolog annotation: Hit_ID=XP_392746.1; Match level="QueryCoverage =87%, HitCoverage=65%, E-value=8e-29, Identity=30%"; Hit description =similar to ENSANGP00000012181 [Apis mellifera]
  misc_feature: Gene Ontology Annotation: Molecular function=cyclin-dependent protein kinase, intrinsic regulator activity; Biological process=regulation of CDK activity
  misc_feature: Pfam annotation: Pfam_ID=Cyclin_N; Match level="Score=15.8, E-value =8.9e-06, Copies=1"; Pfam description=Cyclin, N-terminal domain
MDKTVKSRGWPLTGAKCNIKPLLFDLEEALSVENTYRPSVLAIQYNVKPGEVTLKSRDGIVHLLRFLKSWFDTPEQVFFVAVGYLDAFIARIKVPEKYLMCLAFACFFIAAREEQLDIPLSTLIYMARCNFTFQDVLRMVDVVTNKLQLGSKITTIGDILRLYIQFLGSCHSTVSEILDEEELLTKLGVLLTDSSCAFFRPSVLAFTLLRFEVDKQLSHTINKTASFGDVIHTLAVMKELQLRCETSAADLVSCSQFASKVLKRYNNHEPCGNNAYLKWNFFPSFRRRDRSSRSTLSVINEKPNGQIKNGRINRKKNRTN

SEQ ID NO: 23322 - protein, 308 aa, Diabrotica virgifera
  misc_feature: Coding regions on vcDNA: vcDNA=SeqID_3019; Strand=+; Position=365-1291
  misc_feature: Homolog annotation: Hit_ID=XP_392746.1; Match level="QueryCoverage =91%, HitCoverage=64%, E-value=8e-29, Identity=30%"; Hit description =similar to ENSANGP00000012181 [Apis mellifera]
  misc_feature: Gene Ontology Annotation: Molecular function=cyclin-dependent protein kinase, intrinsic regulator activity; Biological process=regulation of CDK activity
  misc_feature: Pfam annotation: Pfam_ID=Cyclin_N; Match level="Score=15.8, E-value =8.9e-06, Copies=1"; Pfam description=Cyclin, N-terminal domain
MDKTVKSRGWPLTGAKCNIKPLLFDLEEALSVENTYRPSVLAIQYNVKPGEVTLKSRDGIVHLLRFLKSWFDTPEQVFFVAVGYLDAFIARIKVPEKYLMCLAFACFFIAAREEQLDIPLSTLIYMARCNFTFQDVLRMVDVVTNKLQLGSKITTIGDILRLYIQFLGSCHSTVSEILDEEELLTKLGVLLTDSSCAFFRPSVLAFTLLRFEVDKQLSHTINKTASFGDVIHTLAVMKELQLRCETSAADLVSCSQFASKVLKRYNNHEPCGNNAYLKWNFFLISVKKRDRSPRPTNPYKGKPKAKTP

SEQ ID NO: 23323 - protein, 389 aa, Diabrotica virgifera
  misc_feature: Coding regions on vcDNA: vcDNA=SeqID_3020; Strand=+; Position=27-1196
  misc_feature: Homolog annotation: Hit_ID=AAO53177.1; Match level="QueryCoverage =85%, HitCoverage=16%, E-value=1e-13, Identity=24%"; Hit description =similar to Dictyostelium discoideum (Slime mold). Adenylyl cyclase
  misc_feature: Gene Ontology Annotation: Biological process=regulation of protein activity, epigenetic
QASKNKPHYGQQQNYGDVENNQYSSHPVYNFWKTWNQQHNGQEPWNQWVENGAQNQPGNYWRQYAQAQSQVQAQAQAQAQAQAQAQAQAGNVALPWMYHIWNVQDLNELSPVQRVQLLLNYARLHQQWNQYGSDASDNEYMQHVLYQHLPGQAQSYSHDQIVPYVMQYFNQNPMKYNDIMHEVMQTPWAHQQLIHHVMSELNQHYGQAPWSHEQIQNQVMQHQLVYGSSNSQQQLQQLVEFIHHIQNQLTPVHYQQLEHVQPLNSEQTLPWHQGQVYSWTHNQVLPLNYETVQQRYQHAQPQLYQQSQSYYHSNVLPWTQSYSQRTSMNPQSHYSYNLHQQHIPQCMEQPGWGNQHNGWGNPHYTPNMSSHGDLYAAVGHHIGLERIKL

SEQ ID NO: 23324 - protein, 314 aa, Diabrotica virgifera
  misc_feature: Coding regions on vcDNA: vcDNA=SeqID_3021; Strand=+; Position=32-973
MKVLILLSVVALSSCLPASRNQQYVDVDYNSYNAHPVYNFWRTWNQQHYGQEPWNQWVQYGVQNQPGNYWRQYVQRSNQAENVDLPWMYHSWDVQDVQNLTPVQRVQLLLNYVRLHQQWNQWTHDVTANERLQNMLYQHLPEHLWSSNEQIVPYMMNYFNQYPMKYNDIMHEVMQTPWAHQQLMFHVMSELYQHFGQAPWSHEQIMNQIMQHQYLYGTTLSQQQLQQLVEFVLHIQYELTPLHYQQLEQVQPWNREQVLSWNQGQVLPWAYRQLLPLNYETVLPWTRQYSAQNNMNLEFQYTTISTNTNAIVPI

SEQ ID NO: 23325 - protein, 276 aa, Diabrotica virgifera
  misc_feature: Coding regions on vcDNA: vcDNA=SeqID_3022; Strand=+; Position=3-828
  misc_feature: Homolog annotation: Hit_ID=XP_394434.1; Match level="QueryCoverage =94%, HitCoverage=25%, E-value=1e-102, Identity=71%"; Hit description= similar to CG1782-PA [Apis mellifera]
  misc_feature: Gene Ontology Annotation: Molecular function=ubiquitin activating enzyme activity; Cellular component=nucleus; Biological process=DNA replication
  misc_feature: Pfam annotation: Pfam_ID=UBACT; Match level="Score=202.7, E-value =7.3e-58, Copies=2"; Pfam description=Repeat in ubiquitin-activating (UBA) p
  misc_feature (236)..(236): Xaa can be any naturally occurring amino acid
PEALTFDVNDPLHLDYVIAAANLKAEVYGIPTSRNREQIAEVVMQVNVPEFIPKSGVKIAVTDSQMAMNGNNVDLDRVSQIKEELPSVAELGGLRLTPLEFEKDDDTNFHMDFIVAASNLRAANYKIPPADRHKSKLIAGKIIPAIATTTSVVAGMVCLELYKLTRSYTSLTPFKNNFINLALPFFSCSEPIAAQQMEYCGNKWTLWDRFDVQGEMTLSEFLEYFKEKHGLEITMXLSPGVCMLYSVFMAKAKAQERFDLSECHKSSEGSQRRKSN

SEQ ID NO: 23326 - protein, 346 aa, Diabrotica virgifera
  misc_feature: Coding regions on vcDNA: vcDNA=SeqID_3023; Strand=+; Position=129-1169
  misc_feature: Homolog annotation: Hit_ID=XP_321835.1; Match level="QueryCoverage =95%, HitCoverage=97%, E-value=1e-152, Identity=79%"; Hit description= ENSANGP00000020396 [Anopheles gambiae]
  misc_feature: Gene Ontology Annotation: Molecular function=succinate-CoA ligase (ADP-forming) activity; Cellular component=mitochondrion; Biological process=succinyl-CoA metabolism
  misc_feature: Pfam annotation: Pfam_ID=CoA_binding; Match level="Score=243.2, E -value=4.8e-70, Copies=1"; Pfam description=CoA binding domain
YITIINTISIMATPTRILSRLLADGIKVKQPIRFNSYESTRPNLKLSAQTKVICQGFTGKQGTFHSKQAIEYGTRMVGGVSPGKGGKTHLDLPVFNSVKEAREATGADATVIYVPPPGAAAAIIEAIDAEVPLVVCITEGIPQHDMVRVKHKLLRQNKTRLIGPNCPGIIAPEQCKIGIMPGHIHQKGVVGVVSRSGTLTYEAVHQTTQVGLGQTHCVGIGGDPFNGTDFIDCLEVFLKDPETKGIILIGEIGGVAEEQAADYLIKHNSGSNAKPVVSFIAGLSAPPGRRMGHAGAIISGGKGGAQDKINALEKEGVIVTKSPAQMGNELLKEMRPLGLTQVCLTV

SEQ ID NO: 23327 - protein, 414 aa, Diabrotica virgifera
  misc_feature: Coding regions on vcDNA: vcDNA=SeqID_3024; Strand=+; Position=28-1272
  misc_feature: Homolog annotation: Hit_ID=AAL05409.1; Match level="QueryCoverage =95%, HitCoverage=97%, E-value=4e-47, Identity=29%"; Hit description =peritrophin [Aedes aegypti]
  misc_feature: Pfam annotation: Pfam_ID=CBM_14; Match level="Score=241.2, E-value =1.8e-69, Copies=5"; Pfam description=Chitin binding Peritrophin-A domain
MMGVYGILCTLLVVLGSAHYCTAYYNASHESYKLPCNQDELDYRAYPYDCHKYIACEDNSLVVLDCPNIFIWNEDRKACDFAANTECHQIPFPEPDCSDGKNSYWRYPFDCALFWECMNNQLYLLPCPDDYFWDDAIKKCDINEAVDCSGIIPNPNSTTTQAPVTTTSEPFPYTTPEMICTDDNTYFPYIFDCSKYYECSNGIPVLMDCPAGELWNIIINNCDWPDNVDCSYVVTTSAKPTSAAPDTSTSATQSTPSQVPTESTAAPGPYTTPDLICTDENNYFPYIYDCSKYYECSNGVPVLMDCPKGEFWNIKLNNCDWPQNVDCSYVVTTSGASTVSTEAPTKAPTEAPTDVPTDAPTEGPGPYYTTPEIICKEDNTYFPYIFDCSKYYECSNGQPILMTCPAGQGWSNLL

SEQ ID NO: 23328 - protein, 142 aa, Diabrotica virgifera
  misc_feature: Coding regions on vcDNA: vcDNA=SeqID_3025; Strand=-; Position=85-514
  misc_feature: Homolog annotation: Hit_ID=NP_609588.1; Match level="QueryCoverage =98%, HitCoverage=54%, E-value=2e-21, Identity=41%"; Hit description =CG6180-PA [Drosophila melanogaster] gb|AAF53219.2| CG6180-PA [Drosophila melanogaster]
  misc_feature (20)..(20): Xaa can be any naturally occurring amino acid
  misc_feature (60)..(60): Xaa can be any naturally occurring amino acid
  misc_feature (87)..(87): Xaa can be any naturally occurring amino acid
PTQVKKFPAVKRPAQKKSPXKLWKADPEAPRLKKPQFRERAPWAGGKIPGGKVSKRQIFXKKVGFGPPPKKGFKRKFFWGTNQKGKXNFKDPNLPNDPGKKKGGFLLKRFQPKKILGNPVLAIWSQLRKINKVPIWANQLEG

SEQ ID NO: 23329 - protein, 548 aa, Diabrotica virgifera
  misc_feature: Coding regions on vcDNA: vcDNA=SeqID_3026; Strand=+; Position=75-1721
  misc_feature: Homolog annotation: Hit_ID=XP_394574.1; Match level="QueryCoverage =98%, HitCoverage=98%, E-value=1e-175, Identity=55%"; Hit description= similar to CG11594-PA [Apis mellifera]
  misc_feature: Gene Ontology Annotation: Molecular function=kinase activity; Cellular component=cellular_component unknown; Biological process =biological_process unknown
  misc_feature: Pfam annotation: Pfam_ID=FGGY_N; Match level="Score=16.6, E-value =3.6e-11, Copies=1"; Pfam description=FGGY family of carbohydrate kinases,
MPSTDNIAYFVGVDVGTGSVRAALVTECGEIVSSAVNCTRTWNIQPDFYEQSTDDIWNAVVTCVKIVVQKVQPDKIKGIGFDATCSLACFDKSGAPLTVSPSGNNQQNVILWLDHRAVNEAAEINKLNHPVLQYVGGKISPEMETPKLLWLKRNIKDTWDKAGWFFDLPDFLTWRATGADSRSSCSLVCKWTYEMNIAGTEAWNKSYFQQIGLEDLAENNWQKIGSVVLAPGSAVGKGLSQQAAAELGLVAGTPVGASMIDAHAGGLGLIGCRVPGVDPAFHTRVGLICGTSTCHMAVSREATFTPGIWGPYKNAMIPGMWLNEGGQSATGKLVDHIIDTHPATPEIKKKLGDMHIQKYLSDILNGLAKKENLKSVAYLTKDLHVWPDFHGNRSPIADPTLKGMICGLTLTTDEENLALLYLATMQALSYGTRHILDTLKDSGYTDIKSTLICGGLSKNPIFTHSQADVCNLPTVCPNEVESVLLGCAILGACAAGHFENMTAAIMSMGGEGKVVEPNKELVEYHNKKYKVFLKMYEDQVAYRNAMNS

SEQ ID NO: 23330 - protein, 89 aa, Diabrotica virgifera
  misc_feature: Coding regions on vcDNA: vcDNA=SeqID_3027; Strand=-; Position=245-514
AEKANEFQYQPLLSALVRVPTETFFFVFFNTFYDCKYIYYIIVFSENTYLVKKIFDNLCSDIICGLFNVFVCVLFFYYFNFWHCSNKNV

SEQ ID NO: 23331 - protein, 75 aa, Diabrotica virgifera
  misc_feature: Coding regions on vcDNA: vcDNA=SeqID_3028; Strand=+; Position=58-285
LVRTHFSLATTVLLLGLKTLYIHHFFHFFISYIFANNIFLIKYLLFEVFAKNRLQRGFLLKNKHFHSQITRKVLT

SEQ ID NO: 23332 - protein, 323 aa, Diabrotica virgifera
  misc_feature: Coding regions on vcDNA: vcDNA=SeqID_3029; Strand=+; Position=71-1039
  misc_feature: Homolog annotation: Hit_ID=EAA06889.2; Match level="QueryCoverage =95%, HitCoverage=25%, E-value=2e-85, Identity=51%"; Hit description =ENSANGP00000001645 [Anopheles gambiae str. PEST] ref|XP_559427.1| ENSANGP00000001645 [Anopheles gambiae st
  misc_feature: Gene Ontology Annotation: Molecular function=molecular_function unknown; Cellular component=cellular_component unknown; Biological process=N-linked glycosylation
  misc_feature: Pfam annotation: Pfam_ID=E-MAP-115; Match level="Score=-83.1, E-value= 0.07, Copies=1"; Pfam description=E-MAP-115 family
  misc_feature (264)..(264): Xaa can be any naturally occurring amino acid
MSTIIVSYTSLVAKNLIKYRNKQLIFMQKVVRGYLVRKKHGPRINTLRNIKKLNSTLAQIEQSAQQLKKDKDSVRNDINNLKTQFDAAIDRIKKDDKIDKATAENLYKSLSDKVNLQMAALQKKIQEQKIADEQERLRKLQEEMERQRKLKEEEERRLREEEENRRLKAEMEARRKIEEEERRKQEEADRLLAKKLQEQHAKDEEEQRRLQEQEDQEKQDRELALRLAQESNGSIEESPPMIRKSEAHRNHQATLANSKYDLSXWKYSELRDTINTSCDIDLLEACRHEFHRRLKVYHALEAKNPQRTIMDENERAPRSVMES

SEQ ID NO: 23333 - protein, 73 aa, Diabrotica virgifera
  misc_feature: Coding regions on vcDNA: vcDNA=SeqID_3030; Strand=-; Position=1-219
NRILFNILRAYFAPREDNDSLVQPSFGSILGSTIRVVPWLHNVVGIVVRISGSSIGTMAFVVGGDCSCIGTLG

SEQ ID NO: 23334 - protein, 56 aa, Diabrotica virgifera
  misc_feature: Coding regions on vcDNA: vcDNA=SeqID_3031; Strand=+; Position=2-172
  misc_feature: Homolog annotation: Hit_ID=XP_311527.1; Match level="QueryCoverage =100%, HitCoverage=15%, E-value=7e-15, Identity=73%"; Hit description= ENSANGP00000010075 [Anopheles gambiae]
  misc_feature: Gene Ontology Annotation: Molecular function=pyruvate dehydrogenase (lipoamide) activity; Cellular component=mitochondrion; Biological process=pyruvate metabolism
ILARIMETETFFHLDQPAIRITGADVPMPYAKSLEAAALPTAKDVVDATKKLLKVK

SEQ ID NO: 23335 - protein, 360 aa, Diabrotica virgifera
  misc_feature: Coding regions on vcDNA: vcDNA=SeqID_3032; Strand=+; Position=84-1166
  misc_feature: Homolog annotation: Hit_ID=XP_311527.1; Match level="QueryCoverage =97%, HitCoverage=96%, E-value=1e-160, Identity=77%"; Hit description= ENSANGP00000010075 [Anopheles gambiae]
  misc_feature: Gene Ontology Annotation: Molecular function=pyruvate dehydrogenase (lipoamide) activity; Cellular component=mitochondrion; Biological process=coenzymes and prosthetic group metabolism
  misc_feature: Pfam annotation: Pfam_ID=Transket_pyr; Match level="Score=260.3, E -value=3.3e-75, Copies=1"; Pfam description=Transketolase, pyridine binding domai
MASIKSLNLIGNLKKGITRRSFSTTNAVASKQMTVRDALNSAMDEEMERDERVFILGEEVAQYDGAYKVTRGLWKKYGDKRVIDTPITEMGFTGIATGAAMAGLRPICEFMTFNFAMQSIDQIINSAGKTFYMSAGRVNVPIVFRGPNGAASGVAAQHSQCFGAWYAHCPGLKVISPYNSEDSKGLLKAAIRDPDPVVFLENELLYGVQYPMSDEALSKDFVLPIGKAKIEKPGKHITFVAHSKAVELCLDAAKELAGKGIEAEVINLRSLRPLDTDTVMKSVAKTHHLISVELGWPTCGIGAEILARIMETETFFHLDQPAIRITGADVPMPYAKSLEAAALPTAKDVVDATKKLLKVK

SEQ ID NO: 23336 - protein, 74 aa, Diabrotica virgifera
  misc_feature: Coding regions on vcDNA: vcDNA=SeqID_3033; Strand=-; Position=131-355
KYLYFKFIVFYIKSIPLDGAILFAATKLMGNVKSCTYCSLYIVFNFIDHASILVIIRHQIFMTFVQRQQKLFKL

SEQ ID NO: 23337 - protein, 374 aa, Diabrotica virgifera
  misc_feature: Coding regions on vcDNA: vcDNA=SeqID_3034; Strand=+; Position=1-1125
  misc_feature: Homolog annotation: Hit_ID=XP_313510.1; Match level="QueryCoverage =99%, HitCoverage=41%, E-value=1e-121, Identity=61%"; Hit description= ENSANGP00000000428 [Anopheles gambiae]
  misc_feature: Gene Ontology Annotation: Molecular function=transporter activity; Cellular component=integral to membrane; Biological process=negative regulation of locomotion
  misc_feature: Pfam annotation: Pfam_ID=V_ATPase_I; Match level="Score=-84.5, E -value=4.5e-12, Copies=1"; Pfam description=V-type ATPase 116kDa subunit family
VFGSSWEIRNISKYFDPGLYVLDPKTTENYGGTPYPIGMDPVWQLAKNKIIFQNSFKMKISIILGILHMLFGVVMSLLNNMYFKDKLSTLAEFIPQIIFLVFLFFYMVILMFIKWFLYYANEVDTDEAFRLGTRCAPNVLITFINMILQKETPFEPRCGTYNMYSGQLGFQKFLFACAMFCVPWMLLAKPIVIMRERKRTQQYSVTHQQMQSATENGDAEQPMHNNTSQPPAMGGGGHGEHEEEPMSEIFIHQAIHTIEYVLGSVSHTASYLRLWALSLAHSQLSEVLWIMVLSKGLKVDGWAGGVALYVIFAFWAVLTVSILVLMEGLSAFLHTLRLHWVEFQSKFYKGTGYGFQPFSFEIILDSASQAKEEV

SEQ ID NO: 23338 - protein, 149 aa, Diabrotica virgifera
  misc_feature: Coding regions on vcDNA: vcDNA=SeqID_3035; Strand=+; Position=118-567
  misc_feature: Homolog annotation: Hit_ID=AAF16720.1; Match level="QueryCoverage =97%, HitCoverage=98%, E-value=1e-59, Identity=76%"; Hit description =unknown [Manduca sexta]
MNSYVVLVVMFLAVAFAAEEEAKADGPKTYRRLIPADVLRDFPGMCFASTKCATVEPGKSWDLTPFCGRSTCVVSEDKPPRLLELVEDCGPLPLANPKCKLDEEKTNKTAAFPYCCPQFTCEEGAKLEYPEIPTVAPVPEDAAATTTKA

SEQ ID NO: 23339 - protein, 75 aa, Diabrotica virgifera
  misc_feature: Coding regions on vcDNA: vcDNA=SeqID_3036; Strand=+; Position=560-787
VCKVRRECATFFINKMAPENRVFSILSYNSKDFKFTPRTPKQKFTVIKFCIETCFSRFTSTKIFPGKCGFFQQNL

SEQ ID NO: 23340 - protein, 288 aa, Diabrotica virgifera
  misc_feature: Coding regions on vcDNA: vcDNA=SeqID_3037; Strand=+; Position=2-868
  misc_feature: Homolog annotation: Hit_ID=XP_319122.1; Match level="QueryCoverage =97%, HitCoverage=83%, E-value=4e-35, Identity=31%"; Hit description =ENSANGP00000011965 [Anopheles gambiae]
  misc_feature: Gene Ontology Annotation: Biological process=phosphate metabolism
LRPIMFDIDGVVLVYLSPIVGASECVKNLKKLGKAVHYVTNNTVMTTEDIAKALIERNFDTTTRDIVTPIETNIAYLSKQNVKNNIFLMSNNPHKDALKKAGFNILPEKFQIIEENTNALFEHFDSKINVDAVIYDFDFNSNYVQLQKALWCLQNNPDCIFLVTLNDKTGPTGPRGCILGPNIFVETLKNLSGKNFIQVGKPSETCVNFIKEMYHVIDPKRVLFVGDSIESDMSTGAIGGFQKMLVLTGSTKIEEITDWKFPEEYKPEFYVESLDVLNKIIKSIFPDL

SEQ ID NO: 23341 - protein, 179 aa, Diabrotica virgifera
  misc_feature: Coding regions on vcDNA: vcDNA=SeqID_3038; Strand=+; Position=1-540
  misc_feature: Homolog annotation: Hit_ID=XP_394732.1; Match level="QueryCoverage =87%, HitCoverage=11%, E-value=4e-11, Identity=32%"; Hit description =similar to ENSANGP00000007504 [Apis mellifera]
  misc_feature: Gene Ontology Annotation: Molecular function=calcium ion binding; Cellular component=cellular_component unknown; Biological process =biological_process unknown
  misc_feature: Pfam annotation: Pfam_ID=LRR_1; Match level="Score=25.1, E-value =0.00021, Copies=4"; Pfam description=Leucine Rich Repeat
VFNGLSFTTISLTGNLISKIEEGSFDDTEALRNLKLGSNKIGDLTPTSLGTLNNKDLELSLDDNGISNIAPNSFSKVTLLSLKLHNNSLTAIKRDTFKGAEIGFIGLPKNQISSVEENAFEDVKGLNLIDLSFNNLHVPVSSNSKHINLYVTAGADLNRYNSETLNNLVRSTYGGQVEY

SEQ ID NO: 23342 - protein, 212 aa, Diabrotica virgifera
  misc_feature: Coding regions on vcDNA: vcDNA=SeqID_3039; Strand=+; Position=2-640
  misc_feature: Homolog annotation: Hit_ID=XP_396726.1; Match level="QueryCoverage =78%, HitCoverage=34%, E-value=5e-15, Identity=30%"; Hit description =similar to CG7896-PA [Apis mellifera]
  misc_feature: Gene Ontology Annotation: Molecular function=calcium ion binding; Cellular component=cellular_component unknown; Biological process =biological_process unknown
  misc_feature: Pfam annotation: Pfam_ID=LRR_1; Match level="Score=24.2, E-value =0.0004, Copies=4"; Pfam description=Leucine Rich Repeat
NNLIKALNPNNFAGSKISALSINNNQLVQIGKGVFNGLSFTTISLTGNLISKIEEGSFDDTEELRNLKLGSNKIGDLTPTSLGTLNNKYLELSLDNNGISNIAPNSFSKVILLSLKLHNNSLTAIKRDTFKGAEIGFIGLPKNQISSVEENAFEDVKGLNLIDLSFNNLHVPVSSNSKHINLYVTAGADLNRYNSETLNNLVRSTYGGQVVE

SEQ ID NO: 23343 - protein, 606 aa, Diabrotica virgifera
  misc_feature: Coding regions on vcDNA: vcDNA=SeqID_3040; Strand=+; Position=16-1836
  misc_feature: Homolog annotation: Hit_ID=XP_317311.1; Match level="QueryCoverage =91%, HitCoverage=82%, E-value=2e-36, Identity=25%"; Hit description =ENSANGP00000006849 [Anopheles gambiae]
  misc_feature: Gene Ontology Annotation: Molecular function=insulin-like growth factor binding; Cellular component=soluble fraction; Biological process=signal transduction
  misc_feature: Pfam annotation: Pfam_ID=LRR_1; Match level="Score=128.8, E-value =1.3e-35, Copies=14"; Pfam description=Leucine Rich Repeat
MVSKLLFLVLVAFFAYVQSEITVNVYSSYWESEEAVIPSIENLKSVIANTTYRVEIENQTIPKLPSGALDGVTISELKLKHDELKDIEPGALQGAHINRIEFPNNDIETIKKGVFNDRSLWELDLSNNQISTIDDDAFDTLDVNSLHLNDNNLEKITAGTFHNTKVTSLDLNNNKIQKIEVNALNQIPSLFYVQLSNNLIKDLGGSFSKLDTVIDLNLGNNKIEVIESNSFAGSRLNSLHLQDNYIKELKPNSFNGLNLNYLNLSNNDISVIASDAFADQPGLYSIILSHNNIGGLKPKFLKGINSQQTTLSLDNNNIDNVEPASFDEIVISGLELQENKIEIIKKGVFNKKNFNSINLAKNKISKIEDGALEDLVLNSLTLSENSLTALTEEMFFGANISNVKLDKNQLSKIEDTTFHQINGLTSLDLSNNRIEDITNLFSHLDHLYDLNLDNNLIKALNPNNFAGSKISALSINNNQLVQIGKGVFNGLSFTTISLTGNLISKIEEGSFDDTEALRNLKLGSNKIGDLTPTSLGTLNNKDLELSLDNNGISNIAPNSFSKVILLSLKLHNNSLTAIKRDTFKGAEIGFIGLPKNQISSVEENAF

SEQ ID NO: 23344 - protein, 108 aa, Diabrotica virgifera
  misc_feature: Coding regions on vcDNA: vcDNA=SeqID_3041; Strand=+; Position=112-435
  misc_feature: Homolog annotation: Hit_ID=XP_321677.1; Match level="QueryCoverage =85%, HitCoverage=37%, E-value=1e-09, Identity=30%"; Hit description =ENSANGP00000011488 [Anopheles gambiae]
MVQKKVWAASNDGAIEYISLTSEYLEDALDVLRKSFYRYEAGCFATGLSEDLEAMAEMDSYMIEVAKGGVSIVAVEKATNIVCGVAFNKIQLDHGPSGKKYYKNYLNM

SEQ ID NO: 23345 - protein, 271 aa, Diabrotica virgifera
  misc_feature: Coding regions on vcDNA: vcDNA=SeqID_3042; Strand=+; Position=70-885
  misc_feature: Homolog annotation: Hit_ID=XP_308155.1; Match level="QueryCoverage =88%, HitCoverage=99%, E-value=3e-98, Identity=73%"; Hit description =ENSANGP00000021517 [Anopheles gambiae]
  misc_feature: Gene Ontology Annotation: Molecular function=adenylate kinase activity; Cellular component=mitochondrial intermembrane space; Biological process=purine nucleotide metabolism
  misc_feature: Pfam annotation: Pfam_ID=ADK; Match level="Score=311.6, E-value=1.2e -90, Copies=1"; Pfam description=Adenylate kinase
QIIYDIVINYLNFLSYNLEAFSPPQEGPSIVETMAPLAAKVIPKANEVEEGIRAVLLGPPGSGKGTQAPLLKERYCVCHLSTGDMLRAEVQSGSSLGKKIQQVIDEGKLVNDDLVVNMIDKNLDKPECQNGFLLDGFPRTVVQAEKLDDLLEKRNTQLDAVIEFRIDDNLLFRRITGRLIHSASGRSYHEEFKPPKIPMTDDVTGEPLIRRSDDNIEALKKRLATYHTQTKPLVDYYQIRHIHHHVNAAQAADAIFANIDSIFQGKRAHKL

SEQ ID NO: 23346 - protein, 201 aa, Diabrotica virgifera
  misc_feature: Coding regions on vcDNA: vcDNA=SeqID_3043; Strand=-; Position=381-986
  misc_feature: Homolog annotation: Hit_ID=AAT40504.1; Match level="QueryCoverage =98%, HitCoverage=24%, E-value=3e-55, Identity=53%"; Hit description =putative polyprotein [Solanum demissum]
NKVKYNIIGEMIVKSNSFKYLGSVLQSNGEIDGDACSRIRAGWMKWKEASGVLCDRKIPMKLKGKFYKTSTRPAMMRGTECWAVKKKAEQRMHVAEMRMLRWMSGVTKKDKIRNEYIRGSLGVAPIDAKMREHRLRWFGHVQRRDVNHPIRRIAEVQIPGRSRRGRPKKTIRQDMLVKGINIDMTQDRIVWRNAIREADTA

SEQ ID NO: 23347 - protein, 308 aa, Diabrotica virgifera
  misc_feature: Coding regions on vcDNA: vcDNA=SeqID_3044; Strand=-; Position=229-1155
  misc_feature: Homolog annotation: Hit_ID=AAT40504.1; Match level="QueryCoverage =98%, HitCoverage=36%, E-value=3e-90, Identity=52%"; Hit description =putative polyprotein [Solanum demissum]
GRRTSVRTGLGETDKFQVKVGWHQGSVLSPYLFSLVLDQITAKLQGSIPWCLMYAYDVVLIGNSERDLEQKLEQWRQGLEENGLKLSRTKTEYLKCSFKDGATTNKMVSLDGEMIVKSNSFKYLGSELQSNGEIDGDACSRIRAGWMKWKEASGVLCDRKIPMKLKGKFYKTAIRPAMMYGTECWAVKKKEEQRMHVAEMRMLRWMSGVTKKDKIRNEYIRGSLGVAPIDAKMREHRLRWFGHVQRRDVNHPIRRIAEVQIPGRSRRGRLKKSWGETIRQDMLVKGINIDMAQDRIVWRNAIREADPA

SEQ ID NO: 23348 - protein, 243 aa, Diabrotica virgifera
  misc_feature: Coding regions on vcDNA: vcDNA=SeqID_3045; Strand=-; Position=1698 -2429
  misc_feature: Homolog annotation: Hit_ID=CAF92802.1; Match level="QueryCoverage =53%, HitCoverage=44%, E-value=5e-11, Identity=32%"; Hit description =unnamed protein product [Tetraodon nigroviridis]
VPTEIIKIHLNYIYFSYIEVKSETKQKYRRGPQKIKWWLLKDEKEGLFRRRIVEKICWNMKGSPNTIWRKMASSIRETAMEILGKTSGKKFEDKETWWWSNEVQGKIKEKRKLYKKWQETRSDTDLQNYMVAKKEAKVAVAKAKAEAYSHLYDQLDTREGETKIYKIAKQRARKAKDFNQIRCIRDENNKILVHEREVKKRWRKYFDSLLNEEFDRQPVEATETVAAMVTKITNEEVPKRFKK

SEQ ID NO: 23349 - protein, 317 aa, Diabrotica virgifera
  misc_feature: Coding regions on vcDNA: vcDNA=SeqID_3046; Strand=-; Position=743-1696
  misc_feature: Homolog annotation: Hit_ID=AAT40504.1; Match level="QueryCoverage =94%, HitCoverage=36%, E-value=3e-91, Identity=53%"; Hit description =putative polyprotein [Solanum demissum]
EGVTTSVRTGVGETDKFQVKVGLHQGSVLSPYLFSLVLDQITAKLQGSIPWCLMYADDVVLVGNSERDLEQKLEQWRQALEEKGLKLSRTKTEYLQCSFKDGVTTNKMVSLDGELIVKSNSFKYLGSVLQSNGEIDGDACSRIRAGWMKWKEASGVLCDRKIPMKLRGKFYKTAIRPAMMYGTECWAMKKKEEQRMHVAEMRMFRWMSGVTKKDKIKNEYIRGSLGVAPIDAKMREHRLRPFGHVQRRDANHPIRRIAEVQIPGRSRRGRPKKTWGETIRWDMLVKGINIDMTQDRIVWRNAIREGSRPRIGIRQRG

SEQ ID NO: 23350 - protein, 301 aa, Diabrotica virgifera
  misc_feature: Coding regions on vcDNA: vcDNA=SeqID_3047; Strand=+; Position=79-979
  misc_feature: Homolog annotation: Hit_ID=EAA06257.2; Match level="QueryCoverage =100%, HitCoverage=91%, E-value=3e-91, Identity=53%"; Hit description= ENSANGP00000020750 [Anopheles gambiae str. PEST] ref|XP_565952.1| ENSANGP00000020750 [Anopheles gambiae s
  misc_feature: Gene Ontology Annotation: Molecular function=molecular_function unknown; Cellular component=cellular_component unknown; Biological process=biological_process unknown
  misc_feature: Pfam annotation: Pfam_ID=ADH_zinc_N; Match level="Score=42.5, E-value= 3.6e-10, Copies=1"; Pfam description=Zinc-binding dehydrogenase
  misc_feature (281)..(281): Xaa can be any naturally occurring amino acid
  misc_feature (290)..(290): Xaa can be any naturally occurring amino acid
MVKGKRFVLQKVFDGFPKESDFKVEEYELPPVKNGEFLAEALYLSVDPYMRAYVSDSSVIGTTMIGSQVAKIVESKNPKYPPGKYVVGYFGWQTHTVAAGERAGITFPPFLIPDLGELPISLALGVLGMPGNTSYFGLLELCQPKEGETLVVSGAAGAVGSHVGQIAKIKGCTVIGIAGSDEKGKWLTEELGFDHFINYKTANIPEELKKAAPKGIDCYFDNVGGEISSAVIHQMNLYGRISVCGSIANYNDTTRSLAPVVQPFIVSKHLKMEGFVVRRWXKRWMEGIKXNMGWIKQGKVK

SEQ ID NO: 23351 - protein, 192 aa, Diabrotica virgifera
  misc_feature: Coding regions on vcDNA: vcDNA=SeqID_3048; Strand=+; Position=78-656
  misc_feature: Homolog annotation: Hit_ID=EAL33012.1; Match level="QueryCoverage =96%, HitCoverage=33%, E-value=2e-68, Identity=69%"; Hit description =GA17292-PA [Drosophila pseudoobscura]
  misc_feature: Gene Ontology Annotation: Molecular function=molecular_function unknown; Cellular component=integral to endoplasmic reticulum membrane; Biological process=signal transduction
  misc_feature: Pfam annotation: Pfam_ID=Reticulon; Match level="Score=272.3, E-value= 8e-79, Copies=1"; Pfam description=Reticulon
MESLIYWRDPKKSGPVFGGVLVVLLALTYFSLISVVAYVSLIALGVTLVFRIYKSIVQAVQKTGDGHPFKEYLELDISLPQEKVKQITEVAIAHINAAIVELRRLFLVEDLVDSIKFAVLLWTLTYVGAWFNGMTLIILAWVALFTLPKVYEVNKTQIDANLEIVRTKLAEITSKIKAAIPMGKKAEEKKEQ

SEQ ID NO: 23352 - protein, 212 aa, Diabrotica virgifera
  misc_feature: Coding regions on vcDNA: vcDNA=SeqID_3049; Strand=+; Position=109-749
  misc_feature: Homolog annotation: Hit_ID=XP_317540.1; Match level="QueryCoverage =92%, HitCoverage=82%, E-value=5e-71, Identity=66%"; Hit description =ENSANGP00000010107 [Anopheles gambiae]
  misc_feature: Gene Ontology Annotation: Molecular function=molecular_function unknown; Cellular component=integral to endoplasmic reticulum membrane; Biological process=signal transduction
  misc_feature: Pfam annotation: Pfam_ID=Reticulon; Match level="Score=264.0, E-value= 2.6e-76, Copies=1"; Pfam description=Reticulon
  misc_feature (148)..(148): Xaa can be any naturally occurring amino acid
  misc_feature (150)..(150): Xaa can be any naturally occurring amino acid
  misc_feature (180)..(180): Xaa can be any naturally occurring amino acid
MGRRQNKYQDVSEDLPERGPVESLIYWRDPKKSGPVFGGVLVVLLALTYFSLISVVAYVSLIALGVTLAFRIYKSIVQAVQKTGDGHPFKEYLELDISLPQEKVKQITEVAIAHINAAIVELRRLFLVEDLVDSIKFAVLLWTLTYVXSXFNGMTLIILAWVALFTLPKVYEVNKTQIDXNLEIVRTKLAEITSKIKAAIPMGKKAEEKKEQ

SEQ ID NO: 23353 - protein, 288 aa, Diabrotica virgifera
  misc_feature: Coding regions on vcDNA: vcDNA=SeqID_3050; Strand=+; Position=2-868
  misc_feature: Homolog annotation: Hit_ID=AAR82778.1; Match level="QueryCoverage =96%, HitCoverage=64%, E-value=1e-80, Identity=55%"; Hit description =LD43688p [Drosophila melanogaster]
  misc_feature: Gene Ontology Annotation: Molecular function=molecular_function unknown; Cellular component=endoplasmic reticulum; Biological process=signal transduction
  misc_feature: Pfam annotation: Pfam_ID=Reticulon; Match level="Score=267.0, E-value= 3.2e-77, Copies=1"; Pfam description=Reticulon
EISKEPIVPVQPAPPKPQPEKIVPSAPVTVSAPEKKVEPEKIVKKVEEKPEKIIKKVEEKPVPVVTPAKIAPTDAAAIFCKMGLDAWVNPEKLYPKEESLIYWCDPKKSGPVFGGVLVVLLALTYFSLISVVAYVSLIALGVTLAFRIYKSIVQAVQKTGDGHPFKEYLELDISLPQEKVKQITEVAIAHINAAIVELRRLFLVEDLVDSIKFAVLLWTLTYVGAWFNGMTLIILAWVALFTLPKVYEVNKTQIDANLEIVRTKLAEITSKIKAAIPMGKKAEEKKEQ

SEQ ID NO: 23354 - protein, 251 aa, Diabrotica virgifera
  misc_feature: Coding regions on vcDNA: vcDNA=SeqID_3051; Strand=+; Position=215-970
  misc_feature: Homolog annotation: Hit_ID=NP_787985.1; Match level="QueryCoverage =84%, HitCoverage=91%, E-value=3e-78, Identity=66%"; Hit description =CG33113-PE, isoform E [Drosophila melanogaster] ref|NP_787984.1| CG33113-PB, isoform B [Drosophila
  misc_feature: Gene Ontology Annotation: Molecular function=molecular_function unknown; Cellular component=endoplasmic reticulum; Biological process=signal transduction
  misc_feature: Pfam annotation: Pfam_ID=Reticulon; Match level="Score=276.5, E-value= 4.5e-80, Copies=1"; Pfam description=Reticulon
MSEDFKKLANEIVQDVVDGVQEIQHLPANDNKSGCCQRSLLCVLFSPNAWFNPEKLDPKVESLIYWRDPKKSGPVFGGVLVVLLALTYFSLISVVAYVSLIALGVTLAFRIYKSIVQAVQKTGDGHPFKEYLELDISLPQEKVKQITEVAIAHINAAIVELRRLFLVEDLVDSIKFAVLLWTLTYVGAWFNGMTLIILAWVALFTLPKVYEVNKTQIDANLEIVRTKLAEITSKIKAAIPMGKKAEEKKET

SEQ ID NO: 23355 - protein, 116 aa, Diabrotica virgifera
  misc_feature: Coding regions on vcDNA: vcDNA=SeqID_3052; Strand=+; Position=35-385
  misc_feature: Pfam annotation: Pfam_ID=Lipocalin; Match level="Score=13.4, E-value =0.0011, Copies=1"; Pfam description=Lipocalin / cytosolic fatty-acid bind
YLHTMVLSGKYSVIGEENFVQYLKDYGIPEEQIKNSGQFSIEFKQDGNKVIVTESAAGKSKVTSFTLGEEFEEERFGHKIKSNAKLEGDILVITNGDHSRTFNFTSTGLEIAHKSP

SEQ ID NO: 23356 - protein, 282 aa, Diabrotica virgifera
  misc_feature: Coding regions on vcDNA: vcDNA=SeqID_3053; Strand=+; Position=61-906
  misc_feature: Homolog annotation: Hit_ID=NP_651526.1; Match level="QueryCoverage =80%, HitCoverage=69%, E-value=9e-45, Identity=41%"; Hit description =CG6271-PA [Drosophila melanogaster] gb|AAF56654.1| CG6271-PA [Drosophila melanogaster]
  misc_feature: Gene Ontology Annotation: Molecular function=phospholipase A1 activity; Cellular component=extracellular space; Biological process= lipid metabolism
  misc_feature: Pfam annotation: Pfam_ID=Lipase; Match level="Score=49.7, E-value =1.5e-15, Copies=1"; Pfam description=Lipase
  misc_feature (263)..(263): Xaa can be any naturally occurring amino acid
MKVILCLLGVVTLVLSTPVYQEDLQKYYPQGSIPCPFFKKDASFNASSDDIKVYFRNKDHPESSVPIDINHSSEVDALGFSPNKDTMFVVHGWHNGHDSPVCDEISKAVLQKNDINVFLIDWNKIASNLYLVAYKAVPEVGQLLGTLIRNLVNNNKLDLNKASIVGHSLGAHVAGLAGAELNGRISNIVGLDPALPCFSYNDISTRLDPSDAQYVEVIHTCAGLLGFDVDIGHSDYYPNGGKDQPGCTLDVVGMCRHSRSYYXLCGVFNSGFAKQCNCYKDF

SEQ ID NO: 23357 - protein, 295 aa, Diabrotica virgifera
  misc_feature: Coding regions on vcDNA: vcDNA=SeqID_3054; Strand=+; Position=2-888
  misc_feature: Homolog annotation: Hit_ID=AAH78056.1; Match level="QueryCoverage =97%, HitCoverage=61%, E-value=1e-105, Identity=59%"; Hit description= MGC82850 protein [Xenopus laevis]
  misc_feature: Pfam annotation: Pfam_ID=SBP56; Match level="Score=294.5, E-value =1.8e-85, Copies=1"; Pfam description=56kDa selenium binding protein (SBP56)
  misc_feature (236)..(236): Xaa can be any naturally occurring amino acid
  misc_feature (269)..(269): Xaa can be any naturally occurring amino acid
KAPKYNYDFWYQPYFDTMVATEWGVPKVFKKGFQPSDTRPEIYGRSLNFFSWKKREFIQSINLGEDGIAPLEVRFLHNPKEPQGYVGCAVNANIFRFYRKDDGTWAAHKVIDVPQKKVSGWIGPYIQGMITDILISLDDKYLYFNNWLHGDVRQYDISDREHPKLTGQIFLGGRILSDSDLKVLEDQELKEQPKPVYIKGKRFQAGPQMMQLSLDGKRLYITSSVLSPWDKQFYPXVVENGTKMVKIDINHENGGMKLDENFLVDFGEXADGPLLAHEPRYPGGDCTSDFWWGSK

SEQ ID NO: 23358 - protein, 238 aa, Diabrotica virgifera
  misc_feature: Coding regions on vcDNA: vcDNA=SeqID_3055; Strand=+; Position=349-1065
  misc_feature: Homolog annotation: Hit_ID=EAL28583.1; Match level="QueryCoverage =95%, HitCoverage=45%, E-value=1e-19, Identity=31%"; Hit description =GA21738-PA [Drosophila pseudoobscura]
  misc_feature: Gene Ontology Annotation: Biological process=regulation of protein activity, epigenetic
  misc_feature: Pfam annotation: Pfam_ID=RRM_1; Match level="Score=31.1, E-value=3.4e- 06, Copies=1"; Pfam description=RNA recognition motif. (a.k.a. RRM, R
SNNQSNSSNGLGAVPNNTLQQLSSLTGLSALNALQSANLGSLLGNNLGSNDLSSLVSNSLGGGGGGNPQPFGNNSSSNYNSQTSNYNSQSSNLGSGNSYHRGGGGGDDYQSGGGNSFGGGGNYGNGNNDGYNSSNSLSGRGFQNSGNISTYTSDRLSFVDNTNKTFSKKVLISNLPSTLSYNLLNEKCQEFGDVQGFETKGQGSVLLTYASDWQAEKAIKNLDKARIDGRMIDARLYF

SEQ ID NO: 23359 - protein, 416 aa, Diabrotica virgifera
  misc_feature: Coding regions on vcDNA: vcDNA=SeqID_3056; Strand=+; Position=103-1353
  misc_feature: Homolog annotation: Hit_ID=NP_649899.1; Match level="QueryCoverage =99%, HitCoverage=73%, E-value=5e-89, Identity=43%"; Hit description =CG9373-PA [Drosophila melanogaster] gb|AAF54387.1| CG9373-PA [Drosophila melanogaster]
  misc_feature: Pfam annotation: Pfam_ID=RRM_1; Match level="Score=146.6, E-value =5.7e-41, Copies=2"; Pfam description=RNA recognition motif. (a.k.a. RRM, R
GGLKDFRMTDTESNNDRGRRDNKRPREDSFRDRSRDRGNASTTQRSTKPSQTRVFVSNIPYEYRWQDVKDIFRNEVGDVSFVELFYDESNKSKGTGIVEFADKGSVDKCMEKMQRYEVNGRKLVVRDDSGVTRDRTGAILSGTSRRPPAERNFGGGGGGNSFNNSISFSSNNDGNWGNTYGLSPQFLESLKIDPPLVNRVFIANLEYNVDEKKLRDAFKLAGRIVNIDLPLDKDGRIRGFAVIEYDHPVEAVQAISMFNHQSFFDRTLAVRMDRANDNIKLPEGLRSIGMGLGPNGEPLKCVAHNLNNQSNSSTNGLLGAVPNNTLQQLSSLTGLSALNALQSANLGSLLGNNLGSNDLSSLVSNSLGGGGGGNPQPFGNNSSSNYNSQTSNYNSQSSNLGSGNSYHRGGGGGAWK

SEQ ID NO: 23360 - protein, 324 aa, Diabrotica virgifera
  misc_feature: Coding regions on vcDNA: vcDNA=SeqID_3057; Strand=+; Position=127-1101
  misc_feature: Homolog annotation: Hit_ID=EAL28583.1; Match level="QueryCoverage =89%, HitCoverage=50%, E-value=9e-81, Identity=54%"; Hit description =GA21738-PA [Drosophila pseudoobscura]
  misc_feature: Pfam annotation: Pfam_ID=RRM_1; Match level="Score=146.6, E-value =5.7e-41, Copies=2"; Pfam description=RNA recognition motif. (a.k.a. RRM, R
MTDTESNNDRGRRDNKRPREDSFRDRSRDRGNASTTQRSTKPSQTRVFVSNIPYEYRWQDVKDIFRNEVGDVSFVELFYDESNKSKGTGIVEFADKGSVDKCMEKMQRYEVNGRKLVVRDDSGVTRDRTGAILSGTSRRPPAERNFGGGGGGNSFNNSISFSSNNDGNWGNTYGLSPQFLESLKIDPPLVNRVFIANLEYNVDEKKLRDAFKLAGRIVNIDLPLDKDGRIRGFAVIEYDHPVEAVQAISMFNHQSFFDRTLAVRMDRANDNIKLPEGLRSIGMGLGPNGEPLKCVAHNLNNQSNSSTNGLFGAVPNKNLLQANN

SEQ ID NO: 23361 - protein, 135 aa, Diabrotica virgifera
  misc_feature: Coding regions on vcDNA: vcDNA=SeqID_3058; Strand=+; Position=42-446
MKQVIVSLCCLIIATAAIPIESFVDEDGQQYVLVPLQRQRRDLTWGANQNGYSLGQKGTIYSSGNHQFDGSYGASKAWGSHGIKPDSFGGRVDYTHSTSGSNAFVGANRTPGWGTDVAAGGRYNIVQGKNWNVGA

SEQ ID NO: 23362 - protein, 298 aa, Diabrotica virgifera
  misc_feature: Coding regions on vcDNA: vcDNA=SeqID_3059; Strand=+; Position=183-1079
  misc_feature: Homolog annotation: Hit_ID=NP_729468.2; Match level="QueryCoverage =67%, HitCoverage=40%, E-value=2e-20, Identity=28%"; Hit description =CG4432-PA, isoform A [Drosophila melanogaster] gb|AAF50302.3| CG4432- PA, isoform A [Drosophila
  misc_feature: Gene Ontology Annotation: Molecular function=peptidoglycan recognition activity; Biological process=anti-Gram-positive bacterial polypeptide induction
  misc_feature: Pfam annotation: Pfam_ID=Amidase_2; Match level="Score=65.8, E-value =1.2e-16, Copies=1"; Pfam description=N-acetylmuramoyl-L-alanine amidase
MRGNMKLIRVKSRHRYRTGTENNNSVKNSEYCENYSYKAKSNVSAKVQKEDEVAFSARKKCTLRIYLIGVLLVFLVSTTAVILVFVLRKDAQDQIPHKEDTIIITNSSSRLIPKEVWGGRKAVGKMEELKTPVGLVILKHTAGGNCSNFEQCAKKMQTLQSTDIGDNDLPDIYFNFGIGADGNAYFGRGWNILPASRANCIEIVLIGNFQIDPFTLTMFKATKALLKHGTDHKYLSEDYKLIGHNQVNTTKSPGKNVLAVINQFQHFDPTDYKGIPLDSDPMILTSSTIPTTLTEDEE

SEQ ID NO: 23363 - protein, 407 aa, Diabrotica virgifera
  misc_feature: Coding regions on vcDNA: vcDNA=SeqID_3060; Strand=+; Position=127-1350
  misc_feature: Homolog annotation: Hit_ID=EAA12268.3; Match level="QueryCoverage =89%, HitCoverage=56%, E-value=2e-80, Identity=48%"; Hit description =ENSANGP00000019165 [Anopheles gambiae str. PEST] ref|XP_554946.1| ENSANGP00000019165 [Anopheles gambiae st
  misc_feature: Gene Ontology Annotation: Molecular function=SH3/SH2 adaptor protein activity; Cellular component=endosome; Biological process=synaptic vesicle endocytosis
  misc_feature: Pfam annotation: Pfam_ID=SH3_1; Match level="Score=85.1, E-value=1.8e- 22, Copies=1"; Pfam description=SH3 domain
MPVKKPAPLSKDPDVVESQEEEEQILKAIELSLKESGGSPRSSTNTTTTHSTSLYPSMNLNAPSRAPAGATAAAAPSAKEPRKVRALYDFEAAEDNELTFNSGEILFVLDDSNPNWWKGTNQRGEGLFPANFVTADLSVEPEKFLYEKAKKMVQFKETAEVKVVKDEPEDVEINEQKIDRLLHLLHEADPTNPEKDTDEMLNLEREANGMGPLIDAELEKVDRKHAQLTQLSADLVEALGLYHTLMREPPFPSISKMPYGYPPSSHMPFNGTLPPNAHIPMMLQGNQGPDRAPFMHAPGGVPQAMMQQMHMQHIPPMAGGPQLQHPQMQQHLQGPPSQIPPQMQQQMMEERRMEPHMMHMDFQTMVQLVRCLSLFHHSRSRGQHHKRTYPMAPNNTQASNMLLPVLI

SEQ ID NO: 23364 - protein, 332 aa, Diabrotica virgifera
  misc_feature: Coding regions on vcDNA: vcDNA=SeqID_3061; Strand=+; Position=129-1125
  misc_feature: Homolog annotation: Hit_ID=EAA12268.3; Match level="QueryCoverage =86%, HitCoverage=44%, E-value=6e-70, Identity=50%"; Hit description =ENSANGP00000019165 [Anopheles gambiae str. PEST] ref|XP_554946.1| ENSANGP00000019165 [Anopheles gambiae st
  misc_feature: Gene Ontology Annotation: Molecular function=SH3/SH2 adaptor protein activity; Cellular component=Golgi apparatus; Biological process =synaptic vesicle endocytosis
  misc_feature: Pfam annotation: Pfam_ID=VHS; Match level="Score=136.8, E-value=4.9e -38, Copies=1"; Pfam description=VHS domain
  misc_feature (234)..(234): Xaa can be any naturally occurring amino acid
MGIFGTAADAAITEEIETATTEKNDDEDWGLIMTICDKAGQTSDNAKAYFRAIIKRLYHEDPHVGVKAVTLLDACVKNSGKVFHVEVASREFENDFSKLMNKSHHTVAKKLRASLCKWAENEFKSDPQLNLIPSMYNKLKNKGLDCSSTDMPVKKPAPLSKDPDVVESQEEEEQILKAIELSLKESGGSPRSSTNTTTTHSTSLYPSMNLNAPSSAPAGATAAAAPSAKEPREXRALYDFEAAEDNGLTFNSGEIFFVLYDSNPNWGKGNNHRGERIFSANFLSPNLSLGTKKFCIKKKKKKDKFKKTPRGKIVKTNPKKKKKKQKKKAGPS

SEQ ID NO: 23365 - protein, 153 aa, Diabrotica virgifera
  misc_feature: Coding regions on vcDNA: vcDNA=SeqID_3062; Strand=+; Position=2-463
NKVLVRDEVFIFVLAACTAHIVSSAAVETSDNQLVLHQLRRLQRDLQARGSVDLSIDNIINTVISTVINVVSSILIKAFCGAITPYLLLVSVFRSTVIKALSLIVQFLGEVATSLLPALSDTVTQITSFISTVDSTIGNALDYVNKAGCSVSV

SEQ ID NO: 23366 - protein, 161 aa, Diabrotica virgifera
  misc_feature: Coding regions on vcDNA: vcDNA=SeqID_3063; Strand=+; Position=3-488
TVIFQPISSLSSIYDVCYIRADKQLNNTLQAVPEFTTPDEFKDTKELINRIKIIVSKIESTNVQRQIRDIEGSLDEYRKTTDHLKENLNELQRIKNAFDTFNNYKAFNKKTQTVCTSAKIYYGKLKKDYENLKLYLEQLSDDIKKKVDDINSKSLKIKKST

SEQ ID NO: 23367 - protein, 103 aa, Diabrotica virgifera
  misc_feature: Coding regions on vcDNA: vcDNA=SeqID_3064; Strand=+; Position=2-313
  misc_feature: Homolog annotation: Hit_ID=NP_572567.1; Match level="QueryCoverage =100%, HitCoverage=37%, E-value=9e-20, Identity=48%"; Hit description= CG32701-PA [Drosophila melanogaster] gb|AAF46502.1| CG32701-PA [Drosophila melanogaster]
  misc_feature: Gene Ontology Annotation: Molecular function=signal sequence binding; Cellular component=integral to membrane; Biological process =cotranslational membrane targeting
  misc_feature: Pfam annotation: Pfam_ID=TRAP_alpha; Match level="Score=-157.5, E -value=0.007, Copies=1"; Pfam description=Translocon-associated protein (TRAP),
LEEGLDGETFFLYVFLAAGVVLLLVIGQQTLLSVGKKRSGGSGGSSRKSAPVETGTNNPNNVDYDWLPKQTLASLNKEKLQKSPKGKPQSPRQRKVKRTTGSE

SEQ ID NO: 23368 - protein, 309 aa, Diabrotica virgifera
  misc_feature: Coding regions on vcDNA: vcDNA=SeqID_3065; Strand=+; Position=79-1008
  misc_feature: Homolog annotation: Hit_ID=XP_321364.1; Match level="QueryCoverage =93%, HitCoverage=99%, E-value=5e-78, Identity=55%"; Hit description =ENSANGP00000012186 [Anopheles gambiae]
  misc_feature: Gene Ontology Annotation: Molecular function=signal sequence binding; Cellular component=integral to membrane; Biological process =cotranslational membrane targeting
  misc_feature: Pfam annotation: Pfam_ID=TRAP_alpha; Match level="Score=447.2, E -value=1.9e-131, Copies=1"; Pfam description=Translocon-associated protein (TRAP),
NTSKLSEAVRSCGSVNMNKLIFLALLVFPAVIFIFENGKMVSYAEEDPIEDEVEVEGEVDSDVEATTPDEEVDEDTKSLSSPYADTTLLFVKPESTGASQLEIPAGLPVEFLVGFRNKGDQDFVVDTLEASFRYPMDFNFFIQNFSAVGYSKIVQPEEEATFLYSFLPAEAYAGRPFGLNILLNYHDASGNAFQEAVFNETVQIVELEEGLDGETFFLYVFLAAGVVLLLVIGQQTLLSVGKKRSGGSGGSSRKSAPVETGTNNPNNVDYDWLPKQTLASLNKEKLQKSPKGKPQSPRQRKVKRTTGSE

SEQ ID NO: 23369 - protein, 102 aa, Diabrotica virgifera
  misc_feature: Coding regions on vcDNA: vcDNA=SeqID_3066; Strand=+; Position=113-421
  misc_feature: Homolog annotation: Hit_ID=XP_310538.1; Match level="QueryCoverage =87%, HitCoverage=76%, E-value=1e-28, Identity=65%"; Hit description =ENSANGP00000017302 [Anopheles gambiae]
  misc_feature: Pfam annotation: Pfam_ID=ACBP; Match level="Score=163.9, E-value=3.4e- 46, Copies=1"; Pfam description=Acyl CoA binding protein
FIRSFPVLYQKPKMSLDERFQKAAADIKNLKSKPTDNDLLEIYGLFKQATEGDCTTARPGLLDLKGKAKWDSWNGRKGSSQDKAKEEYIAKVQSLIDSLGLA

SEQ ID NO: 23370 - protein, 100 aa, Diabrotica virgifera
  misc_feature: Coding regions on vcDNA: vcDNA=SeqID_3067; Strand=+; Position=49-351
  misc_feature: Homolog annotation: Hit_ID=NP_611420.1; Match level="QueryCoverage =76%, HitCoverage=96%, E-value=3e-14, Identity=46%"; Hit description =CG10460-PA [Drosophila melanogaster] gb|AAF57567.1| CG10460-PA [Drosophila melanogaster]
  misc_feature: Gene Ontology Annotation: Molecular function=molecular_function unknown; Cellular component=cellular_component unknown; Biological process=biological_process unknown
MFCKVFVLALIVAVAVASQTAEEAWPKYKTDYNRNYDAQEDATRFAIFKTNYDQIEAHNKKFEAGEVTWSMGLNQFADRTPEELKHLHGLRRPVGGSGVH

SEQ ID NO: 23371 - protein, 142 aa, Diabrotica virgifera
  misc_feature: Coding regions on vcDNA: vcDNA=SeqID_3068; Strand=+; Position=2-430
  misc_feature: Homolog annotation: Hit_ID=AAO18181.1; Match level="QueryCoverage =86%, HitCoverage=96%, E-value=2e-12, Identity=30%"; Hit description =12 kDa hemolymph protein e precursor [Tenebrio molitor]
  misc_feature: Pfam annotation: Pfam_ID=PBP_GOBP; Match level="Score=46.1, E-value =1e-10, Copies=1"; Pfam description=PBP/GOBP family
MKCLIIVTVFCILVVVNAGPTPTSEQKEAVKKAHDHCQTNEETRIDDDVFEKVKKGEKVDNAKLSKHTLCMNVQTGLQTQSGDINVDKLRKALTEAISDPNLVNTIVEKCGKRVAGETAEESAVTFFKCLHSQGPPHGHGHH

SEQ ID NO: 23372 - protein, 96 aa, Diabrotica virgifera
  misc_feature: Coding regions on vcDNA: vcDNA=SeqID_3069; Strand=-; Position=381-671
FIFIFLDMLVIVESKNAYILVFFLVLNLRYHYFLFLFIYDLHSLLALIVNFIFLVIIPKDVASTWRYIINIFCYSFSTYYISMVMVHLEYKPYVQT

SEQ ID NO: 23373 - protein, 380 aa, Diabrotica virgifera
  misc_feature: Coding regions on vcDNA: vcDNA=SeqID_3070; Strand=+; Position=56-1198
  misc_feature: Homolog annotation: Hit_ID=BAA34642.1; Match level="QueryCoverage =92%, HitCoverage=93%, E-value=3e-91, Identity=47%"; Hit description =pro-phenoloxidase activating enzyme-I precursor [Holotrichia diomphalia]
  misc_feature: Gene Ontology Annotation: Molecular function=serine-type endopeptidase activity; Cellular component=extracellular; Biological process=Tl signaling pathway
  misc_feature: Pfam annotation: Pfam_ID=Trypsin; Match level="Score=244.6, E-value =1.9e-70, Copies=1"; Pfam description=Trypsin
MLVRSYLCVLLVLIFENNGVFSQRGTSCKTPNQEWATCNSIYSCRALLSAVQTRDPTQLKFLKESQCGYDSEPLVCCGSTSTFALTGRRVLNNDVTAVATGGSNSNYRVNSAIPDRPKCGQDFSDKIFGGTATKINEFPWMALLQYANPAGHRRWACAGSLINERYILTAAHCVTGDISRVVGKLVNVRLGEYNTESEVDCDGELCNDPQDIGIEEVLYNEGYNNNNVHRYNDIALIRLNRNVKFSRFIYPICLPHPNEAARVGDRVIVAGWGKTESSSRSNIKLKVEIPIAQRSQCTRAFASAGIILKNSQICAGGQRGRDSCAGDSGGPLMKTVEDDSSTWYQEGIVSFGARCGTEGWPGIYTKVENYLGWIHRNVRE

SEQ ID NO: 23374 - protein, 424 aa, Diabrotica virgifera
  misc_feature: Coding regions on vcDNA: vcDNA=SeqID_3071; Strand=+; Position=226-1500
  misc_feature: Homolog annotation: Hit_ID=AAQ02892.1; Match level="QueryCoverage =98%, HitCoverage=97%, E-value=1e-180, Identity=72%"; Hit description= aspartate aminotransferase [Aedes aegypti]
  misc_feature: Gene Ontology Annotation: Cellular component=mitochondrion; Biological process=aspartate catabolism
  misc_feature: Pfam annotation: Pfam_ID=Aminotran_1_2; Match level="Score=344.1, E -value=2e-100, Copies=1"; Pfam description=Aminotransferase class I and II
MSLKQTVSLLHSKNGINAVAQRASSWWSGVQMGPPDVILGVTEAFKKDNNPNKINLGVGAYRDDNGKPYVLPSVRAAEEKIKAKGLDKEYAPISGVAEFCKRSIELALGENSSVLKDGMNATVQGISGTGSLRIGGAYLNSFFPGNKIIYLPAPSWGNHNPIFKHSGLEVKTYRYYDAKTCGLDFQGTIEDISKIPEKSIILLHACAHNPTGVDPNKEQWKELSDVIRKRNLFVYFDMAYQGFATGSVDNDAFAVRYFVEQGHRIALAQSFAKNMGLYGERAGAFSIIANSKEEADRVMSQIKILIRPMYSNPPLHGARIVAEILSDSTLRSQWLPEVKGMADRIISVRSKLRENLKKEGSSRNWEHITNQIGMFCFTGMGPEQVDKLVKEHSVYLTRDGRISMAGVTSKNVDYLARAMHLATK

SEQ ID NO: 23375 - protein, 149 aa, Diabrotica virgifera
  misc_feature: Coding regions on vcDNA: vcDNA=SeqID_3072; Strand=+; Position=175-624
  misc_feature: Homolog annotation: Hit_ID=EAL34012.1; Match level="QueryCoverage =95%, HitCoverage=97%, E-value=5e-24, Identity=42%"; Hit description =GA20242-PA [Drosophila pseudoobscura]
  misc_feature: Gene Ontology Annotation: Cellular component=extracellular space
  misc_feature: Pfam annotation: Pfam_ID=E1_DerP2_DerF2; Match level="Score=114.4, E -value=2.7e-31, Copies=1"; Pfam description=ML domain
MHYKIFIVFVALLGACVATDTVNWSDCGSTAGEVKSVVVANCHSDRCILKRGTNATLAITFDSKVSSKNLTAVVYGDVLGYKTKFPLPNSNACKGVGVECPLEEGKTYVYTDTFDVKQVYPRVIVEIWWELITDTGDKAVCVIIPAKIN

SEQ ID NO: 23376 - protein, 239 aa, Diabrotica virgifera
  misc_feature: Coding regions on vcDNA: vcDNA=SeqID_3073; Strand=+; Position=80-799
  misc_feature: Homolog annotation: Hit_ID=EAL32687.1; Match level="QueryCoverage =98%, HitCoverage=98%, E-value=3e-88, Identity=70%"; Hit description =GA11169-PA [Drosophila pseudoobscura]
  misc_feature: Gene Ontology Annotation: Molecular function=chaperone activity; Cellular component=nucleolus; Biological process=rRNA processing
  misc_feature: Pfam annotation: Pfam_ID=KH_1; Match level="Score=25.7, E-value =0.00014, Copies=1"; Pfam description=KH domain
MAEINIDIDNFEPKKAQKRGVSTSEDMEVEIVNGIEGTNNKVRAPRTKKARSKSFSETKDDMRKIAVPSHRYSPLKENWLKIFTPVVEHLQLQIRFNLKTRNVEIRACKETPDISNLQKAADFVKAFIYGFEVEDALALIRLDDLFVETFEIKDVKTLKGDHQSRAIGRLAGKGGRTKFTIENVTKTRIVLADSKIHILGSFQNIALARRAVCNLILGSPPSKVYGQLRNVASRVSERM

SEQ ID NO: 23377 - protein, 71 aa, Diabrotica virgifera
  misc_feature: Coding regions on vcDNA: vcDNA=SeqID_3074; Strand=+; Position=174-389
PYELYRYEYVVTNSRRYELSVTICRVTNCRVTRCHGTIITHARIKRYKDKITDCTWPTLSVMFGDKMVPVR

SEQ ID NO: 23378 - protein, 785 aa, Diabrotica virgifera
  misc_feature: Coding regions on vcDNA: vcDNA=SeqID_3075; Strand=+; Position=112-2464
  misc_feature: Homolog annotation: Hit_ID=NP_609630.1; Match level="QueryCoverage =88%, HitCoverage=47%, E-value=6e-27, Identity=23%"; Hit description =CG6108-PA [Drosophila melanogaster] gb|AAF53275.1| CG6108-PA [Drosophila melanogaster]
  misc_feature: Gene Ontology Annotation: Molecular function=molecular_function unknown; Cellular component=condensed nuclear chromosome kinetochore; Biological process=mitotic spindle assembly (sensu Saccharomyces)
  misc_feature (731)..(731): Xaa can be any naturally occurring amino acid
MKSITNITSLNAYSSDEDISKEEIQEDEYSGESNDEIDDASSIGYEDDAYSHQLSVIMEESERTESRIRSFSAMSDTTTIAERSDPEEDIVDYSKTEKLDSRHESISDDYNKHNEEENIVNCRELESDDSKQERASDHYDRHNEEDVLLDTYKEDDINVDCEHDDDDIKSNDSEDWWGIIGKEDDDLPAPKKTQLFCNVNVEEKSILNEYAASEDIIESDNSDTEDIVSIKVNDVETDRVDNLEIHKNDTVSNYSTEVTNSNKNTTQNCNEESNEYSSEVTNTNTNTTQGCNEESNNYTEYTVVRRIKKKNNVVHKETEVKESLSRPPSIYQSLESLQSEPKSRPRSIYESLEDIQAESTGSLIKVDNFVGILEQIQKETGFWNLNSRLNNEKGIEPVKFRRTRSVEEKHLDEEKRFTWTSFENFNRESLDDLENKIKRMSCGSLEDLKVNIKTDETVEGSTNYIKYNSSLSSTPVIETQIILEDINDDNKSSTNESHTEDSDSSASEKDDKETNNSLVRLDDDADVKIPTIKDRIQALRESINLKRRIFSDDTKELSKDKISINDSSNRSKTASSKSSLKSFEEFSEEEEVDSGVTSDMSRHISDTEEFPELRKLTKYQRAATHSRLFKLLQEECNNEDVEEDAEESKQALDLNLNEAKNPVNERLVNELVDSLLKLKKGQAFKNLPKEKLYAAAVKILQEDMEVTDTLSGYSTSVQTPQEFGTNSDDYXTYYDTWDRSEESFDIFPSAFSLQELSSNKQGGGLSPIIKCPKVVSSKNIHKKLI

SEQ ID NO: 23379 - protein, 196 aa, Diabrotica virgifera
  misc_feature: Coding regions on vcDNA: vcDNA=SeqID_3076; Strand=+; Position=693-1280
  misc_feature: Homolog annotation: Hit_ID=XP_392667.1; Match level="QueryCoverage =96%, HitCoverage=85%, E-value=6e-41, Identity=43%"; Hit description =similar to ENSANGP00000014906 [Apis mellifera]
  misc_feature: Gene Ontology Annotation: Molecular function=molecular_function unknown
  misc_feature: Pfam annotation: Pfam_ID=MtN3_slv; Match level="Score=76.5, E-value =7.4e-20, Copies=2"; Pfam description=MtN3/saliva family
  misc_feature (168)..(168): Xaa can be any naturally occurring amino acid
  misc_feature (180)..(180): Xaa can be any naturally occurring amino acid
MEALSNILQPYKNVVGQTASIVTIAQFFSGAFICKDIYKKKSTAGIQAVPFIGGITIGILMLKLALLMNDAAMLQVNVAAIGLNVLYLAFYYYYSADKYNEVLKPGSVGVAIVAVFIGYSLVEAPQLLEYRYSLVVTILMLASFGAPLLDVKAIIDKRDASSIPFPFXFMRTIVTALWLXYGIILQNAFMIVQNVI

SEQ ID NO: 23380 - protein, 88 aa, Diabrotica virgifera
  misc_feature: Coding regions on vcDNA: vcDNA=SeqID_3077; Strand=+; Position=1797 -2063
KIIICHYIIHYTSSHDTSYIACHFSCSVEKMKVTHDDPTFFFFCLFLPFFFKKKPNVWLKKKKQKKKKKNELDGEFFLGKNFSFFLPT

SEQ ID NO: 23381 - protein, 206 aa, Diabrotica virgifera
  misc_feature: Coding regions on vcDNA: vcDNA=SeqID_3078; Strand=+; Position=11-628
  misc_feature: Homolog annotation: Hit_ID=CAD22154.1; Match level="QueryCoverage =79%, HitCoverage=50%, E-value=1e-42, Identity=51%"; Hit description =pherophorin-dz1 protein [Volvox carteri f. nagariensis]
  misc_feature: Gene Ontology Annotation: Molecular function=molecular_function unknown; Cellular component=extracellular space; Biological process =biological_process unknown
MLKILIVTLVLWAGVSYAKDVKNDLSDGILFNSADDKILFPSLIDPKPTEIPPPPPINLPGPPEPPSDVPEALYNKRPRPPPSKRPRPPGPPPSRRPKPPGPPPSRRPKPPGPPPSRRPRPPGPPPSRRPRPPGPPPSRRPRPPGPPPSRRPKPPGPPPSRRPRPPGPPPSRRPQPPGPPPSRRPRPPGPPPSRRPRTTGPPPCRR

SEQ ID NO: 23382 - protein, 128 aa, Diabrotica virgifera
  misc_feature: Coding regions on vcDNA: vcDNA=SeqID_3079; Strand=+; Position=51-437
  misc_feature: Homolog annotation: Hit_ID=AAR10195.1; Match level="QueryCoverage =100%, HitCoverage=100%, E-value=3e-68, Identity=97%"; Hit description=similar to Drosophila melanogaster RpL40 [Drosophila yakuba] gb|AAR09801.1| similar to Drosophila melano
  misc_feature: Pfam annotation: Pfam_ID=ubiquitin; Match level="Score=154.3, E-value= 2.7e-43, Copies=1"; Pfam description=Ubiquitin family
MQIFVKTLTGKTITLEVEPSDTIENVKAKIQDKEGIPPDQQRLIFAGKQLEDGRTLSDYNIQKESTLHLVLRLRGGLIEPSLRILAMKYNCEKMICRKCYARLHPRATNCRKKKCGHTNNLRPKKKLK

SEQ ID NO: 23383 - protein, 72 aa, Diabrotica virgifera
  misc_feature: Coding regions on vcDNA: vcDNA=SeqID_3080; Strand=-; Position=1-216
LPPPPYYVSSHTTRITSRAFEGEIHLFAYSPDFAPFVFFVSGNHRLRRQACVFTLKANTLKNNKADFSKNMF

SEQ ID NO: 23384 - protein, 54 aa, Diabrotica virgifera
  misc_feature: Coding regions on vcDNA: vcDNA=SeqID_3081; Strand=-; Position=775-939
  misc_feature (8)..(8): Xaa can be any naturally occurring amino acid
LERRCKAXSDTQSSQRLLQISTTTARAVRVCFSVVNCFNSPCTAALSLMENYFL

SEQ ID NO: 23385 - protein, 271 aa, Diabrotica virgifera
  misc_feature: Coding regions on vcDNA: vcDNA=SeqID_3082; Strand=-; Position=2773 -3588
  misc_feature: Homolog annotation: Hit_ID=XP_392776.1; Match level="QueryCoverage =90%, HitCoverage=48%, E-value=1e-114, Identity=80%"; Hit description= similar to glutamate dehydrogenase, short peptide [Apis mellifera]
  misc_feature: Gene Ontology Annotation: Cellular component=mitochondrion; Biological process=glutamate catabolism
  misc_feature: Pfam annotation: Pfam_ID=GLFV_dehydrog_N; Match level="Score=205.5, E- value=1e-58, Copies=1"; Pfam description=Glu/Leu/Phe/Val dehydrogenase, dimeri
DNGQYEIIKGYRAQHSTHRTPCKGGMRFSMDVSRDEVKALAALMTFKCACVDVPFGGAKAGVKIDHKKYSEHELEKITRRFTLELVKKGFIGPSIDVPAPDMGTGEREMSWLADTYAKTIGYQDINNHACTTGKPINQGGIHGRVSATGRGVFHGIENFSNEESVMQKCGLTTGIRGKTVIIQGFGNVGLHTMRYLHRAGAKVIGVIEYDGSIFNENGIDPKDLEDYIVTNGSINGFPGAKKYEKNLIIPRMGYLGHRLPLKKVITKERFF

SEQ ID NO: 23386 - protein, 553 aa, Diabrotica virgifera
  misc_feature: Coding regions on vcDNA: vcDNA=SeqID_3083; Strand=+; Position=226-1887
  misc_feature: Homolog annotation: Hit_ID=XP_313645.1; Match level="QueryCoverage =99%, HitCoverage=99%, E-value=0.0, Identity=72%"; Hit description =ENSANGP00000013061 [Anopheles gambiae] gb|EAL40521.1| ENSANGP00000025473 [Anopheles gambiae
  misc_feature: Gene Ontology Annotation: Cellular component=mitochondrion; Biological process=glutamate catabolism
  misc_feature: Pfam annotation: Pfam_ID=GLFV_dehydrog; Match level="Score=363.8, E -value=2.3e-106, Copies=1"; Pfam description =Glutamate/Leucine/Phenylalanine/Valin
MLNLKMISKFAPLKSRSAEVSTLLKALPAACNQLQGRTYADHVIPDRLKDMPNNPNPRFFDMVEYFFHKACVLVEDKLVEDLGNVKGSRLNLDQRKAKVKGILTFMEQCDHILEVAFPIKRDNGQYEIIKGYRAQHSTHRTPCKGGMRFSMDVSRDEVKALAALMTFKCACVDVPFGGAKAGVKIDHKKYSEHELEKITRRFTLELVKKGFIGPSIDVPAPDMGTGEREMSWLADTYAKTIGYQDINNHACTTGKPINQGGIHGRVSATGRGVFHGIENFSNEESYMQKCGLTTGIRGKTVIIQGFGNVGLHTMRYLHRAGAKVIGVIEYDGSIFNENGIDPKDLEDYRVTNGSINGFPGAKKYEDNLLFHECDILVPAATEKVITKDNADKVKAKIIAEAANGPLTPAADQILLKKNVLVIPDLYVNAGGVTVSFFEWLKNINHVSYGRLTFKYEKDSNYHLLQSVQESLERKFTDVGSIPILPSTPFNKRIAGASEKDIVHSGLSFTMERSAKAILKTASQYNLGLDLRSAAYINSVQKIFTTYSEAGLTM

SEQ ID NO: 23387 - protein, 89 aa, Diabrotica virgifera
  misc_feature: Coding regions on vcDNA: vcDNA=SeqID_3084; Strand=-; Position=423-692
PMLRHRLVMAGHIGRMEDNRWTKRIVELGPRENKRSRCRPQTRRTDNIKRTTVHKWMQKERTEMNEIYLRDKRVVVKLEDIKIPQELPK

SEQ ID NO: 23388 - protein, 210 aa, Diabrotica virgifera
  misc_feature: Coding regions on vcDNA: vcDNA=SeqID_3085; Strand=+; Position=214-846
  misc_feature: Homolog annotation: Hit_ID=BAC98835.1; Match level="QueryCoverage =92%, HitCoverage=69%, E-value=3e-18, Identity=29%"; Hit description =juvenile hormone acid methyltransferase [Bombyx mori]
  misc_feature (184)..(184): Xaa can be any naturally occurring amino acid
  misc_feature (204)..(204): Xaa can be any naturally occurring amino acid
MAMIMPELYAKLSTNNVNITKTLLKKYKHLLNFKKNPSILEFGFASGENSKQTLQPYLPHDYKEFVAVDISEPMVERARKNNTHIPRSKFYCLDTSAPDLPEMFQNRFDNVFSIMTIHLVNNPRQTFANTFKMLKDGGETFQTFFKHTPCDSAFLKLSKHPKWGKEQYNQKKMLNPYYDKPEPXGYITADLKAAGFQNIQIMEXDTTYNF

SEQ ID NO: 23389 - protein, 452 aa, Diabrotica virgifera
  misc_feature: Coding regions on vcDNA: vcDNA=SeqID_3086; Strand=+; Position=5-1358
  misc_feature: Homolog annotation: Hit_ID=XP_319685.1; Match level="QueryCoverage =90%, HitCoverage=76%, E-value=4e-89, Identity=41%"; Hit description =ENSANGP00000021422 [Anopheles gambiae]
  misc_feature: Gene Ontology Annotation: Molecular function=inorganic phosphate transporter activity; Cellular component=integral to membrane; Biological process=phosphate transport
  misc_feature: Pfam annotation: Pfam_ID=MFS_1; Match level="Score=142.1, E-value =1.3e-39, Copies=1"; Pfam description=Major Facilitator Superfamily
  misc_feature (412)..(412): Xaa can be any naturally occurring amino acid
  misc_feature (438)..(438): Xaa can be any naturally occurring amino acid
  misc_feature (441)..(441): Xaa can be any naturally occurring amino acid
MVQDNKISNNLVYQLVNTEIKEGDDVTARIEEKKDDKIDSGPKFGKRHVQVIFLFTLLLIGYCIRVNLSLTIVAMTDPNANENKDIPTFDWKNRNVILSAFFWGYVTPQILAGWLMTRYGPKWFLVGSMAIGAILGYAIPLLATYYGSTAVIICRVIQGASQGFFVPGISCFTSRWIPIAERGRLGTFMYAASPMGSVVSMMLSGAISASSYGWPMVFHFFSTLGIVWCVLYLFCGSNSPSENKSITEVEKNYILRTSVDVNKKPLPTPWRHILTSIHFYALIYTYTCNVLGLWLLLTQIPTYMSKIMKFDIKSNGTLTASIYLSQWLLSIILGSVSDYVINRKILSLTLTRKLVSGVGTFGPAISLVFLAQCTEENTVKGVILLFLAVGTGGAQICSILINSVDLSPNHAXGVLSGICHAFSHVFAIFAPLIAEFLXSDXYNPSSWQIVFY

SEQ ID NO: 23390 - protein, 173 aa, Diabrotica virgifera
  misc_feature: Coding regions on vcDNA: vcDNA=SeqID_3087; Strand=+; Position=415-931
  misc_feature: Homolog annotation: Hit_ID=XP_315923.1; Match level="QueryCoverage =85%, HitCoverage=25%, E-value=2e-54, Identity=65%"; Hit description =ENSANGP00000013487 [Anopheles gambiae]
  misc_feature: Gene Ontology Annotation: Molecular function=electron acceptor activity; Cellular component=mitochondrial inner membrane; Biological process=electron transport
  misc_feature (82)..(82): Xaa can be any naturally occurring amino acid
MLKSLYRCKKIQKTEIMALKLKTSNNLAKQVHILIRNYSKITTHYTIHPREKDPRWKEVNMERFTDETDILIVGGGPAGMSXAIRAKQLAEKDGKELRVCLVEKASQVGGHILSGAVIQPTALDELIPDWKEKGAPLNTPVTEDKFGFLTATGRFNIPVFKGLPMGHHGNYIV

SEQ ID NO: 23391 - protein, 254 aa, Diabrotica virgifera
  misc_feature: Coding regions on vcDNA: vcDNA=SeqID_3088; Strand=+; Position=116-880
  misc_feature: Homolog annotation: Hit_ID=XP_312022.1; Match level="QueryCoverage =45%, HitCoverage=24%, E-value=4e-18, Identity=39%"; Hit description =ENSANGP00000018576 [Anopheles gambiae]
  misc_feature: Gene Ontology Annotation: Cellular component=endoplasmic reticulum
  misc_feature: Pfam annotation: Pfam_ID=Perilipin; Match level="Score=-85.0, E-value= 0.014, Copies=1"; Pfam description=Perilipin family
MAAITEVSEAPVAQSNLTCLESVNRFSKLPVVDSTIKTATSLYEKVKDLNGLTHWTFSTAETTLCKAVDLGMPIATPVIKNFEGPIKKVDNVLCSGLDYVEEKIPAVKLPTNEIYNTTKDYVNNTITPAVETAKAYAEPAVKTAKDLVEPAYERAKSAVEPTLERARHIVEPIVQPALDKANAIKENVMQRVDEYLHLSHQEGEVVECQECVQIRKRLEAQQQQDNQNEQQQQDHIPRGNNKARFVLVYSVFYV

SEQ ID NO: 23392 - protein, 132 aa, Diabrotica virgifera
  misc_feature: Coding regions on vcDNA: vcDNA=SeqID_3089; Strand=+; Position=109-507
  misc_feature: Homolog annotation: Hit_ID=XP_312022.1; Match level="QueryCoverage =72%, HitCoverage=20%, E-value=3e-16, Identity=43%"; Hit description =ENSANGP00000018576 [Anopheles gambiae]
MAAITEVSEAPVAQSNLTCLESVNRFSKLPVVDSTIKTATSLYEKVKDLNGLTHWTFSTAETTLCKAVDLGMPIATPVIKNFEGPIKKVDNVLCSGLDYVEEKIPAVKLPTNEIALLQHHQRLRQQHDNTRC

SEQ ID NO: 23393 - protein, 179 aa, Diabrotica virgifera
  misc_feature: Coding regions on vcDNA: vcDNA=SeqID_3090; Strand=+; Position=71-610
  misc_feature: Homolog annotation: Hit_ID=XP_392912.1; Match level="QueryCoverage =97%, HitCoverage=98%, E-value=5e-84, Identity=85%"; Hit description =similar to ENSANGP00000013674 [Apis mellifera]
  misc_feature: Gene Ontology Annotation: Molecular function=signal peptidase activity; Cellular component=signal peptidase complex; Biological process=proteolysis and peptidolysis
  misc_feature: Pfam annotation: Pfam_ID=Peptidase_S24; Match level="Score=38.5, E -value=2e-08, Copies=1"; Pfam description=Peptidase S24-like
MESLNVFEDLRRMNKRQFIYQVLSFGMIVSSALMIWKGLMVVTGSESPIVVVLSGSMEPAFHRGDLLFLTNYPEEPVRVGEIVVFKVEGRDIPIVHRVLKLHEKKNGTVKFLTKGDNNSVDDRGLYAPGQLWLTKDDVVGRARGFLPYVGMVTILMNEYPKFKYAVLACLGLYVLVHRE

SEQ ID NO: 23394 - protein, 256 aa, Diabrotica virgifera
  misc_feature: Coding regions on vcDNA: vcDNA=SeqID_3091; Strand=+; Position=8-778
  misc_feature: Homolog annotation: Hit_ID=XP_315663.1; Match level="QueryCoverage =98%, HitCoverage=84%, E-value=1e-49, Identity=43%"; Hit description =ENSANGP00000021685 [Anopheles gambiae]
  misc_feature: Gene Ontology Annotation: Molecular function=protein binding; Biological process=NADH oxidation
  misc_feature: Pfam annotation: Pfam_ID=adh_short; Match level="Score=170.9, E-value= 2.8e-48, Copies=1"; Pfam description=short chain dehydrogenase
QEMDRWLGKVALVTGASAGVGAAISEKLVEAGLKVVGVARRTKVLDELAQKLSSKKGKFFPYTGDVSKEDDIIKAFSWTKENVGPASVLINNAAVLLLEDLSSITTQHLKQEFDINVISVCIANREAIKQMKENNIAGHIININSIAGHKVMNFPKLNVYAATKHAVSALTETLRLEQSNQKTNIKVTSISPGAIVTEMMMNVSKEMGMPIENPEEIEKVAALSAKDIADSVYYVLSTPPHVNITELTIQVVGETA

SEQ ID NO: 23395 - protein, 306 aa, Diabrotica virgifera
  misc_feature: Coding regions on vcDNA: vcDNA=SeqID_3092; Strand=+; Position=59-976
  misc_feature: Homolog annotation: Hit_ID=XP_394781.1; Match level="QueryCoverage =95%, HitCoverage=45%, E-value=1e-119, Identity=66%"; Hit description= similar to ENSANGP00000019149 [Apis mellifera]
  misc_feature: Gene Ontology Annotation: Molecular function=molecular_function unknown; Cellular component=cellular_component unknown; Biological process=biological_process unknown
  misc_feature: Pfam annotation: Pfam_ID=MR_MLE_N; Match level="Score=9.7, E-value =0.00043, Copies=1"; Pfam description=Mandelate racemase / muconate lactoni
MSKSLTGVNLKIVSLDVKDVRFPTSLQADGSDAMHTDPDYSCAYVTIKLQSGLEGYGLTFTCGRGTEVIVAAVESLKSLVVGQVVTDIYKEFGVFWRSLTSESQIRWIGPEKGVTHLATAAIINALWDLWGKLVKKPVWQLLADMEPEQLVSCIDFRYLTNVVTKEEAIEMLRKGREGREERINKLLEKGYPCYTTQAGWLGYSNEKIQQLAQKYMDAGFTAFKVKVGKNLKDDCKRLEYIRNIIGWEKTLMVDANQVWEVQEAIDWMKQLAKYKPLWIEEPTSPDDVLGHAEISKALKPLGISIA

SEQ ID NO: 23396 - protein, 495 aa, Diabrotica virgifera
  misc_feature: Coding regions on vcDNA: vcDNA=SeqID_3093; Strand=+; Position=34-1521
  misc_feature: Homolog annotation: Hit_ID=AAG26008.1; Match level="QueryCoverage =95%, HitCoverage=94%, E-value=1e-146, Identity=52%"; Hit description= beta-glucosidase precursor [Tenebrio molitor]
  misc_feature: Gene Ontology Annotation: Cellular component=endoplasmic reticulum; Biological process=aging
  misc_feature: Pfam annotation: Pfam_ID=Glyco_hydro_1; Match level="Score=664.5, E -value=7.3e-197, Copies=1"; Pfam description=Glycosyl hydrolase family 1
MITKEVWLLCIVLSTSLATTINVSKFPKDFMFGTATASYQVEGAWNEDGKGENTWDEVSHRVPSPIVDNSTGDVACDSYHKYKEDVAMLKHLGVTHYRFSLSWSRILPTGFNNKVNPLGIAYYKNLIKELRANNIEPLVTIFHWDTPQPLENLGGWTNELIVDRFVDFAKVAFENFGDDVTYWLTFNEPKQICHEGYGSKNKAPLVDSPGIGEYLCAHNLLKAHAKAWRLYDEQFRSTQKGKVGITVDTAWFEPDTTIADDVVAAERAQQFNHGLYVRPLTIGDYPEQMKKAIARRSLLQGFSQSRLPEFTQDEIQYLKGTLDYLGLNYYTTRMARNAADKQIDVVSYDADSEVDTYQKDEWPKSASSWLRVVPWGLRKLLNWIKNTYGDIPIIITENGISEDGTSLEDDMRVDYYQQHLSAVLDAMDDGVNVFGFTAWSLMDNFEWLRGYTEHFGLYHVDFTSPNRKRTPKKSVEYFKNVIQYGCVLGNSTCDN

SEQ ID NO: 23397 - protein, 521 aa, Diabrotica virgifera
  misc_feature: Coding regions on vcDNA: vcDNA=SeqID_3094; Strand=+; Position=28-1593
  misc_feature: Homolog annotation: Hit_ID=XP_312441.1; Match level="QueryCoverage =99%, HitCoverage=97%, E-value=0.0, Identity=67%"; Hit description =ENSANGP00000022164 [Anopheles gambiae]
  misc_feature: Gene Ontology Annotation: Molecular function=methylmalonate -semialdehyde dehydrogenase (acylating) activity; Cellular component =mitochondrion; Biological process=pyrimidine nucleotide metabolism
  misc_feature: Pfam annotation: Pfam_ID=Aldedh; Match level="Score=673.6, E-value =1.2e-199, Copies=1"; Pfam description=Aldehyde dehydrogenase family
AGLTMIKSTVSPVATLLRRSYSNVAPTTKLFLDGKFVDSKTTEWIDLHDPATNNVVTKVPKSTASEMEAAVESSKNAFKSWSQTSVLTRQQLMLKLQAVLRRDLKKIAQNITLEQGKTLVDAEGDVIRGLQVIEHACAAGTLLQGESLQNISKDMDVVSYKLPLGVTAGICPFNFPAMVPLWMIPLALITGNTMIMKPSERDPGATMLIAELLNEVGCPPGVVNVIHGAHQAVDFICDNKDIKAISFVGSDVAGKYIYSRGTANGKRVQSNMGAKNHAVILPDAHKESALDQIIGAAFGAAGQRCMALSVVIMVGEAQQWIPDLVAKAKQLKVNAGHEPGTDVGPVISPQAKERILRLVAQGIEQGAKCALDGRNIKVEKYPNGNFVGPTILTDVQTNQVCYKEELFGPVLCVMSADTLDDAIKIINANPYGNGTAIMTTNGNHARQFVHETDVGQVGVNVPIPVPLPMFSFTGSRGSFHGDLHFYGKQGLNFYTQTKTVTSLWRKGQVDSRPSVNMPVQN

SEQ ID NO: 23398 - protein, 264 aa, Diabrotica virgifera
  misc_feature: Coding regions on vcDNA: vcDNA=SeqID_3095; Strand=+; Position=3-794
HSLSVVLQASLDQLPKAFATLVIDLPVDGESNSIDFKKALYEANYTISSDDERSFGTEGITIDTKEAAGNLKVLISPDSLYGAYFDVKQDNYEVIVTVKAKIPSDVYEKVSVIPLALEATSSGTQKVGKTVVNVNIEYNKGSVKFSSSLYNGNYTVKEGEATIYVDEIALATDQDADHISVDVDNDYHKYFKASYDKSKVTITKTADIPIADLKKISTISIQLKATVKNSKVEDNTVINLLIITDDTPTPEQGKIMFDNTINTG

SEQ ID NO: 23399 - protein, 154 aa, Diabrotica virgifera
  misc_feature: Coding regions on vcDNA: vcDNA=SeqID_3096; Strand=+; Position=22-486
  misc_feature: Pfam annotation: Pfam_ID=PBP_GOBP; Match level="Score=35.2, E-value =2e-07, Copies=1"; Pfam description=PBP/GOBP family
PFAFKTNMNATIVILCVLIASFVCLQAAPPARKTSAEKREDMKQRTVIGLSCLKETKLDRSVVEKAMAQLGHSEDPKYKDFLSCSYKKQGYQDENGNILYENISNFLSNYYKADSLKIVEKCKGTTGSNHSEMAYNAMRCVISTLNDIPDEELI

SEQ ID NO: 23400 - protein, 271 aa, Diabrotica virgifera
  misc_feature: Coding regions on vcDNA: vcDNA=SeqID_3097; Strand=+; Position=133-948
  misc_feature: Homolog annotation: Hit_ID=CAA71672.1; Match level="QueryCoverage =88%, HitCoverage=84%, E-value=2e-43, Identity=42%"; Hit description =Chymotrypsin BI [Litopenaeus vannamei]
  misc_feature: Gene Ontology Annotation: Molecular function=serine-type peptidase activity; Cellular component=extracellular; Biological process =proteolysis and peptidolysis
  misc_feature: Pfam annotation: Pfam_ID=Trypsin; Match level="Score=225.1, E-value =1.3e-64, Copies=1"; Pfam description=Trypsin
MLKFSVILGLLTVSLALPSTHNEVYKLGNTNQALKIINGNPAKPHQFPYQVGMYVYTSSRSDFCGGSLISPNYVLTAAHCVDKAVRVNMVFGAHNITDPEEKSQVRLSSTSFIVHEGWDGDNINKNDIALIKLPSPVQTSKVIKTVSIAAGTNKYVNSVGNVAGWGLTKNDQTVVTPVLRYISPSILSNDDCKKVDQDYEAVILDTLLCSNPGSHKQGTCQGDSGGPLVVNGVQIGIVSFGSTDCEEGKPSIFTRVTEYHDWIAKHSDVKF

SEQ ID NO: 23401 - protein, 389 aa, Diabrotica virgifera
  misc_feature: Coding regions on vcDNA: vcDNA=SeqID_3098; Strand=+; Position=76-1245
  misc_feature: Homolog annotation: Hit_ID=XP_392189.1; Match level="QueryCoverage =100%, HitCoverage=30%, E-value=1e-175, Identity=75%"; Hit description=similar to ENSANGP00000019902 [Apis mellifera]
  misc_feature: Gene Ontology Annotation: Molecular function=proteasome endopeptidase activity; Cellular component=proteasome regulatory particle (sensu Eukarya); Biological process=ATP-dependent proteolysis
  misc_feature: Pfam annotation: Pfam_ID=PCI; Match level="Score=105.6, E-value=1.2e -28, Copies=1"; Pfam description=PCI domain
MPIENLEDQGLEKNPDLELAHCKFLLTLPEYRSDKNVHSKITEAIKKDDMAPWYELICKDAGWKLDANLLSALKAKNAEKIKLLDEAIEDAEKNLGEMEVREAYLRKAEYYSRIGDKDNAVSTFRQTYDKTVSLGHRLDIIFHLIRIGLFFMDHDLITRNIEKAKTLIEEGGDWDRRNRLKVYQGAYCMSVRDFKSAANLFLDTVSTFTSYELMDYKAFVRYTVYTSIISLPRNQLRDKVVKGSEILEVLHSEPFVKDYLFSLYNCQYAEFFTNLAEVETVLRKDYFLNPHYRFYVREMKILAYTQLLESYRSLTLQYMAEAFGVTVEYIDKELSTFIAAGRLHCKIDRVGGIVETNRPDLKNAQFNSVVKQGDLLLNRVQKLSRVINI

SEQ ID NO: 23402 - protein, 101 aa, Diabrotica virgifera
  misc_feature: Coding regions on vcDNA: vcDNA=SeqID_3099; Strand=+; Position=1-303
  misc_feature: Homolog annotation: Hit_ID=XP_318823.1; Match level="QueryCoverage =92%, HitCoverage=68%, E-value=1e-20, Identity=45%"; Hit description =ENSANGP00000010228 [Anopheles gambiae]
  misc_feature: Pfam annotation: Pfam_ID=DUF953; Match level="Score=38.2, E-value =2.4e-08, Copies=1"; Pfam description=Eukaryotic protein of unknown function
RKYSTKKMVQTHVIQGYEKFQEFFKNFDSQGQKVHVLYSSPRKPDNTSWCTYCVRAWPVIDKELEATDPNSHFVRVEVGDMPIWKDPNCPFRHDPKTKLRV

SEQ ID NO: 23403 - protein, 314 aa, Diabrotica virgifera
  misc_feature: Coding regions on vcDNA: vcDNA=SeqID_3100; Strand=+; Position=91-1032
  misc_feature: Homolog annotation: Hit_ID=AAQ11697.1; Match level="QueryCoverage =95%, HitCoverage=55%, E-value=2e-57, Identity=39%"; Hit description =luciferase [Pyrophorus plagiophthalamus]
  misc_feature: Pfam annotation: Pfam_ID=AMP-binding; Match level="Score=-104.2, E -value=0.0094, Copies=1"; Pfam description=AMP-binding enzyme
  misc_feature (293)..(293): Xaa can be any naturally occurring amino acid
MVKDNASFEISGPQPHEALKNETLGQAFLRVLLENPYGHKIMIDSHTGRDLTSQKLLEESCQLAEALRVYGCTSNTAICIGSENNLEFFVPIMASIFAGTIMAPLNVNYTDQELKHTLNITKPILAFCSKRVTQRYLTLQREMKFIEKIIVIDSEEEIEGTETMKSFINRLLQGRIVSPQKFIPFDGDPKENVAFVLCSSGTTGLPKGVMLTHFNVVTRLLQSRYPDYLSHHSIVLGLMPFFHSYGLFFGLTSFFNRHLTIMMDKFEEDSFLKALQDYKVSVVRLAPPLAIFXAKSPKVSKYDLSSVAEYSQRE

SEQ ID NO: 23404 - protein, 145 aa, Diabrotica virgifera
  misc_feature: Coding regions on vcDNA: vcDNA=SeqID_3101; Strand=+; Position=483-917
  misc_feature: Pfam annotation: Pfam_ID=zf-C2H2; Match level="Score=20.4, E-value =0.0057, Copies=1"; Pfam description=Zinc finger, C2H2 type
LQIHRTERMVVCICGTNFATQAGIDTHLRRLRCRGPQTGNDDICNICARTFKSYAGVRQHMRTAHPDEYNGELERKYEKPGRLTRITGEDQIRMSELEIQYEGRWVRKYLEEQFPHFTRDQIRRTRARPSYQELPRRLREDRGRT

SEQ ID NO: 23405 - protein, 291 aa, Diabrotica virgifera
  misc_feature: Coding regions on vcDNA: vcDNA=SeqID_3102; Strand=+; Position=2-877
  misc_feature: Homolog annotation: Hit_ID=NP_788547.1; Match level="QueryCoverage =100%, HitCoverage=66%, E-value=1e-153, Identity=92%"; Hit description=CG5605-PG, isoform G [Drosophila melanogaster] ref|NP _730520.1| CG5605-PF, isoform F [Drosophila
  misc_feature: Gene Ontology Annotation: Biological process=protein biosynthesis
  misc_feature: Pfam annotation: Pfam_ID=eRF1_3; Match level="Score=252.9, E-value =5.5e-73, Copies=1"; Pfam description=eRF1 domain 3
FIVMDGNGALFGTLQGNTREVLHKFTVDLPKKHGRGGQSALRFARLRMEKRHNYVRKVAEVATQLFITNDKPNIAGLILAGSADFKTELSQSDMFDPRLQAKVIKLVDVSYGGENGFNQAIELAAESLQNVKFIQEKKLIGRYFDEISQDTGKYCFGVEDTLRGLELGAVETLICWENLDIQRYVLKNHATGSETILHLTPEQEKDKSHFSDKETGVELELVECQPLLEWLANNYKNFGATLEIITDKSQEGSQFVRGFGGIGGLLRYKVDFQSLQLDDMDNGEEFDLDDY

SEQ ID NO: 23406 - protein, 314 aa, Diabrotica virgifera
  misc_feature: Coding regions on vcDNA: vcDNA=SeqID_3103; Strand=+; Position=323-1268
  misc_feature: Homolog annotation: Hit_ID=NP_788547.1; Match level="QueryCoverage =98%, HitCoverage=70%, E-value=1e-168, Identity=97%"; Hit description= CG5605-PG, isoform G [Drosophila melanogaster] ref|NP_730520.1| CG5605-PF, isoform F [Drosophila
  misc_feature: Gene Ontology Annotation: Biological process=protein biosynthesis
  misc_feature: Pfam annotation: Pfam_ID=eRF1_2; Match level="Score=256.9, E-value =3.5e-74, Copies=1"; Pfam description=eRF1 domain 2
  misc_feature (302)..(302): Xaa can be any naturally occurring amino acid
MSGEETSADRNVEIWKIKKLIKSLELARGNGTSMISLIIPPKDQISRVSKMLADEFGTASNIKSRVNRLSVLGAITSVQHRLKLYTKVPPNGLVIYCGTIVTDEGKEKKVNIDFEPFKPINTSLYLCDNKFHTEALTALLADDNKFGFIVMDGNGALFGTLQGNTREVLHKFTVDLPKKHGRGGQSALRFARLRMEKRHNYVRKVAEVATQLFITNDKPNIAGLILAGSADFKTELSQSDMFDPRLQAKVIKLVDVSYGGENGFNQAIELAAESLQNVKFIQEKKLIGRYFDEITQKTGKNXFGVEKTLKGFGN

SEQ ID NO: 23407 - protein, 135 aa, Diabrotica virgifera
  misc_feature: Coding regions on vcDNA: vcDNA=SeqID_3104; Strand=-; Position=2-406
GDAHLQQVYKAQLRSRCQRTSENLQEFEADVARVVRLAYPEAPDSILEEIAVDTFINGLKESELQKALRLARPKVLDEALAIALEHETASQTSRSHRVRTIEESDEHNDEPLEEMIRRVVRTEMPKRREPRSWNC

SEQ ID NO: 23408 - protein, 40 aa, Diabrotica virgifera
  misc_feature: Coding regions on vcDNA: vcDNA=SeqID_3105; Strand=+; Position=1-123
IRHELVPNGTKHDPHGGGGGGYFKILNRNSFFYFTFGFFA

SEQ ID NO: 23409 - protein, 356 aa, Diabrotica virgifera
  misc_feature: Coding regions on vcDNA: vcDNA=SeqID_3106; Strand=+; Position=88-1158
  misc_feature: Homolog annotation: Hit_ID=AAK26174.1; Match level="QueryCoverage =81%, HitCoverage=95%, E-value=7e-48, Identity=41%"; Hit description =anterior fat body protein [Calliphora vicina]
  misc_feature: Gene Ontology Annotation: Cellular component=nucleus
  misc_feature: Pfam annotation: Pfam_ID=SMP-30; Match level="Score=235.0, E-value =1.4e-67, Copies=1"; Pfam description=Senescence marker protein-30 (SMP-30)
MWRFLCLVFVIFRVGSADLGPCVHQVTSPVGHAEGPHWDARRNILYFVNIPDGEVYAYHYNSKILKKITLSGTASPVVPSRKDPNLLIVGVNRSVVAVEWDGKNKLGGQQVLTTLSHQFPGSRLNDGKADKQGRLWWGTIGPEVNLVVASDQGLFYTITRENLNDPKVAVQPVTNSNGLAWNKANNKLYYIDTPTLKVVSFDYHDGNGTISSTNQTVFDLRSTHNVTGLPDGMTIDTEDNLYIALFGGGSVIKVNPATGKLLKVIAIPARDVSSVMWGGPNLDILFVTTSDRNLSPSERIQYPAAGSVFAVTGLKAKGFEAHTADIIDEIAQTEGVWDIVINTFRNFFPLNYNGMY

SEQ ID NO: 23410 - protein, 47 aa, Diabrotica virgifera
  misc_feature: Coding regions on vcDNA: vcDNA=SeqID_3107; Strand=+; Position=3-146
CPDTCFWVYSLTKRLYKKTELNQITPTRWFYLNIVLKLFSCGIFAIN

SEQ ID NO: 23411 - protein, 365 aa, Diabrotica virgifera
  misc_feature: Coding regions on vcDNA: vcDNA=SeqID_3108; Strand=+; Position=86-1180
  misc_feature: Homolog annotation: Hit_ID=XP_396873.1; Match level="QueryCoverage =96%, HitCoverage=78%, E-value=1e-142, Identity=63%"; Hit description= similar to ENSANGP00000011321 [Apis mellifera]
  misc_feature: Pfam annotation: Pfam_ID=Metallophos; Match level="Score=78.9, E -value=1.4e-20, Copies=1"; Pfam description=Calcineurin-like phosphoesterase
  misc_feature (310)..(310): Xaa can be any naturally occurring amino acid
  misc_feature (351)..(351): Xaa can be any naturally occurring amino acid
MWGKIFFCFSFIQVSLSVYYYQPEQIHIAYGNNIYDIVVTWSTFDDTKQSLVEYGIGGLVLTANGTSSLFVDGGKEQRSQHIHSVVLKNLTPGSTYLYHCGSDLGWSNIFTFKTAPNSPDWQPHLAVYGDMGNDNAKSLTRLQEETQRGLYDAILHVGDFAYDMDSDNALIGDEFMRQIEPVAAYVPYMTCPGNHEEAYNFSNYRYRFSMPGGLNSPMYSINIGPMHIISISTEVYYFLDYGIKPLVFQYEWLEQDLATANLPENREKQPWIIVMGHRPMYCSNTDHDDCTHHETITRVGLPFLQFFGLXNLLYNYGVDLAIWAHEHSYEKAVAVYNYTVYNGSYEQPYVXPGAPVQFTTGSAGC

SEQ ID NO: 23412 - protein, 553 aa, Diabrotica virgifera
  misc_feature: Coding regions on vcDNA: vcDNA=SeqID_3109; Strand=-; Position=304-1965
  misc_feature: Homolog annotation: Hit_ID=AAS89976.1; Match level="QueryCoverage =99%, HitCoverage=97%, E-value=2e-74, Identity=29%"; Hit description =peritrophin membrane protein 1 [Spodoptera frugiperda]
  misc_feature: Gene Ontology Annotation: Molecular function=chitin binding; Biological process=cytokinesis after mitosis
  misc_feature: Pfam annotation: Pfam_ID=CBM_14; Match level="Score=389.4, E-value =4.7e-114, Copies=6"; Pfam description=Chitin binding Peritrophin-A domain
TNSTPAPNSCQKEGVVCPAVDGPDSVYFPLRDCTKFCQCSNDVPYEHACPAGLHFNPKLNVCDWPQNAGCGGSDPVTTEQTATPTQDSGHNTNPTPAPNSCQKENVVCPAVDGPDSVYFPLSDCTKFCQCSNGVPYEHNCPAGLHFNPKLNVCDWPQNAGCGGSDPVTTEQTVTQTQDSGNNTNPTPAPNACQKEGVVCPAVDGPDSVYFPLSDCTKFCQCSNGVPYEHACPAGLHFNPKLNVCDWPQNAGCAGSDPVTTEQTVTTTQDSGNNTNPTPAPSSCQKEGVVCPAVDGPDSVYFPLSDCTKFCQCSNGVPYEHACPAGLHFNPKLNVCDWPQNAGCGGSDPVTTEQTVTPTQDSGNNTNPTPAPNSCQKEGVVCPAVDGPDSVYFPLRDCTKFCQCSNGVPYEHACPAGLHFNPKLNVCDWPQNAGCGGSDPVTTEQTITPTQDSGNNTNSTPAPNSCQKEGVVCPAVDGPDSVYFPLSDCTKFCQCSNGVPYEHDCPAGLHFNPKLNVCDWPQNAGCGGSDPVTTEQTVTQTQDSGNNTNPNSSS

SEQ ID NO: 23413 - protein, 242 aa, Diabrotica virgifera
  misc_feature: Coding regions on vcDNA: vcDNA=SeqID_3110; Strand=+; Position=121-849
  misc_feature: Homolog annotation: Hit_ID=EAA13868.2; Match level="QueryCoverage =93%, HitCoverage=93%, E-value=4e-56, Identity=45%"; Hit description =ENSANGP00000022215 [Anopheles gambiae str. PEST] ref|XP_553452.1| ENSANGP00000022215 [Anopheles gambiae st
  misc_feature: Gene Ontology Annotation: Molecular function=signal transducer activity; Cellular component=integral to membrane; Biological process=N-linked glycosylation
  misc_feature: Pfam annotation: Pfam_ID=Tetraspannin; Match level="Score=207.9, E -value=2e-59, Copies=1"; Pfam description=Tetraspanin family
MDCAMCMRGYSRYMLILFNFIFVITGIVIISVGLSSKAYFNEFDQLMDNKYFYISDFLIVIGVVIFFIAFFGCCGAMKENACMTTTYSTLLVIIFILELAVGITAVVLKGKTEEFLADKLEETMHTYNNHSFNETTVVWDTIQSQFQCCGVHNFTDWKNVPAVNYTTGLPLSCCKIPAGSTQFTCNPIFAYHKGCLEKFGDFVKQNISYVEGVGIGLAVIQLLGILFSCCLSKFIRSDYETV

SEQ ID NO: 23414 - protein, 234 aa, Diabrotica virgifera
  misc_feature: Coding regions on vcDNA: vcDNA=SeqID_3111; Strand=+; Position=23-727
MELLQFFTVVFFVVFVKASDLDDARKILDCAQKALKVGVPDLDLPSYNPLDYDKDIPYFKDLAGELYFLYHNTQVYGIPDWQVKEINQINQDSDAFAVFNFSLTFQQLNASSNFDLNMTDFFFQTEYNGTQTLKLFNNEWTGSINVTKPNQDSVEQINDLQISWRAQRLLPVVHTNPSGYESLFASVYNYTIMTALSKPNTFVGDFLQEKLNTDWWLNGKIWKLVQWCEDNEYI

SEQ ID NO: 23415 - protein, 57 aa, Diabrotica virgifera
  misc_feature: Coding regions on vcDNA: vcDNA=SeqID_3112; Strand=+; Position=3-176
  misc_feature: Homolog annotation: Hit_ID=AAH87512.1; Match level="QueryCoverage =96%, HitCoverage=20%, E-value=7e-23, Identity=89%"; Hit description =Unknown (protein for MGC:99368) [Xenopus laevis]
  misc_feature: Gene Ontology Annotation: Molecular function=molecular_function unknown; Cellular component=cellular_component unknown; Biological process=biological_process unknown
HTLRGLFIIDTKGVVRQITMNDLPVGRSVDETIRLVQAFQFTDQNGEVCPAGWKPKH

SEQ ID NO: 23416 - protein, 380 aa, Diabrotica virgifera
  misc_feature: Coding regions on vcDNA: vcDNA=SeqID_3113; Strand=+; Position=182-1324
  misc_feature: Homolog annotation: Hit_ID=NP_005189.2; Match level="QueryCoverage =96%, HitCoverage=91%, E-value=5e-85, Identity=45%"; Hit description =choline/ethanolamine kinase isoform a [Homo sapiens] gb|AAH82263.1| Choline/ethanolamine
  misc_feature: Gene Ontology Annotation: Molecular function=choline kinase activity; Cellular component=cytosol; Biological process=phosphatidylcholine biosynthesis
  misc_feature: Pfam annotation: Pfam_ID=Choline_kinase; Match level="Score=240.5, E -value=3.1e-69, Copies=1"; Pfam description=Choline/ethanolamine kinase
MLDIVPKNKPAAGDCFEMKELTARICRDYLQGAWKKVNAKNIGFKHISGGLSNHLFHVSLPDSLKTADANVEHEPKDVLIRVYGQTHGEGALEALITESVIFTLLSERNLGPKLHGIFPGGRIEQYIDARPLLTKELSDERLSVSIAKKMAAIHSMEVPLHKAPEWIWNTLDRWLNSLKNMQLTNMPESTKHILEKVNFGSEIEWLRTRLEGENSPVVFCHNDMQVGNILLPRDAELENNNDEEPKLVIIDFEYCSYNYRSFDIANHFLEWVYDYTLKEYPFYSEDHSKYPTEKQRLAFIRAYLRERGSRENPKKILREVEVFTLAPHLFWSVWALINAETSSIPFGYWEFANTRLNSYFQLKQKLSSQQLKRKMDELIV

SEQ ID NO: 23417 - protein, 145 aa, Diabrotica virgifera
  misc_feature: Coding regions on vcDNA: vcDNA=SeqID_3114; Strand=+; Position=26-463
  misc_feature: Homolog annotation: Hit_ID=XP_316940.1; Match level="QueryCoverage =90%, HitCoverage=61%, E-value=3e-37, Identity=54%"; Hit description =ENSANGP00000023691 [Anopheles gambiae] gb|EAA43818.1| ENSANGP00000023691 [Anopheles gambiae
  misc_feature: Pfam annotation: Pfam_ID=FUN14; Match level="Score=97.0, E-value=5e -26, Copies=1"; Pfam description=FUN14 family
MPVIINIENPSSSDRSKKAMDDVEGAKSAIKRFIGDVSKSSATKQIILGASSGWVTGFLSMRVGKTAAMALGGGIILLQIANEKGYIKVNWDKVNRNLDQVADKVEEQLTGEAVSWMDKVKHFARNNTPFSSGFVGGFLIGLASN

SEQ ID NO: 23418 - protein, 174 aa, Diabrotica virgifera
  misc_feature: Coding regions on vcDNA: vcDNA=SeqID_3115; Strand=+; Position=39-563
  misc_feature: Homolog annotation: Hit_ID=XP_316939.1; Match level="QueryCoverage =92%, HitCoverage=67%, E-value=4e-49, Identity=54%"; Hit description =ENSANGP00000019299 [Anopheles gambiae]
  misc_feature: Pfam annotation: Pfam_ID=FUN14; Match level="Score=96.2, E-value=8.5e- 26, Copies=1"; Pfam description=FUN14 family
MPVIIKKENPSSSDRSKKAMDDVEGAKSAIKRFIGDVSKSSATKQIILGASSGWVTGFLSMRVGKTAAMALGGGIILLQIANEKGYIKVNWDKVNRNLDQVADKVEEQLTGEAVSWMDKGERFVDRKLDQAKDIAKKGQKKAKRWYSGENCQLREVHIFMISFVAGVAIGIGTA

SEQ ID NO: 23419 - protein, 66 aa, Diabrotica virgifera
  misc_feature: Coding regions on vcDNA: vcDNA=SeqID_3116; Strand=+; Position=222-422
ELRMFLSQARCLALRLTVPVPHQNVPINRSGGKLVPPSAILLAGLGVGVSSFSLKQMLQSKRPKLL

SEQ ID NO: 23420 - protein, 189 aa, Diabrotica virgifera
  misc_feature: Coding regions on vcDNA: vcDNA=SeqID_3117; Strand=+; Position=2-571
  misc_feature: Homolog annotation: Hit_ID=AAP57194.1; Match level="QueryCoverage =93%, HitCoverage=82%, E-value=7e-76, Identity=77%"; Hit description =ferritin [Leptinotarsa decemlineata]
  misc_feature: Gene Ontology Annotation: Molecular function=ferrous iron binding; Cellular component=ferritin complex; Biological process=iron ion homeostasis
  misc_feature: Pfam annotation: Pfam_ID=Ferritin; Match level="Score=155.7, E-value =1.1e-43, Copies=1"; Pfam description=Ferritin-like domain
MGEHGALGEWLYDKNNVCVKKMRGQVEEELKASMQYMAMGAYFARDTVNRPGFADLFFKSASEEREHAIKLIHYLLMRGELTSSISDLIKRNLAPAQTTWENGVSALKHALKLEASVTRKIRDVIQVCEDGSNFNDYHLVDYLTGDFLEEQYHGQRDLAGKVSNLQKMMGEHGALGEWLYDKKLQGASS

SEQ ID NO: 23421 - protein, 212 aa, Diabrotica virgifera
  misc_feature: Coding regions on vcDNA: vcDNA=SeqID_3118; Strand=+; Position=216-854
  misc_feature: Homolog annotation: Hit_ID=AAP57194.1; Match level="QueryCoverage =97%, HitCoverage=97%, E-value=4e-88, Identity=74%"; Hit description =ferritin [Leptinotarsa decemlineata]
  misc_feature: Gene Ontology Annotation: Molecular function=ferrous iron binding; Cellular component=ferritin complex; Biological process=iron ion homeostasis
  misc_feature: Pfam annotation: Pfam_ID=Ferritin; Match level="Score=155.7, E-value =1.1e-43, Copies=1"; Pfam description=Ferritin-like domain
MKSVAVFVFLACFAGLQAVQLKCAHQELDIPKDWIDMNNVCVKKMRGQVEEELKASMQYMAMGAYFARDTVNRPGFADLFFKSASEEREHAIKLIHYLLMRGELTSSISDLIKRNLAPAQTTWENGVSALKHALKLEASVTRKIRDVIQVCEDGSNFNDYHLVDYLTGDFLEEQYHGQRDLAGKVSNLQKMMGEHGALGEWLYDKKLQGASS

SEQ ID NO: 23422 - protein, 291 aa, Diabrotica virgifera
  misc_feature: Coding regions on vcDNA: vcDNA=SeqID_3119; Strand=+; Position=56-931
  misc_feature: Homolog annotation: Hit_ID=XP_309520.1; Match level="QueryCoverage =95%, HitCoverage=93%, E-value=1e-102, Identity=63%"; Hit description= ENSANGP00000012620 [Anopheles gambiae]
  misc_feature: Gene Ontology Annotation: Molecular function=spermidine synthase activity; Cellular component=cellular_component unknown; Biological process=cell organization and biogenesis
  misc_feature: Pfam annotation: Pfam_ID=Spermine_synth; Match level="Score=381.3, E -value=1.3e-111, Copies=1"; Pfam description=Spermine/spermidine synthase
MDQVKNGWFSEISELWPGQCFSLKVKEVLYKEKSEYQDILIFESTNNGTALVLDGIIQCTQKDEFSYQEMLTFLALCCHDNPQRVLIVGGGDGGVAREVQKHPLVKEIVQVEIDEKVVNASKKHLPFMAKGFDSAKLTLKICDGFEYMKKHKNEFDVIITDSSDPIGPAVNLFTESYYKLAKEALKPNGIISCQAGTVWSDLPHVKKTLTNCRKHFKTVRYGFSTIPSYPDGQIGYLVASTDGSNDLRTPKFKFTQEQLDNLNLRFYNDEMHSAAFVLPNFVKRELRELAE

SEQ ID NO: 23423 - protein, 789 aa, Diabrotica virgifera
  misc_feature: Coding regions on vcDNA: vcDNA=SeqID_3120; Strand=+; Position=153-2522
  misc_feature: Homolog annotation: Hit_ID=BAC65324.1; Match level="QueryCoverage =100%, HitCoverage=100%, E-value=0.0, Identity=82%"; Hit description =hypothetical protein [Antheraea yamamai]
  misc_feature: Gene Ontology Annotation: Molecular function=iron ion binding; Cellular component=mitochondrion; Biological process=citrate metabolism
  misc_feature: Pfam annotation: Pfam_ID=Aconitase; Match level="Score=873.3, E-value= 9.6e-260, Copies=1"; Pfam description=Aconitase family (aconitate hydratase
MASCIRIISRTSNSKSLMFSEIQSRCFHVSPLAAAAAKVAMSKLDTDPIPYEKLNKTLGVVKKRLGRPLTLSEKVLYSHIDQPESQDIQRGTSYLRLRPDRVAMQDATAQMAMLQFISSGLKRVAVPSTIHCDHLIEAQIGGPQDLARAKDINKEVYNFLASAGNKYGVGFWKPGSGIIHQIILENYAFPGLLMIGTDSHTPNGGGLGGLCIGVGGADAVDVMANIPWELKCPKVIGVKLTGKLSGWTSPKDIILKVADILTVKGGTGAIIEYHGPGCESVSCTGMATICNMGAEIGATTSLFPFNNRMADYLSATRRGDIANEAQKYKESLLSPDKGAEYDELIEINLDTLEPHVNGPFTPDLASPISKLGANANKNGWPVDIRVGLIGSCTNSSYEDMGRCASIAKEAMKHGIKSKIPFNVTPGSEQIRATIERDGISKTLTEFGGTVLANACGPCIGQWDRKDVKKGEKNTIVTSYNRNFTGRNDANPATHCFVTSPELVTALSIAGRLDFNPLTDSLKGSDGKSFKLTAPFGDELPSKGFDPGQDTYAAPVADGSNVKVDVDVKSQRLQLLEPFDKWDGKDLDDMTILIKVKGKCTTDHISAAGPWLKYRGHLDNISNNMFITATNAENGELNKIKNQTTGQWGAVPDVARDYKAKGIRWVTIGDENYGEGSSREHAALEPRHLGGRAIIVKSFARIHETNLKKQGMLPLTFANASDYDKIQPTDKISLKDLKNLSPGKPVDCEVKHADGSVDKIKLNHSMNDLQISWFRAGSALNRMKEIAAGK

SEQ ID NO: 23424 - protein, 43 aa, Diabrotica virgifera
  misc_feature: Coding regions on vcDNA: vcDNA=SeqID_3121; Strand=-; Position=72-203
RYYLCDRRIKCFDITKYLSTIYYIGYLKYFGGDKDFRPIVKRS

SEQ ID NO: 23425 - protein, 481 aa, Diabrotica virgifera
  misc_feature: Coding regions on vcDNA: vcDNA=SeqID_3122; Strand=+; Position=3-1447
  misc_feature: Homolog annotation: Hit_ID=XP_319323.1; Match level="QueryCoverage =98%, HitCoverage=42%, E-value=0.0, Identity=86%"; Hit description =ENSANGP00000012364 [Anopheles gambiae]
  misc_feature: Gene Ontology Annotation: Molecular function=ATP citrate synthase activity; Cellular component=citrate lyase complex; Biological process=ATP catabolism
  misc_feature: Pfam annotation: Pfam_ID=Ligase_CoA; Match level="Score=186.0, E -value=8.1e-53, Copies=1"; Pfam description=CoA-ligase
  misc_feature (14)..(14): Xaa can be any naturally occurring amino acid
VRFGGVKPGCFKIXGTLGGMMDNILHSKLYRPGSVAYVSRSGGMSNELNNIVSKATDGVYEGVAIGGDRYPGTTFMDHIMRYQADDNVKMIILLGEVGGTEEYQVCKALQTKQITKPLVAWCIGTCAGMFTSEVQFGHAGSCANSNQETATAKNEALKAAGAHVPDSFHYLGDIVGKVYEQLVKQGVIVPRPEGPPPTVPMDYSWARELGLIRKPASFMTSICDERGQELIYAGMPISDVLQKNVGIGGVISLLWFQRCLPPYACKFFEMCLMVTADHGPAVSGAHNTIVCARAGKDLVSSLVSGLLTIGDRFGGALDGAAKMFSEAYDKGMHPAEFVNHMRNIGQLIMGIGHRVKSINNPDQRVKIVKEFVMANFPATPLLQYALEVEKITTSKKPNLILNVDGVIACSFVDMLRNCGVFTPEEAQEYIDIGAINSLFVLGRSIGFIGHYMDQKRLKQGLYRHPWDDISYVLPEQYNNDN

SEQ ID NO: 23426 - protein, 198 aa, Diabrotica virgifera
  misc_feature: Coding regions on vcDNA: vcDNA=SeqID_3123; Strand=+; Position=3-599
  misc_feature: Homolog annotation: Hit_ID=XP_313587.1; Match level="QueryCoverage =96%, HitCoverage=26%, E-value=1e-52, Identity=57%"; Hit description =ENSANGP00000003537 [Anopheles gambiae]
TVLMAPEISFQVPGTFSILNYTKSDLWAAATIAYEIFGARNPFYKSNDQIYLKSSGYKEEDLPALPTEAPYIIKMLIKNLLQRKPNKRLNPEVAANVCQLYLWAPSSWLKAEARKLPSSAEILQWLLSLTTKILCEGRIANRRFSQSAQPDSEQANMEKGGRRTYPEYLLISSFLVRAKLSNIKSALAWIQEVNCVDF

SEQ ID NO: 23427 - protein, 120 aa, Diabrotica virgifera
  misc_feature: Coding regions on vcDNA: vcDNA=SeqID_3124; Strand=+; Position=194-556
KYALLFEIIKKFKYFKPTPPLSLPVSFLIRKYVVASCNLIDYLGPIMSSCAGISNQLCTLFGPTIILDILLWIYVAFNFHSSQAFSSSSYMSKISQYLLVDSICGFGQSSFDVVFLLLNY

SEQ ID NO: 23428 - protein, 62 aa, Diabrotica virgifera
  misc_feature: Coding regions on vcDNA: vcDNA=SeqID_3125; Strand=-; Position=441-629
NLYCVYFIKLYCVIYFKYSIYSRASIIRTNWYRGSSDYQIVRIIEHMFKIIHTKFINLVHMY

SEQ ID NO: 23429 - protein, 80 aa, Diabrotica virgifera
  misc_feature: Coding regions on vcDNA: vcDNA=SeqID_3126; Strand=-; Position=428-670
SHGTTLLTIHKHIFYLQNFLIPINFFVCISFDLHKLYKIWQLWAQYNPCRQRRVFDRRISFAPKSVLARAKRERFYEHYM

SEQ ID NO: 23430 - protein, 133 aa, Diabrotica virgifera
  misc_feature: Coding regions on vcDNA: vcDNA=SeqID_3127; Strand=+; Position=250-651
SLLSINKLNLRGSERIFGCNAIQMGIHFFQILRKLISSLEGFKRGMKDYVIGEGRKSLRTSTMFILISYRGEKTKRKFSVIFKFKYLIQNKLFIYSKGFSALGNDLVFHSAFEFFKNIYWFFQDLKKMNTMPW

SEQ ID NO: 23431 - protein, 99 aa, Diabrotica virgifera
  misc_feature: Coding regions on vcDNA: vcDNA=SeqID_3128; Strand=+; Position=231-530
RKSFPKIPNKIMIVQKPTQKTIPALRLPRDCAKIFFYFIPDVSGDEYSSGSKWLKDTNPLLIWVINLMELGNKLEVKLPIKTGQDPLKEVLFFFSVPKT

SEQ ID NO: 23432 - protein, 259 aa, Diabrotica virgifera
  misc_feature: Coding regions on vcDNA: vcDNA=SeqID_3129; Strand=+; Position=582-1361
  misc_feature: Homolog annotation: Hit_ID=CAD33827.1; Match level="QueryCoverage =98%, HitCoverage=76%, E-value=1e-127, Identity=87%"; Hit description= glyceraldehyde-3-phosphate dehydrogenase [Plutella xylostella]
  misc_feature: Gene Ontology Annotation: Molecular function=glyceraldehyde 3 -phosphate dehydrogenase (phosphorylating) activity; Cellular component=cytoplasm; Biological process=glycolysis
  misc_feature: Pfam annotation: Pfam_ID=Gp_dh_C; Match level="Score=415.0, E-value =9.2e-122, Copies=1"; Pfam description=Glyceraldehyde 3-phosphate dehydrogen
QRRDPAAIPWGKAGADYVVESTGVFTTIEKAKKHLDGGAKKVIISAPSADAPMYVCGVNLDAYNPADPVISNASCTTNCLAPLAKVIHDNFEIVEGLMTTVHATTATQKTVDGPSGKLWRDGRGAGQNIIPASTGAAKAVGKVIPSLNGKLTGMAFRVPVPNVSVVDLTVRLGKPASYDQIKAKVKEAAEGPLKGILGYTDEEVVSNDFVGDTHSSVFDAKAGIQLNDKFVKLISWYDNEYGYSNRVVDLITYIDTKKA

SEQ ID NO: 23433 - protein, 216 aa, Diabrotica virgifera
  misc_feature: Coding regions on vcDNA: vcDNA=SeqID_3130; Strand=+; Position=111-761
  misc_feature: Homolog annotation: Hit_ID=AAD54937.1; Match level="QueryCoverage =97%, HitCoverage=95%, E-value=2e-48, Identity=46%"; Hit description =glutathione S-transferase 6A [Musca domestica]
  misc_feature: Gene Ontology Annotation: Molecular function=glutathione transferase activity; Cellular component=cellular_component unknown; Biological process=glutathione conjugation reaction
  misc_feature: Pfam annotation: Pfam_ID=GST_N; Match level="Score=67.7, E-value=3.2e- 17, Copies=1"; Pfam description=Glutathione S-transferase, N-terminal
MAPKLYCSEVSPAVRSTLLTIKALGLDVELVPMNLATGEHLTPDYLKLNPLHTVPTLQDGDFVVWDSHAINIYLIEKYHPETDLYPKCNQARATIHQRLFFDAGILFARMADIVKSVVREGAKMVSKDRADKVIEGYSFLEALLEMNKYVAGDHVTIADFSLVTTTASCNVVVPIASNRYPKISEWLANMEQLPYYKEAVQAGLDMFTGMMKSKLA

SEQ ID NO: 23434 - protein, 89 aa, Diabrotica virgifera
  misc_feature: Coding regions on vcDNA: vcDNA=SeqID_3131; Strand=+; Position=54-320
  misc_feature (63)..(63): Xaa can be any naturally occurring amino acid
NRPRDHDDQTTKSRRRQTSGGEGEDKNRRGNKNHSNDNHDLAGYKTVSKTIEVKTTLPSDSKXSEPVSSPQETHVSITTIVTETRTIQP

SEQ ID NO: 23435 - protein, 94 aa, Diabrotica virgifera
  misc_feature: Coding regions on vcDNA: vcDNA=SeqID_3132; Strand=+; Position=29-313
LTLVSLTMNFKRAPHFQRSYFGKVYRSPKCPSLHTRSTSRGTHSRRAIRTRTSIPLSRSQYRHRMEVDRGAAKSHKVTVYTLVLDELRSTSRVV

SEQ ID NO: 23436 - protein, 79 aa, Diabrotica virgifera
  misc_feature: Coding regions on vcDNA: vcDNA=SeqID_3133; Strand=+; Position=2-241
  misc_feature: Homolog annotation: Hit_ID=NP_572978.1; Match level="QueryCoverage =92%, HitCoverage=11%, E-value=5e-13, Identity=51%"; Hit description =CG9519-PA [Drosophila melanogaster] gb|AAF48397.2| CG9519-PA [Drosophila melanogaster]
SRSLTSTLYHPSTTTKMGTSESNSVVDVNMKVHGISNLRVVDAGSMPKLVRGHPLAVIWAMAEKIADAIKEKYINNLEV

SEQ ID NO: 23437 - protein, 233 aa, Diabrotica virgifera
  misc_feature: Coding regions on vcDNA: vcDNA=SeqID_3134; Strand=+; Position=135-833
  misc_feature: Homolog annotation: Hit_ID=AAH74241.1; Match level="QueryCoverage =75%, HitCoverage=62%, E-value=3e-71, Identity=67%"; Hit description =MGC83977 protein [Xenopus laevis]
  misc_feature: Pfam annotation: Pfam_ID=zf-C3HC4; Match level="Score=72.3, E-value =1.3e-18, Copies=1"; Pfam description=Zinc finger, C3HC4 type (RING finger)
MDSVTDEQAPSNSQEDRGSNTETGVQVHTKDSARYCWVCFATDEEDRTAAWVQPCNCRGTTKWVHQACLQRWVDEKQKGGNLGKVTCPQCQTEYIIVFPNMGVLVLVLDTVDSFIYKGCPFLAAGIVVGAIYWCAVTYGAITIMQVIGQKEGLAIMEQADPLVLLIGLPAIPVALVLGKMIRWEDAVLTFMRKNLSKIPIIRNVFPFSECTRLEMNASSSETSNNEDIPPLSN

SEQ ID NO: 23438 - protein, 435 aa, Diabrotica virgifera
  misc_feature: Coding regions on vcDNA: vcDNA=SeqID_3135; Strand=+; Position=1-1452
  misc_feature: Homolog annotation: Hit_ID=NP_608540.1; Match level="QueryCoverage =100%, HitCoverage=66%, E-value=8e-47, Identity=24%"; Hit description= CG2839-PA [Drosophila melanogaster] gb|AAF51469.2| CG2839-PA [Drosophila melanogaster]
  misc_feature: Gene Ontology Annotation: Molecular function=pre-mRNA splicing factor activity; Cellular component=nuclear matrix; Biological process =histogenesis and organogenesis
KDSPRKKRSTSRRRSDSRRRSASRRRSPSRGRRSPSRDRRRRSMSRGRPSPRRGPGGPRGSYGRRSRSRNRRGNSRQRRSSPRRRSRSHSRNRFRRSRSRNRNAYRRPSPSRDRRMSRDRRSRSRRRSRERGSVRRRSPPRDRSRPRRPSPSPQKRDNRNQGRPRKDDRHPEPPPKKVEEARRRIEEEINRHEKKEREEGERKKKAEAAAAEERSRKEKEREKEKKKSRSITSKEKPEAKPKKVTKKPPKSESESSSESESDEDTRKDKRKVRTKKKPKKRDSSSSESEDERSSREVEVKKKKKKKKRDSSEEKSSKKRHQSSDSEEDKKKKKRRSKSSEKSKKSKRDTSESDVPAKKKKSRQDSSDESEKEKSRKHKKEKDSSSESDDDSSKKRKHKKKATKSVSDSDEEQEVKKKKRDKKHKKKKKHTKKHKK

SEQ ID NO: 23439 - protein, 93 aa, Diabrotica virgifera
  misc_feature: Coding regions on vcDNA: vcDNA=SeqID_3136; Strand=+; Position=3-284
HASGNCDSIVNYSNMEPLAIIIPVYSVVLLMLLLQILWAFKIKKKLYKMIDEGYYFLELETGWGRKILKPIPPGNVDLSSGSPRLISNIIIRQ

SEQ ID NO: 23440 - protein, 291 aa, Diabrotica virgifera
  misc_feature: Coding regions on vcDNA: vcDNA=SeqID_3137; Strand=+; Position=1-876
PLHASYYIKMYRLLTVLLVVSSSLAFPAKEEISTKNSNVRFYEAANKTPFSTDNITIDYSTNEEFGLNITAISRVNNLEDFLLLVSNLTHNVSILNIGQLSFGQSSKHKLNPFEKNAYVVAETVSTFSVSKEGDLVLNASAGTVQSLKLVTDFTDLQKRPRIEYNLTVVTEVNMTWITKSGPLKNKVTNLPSHISDPQPYTTPNFTALVPLVNGTFNDESSCRNEICKSTSKSSYNTGSYYVFDDITVTFERYISKPNITSTRFENGSNTTYAVISTTDVKTVIVVGPHRC

SEQ ID NO: 23441 - protein, 493 aa, Diabrotica virgifera
  misc_feature: Coding regions on vcDNA: vcDNA=SeqID_3138; Strand=-; Position=204-1685
  misc_feature: Homolog annotation: Hit_ID=AAF70178.1; Match level="QueryCoverage =99%, HitCoverage=99%, E-value=1e-145, Identity=52%"; Hit description= cytochrome P450 monooxigenase CYP4Q4 [Tribolium castaneum]
  misc_feature: Gene Ontology Annotation: Molecular function=fatty acid (omega-1) -hydroxylase activity; Cellular component=extracellular space; Biological process=prostaglandin metabolism
  misc_feature: Pfam annotation: Pfam_ID=p450; Match level="Score=372.2, E-value=6.8e- 109, Copies=1"; Pfam description=Cytochrome P450
MIVLLIAAVVALVYIFYRINRKDETFWKHILAIPGPKAYPILGTQVHFESAEDVFKRDRANAKAYHPIYQQHSLPFAIVNLIAPEDIELILNNSKHIEKGAFYDFLHSWLGNGLLTSKGANWHKRRKILTPAFHFNILQEFVDVFNKETNHLVELFKSKCDQPIDLIKPVTEFTLYSIGETSLGKDLREEPHCDEYKQAVYEYGDNFVYRMVRPWLFPDTFFNLTKVGRRNKEIVKVMHDFSNGIIAERYKLFKKDGTMSYSERKRLALLDLMIKAKYNGADIDDVGIREEVDTFILGGHDTTALSLCHTLMLLANNPDIQEEMYQEAISIVGDPKNPTYTELGELKYIERCIKESLRLYPSAPMISRIAGEDVKTKTGYTIPKSAIVSICIYDVHHSPDYYENPEKFDPDRFLPENSSSRHPYAYIPFSAGSRNCIGQKYAMLELKSALSGILCNFKLEAVTKPSDIIHKADIVMRPSNEVKVRFIPRTQKK

SEQ ID NO: 23442 - protein, 294 aa, Diabrotica virgifera
  misc_feature: Coding regions on vcDNA: vcDNA=SeqID_3139; Strand=-; Position=3-884
  misc_feature: Homolog annotation: Hit_ID=Q25490; Match level="QueryCoverage=93%, HitCoverage=8%, E-value=2e-25, Identity=27%"; Hit description =Apolipophorins precursor [Contains: Apolipophorin-I (APOLP-1); Apolipophorin-II (APOLP-2)]
ENKVDFKASRELVRADKSQINNELDINGLKLAVKGLITHNIKPSSVDIGADLTVVLPTHPTPFKVDSGLQYNPTDFAAHNKILSGNVVVVDAFLNANKNGNANGSVKVNIKNVLVVNGQLKSVKGVGNGHIKIDAQSLKKVVKAESDFEIQPPTLYKIVVTLYPSFDKDPNQKIILSTNSKLSPTSVDTKNSVNLLGKVLEVNLNVAKSGDAENKRYNGEVEVILPNDQYLQGKVNGAYNTRNDILNGQGQASVEYRKNKNTPGRKLSLSGKYNNVNIKEGVYDVSYNLAADDA

SEQ ID NO: 23443 - protein, 684 aa, Diabrotica virgifera
  misc_feature: Coding regions on vcDNA: vcDNA=SeqID_3140; Strand=+; Position=3-2058
  misc_feature: Homolog annotation: Hit_ID=XP_319941.1; Match level="QueryCoverage =99%, HitCoverage=28%, E-value=0.0, Identity=59%"; Hit description =ENSANGP00000016695 [Anopheles gambiae]
  misc_feature: Gene Ontology Annotation: Cellular component=mitochondrion; Biological process=polar body extrusion after meiotic divisions
  misc_feature: Pfam annotation: Pfam_ID=Thioesterase; Match level="Score=-6.3, E -value=0.00027, Copies=1"; Pfam description=Thioesterase domain
  misc_feature (328)..(328): Xaa can be any naturally occurring amino acid
SFEQMIMNQTNGRGVDCVLNSLAAHQLQASVRCLAIGGRFLEIGKVDLSNNSALGMSIFLKNTTFHGILLDALFDSDSPQKRQVMRLVTEGIKSGAVRPLPKTVYNEHQVEQAFRFMASGKHIGKVLLQIREEEPKTATRPAVKTVSAIPRTYMDPEKSYILVGGLGGFGLELANWLVTRGAKKMVLTSRSGIKTGYQSLCIRRWREKGVNVLVSTADATTDKGARRLLTEASELGPVGGIFNLAVVLRDAMMENQSEADFKTVCKPKVDGSKMLDMVSREMANNLDYFVNFSSVSCGRGNAGQANYGLANSAMERIVEARQNVGLPXIAIQWGAIGDVGLILETMGGNDTEVGGTLPQRMSSCLNTMDILLQQPHSVVASMVLADKHKGSAGGSQVSLTSAVANILGIKDPNTVAPSNTLADLGMDSLMGAEIKQTLERNYDLVLSAQEIRALTFGRLVELSDGGALPAGGAATESSPAQDNNVQFDKSADIMPKKSLVQMNSKGSDSKKAPVFVIHPIEGVVNALENLSKNIEIPVYGLQCTAETPLTSITDLAKYYISLMKSVQPKGPYTIIGYSFGASVAIEMGILLEKSKERVSLLLLDGSHSYVATHTGKAKNTKIQGNTVAEQSEVLLYFILHSRTSISKAFRRTYGPESWEERLARATSIVAEVPNTRRKILLMPH

SEQ ID NO: 23444 - protein, 155 aa, Diabrotica virgifera
  misc_feature: Coding regions on vcDNA: vcDNA=SeqID_3141; Strand=+; Position=41-508
  misc_feature: Homolog annotation: Hit_ID=AAV91350.1; Match level="QueryCoverage =97%, HitCoverage=94%, E-value=1e-23, Identity=38%"; Hit description =defense protein 1 [Lonomia obliqua]
  misc_feature: Pfam annotation: Pfam_ID=Reeler; Match level="Score=33.0, E-value =6.2e-07, Copies=1"; Pfam description=Reeler domain
MFKLLVLLSVVYYTHAYSTGAPVEVCDDMTPKHPYNPQASEIPYKFGLSKNEVKGGEQVEIAITGTFKGLLLEVREGDKAVGEWVVAANDPDFQTIDCHGNKHSAITHKNASDKSNVKLVWKAPSKVGKYVLYATVAETGERFWARKPTEVINVF

SEQ ID NO: 23445 - protein, 93 aa, Diabrotica virgifera
  misc_feature: Coding regions on vcDNA: vcDNA=SeqID_3142; Strand=+; Position=38-319
VLQYHSVLTSRYQIFTSNFIMADRDSKANTDNRATQLNANNDRFYQSRGLDSRPDNWKDTASAGGQGYTQQDRDNRSNQLNPNNDAYGKSRQN

SEQ ID NO: 23446 - protein, 430 aa, Diabrotica virgifera
  misc_feature: Coding regions on vcDNA: vcDNA=SeqID_3143; Strand=+; Position=2-1291
  misc_feature: Homolog annotation: Hit_ID=EAL29004.1; Match level="QueryCoverage =74%, HitCoverage=49%, E-value=6e-66, Identity=40%"; Hit description =GA11275-PA [Drosophila pseudoobscura]
  misc_feature: Pfam annotation: Pfam_ID=Glyco_hydro_31; Match level="Score=-231.1, E- value=0.096, Copies=1"; Pfam description=Glycosyl hydrolases family 31
SKGCHKLFTFLIFLTTLHSIRGIVVKNGNITLQLEPKSNGISFAAYDGKIKKLEGILGRGINISNVDCIGTQVCVINDSNFSVEPISAGFRLKWKTFNTRRAFQDCYDLTEGVQWYGGPTIFSLIWPIQTNEIDGSSPYVLDNGKGMPYAERYWLNSKGSYIFLDDDVPLYVDQNKLRNNSVCFKSYIRDPFHAYFNRTRNVLQYYLIFKDDVKQAHLHAVNKFLGKPKDHPNEAMVAEPIWTTWAKYKTKINDSVVLKFAKDIRNHGYEKGQIEIDDNWERCYGAEQFSHNFTNIKDTVKILKSINFRVTLWIHPFVNDNCNNNSQIGLEKGYFVIDKYGRHTGWWWNSNDAYVIDFTNPQATEWWLQRVKKLQKDFGSDSFKFDAGETDFSPQPAVYKTVDQELIPNIFSGKYLRTCATFGNFDRSED

SEQ ID NO: 23447 - protein, 169 aa, Diabrotica virgifera
  misc_feature: Coding regions on vcDNA: vcDNA=SeqID_3144; Strand=+; Position=97-606
  misc_feature: Homolog annotation: Hit_ID=BAC82199.1; Match level="QueryCoverage =78%, HitCoverage=91%, E-value=2e-44, Identity=51%"; Hit description =acaloleptin A precursor [Acalolepta luxuriosa]
  misc_feature: Pfam annotation: Pfam_ID=Coleoptericin; Match level="Score=3.6, E -value=0.0072, Copies=1"; Pfam description=Coleoptericin
MKFSAYLALLMVLAVVVSTSAKHHKKKKNWQVQPDVGRDGAGNVNAGVEVKNSGKNHDFEAGWSKVVRGPNRAKPTWHVGGTWRFKRSPDPQWEVNPGANRDENGNVNAGVELKRKGEKHDFDAGWNKVVSGPNRAKPTWHVGGTFRFKRSPVPDWQSTLGVIEMKTVT

SEQ ID NO: 23448 - protein, 283 aa, Diabrotica virgifera
  misc_feature: Coding regions on vcDNA: vcDNA=SeqID_3145; Strand=+; Position=746-1594
  misc_feature: Pfam annotation: Pfam_ID=SAP; Match level="Score=35.3, E-value=1.9e -07, Copies=1"; Pfam description=SAP domain
MLLQELTVKQLREQLEERDLDSSGLKIVLQARLEEVLTKNGEDPETFHFQSAEQAILSKLKTVSETIDDTSKINNEKFESISQKIDETSKKSDEKFENVAKKFDETSQVIKEVCRQSNEKFESVSQVIKDVCRQNDEKFEEVSRTFDKIQKSVDDSKEMLEEKIKQLETMVTNTKVLPSVNAVVLAVEEKIKELESMITDTKVQPSVHAVALDPVVKDELPRDEMSHNIRFKLPPFDGKSSWSIYLRQFEAIATANHWTEQEKAVSLTAALRGDAADILTHAS

SEQ ID NO: 23449 - protein, 249 aa, Diabrotica virgifera
  misc_feature: Coding regions on vcDNA: vcDNA=SeqID_3146; Strand=+; Position=52-801
  misc_feature: Homolog annotation: Hit_ID=CAA76931.1; Match level="QueryCoverage =95%, HitCoverage=97%, E-value=4e-77, Identity=55%"; Hit description =endoglucanase [Phaedon cochleariae]
  misc_feature: Pfam annotation: Pfam_ID=Glyco_hydro_45; Match level="Score=325.6, E -value=7.4e-95, Copies=1"; Pfam description=Glycosyl hydrolase family 45
HTYHHDRNPRSQIPLPILLVLAVATSIKAEVSPDIIAVPNGLSGKGITTRYWDCCKPSCAWADNVNTPDKQPLKSCRVDGEAVAPPNDPSGCDINGSSFVCNNNQPYVVNSTLSYGFASASFSGGIDTSMCCSCMLLNFEGQLKGKQFLVQLTNSGEEYQTNQFDLGIPGGGVGLFPKGCTAQWNAPSTGWGDLYGGVHTEEECNELPEVLQPGCKWRFTFMEGVSNPEVTFYQVQCPRELVERSGCVL

SEQ ID NO: 23450 - protein, 70 aa, Diabrotica virgifera
  misc_feature: Coding regions on vcDNA: vcDNA=SeqID_3147; Strand=-; Position=149-361
NLDSSEHNNNTRLQPYLVEAKCSRAKLNLAIRCSWESSYPVSLVREDKLAACSCLLTFHSLMFIFLIFCG

SEQ ID NO: 23451 - protein, 127 aa, Diabrotica virgifera
  misc_feature: Coding regions on vcDNA: vcDNA=SeqID_3148; Strand=+; Position=27-407
  misc_feature: Homolog annotation: Hit_ID=XP_312603.1; Match level="QueryCoverage =99%, HitCoverage=32%, E-value=2e-45, Identity=65%"; Hit description =ENSANGP00000014914 [Anopheles gambiae]
  misc_feature: Gene Ontology Annotation: Molecular function=glutamate-ammonia ligase activity; Cellular component=cytoplasm; Biological process=nitrogen metabolism
  misc_feature: Pfam annotation: Pfam_ID=Gln-synt_N; Match level="Score=130.9, E -value=3e-36, Copies=1"; Pfam description=Glutamine synthetase, beta -Grasp domai
IKYKEYSSVTNTLIMAKMLDSSPNAALNKSLLQHYLTLPIPDGKCQATYIWIDGSGENVRCKTRTLDFVPTCPKELPVWNFDGSSTNQAKGHNSDVFLCPVAMYKDPFLRGNNKLVLCDTYKYDRTP

SEQ ID NO: 23452 - protein, 264 aa, Diabrotica virgifera
  misc_feature: Coding regions on vcDNA: vcDNA=SeqID_3149; Strand=+; Position=58-848
  misc_feature: Homolog annotation: Hit_ID=XP_312603.1; Match level="QueryCoverage =97%, HitCoverage=65%, E-value=1e-108, Identity=69%"; Hit description= ENSANGP00000014914 [Anopheles gambiae]
  misc_feature: Gene Ontology Annotation: Molecular function=glutamate-ammonia ligase activity; Cellular component=cytoplasm; Biological process=glutamate metabolism
  misc_feature: Pfam annotation: Pfam_ID=Gln-synt_N; Match level="Score=130.9, E -value=3e-36, Copies=1"; Pfam description=Glutamine synthetase, beta -Grasp domai
  misc_feature (251)..(251): Xaa can be any naturally occurring amino acid
MFNSELIMAKMLDSSPNAALNKSLLQHYLTLPIPDGKCQATYIWIDGSGENVRCKTRTLDFVPTCPKELPVWNFDGSSTNQAKGHNSDVFLCPVAMYKDPFLRGNNKLVLCDTYKYDRTPTETNHRVTCLQAMKAAQEEKPWFGIEQEYTLLDMDLRPLGWPKHGFPGPQGPYYCGVGANKVYARDIVEAHYRCCLYAGVTISGTNAEVMPAQGEYQVGPCEGISIGDELWIFFRILLRVGRKPPVICAFXSLPMESDWKRAGA

SEQ ID NO: 23453 - protein, 368 aa, Diabrotica virgifera
  misc_feature: Coding regions on vcDNA: vcDNA=SeqID_3150; Strand=+; Position=351-1457
  misc_feature: Homolog annotation: Hit_ID=XP_312603.1; Match level="QueryCoverage =100%, HitCoverage=93%, E-value=1e-172, Identity=74%"; Hit description=ENSANGP00000014914 [Anopheles gambiae]
  misc_feature: Gene Ontology Annotation: Molecular function=glutamate-ammonia ligase activity; Cellular component=cytoplasm; Biological process=nitrogen metabolism
  misc_feature: Pfam annotation: Pfam_ID=Gln-synt_C; Match level="Score=367.1, E -value=2.3e-107, Copies=1"; Pfam description=Glutamine synthetase, catalytic domain
MAKMLDSSPNAALNKSLLQHYLTLPIPDGKCQATYIWIDGSGENVRCKTRTLDFVPTCPKELPVWNFDGSSTNQAKGHNSDVFLCPVAMYKDPFLRGNNKLVLCDTYKYDRTPTETNHRVTCLQAMKAAQEEKPWFGIEQEYTLLDMDLRPLGWPKHGFPGPQGPYYCGVGANKVYARDIVEAHYRCCLYAGVTISGTNAEVMPAQWEYQVGPCEGISIGDELWISRYILQRVAEDYGVIVTFDPKPMEGDWNGAGAHTNFSTQVMREPNGIGAIEKAIEKLSKNHARHIKAYDPKGGKDNERRLTGKHETSSIHDFSAGVANRGASIRIPRGCAEDKKGYLEDRRPASNCDPYSVSEAIIRTCCLNE

SEQ ID NO: 23454 - protein, 107 aa, Diabrotica virgifera
  misc_feature: Coding regions on vcDNA: vcDNA=SeqID_3151; Strand=+; Position=3-326
WTYRQAQQGYGSAQPWTYRQTQQGYQSAQPWTYSQTQQRYEAAQPWSYRQTQQGYEGAQPWSHYQTVSQTYGNPLAQYYSNQQNQQPWTQYWNRYGQQYQHQQQYVM

SEQ ID NO: 23455 - protein, 402 aa, Diabrotica virgifera
  misc_feature: Coding regions on vcDNA: vcDNA=SeqID_3152; Strand=+; Position=12-1220
  misc_feature: Homolog annotation: Hit_ID=EAL26758.1; Match level="QueryCoverage =76%, HitCoverage=42%, E-value=5e-43, Identity=35%"; Hit description =GA20670-PA [Drosophila pseudoobscura]
  misc_feature: Gene Ontology Annotation: Molecular function=protein tyrosine phosphatase activity; Cellular component=extracellular; Biological process=regulation of cell cycle
  misc_feature: Pfam annotation: Pfam_ID=Acid_phosphat_A; Match level="Score=14.2, E -value=1.9e-08, Copies=1"; Pfam description=Histidine acid phosphatase
MFLQIKFLVLLFWAVIAASDRTVLEGSASDLTESNQLIAVVQIIRHGHRLPTVFYKNDKYSDLSKYWNGLDLGDLTNEGKRQHYRLSMFTRNRYGKWLPKNYNKNDFYAQTTEYDRTHMSGQVNIYGLYPSKLDQRWRLLTDWQPIPLHPGDANIWESIPKNCAAYTGEYAKVLASDRYAAINKQYADVYAYLSKYSGNNVTNVEQAFPVFDSFKSESTVGLRLPVWASKVYPKPLTELIGHMYNAWVYTTKQQRLYAGALLDSILNYFDNKINGSVSQKFKMYSGHDLNIASILSAFGAFNPPYPPDFASSIYLELRNNSGSYFVNAWSKDGTNFKKVSIKGCALDCPLDEVRQRLDGIVLDVDTKVKECNAKLEFENVDVENMYKKFTQTGEMERLKDLF

SEQ ID NO: 23456 - protein, 95 aa, Diabrotica virgifera
  misc_feature: Coding regions on vcDNA: vcDNA=SeqID_3153; Strand=+; Position=165-449
HSTLSSKMFIKINKRAWINLFIFVILSVTIIFMFSDDHVTEISIKTNSEIKEKHAIISYTINNTTKTTATSTSTTTNTATATSISTTPSADIHCY

SEQ ID NO: 23457 - protein, 171 aa, Diabrotica virgifera
  misc_feature: Coding regions on vcDNA: vcDNA=SeqID_3154; Strand=+; Position=459-971
  misc_feature: Homolog annotation: Hit_ID=EAL39606.1; Match level="QueryCoverage =58%, HitCoverage=27%, E-value=3e-10, Identity=34%"; Hit description =ENSANGP00000029565 [Anopheles gambiae str. PEST] ref|XP_555205.1| ENSANGP00000029565 [Anopheles gambiae st
  misc_feature (129)..(129): Xaa can be any naturally occurring amino acid
  misc_feature (149)..(149): Xaa can be any naturally occurring amino acid
MFIKINKRAWINLFIFVILSVTIIFMFSDDHVTEISIKTNSEIKEKHAIISYTINNTTKTTATSTSTTTNTATATSISTTPSADIHCYRETSLASLPDISEISPRPGKSIFFHETSCKSFNKGKITINXRQACAVESAARLNPDLDIYXVYSSPSLIKSEGDESDKFLNAL

SEQ ID NO: 23458 - protein, 108 aa, Diabrotica virgifera
  misc_feature: Coding regions on vcDNA: vcDNA=SeqID_3155; Strand=+; Position=117-443
  misc_feature: Homolog annotation: Hit_ID=CAG25527.1; Match level="QueryCoverage =100%, HitCoverage=100%, E-value=7e-46, Identity=75%"; Hit description=putative FK506-binding protein [Suberites ficus]
  misc_feature: Gene Ontology Annotation: Molecular function=ATP-binding cassette (ABC) transporter activity; Cellular component=membrane; Biological process=transport
  misc_feature: Pfam annotation: Pfam_ID=FKBP_C; Match level="Score=180.7, E-value =3.2e-51, Copies=1"; Pfam description=FKBP-type peptidyl-prolyl cis -trans is
MGVMVDTITPGDGRTFPKTGQFVSVHYTGTLEDGQKFDSSRDRGAPFKFHIGRGEVIKGWDEGVAQLSLGQRAKLTCTADYAYGSRGHPGIIPPNATLIFDVELIAIE

SEQ ID NO: 23459 - protein, 193 aa, Diabrotica virgifera
  misc_feature: Coding regions on vcDNA: vcDNA=SeqID_3156; Strand=+; Position=127-708
  misc_feature: Homolog annotation: Hit_ID=XP_315261.1; Match level="QueryCoverage =89%, HitCoverage=75%, E-value=5e-44, Identity=54%"; Hit description =ENSANGP00000022311 [Anopheles gambiae]
  misc_feature: Gene Ontology Annotation: Biological process=signal transduction
ISNMPRGKFTNHKGRNRRFTNPEELEEERRREEQQKKWRQQRGESSSEESEEEAAADKKISEESGSGSESSEESDGEDAKAKGVSKLIEIENPNRIQKKTKKLTTLNTTTDLDSKPQLSRREREEIEKQKAQALYQKLHAEGKTEQARADLARLAIIKQQREEAKKRREAEVKEKENAAKEKTAQTKKALGKK

SEQ ID NO: 23460 - protein, 275 aa, Diabrotica virgifera
  misc_feature: Coding regions on vcDNA: vcDNA=SeqID_3157; Strand=+; Position=344-1168
  misc_feature: Homolog annotation: Hit_ID=XP_394545.1; Match level="QueryCoverage =100%, HitCoverage=78%, E-value=1e-111, Identity=71%"; Hit description=similar to CG5001-PA [Apis mellifera]
  misc_feature: Gene Ontology Annotation: Molecular function=heat shock protein activity; Cellular component=nucleus; Biological process=response to heat
  misc_feature: Pfam annotation: Pfam_ID=DnaJ; Match level="Score=142.5, E-value=9.8e- 40, Copies=1"; Pfam description=DnaJ domain
MGKDFYKILNIQRGASDDDIKKAYRKLALKYHPDKNKAAGAEEKFKEVAEAYEVLSDKKKREIYDKYGEEGLHGNPEGTGNSSSGTNFSYTYHGDPRATFAQFFGNPSPFATFFDNRMFGAMHDDDIDVDEPYMFLGDWRQPREGPGGAFRSHSFNFHNAPNRRQNADKIQDPAIEHDLYVSLEDITKGCQKKLKICRRVMQPDGSTKKEDKVLTINVKPGWKAGTKITFQREGDQGRNKIPADIVFIIRDKPHPLFKREGSDIKYTAKISLKQA

SEQ ID NO: 23461 - protein, 280 aa, Diabrotica virgifera
  misc_feature: Coding regions on vcDNA: vcDNA=SeqID_3158; Strand=+; Position=2-844
  misc_feature: Homolog annotation: Hit_ID=AAC47272.1; Match level="QueryCoverage =94%, HitCoverage=57%, E-value=2e-24, Identity=26%"; Hit description =integrase
  misc_feature: Pfam annotation: Pfam_ID=rve; Match level="Score=69.1, E-value=1.2e -17, Copies=1"; Pfam description=Integrase core domain
KNENVAKNIEARNKLDIVAIDMLSDLIMTTKRNKHILVMVDVFSKYVKLYSCRTTKGEEILRKIDNCIAIVGTPKKILLDNATYFRNDRFKGQLRERGIETNFVSIRHPQSNPSERFIQEVTKFLRIATDGQHRHWDRKMAEIERYLNTIPSTVTKETQEYIMKGVLPIRPWEDQEPKEYQQVIETVQRRLRRSNEKYIQRQEQNRKRRPVTFQKGEKVLVRALRVSNLPGGICAKLMPVFEGPYIVNNENGINSYELRHRNSEKIRGIYNIHDVYKYHE

SEQ ID NO: 23462 - protein, 257 aa, Diabrotica virgifera
  misc_feature: Coding regions on vcDNA: vcDNA=SeqID_3159; Strand=+; Position=278-1051
ATGVFSRRRSLKTKNQTGIFCNPKEFIKLAGNNEKKNGVNLKFVDGFINEKPIKIMIDTGSEITLVNRKLIEEVNLTNLIYKIPRVNLVGANKRTLATINEGIRVMVRLGKKMYALQCVIMPNMSHDMIVGVDELAEKHVVIDFKNNTMNLTEEKEEEQDKEQEKQNTDESGKDQTVEMNLATKQGQRKRKAEGEKVRKRHESVKPVAPQSEIVSPGEEKLRVSKANGKQIVLKSGEKRKKNGFGEKGKEKIITPHL

SEQ ID NO: 23463 - protein, 631 aa, Diabrotica virgifera
  misc_feature: Coding regions on vcDNA: vcDNA=SeqID_3160; Strand=+; Position=2-1895
  misc_feature: Homolog annotation: Hit_ID=AAL39987.1; Match level="QueryCoverage =99%, HitCoverage=82%, E-value=1e-164, Identity=45%"; Hit description= SD08921p [Drosophila melanogaster]
  misc_feature: Gene Ontology Annotation: Molecular function=15-hydroxyprostaglandin dehydrogenase (NAD+) activity; Cellular component=cellular_component unknown; Biological process=biological_process unknown
  misc_feature: Pfam annotation: Pfam_ID=ABC_tran; Match level="Score=91.8, E-value =1.7e-24, Copies=1"; Pfam description=ABC transporter
  misc_feature (434)..(434): Xaa can be any naturally occurring amino acid
KNGQVAVSGSYDDIRNSNTDYSKVLANIEEEEEEIRRKSRIVQTKQEKDEEEEEVQVLQREAKSTGNISGRVYLKYAQAGGHLFKAFCLIFLFVMGQALLSMCQYFVTFWVNIQQWKASQNSASPTAPASLENMTAPLDITSPSPQPVDHTGFADWWLTPLFISENTVIYFSALNILMVVIMNIRSSSFYAWSITASTKMHNTMFENIVYSPMRFFTINPSGRILNRFSKDIGALDEVLPMTFMDTVQIGLEVGAICFVISSLTYWIMIPTICMGILFYVIRIIFLETSRDVKRVESVTRSPIYTHLTASLQGLTTIRAFKAEDILKTEFDKYQNTHSAAFFMYLGANRTFGFWVDFICVIYIALVILSLIFVESETFGGNMGLALTQIMGLTRMFQWGMRQWSELENQMTSVERVQEYADLKHEEDNHTVEPXKTWPDQGKVEFKNMSLQYSPDDPPVLKNLSFVIQPSEKVGIVGRTGAGKSSLIQVVFRLTHIDGSILIDDIDTKYVALKKLRSKISIIPQEPVLFSGTLRNNLDPFDEYKDEVLWNALEQVELKSAVDDLPAGLDSKMAEGGSNFSVGQRQLVCLARAVIRNNKILVLNETTANVDPYTDGLISTTIKKKFPQVAQN

SEQ ID NO: 23464 - protein, 257 aa, Diabrotica virgifera
  misc_feature: Coding regions on vcDNA: vcDNA=SeqID_3161; Strand=-; Position=752-1525
  misc_feature: Homolog annotation: Hit_ID=NP_496088.1; Match level="QueryCoverage =88%, HitCoverage=47%, E-value=3e-23, Identity=29%"; Hit description =reverse transcriptase family member (2J964) [Caenorhabditis elegans] pir||T27754 hypothetical
LVQEQSVEGPKKNGLPQGSVLATILYNIYTNDQPIHQQTRQFIYADDTAVAAQGRTFNEVEVKLTDALGDLALYYDKNHLKPNPTKTQVCAFHLRNKHARRSLEVEWRGQMLEHNKTPKYLGVRLDRTLSYRYHCQDVKKKVSARNNIIRKLTNTKWGAQPHTLRISALALCFSAAEFEAPVWSNSAHAKNVDVALNETVRIISGCLKPTPIEEVYPIAGIAPPPIRRKVTSEVERKKQETDRRHTPYMTTKLSQAD

SEQ ID NO: 23465 - protein, 274 aa, Diabrotica virgifera
  misc_feature: Coding regions on vcDNA: vcDNA=SeqID_3162; Strand=+; Position=183-1007
  misc_feature: Homolog annotation: Hit_ID=XP_310255.1; Match level="QueryCoverage =92%, HitCoverage=31%, E-value=2e-47, Identity=38%"; Hit description =ENSANGP00000015103 [Anopheles gambiae]
MDSSSSSSESGDTGGGEIKNENKPERKEKKQASMKEIAISFAKKGALFFLGYLICYLNFSLTLPILAICTLVYFETQTSQITRKISSKSKASSYTKKDLLKVVDELPSWVTFPDRERAEWLNEIIGQLWPSISLYVIKLCRTKLQAKIKKKFDSFRFEDIDFGVSPPKIDGVKVYNKTITKDAIIIDFDVYYDGDCDIKFSLSGQQIGCIKDFQVGAELRLVLKPLMVKMPIVGGIQIFFLNTPDINFELEGITGIPGFSYFIRKKIEERIKKK

SEQ ID NO: 23466 - protein, 225 aa, Diabrotica virgifera
  misc_feature: Coding regions on vcDNA: vcDNA=SeqID_3163; Strand=+; Position=343-1019
  misc_feature: Homolog annotation: Hit_ID=XP_310255.1; Match level="QueryCoverage =86%, HitCoverage=23%, E-value=6e-29, Identity=35%"; Hit description =ENSANGP00000015103 [Anopheles gambiae]
  misc_feature (192)..(192): Xaa can be any naturally occurring amino acid
MSGNTNMDSSSSSSESGDTGGGEIKNENKPERKEKKQASMKEIAISFAKKGALFFLGYLICYLNFSLTLPILAICTLVYFETQTSQITRKISSKSKASSYTKKDLLKVVDELPSWVTFPDRERAEWLNEIIGQLWPSISLYVIKLCRTKLQAKIKKKFDSFRFEDIDFGVSPPKIDGVKVYNKTITKDAILXDFDVYYDGDCEIKFSLSEQKIGCIKDFPSWKPG

SEQ ID NO: 23467 - protein, 373 aa, Diabrotica virgifera
  misc_feature: Coding regions on vcDNA: vcDNA=SeqID_3164; Strand=+; Position=24-1142
  misc_feature: Homolog annotation: Hit_ID=CAA77014.1; Match level="QueryCoverage =100%, HitCoverage=94%, E-value=1e-118, Identity=53%"; Hit description=chitinase [Phaedon cochleariae]
  misc_feature: Gene Ontology Annotation: Molecular function=chitinase activity; Cellular component=extracellular space; Biological process=response to bacteria
  misc_feature: Pfam annotation: Pfam_ID=Glyco_hydro_18; Match level="Score=378.0, E -value=1.2e-110, Copies=1"; Pfam description=Glycosyl hydrolases family 18
  misc_feature (332)..(332): Xaa can be any naturally occurring amino acid
MKLQIYLGFVSLIFLWAYSTPANGYNVVCYFSSWAIYRNFSGKFDVSDIDPHLCTHVNFAFVELYEDGSLYIVDPWESNDKNNGGYYEGFKQLKNLKNANPGLKILLSLGGWNEGSKNFSIVAADQSKRERLARECLALIEEYDYDGIDIDWEYPTLREGSHPSDKDNFVEMLKDFQAIMKPKGLLLSAAVAGAVDKIESAYHVEEVAKYLDMINVMAYDYHGAFDNLVGHVSPLHASSKDYQHGRNATYTVATGLEYWLYKNADPSKINLGLPTYGRTFTLADRTKTELYSEVLGPGERGLYTGIRGSLGYHEICEFYSGSDSTYYWDDEXKVPHRVWEDQWAGYDDQRSIQYKVDFAVSHNLAGVLICSLD

SEQ ID NO: 23468 - protein, 374 aa, Diabrotica virgifera
  misc_feature: Coding regions on vcDNA: vcDNA=SeqID_3165; Strand=+; Position=2-1123
  misc_feature: Homolog annotation: Hit_ID=EAL33796.1; Match level="QueryCoverage =98%, HitCoverage=61%, E-value=1e-114, Identity=53%"; Hit description= GA15630-PA [Drosophila pseudoobscura]
  misc_feature: Gene Ontology Annotation: Molecular function=molecular_function unknown; Cellular component=nucleoplasm; Biological process =chromosome segregation
  misc_feature: Pfam annotation: Pfam_ID=RIO1; Match level="Score=244.1, E-value=2.6e- 70, Copies=1"; Pfam description=RIO1 family
GRVGQYDKEYDDQLKRTEEKFNGSSKVSISFDNYRRAPLNEDFISDSEEEEIVDVRDRKFWDRFESLEREFASIPQCGYKVQPDGQMVTKHDVVMSGRKNACKLLSFPPEFQTGDGENFDLKLSNKVFNSLKMYSKNEQHARRHKVHDKKEDQATAEFGVDEFTRLLLYKMINNQLLERVNGVISIGKEAVILHADSDPSFPFDSNLPKECVIKIFKTTLSEFKQRDKYIKDDHRFKDRIGKQTARKTVYIWAEKEMANLMRLQKAEIPCPKVVTLKNHLLVMSFIGENHRPAPKLKDAVMSDADYIVAYEQVTENMKALYDKANLIHADLSEYNILWYQDQCYFIDVSQSVEPSHENAFHFLYKDCTNVTKFF

SEQ ID NO: 23469 - protein, 214 aa, Diabrotica virgifera
  misc_feature: Coding regions on vcDNA: vcDNA=SeqID_3166; Strand=+; Position=58-702
  misc_feature: Homolog annotation: Hit_ID=NP_725229.1; Match level="QueryCoverage =100%, HitCoverage=99%, E-value=3e-71, Identity=67%"; Hit description= CG8759-PC, isoform C [Drosophila melanogaster] ref|NP_599139.1| CG8759-PA, isoform A [Drosophila
  misc_feature: Gene Ontology Annotation: Molecular function=transcription co -activator activity; Cellular component=nucleus; Biological process =nuclear positioning
  misc_feature: Pfam annotation: Pfam_ID=NAC; Match level="Score=91.5, E-value=2.1e -24, Copies=1"; Pfam description=NAC domain
MPEMTEVDKTVIQETKPEQSESSTDSDSDEDIPELEDAGTASAASATFPGAAAAGLPMDMVSKAKQSRGEKKARKIMSKLGLKPVQGVNRVTIRKSKNILFVINKPDVYKNPVSDTYIVFGEAKIEDLSQQAQVAAAEKFKEVSPAGDNAAGTTTTSVAPIAEESEDEEVDESGVEEKDVELVMSQANVSRSKAVKALKNNQNDIVNAIMELTM

SEQ ID NO: 23470 - protein, 138 aa, Diabrotica virgifera
  misc_feature: Coding regions on vcDNA: vcDNA=SeqID_3167; Strand=+; Position=21-437
  misc_feature: Homolog annotation: Hit_ID=BAD26660.1; Match level="QueryCoverage =99%, HitCoverage=98%, E-value=9e-49, Identity=70%"; Hit description =Ribosomal protein L28 [Plutella xylostella]
  misc_feature: Gene Ontology Annotation: Molecular function=structural constituent of ribosome; Cellular component=cytosolic large ribosomal subunit (sensu Eukarya); Biological process=protein biosynthesis
  misc_feature: Pfam annotation: Pfam_ID=Ribosomal_L28e; Match level="Score=148.1, E -value=2e-41, Copies=1"; Pfam description=Ribosomal L28e protein family
MSSHLVWGIIRNNNAFLLKKRNISKPFSTEANNLTNLSSYRYNGLIHKKSVGIVDAADKKGFTVVYKKACKQHKPKQNVVKRTMKSGPRRSLHKLKRLLNANKYRTDLTKAALRRASAVLRSQKPLPAKKQKVAPKKE

SEQ ID NO: 23471 - protein, 82 aa, Diabrotica virgifera
  misc_feature: Coding regions on vcDNA: vcDNA=SeqID_3168; Strand=+; Position=470-718
FFLCLVYFTNHLRLAHNANSPRCMLVPLGKLFRLIFLHKLTQKQVLITNSQGARQYRGRKVVLHIFLNEFKKSIFSLRTNLF

SEQ ID NO: 23472 - protein, 359 aa, Diabrotica virgifera
  misc_feature: Coding regions on vcDNA: vcDNA=SeqID_3169; Strand=+; Position=133-1212
  misc_feature: Homolog annotation: Hit_ID=XP_314648.1; Match level="QueryCoverage =91%, HitCoverage=92%, E-value=1e-81, Identity=45%"; Hit description =ENSANGP00000020769 [Anopheles gambiae]
  misc_feature: Gene Ontology Annotation: Molecular function=homocysteine S -methyltransferase activity; Cellular component=cellular_component unknown; Biological process=sulfur amino acid metabolism
  misc_feature: Pfam annotation: Pfam_ID=S-methyl_trans; Match level="Score=172.3, E -value=1.1e-48, Copies=1"; Pfam description=Homocysteine S -methyltransferase
MAPPGIGNSVEIRPEATASSAERSSSNGVATFQKDIVVLDGGFATQLGCHVQQPIDGDVLWSSRFLATNPEAVIDTHLDFLRAGADVIITNTYQADVNLFAKHLNMTKEEGYNLIKDSVKMAKTAVERYLKEYPEARKPLIAGSVGPYGASLHDGSEYTGAYAKTTSAETMREWHGPRIKALVEGGVDLLAIETIPNAVEAEMLVQLIKEEYPNVKAWLAFSVAQDGKSIAYGEDFKTIARKCYDSNPEQLVAIGINCTAPRLIEPLLTGINDDRKDNPRPLIVYPNSGESYNVELGEWSQSSLTDGPRWHNRENCEPVDTNIHKWLDLGVTWVGGCCRTYAVDVTRIRDQVQLWKEKQ

SEQ ID NO: 23473 - protein, 284 aa, Diabrotica virgifera
  misc_feature: Coding regions on vcDNA: vcDNA=SeqID_3170; Strand=-; Position=8-862
  misc_feature: Homolog annotation: Hit_ID=AAF19266.1; Match level="QueryCoverage =97%, HitCoverage=98%, E-value=2e-94, Identity=59%"; Hit description =cytosolic juvenile hormone binding protein 36 kDa subunit [Bombyx mori]
  misc_feature: Pfam annotation: Pfam_ID=Glyoxalase; Match level="Score=35.5, E-value= 1.6e-07, Copies=2"; Pfam description=Glyoxalase/Bleomycin resistance prote
MSLSGRALHFVFKIPNRKESMRFYFQVLGMKLLRHEEFAEGCEATCNGPYDGRWSKTMVGYGEEDNHFVIELTYNYGITNYKKGNDFEKITIKSKEALERAKEQNWPVENGNILVAPGGYRFQIVDEPQPSDRDPMDSVTLNVSNLKKSIEYWNGILGLKIFKTNDKSALLGFKENEAKLEIQEISEAIDRGEAFGRIAFSIPHAEQEPLSTKINENNCKVLTPLTVLPTPGKADVRVLILADPDGHEICFVDDERYRQLSQPDYRSERVLNVQMRKDNYDTSS

SEQ ID NO: 23474 - protein, 319 aa, Diabrotica virgifera
  misc_feature: Coding regions on vcDNA: vcDNA=SeqID_3171; Strand=+; Position=1-957
  misc_feature: Homolog annotation: Hit_ID=XP_316724.1; Match level="QueryCoverage =100%, HitCoverage=86%, E-value=1e-137, Identity=32%"; Hit description=ENSANGP00000002653 [Anopheles gambiae] gb|EAA11800.1| ENSANGP00000002653 [Anopheles gambiae
  misc_feature: Gene Ontology Annotation: Molecular function=actin binding; Cellular component=plasma membrane; Biological process=neuromuscular synaptic transmission
  misc_feature: Pfam annotation: Pfam_ID=Spectrin; Match level="Score=127.9, E-value =2.4e-35, Copies=2"; Pfam description=Spectrin repeat
  misc_feature (256)..(256): Xaa can be any naturally occurring amino acid
  misc_feature (264)..(264): Xaa can be any naturally occurring amino acid
DRCKDISDDGQRLVSEGNHHSDSINQRCQQLQTKLDHLAALAGRRKAKLVDNSAYLQFMWKADVVESWIADKESHVKSEEFGRDLSSVQTLLTKQETFDAGLTAFEHEGIQNITALKDQLISSNHDQTQAIVQRHQAVISRWQKLLNDSDARKQRLLRMQEQFKEIEELFLMFAKRASAFNSWFENAEEDLTDPVRCNSIEEIRALKEAHSQFQASLSSAQADFDGLAALDQQIKMFNVGPNPYTWFNMEALEDTXEEFTEDYXPRGDVELNKEAQRQEENDKLRKEFAKHANAFHQWLTETRTSMMEGSGSLEQQLEA

SEQ ID NO: 23475 - protein, 183 aa, Diabrotica virgifera
  misc_feature: Coding regions on vcDNA: vcDNA=SeqID_3172; Strand=+; Position=3-551
  misc_feature: Pfam annotation: Pfam_ID=SNARE; Match level="Score=-0.8, E-value =0.098, Copies=1"; Pfam description=SNARE domain
VVQRVQATVQHSPKMKYFVLLVSIVAITASDLQGTAVDQCLCRDELTQIYNQLVEANAELKEANDEMIQLDSDMEYMDNRFEAQNENLEELESALTMLRYIQLQTLQELSSQDQILNCIVVTVQNIDVQVKNETTHVNQQTIDIGALQQLTNEIQQCNNVNTCVTPTTTLAPTDIIVTTITTV

SEQ ID NO: 23476 - protein, 52 aa, Diabrotica virgifera
  misc_feature: Coding regions on vcDNA: vcDNA=SeqID_3173; Strand=+; Position=1-159
IRHEMLKYLFTQDSSNLFIIGLKCTGKQNLPLQLLPQQRLCLRMNVFFSIHF

SEQ ID NO: 23477 - protein, 106 aa, Diabrotica virgifera
  misc_feature: Coding regions on vcDNA: vcDNA=SeqID_3174; Strand=+; Position=1-321
LSDQLNRNLSKHLQEYSASGSYAAYGNFDRSQMADLRAKLEESLMNQLRQGLQQSMQTHSSYSSSSSSSSSSSNSAGYRPAANYQMGGYSNGYRSGRDSYDGHNYR

SEQ ID NO: 23478 - protein, 87 aa, Diabrotica virgifera
  misc_feature: Coding regions on vcDNA: vcDNA=SeqID_3175; Strand=+; Position=97-360
  misc_feature: Homolog annotation: Hit_ID=XP_317625.1; Match level="QueryCoverage =81%, HitCoverage=22%, E-value=4e-12, Identity=52%"; Hit description =ENSANGP00000018535 [Anopheles gambiae]
MEVEFPSIDPNEDLTQDKTEDPKKAKKEENGANSDGEDLDEEEEEAIEEEEDTGEEDVVEGDDEEIEAEDEEDVEGEGVEEEEDDDA

SEQ ID NO: 23479 - protein, 656 aa, Diabrotica virgifera
  misc_feature: Coding regions on vcDNA: vcDNA=SeqID_3176; Strand=+; Position=187-2157
  misc_feature: Homolog annotation: Hit_ID=AAO52302.1; Match level="QueryCoverage =96%, HitCoverage=47%, E-value=1e-13, Identity=20%"; Hit description =similar to Homo sapiens (Human). Dentin sialophosphoprotein precursor [Contains: Dentin phosphoprotein
MKVPFLFITVLGCSLASPNGYYHQEYNYKTSQSSYKNNELQHKTDDQGYYKKDGDLENRYKPIEDSNSEHSEYINPKLQNGQYGLDTNSYGHMRADGTYGYGNQNSMGVEGLARNDRIYGSQAGYSAGYGSSNSHSYSTNSNLRMLTSRLQQELERDLQEAVRQNSAYSQSRIDMTELERELRRNLTERLNNELNLKYGQQIVRSGMSYSMSGGRLQPTANYDNQELVDLKSQIENTLLNQLRTQYSQYSQQSSYGSSNSYQHNGGAYVYPVTQRPVYYTTTYRPIYPTLTSGGYVDTHNQQYNTVKTRYTPIANPESLTSIASRVQSQLDANLNNVLDETRRTHFSSSQQYSLTNPDALLERLRNELRNNITYQLDDMISKNYGSQTQKDGYLYSVGSNGAISTDYNYGLRDMENLKEQIQRNLINKLERDFESSRKSWSSSSSYSSQSSYGNTYGSAQPAYYQPGVKAGYNSGSEYNSASRYNSASGYNTANQHNSASGYNSGGTTYSSGNMAELQRQLQADLSRQLNQALNQESHSSYSYTPQNYQSSLQDLSDQLNRNLTKHLQEYSASGSYAAYGNFDRSQMADLRVKLEESLMNQLRQGLQQSMQTHSSYSSSSSSSSSSSNSAGYRPAANYQMGGYSSDDACYRRLPEI

SEQ ID NO: 23480 - protein, 133 aa, Diabrotica virgifera
  misc_feature: Coding regions on vcDNA: vcDNA=SeqID_3177; Strand=+; Position=108-509
  misc_feature: Homolog annotation: Hit_ID=XP_317625.1; Match level="QueryCoverage =89%, HitCoverage=39%, E-value=2e-19, Identity=46%"; Hit description =ENSANGP00000018535 [Anopheles gambiae]
  misc_feature: Gene Ontology Annotation: Cellular component=nucleus
TKLAHASAHACRALIVTSGIDPNQNINKMSSKDNSDVAVDKLDNEKSTDGKAEIKGTKRAAEDKTEDPKKAKKEENGANSDGEDLDEEEEEAIEEEEDTGEEDVVEGDDEEIEAEDEEDVEGEGVEEEEDDDA

SEQ ID NO: 23481 - protein, 305 aa, Diabrotica virgifera
  misc_feature: Coding regions on vcDNA: vcDNA=SeqID_3178; Strand=+; Position=120-1037
MKLHEELQIHYTKEHKTRSSWNADEQCVVFHNLSFARAKVLEKLDDRKYRVNIFDRATEDVINVDKMYEFDKYFTKFPNVVFKSHLANIKPAGGDKWSLSAIEALECVFTKYKEICGAKVPGDISGKSIPMNMWYTKVKIAGALEPSIMKFISLSNLLVKMGVAYKISSPSVKSESGSVKSERSAVSSKISNGNLSGLENDEVPVGKESVTSVESLAIPKNKAWSDAGEEEEETLKAVKNASDSLETPQEVDMDDWVPAFPEQQKKFFFGENGGDPRGGIFFFRGREFGIRVIKKKGKKKEGKFF

SEQ ID NO: 23482 - protein, 298 aa, Diabrotica virgifera
  misc_feature: Coding regions on vcDNA: vcDNA=SeqID_3179; Strand=+; Position=84-973
  misc_feature: Homolog annotation: Hit_ID=XP_309476.1; Match level="QueryCoverage =98%, HitCoverage=67%, E-value=1e-150, Identity=91%"; Hit description= ENSANGP00000021987 [Anopheles gambiae]
  misc_feature: Gene Ontology Annotation: Molecular function=proteasome endopeptidase activity; Cellular component=proteasome regulatory particle (sensu Eukarya); Biological process=proteolysis and peptidolysis
  misc_feature: Pfam annotation: Pfam_ID=AAA; Match level="Score=-10.3, E-value =0.0024, Copies=1"; Pfam description=ATPase family associated with various
  misc_feature (275)..(275): Xaa can be any naturally occurring amino acid
  misc_feature (289)..(289): Xaa can be any naturally occurring amino acid
IKTIKMPDHLGDDMRKIKEQKEEPEKEIKALDEGDIALLKTYGQGQYTKTIKTCEEDIQTIIKRVNELTGIKESDTGLAPPALWDLAADKQTLQNEQPLQVARCTKIINADTDDPKYIINVKQFAKFVVDLADSVAPTDIEEGMRVGVDRNKYQIHIPLPPKIDPTVTMMQVEEKPDVTYSDVGGCKEQIEKLREVVETPLLHPEKFVKLGIEPPKGVLLFGPPGTGKTLCARAVANRTDACFIRVIGSELVQKYVGEGARMVRELFEMARSKKXACLIFFDEIDAIGXGARFDDGAG

SEQ ID NO: 23483 - protein, 294 aa, Diabrotica virgifera
  misc_feature: Coding regions on vcDNA: vcDNA=SeqID_3180; Strand=+; Position=374-1254
  misc_feature: Homolog annotation: Hit_ID=XP_394896.1; Match level="QueryCoverage =94%, HitCoverage=77%, E-value=4e-66, Identity=44%"; Hit description =similar to ENSANGP00000022032 [Apis mellifera]
  misc_feature: Pfam annotation: Pfam_ID=ADP_ribosyl_GH; Match level="Score=10.9, E -value=1.7e-06, Copies=1"; Pfam description=ADP-ribosylglycohydrolase
  misc_feature (262)..(262): Xaa can be any naturally occurring amino acid
MSIIKHFTMAKMEAAVLKSKFKGCLLGALVGDCTGSPFEGDTITHGDKLIIQKYFDRMQDPTFSAPYKSYTDDTAMMKSVAKFLTDKPEPDYKFLARLFVNEYFKEPKRGYGQSIVDVFRKLKNTKYEDVFKPAKEQFLGEGSFGNGGAMRIAPVALYFHDNYKAMVEAATNATKLTHTHILGVNGAILQSIAIQLALKCDPEAKIDAERFCAELYRRMRKVERVEEDLDDIEEDESASRRAYQDKIRIVEYLIGKKDDDDXERKKYINFGKRISAYESVPTAIYCFFEGPEGN

SEQ ID NO: 23484 - protein, 278 aa, Diabrotica virgifera
  misc_feature: Coding regions on vcDNA: vcDNA=SeqID_3181; Strand=+; Position=137-973
  misc_feature: Homolog annotation: Hit_ID=XP_395379.1; Match level="QueryCoverage =99%, HitCoverage=27%, E-value=1e-76, Identity=50%"; Hit description =similar to ENSANGP00000001411 [Apis mellifera]
MTIADLYKGKNVFITGGTGFMGQALIEKLLRSCPDIGTIYLLLRPKKDDTVRQRLEKLKQLPAFDVLRQENPEVLDKLKPISGDCGSVNLGLSESDRQLLIDNVNIIFHSAASVRFDDFLKYAILLNVRGTREVAQLALELKNISMLVHVSTTYCNCDRSLIEEKLYPSHGTWEEAIRLAEECDEQILNVLSQKYISPMPNTYTYAKQLGEQVINDMCNGKIPTLIVRPSIVTSAKDEPFPGWNTNFNGPVGMNVAGGKGLLRTVYGYKDAVIDMLAC

SEQ ID NO: 23485 - protein, 519 aa, Diabrotica virgifera
  misc_feature: Coding regions on vcDNA: vcDNA=SeqID_3182; Strand=+; Position=172-1728
  misc_feature: Homolog annotation: Hit_ID=XP_416167.1; Match level="QueryCoverage =82%, HitCoverage=33%, E-value=8e-39, Identity=27%"; Hit description =PREDICTED: similar to Apoptotic protease activating factor 1 (Apaf -1) [Gallus gallus]
  misc_feature: Gene Ontology Annotation: Molecular function=caspase activator activity; Cellular component=cytosol; Biological process=apoptosis
  misc_feature: Pfam annotation: Pfam_ID=NB-ARC; Match level="Score=0.3, E-value=8.7e- 09, Copies=1"; Pfam description=NB-ARC domain
  misc_feature (132)..(132): Xaa can be any naturally occurring amino acid
  misc_feature (144)..(144): Xaa can be any naturally occurring amino acid
MDESLSSQIIAYKSVIADIDDFIDYLISINLLNENAYLDVWKRRPQDRLNELFNKIPLNGSSEAVLKYLKENYPHHEKELENERNYRIASVRGSFPELPPYYVSRKTLVDEVKFKLQDLKWDQKLVIHGMMXYGKSCLIHDVLXDAKVREYFDNYLFWVNLGDCHSKEDVWQPMWRLYTAASSIIETKTSHCLDDVDGLKNLLKKLFLEDRLKNSLIILDDASKTEVLTFFDIKAKTVITTQNRSILVGRNVTFVEVKTGFSSKESLELFKKSLDVKHDLPVAAEEIHHICRGHPMRISLIGSYLNENAEEALHGDHIWQYIIDQFLNGQYELNEYTNPHDFHGIIDKCIETLLTDDLKELYKDLSIFEQDVNIPPEVLQILWNKTSDQVRNIMSTLAGKSLVVRFFHTGLNIYIYGIHDVYLSYLKEETKDNRKYLHRKLLEGYDKITNCDYTKLPDDNYTLQFIGYHMYHGEEFHKFKEFLNLNFLELKIKAVGTEDVLRDMYKYRKYIPRNEIHLK

SEQ ID NO: 23486 - protein, 334 aa, Diabrotica virgifera
  misc_feature: Coding regions on vcDNA: vcDNA=SeqID_3183; Strand=+; Position=81-1082
  misc_feature: Homolog annotation: Hit_ID=XP_312237.1; Match level="QueryCoverage =99%, HitCoverage=58%, E-value=1e-177, Identity=89%"; Hit description= ENSANGP00000010808 [Anopheles gambiae]
  misc_feature: Gene Ontology Annotation: Molecular function=eukaryotic elongation factor-2 kinase activator activity; Cellular component=nucleus; Biological process=activation of MAPK
  misc_feature: Pfam annotation: Pfam_ID=Pkinase; Match level="Score=367.8, E-value =1.5e-107, Copies=1"; Pfam description=Protein kinase domain
MAEAAKPGAQPLVKIGHYVLGATLGVGTFGKVKIGEHQLTGHKVAVKILNRQKIKSLDVVGKIRREIQNLKLFRHPHIIKLYQVISTPTDIFMIMEYVSGGELFDYIVKHGKLQEHEARRFFQQIISGVDYCHRHMIVHRDLKPENLLLDHNMHVKIADFGLSNMMMDGEFLRTSCGSPNYAAPEVISGKLYAGPEVDIWSCGVILYALLCGTLPFDDEHVPTLFRKIKSGIFPIPDYLNKPVVNLLCQMLQIDPMKRASIEDIKKHEWFQKDCPAYLFPSPVEQDSSVIDIDAIREVCDKFGVQEAEVHSALLSGDPHDQLAIAYHLIIDNKR

SEQ ID NO: 23487 - protein, 308 aa, Diabrotica virgifera
  misc_feature: Coding regions on vcDNA: vcDNA=SeqID_3184; Strand=+; Position=2-928
  misc_feature: Homolog annotation: Hit_ID=XP_312568.1; Match level="QueryCoverage =93%, HitCoverage=61%, E-value=8e-53, Identity=37%"; Hit description =ENSANGP00000014917 [Anopheles gambiae]
  misc_feature: Gene Ontology Annotation: Molecular function=protein tyrosine phosphatase activity; Cellular component=extracellular; Biological process=regulation of cell cycle
  misc_feature: Pfam annotation: Pfam_ID=Acid_phosphat_A; Match level="Score=-30.5, E- value=3.2e-06, Copies=1"; Pfam description=Histidine acid phosphatase
HLIASFVLLVGLTLSGVHAELIAVIQIFRHGQRTPINFYPNDPYKDPSYWGGLAGGQLTNEGKRMHMKLGQYTRSRYANFIPQKYDPSFFYAQTTDVDRTHMSAQSNVYGLFPVTTNDQRWENKINWQPIPIHPANNIVLSNFVYPPNCPAFTTEMQAVLASQEFTTYDSENAGLYAYLTKHSGMNITDVTTAFDIWDCVKTEDNVGFSLPAWTKSIYPEPLRTTIGKFFEVFTYTTNMKRIIIGPFLNEVVEYLESMAANSSSSHKYKMYSAHESNMGAILNAFGAFNPSSPPAFASTVYIELHKEN

SEQ ID NO: 23488 - protein, 386 aa, Diabrotica virgifera
  misc_feature: Coding regions on vcDNA: vcDNA=SeqID_3185; Strand=+; Position=93-1253
  misc_feature: Homolog annotation: Hit_ID=EAL26672.1; Match level="QueryCoverage =82%, HitCoverage=90%, E-value=1e-44, Identity=30%"; Hit description =GA13500-PA [Drosophila pseudoobscura]
  misc_feature: Pfam annotation: Pfam_ID=Abhydrolase_3; Match level="Score=-65.8, E -value=0.0038, Copies=1"; Pfam description=alpha/beta hydrolase fold
MTRHGRFQDYCLVHDNDADEIDLLPDFRKPRCRYKRCICITITLCVVLALIAFMLVFIVFPFVFMNSIPLQTSLIFTRFNLPRNPEYFENQHFPAYRNRYVSFNYTKDEGSKLLGVWHILPVNLAYEDLYDNATDINYDEILLNSNYSVLLYFHGTGEVRSYSERKYELLSYNFQIIAFDYRGYGDSSDGKLTEDTVVEDCVELYKWVRNRTKSDIYVWGHSLGAALATRTVAEMENYYNVHTKALVLESGFTSMRDELYVHPYGKLFAWLPWFDTVVVEPLMHNGFVFNTTKHLKTITCPVMILHAQDDNEIPYYFGRRLADIAESRNITTVYHEFDAMFGYKHYYLYQDPFMKFYIMNFIEQVNSKRIIEGNNTTMVPSMGTTV

SEQ ID NO: 23489 - protein, 367 aa, Diabrotica virgifera
  misc_feature: Coding regions on vcDNA: vcDNA=SeqID_3186; Strand=+; Position=3-1106
  misc_feature: Homolog annotation: Hit_ID=NP_572799.1; Match level="QueryCoverage =90%, HitCoverage=80%, E-value=8e-13, Identity=25%"; Hit description =CG15731-PA [Drosophila melanogaster] gb|AAF48163.2| CG15731-PA [Drosophila melanogaster]
DAWEDVHGAVENVFGGHGGGHDSVSVHKEVVETTGYGGHRGGHASTIGSGHNSGHQDSYVEETVETVRRQPSHTVYTSGQHQTGQEAFEDVDEVTGGKSKIIKTTQYVRQPNQQGLHGYGEDDLEGVVGGHNSQRTVKVVKTTHTSGSYGSGQQQTGQEAFEDADEVTGGKSRIIKYTQYGQQSNQQGLHGYGEDDLGGVVGGHNSQRTVKVVKTTHTSGSYGSGQQQTGHEAFEDADEVTGGKSRIIKYTQYGQQSNQQGLHGYGEDDLGGVVGGHNSQRNVKVVKTTHTSGSYGSGQQQTGQEAFEDADEVVGGHSGRIVKVVKTTHTSGGYGSGGQEQLGQIKSYLRREPLQTGQQAFDEERFR

SEQ ID NO: 23490 - protein, 292 aa, Diabrotica virgifera
  misc_feature: Coding regions on vcDNA: vcDNA=SeqID_3187; Strand=+; Position=3-881
  misc_feature: Homolog annotation: Hit_ID=ZP_00236207.1; Match level="QueryCoverage =55%, HitCoverage=56%, E-value=3e-13, Identity=30%"; Hit description =VrrB [Bacillus cereus G9241] gb|EAL16275.1| VrrB [Bacillus cereus G9241]
DAHIVESGHGYGGHHDSHILETSHGYGGHHDSHVVETGHGYGGHHDTQVVETVHGYGGHHDVDTGHGFGRVDTHNVHEVVESSHGHDDVHGAVENVSGGHGGGHGSVSVHKEVVETTGYGGHRGGHASTIGSGHNSGHQDSYVEETVETVRRQPSHTVYTSGKHQTGQEAFEDVDEVTGGKSKIIKTTQYVRQPNQQGLHGYGEDDLEGVVGGHNSQRTVKVVKTTHTSGSYGSGQQQTGQEAFEDADEVTGGKSRIIKYTQYGQQSNQQGLHGYGEDDLGGVVGGHNSQRT

SEQ ID NO: 23491 - protein, 165 aa, Diabrotica virgifera
  misc_feature: Coding regions on vcDNA: vcDNA=SeqID_3188; Strand=-; Position=216-713
  misc_feature: Homolog annotation: Hit_ID=KGZQHL; Match level="QueryCoverage=90%, HitCoverage=84%, E-value=3e-24, Identity=30%"; Hit description =histidine-rich glycoprotein precursor - Plasmodium lophurae emb|CAA25698.1| histidine-rich
  misc_feature: Gene Ontology Annotation: Molecular function=DNA binding; Cellular component=nucleus; Biological process=sex differentiation
  misc_feature (25)..(25): Xaa can be any naturally occurring amino acid
  misc_feature (85)..(85): Xaa can be any naturally occurring amino acid
HYRDHHHVHQKHFQQHREHHHVRGXILQLHEHYGYQLCQIRDQYRHHDAHHNREQFRQPEYHDGHHNHDQFRQHDYHGAHHNHDXFLKYENHDVHHIRDHFRQYEHHDAHHNREHRDVRHIHGQFQQPDGHLHGENHTHHDVYLHTNLHVVLCGGCILHDHSLRY

SEQ ID NO: 23492 - protein, 59 aa, Diabrotica virgifera
  misc_feature: Coding regions on vcDNA: vcDNA=SeqID_3189; Strand=-; Position=761-940
GFGEWRKCEKWDKETINSSRGFLEFLTLFFSEIFTFSDNLFNVHIAMQDKRDWFLCKKN

SEQ ID NO: 23493 - protein, 64 aa, Diabrotica virgifera
  misc_feature: Coding regions on vcDNA: vcDNA=SeqID_3190; Strand=+; Position=132-326
  misc_feature: Homolog annotation: Hit_ID=XP_321574.1; Match level="QueryCoverage =100%, HitCoverage=100%, E-value=4e-23, Identity=76%"; Hit description=ENSANGP00000025348 [Anopheles gambiae] gb|EAA43169.1| ENSANGP00000025348 [Anopheles gambiae
  misc_feature: Pfam annotation: Pfam_ID=RAMP4; Match level="Score=143.8, E-value =3.8e-40, Copies=1"; Pfam description=Ribosome associated membrane protein R
MAPKQRMRLANEKAMKNVTLRGNVPKSTKQSQESSPVGPWLLALFVFVVCGSAVFQIIQSIRMA

SEQ ID NO: 23494 - protein, 218 aa, Diabrotica virgifera
  misc_feature: Coding regions on vcDNA: vcDNA=SeqID_3191; Strand=-; Position=333-988
  misc_feature: Homolog annotation: Hit_ID=AAU04866.1; Match level="QueryCoverage =94%, HitCoverage=65%, E-value=1e-42, Identity=44%"; Hit description =mariner transposase [Mariner transposase delivery vector pFA545]
  misc_feature: Gene Ontology Annotation: Molecular function=transposase activity; Cellular component=cellular_component unknown; Biological process =DNA transposition
  misc_feature: Pfam annotation: Pfam_ID=Transposase_1; Match level="Score=47.3, E -value=4.5e-11, Copies=1"; Pfam description=Transposase
  misc_feature (74)..(74): Xaa can be any naturally occurring amino acid
  misc_feature (122)..(122): Xaa can be any naturally occurring amino acid
  misc_feature (151)..(151): Xaa can be any naturally occurring amino acid
SLLICILMGKNIAQIEQWIKKCYRDCAPSITTIKQWFVVFKRDSKDTNNAEYSGRPNDAIIPENIEKMLKFVKXKLQEITDTLHLSKGSILTTIHEHLSMRKLFSKWVLRFLTPGQAVWTCXNWSFCRYVTMNETWINHFSPESNRQSSEXQHPKKATKTQPTTRKVMASVFWDVQGIIFIDYLKHGENINNEYTGLLERLKTEIKAHKQVASIEACE

SEQ ID NO: 23495 - protein, 251 aa, Diabrotica virgifera
  misc_feature: Coding regions on vcDNA: vcDNA=SeqID_3192; Strand=-; Position=280-1035
  misc_feature: Homolog annotation: Hit_ID=AAU04866.1; Match level="QueryCoverage =85%, HitCoverage=65%, E-value=2e-46, Identity=46%"; Hit description =mariner transposase [Mariner transposase delivery vector pFA545]
  misc_feature: Gene Ontology Annotation: Molecular function=transposase activity; Cellular component=cellular_component unknown; Biological process =DNA transposition
  misc_feature: Pfam annotation: Pfam_ID=Transposase_1; Match level="Score=39.7, E -value=8.3e-09, Copies=1"; Pfam description=Transposase
  misc_feature (98)..(98): Xaa can be any naturally occurring amino acid
  misc_feature (184)..(184): Xaa can be any naturally occurring amino acid
  misc_feature (206)..(206): Xaa can be any naturally occurring amino acid
VDSAKHFFVIFINNGFKTTSGVDLSLLICILMGKNIAQIEQWIKKCYRDCAISITTIKQWFAEFKRDSKDTNNAEYSGRPNDAIIPENIEKMLKFVKXKLQEITDTLHLSKGSILTTTHEHLSMRKLFSKWVLRFLTPGQKQQQIDESRSGLDMFNWSFCRYVTMNETWINHFSPESNRQSSEXQHPEKATKTQPTTRKVMASVFXDAQGIIFIDYLKHGEKINNEYTALLERLKTEIKAHKHVASIEACE

SEQ ID NO: 23496 - protein, 91 aa, Diabrotica virgifera
  misc_feature: Coding regions on vcDNA: vcDNA=SeqID_3193; Strand=-; Position=1339 -1612
  misc_feature: Homolog annotation: Hit_ID=AAT79489.1; Match level="QueryCoverage =90%, HitCoverage=24%, E-value=2e-18, Identity=61%"; Hit description =mariner transposase C9 mutant [Mutagenesis vector pCAM45]
  misc_feature: Pfam annotation: Pfam_ID=Transposase_1; Match level="Score=35.7, E -value=1.2e-07, Copies=1"; Pfam description=Transposase
  misc_feature (14)..(14): Xaa can be any naturally occurring amino acid
  misc_feature (23)..(23): Xaa can be any naturally occurring amino acid
  misc_feature (46)..(46): Xaa can be any naturally occurring amino acid
VPMNETWINHFSPXESNRQSSEXTAPGEKLQKTQPTTRKVMASVFXDAQGIIFIDYLKHGEKINNEYTALLERLKTEIKAHKHVASIEACE

SEQ ID NO: 23497 - protein, 217 aa, Diabrotica virgifera
  misc_feature: Coding regions on vcDNA: vcDNA=SeqID_3194; Strand=+; Position=27-680
  misc_feature: Homolog annotation: Hit_ID=XP_314956.1; Match level="QueryCoverage =93%, HitCoverage=90%, E-value=3e-85, Identity=76%"; Hit description =ENSANGP00000019325 [Anopheles gambiae]
  misc_feature: Gene Ontology Annotation: Molecular function=calcium ion binding; Cellular component=extracellular space; Biological process=protein folding
  misc_feature: Pfam annotation: Pfam_ID=FKBP_C; Match level="Score=186.9, E-value =4.3e-53, Copies=1"; Pfam description=FKBP-type peptidyl-prolyl cis -trans is
MFGNTLFTGFFFGALFAIASCTDDLKVEVLFKPEMCDVKSKQGDTLTMHYTGTLTDGSKFDSSLDRDQAFSFQLGVGQVIKGWDQGLVDMCVGEKRKLTIPPHLGYGDKGAGNVIPGKATLIFEVELINISDAKPATANVFKEIDSNKDNQLSREELSDYLKKQMAAADDGDVPSEEMKNMLADHDKLVEEIFQHEDQDKNGYISHAEFSGPKHDEL

SEQ ID NO: 23498 - protein, 157 aa, Diabrotica virgifera
  misc_feature: Coding regions on vcDNA: vcDNA=SeqID_3195; Strand=+; Position=31-504
  misc_feature: Homolog annotation: Hit_ID=S78002; Match level="QueryCoverage=88%, HitCoverage=97%, E-value=1e-35, Identity=56%"; Hit description =cuticle structural protein PCP15.6, post-ecdysial - yellow mealworm
  misc_feature: Gene Ontology Annotation: Biological process=eggshell formation (sensu Insecta)
MNCLAFVAFFAAVAATYAAPSATIVQGPSARSTLVGADGSVISSVQPGASIVAEEHPGVIAHTAPVVSAYSSYHAPLTYSAPLVSAYSHPVHAAYSAPVLSAYSAPVVSAYSAPVVSAYSAPVVGHGSVDTVVAGPSGTIATSRHGAGLVSAHGLYL

SEQ ID NO: 23499 - protein, 163 aa, Diabrotica virgifera
  misc_feature: Coding regions on vcDNA: vcDNA=SeqID_3196; Strand=+; Position=43-534
  misc_feature: Homolog annotation: Hit_ID=S78002; Match level="QueryCoverage=88%, HitCoverage=97%, E-value=5e-34, Identity=54%"; Hit description =cuticle structural protein PCP15.6, post-ecdysial - yellow mealworm
  misc_feature: Gene Ontology Annotation: Biological process=eggshell formation (sensu Insecta)
MNCLAFVAFFAAIAATYAAPSATIVQGPSARSTLVGADGSVISSVQPGASIVAEEHPGVIAHTAPVVAAAPVVSAYSSYHAPLTYSAPLVSAYSHPVHAAYSAPVLSAYSAPVVSAYSAPVVSAYSAPVVGHGSVDTVVAGPSGTIATSRHGAGLVSAHGLYL

SEQ ID NO: 23500 - protein, 167 aa, Diabrotica virgifera
  misc_feature: Coding regions on vcDNA: vcDNA=SeqID_3197; Strand=+; Position=274-778
  misc_feature: Homolog annotation: Hit_ID=NP_524902.2; Match level="QueryCoverage =94%, HitCoverage=89%, E-value=6e-40, Identity=50%"; Hit description =CG15855-PA [Drosophila melanogaster] gb|AAG22243.1| CG15855-PA [Drosophila melanogaster]
  misc_feature: Gene Ontology Annotation: Molecular function=calcium ion binding; Cellular component=plasma membrane; Biological process=cell organization and biogenesis
  misc_feature: Pfam annotation: Pfam_ID=efhand; Match level="Score=111.9, E-value =1.6e-30, Copies=4"; Pfam description=EF hand
  misc_feature (59)..(59): Xaa can be any naturally occurring amino acid
MAAYQFSKRRSSSIKKEFNESELEGLKIAFELLDRNQDGQVTPGEFKIMLNNLGIDIKXKKAEEIIRIASHSGSDLIDQNDFLSFVKQIQKACPGDVDEDIASDLKAAFQVFDLDGDGYITKEELKTAMEMIGEAVTDQQLEQVIRLADTDKDGRINYEEFVKLLTS

SEQ ID NO: 23501 - protein, 62 aa, Diabrotica virgifera
  misc_feature: Coding regions on vcDNA: vcDNA=SeqID_3198; Strand=-; Position=44-232
FHPRVDIKFWFLFWCLCIIVDDVSLNFYLLINVDMFLLLISFSIGEEIPIHFSLLRKMGMLI

SEQ ID NO: 23502 - protein, 103 aa, Diabrotica virgifera
  misc_feature: Coding regions on vcDNA: vcDNA=SeqID_3199; Strand=+; Position=86-397
ECHARERIRNDEIRQRMGVDGSLTTDIERKQLIWYGHVQRMDNSRLPKIIMQWVPPNRRKRGRPKKSWREGVTKAMSARDLREGQWDDRVSWKLGIGQRRKTF

SEQ ID NO: 23503 - protein, 286 aa, Diabrotica virgifera
  misc_feature: Coding regions on vcDNA: vcDNA=SeqID_3200; Strand=+; Position=1-861
  misc_feature: Homolog annotation: Hit_ID=ZP_00158147.1; Match level="QueryCoverage =91%, HitCoverage=34%, E-value=3e-18, Identity=26%"; Hit description =COG4886: Leucine-rich repeat (LRR) protein [Anabaena variabilis ATCC 29413]
  misc_feature: Gene Ontology Annotation: Molecular function=cell adhesion molecule activity; Cellular component=plasma membrane; Biological process =cell adhesion
  misc_feature: Pfam annotation: Pfam_ID=LRR_1; Match level="Score=47.7, E-value=3.5e- 11, Copies=6"; Pfam description=Leucine Rich Repeat
MLCKVLVVLFTLFVCLKCSNISVELHINKFFKGVNITINSIFELKQNVVNRSEVHLIQIKDQNVPVIPKNFLNGTSVSDFGISRSQVREVEPGALDGVSLDFLNLNANNIARIKKGIFNKKSLYIVDFQNNVVSNIEDDAFAGATITLLDLSHNKMAKLTSKMFAGSNITYIFLHSNVISNIEDGTFDKIDNMQRLVLSNNQLEALGNVFKNLTNLKQLLLAENRIKTLEPGCFSGSGISLEIFLSGNQLTHIAKGVFYKVPVFSLDFRNNSISKIDKGALAGLSL

SEQ ID NO: 23504 - protein, 359 aa, Diabrotica virgifera
  misc_feature: Coding regions on vcDNA: vcDNA=SeqID_3201; Strand=+; Position=2-1078
  misc_feature: Homolog annotation: Hit_ID=XP_307960.1; Match level="QueryCoverage =100%, HitCoverage=28%, E-value=1e-111, Identity=57%"; Hit description=ENSANGP00000013501 [Anopheles gambiae] gb|EAA03817.1| ENSANGP00000013501 [Anopheles gambiae
  misc_feature: Gene Ontology Annotation: Molecular function=chromatin binding; Cellular component=dosage compensation complex (sensu Drosophila); Biological process=dosage compensation, by hyperactivation of X chromosome
  misc_feature: Pfam annotation: Pfam_ID=DEAD; Match level="Score=40.5, E-value=4.9e -09, Copies=1"; Pfam description=DEAD/DEAH box helicase
  misc_feature (338)..(338): Xaa can be any naturally occurring amino acid
  misc_feature (341)..(341): Xaa can be any naturally occurring amino acid
KGSNNRSNKKFLSLEQLQKDDKRVVESFYTRIKDEKYKKMLNVRKNLPAWSLQKDILNSINQSPVIVVSGETGCGKSTQVPQFILDEWIKNYGNDNRHVEIVCTQPRRISAIGVAERVADERVDKIGNTVGYQIRLESKMSSSTRLSFCTTGILLRRLEGEPTLPNVTHIIVDEVHERSEESDFLLLILKELLQIRPDLKVILMSATVNASLFSQYFGDIPVIDIPGRTFPVEQYFLEDILETTGYVMEDGSEYCRKLKKDEDYLEIMMSANEVGYSNQKPRDNVKDESLNAIQVMARYQDYSITTCKNIFIMDPDKINYDLIEHVLEWIVAGDHDYXESXNYFWYFWQGIGEITTLYD

SEQ ID NO: 23505 - protein, 404 aa, Diabrotica virgifera
  misc_feature: Coding regions on vcDNA: vcDNA=SeqID_3202; Strand=+; Position=59-1273
  misc_feature: Homolog annotation: Hit_ID=XP_318917.1; Match level="QueryCoverage =94%, HitCoverage=70%, E-value=2e-95, Identity=47%"; Hit description =ENSANGP00000015123 [Anopheles gambiae]
  misc_feature: Gene Ontology Annotation: Molecular function=neuronal Cdc2-like kinase binding; Cellular component=cellular_component unknown; Biological process=regulation of neuron differentiation
  misc_feature: Pfam annotation: Pfam_ID=DUF773; Match level="Score=303.6, E-value =3.1e-88, Copies=1"; Pfam description=Protein of unknown function (DUF773)
  misc_feature (381)..(381): Xaa can be any naturally occurring amino acid
LIANNMMDEQNIPIDINTTKLLEWLISRRHVKTDWQNSILKIREKINNAIQDMPAHEGIIKLLSGQHINYFHCLKIVEILKETEADSKNLFGRYGSQRMKDWQDIVTSYQKDNVYVAEVSQMLIRNVSFEIPSLRKQVSKLEQSQLECEKKIKDYSRAESTAQKEFKNSCDQLGISGKKIKSEIIDLLKDLPGTYKTISEKIKIVAPAVELYNAFNKYLSGKKIDESALPLLEYLIKHGNTTTYEYIYGEKPVSIEESTPDISEDKSSSDSDKIDFGDIDFGDNGGEINFDINTDNGTIDFGDVIEESQNIDWGASNPEEGFEIVTHADLDINLEESGIVVEKTGIDGGVAKGEEALTILDNPKTQEQVINSLMELSAFIXMRLYEMMNDTDMLSTSQCKMLQL

SEQ ID NO: 23506 - protein, 270 aa, Diabrotica virgifera
  misc_feature: Coding regions on vcDNA: vcDNA=SeqID_3203; Strand=+; Position=230-1042
  misc_feature: Homolog annotation: Hit_ID=AAR08420.1; Match level="QueryCoverage =97%, HitCoverage=54%, E-value=1e-107, Identity=68%"; Hit description= Kruppel-like protein 1 [Apis mellifera]
  misc_feature: Gene Ontology Annotation: Molecular function=transcription factor activity; Cellular component=nucleus; Biological process=regulation of transcription, DNA-dependent
  misc_feature: Pfam annotation: Pfam_ID=zf-C2H2; Match level="Score=178.5, E-value =1.4e-50, Copies=7"; Pfam description=Zinc finger, C2H2 type
MVGYYSEATLPIAQVRTSNEEPLSVKKLVCSPDLTISSDHFANKSADSEAIQCQVCNKMYTSKVAFTNHARTHAKETEDPYRCNICSKTFAVPARLTRHYRTHTGEKPFRCEFCSKPFSVKENLSVHRRIHTKERPYKCEVCSRAFEHSGKLHRHMRIHTGERPHKCSVCAKTFIQSGQLVIHMRTHTGEKPYVCTVCQKGFTCSKQLKVHSRTHTGEKPYSCEMNGKSFGYFHVLKVHQVAHYGEKVYKLYYSATTHFTSKKKNWRDHN

SEQ ID NO: 23507 - protein, 302 aa, Diabrotica virgifera
  misc_feature: Coding regions on vcDNA: vcDNA=SeqID_3204; Strand=+; Position=139-1045
  misc_feature: Homolog annotation: Hit_ID=XP_319416.1; Match level="QueryCoverage =91%, HitCoverage=40%, E-value=1e-117, Identity=76%"; Hit description= ENSANGP00000002842 [Anopheles gambiae]
  misc_feature: Gene Ontology Annotation: Molecular function=biotin binding; Cellular component=mitochondrial matrix; Biological process=biotin metabolism
  misc_feature: Pfam annotation: Pfam_ID=CPSase_L_chain; Match level="Score=164.8, E -value=1.9e-46, Copies=1"; Pfam description=Carbamoyl-phosphate synthase L chain,
  misc_feature (284)..(284): Xaa can be any naturally occurring amino acid
  misc_feature (292)..(292): Xaa can be any naturally occurring amino acid
MLLTKILINGEGIVNIFSKQYYGIRRKSTLRKIDKLLIANRGEIACRIVRTAKRLGVRTVAVYSDADEKSLHVSLADEAYRIGPATASQSYLRGDKLLEVAKKSGSQAIHPGYGFLSENVEFAERCQKEGIIFIGPPSSAIKDMGIKSTSKAIMSAAGVPIVEGYHGEDQSIETLKKEAKRIGFPVMIKAVRGGGGKGMRIALTEEDFEEALESAKTESQKAFADSVVLLEKFVTEPRHVEVQVFADTHGNAVHLFERDCSVQRRHQKIIEEAPAPGLSSKLRXKLGMAAVXAGKAVGYVGA

SEQ ID NO: 23508 - protein, 306 aa, Diabrotica virgifera
  misc_feature: Coding regions on vcDNA: vcDNA=SeqID_3205; Strand=+; Position=75-997
  misc_feature: Homolog annotation: Hit_ID=XP_397089.1; Match level="QueryCoverage =94%, HitCoverage=48%, E-value=6e-76, Identity=47%"; Hit description =similar to ENSANGP00000011801 [Apis mellifera]
  misc_feature: Gene Ontology Annotation: Molecular function=molecular_function unknown; Cellular component=nucleus; Biological process=bud site selection
  misc_feature: Pfam annotation: Pfam_ID=Seryl_tRNA_N; Match level="Score=-11.2, E -value=0.0017, Copies=1"; Pfam description=Seryl-tRNA synthetase N -terminal doma
  misc_feature (135)..(135): Xaa can be any naturally occurring amino acid
  misc_feature (277)..(277): Xaa can be any naturally occurring amino acid
MVYKRKKYHYGDTHLKKKWRTKRRTKDLDQIDEDIKPENTEKLLNQDIDFDKPGSAQHYCIHCARYFISDSALQDHFKTKVHKRRLKALETEPYTIEDSERAAGLGNWKTPSKRKIETQPNKEDSEGSSKKMKIXKMNNCRFSFLKIKHFTSRYYSSALYITGDKAQKTFVVLTPVIDFEKHLINKNKVVKNIRVRGLKIDFDDIVKQWTFFQEVSKRKHLLELTRQDIAQKITNLLKKSDTDPSEVEKYKVHAKIVKDDLKNLKISFYDIEEATMXKILSLPNDLHSQTLSHEKTVCIHTSISQK

SEQ ID NO: 23509 - protein, 401 aa, Diabrotica virgifera
  misc_feature: Coding regions on vcDNA: vcDNA=SeqID_3206; Strand=+; Position=2-1207
  misc_feature: Homolog annotation: Hit_ID=XP_319948.1; Match level="QueryCoverage =100%, HitCoverage=82%, E-value=0.0, Identity=96%"; Hit description =ENSANGP00000016786 [Anopheles gambiae]
  misc_feature: Gene Ontology Annotation: Molecular function=protein transporter activity; Cellular component=endoplasmic reticulum membrane; Biological process=reproduction
  misc_feature: Pfam annotation: Pfam_ID=SecY; Match level="Score=17.9, E-value=2.6e -15, Copies=1"; Pfam description=eubacterial secY protein
LMELGISPIVTSGLIMQLLAGAKIIEVGDTPKDRALFNGAQKLFGMVITVGQAIVYVMTGMYGDPAEIGAGVCLLIIIQLFVAGLIVLLLDELLQKGYGLGSGISLFIATNICETIIWKAFSPATVNTGRGTEFEGAVIALFHLLTTRQDKIRGLREAFYRQNLPNLMNLLATVLVFAIVIYFQGFRVDLPIKSARYRGQYSSYPIKLFYTSNIPIILQSALVSNLYVISQMLAVKFQGNFLINLLGVWADVGGGGPARSYPIGGLCYYLSPPESVSHILEDPIHAMLYIVFMLGSCAFFSKTWIEVSGSSAKDVAKQLKEQQMVMRGHRDNSMIHELNRYIPTAAAFGGLCIGALSVLADFMGAIGSGTGILLAVTIIYQYFEIFVKEQSEMGGMGALLF

SEQ ID NO: 23510 - protein, 338 aa, Diabrotica virgifera
  misc_feature: Coding regions on vcDNA: vcDNA=SeqID_3207; Strand=+; Position=96-1111
  misc_feature: Homolog annotation: Hit_ID=EAL25176.1; Match level="QueryCoverage =93%, HitCoverage=50%, E-value=1e-102, Identity=60%"; Hit description= GA10086-PA [Drosophila pseudoobscura]
  misc_feature: Gene Ontology Annotation: Molecular function=structural molecule activity; Cellular component=lamin filament; Biological process =nuclear envelope reassembly
  misc_feature: Pfam annotation: Pfam_ID=Filament; Match level="Score=61.7, E-value =2e-15, Copies=1"; Pfam description=Intermediate filament protein
  misc_feature (310)..(310): Xaa can be any naturally occurring amino acid
  misc_feature (321)..(321): Xaa can be any naturally occurring amino acid
MASKSKKGSTPLASQRPASPLSPTRHSRLQEKHELQNLNDRLAGYIDRVRYLEGENNRLTREIQSTQETVTREVSNIKSMYDHELSDARKLLDETHREKARLEIDVKRLLEENDELKSELAKKNKDLALAENSARIYETRCNELQLKANQAAADAKKAIADAKELEKERDKLRKLLDNHRKQLEEESLARVEVENANQSLREELSFKDQIHQQQLTETRTRRQVEISEIDGRLAEKYEAKLQEALQELRDQYESQMANNRGEIELLYEQKIKNLQSANDRHAASASGALDELRQVRTRIDTLNSRISDLXTTKQAYHFFVXHLQNVIENERMRHGADL

SEQ ID NO: 23511 - protein, 316 aa, Diabrotica virgifera
  misc_feature: Coding regions on vcDNA: vcDNA=SeqID_3208; Strand=+; Position=82-1029
  misc_feature: Homolog annotation: Hit_ID=XP_392523.1; Match level="QueryCoverage =75%, HitCoverage=22%, E-value=2e-84, Identity=63%"; Hit description =similar to ENSANGP00000014913 [Apis mellifera]
  misc_feature: Pfam annotation: Pfam_ID=Glutaminase; Match level="Score=-35.2, E -value=2.4e-11, Copies=1"; Pfam description=Glutaminase
  misc_feature (277)..(277): Xaa can be any naturally occurring amino acid
  misc_feature (296)..(296): Xaa can be any naturally occurring amino acid
MLSNRFLSCLSRCQVRSQFEQWISIHTIRMSGFHTNRKKNDIDQTRAIINRQRRQYSFIHDTSYLCYGSDYETDVALFEMFKNQDTGLLHIGKFLSAVKATGLRKTDLRLQDMMENLKKLSKTKSDGNDVDTQKLTLEQFRSIVQPNVGLLSYAFRHQFIIPEFQEFSKELELIYWKCKENTSGTVASYIPQLKRMNPNYWGVSIVTIDGQRYSIGDVNIPFTIQSCSKPLSYGIALDLLGANVVHQYVGQEPSGRNFNELILHPNKKPPNPMINAXGAIIICSLLKTMNSQKWTXPKNFAFPMNFFKRLAGKEKI

SEQ ID NO: 23512 - protein, 314 aa, Diabrotica virgifera
  misc_feature: Coding regions on vcDNA: vcDNA=SeqID_3209; Strand=+; Position=21-962
  misc_feature: Homolog annotation: Hit_ID=AAF70178.1; Match level="QueryCoverage =99%, HitCoverage=62%, E-value=2e-71, Identity=45%"; Hit description =cytochrome P450 monooxigenase CYP4Q4 [Tribolium castaneum]
  misc_feature: Gene Ontology Annotation: Molecular function=monooxygenase activity; Biological process=leukotriene metabolism
  misc_feature: Pfam annotation: Pfam_ID=p450; Match level="Score=-103.4, E-value =1.6e-06, Copies=1"; Pfam description=Cytochrome P450
MILLIAILIPLIIYIYVKKRQRYQDIWQYVDVIPGPKSYPVLGTTYELHTQASLFTRDRIRAKEFFPIYKEWSLGVPVVNIIHPDDIELVTTNPKSITKSFIYHFLHPWLGNGILTSTGSPWHKRRKILTPAFHMDILHQFVEVFNKETTFLVERLKKVCNAPYLNLSEHITDYTLFSVAETSLGISLREDKSCASYKKALYDFGADFAYWLIRPWLYVPIIYKYSSLCEKNTKSIEVMHNFSKNVITERKKTFKLEDTPTYSKTKYRALLDVLLTTQHNGNPITVDEIREELDTFIFEGHDTTSVSIMYTLMA

SEQ ID NO: 23513 - protein, 80 aa, Diabrotica virgifera
  misc_feature: Coding regions on vcDNA: vcDNA=SeqID_3210; Strand=+; Position=137-379
  misc_feature: Homolog annotation: Hit_ID=AAQ22984.1; Match level="QueryCoverage =87%, HitCoverage=22%, E-value=4e-14, Identity=50%"; Hit description =cathepsin L-like cysteine proteinase precursor [Acanthoscelides obtectus]
  misc_feature: Gene Ontology Annotation: Molecular function=molecular_function unknown; Cellular component=cellular_component unknown; Biological process=biological_process unknown
MSGLSLEEQWKNFKFAHNKEYTDEEEPRRLEIFKENLQKIEEHNKKFEAGEVTYQMGVNKFADLTSEEMSQFRGFKPREK

SEQ ID NO: 23514 - protein, 254 aa, Diabrotica virgifera
  misc_feature: Coding regions on vcDNA: vcDNA=SeqID_3211; Strand=+; Position=174-936
  misc_feature: Homolog annotation: Hit_ID=XP_311564.1; Match level="QueryCoverage =94%, HitCoverage=44%, E-value=3e-39, Identity=38%"; Hit description =ENSANGP00000016033 [Anopheles gambiae]
  misc_feature: Pfam annotation: Pfam_ID=zf-MYND; Match level="Score=36.8, E-value =6.3e-08, Copies=1"; Pfam description=MYND finger
  misc_feature (223)..(223): Xaa can be any naturally occurring amino acid
MSEKCEICEEPSELKCSACKLVSYCCKDHQKQGWKAHKPLCRPFEIQEDPVIGKCLVATRDIKPGDLILSECPLVYGPRPHMVEEGPVPCPGCCKLIIGEQSARCEGCDFPICHPACPGLKDMEKHGHECMILGLRDVKAINGLHDFYRQDALLVLRCLLLQNKHPKKFAQLMEMEGHLKKRGADVTSQVQERIVDYLHSNFFHPMTILKGRSGRKVLEDLSXKTIQKLCGVIDVNALEINQTPKDLLYSNLFT

SEQ ID NO: 23515 - protein, 308 aa, Diabrotica virgifera
  misc_feature: Coding regions on vcDNA: vcDNA=SeqID_3212; Strand=+; Position=30-956
  misc_feature: Homolog annotation: Hit_ID=BAB17302.1; Match level="QueryCoverage =27%, HitCoverage=9%, E-value=5e-10, Identity=42%"; Hit description =inter-alpha-trypsin inhibitor heavy chain3 [Oryctolagus cuniculus]
  misc_feature: Gene Ontology Annotation: Molecular function=copper ion binding; Cellular component=extracellular space
LGKYPLEEGFDISNWRVKSWSKHGLISLPPLREAPVTELERLWAYLTIKQKLEQRELAENKTQLTKEALDLALKYSFVTDVSSLVVVKPNQTSAVNTEDASKPRSETLPLRTYSSGSVSYGMPGLPGPPAQSFGARSYFDPQPRSGGGGAYQPLSLSGQRSYSTFSQSSAFADLDDDLDSRFLVQPHATWRATWRPTHIISTTFAPTSTTSKPAIKDLLPWLKNIVHQNGTLSILGGAYDLGEGQVVLSNGECTRTPNKNVPKGTCSLLSNCPHVHSYLTDFLTYEQFACILDNKYAGVCCPEVAPVP

SEQ ID NO: 23516 - protein, 866 aa, Diabrotica virgifera
  misc_feature: Coding regions on vcDNA: vcDNA=SeqID_3213; Strand=+; Position=24-2621
  misc_feature: Homolog annotation: Hit_ID=AAH56811.1; Match level="QueryCoverage =74%, HitCoverage=67%, E-value=1e-100, Identity=36%"; Hit description= LOC402873 protein [Danio rerio]
  misc_feature: Gene Ontology Annotation: Molecular function=endopeptidase inhibitor activity; Cellular component=extracellular space
  misc_feature: Pfam annotation: Pfam_ID=VWA; Match level="Score=76.5, E-value=7.2e -20, Copies=1"; Pfam description=von Willebrand factor type A domain
MNGILFALVASVCLGGAFCIPGLVVRGIRSAKEGLDGQEAQNQDPIISEFNIHSNISNRFAKTLVTSKVKNAEKNPKEATFTVVLPEKAFISKFVMEIGGKSYEAYVKEKEEAKNIYDSAVRQGISAGHVSVSARDSNRFTVSINVEPESKATFHLTYEELLERKNNQYELVLNIHPGQVVKDMNIEVFVNESRPLKFVKTPSLRSGNEISKNDANLDPAADIQIINSTSAVVKFKPNSDKQREFAKELGQKENEGIAGQFVVQYDVDRDSQKGEILLKDGYFVHFFAPEDVEPLPKHVVFILDTSGSMYGRKLRQMKEAMGSILDQLKDTDAFHIVEFNSDILVWNIDSESKTSLRVHNEREPFEELSKLELPNALAATKEAISKGKAVIEKLQDTGLTNMLGSIETGLHLVHKELKSGSKRQPLIIFLTDGDPTMGISNTEEITKIVTKINGDRDHVPIFSLSFGDGADKKFLRKLSLKNLGFARHIYEGADAAIQLQEFYKQISSPLLSNIEFEYTDDVTEVSKKTFPIYFKGSELVVTGKYPIDEGFDISNWRVKSWSKHGLISLPPVREAPVTELERLWAYLTIKQKLEQRELAENKTQLTKEALDLALKYSFVTDVSSLVVVKPNQTSAVNTEDASKPRSETVPLRTYSSGSVSYGMPGLPGPPAQAFGARSYFDLQPRLGGGGAYQPLSLSGHRLADLDDDLDSRFLVQPHVTWRATWRPTHIISTTFAPTSTTSKPAIKDLLPWVKNIVHQNGTLSILGGAYDLGEGQVVLSNGECTKTPNKNVPKGTLQSTVKLSTWSFISDRFPDLQTVLPGFLDKKKSGSLLAQKVAARGHKFKEFKMGFKKKIKKKKGFFFLTF

SEQ ID NO: 23517 - protein, 282 aa, Diabrotica virgifera
  misc_feature: Coding regions on vcDNA: vcDNA=SeqID_3214; Strand=+; Position=136-982
  misc_feature: Homolog annotation: Hit_ID=NP_652729.2; Match level="QueryCoverage =99%, HitCoverage=43%, E-value=4e-34, Identity=32%"; Hit description =CG1898-PA [Drosophila melanogaster] gb|AAF47584.2| CG1898-PA [Drosophila melanogaster]
  misc_feature: Gene Ontology Annotation: Molecular function=GTP binding; Biological process=signal transduction
  misc_feature (116)..(116): Xaa can be any naturally occurring amino acid
MARHRDIRNMDYSDDYDGYDDVYGHSVDDDFFESPSNKQFIYNRDMSQRSSEGDIKEEDEQEAELSDSDRAKLTSCIAQINTTLESVNISRNDLVNIIIKSKFDVERSINTILEDXNIEQLLLKKIQTPQIEQTKVISSTPKTVTNITKGFDLPQKGSFTPRSQSPASGKAFTPRSQSPASGKIFTPRSQSPASGKVTPVNNHTLDFAEEVKQSKGRDNKFDPQQLYQKERGDEKEHLYMVVIGHVDAGKSTLMGRLLCEWGKVNQKGLHKYETKKEKIRKT

SEQ ID NO: 23518 - protein, 71 aa, Diabrotica virgifera
  misc_feature: Coding regions on vcDNA: vcDNA=SeqID_3215; Strand=-; Position=79-294
YRYKVTLALFSNTFHHNPELGSKRTKKTVKNYIALNGYRTDEGLGIIYNMRYNLRLPKSIKILDQYLKRLK

SEQ ID NO: 23519 - protein, 72 aa, Diabrotica virgifera
  misc_feature: Coding regions on vcDNA: vcDNA=SeqID_3216; Strand=+; Position=467-685
FAIYCRSSYFAQWNVRCRDNPGGSCIRGIGYIFLFYSIHAFLLLLLNIFWHYPISVVEKGPAINFDRGPLWG

SEQ ID NO: 23520 - protein, 127 aa, Diabrotica virgifera
  misc_feature: Coding regions on vcDNA: vcDNA=SeqID_3217; Strand=-; Position=357-740
KLFHKVQTEFFDLSCVVWFGFGHNRSVCCFNCIYFCLISRKYNITPFKTTNTKIYSLQNETKKHRRDQRIAYIKQLVNPPIFMWEKHMIKPLLNEHESDFLHQKQRDTRYANMSGTTSTEYNGKIHH

SEQ ID NO: 23521 - protein, 441 aa, Diabrotica virgifera
  misc_feature: Coding regions on vcDNA: vcDNA=SeqID_3218; Strand=+; Position=2-1326
  misc_feature: Homolog annotation: Hit_ID=XP_312456.1; Match level="QueryCoverage =97%, HitCoverage=48%, E-value=0.0, Identity=75%"; Hit description =ENSANGP00000022086 [Anopheles gambiae]
  misc_feature: Gene Ontology Annotation: Molecular function=proteasome endopeptidase activity; Cellular component=proteasome regulatory particle (sensu Eukarya); Biological process=proteolysis and peptidolysis
  misc_feature: Pfam annotation: Pfam_ID=PC_rep; Match level="Score=145.0, E-value =1.7e-40, Copies=6"; Pfam description=Proteasome/cyclosome repeat
  misc_feature (397)..(397): Xaa can be any naturally occurring amino acid
GFVNAAFGQDKLLMEDGNKWLYKNKEHGMLSATASLGLILLWDVDGGLTPIDKYLYSSEDHIKSGALLACGIVNCGVRNECDPALALLSDYVLHNTNIMRIGAIVGLGLAYVGSNREAVLSLITPVLSDPKSNMEVIGMAALACGMISAGSGNSHVTTSIMQVLMEKSEIELKDTYARFLPLGLGLCHLGKQESIDTIIAALEVIPDPFRSMATTMVDICAYAGTGNVLKVQHLLHICSEHYDAPETPDKTSKDKDKKEAEKEKDKDLSARQAIAVLGIALISMGEDIGSEMAFRTFGHLLRYCEPAIRRAVPLALGLISVSNPKLSILDTLSKFSHDSDAEVAHNAIFAMGLVGAGTNNARLAAMLRQLAQYHAKDPHNLFMVRIPQGLTPLGKGXFTSHPFHSDRQLMSPVVEVGLMGTLLRFLMLKTYIGEIPLLLSP

SEQ ID NO: 23522 - protein, 318 aa, Diabrotica virgifera
  misc_feature: Coding regions on vcDNA: vcDNA=SeqID_3219; Strand=-; Position=148-1104
  misc_feature: Homolog annotation: Hit_ID=EAL27550.1; Match level="QueryCoverage =96%, HitCoverage=95%, E-value=8e-79, Identity=49%"; Hit description =GA15457-PA [Drosophila pseudoobscura]
  misc_feature: Gene Ontology Annotation: Molecular function=electron transporter activity; Cellular component=cytoplasm; Biological process=glucose metabolism
  misc_feature: Pfam annotation: Pfam_ID=Aldo_ket_red; Match level="Score=391.0, E -value=1.6e-114, Copies=1"; Pfam description=Aldo/keto reductase family
MAKTISCGGLSMPTVGLGTWEARDDSEIETALDAALELGYRHIDTAAAYGNEHVIGKVLKKWFDSGKLTRDDLFIVTKLPAPGIHPDRVEKYLTKSLADLQLDYLDLYLIHFPVGIKEGEGAPQFEKEEHKALWQNMEKQVDAGRTKTIGVSNFNVKQIDKFLKFARIKPACNQIELHVFLQQPELVQFCQKNNVVVTAYSPLGNPGYNKFLKRVGAEERTDLVNVLTNPVITEIAKKHNRSNAQVALRFLIQKNCVVIPKSVNPARIKSNFELYDFSLDNADMKKIEALDIGEEARIVDWRVYAKIDETPEYPFARK

SEQ ID NO: 23523 - protein, 289 aa, Diabrotica virgifera
  misc_feature: Coding regions on vcDNA: vcDNA=SeqID_3220; Strand=+; Position=107-973
  misc_feature: Homolog annotation: Hit_ID=EAL27550.1; Match level="QueryCoverage =97%, HitCoverage=87%, E-value=1e-73, Identity=51%"; Hit description =GA15457-PA [Drosophila pseudoobscura]
  misc_feature: Gene Ontology Annotation: Molecular function=electron transporter activity; Cellular component=cytoplasm; Biological process=glucose metabolism
  misc_feature: Pfam annotation: Pfam_ID=Aldo_ket_red; Match level="Score=356.8, E -value=3e-104, Copies=1"; Pfam description=Aldo/keto reductase family
MAKTISCGGLSMPTVGLGTWEARDDSEIETALDAALELGYRHIDTAAAYGNEHVIGKVLKKWFDSGKLTRDDLFIVTKLPAPGIHPDRVEKYLTKSLADLQLDYLDLYLIHFPVGIKEGEGAPQFEKEEHKALWQNMEKQVDAGRTKTIGVSNFNVKQIDKFLKFARIKPACNQIELHVFLQQPELVQFCQKNNVVVTAYSPLGNPGYNKFLKRVGAEERTDLVNVLTNPVITEIAKKHNRSNAQVALRFLIQKNCVVIPKSVNPAKDKSNFELYDFSLDKCDMKKIEA

SEQ ID NO: 23524 - protein, 157 aa, Diabrotica virgifera
  misc_feature: Coding regions on vcDNA: vcDNA=SeqID_3221; Strand=+; Position=89-559
  misc_feature: Homolog annotation: Hit_ID=CAE47500.1; Match level="QueryCoverage =100%, HitCoverage=48%, E-value=1e-74, Identity=85%"; Hit description= cathepsin L-like proteinase [Diabrotica virgifera virgifera]
  misc_feature: Gene Ontology Annotation: Molecular function=cathepsin S activity; Cellular component=extracellular space; Biological process =proteolysis and peptidolysis
MKVFVLIFLVTAAVHALTDKEEWVKFKIRHNKSYRNYIEEQKRFTIFQDNLRKIANHNDQFDKGLSTFKLGVTKFADLTEKEFFDMLGLSKSNKSTRTRVIHSLAPVKDLPSKFDWREKGAVTEVKDQGSCGSCWSFSTTGTVEGAYFLKTGKLVSL

SEQ ID NO: 23525 - protein, 402 aa, Diabrotica virgifera
  misc_feature: Coding regions on vcDNA: vcDNA=SeqID_3222; Strand=+; Position=1-1206
  misc_feature: Homolog annotation: Hit_ID=EAA08206.2; Match level="QueryCoverage =97%, HitCoverage=59%, E-value=3e-94, Identity=45%"; Hit description =ENSANGP00000020975 [Anopheles gambiae str. PEST] ref|XP_563511.1| ENSANGP00000020975 [Anopheles gambiae st
  misc_feature (16)..(16): Xaa can be any naturally occurring amino acid
  misc_feature (343)..(343): Xaa can be any naturally occurring amino acid
  misc_feature (383)..(383): Xaa can be any naturally occurring amino acid
SRAKRRRSSIAKSVAXTITVPELGGAVNPAAVLDDDLGEISGEFGDSVSVTSRTGRRVSIAPEPTAEHIIPELPPDEEPEVSFKDYFKFVQSHHMRALIWKNFLWMWRNIPMMMFIIGLPISQTILFCWTIGHDPQGIKVSVVNNEINFPDETCHQQPLNCNGTKISCNYLNEVAKSYSITWEFMKTEEEARHRVERGKSWGVVVVPHNFTDALWSRIENSRDTPPEDIMASTISVYEDKSNENIATFLTRDMLYGFLTFISEFVKSCGYNEKSVGVPIRYNEPIYGYQDPDFTDFAAPGVVLTIIFFMAVALTSGSMIMERNEGILERSLVNGISGTELWFXQIIPQFVVMLGQSIAVLLVAFILFGLPQRGNWTTVTTLTXRAGIWGRGFGFRGGRQFGK

SEQ ID NO: 23526 - protein, 286 aa, Diabrotica virgifera
  misc_feature: Coding regions on vcDNA: vcDNA=SeqID_3223; Strand=+; Position=81-938
  misc_feature: Homolog annotation: Hit_ID=XP_315584.1; Match level="QueryCoverage =96%, HitCoverage=53%, E-value=2e-91, Identity=61%"; Hit description =ENSANGP00000017612 [Anopheles gambiae]
  misc_feature: Gene Ontology Annotation: Molecular function=nucleic acid binding; Cellular component=intracellular; Biological process=aspartyl-tRNA aminoacylation
  misc_feature: Pfam annotation: Pfam_ID=tRNA_anti; Match level="Score=41.0, E-value =3.4e-09, Copies=1"; Pfam description=OB-fold nucleic acid binding domain
MVDGKPNESTTSKAALKKEAKKAEKAAKKAEHKQAAGETQQNVVEEVDISVGKYGNLPLIKSETKHNERTFTSVSDLNKSVSGKTVWIRARLHTSRSRGKQCFIVLRQKEFTVQAILNVSDVVSKSMVKFSSGVPKESILDVEAKVSVVPNNIASCSQQDVELVVSQLWVVSLSAPQLPLQIEDASRPEKPEEEEGLNIRVNQDTRLDNRILDLRTPTNQAIYRLEGGVCRLFREALTKKGFVEIHTPKIISAASEGGANVFTVSYFKASAYLAQSPQVSEQMAIA

SEQ ID NO: 23527 - protein, 556 aa, Diabrotica virgifera
  misc_feature: Coding regions on vcDNA: vcDNA=SeqID_3224; Strand=+; Position=55-1721
  misc_feature: Homolog annotation: Hit_ID=NP_871928.1; Match level="QueryCoverage =93%, HitCoverage=59%, E-value=1e-30, Identity=22%"; Hit description =neprilysin family member (2D712) [Caenorhabditis elegans] gb|AAN65322.1| Hypothetical protein
  misc_feature: Gene Ontology Annotation: Molecular function=metallopeptidase activity; Cellular component=integral to plasma membrane; Biological process=reproduction
  misc_feature: Pfam annotation: Pfam_ID=Peptidase_M13_N; Match level="Score=-108.9, E-value=2.7e-05, Copies=1"; Pfam description=Peptidase family M13
  misc_feature (504)..(504): Xaa can be any naturally occurring amino acid
  misc_feature (508)..(508): Xaa can be any naturally occurring amino acid
  misc_feature (511)..(511): Xaa can be any naturally occurring amino acid
  misc_feature (516)..(516): Xaa can be any naturally occurring amino acid
  misc_feature (532)..(532): Xaa can be any naturally occurring amino acid
MMKLPIVLLILTIVSSLKGLNIDDNDDFPGYNYMNLSSDPCEDFFEYTCGNFKKLYPLSEGVLTIDQFTLLDEKLTETVRLILSENERDEDPVALRKAKAAYSACIDEDYLAKRKNPETIIVANEQGFPLTQLPCQQQATNYSFLDIADAVSKYGIPMLFNVITTSNPGNASSNILFISKVDSLTAAQIRHNHGTSYENIIEEGFVTTDGSDRKSSQSLKPFDIFLRQMSLKLRNATESFLTDTEVFTNLDDVVQFTRAVFSVANVDYSNAAILPILGDDVYTVTLEDINTWTEKQFNDTVKLNWIEFFQHYFANAGIDITADTRLLNYSGLDKILYGILNLVKSTQDHVVKSYVMMRIFTHLALDGDAHSRKLMEDYFAGINVQIYPRKEYCARKIMDSTGTAGLAFAVAYGYQLNHFNVNNYQEVIQLIEDLTDSFRELIQNTTWMDTQSKEDAVAKLQRMIMILGHPDISYDKENLDKFYENLKICKWNHYGNSIRIKAFXNAYXISXISKKXEEDFWDKSPFEVNAYXYKANNKMIFPIAMLNPPVFLVAVA

SEQ ID NO: 23528 - protein, 675 aa, Diabrotica virgifera
  misc_feature: Coding regions on vcDNA: vcDNA=SeqID_3225; Strand=+; Position=97-2124
  misc_feature: Homolog annotation: Hit_ID=XP_321442.1; Match level="QueryCoverage =99%, HitCoverage=89%, E-value=0.0, Identity=72%"; Hit description =ENSANGP00000022170 [Anopheles gambiae]
  misc_feature: Gene Ontology Annotation: Molecular function=iron-sulfur electron transfer carrier; Cellular component=membrane fraction; Biological process=mitochondrial electron transport, NADH to ubiquinone
  misc_feature: Pfam annotation: Pfam_ID=Molybdopterin; Match level="Score=449.0, E -value=5.3e-132, Copies=1"; Pfam description=Molybdopterin oxidoreductase
MLRFTVSKVLSGAKASPKHLFVATRCQSGEVKKPEKIEVFIDDKPVMVEPGTTVLQAAAMIGIEIPRFCYHERLAVAGNCRMCLVEVEKSPKPVAACAMPVMKGWRIKTDSEMTKKAREGIMEFLLVNHPLDCPICDQGGECDLQDQSMAFGSDRSRFTDIDFSGKRAVEDKDIGPLVKTIMTRCIHCTRCIRFASEIAGVDDLGTTGRGNDMQVGTYVEKLFMSELSGNVIDLCPVGALTSKPYSFTARPWEIRKVDSIDVLDAVGSNIIVSTRTGEVMRIVPRVNEEINEEWLADKSRFSYDGLKRQRLVTPMVKNNQGELKPVDWEVALLTVCKAIKQAGNKIGAIAGGLADAEALVALKDLLNRLGSENLCTEHTFPLDGSGTDLRSSYLLNNKIAGVEEADLVLLVGSNPRFEAPLLNARLRKGFIHNDLNVASIGPKIDLTYEHEDLGDDPKILQLIVSGQHPFSKKLQAAKRPLIIIGSETLERKDGAAILSAAQILAAGTASGNKDWKVLNVLHKVASQVAALDIGYTPGVDKIREADVKVLFLLGADNGAIDKSDLPNDCFVIYQGHHGDQGAGIADAILPGAAYTEKQATYVNTEGRAQQTLVAVTPPGRAREDWKIIRALSEILGVKMPYDNLSEIRDRLDEVAPHLTRYGHAEEANYFLHAAD

SEQ ID NO: 23529 - protein, 576 aa, Diabrotica virgifera
  misc_feature: Coding regions on vcDNA: vcDNA=SeqID_3226; Strand=+; Position=111-1841
  misc_feature: Homolog annotation: Hit_ID=AAO39490.1; Match level="QueryCoverage =98%, HitCoverage=86%, E-value=0.0, Identity=54%"; Hit description =SD17909p [Drosophila melanogaster]
  misc_feature: Gene Ontology Annotation: Molecular function=chaperone activity; Cellular component=integral to membrane; Biological process =fertilization (sensu Animalia)
  misc_feature: Pfam annotation: Pfam_ID=Calreticulin; Match level="Score=726.8, E -value=1.2e-215, Copies=1"; Pfam description=Calreticulin family
MNCRIRTLILVVLLIGGVIGDNADDDDITVETVDESVPDVAYESPVPLDPKKVYFAEHFDDPALFQKRWIKSQAKKEGIEEDIAKYDGQWEVEAATKDSLPNDSGLVLKTKAKHAAISAHLSKPFVFADKPLILQYEVLLQEGQECGGSYLKLLSEGPESKNLNNFHDKTPYTIMFGPDKCGNDHKLHFIFRHRNPLNGSIEEKHCQKPKERLEEYFSDKLPHLYTLILNPDNTFEISVDKKVVNSGSLLEDFVPPVNPPAEIDDPNDKKPEDWDEREKIPDPDDRKPADWDEDAPPQIFDESESIPEGWLENEPTHVPDPDAIKPADWDSDMDGEWEPPLIENPACKAAAGCGHWEPPLINNPSYKGKWRPRLITNPNYKGKWRPKKIPNPDYFDDQHPFKMTTVSAVGLELWSMSQDILFDNLLITEDITIANKWASDTFDKKRQKIAKDSESFVQRLASLTNEYPFLWAVYILVLAVPVIFILYLCCKPSSSASQKQEREELNKAAETKKTDELTEGVEEENEAPEAEEEEGDDEEQEKNSEPDSDNETAEPEEGEKSQPSGDGTRKRKVRKE

SEQ ID NO: 23530 - protein, 317 aa, Diabrotica virgifera
  misc_feature: Coding regions on vcDNA: vcDNA=SeqID_3227; Strand=+; Position=1-948
  misc_feature: Homolog annotation: Hit_ID=XP_312631.1; Match level="QueryCoverage =99%, HitCoverage=53%, E-value=1e-142, Identity=75%"; Hit description= ENSANGP00000015368 [Anopheles gambiae]
  misc_feature: Gene Ontology Annotation: Cellular component=nucleoplasm; Biological process=cell organization and biogenesis
  misc_feature: Pfam annotation: Pfam_ID=eIF-3_zeta; Match level="Score=389.1, E -value=5.8e-114, Copies=1"; Pfam description=Eukaryotic translation initiation fac
  misc_feature (283)..(283): Xaa can be any naturally occurring amino acid
  misc_feature (302)..(302): Xaa can be any naturally occurring amino acid
  misc_feature (309)..(309): Xaa can be any naturally occurring amino acid
  misc_feature (316)..(316): Xaa can be any naturally occurring amino acid
ANVQGGGMQALGKGVKTRDTYKRSQVKRWGQGRPQIKIRDASVTVRPDWSTIEEMDFPRLGKLSLPGIKDGDDVLCCGELEYYDKSYDRVNVKNEKALQSVNRIFHTVTTTDDPVIRKLTKTEGNVYATDAILATIMCCTRSNYSWDIVIEKIGDKLFFDKRDNTEFDLLTVNETSVEPPQDDGNSLNSPRNLALEATFINHNFSQQVLKIGANEPRYKFDDPNPFISEEEEGEIASVAYRYRKWDLGGGITLVARCEHDAVVQSPNGELQFLTIKALNEWDXKLANGVEWRQKLDTPRGAXLANELRXHACKLAXW

SEQ ID NO: 23531 - protein, 559 aa, Diabrotica virgifera
  misc_feature: Coding regions on vcDNA: vcDNA=SeqID_3228; Strand=+; Position=83-1760
  misc_feature: Homolog annotation: Hit_ID=XP_312631.1; Match level="QueryCoverage =99%, HitCoverage=94%, E-value=0.0, Identity=72%"; Hit description =ENSANGP00000015368 [Anopheles gambiae]
  misc_feature: Gene Ontology Annotation: Cellular component=nucleoplasm; Biological process=cell organization and biogenesis
  misc_feature: Pfam annotation: Pfam_ID=eIF-3_zeta; Match level="Score=1115.3, E -value=0, Copies=1"; Pfam description=Eukaryotic translation initiation fac
  misc_feature (325)..(325): Xaa can be any naturally occurring amino acid
  misc_feature (355)..(355): Xaa can be any naturally occurring amino acid
  misc_feature (360)..(360): Xaa can be any naturally occurring amino acid
  misc_feature (377)..(377): Xaa can be any naturally occurring amino acid
  misc_feature (380)..(380): Xaa can be any naturally occurring amino acid
  misc_feature (390)..(390): Xaa can be any naturally occurring amino acid
MTMTDYSSGGEAPHFVAPVIQDNQAGWGPCEVPDQFKDMPYQPFSKGDRLGKISDWTGAAFQDKKYANKYASQFGSGSQYAYYHDEDESTFHLVDTTRVQKPPYQRGRFRANQRNMRGRGGRANVQGGGMQALGKGVKTRDTYKRSQVKRWGQGRPQIKIRDASVTVRPDWSTIEEMDFPRLGKLSLPGIKDGDDVLCCGELEYYDKSYDRVNVKNEKALQSVNRIFHTVTTTDDPVIRKLTKTEGNVYATDAILATIMCCTRSNYSWDIVIEKIGDKLFFDKRDNTEFDLLTVNETSVEPPQDDGNSLNSPRNFLLLATFINHXFTIQVPQIDEIEKKGEFNDPTPIISGFLIXEIASXAYRYRKWDQKKRITLVXCEXDAVSISQRDXQFLTIKALNEWDSKLANGVEWRQKLDTQRGAVLANELRNNACKLAKWTVQALLAGSDQIKFGYVSRAHVRDNSKHVILGTQQYKPHEFATQINLNMDNAWGILRCIVDIVMKQKDGKYLIMKDPNKPMIRLYDIPDNTFESDGETESDDDVPESSTAFPLYSYSSSSKR

SEQ ID NO: 23532 - protein, 347 aa, Diabrotica virgifera
  misc_feature: Coding regions on vcDNA: vcDNA=SeqID_3229; Strand=+; Position=626-1666
  misc_feature: Homolog annotation: Hit_ID=XP_396755.1; Match level="QueryCoverage =92%, HitCoverage=8%, E-value=7e-88, Identity=53%"; Hit description =similar to CG33208-PF [Apis mellifera]
  misc_feature: Gene Ontology Annotation: Molecular function=Rho GTPase activator activity; Cellular component=cellular_component unknown; Biological process=Rho protein signal transduction
  misc_feature: Pfam annotation: Pfam_ID=RhoGAP; Match level="Score=33.1, E-value =4.1e-08, Copies=1"; Pfam description=RhoGAP domain
MIQVESNSMGSPISDFTDDNFEEELAEACEENLDSLMFCSTSYPEVGDTAPEKFSEISRYGIVDVKGDDADGRKIIVVYACKLPQIKEIDHGLLLSYLKYTLESYVKQDYSLIYFHHGLTSKNKPSIGWLVQAYKAFDRNYKKNLKALYLVHPTSFLKFVSQLFRPLISAKFGKKLNYIHRLKELNDFIPIEKLDIPNEVIEHDKKLGGEVPVSRTSPDSVYEPTCPTQQFGVTLQYIRDQYNVIIPPIVKQCIEYLDQPDALETEGIFRRSANANKVKSLKEIANTGQKVPFEDPHEAAVLLKKFLRELKEPLLTYELYDEIVQFQSWNNDRLRLVSILVMGKLPE

SEQ ID NO: 23533 - protein, 199 aa, Diabrotica virgifera
  misc_feature: Coding regions on vcDNA: vcDNA=SeqID_3230; Strand=+; Position=166-765
  misc_feature: Homolog annotation: Hit_ID=XP_392830.1; Match level="QueryCoverage =82%, HitCoverage=34%, E-value=1e-51, Identity=63%"; Hit description =similar to ENSANGP00000011148 [Apis mellifera]
  misc_feature: Gene Ontology Annotation: Molecular function=kinase activity; Cellular component=cellular_component unknown; Biological process =protein amino acid phosphorylation
  misc_feature: Pfam annotation: Pfam_ID=PH; Match level="Score=64.4, E-value=3.2e -16, Copies=1"; Pfam description=PH domain
MAEGHSSDDSDLENLNEFAGVLSKWTNYIHGWQDRYIVLKNGALSYYKSEQECDYGCRGALSLAKAVIKPHEFDECRFDVSVNDCVWYLRAISVESKQSWVDALESFKVESGYGTGSENSLKRHGSTVSLQSNTYSTASGSSFKRSSRNITEKLSQIGTFQDIFMHTDPYLAKDTLIICVDPNATNGITKKRKLSGGGF

SEQ ID NO: 23534 - protein, 286 aa, Diabrotica virgifera
  misc_feature: Coding regions on vcDNA: vcDNA=SeqID_3231; Strand=+; Position=69-929
  misc_feature: Homolog annotation: Hit_ID=XP_320282.1; Match level="QueryCoverage =68%, HitCoverage=38%, E-value=1e-61, Identity=58%"; Hit description =ENSANGP00000016470 [Anopheles gambiae]
  misc_feature: Gene Ontology Annotation: Molecular function=polypeptide N -acetylgalactosaminyltransferase activity; Cellular component =integral to membrane; Biological process=O-linked glycosylation
MRAIFIRKKHFFSFVAVVLVIWLLGFVYLLADSDFFKYFSNEESNQRQIDRFNKIFRDGRENVPGPIAPDIKMQKPSVQKIEIEEEPTPPKVKYGDMGKGVSLPDYLPPELQAKIDEGWKNHSFNQYVSDLIGVRRELPDYRDEWCTIPYRYEIKLPRTSIIICFFNEAWSTLIRSVNSVLDRTPPNLLEEIILVDDFSDMDHLKSPLEEYWESEPKVKIIRNTQREGLIRSRLIGMSHANAEILTFLDSHIEATPGWLEPLLEQIRVNYTTVVSPVIDSINYTTF

SEQ ID NO: 23535 - protein, 197 aa, Diabrotica virgifera
  misc_feature: Coding regions on vcDNA: vcDNA=SeqID_3232; Strand=+; Position=294-884
  misc_feature: Homolog annotation: Hit_ID=NP_609733.1; Match level="QueryCoverage =96%, HitCoverage=40%, E-value=5e-40, Identity=46%"; Hit description =CG4482-PA, isoform A [Drosophila melanogaster] gb|AAF53425.2| CG4482- PA, isoform A [Drosophila
  misc_feature (99)..(99): Xaa can be any naturally occurring amino acid
  misc_feature (159)..(159): Xaa can be any naturally occurring amino acid
MRGGFDAFPNDGGPTLHYFNYRTSVTGDVTFITFLAVFSTLYVAFLIIYFGIKKKRCSTFCAVTLSLFIGATILITLYGSAWHISKSQLCQHLSSFFPXKLKADIGVYVGLNHVNITLQANSPKNWSDIDFGGGFLLFDEHHFSTLGKGAPILGLKLPXLTVACYVTTGLSPFFAGGRNRSAGYFEKKKLWTWGGGG

SEQ ID NO: 23536 - protein, 494 aa, Diabrotica virgifera
  misc_feature: Coding regions on vcDNA: vcDNA=SeqID_3233; Strand=+; Position=73-1557
  misc_feature: Homolog annotation: Hit_ID=CAA45706.1; Match level="QueryCoverage =100%, HitCoverage=100%, E-value=0.0, Identity=96%"; Hit description =H(+)-transporting ATPase [Manduca sexta] sp|P31401|VATB_MANSE Vacuolar ATP synthase subunit B (V-ATPase B
  misc_feature: Gene Ontology Annotation: Molecular function=hydrogen-transporting ATPase activity, rotational mechanism; Cellular component=plasma membrane; Biological process=proton transport
  misc_feature: Pfam annotation: Pfam_ID=ATP-synt_ab; Match level="Score=309.7, E -value=4.7e-90, Copies=1"; Pfam description=ATP synthase alpha/beta family, nucle
MASTISARQANREHVLAVSRDFISQPRLTYKTVSGVNGPLVILEDVKFPKFNEIVQLRLSDGSLRSGQVLEVSGSKAVVQVFEGTSGIDAKHTVCEFTGDILRTPVSEDMLGRVFNGSGKPIDKGPPILAEDYLDIQGQPINPWSRIYPEEMIQTGITAIDVMNSIARGQKIPIFSAAGLPHNDIAAQICRQAGLVKIPGKSVLDDHEDNFAIVFAAMGVNMETARFFKQDFEENGSMENVCLFLNLANDPTIERIITPRLALTAAEFLAYQCEKHVLVILTDMSSYAEALREVSAAREEVPGRRGFPGYMYTDLATIYERAGRVEGRNGSITQIPILTMPNDDITHPIPDLTGYITEGQIYVDRQLHNRQIYPPINVLPSLSRLMKSAIGEGMTRKDHSDVSNQLYACYAIGKDVQAMKAVVGEEALTPDDLLYLEFLTKFEKNFITQGNYENRTVFESLDIGWQLLRIFPKEMLKRIPASTLAEFYPRDSRH

SEQ ID NO: 23537 - protein, 127 aa, Diabrotica virgifera
  misc_feature: Coding regions on vcDNA: vcDNA=SeqID_3234; Strand=+; Position=151-534
  misc_feature: Homolog annotation: Hit_ID=XP_309156.1; Match level="QueryCoverage =97%, HitCoverage=68%, E-value=3e-30, Identity=51%"; Hit description =ENSANGP00000018748 [Anopheles gambiae]
MAISRLSIIKFLELAIAIACIGLHYKSKTNDLDTDTLSSAAFGGYVIILIGGFAGYLMSTPFNKRIDIFFSLVGCALFVAAGALNIKIYDKYGKSEWRDFGLAKASLAIVNGALFLLDSLLTWRGDF

SEQ ID NO: 23538 - protein, 99 aa, Diabrotica virgifera
  misc_feature: Coding regions on vcDNA: vcDNA=SeqID_3235; Strand=+; Position=951-1250
NLVWHLWHTKYIRHIYGNEFTICLKTFMKFQSLRSLIRNSKYEYRLILVGFCLACLRSRPDQGFLGLRSRFPPSNKRPQTRRDSPLTIKRFLYPQTVLP

SEQ ID NO: 23539 - protein, 295 aa, Diabrotica virgifera
  misc_feature: Coding regions on vcDNA: vcDNA=SeqID_3236; Strand=+; Position=211-1094
  misc_feature: Homolog annotation: Hit_ID=NP_723717.2; Match level="QueryCoverage =94%, HitCoverage=55%, E-value=1e-105, Identity=64%"; Hit description= CG12317-PB, isoform B [Drosophila melanogaster] ref|NP_609542.1| CG12317-PA, isoform A [Drosophila
  misc_feature: Gene Ontology Annotation: Molecular function=amino acid-polyamine transporter activity; Cellular component=plasma membrane; Biological process=amino acid transport
  misc_feature: Pfam annotation: Pfam_ID=BacA; Match level="Score=-169.1, E-value =0.043, Copies=1"; Pfam description=Bacitracin resistance protein BacA
  misc_feature (253)..(253): Xaa can be any naturally occurring amino acid
MGGKSSPLSNGNSKINESNDADTVKLQRKITLMNGVAIIVGTIIGSGIFVSPQGVYVGTKSVGASIIIWCFSGMFSMLGALCYAELGTSVTRSGGDYAYIYVAFGPLGAFLMLWISLLIIRPTTQAIVAITFAEYAAKPFFPECKPPENAIRLLAAVCLCLLTAVNCLSIRWAMRIQGVFTYAKILALVGIIIMGVYHLASGHTENFNNAFDGKYDLSHIALSFYSGLFAFGGWNFLNFVTEELQDPYRNLPXAIWIALPTVTGIYVLANVAYFAVLTGVEIESSTAVALSFGMK

SEQ ID NO: 23540 - protein, 270 aa, Diabrotica virgifera
  misc_feature: Coding regions on vcDNA: vcDNA=SeqID_3237; Strand=+; Position=114-924
  misc_feature: Homolog annotation: Hit_ID=NP_651000.1; Match level="QueryCoverage =100%, HitCoverage=72%, E-value=1e-109, Identity=73%"; Hit description=CG6439-PA [Drosophila melanogaster] gb|AAF55942.1| CG6439-PA [Drosophila melanogaster]
  misc_feature: Gene Ontology Annotation: Molecular function=isocitrate dehydrogenase (NAD+) activity; Cellular component=mitochondrial matrix; Biological process=carbohydrate metabolism
  misc_feature: Pfam annotation: Pfam_ID=Iso_dh; Match level="Score=37.4, E-value =1.4e-14, Copies=1"; Pfam description=Isocitrate/isopropylmalate dehydrogen
  misc_feature (252)..(252): Xaa can be any naturally occurring amino acid
MAVTTRNVPRLLVQALQILPRTSTRGLSSGMAERPDARTTCTLIPGDGVGPELMYSVTEVFKAAGIPVDFDTYFFSEVNPTLSAPLEKVADSISRNRVCLKGILATPDYSHTGELQTLNMKLRNALDLYANVVHVRSLPGVKSRHSNIDCVIIREQTEGEYSALEHEGVKGVVECLKIVTAKKSQRIAKFAFDYATKNNRKKVTAVHKANIMKLGDGLFLRSCEEMAKLYPKIEFERMIVDNCTMQMVSNPXKFDVMGTPNLYGNIVDNL

SEQ ID NO: 23541 - protein, 510 aa, Diabrotica virgifera
  misc_feature: Coding regions on vcDNA: vcDNA=SeqID_3238; Strand=+; Position=76-1605
  misc_feature: Homolog annotation: Hit_ID=XP_319682.1; Match level="QueryCoverage =99%, HitCoverage=71%, E-value=0.0, Identity=74%"; Hit description =ENSANGP00000021424 [Anopheles gambiae]
  misc_feature: Gene Ontology Annotation: Molecular function=threonine-tRNA ligase activity; Cellular component=cytoplasm; Biological process=tRNA modification
  misc_feature: Pfam annotation: Pfam_ID=tRNA-synt_2b; Match level="Score=169.7, E -value=6.2e-48, Copies=1"; Pfam description=tRNA synthetase class II core domain
IKKMSDNKEKPESKNEKSKSKKNKQPAQNGGDSTAAKELKPRPEFIDNRLAIWDKLKAQYEAELAQKPEESIKVTLPDGKIIEGVSWKTTPYDIAKGISQGLADNTVIAKVNDVLWDLDRPLEVDCTLQLLKFDDEEAQAVFWHSSAHVLGEALERIYGGCLCYGPPIDSGYYYDMFLDSKGISQTDFPVVESLMKNIVKEKQPFERLEMKKEDLIEMFKYNEFKQRILKEKVTTPTTTVYRCGPLIDLCRGPHIRHTGKIKALKVTKNSSTYWEGKADAETLQRVYGISFPDPKKLKEWEHLQEEAAKRDHRKIGREQELFFFHELSPGSCFFQPKGAHIYNTLMSFIKEQYRKRGFEEVISPNMYNVKLWQTSGHWSHYEENMFSFDIEKEKFALKPMNCPGHCLMFDNRVRSWRELPLRLADFGVLHRNELSGALTGLTRVRRFQQDDAHIFCTSEHIRDEIHKCLDFVSFVYSAFGFTFELCLSTRPEKFIGEAELWDSAEKALAD

SEQ ID NO: 23542 - protein, 231 aa, Diabrotica virgifera
  misc_feature: Coding regions on vcDNA: vcDNA=SeqID_3239; Strand=+; Position=224-919
  misc_feature: Homolog annotation: Hit_ID=AAF90150.1; Match level="QueryCoverage =96%, HitCoverage=98%, E-value=2e-38, Identity=40%"; Hit description =tetraspanin F139 [Apis mellifera]
  misc_feature: Gene Ontology Annotation: Molecular function=signal transducer activity; Cellular component=integral to plasma membrane; Biological process=cell adhesion
  misc_feature: Pfam annotation: Pfam_ID=Tetraspannin; Match level="Score=164.5, E -value=2.3e-46, Copies=1"; Pfam description=Tetraspanin family
MCGTAMGCAEGIVKLFVFGANIIFALGGLALIVVGVLYKLNINDFTEAIPEEYSSIGVAPILTIVVGSIIFVIAFFGCCGAIRESPCLLTTYGVILLVIFLLQIAVGVFAFIEIKDKDNFKTQVNKQLDTLFNRAKDQNKHELTDLIQKEFECCGPDGPSFWGASIPKSCLDSNNKQYTDGCKTEFYDFLNKAMNVIGITLLALSALEVIGCVFSLCLSSSIKNRERRFRY

SEQ ID NO: 23543 - protein, 60 aa, Diabrotica virgifera
  misc_feature: Coding regions on vcDNA: vcDNA=SeqID_3240; Strand=+; Position=174-353
VNHWNFISTSIFFEDLEDVKLHSIEKTENWIINRIFFYKLTCWCEKTKKIYKILIYIKLK

SEQ ID NO: 23544 - protein, 75 aa, Diabrotica virgifera
  misc_feature: Coding regions on vcDNA: vcDNA=SeqID_3241; Strand=+; Position=1188 -1412
PGGTLFKKKKKGPGDKKINFFFSTPFNPPNYFFLNKTPLFQNDRAPIYYIPNTRHYSLLFFVIKKKMKKKKTCLL

SEQ ID NO: 23545 - protein, 130 aa, Diabrotica virgifera
  misc_feature: Coding regions on vcDNA: vcDNA=SeqID_3242; Strand=+; Position=546-935
LTIIIILIADTKVALKTMLEELNDEAENRGLRVNYNKKKIMTNPDENSLITLGQNIIEQVKKYILRTYLNTQQGKPNGRNKKANQTGLDSIRYIKLHFEKQKIPEISLEREFLTSVYFLFSHMAPKFGHL

SEQ ID NO: 23546 - protein, 570 aa, Diabrotica virgifera
  misc_feature: Coding regions on vcDNA: vcDNA=SeqID_3243; Strand=+; Position=2-1710
  misc_feature: Homolog annotation: Hit_ID=XP_397082.1; Match level="QueryCoverage =99%, HitCoverage=59%, E-value=0.0, Identity=58%"; Hit description =similar to CG15110-PA [Apis mellifera]
  misc_feature: Gene Ontology Annotation: Cellular component=integral to membrane
  misc_feature: Pfam annotation: Pfam_ID=Exostosin; Match level="Score=165.8, E-value= 9.3e-47, Copies=1"; Pfam description=Exostosin family
  misc_feature (551)..(552): Xaa can be any naturally occurring amino acid
DLKVGVEELLRIRGSVLSELRDIERKRQQYKMEIQTYVKNIDELKQELTHQQTNLNRLKISVEQAQVAQREALQQNTPDLALPKKLSADVLPEVLPPVSRYVSKRCRMFSCFDHSRCSLTSGFPVYLYDPDQFPVMHDGWDVDGFLKTTLKQTLGYNPHLTNDPKQACIFLVLVGEALKDTDDVSENVGNHLNLPPLDSDALKRLPYWGGDGRNHILLNLARRDLMSVSGDVFSGVDTGRAILVQSTFTYDLYRSGFDLIISPVLGPPGGDVWQECNPMLPARRHYLLTFQGEIKKQKSPSPRPSFDDSEDSNVELNRFILDHLVQLSKTTTSDKFLFEFECNPASDNNLNVANQDWALCGTDSSRRAVLKDSTFVLIFAPGQEDLISTTLLQARIYEALRSGAVPVILGGDQIKLAYDEVIQWKRAAVFLPRPRITELHFLLRAIPDEDVLLLRRQGRLIWERYLASVQSTLDTIVAVLRDRLNIPAAAADTVLALSVFNETFQPIQVSVASEVEQEESLGPLEPPFDSPTYRRNYSISLVQGPEIWNEXXVIPFRLYPALPMDPLLSS

SEQ ID NO: 23547 - protein, 613 aa, Diabrotica virgifera
  misc_feature: Coding regions on vcDNA: vcDNA=SeqID_3244; Strand=+; Position=91-1932
  misc_feature: Homolog annotation: Hit_ID=A46091; Match level="QueryCoverage=99%, HitCoverage=99%, E-value=0.0, Identity=89%"; Hit description=H+ -exporting ATPase (EC 3.6.3.6) chain A, vacuolar (HO68 type) - human sp|P38607|VAA2_HUMAN
  misc_feature: Gene Ontology Annotation: Molecular function=hydrogen-transporting ATPase activity, rotational mechanism; Cellular component=integral to plasma membrane; Biological process=transport
  misc_feature: Pfam annotation: Pfam_ID=ATP-synt_ab; Match level="Score=324.0, E -value=2.3e-94, Copies=1"; Pfam description=ATP synthase alpha/beta family, nucle
MSKVRIGDEEKEGQYGYVHAVSGPVVTAEKMSGSAMYELVRVGYYELVGEIIRLEGDMATIQVYEETSGVTVGDPVLRTGKPLSVELGPGIMGSIFDGIQRPLKDICDATDSIYIPKGINVPSLSRTAKWDFNPINIKLGSHLTGGDIYGLVHENTLVKHKMILPPRAKGTVTYIAEPGNYTVDEVVLETEFDGDRTKYTMLQVWPVRQARPVSEKLPANHPLLTGQRVLDALFPCVQGGTTAIPGAFGCGKTVISQSLSKYSNSDVIIYVGCGERGNEMSEVLRDFPELTVEIDGHTESIMKRTALVANTSNMPVAAREASIYTGITLSEYFRDMGYNVSMMADSTSRWAEALREISGRLAEMPADSGYPAYLGARLASFYERAGRVKCLGNPDREGSVSIVGAVSPPGGDFSDPVTTATLGIVQVFWGLDKKLAQRKHFPSVDWLGSYSKYLRALDDFYDKNFQEFIPLRTKVKEILQEEDDLAEIVQLVGKASLAETDKITLEIARLLKEDFLQQNSYSSYDRFCPFYKTVGMLRNMIGLYDMARHAVESTAQSENKITWNVIRDSMSGILYQLSSMKFKDPVKDGEAKIKADFDQLYEDIQQAFRNLED

SEQ ID NO: 23548 - protein, 253 aa, Diabrotica virgifera
  misc_feature: Coding regions on vcDNA: vcDNA=SeqID_3245; Strand=+; Position=506-1267
  misc_feature: Homolog annotation: Hit_ID=NP_524100.1; Match level="QueryCoverage =77%, HitCoverage=55%, E-value=8e-15, Identity=29%"; Hit description =CG5904-PA [Drosophila melanogaster] gb|AAF49552.1| CG5904-PA [Drosophila melanogaster]
  misc_feature (199)..(199): Xaa can be any naturally occurring amino acid
  misc_feature (214)..(214): Xaa can be any naturally occurring amino acid
  misc_feature (250)..(250): Xaa can be any naturally occurring amino acid
LISFYIKLKMSLNKLNLIWRQNSSKNNLLFTVCYQKYSYAYKSTGPNKKDSSSSSSSSSSSSDSDLGLPSKQDTENKNKETITKLNSLLQQLIQNDEVAKSSNLVLARPKSKRVPKEERQAKKVESVETKLVNAVSDVAKDIGGDTKQTESELLSKLLGPGDSTPSSKSLNDIVKGMKIDREVKSAEKSRAEQIRNILXNMQAKQRQDPRKPMXPGRKTQQQFKPQQEMVVQKIDLFGSKPLSIFTHKTXQRK

SEQ ID NO: 23549 - protein, 443 aa, Diabrotica virgifera
  misc_feature: Coding regions on vcDNA: vcDNA=SeqID_3246; Strand=+; Position=115-1446
  misc_feature: Homolog annotation: Hit_ID=XP_312860.1; Match level="QueryCoverage =92%, HitCoverage=88%, E-value=0.0, Identity=76%"; Hit description =ENSANGP00000016660 [Anopheles gambiae]
  misc_feature: Gene Ontology Annotation: Molecular function=isocitrate dehydrogenase (NADP+) activity; Cellular component=mitochondrion; Biological process=carbohydrate metabolism
  misc_feature: Pfam annotation: Pfam_ID=Iso_dh; Match level="Score=399.6, E-value=4e- 117, Copies=1"; Pfam description=Isocitrate/isopropylmalate dehydrogen
MAGTLTKFCKNLKDVSAVKNGVLAPAVYVQNRNYASGKRVEVAKPVVEMDGDEMTRIIWHKIKESLIFPYVKLECLYFDLGLPYRDQTNDQVTIDAAHAILKHNVGIKCATITPDEQRVEEFKLKSMWKSPNGTIRNILGGTVFREPILCKNIPRLVPGWTQSMVIGRHAHGDQYKAVDIVVEKPGKLELVLTTDDGKEQRTEVFRYKGAGVGMAMYNTDESIESFAHSSFQVGLQKGWPVYLSTKNTILKKYDGRFKDIFQEIFDKHYKAQFDAKKIWYEHRLIDDMVAQAIKSSGGFVWSCKNYDGDVQSDVVAQGYGSLGMMTSVLMCPDGKTIESEAAHGTVTRHYRMHQKGQQTSTNPIASIFAWTRGLIHRGNLDGNKDLVNFGNKLEQACIDTVESGKMTKDLAASIHGLPNVKEGMFLSTQDFLEAISEQLKRSV

SEQ ID NO: 23550 - protein, 291 aa, Diabrotica virgifera
  misc_feature: Coding regions on vcDNA: vcDNA=SeqID_3247; Strand=+; Position=3-878
DAWDFLKMRLLLLLGFILTVRAASRPLQTYFRSLPNHWFRGFGSTTAAPPTPFVEINGQPSSTPAPYLADNFQSINNRLSSDIRSDFGSTTSSPPTSFIELNQESVSTPSPLENEGLQASSTPFNLNSGLVYGQNLQNYGQNLQSYGQNLQSYGQNLLSYGQNLHGNLFNGFGSTTSAPPTSLVELNSESVSTPAPLESGGLQSGNIPFNLNNGLLSGQNINGNLLFNGFQSTTSAPPTSFVELNGQSVSTPAPFQNEAIQSSSIPFNVNNGLLSGFGSDVSNNLQSYGQC

SEQ ID NO: 23551 - protein, 326 aa, Diabrotica virgifera
  misc_feature: Coding regions on vcDNA: vcDNA=SeqID_3248; Strand=+; Position=82-1059
  misc_feature: Homolog annotation: Hit_ID=XP_311198.1; Match level="QueryCoverage =97%, HitCoverage=78%, E-value=1e-144, Identity=78%"; Hit description= ENSANGP00000019083 [Anopheles gambiae]
  misc_feature: Gene Ontology Annotation: Molecular function=molecular_function unknown; Cellular component=cytoplasm; Biological process=biological_ process unknown
  misc_feature: Pfam annotation: Pfam_ID=MMR_HSR1; Match level="Score=107.2, E-value =4.2e-29, Copies=1"; Pfam description=GTPase of unknown function
FNTLILIYKSMPPKKAQEPERKPLIGRVGTNLRVGIVGVPNVGKSTFFNVLTKSSAAAENFPFCTIDPNESRVPVPDERFDFLCEYFKPLSKVPAFLNIVDIAGLVKGASEGQGLGNAFLSHISACDSIFHLCRAFEDDDVTHVEGEVDPVRDLDIICEELRLKDEDMLMKNLEKLERTVGRGGDKKLKPEYDTLLKIKQVLVDDKKHIRFADWNANDIEILNKYLFLTSKPAMYLVNLSEKDYIKKKNKWLVKIKEWVDKHDPGSLIVPFSGVFEHKLVEEYEDPVRRKTFLEEKGTTSALDKIIVQGYKTLQLEYFFTAGADEV

SEQ ID NO: 23552 - protein, 165 aa, Diabrotica virgifera
  misc_feature: Coding regions on vcDNA: vcDNA=SeqID_3249; Strand=+; Position=386-880
  misc_feature: Homolog annotation: Hit_ID=NP_996411.1; Match level="QueryCoverage =98%, HitCoverage=20%, E-value=1e-34, Identity=45%"; Hit description =CG32666-PA, isoform A [Drosophila melanogaster] ref|NP_727533.1| CG32666-PB, isoform B [Drosophila
  misc_feature: Gene Ontology Annotation: Molecular function=protein serine/threonine kinase activity; Cellular component=nucleus; Biological process =induction of apoptosis
  misc_feature: Pfam annotation: Pfam_ID=Pkinase; Match level="Score=-96.1, E-value =0.0062, Copies=1"; Pfam description=Protein kinase domain
  misc_feature (129)..(129): Xaa can be any naturally occurring amino acid
  misc_feature (138)..(138): Xaa can be any naturally occurring amino acid
  misc_feature (149)..(149): Xaa can be any naturally occurring amino acid
  misc_feature (157)..(157): Xaa can be any naturally occurring amino acid
  misc_feature (160)..(160): Xaa can be any naturally occurring amino acid
MLGFTPSRDGLLQIEDDLLSTLVLKEPITGVYDLDKTPLGRGKYATVWRAVHKKTGTAYAAKFVKKRRRNQDQMKEIIHEIAVLMQCKMTNRVIRLHEVYESITEMVLVLELAAGGELQHILDGGHVLXRGGSPVSMXQILEGVAYLHXQNIAHLDXEPXNLLLS

SEQ ID NO: 23553 - protein, 161 aa, Diabrotica virgifera
  misc_feature: Coding regions on vcDNA: vcDNA=SeqID_3250; Strand=+; Position=355-840
  misc_feature: Homolog annotation: Hit_ID=AAF13316.1; Match level="QueryCoverage =100%, HitCoverage=100%, E-value=4e-76, Identity=83%"; Hit description=translation initiation factor 5A [Spodoptera frugiperda] gb|AAF13315.1| translation initiation factor 5A
  misc_feature: Gene Ontology Annotation: Molecular function=translation initiation factor activity; Cellular component=ribosome; Biological process =translational initiation
  misc_feature: Pfam annotation: Pfam_ID=eIF-5a; Match level="Score=85.9, E-value=1e -22, Copies=1"; Pfam description=Eukaryotic initiation factor 5A hypusi
MADNLDDSHFETGDSGASATYPMQCSALRKNGFVMLKSRPCKIVEMSTSKTGKHGHAKVHLVGIDIFTGKKYEDICPSTHNMDVPHVKREDYQLTDISDDDYLSLMSDNGELREDLKVPDGEVGGTVRAEHAAGKDILCTVLKSCGEEVVIAVKTNTALDK

SEQ ID NO: 23554 - protein, 397 aa, Diabrotica virgifera
  misc_feature: Coding regions on vcDNA: vcDNA=SeqID_3251; Strand=+; Position=3-1190
  misc_feature: Homolog annotation: Hit_ID=XP_312855.1; Match level="QueryCoverage =98%, HitCoverage=37%, E-value=1e-103, Identity=47%"; Hit description= ENSANGP00000021497 [Anopheles gambiae]
  misc_feature: Gene Ontology Annotation: Molecular function=protein C-terminus binding; Cellular component=synaptic vesicle; Biological process =synaptic vesicle priming
  misc_feature (60)..(60): Xaa can be any naturally occurring amino acid
  misc_feature (81)..(81): Xaa can be any naturally occurring amino acid
  misc_feature (83)..(83): Xaa can be any naturally occurring amino acid
  misc_feature (372)..(373): Xaa can be any naturally occurring amino acid
  misc_feature (376)..(376): Xaa can be any naturally occurring amino acid
  misc_feature (380)..(381): Xaa can be any naturally occurring amino acid
  misc_feature (383)..(383): Xaa can be any naturally occurring amino acid
  misc_feature (390)..(390): Xaa can be any naturally occurring amino acid
SSDGGAVQSLNIAFYIALLRIEKAEQLDPLVHVYNTDKYSSSAVDTMTIFYLAKVFCEQXLNWSDLKNCHTFIAEIIDDIXKXSAIYADKMKDRVDGLRDTQHIYEKRFEVTNEWCLAINNIDYVRETLEPFTRDLGMTEVIEKICDLKSPLDGQRCEQTLENVIANAIDTVRNKIIELLETVVNKMAPSMKRLLIEGAELCDQDSNSMDRLMMYVDNNLCTLHRELNDENFNRTLEIVWNMLADTLEDIIQTNVDKRRPPSFFANLHKTLNLMLGSFKNPNDCDSCDALTRTEQTLRVHGLETTDLIHEVHKNLTAKFKNTKDSPFGEISVRAKFQDNDLIVEVMNARNLMAMDSNGSCDSFVRVHLGTEXXVIXIEKXXDXNPHRMQXPLYDEQF

SEQ ID NO: 23555 - protein, 870 aa, Diabrotica virgifera
  misc_feature: Coding regions on vcDNA: vcDNA=SeqID_3252; Strand=+; Position=29-2637
  misc_feature: Homolog annotation: Hit_ID=AAP94045.1; Match level="QueryCoverage =93%, HitCoverage=88%, E-value=1e-156, Identity=36%"; Hit description= membrane alanyl aminopeptidase [Tenebrio molitor]
  misc_feature: Gene Ontology Annotation: Molecular function=receptor activity; Cellular component=integral to plasma membrane; Biological process =pathogenesis
  misc_feature: Pfam annotation: Pfam_ID=Peptidase_M1; Match level="Score=382.7, E -value=4.6e-112, Copies=1"; Pfam description=Peptidase family M1
  misc_feature (851)..(851): Xaa can be any naturally occurring amino acid
  misc_feature (854)..(854): Xaa can be any naturally occurring amino acid
MWVILLLSILASATASNPDLASSDTDPDLFPVQRATEEAEISSNKYLLSSPVIPTHYDVGLTVPLEALSGGSTNYDGTVDITLSVINATNVVQLHSLVNIVSITFTDSSIVIHNYTLNPNLETISIFLNSTLNANAIYKLNIKFNASLEKVNMRGFYRSDYIINGTKEYLATTQFQATSARRAFPCFDEPGLKATFQLTLTHPSEFNAKSNTPSQSQAVVQATNTTTTVFEKTPVMSIYLIAIVISKFNCTSSTNLGTNFGVCSRTDLSNDRNEALKYGMKILEAFDTYTASPYNLTNLKKLDQFAIPDFSAGAMENWGIVTYREYSLIWNNEQTSRALRQSLLSIVAHEFAHNWFGNLVTTKWWDTTFLNEGFARYFQYFILTKITDLSDFQMDKQFIVEQQQTAFIEDASPLSRSLTSEAWTPAEISNKFNTISYNKGACVFRMIENLIGSVAFQTALQKYLNATAYGSGTTEKLWANFPNSIALPPNVNFTDFVDNWTNKPGFPVVNAVFNGKNVTFSQKRFLYTGNNNTQWYIPITYRLSNSSSYETFWLAPNSSVTILNNLTDKDWLIVNDDSRGYYRVKYCKRLTQRIQSLLNQNHTQISELNRAQILDDSLNLARAGYIKYSEAFELLEYLKNETSYFPWFTTIKNMDYLVTRLGANTELGKRTNAMILDLISQISANISTTKWEEIDQVTTLKLQRVWADACKRGQASCISETKRLFQALRLNKTSVNPNIRDVVYCNALRNSNNIAADWEFLWNRLLISIHPQEDLYILLSLGCTTHKPYLTRLLDATINSTSVIKLQNLYTVWNSVGSASKEGLDLAFEYFVNNYKKIIEYYPDGISLLSXLAXRFTTNAEVTKLQQFAD

SEQ ID NO: 23556 - protein, 244 aa, Diabrotica virgifera
  misc_feature: Coding regions on vcDNA: vcDNA=SeqID_3253; Strand=+; Position=105-836
  misc_feature: Homolog annotation: Hit_ID=XP_317153.1; Match level="QueryCoverage =98%, HitCoverage=65%, E-value=1e-106, Identity=76%"; Hit description= ENSANGP00000025137 [Anopheles gambiae]
  misc_feature: Gene Ontology Annotation: Molecular function=mRNA binding; Cellular component=snRNP U1; Biological process=mRNA splicing
  misc_feature: Pfam annotation: Pfam_ID=LUC7; Match level="Score=404.2, E-value=1.6e- 118, Copies=1"; Pfam description=LUC7 N_terminus
MTAHDQMRAMLDQLMGTGRNGESNKFHVKFNDTRVCKSFLLSCCPHEILSSTRMDLGECPKIHDLALRADFDKAQQSKDYFYDLDAMEHLQAFIGDCDRRTESAKQRLAETQEELSAEVAVKANSVHELAEQIGQKLAKAEQLGEEGFVDESMKLMGEVEELRKKKLDAEQEYRNSMPASSYQQQKLRVCEVCSAYLGIHDNDRRLADHFRGKTHLGFIKIREKLADLEENSEKRKREKEKIWQ

SEQ ID NO: 23557 - protein, 184 aa, Diabrotica virgifera
  misc_feature: Coding regions on vcDNA: vcDNA=SeqID_3254; Strand=+; Position=39-593
LLIRKRESNRLQQLAYNSNPVITPIYRSLPFHNTVISEKIKHILCSSDNVHISFKVNNTLNKTLSNTKDPINFMNRSGVYRLSCSDCDASYVGRTYRSLSTRAAEHTKRDNTSAFSHHLKVNKHHLNIPDGVTLIHNIQDKNTLRLDLYEDLEIVRDARTSPNCVNRQLSLNRDFTPIHRQLFP

SEQ ID NO: 23558 - protein, 218 aa, Diabrotica virgifera
  misc_feature: Coding regions on vcDNA: vcDNA=SeqID_3255; Strand=+; Position=231-887
  misc_feature: Homolog annotation: Hit_ID=AAS91007.1; Match level="QueryCoverage =99%, HitCoverage=96%, E-value=1e-93, Identity=75%"; Hit description =kiser [Bombyx mori]
  misc_feature: Gene Ontology Annotation: Molecular function=molecular_function unknown; Cellular component=cellular_component unknown; Biological process=biological_process unknown
  misc_feature: Pfam annotation: Pfam_ID=MSF1; Match level="Score=241.7, E-value=1.4e- 69, Copies=1"; Pfam description=MSF1-like conserved region
MKIWTSEHTFNHPWEKVATAAWRKYPNPHNTAVIGTDVVERKVVDGVLHTHRLVSSIWYFPRWAQALIGSAKICYASEQSEVNPSLRHMVLKTINLTFCRHIAVNETLKYTPHPSDSTKTLLKQEAVVTVKGVPLTNYMEDLLTTKISNNAGKGRQAMEWVINKLNDEVKDLTRSTDEIFSHTKRSLDDIATSAKKSMGDISQKAKKSLDDMQTMTLS

SEQ ID NO: 23559 - protein, 364 aa, Diabrotica virgifera
  misc_feature: Coding regions on vcDNA: vcDNA=SeqID_3256; Strand=+; Position=21-1113
  misc_feature: Homolog annotation: Hit_ID=EAA06007.2; Match level="QueryCoverage =82%, HitCoverage=52%, E-value=7e-70, Identity=46%"; Hit description =ENSANGP00000005557 [Anopheles gambiae str. PEST] ref|XP_559520.1| ENSANGP00000005557 [Anopheles gambiae st
  misc_feature: Pfam annotation: Pfam_ID=GMC_oxred_N; Match level="Score=316.9, E -value=3.1e-92, Copies=1"; Pfam description=GMC oxidoreductase
  misc_feature (352)..(352): Xaa can be any naturally occurring amino acid
MFRSVFFFCIFISVSSKDYYTKEDVDDYVKLLEDAVESSKTYQPATSAHEYKALKSGPPQDAGDYDFIVVGSGSTGSLVASRLSENPDWNVLVLEAGNFGNNITDVTAMSYKAMIMSDYNWGYYSVPQNNTCLGFEENRCPHIRGKGVGGTSLLNALIDIRGNRLDFDNWCAMGNKGWCYNETLPFFLKTEHLHWTDPNAPIDPAYHNSTGLLWVEQPMPRTEHTKIFLEANEQMGYKIRDVNGAEQIGVMPFQINTRYGRRQDSGTAFIKPFLNRKNLKVLTKALATKIIIKNKTATGVQYLQNGVLYEARSNKEVIVSAGAINSPQLLMLSGIGPKAHLQKFNIPVIQDXEVGSSLSDHLPV

SEQ ID NO: 23560 - protein, 320 aa, Diabrotica virgifera
  misc_feature: Coding regions on vcDNA: vcDNA=SeqID_3257; Strand=+; Position=3-961
  misc_feature: Homolog annotation: Hit_ID=XP_317256.1; Match level="QueryCoverage =99%, HitCoverage=62%, E-value=4e-82, Identity=47%"; Hit description =ENSANGP00000021816 [Anopheles gambiae]
  misc_feature: Pfam annotation: Pfam_ID=p450; Match level="Score=-38.4, E-value=1.5e- 09, Copies=1"; Pfam description=Cytochrome P450
  misc_feature (296)..(296): Xaa can be any naturally occurring amino acid
SIGDEIAEIYQKARDNGWKHLGLYNMVSPVYMPLDLDIIKLILTKDFNHFVDRGIYVNEKDEPISAHLFAIGGKKWRNLRTKFTPTFTSGKMRAMFQTIAQCGTQLNKYLVEEISHHEPIDIKNILGNFATDVIGSCAFGLECNSFKDPNNPFRVNGRQIFQRTNFENLKFMTATIFPNLARRFGVKMLRKEVSDFFSKVVTDTVNYREKNQVHRNDFMQLLIDIKNNKEGEHTPGDGTSLTLDEMIAQSFVFFIAGFETSSTTMTFALYELGKNQSVQDTLRDEINHVLKKYNGXITYDAINEMKYMNQVIDETLRMYP

SEQ ID NO: 23561 - protein, 238 aa, Diabrotica virgifera
  misc_feature: Coding regions on vcDNA: vcDNA=SeqID_3258; Strand=+; Position=237-952
  misc_feature: Homolog annotation: Hit_ID=EAL42121.1; Match level="QueryCoverage =92%, HitCoverage=42%, E-value=5e-48, Identity=41%"; Hit description =ENSANGP00000026844 [Anopheles gambiae str. PEST] ref|XP_560700.1| ENSANGP00000026844 [Anopheles gambiae st
  misc_feature (204)..(204): Xaa can be any naturally occurring amino acid
MSIITGVILYDVIGVAIGLVTLAWIYSKWALQYWKNKGVPYFEPAVFWGNLRPPHRRDRSIGDEIAEIYQKARDNGWKHLGLYNMVSPVYMPLDLDIIKLILTKDFNHFVDRGIYVNEKDEPISAHLFAIGGKKWRNLRTKFTPTFTSGKMRAMFQTIAQCGTQLNKYLVEEISHHEPIDIKNILGNFATDVIGSCAFGLECNXFKDPNNPFRVNGRKIFQRTNFENLKFMTATIFPN

SEQ ID NO: 23562 - protein, 97 aa, Diabrotica virgifera
  misc_feature: Coding regions on vcDNA: vcDNA=SeqID_3259; Strand=-; Position=63-355
  misc_feature: Homolog annotation: Hit_ID=AAC46945.1; Match level="QueryCoverage =82%, HitCoverage=24%, E-value=1e-09, Identity=42%"; Hit description =mariner transposase pir||S35520 transposase - lacewing
  misc_feature (34)..(34): Xaa can be any naturally occurring amino acid
MRNIFATLSIHKIHADFILGEHPPYSPDFVPSDXLTKKFVGGKPFSSSNNEVITDVEVYFAGLQDYQFREGIHKLESHCNQCIDVQGEYTQYVHQPP

SEQ ID NO: 23563 - protein, 168 aa, Diabrotica virgifera
  misc_feature: Coding regions on vcDNA: vcDNA=SeqID_3260; Strand=-; Position=1042 -1551
  misc_feature: Homolog annotation: Hit_ID=XP_307274.1; Match level="QueryCoverage =89%, HitCoverage=31%, E-value=8e-19, Identity=37%"; Hit description =ENSANGP00000023005 [Anopheles gambiae]
  misc_feature (59)..(59): Xaa can be any naturally occurring amino acid
  misc_feature (86)..(86): Xaa can be any naturally occurring amino acid
  misc_feature (107)..(107): Xaa can be any naturally occurring amino acid
HLYVVLSCVTYSYEQLNMGNRTSMPFSIILGLRQGDPLSPLLFNLALECAISKISSELXSKLLLAFADDLDAASSIQQETCEVFLXLDEETGSLGLRINEEKTKYVXLVTKNPRPRVRQNIIINDRNLEVAKEFKYLNPVITDDKHIDKEVLARISAGNKALYSLSSF

SEQ ID NO: 23564 - protein, 528 aa, Diabrotica virgifera
  misc_feature: Coding regions on vcDNA: vcDNA=SeqID_3261; Strand=+; Position=90-1675
  misc_feature: Homolog annotation: Hit_ID=AAV74190.1; Match level="QueryCoverage =99%, HitCoverage=99%, E-value=0.0, Identity=73%"; Hit description =chitinase 1 [Tribolium castaneum]
  misc_feature: Gene Ontology Annotation: Molecular function=chitinase activity; Cellular component=extracellular space; Biological process=chitin catabolism
  misc_feature: Pfam annotation: Pfam_ID=Glyco_hydro_18; Match level="Score=464.0, E -value=1.6e-136, Copies=1"; Pfam description=Glycosyl hydrolases family 18
  misc_feature (261)..(261): Xaa can be any naturally occurring amino acid
MFLKTVVLVFLASFQTIDATPAKVVCYFSNWAIYRPGSGRYALDDVPVDLCTHLIYSFIGVDDKSWSILVIDPELDIEQNGFRNFSDIKKTHPHVKLEIAVGGWAEGGSKYSALVAQQARRDSFISSVVAFMKEYNLDGFDLDWEYPGAADRGGSFSDKDKFFYFVEELRRAFDNEGKGWEITMAVPVAKFRLQEGYYVPELCDLVDAIHVMSYDLRGNWAGFADTHSPLYKRPHDQWAYEKLNVNDGAQLWVDAGCSPKXLVIGIPFYGRTFTLSAGNTNYNLGTYINKEAGGGAPGPYTNATGFLAYYEICTELLKENNGWTKKWDEHGKVPYAYKGTQWVGYEDPESVQIKMNWIKSKGYAGAMTWAIDMDDFHGLCGPTNVLMHILHANMDSYSVPEPHVSTTARPEWDRPKSTTSSGSATVVTSSTPKPPKPTYSSTVPTSQQTTNGAPTQPTAPSSSSYYPEDADNLTECDADFMPHRDCDKYYRCDHGKPTLFNCEPGTVFHTGLNVCDWPANSDREECRP

SEQ ID NO: 23565 - protein, 283 aa, Diabrotica virgifera
  misc_feature: Coding regions on vcDNA: vcDNA=SeqID_3262; Strand=-; Position=2-847
  misc_feature: Homolog annotation: Hit_ID=XP_314289.1; Match level="QueryCoverage =99%, HitCoverage=86%, E-value=1e-149, Identity=95%"; Hit description= ENSANGP00000024565 [Anopheles gambiae]
  misc_feature: Gene Ontology Annotation: Molecular function=ribose-phosphate pyrophosphokinase activity; Cellular component=cellular_component unknown; Biological process=nucleobase, nucleoside, nucleotide and nucleic acid metabolism
  misc_feature: Pfam annotation: Pfam_ID=Pribosyltran; Match level="Score=130.7, E -value=3.5e-36, Copies=1"; Pfam description=Phosphoribosyl transferase domain
  misc_feature (264)..(264): Xaa can be any naturally occurring amino acid
  misc_feature (270)..(270): Xaa can be any naturally occurring amino acid
RKKMPNIKVFSGTSHPDLAQRIVDRLGIDLGKVVTKKFSNLETCVEIGESVRGEDVYIVQSGCGEVNDNLMELLIMINACKIASASRVTAVIPCFPYARQDKKDKSRAPISAKLVANMLSVAGADHIITMDLHACQIQGFFDIPVDNLYAEPAVLKWIKENIAEWRNSIIVSPDAGGAKRVTSIADRLNVEFALIHKERKKANEVASMVLVGDVKDRVAILVDDMADTCGTICHAAEKLMEAGATKVYAILTHGIFSGPAISRXNNACFXEAVVVTNTIPQDA

SEQ ID NO: 23566 - protein, 376 aa, Diabrotica virgifera
  misc_feature: Coding regions on vcDNA: vcDNA=SeqID_3263; Strand=-; Position=277-1407
  misc_feature: Homolog annotation: Hit_ID=XP_314288.1; Match level="QueryCoverage =91%, HitCoverage=75%, E-value=1e-179, Identity=92%"; Hit description= ENSANGP00000013157 [Anopheles gambiae]
  misc_feature: Gene Ontology Annotation: Molecular function=ribose-phosphate pyrophosphokinase activity; Cellular component=cellular_component unknown; Biological process=nucleobase, nucleoside, nucleotide and nucleic acid metabolism
  misc_feature: Pfam annotation: Pfam_ID=Pribosyltran; Match level="Score=134.2, E -value=3e-37, Copies=1"; Pfam description=Phosphoribosyl transferase domain
PVLSLQDPLELEVEAGAIVQKNVVRELVKETPLLKKKMPNIKVFSGTSHPDLAQRIVDRLGIDLGKVVTKKFSNLETCVEIGESVRGEDVYIVQSGCGEVNDNLMELLIMINACKIASASRVTAVIPCFPYARQDKKDKNISSEKELHVEKWKSIEWKFRSRAPISAKLVANMLSVAGADHIITMDLHASQIQGFFDIPVDNLYAEPAVLKWIKENIAEWRNSIIVSPDAGGAKRVTSIADRLNVEFALIHKERKKANEVASMVLVGDVKDRVAILVDDMADTCGTICHAAEKLMEAGATKVYAILTHGIFSGPAISRINNACFEAVVVTNTIPQDGHMKDCSKVQCIDVSMMFAEAVRRTHNGESVSYLFSNVPY

SEQ ID NO: 23567 - protein, 215 aa, Diabrotica virgifera
  misc_feature: Coding regions on vcDNA: vcDNA=SeqID_3264; Strand=+; Position=1073 -1720
  misc_feature: Homolog annotation: Hit_ID=AAC38959.1; Match level="QueryCoverage =98%, HitCoverage=45%, E-value=1e-111, Identity=93%"; Hit description= elongation factor-1alpha F2 [Apis mellifera]
  misc_feature: Gene Ontology Annotation: Molecular function=translation factor activity, nucleic acid binding
  misc_feature: Pfam annotation: Pfam_ID=GTP_EFTU_D3; Match level="Score=210.8, E -value=2.7e-60, Copies=1"; Pfam description=Elongation factor Tu C -terminal domai
FVVFQDVYKIGGIGTVPVGRVETGILKPGMVVTFAPVGLTTEVKSVEMHHEALQEAVPGDNVGFNVKNVSVKELRRGYVAGDSKNNPPRGASDFMAQVIVLNHPGQIANGYTPVLDCHTAHIACKFAEIKEKCDRRTGKTTEENPKAIKSGDAAIVNLVPSKPMCVESFQEFPPLGRFAVRDMRQTVAVGVIKSVTFKDTAGKVTKAAEKAQKKK

SEQ ID NO: 23568 - protein, 461 aa, Diabrotica virgifera
  misc_feature: Coding regions on vcDNA: vcDNA=SeqID_3265; Strand=+; Position=31-1416
  misc_feature: Homolog annotation: Hit_ID=AAC38959.1; Match level="QueryCoverage =100%, HitCoverage=100%, E-value=0.0, Identity=94%"; Hit description =elongation factor-1alpha F2 [Apis mellifera]
  misc_feature: Gene Ontology Annotation: Molecular function=translation factor activity, nucleic acid binding
  misc_feature: Pfam annotation: Pfam_ID=GTP_EFTU; Match level="Score=371.1, E-value =1.5e-108, Copies=1"; Pfam description=Elongation factor Tu GTP binding doma
MGKEKIHINIVVIGHVDSGKSTSTGHLIYKCGGIDKRTIEKFEKEAQEMGKGSFKYAWVLDKLKAERERGITIDIALWKFETAKYYVTIIDAPGHRDFIKNMITGTSQADCAVLIVAAGTGEFEAGISKNGQTREHALLAFTLGVKQLIVGVNKMDSTEPPYSETRFEEIKKEVSSYIKKIGYNPAAVAFVPISGWHGDNMLESSDKMPWFKGWAVERKEGKAEGKTLIEALDAILPPSRPTEKPLRLPLQDVYKIGGIGTVPVGRVETGILKPGMVVTFAPVGLTTEVKSVEMHHEALQEAVPGDNVGFNVKNVSVKELRRGYVAGDSKNNPPRGASDFMAQVIVLNHPGQIANGYTPVLDCHTAHIACKFAEIKEKCDRRTGKTTEENPKAIKSGDAAIVNLVPSKPMCVESFQEFPPLGRFAVRDMRQTVAVGVIKSVTFKDTAGKVTKAAEKAQKKK

SEQ ID NO: 23569 - protein, 402 aa, Diabrotica virgifera
  misc_feature: Coding regions on vcDNA: vcDNA=SeqID_3266; Strand=-; Position=329-1537
  misc_feature: Homolog annotation: Hit_ID=AAM50570.1; Match level="QueryCoverage =93%, HitCoverage=88%, E-value=1e-40, Identity=30%"; Hit description =AT24407p [Drosophila melanogaster]
  misc_feature: Gene Ontology Annotation: Molecular function=molecular_function unknown
  misc_feature: Pfam annotation: Pfam_ID=DUF227; Match level="Score=88.7, E-value =1.5e-23, Copies=1"; Pfam description=Domain of unknown function (DUF227)
MEGERIKNLNNLLKPALGENVEIVDKTITNLTQPGENYLSDMLRLQIATRNKDTKTTNTEYFVAKCPVIDEKLPKGIADDIYRMFKPEIAFYKEIIPTMQKFLKEHGLKEVEFFPKLIAARYDLDGNEEPDGDAVMILENLQAAGYSNADRHKGFDLDGAKLLLTDLAVFHAIPLAIKQKDPELFKKTFVDKSFMPKWVDNPTAKGPDGDHGPPQIPRTVLKQILTQDSFCSQHVNKLDGLMSIEEEGFKTGDSFRPKPNKSAFSGFVHKDLWLNNTMQLKNEDGEIIKNKFLDFQVYSVQEITADLIFFLMSSVEIEVLEEHFDDLLMMYHKHFIKTLEALNCDIAPFKYALFINNLKQTAPSEFFHIILMNILVIFGKKKKKGRFEEVKNLTMHDIHPIR

SEQ ID NO: 23570 - protein, 234 aa, Diabrotica virgifera
  misc_feature: Coding regions on vcDNA: vcDNA=SeqID_3267; Strand=+; Position=62-766
MNKLAVFTLLFAIGFQSSAGFRAGFRYNRDVQVMVPAGPVTLEAQPAVQTLEAKLPAVQTLEARPLSIQTLEAHLPEIQTLEARPEVQTLEARPAIATLEARPEVSTLELRPEVSTLELSPEVSTPEHKLTVNDKLAMIKQWVEEQANKPISRLRLKENLAIIRGWLDDRANKVRQSVVDLENKVLPAIQKLKADASHAIDTIKQKVKGQEAQAERTKRAMKQLNRQTRAIKKH

SEQ ID NO: 23571 - protein, 112 aa, Diabrotica virgifera
  misc_feature: Coding regions on vcDNA: vcDNA=SeqID_3268; Strand=+; Position=169-504
  misc_feature: Homolog annotation: Hit_ID=XP_319152.1; Match level="QueryCoverage =93%, HitCoverage=30%, E-value=5e-18, Identity=40%"; Hit description =ENSANGP00000011968 [Anopheles gambiae]
  misc_feature: Pfam annotation: Pfam_ID=Varsurf_PPLC; Match level="Score=1.4, E -value=0.032, Copies=1"; Pfam description=Variant-surface -glycoprotein phospholi
MGNEFRDLADDLENWMSRLPQNVRQIPITNISIPGSHDSFTANITKDSDISPDAEDIVKELSILGPLFKEVIARWSRTQSFLANDQLIRGIRYFDIRTSTKEGTDELYIVHS

SEQ ID NO: 23572 - protein, 361 aa, Diabrotica virgifera
  misc_feature: Coding regions on vcDNA: vcDNA=SeqID_3269; Strand=+; Position=125-1210
  misc_feature: Homolog annotation: Hit_ID=XP_313587.1; Match level="QueryCoverage =100%, HitCoverage=66%, E-value=7e-43, Identity=48%"; Hit description= ENSANGP00000003537 [Anopheles gambiae]
  misc_feature (277)..(277): Xaa can be any naturally occurring amino acid
  misc_feature (288)..(288): Xaa can be any naturally occurring amino acid
  misc_feature (317)..(317): Xaa can be any naturally occurring amino acid
  misc_feature (332)..(332): Xaa can be any naturally occurring amino acid
  misc_feature (346)..(346): Xaa can be any naturally occurring amino acid
MSLRALGSRLFKHGSVLIRNTRNKREFNTKTIADKINAAASHTPPSNFTSNQVVPRSFALRNVGVQIGLQARRILIDNVLNRVTNSLAADLRKRAARRILFGDSGPFFALVGVSLASGTGILTKEEELEGVCWEIREAVSKLKWHHQDIDLDETRFETSPVNLDDLSFGKPLAKGANAVVYAANLKSCDSNVSEQSTAVIDIKDTESDDTNKFPLALKMMFNYDIQSNAMAILNAMYRETVPARLYYSNIGISDWEIDLSKRNRHLPPHPNVVAIFXVFTDYVPELQXARGLYPAALPRRIHPDGEGRNMSLFLLMXRYSTNLENFLRTSPXSVRSSVLIFTQLLXSIAHINAHGIAHRDL

SEQ ID NO: 23573 - protein, 96 aa, Diabrotica virgifera
  misc_feature: Coding regions on vcDNA: vcDNA=SeqID_3270; Strand=+; Position=105-395
  misc_feature: Pfam annotation: Pfam_ID=Kunitz_BPTI; Match level="Score=23.6, E -value=7.5e-06, Copies=1"; Pfam description=Kunitz/Bovine pancreatic trypsin inhi
MKFIYFLFSIVALMAFVYANDQEVFYSSDCFRPVEYHPNGIACMALIPVWRWDVGAQACVRDTYGGCNPTNNNFPTLEECNEVARPICQYLRASVF

SEQ ID NO: 23574 - protein, 248 aa, Diabrotica virgifera
  misc_feature: Coding regions on vcDNA: vcDNA=SeqID_3271; Strand=+; Position=45-791
  misc_feature: Homolog annotation: Hit_ID=NP_076273.1; Match level="QueryCoverage =99%, HitCoverage=94%, E-value=7e-40, Identity=41%"; Hit description =RIKEN cDNA 2310016N21 [Mus musculus] gb|AAF78898.1| YIP1B [Mus musculus] dbj|BAB26268.1|
  misc_feature: Gene Ontology Annotation: Molecular function=molecular_function unknown; Cellular component=membrane; Biological process=regulation of protein activity, epigenetic
  misc_feature: Pfam annotation: Pfam_ID=Yip1; Match level="Score=118.1, E-value=2.1e- 32, Copies=1"; Pfam description=Yip1 domain
MGDYINSNQQDYYWSQQNPPNNQGYYEQDYTQFQNQTLEFNTNIEYNDQAFSNTPQMLIPEQYDNIGKGEDEFDEPPLLEELEIYPDRILEKILAVLNPLRGHSLADDAEYLTKDSDVVGPILFCLLLAANLFLAGKSGYIYGISMISCILMYALLSLMSPDNGTFSLSIVGSILGYCLIPIVALSSLGIFFRLNGPTGLFLAILTIAWSSLSASRLFIAVSGDKEQQPLIAYPCMLVYGVITLLVLF

SEQ ID NO: 23575 - protein, 313 aa, Diabrotica virgifera
  misc_feature: Coding regions on vcDNA: vcDNA=SeqID_3272; Strand=+; Position=58-996
  misc_feature: Homolog annotation: Hit_ID=NP_609374.1; Match level="QueryCoverage =84%, HitCoverage=64%, E-value=5e-71, Identity=51%"; Hit description =CG5390-PA [Drosophila melanogaster] gb|AAF52904.1| CG5390-PA [Drosophila melanogaster]
  misc_feature: Gene Ontology Annotation: Molecular function=serine-type endopeptidase activity; Cellular component=integral to membrane; Biological process=cytoskeleton organization and biogenesis
  misc_feature: Pfam annotation: Pfam_ID=Trypsin; Match level="Score=151.1, E-value =2.5e-42, Copies=1"; Pfam description=Trypsin
  misc_feature (225)..(225): Xaa can be any naturally occurring amino acid
  misc_feature (273)..(273): Xaa can be any naturally occurring amino acid
  misc_feature (291)..(291): Xaa can be any naturally occurring amino acid
  misc_feature (296)..(296): Xaa can be any naturally occurring amino acid
MISLRFTKGVILYFLGWWFIGFTLNAGAVSMNTGTDANLRCGQRNKRGAGNQLSGAQDGEAQFGEFPWMLAIMKNLPGKDPAYKCGGSLINPNVALTAAHCVTDNNTESKYIVRAGLWDMELLVEILPHQDREVKKIIVHPEFIPQALYNDIALLVLTTPLTLAEHIRTVCLPPQGFPLDSSMGRAFVSGWGKTKLANEILDSATILKKTDVPIVEKTKCEENLXKTRLGPKYRMHDSFMCAGGEANKDACKGDGGSPLVLPVGEDNTTYFQXVFAWGIGCWEESRPGVYXNVGKXRNWIDEQMKNNNFDATT

SEQ ID NO: 23576 - protein, 109 aa, Diabrotica virgifera
  misc_feature: Coding regions on vcDNA: vcDNA=SeqID_3273; Strand=-; Position=386-715
RMKKNRKVLTTIKSRKIQYFAHIMRNESRYALLQAILQGKIFRTRGPGRRRHSWLKNLRTWFNTTSLQLFRATADNKKIAMIRRLVANICHEQAHHEEDCLLCTVLNCV

SEQ ID NO: 23577 - protein, 127 aa, Diabrotica virgifera
  misc_feature: Coding regions on vcDNA: vcDNA=SeqID_3274; Strand=+; Position=319-702
ALRYPYIIDMPIRDERWQSSWLSYSQQCGKASQMLNQVLRLFNHDLVPGPRFSNIFPCRMAYLDSFRIMCPKYYNFRDFIVVSISRFSFILLKTSAHRSLNILLYSRISNASNFLHTSWLKVRDSTL

SEQ ID NO: 23578 - protein, 52 aa, Diabrotica virgifera
  misc_feature: Coding regions on vcDNA: vcDNA=SeqID_3275; Strand=-; Position=212-370
SVRYNSSHAVQSTLNQIKSKQKMKRTPMCLVYSIQYTKCIYTSTFVSIYVLT

SEQ ID NO: 23579 - protein, 91 aa, Diabrotica virgifera
  misc_feature: Coding regions on vcDNA: vcDNA=SeqID_3276; Strand=+; Position=726-1001
RMLAIIIAIFTLSAATRKSCTDVVLNQVLRFFNQDVPLLPGPRFPNIFPCRMACRRAYLDSFRIMCPKYSNFRDLMMVSTSRFSLYIIGTL

SEQ ID NO: 23580 - protein, 77 aa, Diabrotica virgifera
  misc_feature: Coding regions on vcDNA: vcDNA=SeqID_3277; Strand=-; Position=494-727
YSQNIDLYLYVFLIKCFLLRDKYYCLLCCTTILDKSASTSSSHLFLGRPTDLPSGLSKTLYFLLILPHDIYLSNLSG

SEQ ID NO: 23581 - protein, 292 aa, Diabrotica virgifera
  misc_feature: Coding regions on vcDNA: vcDNA=SeqID_3278; Strand=+; Position=244-1122
  misc_feature: Homolog annotation: Hit_ID=AAD39461.1; Match level="QueryCoverage =84%, HitCoverage=78%, E-value=2e-37, Identity=35%"; Hit description =reverse transcriptase-like protein [Amblyomma americanum]
NLSGQLKKTIIKIVWEALKVLQKCKKNLVYPESLNDYFVNVSKNITSTILPQQDPISYLSNSRQVSNSFFLRPVDNSELIQTINSIKSKSSCSTDELSIKFFSNLTENVLEILLSLINDSFEKGKFPECLKTAIIIPLHKGGEKSDACNYRPIALLPVLSKIIERLIKTRLMSFIVDNNILSQNQFGFLTNKCTTDAMFSVLHEVYQALNNNLYTATVFCDYAKAFDCVNHDILITKLNFYGIRGISLNWFQSYLNNRKQLVRANDTDSSLKNIVCGVHKVQYWVLYCSLSL

SEQ ID NO: 23582 - protein, 453 aa, Diabrotica virgifera
  misc_feature: Coding regions on vcDNA: vcDNA=SeqID_3279; Strand=+; Position=46-1407
  misc_feature: Homolog annotation: Hit_ID=XP_309657.1; Match level="QueryCoverage =79%, HitCoverage=99%, E-value=3e-95, Identity=47%"; Hit description =ENSANGP00000003881 [Anopheles gambiae]
  misc_feature: Gene Ontology Annotation: Molecular function=lipase activity; Cellular component=extracellular; Biological process=digestion
  misc_feature: Pfam annotation: Pfam_ID=Abhydro_lipase; Match level="Score=70.8, E -value=3.9e-18, Copies=1"; Pfam description=ab-hydrolase associated lipase region
MFIMKQLLLIFALLYSTNAGISLDGVAKAIKDKASSGVTNLVDGIKTDASAIQIGANSALDLGKETTGDISKTLLDLKLENLGTQKRTPVPELVKNEGYPVESYYLTTSDGYILNIFRIPYGKSGKKLNKVAYLQHGLFESSDDWVLMGSKRGLAYILADEGYDVWLGNCRGSYYSRNHTQWNPDKDSEFWQFSWHQIGTTDIPAMIDFILEKTGATKLYHVGHSQGTTSFYVMASMRPEYNAKIAHHISLAPVAYMNHLFSPLMRAMALGTLPIGLTLESLGKNEFLPGSGFLNMLTDSVCSEGVGQVLCKNTLFAMTGFSPKQMNVSDLPLLMAHYPAGASTKQVEHYGQLINSGRFCQYDFTILKNKEHYGQIIPPDYDLSKITAPITLMYSSNDWLAAVVDVEKLAKQLPNLKESYRIPLVTWNHIDYILGKDAPTLVYEKVVSVLSQN

SEQ ID NO: 23583 - protein, 332 aa, Diabrotica virgifera
  misc_feature: Coding regions on vcDNA: vcDNA=SeqID_3280; Strand=+; Position=51-1046
  misc_feature: Homolog annotation: Hit_ID=AAP94193.1; Match level="QueryCoverage =96%, HitCoverage=65%, E-value=3e-77, Identity=47%"; Hit description =cytochrome P450 monooxygenase [Tribolium castaneum]
  misc_feature: Gene Ontology Annotation: Molecular function=monooxygenase activity; Biological process=leukotriene metabolism
  misc_feature: Pfam annotation: Pfam_ID=p450; Match level="Score=-63.2, E-value=2.2e- 08, Copies=1"; Pfam description=Cytochrome P450
KCFGFWSGGAIVALVALIYFNQKKNEEFWKQVMAIPGPEGFPLVGTEYHLDSTEEAFVRDRTYVKLYGTIFRRWASGLAYISLSNPEDIELLLNNTKHLEKDVFYDLLQNWLGQGLLTSKGVEWHKRRKILTPAFHFSILQEFAEVFNKEVSLLVEDIKKSCSKPYIDVVKPISEFTLYSIGETSLGKDLRDDPKCDEYKQAVYDYGDHYMYRMIRPWLHGSFLFNLTEVGKKAQKTCEVLHDFSNNIIRERYETLQKGADAQFAKKRLALLDLMIKAKYNGASIDDLGIREEVDTFILAEDATTAVALMHILMLLANEQEAQEEIYQEIQA

SEQ ID NO: 23584 - protein, 288 aa, Diabrotica virgifera
  misc_feature: Coding regions on vcDNA: vcDNA=SeqID_3281; Strand=+; Position=3-866
  misc_feature: Homolog annotation: Hit_ID=XP_318532.1; Match level="QueryCoverage =57%, HitCoverage=70%, E-value=6e-33, Identity=43%"; Hit description =ENSANGP00000019684 [Anopheles gambiae]
  misc_feature: Gene Ontology Annotation: Molecular function=receptor binding; Cellular component=microfibril; Biological process=cell adhesion
  misc_feature: Pfam annotation: Pfam_ID=Fibrinogen_C; Match level="Score=76.1, E -value=9.6e-20, Copies=1"; Pfam description=Fibrinogen beta and gamma chains, C-t
  misc_feature (271)..(271): Xaa can be any naturally occurring amino acid
MISSIVLLLCVCMSEFVVSEKISAAAPADVKFTKLLDVKFESRTSSLRNDIGRFLYPQTEDIDIGTREDYLQVPVKLLFGIDRQNGIQEYEKTISSMFEQCKYLVGRSQTPFCRLNLVEKNLENNHPRSCREILETGNNKSGVYQIKPRTSRKPFAVLCDMETKGGGWTHIQKRFDGSQDFYLPWRDYKFGFGDLMGEFWLGLENIYHMTAFDRNELLIELTETDKNISYAQYSTFSIGCEKDGYPLKELTGYSGNAGDGLKYHLNAKFTXIGCRSRQRMVGNCAQKY

SEQ ID NO: 23585 - protein, 664 aa, Diabrotica virgifera
  misc_feature: Coding regions on vcDNA: vcDNA=SeqID_3282; Strand=+; Position=2-1994
  misc_feature: Homolog annotation: Hit_ID=NP_477190.1; Match level="QueryCoverage =90%, HitCoverage=95%, E-value=1e-138, Identity=38%"; Hit description= CG16858-PA [Drosophila melanogaster] gb|AAF52203.1| CG16858-PA [Drosophila melanogaster]
  misc_feature: Gene Ontology Annotation: Molecular function=structural molecule activity; Cellular component=collagen type IV; Biological process =negative regulation of cell proliferation
  misc_feature: Pfam annotation: Pfam_ID=C4; Match level="Score=465.9, E-value=4.2e -137, Copies=2"; Pfam description=C-terminal tandem repeated domain in
  misc_feature (71)..(71): Xaa can be any naturally occurring amino acid
RGDFGLMGFPGLPGSEGRPGVIGKRGRPGAPGVRGEPGYSAYSAKGEQGDVGFRGAPGFNGTKGERGTAGXGLSGPTGPSGLKGMMGMFGFEGQNGFPGLRGQKGEPGDYAIDAQPGELGDIGLPGMDGSRGLQGLPGRGGAPGIRGAMGDRGDTGLAGLPGLNGPKGMRGMPGFNGRVGVKGYRGAKGERGEPAPQYLGPQSRGFHFTRHSQSEIVPVCPKNTVKMWDGYSLLHIMGNERSHGQDLGAPGSCLRKFNTMPFLFCNINDVCDYAQSNEYSYWLSTTEPVPMTMTPIAAQNVQRYISRCSVCEAPTRVVAVHSQATEIPQCPQGWEELWVGYSFLMHTDAGAEGSGQSLVSPGSCLEEFRPKPFLECHGHGTCNYYTTAVSYWLATIENYSMFRKPRPETLKAGSLTQKISRCSVCIKRRIDSRRPNQPVPEVPSEINHPYRSPGNRPKDQPSYPSSSGSSSGSYTGSQYRSSSGSQYGGSGSQYGGSSGSQYGGSSGSQYGGSSGSQYGGSGSQYGGSSGSQYGGSSGSQYGGSGSQYGGSSGSQYGGSSGSQYGGSSGYQSSPGSPYGTSSASSPYGPSYGSSSAGSSSSSGRQYPPYYQPDTGRSAAGNSTSTSQRRAHRPPGYRPHNPPPGFINPTGTANPNLRNLNNPPP

SEQ ID NO: 23586 - protein, 219 aa, Diabrotica virgifera
  misc_feature: Coding regions on vcDNA: vcDNA=SeqID_3283; Strand=+; Position=5-664
  misc_feature: Homolog annotation: Hit_ID=XP_392882.1; Match level="QueryCoverage =97%, HitCoverage=94%, E-value=2e-80, Identity=68%"; Hit description =similar to calcyphosine-like protein [Apis mellifera]
  misc_feature: Gene Ontology Annotation: Molecular function=calcium ion binding; Biological process=intracellular signaling cascade
  misc_feature: Pfam annotation: Pfam_ID=efhand; Match level="Score=76.9, E-value =5.4e-20, Copies=3"; Pfam description=EF hand
MSRRMLRPQSATSRQETEMASKSMRELQALGNGGDPVQRLRLICLSRGATGILGLGRLFRIMDDDGNKNLNKEEFLHGLKEVGLDLSGEEAQEMFQKFDTNGDGSVNIDEFLVHIRPPLSETRKKVIDEAFQKLDKTGDGEITIDDLKNVYNVKAHPRYISGEETEESILTRFLGNFETDSTRDGKVTREEFLNYYSGISASIDNDCYFDLMMRQAYKL

SEQ ID NO: 23587 - protein, 473 aa, Diabrotica virgifera
  misc_feature: Coding regions on vcDNA: vcDNA=SeqID_3284; Strand=+; Position=62-1483
  misc_feature: Homolog annotation: Hit_ID=XP_392872.1; Match level="QueryCoverage =98%, HitCoverage=97%, E-value=0.0, Identity=80%"; Hit description =similar to ENSANGP00000010862 [Apis mellifera]
  misc_feature: Gene Ontology Annotation: Molecular function=GTPase inhibitor activity; Cellular component=signalosome complex; Biological process= JNK cascade
  misc_feature: Pfam annotation: Pfam_ID=PCI; Match level="Score=92.6, E-value=1e-24, Copies=1"; Pfam description=PCI domain
MAQVRLQNAVEPMQVDAPPEDNDNNEEDIYVVENPTLDLEVYANSYVGLAKLYRLIYIIDHCPSLKLEALKTAISYAMTTYNVNLYQVLHQKLAEVTTAMNVPDVAAQSTSQDIPTIDNMWMETRSKRAALKLEKLDNDLKNYKSNSIKESIRRGHDDLGDHYLDCGDLSNALKCYSRARDYCTSGKHVVNMCLNVIKVSVYLQNWSHVLSYVSKAESTPDVSETQTKDSNQAIVTKLKCAAGLAELATKKYKSAAKHFLQANLDHCDFPELLSPNNVAMYGGLCALATFDRHELQKNVIGSGSFKLFLELEPQLRDIIFKFYESKYASCLKLLDEVKDNLLLDMYIAPHVNTLYTQIRNRALIQYFSPYLSADMHKMAVAFNRTVPALEDELMQLILDGQIQARIDSHNKILFAKDVDQRSTTFEKGLLMGKEYQRRTRMLILRAAILKNKIHVKSPQRGFSQGREITVVPF

SEQ ID NO: 23588 - protein, 373 aa, Diabrotica virgifera
  misc_feature: Coding regions on vcDNA: vcDNA=SeqID_3285; Strand=+; Position=1-1123
  misc_feature: Homolog annotation: Hit_ID=XP_315491.1; Match level="QueryCoverage =87%, HitCoverage=32%, E-value=3e-67, Identity=39%"; Hit description =ENSANGP00000021218 [Anopheles gambiae]
  misc_feature: Pfam annotation: Pfam_ID=Cache; Match level="Score=64.0, E-value=4e -16, Copies=1"; Pfam description=Cache domain
  misc_feature (325)..(325): Xaa can be any naturally occurring amino acid
LTKGKKNFPGRIFTYLLGQDTTDARELEWIACSNMGYWGNITDMGDIREKMLQYLNVMSRPINLKADKNRTFIWSYLHVDLADRRLSNWLWKKFEGIRQRDVFLDYIKRGIFRQNLMLTSEKHMLLKEEYTYQTYLSYQRDNSAYDYMTTVSLPVFARRPHEYQLLGVAGIDVPLSLFKQLIPYERLGVNGYAFIVTNNGYILTHPDHHTEFQYILKPTFNRVDILEVEILNDDKEPRMFGDSVVKFRKKLVNQESSVNVTLKVKYALNDNKRLMFAHRHYYFAAIGPFTLCVVLPHKYGFDIVNKTLLERPSVKSSASSLASSXWKVHPDWIYCKKCVGDTPEDKVRSAFSLNENSSPSDFAPIRYGSHKMV

SEQ ID NO: 23589 - protein, 257 aa, Diabrotica virgifera
  misc_feature: Coding regions on vcDNA: vcDNA=SeqID_3286; Strand=+; Position=112-885
  misc_feature: Homolog annotation: Hit_ID=XP_308791.1; Match level="QueryCoverage =87%, HitCoverage=45%, E-value=2e-83, Identity=63%"; Hit description =ENSANGP00000021720 [Anopheles gambiae]
  misc_feature: Gene Ontology Annotation: Molecular function=4-aminobutyrate aminotransferase activity; Cellular component=intracellular; Biological process=nitrogen utilization
  misc_feature: Pfam annotation: Pfam_ID=Aminotran_3; Match level="Score=-138.3, E -value=1.6e-06, Copies=1"; Pfam description=Aminotransferase class-III
MWAKSLTTVVQNAAKTSGVRAASTILPGEPKEPIVVTLEIPGPKSKQLISELDTVTQSGTIQFFADYQNSIGNYIADVDGNKYLDIFMQISSMPLGYNHPEMLNVFKDEESLKVLVNRPALGAFPTEYWPKKLKEVLMSVSPGLPNVMTMMCGSCSNENAYKCLFMAYRKHQRGEDVDFSELEKSSCMVNQPPGAPNLSLLSFHGGFHGRTIGTLSTTHSKAIHKLDIPAFDWPVAPFPKYKYPLEKNERENRLVKR

SEQ ID NO: 23590 - protein, 645 aa, Diabrotica virgifera
  misc_feature: Coding regions on vcDNA: vcDNA=SeqID_3287; Strand=+; Position=2-1939
AVRTNIDTGFIPAPLRELLKLKKVSPLQWQEWLLDQKQRNKYIDITLIENWVNQQHQLLKVDIGIIEAWIIQQQNLNPSFLYNWIILKLVPNILGNTSDPAWDGQIRPPAKDQIWQQWLIQQRQKTNLDLTPIEYWINEQHKTLNLDIDFLRGWIMQQQQLNPNFLYNWIIKNQVPNISNGREPIVPTKEQIWQQWLIQQRQKTNLDLTPIEYWINEQRKTWNLDVDFLREWIMQQQQLNPNFLYNWIIKNQVPNISNGKEPVVPTKEQIWQQWLIQQRQKTNLDLTPIEYWINEQRKTWNLDVDFLREWIMHQQQLNPNFLYNWIIKNQVPNISNGKEPVVPTKEQIWQQWLIQQRQKTNLDLTPIEYWINEQRKTWNLDVDFLREWIMQQQQLNPNFLYNWIIKNQVPNISNGKEPVVPTKEQIWQQWLIQQRQKTNLDLTPIEYWINQQHKTWNLDVDFLREWIMQQQQLNPTFLYNWIIKNQVPKISNGKEPIIEPSVEPTWNIDRVSPEVWQQWLIQQKQRNNIDITVIEDWINEQHKVFKLDVGLLEGWIIYQQSLNPSFLYNWIVKKQVPHIIDGKEPIVEPSEKEKEPTWNGKVEKVTPEVWQQWLIQQKQKYNIDITDIENWINQQHKALKLDIAF

SEQ ID NO: 23591 - protein, 351 aa, Diabrotica virgifera
  misc_feature: Coding regions on vcDNA: vcDNA=SeqID_3288; Strand=+; Position=533-1588
  misc_feature: Homolog annotation: Hit_ID=XP_392714.1; Match level="QueryCoverage =94%, HitCoverage=63%, E-value=6e-81, Identity=45%"; Hit description =similar to hrp65-2 isoform [Apis mellifera]
  misc_feature: Gene Ontology Annotation: Molecular function=pre-mRNA splicing factor activity; Cellular component=nucleus; Biological process=male courtship behavior (sensu Insecta), song production
  misc_feature: Pfam annotation: Pfam_ID=RRM_1; Match level="Score=107.1, E-value =4.3e-29, Copies=2"; Pfam description=RNA recognition motif. (a.k.a. RRM, R
KKAIVSIMEGEAAAETKVESTNENTQEKPNNFNRGERRGGGHQRGGRFGRGGQNHGGNQHFENRRGRGNYGGVNRNHANKDENNGNDNRQEGDGNRPGGRDREGRDDQRGDNMGRGRMGGRMGRGAEDKFMEKVQQMAGPSFDVPPVDVTERKFSGRNRLYIGNIGSEVTEEDITELFKPYGETAEVFINKDKNFGFIKVDYHANAEKAKRELDGTVLKSRSLKIRYAPNNATVKVKNLTGYVTNELLHYAFSIFGEIEKATVRVDERGKPTGEAIVDFVRKGSALHAIRKCSDGCFFLTGSVRPCIVEAYEVVNDNDGFSEKNINKKHPGFMKERENGPALADLLRMIME

SEQ ID NO: 23592 - protein, 597 aa, Diabrotica virgifera
  misc_feature: Coding regions on vcDNA: vcDNA=SeqID_3289; Strand=+; Position=317-2107
  misc_feature: Homolog annotation: Hit_ID=NP_998312.1; Match level="QueryCoverage =99%, HitCoverage=85%, E-value=1e-148, Identity=45%"; Hit description= zgc:64087 [Danio rerio] gb|AAH54613.1| Zgc:64087 [Danio rerio]
  misc_feature: Gene Ontology Annotation: Molecular function=acyl-CoA oxidase activity; Cellular component=peroxisome; Biological process=fatty acid metabolism
  misc_feature: Pfam annotation: Pfam_ID=Acyl-CoA_dh; Match level="Score=19.0, E -value=4.2e-06, Copies=1"; Pfam description=Acyl-CoA dehydrogenase, C- terminal do
MSHLIEDFKPGPLDFYRKKTSFDWKKLKVFLETEDGIEYQNEMYKMLESNPVHNKENLTSLPRDEQRRLAFLGSCDQAQNDILRWAYLLQNLRRPSSLARVLTSSVASAYVKHTVGNSLFVSSIINMGTERHQEFINDAEAGKIFGCYCLTEIAHGSNTRGMRTTATYDKKKQVFVFNSPDFEAAKCWAGGLGQTAMFGTVYAQLILDNQNYGLHAFIVPFRDPKTLLPYPGLEIGDMGGKIGLNGIDNGFVQFKNYEIPRVNLLNKIADVSEDGRYITPIKDPNRRHGAALGSLSAGRVNIAAMVDSLGSKALVIAIRYAAVRKQFGPNGKEELPILEYQSHQLRLIPYLAAAYVLRNFNTYFSEKFYEFTMNNILGNSSPNAPELGIEIHGVSSASKPMAGWIMKDAVQECRECCGGHGYLHAAGLGDVRNELDPNLTYEGENHVLIQQTVNWLLKIAPQMLEGRQISTPLQSIDFLSNGLNILKNSRFSARGTDEVSHPESIIKIFQWLVVYLLKATHEKVEDELKAEKDLFEAKNNSQVYYGKSLGIAFIQHFFFARFLVTISEAEDPAIKAVLTRIFSLFGLWSIENGTLRL

SEQ ID NO: 23593 - protein, 194 aa, Diabrotica virgifera
  misc_feature: Coding regions on vcDNA: vcDNA=SeqID_3290; Strand=+; Position=208-793
  misc_feature: Homolog annotation: Hit_ID=EAL39934.1; Match level="QueryCoverage =95%, HitCoverage=24%, E-value=5e-28, Identity=36%"; Hit description =ENSANGP00000028171 [Anopheles gambiae str. PEST] ref|XP_556470.1| ENSANGP00000028171 [Anopheles gambiae st
  misc_feature (58)..(58): Xaa can be any naturally occurring amino acid
  misc_feature (120)..(120): Xaa can be any naturally occurring amino acid
  misc_feature (166)..(166): Xaa can be any naturally occurring amino acid
KKAQSFIPKLICKEKDRQLLTEKQNIINRWKRYLEKNLNADNEHEQNEIYTPEQHIEXEEVVQIIKKLKNNKTPRADRILAELLQQGGSELWGRIHYLIILIWTRKQMEEWAVGIMQPLXYKKGDKREYQNYRPITLLNVVYKIIFGIIYNKLIEYPENIIMSDYXNELRPNRATTDNIFILRTIQEKAYKYNI

SEQ ID NO: 23594 - protein, 65 aa, Diabrotica virgifera
  misc_feature: Coding regions on vcDNA: vcDNA=SeqID_3291; Strand=-; Position=1059 -1256
  misc_feature (25)..(25): Xaa can be any naturally occurring amino acid
  misc_feature (31)..(31): Xaa can be any naturally occurring amino acid
NDFIIMTQNTTYRLYVGTYRLFSFXLDMTLXEALKSAPLLYTIKIVLLLKMFKMYLFVPIVTVCY

SEQ ID NO: 23595 - protein, 114 aa, Diabrotica virgifera
  misc_feature: Coding regions on vcDNA: vcDNA=SeqID_3292; Strand=+; Position=143-487
  misc_feature: Homolog annotation: Hit_ID=NP_079663.1; Match level="QueryCoverage =78%, HitCoverage=78%, E-value=1e-23, Identity=58%"; Hit description =transmembrane protein 14C [Mus musculus] gb|AAH25854.1| Transmembrane protein 14C [Mus musculus]
  misc_feature: Gene Ontology Annotation: Cellular component=integral to membrane
  misc_feature: Pfam annotation: Pfam_ID=TMEM14; Match level="Score=108.9, E-value =1.2e-29, Copies=1"; Pfam description=Transmembrane proteins 14C
FYITQTEMDIPGFLYAGLVAAGGVFGYYKAGSVPSLAAGVLFGGALAYGAVETSRDPSNYTLQLATSSILAGVMGYRFYNSGKIMPAGVVCLMSIAMIVRIAGRASGITGPRHT

SEQ ID NO: 23596 - protein, 294 aa, Diabrotica virgifera
  misc_feature: Coding regions on vcDNA: vcDNA=SeqID_3293; Strand=+; Position=19-904
  misc_feature: Homolog annotation: Hit_ID=EAL28908.1; Match level="QueryCoverage =91%, HitCoverage=44%, E-value=3e-84, Identity=56%"; Hit description =GA11047-PA [Drosophila pseudoobscura]
  misc_feature: Pfam annotation: Pfam_ID=GMC_oxred_N; Match level="Score=226.9, E -value=3.9e-65, Copies=1"; Pfam description=GMC oxidoreductase
  misc_feature (237)..(237): Xaa can be any naturally occurring amino acid
MECGCANNFLGPSLDQTCGGSIFLFMTLLDTFIRNACDISEACERVIPRRRPDHEYDFVVIGGGSGGATAAGKLTQVPGWKVLLIEAGNDEPPGSQVPSMVVSYHGNKYVDWKYKTEPEKVACQGYPEKRCSWPRGKVLGGCSVINGMMYTRGTPKDYDSWAAAGNEGWSYRDVLPVFKRFEDNKEIGTLVEAEYHGTGGPLTTSRFNDQPELAYDILTAAKQSGQKVNKDLNGRDXAGFAIAQSNTRNGVRLSSARAYIRPQRYNTNLHVMLNSTVTKIKFEKRRKTKNCRHG

SEQ ID NO: 23597 - protein, 100 aa, Diabrotica virgifera
  misc_feature: Coding regions on vcDNA: vcDNA=SeqID_3294; Strand=-; Position=761-1063
SFHLVYFFSTTAILHLSSNQLFHLAFCQSLSLLLCLFLVFAGMLYESMYVACRKQKLSVLIYPRHLLRDISYLKRIRRMLVFLLLCKRFQLHFKRISLQR

SEQ ID NO: 23598 - protein, 408 aa, Diabrotica virgifera
  misc_feature: Coding regions on vcDNA: vcDNA=SeqID_3295; Strand=+; Position=166-1392
  misc_feature: Homolog annotation: Hit_ID=CAG10456.1; Match level="QueryCoverage =94%, HitCoverage=82%, E-value=1e-164, Identity=70%"; Hit description= unnamed protein product [Tetraodon nigroviridis]
  misc_feature: Gene Ontology Annotation: Molecular function=tryptophan-tRNA ligase activity; Cellular component=cytoplasm; Biological process =tryptophanyl-tRNA aminoacylation
  misc_feature: Pfam annotation: Pfam_ID=tRNA-synt_1b; Match level="Score=177.9, E -value=2.2e-50, Copies=1"; Pfam description=tRNA synthetases class I (W and Y)
MSGDITNNIEALKVNATEQDDDVVDPWTVTSTKDTGVDYDKLIKRFGCSKIDQELLDRFERITGKKMHHLLRRGIFFSHRDMHLILTNYEAGKPFYLYTGRGPSSSSMHVGHLIPFQICKWLQEVFNVPLVVQLTDDEKSLWKNLTIDEANRLAYENAKDIIAIGFDPEKTFIFSDFDYIGQRPQFYRNLVDIQKHVTFNQVKGIFGFDDSTIIGKIAFPAVQATPCLSSTFPDIFGNKKIQCFIPCAIDQDPYFRMMRDVAPKLGYPKPALILSKFFPALQGAQTKMSASDANSTIYCSDTPKQVKNKINKYAFSGGQATIEEHRKLGGNCDVDISYQYLRFFIEDDERLEQIRKDYSSGAMLTGELKKILIDTLTPLVQEKKKKRAAVTDEILKQFITPRKLNFDY

SEQ ID NO: 23599 - protein, 254 aa, Diabrotica virgifera
  misc_feature: Coding regions on vcDNA: vcDNA=SeqID_3296; Strand=+; Position=23-784
  misc_feature: Homolog annotation: Hit_ID=XP_312593.1; Match level="QueryCoverage =100%, HitCoverage=38%, E-value=1e-89, Identity=65%"; Hit description= ENSANGP00000001283 [Anopheles gambiae]
  misc_feature: Gene Ontology Annotation: Molecular function=actin binding; Cellular component=lamellipodium; Biological process=cell adhesion
  misc_feature: Pfam annotation: Pfam_ID=CH; Match level="Score=53.8, E-value=4.9e -13, Copies=1"; Pfam description=Calponin homology (CH) domain
MATLRPKSPRPVPLKGEKEETIWDKLGTLGRKKRIKEVQEVQAEGKHAIDSPGCPTAPIIPPEDYNLEDNEERCMIEPRAYEDPKFYDLLNVLKEWINDELASQRIIVQDLSEDLYDGQVLQKLLEKLTGDKFDVPEVTQSEEGQKQKLMVVLDHFNKVLGIQRLSHNKWNVESIHSKNIVAITHLLVALARHFRPPVRLPEHVSVEVVVVQKAGGRLVHKTVRESLTKAYDDVGMRCERDALDKLFDHAPDKL

SEQ ID NO: 23600 - protein, 176 aa, Diabrotica virgifera
  misc_feature: Coding regions on vcDNA: vcDNA=SeqID_3297; Strand=+; Position=2-532
  misc_feature: Homolog annotation: Hit_ID=EAL28658.1; Match level="QueryCoverage =86%, HitCoverage=96%, E-value=1e-61, Identity=77%"; Hit description =GA22065-PA [Drosophila pseudoobscura]
  misc_feature: Gene Ontology Annotation: Molecular function=iron ion binding; Cellular component=mitochondrion; Biological process=iron-sulfur cluster assembly
  misc_feature: Pfam annotation: Pfam_ID=NifU_N; Match level="Score=275.4, E-value =9.9e-80, Copies=1"; Pfam description=NifU-like N terminal domain
FSRPGDYVHINFFAFIGFKTLFTRNMALKVTSTLLRSMSVPARLSVACYHKNVIEHYENPRNVGSLDKNDKNVGTGLVGAPACGDVMKLQIKVDDNGKIVEAKFKTFGCGSAIASSSYTTEWVKGKTVDQALKLRNTDIAKELSLPPVKLHCSMLAEDAIKAALSDYKIKNQKKEA

SEQ ID NO: 23601 - protein, 291 aa, Diabrotica virgifera
  misc_feature: Coding regions on vcDNA: vcDNA=SeqID_3298; Strand=+; Position=80-952
  misc_feature: Homolog annotation: Hit_ID=EAA04304.3; Match level="QueryCoverage =89%, HitCoverage=89%, E-value=2e-20, Identity=30%"; Hit description =ENSANGP00000016024 [Anopheles gambiae str. PEST] ref|XP_564972.1| ENSANGP00000016024 [Anopheles gambiae st
MTSKRTVLSRPRTKLYDANYNIGESYYKGALDRLDRKYSGRSLSPPRQPSPVAESIAERHARIFADEDLEYSRRRAEKHIREENAFDARTARFNRASALLADSMDNDISDETATSIRRLRANKKVSIIDDADLENTSNNLKSMRLLDRSDKILDSVGINDSLPRKMAEKDVAQRRSALKMSYRPEEDSLTKWTPLENNITSYRARREEVTASIESDSGASRRAKLSKDRLNDLEEEMVAMQEKQAAREARVARLRKLVAETEQDSASFDLSQLKLNQNPGKNDWQLNIETG

SEQ ID NO: 23602 - protein, 295 aa, Diabrotica virgifera
  misc_feature: Coding regions on vcDNA: vcDNA=SeqID_3299; Strand=+; Position=74-961
  misc_feature: Homolog annotation: Hit_ID=XP_315967.1; Match level="QueryCoverage =97%, HitCoverage=35%, E-value=3e-26, Identity=30%"; Hit description =ENSANGP00000013442 [Anopheles gambiae]
  misc_feature: Gene Ontology Annotation: Molecular function=translation initiation factor activity; Cellular component=eukaryotic translation initiation factor 2B complex; Biological process=regulation of protein biosynthesis
MDKAQKENKKEKVAPDGLTKKERRAQKVGARQTQEPGEATQSPNLPKCNSTSHPNNKPKVESGGVNKKENKSNEHNVASKTLSEKELRRLEWAKKLEEEKAKDNKENEQLSKAELKAKRRELQEAQRQQKDAEKKQKPEQVPKSPSELKEKENTNNKKVVNDNKQKTEKKPITKKEVKKVTDSHKVQLVQHLYNEDLLKLETHTIAVHPDIHPVFIRLGVQYNKKVILGSNARCLALLVALKYLVQDLNSPPKQEFCRYLETVLQTCTQYLHSCRPLAVSMTNALRHFKLQLNPY

SEQ ID NO: 23603 - protein, 280 aa, Diabrotica virgifera
  misc_feature: Coding regions on vcDNA: vcDNA=SeqID_3300; Strand=+; Position=161-1003
  misc_feature: Homolog annotation: Hit_ID=AAP49335.1; Match level="QueryCoverage =36%, HitCoverage=16%, E-value=6e-14, Identity=38%"; Hit description =AmyA [uncultured bacterium]
  misc_feature: Gene Ontology Annotation: Molecular function=basic amino acid transporter activity; Cellular component=integral to plasma membrane; Biological process=basic amino acid transport
MDGFLRVDNPNLPSSPTNSFMADEVASICPLITPSPPTNDLINSLPEPEPDFSIGLELANKLQHVGGDGTSDEDKAESASSSSSALAESQLLNHRNVYLNHNGNNEQKDEEDGLGKSQTFGVQLTFRNPPDNYFFMSWNWPLIRKISAWIYLSALVAMLALVITMISTLPKTCNPPTYWYQGNLLYEIFPASFYSGKKNMEGDFKGITQKADYIQKLGVRGVRLNSIFPNPNYPHDFDNITSLTDIAPVLGSLSEFNVMVKQLKARNISVILDLPLYPYI

SEQ ID NO: 23604 - protein, 269 aa, Diabrotica virgifera
  misc_feature: Coding regions on vcDNA: vcDNA=SeqID_3301; Strand=+; Position=1-811
  misc_feature: Homolog annotation: Hit_ID=EAL27037.1; Match level="QueryCoverage =99%, HitCoverage=31%, E-value=1e-74, Identity=51%"; Hit description =GA11876-PA [Drosophila pseudoobscura]
  misc_feature: Gene Ontology Annotation: Cellular component=cytosol
  misc_feature (11)..(11): Xaa can be any naturally occurring amino acid
  misc_feature (66)..(66): Xaa can be any naturally occurring amino acid
QPMSQNFNELXTNLEPLESNKVLAPKETRKPELSITEITKLGESSQMLNGLLASLNLPAAIEVTGXGDEVPPSILEKSNSIITLGGLGELERMVTELPELLKRNQDILDETDRMLNEEKSSDDALRAQFKEKWTRTPSDNLTEMFKSNSAKYRQIINNAVQADKTVREKFDSHKQGMELLSNGPGAIQSALPSGTGGSVGNSSAVETLRGLMEEVDTIKAEREAIEAELESPTTDMKDAFLGALAKEGVINEAAISFDNLSKIYGPLQK

SEQ ID NO: 23605 - protein, 193 aa, Diabrotica virgifera
  misc_feature: Coding regions on vcDNA: vcDNA=SeqID_3302; Strand=+; Position=85-666
  misc_feature: Homolog annotation: Hit_ID=XP_314318.1; Match level="QueryCoverage =89%, HitCoverage=84%, E-value=3e-54, Identity=58%"; Hit description =ENSANGP00000013204 [Anopheles gambiae]
  misc_feature: Gene Ontology Annotation: Biological process=embryogenesis and morphogenesis
  misc_feature: Pfam annotation: Pfam_ID=TPD52; Match level="Score=214.7, E-value =1.7e-61, Copies=1"; Pfam description=Tumour protein D52 family
MNNISPTAEEAMAAAETPIPDLSHLSTEERAEQERLWKEELATIEDEISTLRTVLASKMRRSAELKRNLGITVWKEVTDDINQGIKNVKESNVYQTVETKVGQVTKAVTDAPIYQKTSSLLGGITGNITNKIGQMRHSESFKSFEEKVGSAYENVKTKVASRSGSQHSLDEAGRSRSGSTVTSPTIPEDKPLA

SEQ ID NO: 23606 - protein, 87 aa, Diabrotica virgifera
  misc_feature: Coding regions on vcDNA: vcDNA=SeqID_3303; Strand=-; Position=101-364
KSKYIRLLYRNSFFVNKFLFTLLFFIFCWIFYFVFYGNLKIFQKYGKHEPCLVSAFKNSYCIKKCLTKTEIKMSWSHSITTSVWTAG

SEQ ID NO: 23607 - protein, 288 aa, Diabrotica virgifera
  misc_feature: Coding regions on vcDNA: vcDNA=SeqID_3304; Strand=+; Position=89-952
  misc_feature: Homolog annotation: Hit_ID=XP_393274.1; Match level="QueryCoverage =88%, HitCoverage=24%, E-value=3e-48, Identity=40%"; Hit description =similar to CG3568-PA [Apis mellifera]
  misc_feature (245)..(245): Xaa can be any naturally occurring amino acid
MSVPHWSPQTRWNKNTLKVLNEFSSNIASVENVNSIIEKSDKFPIKFPTKSNRCNFLKTIVKEESLTSNINSVYPVLHESVLKLCCHFILLKRSHGNLIEKDYYRDLSLKDLINKMLFKRAVVFLNEDDSYLLLNNKSGSGKWETIGTPNQVISIKECMSYDEIKLSALLSVSSMTYFINKGHRTNIGKYEADRSIVEEEGIIIGLIGPRFEKSNVMEYQEIVIGKKQNTTSNGFGTSVEHTTPXLFTSFYDEECLTYEEAIERKKKVDGKFHVIYNDILFDNDLYYK

SEQ ID NO: 23608 - protein, 309 aa, Diabrotica virgifera
  misc_feature: Coding regions on vcDNA: vcDNA=SeqID_3305; Strand=+; Position=3-931
  misc_feature: Homolog annotation: Hit_ID=NP_995599.1; Match level="QueryCoverage =100%, HitCoverage=3%, E-value=1e-135, Identity=73%"; Hit description= CG32019-PD, isoform D [Drosophila melanogaster] gb|AAS64599.1| CG32019-PD, isoform D [Drosophila
  misc_feature: Gene Ontology Annotation: Molecular function=calcium/calmodulin -dependent protein kinase activity; Cellular component=nucleus; Biological process=induction of apoptosis
  misc_feature: Pfam annotation: Pfam_ID=I-set; Match level="Score=85.5, E-value=1.4e- 22, Copies=1"; Pfam description=Immunoglobulin I-set domain
  misc_feature (255)..(255): Xaa can be any naturally occurring amino acid
ISTGTAEFAAPEIVEREPVGFYTDMWAVGVLGYVLLSGLSPFAGENDIETLKNVKACDWDFDEEAFTNVSEEGKDFIRRLLLKNKEKRMTAQECLLHSWLSGDHADRTEVIDRSRYIRMRDKIRSKYDAWDSFALPIGRLSEYSSLRKLLIDKYKIHDAYFDRRQAAPRFVIKPQSAFCYEGQSVKFYCRVIGVAAATVSWYHNNVELRQSVKFMKRYAGDDYYFVINRARLQDRGEYIIRAENHYGAREEVVFXNVQPLPKVVPEYKSEVPGIRRAEPLPYTLWRREQEWAPGVTLLLRPRDVQERET

SEQ ID NO: 23609 - protein, 254 aa, Diabrotica virgifera
  misc_feature: Coding regions on vcDNA: vcDNA=SeqID_3306; Strand=+; Position=134-898
  misc_feature: Homolog annotation: Hit_ID=XP_317158.1; Match level="QueryCoverage =91%, HitCoverage=93%, E-value=2e-72, Identity=57%"; Hit description =ENSANGP00000018357 [Anopheles gambiae]
  misc_feature: Pfam annotation: Pfam_ID=START; Match level="Score=83.4, E-value=6.2e- 22, Copies=1"; Pfam description=START domain
MEPGVVKIADDGDFDMLKRLVDEHTEWKLEYDKGDLTKVWTKSTPNTNFKMVKVQTVFQDVAANTLFDVLHDPGYRKEWDEHMQASIEIGYLNPNNDVGYYALSCPTPVKNRDFVLQRSWLDMGAEKLILNHSVNHKDYAIRKGYIRAISHMTGFVIRESAKGCFLGYISQTDPRGKLPPWLVNKITQKFAPKVVKQLKKAAEGYEMWKSSQENPYFKPWIYPEQTMSSPRINISDCVGHDLLPENPGECDETE

SEQ ID NO: 23610 - protein, 171 aa, Diabrotica virgifera
  misc_feature: Coding regions on vcDNA: vcDNA=SeqID_3307; Strand=+; Position=100-615
MATYATYRHIELDKVGYGKKRVSNQSSEIFNVLCTPPSNKTNGHITPRRSLQSNDSFNKLFGSPENKRPHPRRGSLTKQDVNNRNPVTGNGVMSFDCKISKTSKIYTERNPVTGETYTIVSPATTPTKPMTNGFTNGTSTPSLNGNSTPLTNGNAHSLTNGNGIHTPNGNV

SEQ ID NO: 23611 - protein, 233 aa, Diabrotica virgifera
  misc_feature: Coding regions on vcDNA: vcDNA=SeqID_3308; Strand=+; Position=158-859
  misc_feature: Homolog annotation: Hit_ID=XP_394747.1; Match level="QueryCoverage =78%, HitCoverage=36%, E-value=6e-24, Identity=35%"; Hit description =similar to ENSANGP00000013456 [Apis mellifera]
MHNAKELYQQRMDQIEQMNYIRFKTPDPQHVLITDKCISVLHKHRSLLNDVNYWHQFMVRNVDHAKREQVLTAILDHVFPFDLIPVSYWVEDDFVFFLGRNCGSAIEKLCNGNLVVPNPKSTTPFRLSIMLRFATTSEYKIDVQRNLRFVLTKRSSLYSRTLDLTKFHEDEDLIEFTPLFQPKILYFVLRIAKQLSVPMESYILRKNRNQVLDPLKIYPLHQIVSKALIFSII

SEQ ID NO: 23612 - protein, 164 aa, Diabrotica virgifera
  misc_feature: Coding regions on vcDNA: vcDNA=SeqID_3309; Strand=+; Position=34-525
  misc_feature: Homolog annotation: Hit_ID=XP_320828.1; Match level="QueryCoverage =89%, HitCoverage=45%, E-value=1e-19, Identity=34%"; Hit description =ENSANGP00000017970 [Anopheles gambiae]
  misc_feature: Gene Ontology Annotation: Molecular function=triacylglycerol lipase activity; Cellular component=extracellular; Biological process=lipid metabolism
  misc_feature: Pfam annotation: Pfam_ID=Lipase; Match level="Score=-156.0, E-value =0.045, Copies=1"; Pfam description=Lipase
MMKVIKGFLFFIFITITSSEHASLRATEADIKFYLFTQKDLLYGTHLNISDKGEINRSDFSKDKDTVFYIHGWLDNNSSETLISIKNAYLSKYDVNMLVVDWSTFADSVIYNVAYDNVEPIGNVLGHSIEHLVQNTGQDLSRMIIVGHSLGAHVAGVAGRILNG

SEQ ID NO: 23613 - protein, 79 aa, Diabrotica virgifera
  misc_feature: Coding regions on vcDNA: vcDNA=SeqID_3310; Strand=-; Position=165-404
LRKNYKKQVFAFHGLQPSTLHPGPPYITKKSPMTQQNNTVNFIKIGFIDFAKYILQSSLRKKNSFFQNAARPKIKQSAS

SEQ ID NO: 23614 - protein, 295 aa, Diabrotica virgifera
  misc_feature: Coding regions on vcDNA: vcDNA=SeqID_3311; Strand=+; Position=1-888
  misc_feature: Homolog annotation: Hit_ID=NP_038476.2; Match level="QueryCoverage =97%, HitCoverage=17%, E-value=3e-42, Identity=37%"; Hit description =bromodomain adjacent to zinc finger domain, 1A isoform a [Homo sapiens] gb|AAF32366.1|
  misc_feature: Gene Ontology Annotation: Molecular function=transcription regulator activity; Cellular component=nucleolus organizer complex; Biological process=chromatin modeling
  misc_feature: Pfam annotation: Pfam_ID=PHD; Match level="Score=56.5, E-value=7.6e -14, Copies=1"; Pfam description=PHD-finger
EEVDDSSTRYTKKPQSNLGYPNTMSTSEVLENVILDNILEIEYRIFGGVLGTLQVKNREQWRKSLSLKLYDELETKIKAYVKRRSDRNSERPETPEIKAPLRKYHDPGTHVGTGLDVEMNGESDSIPCSTEHVTRYIKKSVKALAIALAQVARGIDPKYLKKPLGSAGAGKNDKLCDRLDNWEQSLLASTSYSQVCLHYATLDSWIMWSRSALKARCRIWRRPTDSENMLLCDNCNLGHHLYCLKPKLTRIPKGDWFCDGCKKEIEQETKLLNPDPVPWKKRRIFKDENMEEEEE

SEQ ID NO: 23615 - protein, 290 aa, Diabrotica virgifera
  misc_feature: Coding regions on vcDNA: vcDNA=SeqID_3312; Strand=+; Position=108-980
  misc_feature: Homolog annotation: Hit_ID=XP_319772.1; Match level="QueryCoverage =99%, HitCoverage=58%, E-value=3e-93, Identity=62%"; Hit description =ENSANGP00000006535 [Anopheles gambiae]
  misc_feature: Gene Ontology Annotation: Molecular function=lamin binding; Cellular component=nuclear lamina; Biological process=biological_process unknown
  misc_feature: Pfam annotation: Pfam_ID=Fe_hyd_lg_C; Match level="Score=-52.0, E -value=2.1e-13, Copies=1"; Pfam description=Iron only hydrogenase large subunit,
MSRFSGALQLTDLDDFITPSQECIKPVEIKKKPGSKTGAKIQIQSDDYFQIEEDGSAQKLEKVEITLADCLACSGCITSAESVLISKQSEAELRDVLEANKKLKIINGDAVVTEIQIVIVSLSIQPVLSLAVRYNLKPDECAAKLCQYFKQLGADMVVDMTIADDLAILEAQKEFIRRYRATHSDGVKNILPMLASSCPGWVCYAEKTHGSYILPYISTAKSPQQLMGSLLKEYVTKKLEPKYPKAHIYHVAVMPCYDKKLEASRSDFFSQETNRPDVDCVITPCDLEQM

SEQ ID NO: 23616 - protein, 468 aa, Diabrotica virgifera
  misc_feature: Coding regions on vcDNA: vcDNA=SeqID_3313; Strand=+; Position=3-1409
  misc_feature: Homolog annotation: Hit_ID=XP_392460.1; Match level="QueryCoverage =98%, HitCoverage=75%, E-value=0.0, Identity=26%"; Hit description =similar to BMKETTIN [Apis mellifera]
  misc_feature: Gene Ontology Annotation: Molecular function=structural constituent of muscle; Cellular component=sarcomere; Biological process=mitotic chromosome condensation
  misc_feature: Pfam annotation: Pfam_ID=I-set; Match level="Score=407.3, E-value =1.9e-119, Copies=4"; Pfam description=Immunoglobulin I-set domain
DTNAKLGVHGREIHVTKQKQVQKEQKGDLEITRNITATETTDVEHKAKTTERVVQGQVLPSNPPVFTKKIKPVRAFENDSAKFEVEFDGDPLPKITWFREDFPITSSPDLKVYTFSTKSILQMRQVFMEDSGVFSVVAENRGGTAKCSANLVVQERRRHGTRGAVPPSFTATIQSTKANVGQLVRFDAKIDGTKPIDVYWLKNGKKIVSDIRYKTLEEDEIYTLLIIEVVPEDTGKYECVAINNSGEARCEAECVVTSPSAAQKPAKPTTPGAEKAPALLEPLKDQTIKEGQAVVFRCKISAKPTPVIKWQKADKVIKPSKYFQMTKEGDFCTLKISEAFPEDEGVYKCVAENPAGAVSTQAKLKVIAPETQEVAPSLTPMKDVTVPEGSPAQFKTTISGKPKPTIQWLREGFLIPESPDFQMIQEGNNVILLISSTYEEDTGLFTCRATSSAGQVEQSAKLTVKSKK

SEQ ID NO: 23617 - protein, 300 aa, Diabrotica virgifera
  misc_feature: Coding regions on vcDNA: vcDNA=SeqID_3314; Strand=+; Position=58-957
  misc_feature: Homolog annotation: Hit_ID=NP_652625.2; Match level="QueryCoverage =91%, HitCoverage=53%, E-value=5e-30, Identity=30%"; Hit description =CG4739-PA [Drosophila melanogaster] gb|AAF54590.2| CG4739-PA [Drosophila melanogaster]
  misc_feature (255)..(255): Xaa can be any naturally occurring amino acid
  misc_feature (260)..(260): Xaa can be any naturally occurring amino acid
  misc_feature (278)..(278): Xaa can be any naturally occurring amino acid
  misc_feature (283)..(283): Xaa can be any naturally occurring amino acid
  misc_feature (286)..(286): Xaa can be any naturally occurring amino acid
  misc_feature (292)..(292): Xaa can be any naturally occurring amino acid
MKIFLAILTFWAIQKFGSTYNILGVFTFCQHSHFTLGFQLLKSLADSGHNVTMISCFPQQKPIKNWVDISVRVGTNQDQVLGILARGPELQTMTHWTKLNFMAALGETYSSATFEVKAVQALLKSNQKFDVVIQENFLNEAFAIFHHKFNCPSIMFVPTPTTFFSNYIVANPWSPAFIPSIIGEYSAEMNFWQRLRNTFEQVLGEYFIHHTEIPIQNKVLKKYVKGAPDLRSILYNTSLLLISSHVSFIDPIPLXQNVIXIGGFHVTPPEPLQRNQAXFGYRXPRXILFSMXSNKVSLLI

SEQ ID NO: 23618 - protein, 210 aa, Diabrotica virgifera
  misc_feature: Coding regions on vcDNA: vcDNA=SeqID_3315; Strand=+; Position=122-754
  misc_feature: Homolog annotation: Hit_ID=AAP92418.1; Match level="QueryCoverage =92%, HitCoverage=54%, E-value=1e-31, Identity=39%"; Hit description =chitinase precursor [Tenebrio molitor]
  misc_feature: Gene Ontology Annotation: Molecular function=chitinase activity; Cellular component=extracellular space; Biological process=response to bacteria
  misc_feature: Pfam annotation: Pfam_ID=Glyco_hydro_18; Match level="Score=121.4, E -value=2.3e-33, Copies=1"; Pfam description=Glycosyl hydrolases family 18
MKWCGIIVIFCVVLGAVSCAPTNFTRNVICYYTGSFGIKVAPPESIDTNLCTHLNYAFVKINENGTLIHNKYVDIKKEMYKRVVSLKKMNPKLKILISIGDTPAAVFSEVAADPDKRQSLIQNTIDFLRLHGFDGVDVDWEKPYSKDEENFIHLLKEFKKALETKNYLLSVAVYPYPDAGYIVPKITENVDMINIMCYNFLWPLEYLHWS

SEQ ID NO: 23619 - protein, 356 aa, Diabrotica virgifera
  misc_feature: Coding regions on vcDNA: vcDNA=SeqID_3316; Strand=+; Position=93-1163
  misc_feature (354)..(354): Xaa can be any naturally occurring amino acid
MDLSWYIVSWITLPYYLTAIIWLYLFEKVVFWWLSMRYSTRLMRLGCADIFWAVGEKYHNLINVIMTLNLKDPNEDIVADIRDVLNRTIMAEPAKYQKLLSSLNTFLGYSFLLKEQVKADDIITVIDIEKTKYSSMKELMFSYSYKPLPQNNKLMVEIIVIKAPKAWKESNDFKENQIPLMIRINHTVADGLSVMNLCAHTLGENDVNLENSLKNIPKSPEWQLTPAFQLLQKIYLFFMVPGFLIVRYFQGEATSVAGQEFEGPKSAHRQNISYRTEKPGENLVQKVKDLKKQIGDTSFSEIILTAVSASLYNYYEKALFKIPKSVKMAIVATKDLQPLTVNGVPTLRTKFGMXNF

SEQ ID NO: 23620 - protein, 598 aa, Diabrotica virgifera
  misc_feature: Coding regions on vcDNA: vcDNA=SeqID_3317; Strand=+; Position=3-1799
  misc_feature: Homolog annotation: Hit_ID=XP_392097.1; Match level="QueryCoverage =99%, HitCoverage=82%, E-value=0.0, Identity=44%"; Hit description =similar to ENSANGP00000016783 [Apis mellifera]
  misc_feature: Gene Ontology Annotation: Molecular function=extracellular matrix structural constituent; Cellular component=collagen type IV; Biological process=extracellular matrix organization and biogenesis
  misc_feature: Pfam annotation: Pfam_ID=C4; Match level="Score=473.5, E-value=2.2e -139, Copies=2"; Pfam description=C-terminal tandem repeated domain in
SIVGAKGDKGDQGPSGLDGLAGIQGEKGDAGTPGFPGVKGDRGYPGEKGEPGIFGLEGTKGEKGDRGFSGAIGLRGEKGDVGFPGVKGNLGSPGRPGAKGERGLSGVAGLPGLTIKGEKGLPGIPGKNGREGIPGTPGQIGEPGLPGLDGRQGPPGPPGPLGLQGQKGDRGFDGAPGPQGPTGPPGQPGLEGAPGQRGDKGERGNPGAFGAPGQKGDRGQTGLQGISGYPGEKGDRGYDGTPGIEGPMGPPGLKGDAGIPGQSGRPGIPGQKGDKGERALQGGPGPKGDRGFPGNPGLPGERGPAGLDGIPGVHGQKGDKGERGFTGIAGSPGLQGEKGDIGIEGAIGLQGSIGDIGPKGEPGASCVDVPDYLTGSLLVRHSQSKEVPSCERGHIQLWEGYSLLYVEGNEKAHTQDLGYAGSCIRKFSTMPFVFCDVNNVCNYASRNDKSYWLSTSAAIPMMPVEESQIEEYISRCVVCEAPASVIAVHSQSLALPECPYGWSSLWIGYSFVMHTAAGAEGGGQSLSSPGSCLEDFRATPFIECNGAQGSCHYFANTLSFWLATIDNNQQFQKPQKQTLKAGNVRDRISRCQVCIRNT

SEQ ID NO: 23621 - protein, 277 aa, Diabrotica virgifera
  misc_feature: Coding regions on vcDNA: vcDNA=SeqID_3318; Strand=+; Position=47-880
  misc_feature: Homolog annotation: Hit_ID=AAT38514.1; Match level="QueryCoverage =97%, HitCoverage=54%, E-value=1e-38, Identity=31%"; Hit description =antennae-rich cytochrome P450 [Phyllopertha diversa]
  misc_feature: Gene Ontology Annotation: Cellular component=extracellular space
  misc_feature (274)..(274): Xaa can be any naturally occurring amino acid
MLLTSSWIVDTIILTVTLSLLVYKYLTRHFDYWRKRKVTHEKPMLLFGNFYEVFTFKTTIQEHIKKIYDRIDAPYFGIHILDEPILVLKDPKLVKDVLIKDSAVFANRRPATPTHPLMKHALFFLNYPHWKPLRAKITPVFTSAMLKNAHNQYLTDIGQSMTKFLNKNKETIDSRRIGEYFASEMIFKYFFGANANCFEDIPSVFEPYVKKMGEFSVRNAVIQNLYFIKPSWVTFLKLDFISESIMTFFERVFIEGMINRKKYDGSHKLLSIWXIKL

SEQ ID NO: 23622 - protein, 612 aa, Diabrotica virgifera
  misc_feature: Coding regions on vcDNA: vcDNA=SeqID_3319; Strand=+; Position=59-1897
  misc_feature: Homolog annotation: Hit_ID=XP_310333.1; Match level="QueryCoverage =90%, HitCoverage=83%, E-value=1e-113, Identity=40%"; Hit description= ENSANGP00000015188 [Anopheles gambiae]
  misc_feature: Gene Ontology Annotation: Biological process=reproduction
  misc_feature: Pfam annotation: Pfam_ID=GMC_oxred_N; Match level="Score=306.5, E -value=4.1e-89, Copies=1"; Pfam description=GMC oxidoreductase
MYRAKLLVIFMFLLTCGALELEPFYEFVSEKLEQIKKFELPTNNEKVFRINHTKIFDFGRYDFIIVGAGAAGSVLANRLSEITSWKILLLEAGGETDDFSDVPQFNNYLQQTDMNWGYFTAPQTTCCQGMENHQCVYPRGKVIGGCTTLNAAVYARGSPSDYNNWVAMGNPGWSYEEVLPYFKKSEYVVMESYDKSYHGTEGIVFVNHTSPNSTIGDTVLKAHMEKGLKEVDYNGEHQLGVSKVQFNQKDHKHQTSEHAFLDDIKNKNNVKIVLNAAVNQILLTKRKAKGVTFVHNGRIYKATAKKEVILSAGAINTPQLLMLSGIGPKKHLKDLDIPVVADLPAVGQHLQDHPLFVNIYFRTNVSSPNYSLKEQLQLYLEGKAPSTNGAGLEHLAFINVDSITNGEADIEYLNFAPPFGVPGNLKAAYNFQDKFAKQYESYNPLTDISFIMSLMKPKSQGSVTLKSNNILDFPLIDLNYFSDPKGEDLETMYKGIKYILSLADTEAFKSIGATFISKQPNCEQLKDNDKEYWYCALRHMTSTEYHPAGTTRMGPSAVDSVVDTNCLVHTFKNLRVVDAGVVPDITRGHLMAAIYMIAEKISDVIKKNYRKI

SEQ ID NO: 23623 - protein, 137 aa, Diabrotica virgifera
  misc_feature: Coding regions on vcDNA: vcDNA=SeqID_3320; Strand=+; Position=277-690
LRPLCRPNIQLTSVRHSKLLRSSGFLGELRLGSLCHKMKSAAGNPNMTITQNDKKSDLDHFAFQPPMYNLPYPILTISSFSKYIFCFRNPLNELPCFKSQYMVEVNLQVQGFSPCDFLTRSSNCKIPRLGSPTIIQN

SEQ ID NO: 23624 - protein, 294 aa, Diabrotica virgifera
  misc_feature: Coding regions on vcDNA: vcDNA=SeqID_3321; Strand=+; Position=104-983
  misc_feature: Homolog annotation: Hit_ID=AAH59958.1; Match level="QueryCoverage =98%, HitCoverage=60%, E-value=1e-122, Identity=72%"; Hit description= MGC68486 protein [Xenopus laevis]
  misc_feature: Gene Ontology Annotation: Molecular function=electron transporter activity; Cellular component=cytoplasm; Biological process=pentose -phosphate shunt, oxidative branch
  misc_feature: Pfam annotation: Pfam_ID=NAD_binding_2; Match level="Score=443.0, E -value=3.4e-130, Copies=1"; Pfam description=NAD binding domain of 6 -phosphoglucona
  misc_feature (261)..(261): Xaa can be any naturally occurring amino acid
  misc_feature (277)..(277): Xaa can be any naturally occurring amino acid
MAGKGDIGLIGLAVMGQNLILNMADHGFTVVAFNRSIEKVHHFLANEAKGKSILGAESIADLCSKLKSPRRVMLLVKAGDAVDSFINQLVPHLEKGDIIIDGGNSEYQDSERRTKELAAKGIRFVGSGVSGGEEGARYGPSLMPGGNKEAWPYIKDIFQGISAKVDGQPCCDWVGNDGAGHFVKMVHNGIEYGDMQLIGEVYHLMSAIGVNQEQMGNTFDKWNKGALDSFLIEITRDILRYKDSDGQYLLPKIRDTAGQKXTGKWTAISALNYGVPXTLIGESVFQPLLSALKT

SEQ ID NO: 23625 - protein, 240 aa, Diabrotica virgifera
  misc_feature: Coding regions on vcDNA: vcDNA=SeqID_3322; Strand=+; Position=195-912
  misc_feature: Homolog annotation: Hit_ID=NP_996148.1; Match level="QueryCoverage =94%, HitCoverage=25%, E-value=2e-59, Identity=54%"; Hit description =CG1106-PH, isoform H [Drosophila melanogaster] gb|AAN13333.2| CG1106- PH, isoform H [Drosophila
  misc_feature: Gene Ontology Annotation: Molecular function=structural molecule activity; Cellular component=actin cytoskeleton; Biological process =actin filament polymerization
  misc_feature: Pfam annotation: Pfam_ID=Gelsolin; Match level="Score=75.9, E-value =1.1e-19, Copies=1"; Pfam description=Gelsolin repeat
  misc_feature (197)..(197): Xaa can be any naturally occurring amino acid
MSKMWGNGAFSRGTLVCLALLVYLKDSSCVTTNRREHFSQLPQRTGFSTNRNNQRTGVKVMDPSFENAGQVDGLEIWRIEDFKPVPYPKNQYGKFYTGDSYIILNTKTTRSGAKVHDLHFWLGAETSQDEQGSAAIYTVQLDEHLNGEPVQHRETQNHESQLFLSYFKSGGIRYLPGGVSSGFHHVDPNAFEKRLFXQVKGSRNIKVKQVTPIIASMNTGDCFILERGKRNLLSMVGNKG

SEQ ID NO: 23626 - protein, 439 aa, Diabrotica virgifera
  misc_feature: Coding regions on vcDNA: vcDNA=SeqID_3323; Strand=+; Position=93-1412
  misc_feature: Homolog annotation: Hit_ID=NP_996148.1; Match level="QueryCoverage =94%, HitCoverage=47%, E-value=1e-124, Identity=55%"; Hit description= CG1106-PH, isoform H [Drosophila melanogaster] gb|AAN13333.2| CG1106 -PH, isoform H [Drosophila
  misc_feature: Gene Ontology Annotation: Molecular function=structural molecule activity; Cellular component=actin cytoskeleton; Biological process =actin filament polymerization
  misc_feature: Pfam annotation: Pfam_ID=Gelsolin; Match level="Score=164.3, E-value =2.7e-46, Copies=3"; Pfam description=Gelsolin repeat
MSKMWGNGAFSRGTLVCLALLVYLKDSSCVTTNRREHFSQLPQRTGFSTNRNNQRTGVKVMDPSFENAGQVDGLEIWRIEDFKPVPYPKNQYGKFYTGDSYIILNTKTTRSGAKVHDLHFWLGAETSQDEQGSAAIYTVQLDEHLNGEPVQHRETQNHESQLFLSYFKSGGIRYLPGGVSSGFHHVDPNAFEKRLFQVKGSRNIRVKQVTPSIASMNTGDCFILDVGRDIYVYVGTKARRVEQLKAINAANQIRDQDHAGKAKVTIVDTYSPESDYTTFFEALGEGSRDSVPDYTTSDDDESFERTEENHASLYKVSDATGSVKVTKVGQKPLEASSLDPSDCFILDTTDALLYVWIGSKCDEREKKEAMNKADGFLNAHNHPKWTHVQRIVQGAEPTAITQYFRNWQAFGETHPRLLPFCQHLSPPLPLPNPFKISQT

SEQ ID NO: 23627 - protein, 298 aa, Diabrotica virgifera
  misc_feature: Coding regions on vcDNA: vcDNA=SeqID_3324; Strand=+; Position=1-897
  misc_feature: Homolog annotation: Hit_ID=XP_321614.1; Match level="QueryCoverage =100%, HitCoverage=37%, E-value=1e-113, Identity=63%"; Hit description=ENSANGP00000011729 [Anopheles gambiae]
  misc_feature: Gene Ontology Annotation: Molecular function=procollagen-lysine 5 -dioxygenase activity; Cellular component=membrane; Biological process=protein modification
  misc_feature: Pfam annotation: Pfam_ID=2OG-FeII_Oxy; Match level="Score=59.7, E -value=8.1e-15, Copies=1"; Pfam description=2OG-Fe(II) oxygenase superfamily
NDYMDIVHNEKRGLWNVPFISNAYIINATLLRKHDRKVLNYTKPNLDADMTFCSNLRDLDVFMYVSNRLEFGHLINADTFDTTRTEPDMYQIFENERDWEDRYINEEYPENFNLEKKDAQPCPDVYWFPIVSKRFNEALIHMMESYGKWSSGKNEDDRLNGGYEAVPTRDIHMNQVGWERHWLHFLQKYVRPLQEKVFTGYYHDPPKSLMNFVVRYRPDEQPLLRPHHDSSTYTINIALNEKGVDYEGGGCRFIRYNCSVVDTKPGWLLMHPGRLTHFHEGLLVTKGTRYIMIAFVDP

SEQ ID NO: 23628 - protein, 275 aa, Diabrotica virgifera
  misc_feature: Coding regions on vcDNA: vcDNA=SeqID_3325; Strand=-; Position=41-868
  misc_feature: Homolog annotation: Hit_ID=XP_312564.1; Match level="QueryCoverage =77%, HitCoverage=37%, E-value=7e-12, Identity=29%"; Hit description =ENSANGP00000014256 [Anopheles gambiae]
LLKVYKKAKARDILYARPYKVEYPPKPEGPFSYGGFAAFLSGNYKKVPVLIGFNSEETAPQAILKGVAAILLGTVDRNPGQLVDRRINMSPEDRTTAGSLLKQLYTRNTSFREDFGGYIRHSSDQLFANGICKQVELASPKMPNYLYQFAYKGEIGQETWFLPFLPPDVEKVAHVEDTHYLWDDGSTTDLSKFPESDQLVLHKYVKLWTNFVKFYNPTPESDAFLDNVIWESSEPNSLRYLNINETLSMQENPRQYKEVNEIMEKYMQPPFVLFG

SEQ ID NO: 23629 - protein, 350 aa, Diabrotica virgifera
  misc_feature: Coding regions on vcDNA: vcDNA=SeqID_3326; Strand=+; Position=240-1292
  misc_feature: Homolog annotation: Hit_ID=NP_725856.1; Match level="QueryCoverage =92%, HitCoverage=90%, E-value=7e-50, Identity=34%"; Hit description =CG15111-PB, isoform B [Drosophila melanogaster] gb|AAM68437.1| CG15111-PB, isoform B [Drosophila
  misc_feature: Pfam annotation: Pfam_ID=Abhydrolase_1; Match level="Score=-0.0, E -value=0.035, Copies=1"; Pfam description=alpha/beta hydrolase fold
ELETVAEDCVYFGCSIFIILLLIFLAIWVIFPLVFMNSISVQRFFIFFNFQDPKNPEFNNPQKYGMTGVVNFYITTKDLIDGSLVSIGAWLLLQENQIQSTKIAGQDDKTASEIIRNTKSPIAIYLHGVGCNRIKPKETYEVLRKHFLVISLDHRGYGDSGPDKPPTELGIVGDTSQVFQWIRALTDNDIYVWGHSLGTALSTHSVKRLKEQSIVPSGLILESPFTTMREEIPATSLGKIFSWMPWFTATVLNPIEKNGFQFKTTTNILDVDCPIMVMHAQDDNVIPYTLGEKVYHVASTERKIPDQGNVTFHLFGRLGYGHVGITSDPNVPKYIDEFIGFCKDQHKRRG

SEQ ID NO: 23630 - protein, 198 aa, Diabrotica virgifera
  misc_feature: Coding regions on vcDNA: vcDNA=SeqID_3327; Strand=+; Position=3-599
  misc_feature: Homolog annotation: Hit_ID=NP_728587.1; Match level="QueryCoverage =85%, HitCoverage=84%, E-value=2e-15, Identity=28%"; Hit description =CG9134-PC, isoform C [Drosophila melanogaster] ref|NP_728586.1| CG9134-PA, isoform A [Drosophila
  misc_feature: Pfam annotation: Pfam_ID=Lectin_C; Match level="Score=57.5, E-value =3.8e-14, Copies=1"; Pfam description=Lectin C-type domain
  misc_feature (8)..(8): Xaa can be any naturally occurring amino acid
  misc_feature (12)..(13): Xaa can be any naturally occurring amino acid
  misc_feature (24)..(24): Xaa can be any naturally occurring amino acid
SKAAGGGXGGGXXLKKPPAAPGPXSASESYIRVDDNSVHTVPVSSKPQWEKNFENGGQSTLPLVRFENKVYYLGIHITENWLDALKFCETIQMKLVSINSARENEKIGNYVREQGIHNRYWMGGARFIDDAKWLWIPYGREMNYSNWGPGQPLKNAHKCLLGSIVRDQFTWVVGNCNVALNFICERYVDDGGSTLGSI

SEQ ID NO: 23631 - protein, 209 aa, Diabrotica virgifera
  misc_feature: Coding regions on vcDNA: vcDNA=SeqID_3328; Strand=+; Position=293-920
  misc_feature: Homolog annotation: Hit_ID=EAA11440.2; Match level="QueryCoverage =97%, HitCoverage=44%, E-value=2e-80, Identity=71%"; Hit description =ENSANGP00000002547 [Anopheles gambiae str. PEST] ref|XP_557218.1| ENSANGP00000002547 [Anopheles gambiae st
  misc_feature: Gene Ontology Annotation: Molecular function=electron transporter activity; Biological process=UDP-glucose metabolism
  misc_feature: Pfam annotation: Pfam_ID=UDPG_MGDP_dh_N; Match level="Score=273.0, E -value=4.9e-79, Copies=1"; Pfam description=UDP-glucose/GDP-mannose dehydrogenase
  misc_feature (173)..(173): Xaa can be any naturally occurring amino acid
  misc_feature (183)..(183): Xaa can be any naturally occurring amino acid
MTIKNICCLGAGYVGGPTCSVIALKCKDIKVTVADLSEERIAQWNSDRLPIYEPGLDKVVQECRGRNLFFTTNLTQAILDADLIFISVNTPTKLNGNGKGRAPDLKYIEGAARIIADTAQTNKIVVEKSTVPVRAAESISDILTANKKPKVTHQILSNPEFLAEGTAINDLLXPDRVLIGGEXTEAGRQAIEALCSVYNTWIQKKRMLP

SEQ ID NO: 23632 - protein, 155 aa, Diabrotica virgifera
  misc_feature: Coding regions on vcDNA: vcDNA=SeqID_3329; Strand=+; Position=150-617
  misc_feature: Homolog annotation: Hit_ID=XP_395835.1; Match level="QueryCoverage =96%, HitCoverage=28%, E-value=3e-62, Identity=80%"; Hit description =similar to ENSANGP00000013881 [Apis mellifera]
MADPLSLLRQYNVNKKEIIERDGQIIFGEFSWPKNVKTNYLIWGSGKDGTPKEYYTLECLLFFLKNITLSHPVYVRQTAAETIPVVRRPDRKELLAYLNGETASCPAIDKSAPLEIPTQVKRSADYDGPESLAKKPRVEDTHCPEKSEKKNGWLS

SEQ ID NO: 23633 - protein, 342 aa, Diabrotica virgifera
  misc_feature: Coding regions on vcDNA: vcDNA=SeqID_3330; Strand=+; Position=38-1066
  misc_feature: Homolog annotation: Hit_ID=AAO01021.1; Match level="QueryCoverage =100%, HitCoverage=99%, E-value=1e-170, Identity=87%"; Hit description=Fib-PA [Drosophila erecta] sp|Q8I1F4|FBRL_DROER Fibrillarin
  misc_feature: Gene Ontology Annotation: Molecular function=methyltransferase activity; Cellular component=nucleolus; Biological process=ribosomal large subunit assembly and maintenance
  misc_feature: Pfam annotation: Pfam_ID=Fibrillarin; Match level="Score=606.9, E -value=1.6e-179, Copies=1"; Pfam description=Fibrillarin
MGKPDFSPGGGRGGRGGFGGGRGGGGGFGGGRGGGGGRGGFGGGGRGGGGGRGGFGGGRGGGGRGGFGGRGGGDRGGGGRGGFGGRGGGGRGGGRGGRGGGGGGFKGGKTVVIEPHRHEGVFIARGKEDALVTLNLVPGSEVYGEKRISVENEGEKTEYRVWNPFRSKLAAAILGGVDQIHMPPGSKVLYLGAASGTTVSHVSDVVGPEGLVYAVEFSHRSGRDLINVAKKRTNIIPIIEDARHPHKYRMLVGMVDTIFADVAQPDQARIVALNAQYFLKNNGHFVISIKASCIDSTAQPEAVFASEVKKLQADKLKPQEQLTLEPYERDHAVVVGGFRPPP

SEQ ID NO: 23634 - protein, 328 aa, Diabrotica virgifera
  misc_feature: Coding regions on vcDNA: vcDNA=SeqID_3331; Strand=+; Position=12-995
  misc_feature: Homolog annotation: Hit_ID=XP_392686.1; Match level="QueryCoverage =99%, HitCoverage=78%, E-value=4e-78, Identity=43%"; Hit description =similar to CG3344-PA [Apis mellifera]
  misc_feature: Gene Ontology Annotation: Molecular function=carboxypeptidase D activity; Cellular component=Golgi trans face; Biological process =proteolysis and peptidolysis
  misc_feature: Pfam annotation: Pfam_ID=Peptidase_S10; Match level="Score=98.1, E -value=2.2e-26, Copies=1"; Pfam description=Serine carboxypeptidase
  misc_feature (271)..(271): Xaa can be any naturally occurring amino acid
  misc_feature (281)..(281): Xaa can be any naturally occurring amino acid
  misc_feature (293)..(293): Xaa can be any naturally occurring amino acid
  misc_feature (298)..(298): Xaa can be any naturally occurring amino acid
  misc_feature (308)..(308): Xaa can be any naturally occurring amino acid
  misc_feature (312)..(312): Xaa can be any naturally occurring amino acid
  misc_feature (319)..(320): Xaa can be any naturally occurring amino acid
MLSVTLILLLFELTFAKIGFGPGEQDWGYATVREKGHIFWWLYYTTANVSHPTERPLIIWLQGGPGGSSTAIGNFVEIGPLDEDLNVRNTTWVQHANVLFVDNPVGTGFSYVDDGGVYAQNNSEVARDFLDFLIQFYDKLPNFRTVPLYIFGESYGGKMTVEIAVELDKAIKEKQIKANFKGIGLGDSWIAPMDYIFTWAPYLFNLGLLDEKGFEQINSIALKAQKSYEKGDYNMSTVYWALTEVQIVNETANVDFYNILNKIHTDPNFVXNDLDYSYLNXILAKVKNTLKLXSEGDXKSDKVFEALXTDFXEPVTHLXXTLLNFTNI

SEQ ID NO: 23635 - protein, 330 aa, Diabrotica virgifera
  misc_feature: Coding regions on vcDNA: vcDNA=SeqID_3332; Strand=+; Position=1-993
  misc_feature: Homolog annotation: Hit_ID=XP_393270.1; Match level="QueryCoverage =94%, HitCoverage=12%, E-value=6e-24, Identity=28%"; Hit description =similar to CG32704-PA [Apis mellifera]
QQQKRIVSPPLPPEPNLDSPGIQTPPLREAPRPWQTKKPQDEVPAWAKRENQIPSNVDEARKISPPASQQQQQRWPQPQAQGNPPPSFQQQQYEQPKYNQQQFQQAYAGRPDATQHQQPIGIRIDIRTKPQAPYQDQTEMENRPNVVYVTQPLVLQHPGVAPQRQQDPNNQGGARVVPVPVLNRQQSWGSNPVQSNSFKIIQKFTNTDGEEDEYDNVPITEHSPKYTQNFQQPNDQMRRMKVNDGEQSIANTFKQVPRGPQQQQSKGPQVRNIPIQIEGDDTPRPYVHPSEQVVREPKKYTGSSIPSRSFQILQAMTAPNDNDLAEHTDF

SEQ ID NO: 23636 - protein, 304 aa, Diabrotica virgifera
  misc_feature: Coding regions on vcDNA: vcDNA=SeqID_3333; Strand=+; Position=106-1020
  misc_feature: Homolog annotation: Hit_ID=AAM29550.1; Match level="QueryCoverage =100%, HitCoverage=34%, E-value=1e-119, Identity=72%"; Hit description=RE62270p [Drosophila melanogaster]
  misc_feature: Gene Ontology Annotation: Molecular function=molecular_function unknown; Cellular component=membrane; Biological process =intracellular protein transport
  misc_feature: Pfam annotation: Pfam_ID=Adaptin_N; Match level="Score=-110.0, E -value=0.00033, Copies=1"; Pfam description=Adaptin N terminal region
  misc_feature (267)..(267): Xaa can be any naturally occurring amino acid
  misc_feature (282)..(283): Xaa can be any naturally occurring amino acid
  misc_feature (289)..(289): Xaa can be any naturally occurring amino acid
  misc_feature (293)..(293): Xaa can be any naturally occurring amino acid
  misc_feature (301)..(301): Xaa can be any naturally occurring amino acid
MGTFKRDTHDEDGGSSAFQNLEKTTVLQEARVFNETSVNPRKCTPILTKLLYLLNQGETLSAKEATDVFFAMTKLFQSKDVILRRMVYLGIKELSSVADDVIIVTSSLTKDMTGKEDMYRAAAIRALCSITDATMLQAIERYMKQAIVDRNAAVSSAALISSLHMSKLAPDVVKRWVNEAQEAVNSDNAMVQYHALGLLYHIRKTDKLAVTKLISKLNSMGLKSPYALCMLIRITAKLLEEEDQESLLNSPYTIIFTMGLRNKSEMXVYEAAHAMVNLKFTXXNVLAPXISVXTIFCGSPXATL

SEQ ID NO: 23637 - protein, 225 aa, Diabrotica virgifera
  misc_feature: Coding regions on vcDNA: vcDNA=SeqID_3334; Strand=+; Position=137-814
  misc_feature: Homolog annotation: Hit_ID=CAH64510.1; Match level="QueryCoverage =97%, HitCoverage=41%, E-value=3e-73, Identity=59%"; Hit description =putative esterase [Tribolium castaneum]
  misc_feature: Gene Ontology Annotation: Molecular function=carboxylesterase activity; Cellular component=synaptic junction
  misc_feature: Pfam annotation: Pfam_ID=COesterase; Match level="Score=-27.6, E -value=5.4e-10, Copies=1"; Pfam description=Carboxylesterase
MESPIVTVTEGQVRGCQRVNLDGESFYSFLGIPFAKPPLGDLRFKSPQPVETWNGVRDATKDGQPSYQWDDKNNKPVGSEDCLHLGIHTKKLPSKEPSLKPVMVWIHGGGFIFGSNSSTDYGPEYLMLEDIVLVSVNYRLGFLGCLQFEDTSLNVPGNASLKDQLLALKWIQQNIHHFNGDPKNVTIFGESAGGASIHYLMLSPSSKGLFHRAILQSGCTFLSLV

SEQ ID NO: 23638 - protein, 257 aa, Diabrotica virgifera
  misc_feature: Coding regions on vcDNA: vcDNA=SeqID_3335; Strand=+; Position=120-893
  misc_feature: Homolog annotation: Hit_ID=CAH64509.1; Match level="QueryCoverage =99%, HitCoverage=48%, E-value=5e-84, Identity=59%"; Hit description =putative esterase [Tribolium castaneum]
  misc_feature: Gene Ontology Annotation: Molecular function=carboxylesterase activity; Cellular component=synaptic junction
  misc_feature: Pfam annotation: Pfam_ID=COesterase; Match level="Score=58.3, E-value= 2.2e-14, Copies=1"; Pfam description=Carboxylesterase
MESPIVTVVEGQVRGCQKVNLDGESFYSFLGIPFAKPPLGDLRFKAPVPAEPWIEIRDATIDGNSCYQRNEMTKELEGSEDCLYLNVYTKKLPSECNALKPVMVWIHGGAFVTGSNKSSFYGPEFLITEDIVLVTINYRVGFLGFLHLDDTSLDVPGNAGLKDQQLALKWVQNNIKSFNGDPNNVTIFGESAGSASVHIHVVSPSSKGLFHKAILQSGCLLNPWVFSKDYALTFTKTITDTVMTEKEALEVLKKIPG

SEQ ID NO: 23639 - protein, 343 aa, Diabrotica virgifera
  misc_feature: Coding regions on vcDNA: vcDNA=SeqID_3336; Strand=+; Position=269-1297
  misc_feature: Pfam annotation: Pfam_ID=PBP_GOBP; Match level="Score=28.2, E-value =2.5e-05, Copies=1"; Pfam description=PBP/GOBP family
MVGTGKINIIAHRCSRRLPEESAEESAITLYRCLHKPAHVHNNNHTHIHVHRHKRSIKRSKAHKFCQSDESTRVNESDMEKFKKGEEVDTSKIKNYIFCMNKKFEIQNVDGTVNKDGFKKYLENKVSDKTRANELTRKCSEISDPVAEETAIKLYKCVHENDRQDDQNQNALQQQVKLAFEQCQADPKTFVDKKTLKKARKGKKIDTAGLRAHTFCMSLKLNLQSTDGSIKTETVRKNLEGEETEAKINIIVNICGTRDENDPANLTALKLFKCLYKYEKKREQKKRAFLRLQFKKFHQECLSDPRHQVDEESLFLVSHGEEIDDPNLAYTICPNKKSTTKRE

SEQ ID NO: 23640 - protein, 344 aa, Diabrotica virgifera
  misc_feature: Coding regions on vcDNA: vcDNA=SeqID_3337; Strand=+; Position=38-1069
  misc_feature: Pfam annotation: Pfam_ID=PBP_GOBP; Match level="Score=42.1, E-value =1.6e-09, Copies=2"; Pfam description=PBP/GOBP family
MKLVYCVCFLLLFGVVAPDAAAFKEKVKRLEQECQNDKTTYVDEAELERFRNHEPTTATNLGLHYLCTNIKLGIQDENGKINTEAIKNNLREIMVGTGKINIIAHRCSRRLPEESAEESAITLYRCLHKPAHVHNNNHTHIHVHRHKRSIKRSKAHKFCQSDESTRVNESDMEKFKKGEEVDTSKIKNYIFCMNKKFEIQNVDGTVNKDGFKKYLENKVSDKTRANELTRKCSEISDPVAEETAIKLYKCVHENDRMIYTLTANLTALLQCLYKYEKKREQKKRAFLKRLKQFKKFHQECLSSANQVDEESLSVSHGEDIEDPNLASYTTCLNKKIKYQDKKGK

SEQ ID NO: 23641 - protein, 404 aa, Diabrotica virgifera
  misc_feature: Coding regions on vcDNA: vcDNA=SeqID_3338; Strand=+; Position=353-1567
  misc_feature: Homolog annotation: Hit_ID=XP_309478.1; Match level="QueryCoverage =98%, HitCoverage=88%, E-value=1e-147, Identity=63%"; Hit description= ENSANGP00000022045 [Anopheles gambiae]
  misc_feature: Gene Ontology Annotation: Biological process=sulfur amino acid metabolism
  misc_feature: Pfam annotation: Pfam_ID=Cys_Met_Meta_PP; Match level="Score=704.3, E- value=7.5e-209, Copies=1"; Pfam description=Cys/Met metabolism PLP -dependent enzy
MALTNGKVVGADGDNDGYLPFPKGFATAAIHHSQEPEQWDSMAVVTPLVTSTTFKQHGPAQFKKYEYGRSGNPTREVLENVLAKLDNVSYGLAFSSGLGALTAIAGLFKSGDNVIIGDDIYGGTFRFFSKVLTNYNIEITIVDMVDIKNLENAIKPNTKLIWCETPTNPTLKVMDIRAAAKIAKKHNVILAVDNTFLTPYLQRPLDLGADLAVYSLTKYMNGHSDVIMGSIATNNKELFDKLKFLQNSMGIVPAPFDCYQVNRSLKTLALRMAQHKISGLAVAKYLEAHPQVEKVLHPGLQSHPQYELFKSQTSGHSGVFSFVLKGGLTESQKFLSALEVLTLGESLGGYESLVELPSLMTHASVPAEQRAVLGISDSLIRISVGLEDVEDLIADLEQAFKKIK

SEQ ID NO: 23642 - protein, 260 aa, Diabrotica virgifera
  misc_feature: Coding regions on vcDNA: vcDNA=SeqID_3339; Strand=+; Position=53-835
EVWFSVNNKNIICVLSLNMKILTDFTQNLLDFLVEQQYEHSQNIIRTHTKKLNELGDLSFPTNTKNWYQFIDVIKEESVKSVNIVKFEISETTRELVTEQLLQKSSSWPIEINKIVFKKADAHIHLKRSPVLYKTVIKHVLMQDSQYGSCPIMSNNFNVGFSVNIEDSNIVNLTTLRMMILKEVAENFIKYNTMESPRNTYNLHFVANAVDNENINILCGPVLNERCIKSNLTAKELYEKRASDMRMMAQHKYGGSDKTK

SEQ ID NO: 23643 - protein, 474 aa, Diabrotica virgifera
  misc_feature: Coding regions on vcDNA: vcDNA=SeqID_3340; Strand=+; Position=1-1425
  misc_feature: Homolog annotation: Hit_ID=XP_316158.1; Match level="QueryCoverage =93%, HitCoverage=90%, E-value=1e-100, Identity=46%"; Hit description= ENSANGP00000020419 [Anopheles gambiae]
  misc_feature: Gene Ontology Annotation: Molecular function=mitochondrial processing peptidase activity; Cellular component=mitochondrion; Biological process=mitochondrial processing
  misc_feature: Pfam annotation: Pfam_ID=Peptidase_M16; Match level="Score=95.1, E -value=1.8e-25, Copies=1"; Pfam description=Insulinase (Peptidase family M16)
PTSVRLCCQVINSENLGKKDICFISFHTPSLRSMASTLTRTPILRAISARSYSQTLPVSGNPSAELRTSTLPNKLVVAAVDNDASLTRVSIVFRAGSRNEKADNLGATHIVRTAAGLSTKNASQFAIIRNIQQVGANLTATSDRETISYTLEGTRSAVEKALPYLAEVATHQEFRPWEVSELSNRLILDILTRPLQLRAIDLLHNAAYRSKGLGNSLFIPKSQVGKVSSETLQHYVASNFVAGRAAVVGTGVSESLLNQFAASLGIANGEGSTNPSPYKGGELRSNKGGPLAFVAVGGEGAPLKNTKEALAFAVLQKAVCAGPQIKYGVLDNGVYSKALGGSSDVSACAVNVSYSDSGLFGILLAAPAGSVGKAVQSAVNVLKSGSVTDADVQRGKNQLKTAILLNAESGADVVRELGTQAVLAGAPQSANALAAAVDSVSTSDVQSALRKAGGKLTLAAIGNINDVPYLDELK

SEQ ID NO: 23644 - protein, 548 aa, Diabrotica virgifera
  misc_feature: Coding regions on vcDNA: vcDNA=SeqID_3341; Strand=+; Position=87-1728
  misc_feature: Homolog annotation: Hit_ID=XP_316190.1; Match level="QueryCoverage =99%, HitCoverage=98%, E-value=0.0, Identity=69%"; Hit description =ENSANGP00000017082 [Anopheles gambiae]
  misc_feature (281)..(281): Xaa can be any naturally occurring amino acid
  misc_feature (293)..(293): Xaa can be any naturally occurring amino acid
  misc_feature (302)..(302): Xaa can be any naturally occurring amino acid
  misc_feature (313)..(313): Xaa can be any naturally occurring amino acid
  misc_feature (322)..(322): Xaa can be any naturally occurring amino acid
MSKGYGDDFEQGYDYGYDDYGSHTGDPNLDEHNRQHFKMPDSVKNFLVYFRNNVNEGLIFELQALYEHTWPKLTEDYFEKRPWPEENEVAAIVDNDPVFMILYKELYFRHIYARIQGGPSLEQRFNSFFNYCDLFNYILSAEEPVPLELPDLWLWELIDEFVYQFQSFAQYRARLQNKKPLELETLNSNNKVWNVLCVLNVLHSLVDKSNIKQQLEVYASGGDPESVSGEFGSHSLYKMLGYFSLVGLLRLHSLLGDYYQAIKVLENIEVHKKSQYAHIPXCQISTSYYVGFXAYMMMRRYXSDAIRTFSSIXLYIQRTKQXFASKTYQHDQINKQTDQMYHLLAICLVLHPQCVDESIQQVLREKSYHEKMYKMQYGDLTEFENSFVYACPKFLSPYPPPIDSVSGDYSKEAIQHQTAVFMDEVAQQKMLPTIRSYLKLYTTLPLSKLATFMAQNSRNNEGRDLDKEIESLVIHLLCFKHKMKNVVWSKGASGLEGKFQSGSELDFYIDNDMIHIADTKVAHRYGDFFIRKIIKFEDLNRKLHQLKL

SEQ ID NO: 23645 - protein, 148 aa, Diabrotica virgifera
  misc_feature: Coding regions on vcDNA: vcDNA=SeqID_3342; Strand=+; Position=176-622
  misc_feature: Homolog annotation: Hit_ID=AAK92184.1; Match level="QueryCoverage =97%, HitCoverage=98%, E-value=6e-72, Identity=90%"; Hit description =ribosomal protein S15 [Spodoptera frugiperda] emb|CAH04125.1| ribsomal protein S15e [Papilio dardanus]
  misc_feature: Gene Ontology Annotation: Molecular function=structural constituent of ribosome; Cellular component=cytosolic ribosome (sensu Eukarya); Biological process=positive regulation of growth rate
  misc_feature: Pfam annotation: Pfam_ID=Ribosomal_S19; Match level="Score=165.2, E -value=1.4e-46, Copies=1"; Pfam description=Ribosomal protein S19
MADKAEELVKKKRTFKKFTFRGVDLDQLLDMPNEQLMELMHCRARRRFTRGLKRKPMALVKKLRKAKKEAPPLEKPEIVKTHLRNMIIVPEMVGSIVGVYNGKAFTQVEIKPEMIGHYLGEFSLTYKPVKHGRPGIGATHSSRFIPLK

SEQ ID NO: 23646 - protein, 267 aa, Diabrotica virgifera
  misc_feature: Coding regions on vcDNA: vcDNA=SeqID_3343; Strand=+; Position=53-856
  misc_feature: Homolog annotation: Hit_ID=AAW43830.1; Match level="QueryCoverage =74%, HitCoverage=56%, E-value=1e-12, Identity=27%"; Hit description =isoprenoid biosynthesis-related protein, putative [Cryptococcus neoformans var. neoformans JEC21] gb|EAL20
  misc_feature: Gene Ontology Annotation: Molecular function=dimethylallyltransferase activity; Cellular component=cytosol; Biological process=cholesterol biosynthesis
MLKKIFQRDIPKHALKIINRSCQKRRLTSQTRRHPAFERSPVYFKEEEVILNKLIPQIREDVIDESLVYYNNMQKLRRHFENLFTHQVENLKSKYMPSAAITINFYKHFKKDYTEEELMKVGILGWCFKLQDISLIMVDDIMDESEFRYNKPVWYREVGVKQAIIDSLIFEHCSSYLLLKYFSDLKYFPQIQKELLQNIATANSSQILELDDFPLEDYEKYENLVKSYPFFVHSVTSVMYMVGVDDPHLHSIAKKMCMDISIFGKKI

SEQ ID NO: 23647 - protein, 283 aa, Diabrotica virgifera
  misc_feature: Coding regions on vcDNA: vcDNA=SeqID_3344; Strand=+; Position=306-1157
  misc_feature: Homolog annotation: Hit_ID=NP_999274.1; Match level="QueryCoverage =90%, HitCoverage=86%, E-value=1e-19, Identity=30%"; Hit description =pancreatic elastase II [Sus scrofa] sp|P08419|EL2_PIG Elastase 2 precursor pir||A26823
  misc_feature: Gene Ontology Annotation: Molecular function=pancreatic elastase activity; Cellular component=extracellular; Biological process =proteolysis and peptidolysis
  misc_feature: Pfam annotation: Pfam_ID=Trypsin; Match level="Score=83.3, E-value =6.7e-22, Copies=1"; Pfam description=Trypsin
MKPIVLCLMIIAASKAIPTNRLTNDDANLGDFPWIVALNIYARMPWYEITYHECGGVLVSKSWVLTSASCVKSNAQWNTVTEIYAGFVRQNDPSRQSFTISRIERHPGFNMNESRNPSFDDIALVKLDRDVELNENVKIVKLPEADADITKNFTSAGWPYAAITRENQDILQLRSVPFLDYKTCYDQVAAYVALGRTEPLDEAWDNIYLNETQNICTGPKDAETAVFTKGYHGGPLIQDGVVYGVLSYTLNVYIYHKDFYEPSGVFINVFNYISWIKGIVDDL

SEQ ID NO: 23648 - protein, 180 aa, Diabrotica virgifera
  misc_feature: Coding regions on vcDNA: vcDNA=SeqID_3345; Strand=+; Position=1-540
  misc_feature: Homolog annotation: Hit_ID=XP_307900.1; Match level="QueryCoverage =97%, HitCoverage=20%, E-value=2e-75, Identity=74%"; Hit description =ENSANGP00000021671 [Anopheles gambiae]
  misc_feature: Gene Ontology Annotation: Molecular function=ATP-binding cassette (ABC) transporter activity; Cellular component=mitochondrion; Biological process=iron ion homeostasis
RTRGVSAFNIWFGLIVFTTMILYIVLTIVITEWRTKFPTRPNLADNETRSRSVDSLLNFETVKYYGAENYEVDAFREAVLKFQDEEFKSSITLNILNTVQNVIICGGLLAGSLLCVYMVVEPKTLKAGDYVLFATYIVQLYVPLNWFGTYYRAIQKNFVDMENMFDLLREEQEIIDAPGA

SEQ ID NO: 23649 - protein, 342 aa, Diabrotica virgifera
  misc_feature: Coding regions on vcDNA: vcDNA=SeqID_3346; Strand=+; Position=21-1049
  misc_feature: Homolog annotation: Hit_ID=XP_393207.1; Match level="QueryCoverage =94%, HitCoverage=54%, E-value=3e-50, Identity=37%"; Hit description =similar to Glucosylceramidase precursor (Beta-glucocerebrosidase) (Acid beta-glucosidase)
  misc_feature: Gene Ontology Annotation: Cellular component=extracellular space
  misc_feature: Pfam annotation: Pfam_ID=Glyco_hydro_30; Match level="Score=-148.0, E- value=0.00013, Copies=1"; Pfam description=O-Glycosyl hydrolase family 30
MFRESIFLTLGVLLAGVVFSSSDTVKSQNPEECLARDYGKGSVVCVCNDQHCDYSPPVEPVPKNKYIVYTSNQAGLRFKKEVKTYTNAKSGKHCFVPPNDDICEHDWDTSYRVCGVLVPSHLIPSANIFVEPSILYQEVMGWGGAVTDSTVINVANMTKTLQEHLLRSYYSTDGLDYNFARVPMGGTDFSTRFYSYIDTLEHVVDCVDHSLKDFKLAPEDIDLKIPFLKRARQLRNDLKLFSSTWVLPTAYKENNSYMGFLGFIRKEVYQLLADYYIKFFDLYKERGLSFWGVSSTNEPFIAMAEFSIPGTPGNLWTPEDLGYWIRDHLGPTLNGQIIAILN

SEQ ID NO: 23650 - protein, 73 aa, Diabrotica virgifera
  misc_feature: Coding regions on vcDNA: vcDNA=SeqID_3347; Strand=-; Position=520-741
CSRQIKNFNYRMIDKVTYSVKNNFILIIFYVISVIQLKLLFSYSHSALNTRLHVIFMSQFICQSYMMHITSNQ

SEQ ID NO: 23651 - protein, 297 aa, Diabrotica virgifera
  misc_feature: Coding regions on vcDNA: vcDNA=SeqID_3348; Strand=+; Position=49-939
  misc_feature: Homolog annotation: Hit_ID=XP_313650.1; Match level="QueryCoverage =88%, HitCoverage=19%, E-value=9e-13, Identity=28%"; Hit description =ENSANGP00000003674 [Anopheles gambiae]
  misc_feature: Gene Ontology Annotation: Molecular function=structural molecule activity; Cellular component=cornified envelope; Biological process =protein-nucleus import
  misc_feature: Pfam annotation: Pfam_ID=YLP; Match level="Score=17.6, E-value=0.039, Copies=5"; Pfam description=YLP motif
MKQILVLSILFVSTFGAKLNQYLPPRPETDNAQYQPPARPNQPFSAASQSQQQFAAPNFQQASRQYLAPNKGPEQSGQGSSPFGQISGQFGQQSNQFGNRNSFNGNGNSSPNKQYLAPNKQDASGQSSNSFGNFQQPNAFNGNGNGPNRQYLGPNKQDASGQSSNSFGVQSRNNFNGNGPSPSSSFGSKSTNQAPNAGNDNSFGPSFNSFNQKAAPNGQFGQSGSYSNGFNQQSGQGQYNGQFSGPQSAPIGLIRSEFNPDLGDGHYSYSYETENGNSAQEEGFVQNEGKSAHGGIL

SEQ ID NO: 23652 - protein, 328 aa, Diabrotica virgifera
  misc_feature: Coding regions on vcDNA: vcDNA=SeqID_3349; Strand=+; Position=2-985
  misc_feature: Homolog annotation: Hit_ID=EAA14376.2; Match level="QueryCoverage =93%, HitCoverage=92%, E-value=9e-23, Identity=31%"; Hit description =ENSANGP00000014755 [Anopheles gambiae str. PEST] ref|XP_553764.1| ENSANGP00000014755 [Anopheles gambiae st
  misc_feature: Pfam annotation: Pfam_ID=Chitin_bind_4; Match level="Score=101.2, E -value=2.7e-27, Copies=1"; Pfam description=Insect cuticle protein
QILVLSILFTSVFGAKLNQYLPPRPENNNAQYEPPALPNQPFTAASHSQQQFANPNFHINGNGNGNAQGHASSFGLKSTNQAPNSGNDNTFGPSFNSFNQKAAPNGQFGQSNGFNQRSGQPQYNGQFSGSQSASIGLIRSEFNPDLGDGHYSYSYETENGISAQEEGSIQNKGKSAQGGFSYTSPEGEQITLEYTADENGFVPKGSHVPEIPEAILKSIELNKAAETRGEYNEGSYREEYNQEGSNGNNRYHGNANNKYQENSNGGYQGNGPREQSPFASQENRQVASLPGPKSFRTQKNGYQYSGPSKSNNFADQGTFASQQSNQVS

SEQ ID NO: 23653 - protein, 338 aa, Diabrotica virgifera
  misc_feature: Coding regions on vcDNA: vcDNA=SeqID_3350; Strand=+; Position=173-1189
  misc_feature: Homolog annotation: Hit_ID=XP_311576.1; Match level="QueryCoverage =97%, HitCoverage=55%, E-value=1e-125, Identity=66%"; Hit description= ENSANGP00000016083 [Anopheles gambiae]
  misc_feature: Gene Ontology Annotation: Molecular function=lyase activity; Cellular component=peroxisome; Biological process=lipid metabolism
  misc_feature: Pfam annotation: Pfam_ID=TPP_enzyme_N; Match level="Score=166.8, E -value=4.7e-47, Copies=1"; Pfam description=Thiamine pyrophosphate enzyme, N-term
MGDLDGNTVLAQALKKQGIEYVFGIIGYPVIELSMALQMADIHYIGMRNEQAACYAAQAIGYLTGNPGAVLVVSGPGLLHTFGGLANAQINCWPVLVLGGSAPQDHEGIGGFQECNQVELARPYCKYSARPPSIPLIPLHVEKAVRLAKTGRPGAAYLDFPANILSGRVSQEKIPDQYGPVPIPQVFPDPRQIEKVITVLSQAQNPLIIVGKGAAYSRAEKEVRDLIEFANLPFLATPMGKGVVPDTSTKFVGSARSTALQQADVILLLGARLNWILHFGRPPRFSPNVKEIQIDITAEELHNSVKSEVAIQSDIKSAKRLINTKKKGQYFKYKFFKK

SEQ ID NO: 23654 - protein, 479 aa, Diabrotica virgifera
  misc_feature: Coding regions on vcDNA: vcDNA=SeqID_3351; Strand=+; Position=197-1636
  misc_feature: Homolog annotation: Hit_ID=EAA00262.3; Match level="QueryCoverage =95%, HitCoverage=92%, E-value=1e-126, Identity=49%"; Hit description= ENSANGP00000015378 [Anopheles gambiae str. PEST] ref|XP_552299.1| ENSANGP00000015378 [Anopheles gambiae s
  misc_feature: Gene Ontology Annotation: Molecular function=basic amino acid transporter activity; Cellular component=integral to plasma membrane; Biological process=basic amino acid transport
  misc_feature: Pfam annotation: Pfam_ID=Alpha-amylase; Match level="Score=318.1, E -value=1.4e-92, Copies=1"; Pfam description=Alpha amylase, catalytic domain
MLRCALLFSAILAISLVNARGLVEDKDWWKTATFYQIYPKSFKDSNGDGIGDLEGIIQKLDYLADLGITGIWLSPIYKSPLIDEGYDISDFRDINPLFGDLKTFVRLVEGAHSRGLRVVLDYVPNHTSDQHEWFKKSENGEEGYEDYFLWIDSKDGSKTDLPNNWISVFKNSVWEWSDKRNKFYLHQFFKQQPDLNFFNEKVRKEMRDILNYWLEEYGVDGVRIDAVPHLVEAKNLTNEPRTYDPNASPNEYDYLDHIFTRNQPESYDLVYEWRSHIDGISKNTSQTKICMTEAAVDLKYVVPYYGTADGSKLGAHFSFNFVLLGLETTSTAADVASLIHAWVDKLPKIYTSNWVLGNHDNHRIATKAGKERVDCLNMLSAFLPGIQVTYNGEEIGMENGEVDCETQGLDHAENCTDYYKISRDFERTPFQWDSSEFAGFTDGKKTWLPVSSKKAECNAKDQLKDEKSHFKYITRSFRA

SEQ ID NO: 23655 - protein, 226 aa, Diabrotica virgifera
  misc_feature: Coding regions on vcDNA: vcDNA=SeqID_3352; Strand=+; Position=118-798
  misc_feature: Homolog annotation: Hit_ID=AAT01085.1; Match level="QueryCoverage =100%, HitCoverage=100%, E-value=2e-88, Identity=73%"; Hit description=putative vacuolar ATP synthase subunit E [Homalodisca coagulata]
  misc_feature: Gene Ontology Annotation: Molecular function=hydrogen-transporting ATPase activity, rotational mechanism; Cellular component=plasma membrane; Biological process=proton transport
  misc_feature: Pfam annotation: Pfam_ID=vATP-synt_E; Match level="Score=304.3, E -value=1.9e-88, Copies=1"; Pfam description=ATP synthase (E/31 kDa) subunit
MALSDADVQKQIKHMMAFIEQEANEKAEEIDAKAEEEFNIEKGRLVQQQRLKIMEYYEKKEKQVELQKKIQSSNMLNQARLKVLKVREDHVRAVLEDARKRLGEVTRDSGKYTQILESLILQGLYQLFEKDITIRVRPQDRELVKSIMPNVSQKYKDITGKDVNLKIDDESHLSQETTGGIELLALRNKIKINNTLEARLELISQQLIPQIRNALFGRNVNRKFTD

SEQ ID NO: 23656 - protein, 231 aa, Diabrotica virgifera
  misc_feature: Coding regions on vcDNA: vcDNA=SeqID_3353; Strand=+; Position=195-887
  misc_feature: Homolog annotation: Hit_ID=NP_033593.1; Match level="QueryCoverage =82%, HitCoverage=66%, E-value=2e-42, Identity=40%"; Hit description =zinc finger protein 93 [Mus musculus] gb|AAH03776.1| Zinc finger protein 93 [Mus musculus]
  misc_feature: Gene Ontology Annotation: Molecular function=zinc ion binding; Cellular component=nucleus; Biological process=regulation of transcription, DNA-dependent
  misc_feature: Pfam annotation: Pfam_ID=zf-C2H2; Match level="Score=142.1, E-value =1.3e-39, Copies=5"; Pfam description=Zinc finger, C2H2 type
MEVIKVEIKKELAEDNQNCIESHISTSLDIQDLKNEPEEDESGHLQKNRIFTEQTSHEEENIGTHVEDETLNENMKMQTGKQSYQCEICLKEFSNRFNLKIHSRNHTGEKPFKCEICLKQFTSAGSVKTHLKSHSKEKPYTCSICFMKFSLAGNLKKHLRVHTGEKDYKCDICLKDFADAQTLKSHLMTHTGEKPHQCEICFKQFTHRGAFRNHVNTHTKEQQYQCEICLK

SEQ ID NO: 23657 - protein, 286 aa, Diabrotica virgifera
  misc_feature: Coding regions on vcDNA: vcDNA=SeqID_3354; Strand=+; Position=74-935
  misc_feature: Homolog annotation: Hit_ID=AAT38514.1; Match level="QueryCoverage =93%, HitCoverage=53%, E-value=4e-46, Identity=35%"; Hit description =antennae-rich cytochrome P450 [Phyllopertha diversa]
  misc_feature (243)..(243): Xaa can be any naturally occurring amino acid
MSVLNSSWLLYPVILCIAIIFLGYKYFTRQFDYWKKRGVYTSTPVPFFGSLYDVATFKLTSHELFKKFYDETEEPYFGMFLFDKPILVVKSPKLIKDILIKDFNTFGDRSVAHATHHDNGSQFLFFQKRPSWKYTRGKMSPIFSSTMTKQYFADIELINKRFIEYLENISGPVDAKFIAGHFSTEMVARCFFATDPRCFETKVSEFRQRVHRIFEFGVRNGVIQSFYFFKPSLVKFFKLNFVXISAMKYFEKVFLKAMEYRKQYNGKPANMVDLVNDLQKNTIGIF

SEQ ID NO: 23658 - protein, 343 aa, Diabrotica virgifera
  misc_feature: Coding regions on vcDNA: vcDNA=SeqID_3355; Strand=+; Position=115-1144
  misc_feature: Homolog annotation: Hit_ID=AAL51056.1; Match level="QueryCoverage =96%, HitCoverage=84%, E-value=1e-121, Identity=66%"; Hit description= cathepsin D [Apriona germari]
  misc_feature: Gene Ontology Annotation: Molecular function=aspartic-type endopeptidase activity; Cellular component=lysosome; Biological process=induction of non-apoptotic programmed cell death
  misc_feature: Pfam annotation: Pfam_ID=Asp; Match level="Score=426.3, E-value=3.7e -125, Copies=1"; Pfam description=Eukaryotic aspartyl protease
  misc_feature (302)..(302): Xaa can be any naturally occurring amino acid
  misc_feature (319)..(319): Xaa can be any naturally occurring amino acid
MRNYLLLFFICSIYTVNCDFVRIPLQKIQTIRNSLREVGTELTRVSVKQTSNKYGGPTPEPLSNYLDAQYYGPISIGNPPQNFKVVFDTGSSNLWVPSKKCGFTNIACLLHNKYDSSKSSSYKQNGTKFEIHYGSGSLSGFLSTDVVQFGNVAVKDQTFAEAVSEPGLAFVAAKFDGILGMAYDRISVDGVPPVFNQMIKQGLVNQPVFSFYLNRDPSGKEGGEIILGGSDPEHYKGEFTYIPVTRQAYWQFKMDQVTVGSKTFCSAGCQAIADTGTSLIAGPVEEMTAIHQAIGGTPFPGXGNNIVDGQLIPKLPSIXFVLGGKSFPLEGKSELNYLRGDLK

SEQ ID NO: 23659 - protein, 274 aa, Diabrotica virgifera
  misc_feature: Coding regions on vcDNA: vcDNA=SeqID_3356; Strand=+; Position=300-1124
  misc_feature: Homolog annotation: Hit_ID=EAL24895.1; Match level="QueryCoverage =97%, HitCoverage=68%, E-value=1e-115, Identity=73%"; Hit description= GA13759-PA [Drosophila pseudoobscura]
  misc_feature: Gene Ontology Annotation: Molecular function=aspartic-type endopeptidase activity; Cellular component=lysosome; Biological process=induction of non-apoptotic programmed cell death
  misc_feature: Pfam annotation: Pfam_ID=Asp; Match level="Score=413.4, E-value=2.8e -121, Copies=1"; Pfam description=Eukaryotic aspartyl protease
MERNPEVLHNKYDSSKSSSYKQNGTKFEIHYGSGSLSGFLSTDVVQFGNVAVKDQTFAEAVSEPGLAFVAAKFDGILGMAYDRISVDGVPPVFNQMIKQGLVNQPVFSFYLNRDPSGKEGGEIILGGSDPEHYKGEFTYIPVTRQAYWQFKMDQVTVGSKTFCSAGCQAIADTGTSLIAGPVEEMTAINQAIGGTPIPGGEYIVDCQLIPKLPVMNFVLAGKSFPLEGKDYILRVSQMGKTICLSGFMGIDIPPPNGPLWILGDVFIGKYYTEV

SEQ ID NO: 23660 - protein, 281 aa, Diabrotica virgifera
  misc_feature: Coding regions on vcDNA: vcDNA=SeqID_3357; Strand=+; Position=694-1536
  misc_feature: Homolog annotation: Hit_ID=XP_309291.1; Match level="QueryCoverage =99%, HitCoverage=43%, E-value=1e-121, Identity=74%"; Hit description= ENSANGP00000017983 [Anopheles gambiae]
  misc_feature: Gene Ontology Annotation: Molecular function=molecular_function unknown; Cellular component=cytoplasmic vesicle; Biological process =intracellular protein transport
  misc_feature: Pfam annotation: Pfam_ID=Sec1; Match level="Score=-82.2, E-value=6.3e- 08, Copies=1"; Pfam description=Sec1 family
MTSLRQKQINAIKQMLNLNQPQTKLSASEPVWKVLIYDRIGQDIISPLISVKELREQGVTLFVQLHSDRDPIPEVPAIYFCAATEDNLDRISQDFQRGTYDIYHLNFISPISRDKLEDLASAAIAANSVANIHKVYDQYINFISLEDDLFVLKHQNSDIMSYYSINKGDIKDSEMEAIMNNIVDSLFSVFVTLGTVPIIRSPKGNAAEMVAKKLDKKLRENIFDTRNNLFVSDAQSGNFNFQRPLLIILDRNVDMATSLHHTWTYQALAHDLLDLALNRVT

SEQ ID NO: 23661 - protein, 261 aa, Diabrotica virgifera
  misc_feature: Coding regions on vcDNA: vcDNA=SeqID_3358; Strand=+; Position=228-1013
  misc_feature: Homolog annotation: Hit_ID=AAH82401.1; Match level="QueryCoverage =96%, HitCoverage=33%, E-value=6e-40, Identity=37%"; Hit description =LOC397888 protein [Xenopus laevis]
  misc_feature: Gene Ontology Annotation: Molecular function=electron transporter activity; Cellular component=integral to membrane; Biological process=electron transport
  misc_feature (253)..(253): Xaa can be any naturally occurring amino acid
MVCLNVNKVAILTIIVLGVVALTQQRSIKEIEQQPFELDDYLNHTYSALAFNGSWISDSAFMYKTFENDILFFNMSTKSVDLFLDNKVLEEYPTAELRLSPDRSYVLLKYNVSAVFRHSITAVYTIYDVAQQKFYHLANQQPLQLVEFSPEGHGLVYVLENNIYYIDDFSKNIETPVAVTVVGIPGVLYCGVPDWVYEEEVLASGSALWFSPDGAYLAYAVFNDEQVYNLSYTIYGEPGSPGKSYPHEAVIRXPKSGTPNP

SEQ ID NO: 23662 - protein, 297 aa, Diabrotica virgifera
  misc_feature: Coding regions on vcDNA: vcDNA=SeqID_3359; Strand=+; Position=37-927
  misc_feature: Homolog annotation: Hit_ID=XP_422032.1; Match level="QueryCoverage =98%, HitCoverage=38%, E-value=3e-44, Identity=33%"; Hit description =PREDICTED: similar to fibroblast activation protein, alpha subunit; integral membrane serine
  misc_feature: Gene Ontology Annotation: Molecular function=electron transporter activity; Cellular component=integral to membrane; Biological process=electron transport
  misc_feature: Pfam annotation: Pfam_ID=DPPIV_N; Match level="Score=-79.6, E-value =3.1e-05, Copies=1"; Pfam description=Dipeptidyl peptidase IV (DPP IV) N-ter
MNVAILTIIVLGVVALSQQRSIKEIEQQPFELDDYLNHTYSALAFNGSWISDSAFMYKTFENDILFFNMSSKSVDLFLDNKVLAEYPTAELRLSPDRSCVLLKYNVSAVFRHSITAIYAIYDVAQQKFYHLANQQPLQLVEFSPEGHGLVYVLENNIYYIDDFSKHIETPVAVTVVGIPGVLYCGVPDWVYEEEVLASGSALWFSPDGAYLAYAVFNDEQVYNLSYTIYGEPGSPGSQYPHEAVIRYPKSGTPNPIARIYLYDIANKKTKEIQIPLHISNVEPHDFIFYRLTWISAD

SEQ ID NO: 23663 - protein, 166 aa, Diabrotica virgifera
  misc_feature: Coding regions on vcDNA: vcDNA=SeqID_3360; Strand=+; Position=221-718
GIGLNNNTSIDPKVNLTCTSGSLKLPGASCYITDEALATEYERDSHTTVTGDQGKVIPTTHQPAWPTWCFKAIFPKLTMSNLQQSGNGPHVGRRNPESHIGKPISLKGSGGGKSSTRTNKRKRKKKECNRIHIATYNIRSMAQDEKLYKLEKELTKIKWDIVGLSE

SEQ ID NO: 23664 - protein, 226 aa, Diabrotica virgifera
  misc_feature: Coding regions on vcDNA: vcDNA=SeqID_3361; Strand=+; Position=73-753
  misc_feature: Homolog annotation: Hit_ID=NP_611695.1; Match level="QueryCoverage =91%, HitCoverage=100%, E-value=1e-87, Identity=76%"; Hit description= CG2852-PA, isoform A [Drosophila melanogaster] gb|AAF46873.1| CG2852 -PA, isoform A [Drosophila
  misc_feature: Gene Ontology Annotation: Molecular function=chaperone activity; Cellular component=endoplasmic reticulum; Biological process=signal transduction
  misc_feature: Pfam annotation: Pfam_ID=Pro_isomerase; Match level="Score=370.9, E -value=1.7e-108, Copies=1"; Pfam description=Cyclophilin type peptidyl-prolyl cis-
MSFLLLHRLIRDKIGYKAAMKVLLVTLAFVAVLAYVRSDDSSKKGPKVTDKVWFDITIGGEPLGRIEIGLFGKTVPRTVKNFRELATKPAGEGYKGSKFHRVIRDFMIQGGDFTKGDGTGGRSIYGERFADENFKLKHFGAGWLSMANAGKDTNGSQFFITTKQTSWLDGRHVVFGKILKGMDVIKKIEATETDSRDKPKQDVVIADCGAVDVDEPFSVEKADARD

SEQ ID NO: 23665 - protein, 246 aa, Diabrotica virgifera
  misc_feature: Coding regions on vcDNA: vcDNA=SeqID_3362; Strand=+; Position=306-1047
  misc_feature: Homolog annotation: Hit_ID=XP_317844.1; Match level="QueryCoverage =85%, HitCoverage=44%, E-value=3e-59, Identity=54%"; Hit description =ENSANGP00000014209 [Anopheles gambiae]
  misc_feature: Gene Ontology Annotation: Molecular function=protein binding; Cellular component=cellular_component unknown; Biological process =EGF receptor signaling pathway
  misc_feature: Pfam annotation: Pfam_ID=PID; Match level="Score=141.0, E-value=2.8e -39, Copies=1"; Pfam description=Phosphotyrosine interaction domain (P
  misc_feature (211)..(211): Xaa can be any naturally occurring amino acid
MSAFNIKPSGGWIHSEKLLATEGATYTVKYVGCLEVKVSMKKLNFKTRSGVAKECINRVCEYSKLKNIDKKRKVDKKVLKAIVEVPNLNYAGMYVNLNVSSIKLTLTCIETNQIIACHEMPRISFASGGEKDALDFVGYIAKDPNEVRACYVLECGGGLAKDVISTIGEAFELRFQQFANKTPLGLGATMGHYSGSTGGDADKDYYNDLPXKVPPDVCEPPPVPPLPSLGTAVHTLPPGSRVQISY

SEQ ID NO: 23666 - protein, 743 aa, Diabrotica virgifera
  misc_feature: Coding regions on vcDNA: vcDNA=SeqID_3363; Strand=+; Position=2-2235
  misc_feature: Homolog annotation: Hit_ID=A35175; Match level="QueryCoverage=98%, HitCoverage=71%, E-value=7e-63, Identity=25%"; Hit description=mucin 1 precursor, repetitive splice form A [validated] - human
  misc_feature: Gene Ontology Annotation: Molecular function=signal transducer activity; Cellular component=extracellular space; Biological process= invasive growth
  misc_feature (246)..(246): Xaa can be any naturally occurring amino acid
  misc_feature (659)..(659): Xaa can be any naturally occurring amino acid
TIRQNDGSCIKPNPPPCPSGTVRQPNGSCQKTTIEPYCPSGTTKQPDGSCIRPTPTPCPFGTIRQPNGNCVKPTPSPCPIGFRRLPNGDCAKPTPEPCPEGTRRESDGRCVQPTPYCPSGTVRQTDGSCRKPTPEPCPPGTIRQPDGFCERPTPAPCPFGTIRQPDGSCERPTPKPCPSGTIRQPDGSCERPAPAPCPFGTIRQPDGSCEKPTPSPCPSGTVRQPDGSCSRPTPAPCPFGTIRQPXGSCGRPTPRPCPSGTIRQPDGSCERPTPAPCPFGTIRQPDGSCERPTPSPCPSGTVRQPDGSCSRPTPAPCPFGTIRQPDGSCEKPTPRPCPSGTIRQPDGSCERPTPAPCPFGTIRQPDGSCERPTPAPCPSGTVRQPDGSCSRPTPTPCPFGTIRQPDGSCERPTPRPCPSGTIRQPDGTCERPTPAPCPFGTIRQPDGSCERPTPAPCPSGTIRQPDGSCERPTPAPCPFGTIRQPDGSCERPTPPPGPSGTVRQPDGSCSRPTPAPCPFGTIRQPDGSCERPTPRPCPSGTIRQPDGSCERPTPAPCPFGTIRQPDGSCERPTPAPCPSGTVRQPDGSCSRPTPAPCPFGTIRQPDGTCERPTPKPCASGTIRQPDGSCQRPTPAPCPFGTIRQPDGSCEKPTPQTCPXSTIRQPNGILSTTNSRPPGPSEQGDNLDGSLHKANRNIYPLNQRTPPHPMMVTTMKEPSPPFGLTGPGKFCNLFPGPKTRKLKG

SEQ ID NO: 23667 - protein, 249 aa, Diabrotica virgifera
  misc_feature: Coding regions on vcDNA: vcDNA=SeqID_3364; Strand=+; Position=252-1001
  misc_feature: Homolog annotation: Hit_ID=XP_395257.1; Match level="QueryCoverage =84%, HitCoverage=69%, E-value=9e-40, Identity=41%"; Hit description =similar to Hypothetical protein FLJ20551 [Apis mellifera]
  misc_feature: Gene Ontology Annotation: Molecular function=transporter activity; Cellular component=mitochondrial membrane; Biological process =mitochondrial transport
  misc_feature: Pfam annotation: Pfam_ID=Mito_carr; Match level="Score=113.8, E-value= 4.2e-31, Copies=2"; Pfam description=Mitochondrial carrier protein
MAVSYQSSFRDSSIGQNNYHNNLQVRVLENPVIKAFLSGSCSGVISTVLLQPLDVVKTRLQNPPAALRNQPNGLHIIPIVSNVIKHEQISGLWKGTTPSLMRAVPGIGLYFCCLEYVKTHFFKKKAPTASESILIGICARGMAGATLMPMTVVKTRIESGVYQYSGVMVALQDIFPPPSIKGLTRGLEPTFFRERPPTRIYFLVLKPIKNPPYQKIFFPHNTPPANFPLGWGNPTKWASRGGPPPRRRF

SEQ ID NO: 23668 - protein, 136 aa, Diabrotica virgifera
  misc_feature: Coding regions on vcDNA: vcDNA=SeqID_3365; Strand=+; Position=2-412
  misc_feature: Homolog annotation: Hit_ID=AAH61961.1; Match level="QueryCoverage =93%, HitCoverage=23%, E-value=3e-17, Identity=43%"; Hit description =Nol5 protein [Danio rerio]
  misc_feature: Gene Ontology Annotation: Molecular function=snoRNP binding; Cellular component=nucleolus; Biological process=snRNP protein-nucleus import
GRVGHGISEIQQYPDAADSTLPTVGKRKRSESEGFGLDDASTPGSSKKAKKIKSEVEAEPEEAEETPKKKKKKAKQEKVDESVKEEIEEEVADESISKKKKKKVKQEEQQEEAVNDEAPTSEKKKKKKKKKQSESE

SEQ ID NO: 23669 - protein, 185 aa, Diabrotica virgifera
  misc_feature: Coding regions on vcDNA: vcDNA=SeqID_3366; Strand=+; Position=28-585
  misc_feature: Homolog annotation: Hit_ID=AAD53751.1; Match level="QueryCoverage =94%, HitCoverage=92%, E-value=5e-48, Identity=39%"; Hit description =death-associated LIM only protein DALP [Manduca sexta]
  misc_feature: Gene Ontology Annotation: Molecular function=transcription co -activator activity; Cellular component=focal adhesion; Biological process=integrin-mediated signaling pathway
  misc_feature: Pfam annotation: Pfam_ID=LIM; Match level="Score=123.7, E-value=4.5e -34, Copies=3"; Pfam description=LIM domain
QGSVVQFTPTFNNMSSAATEPKVCHKCKEQVKGGVLTALGKTWHPDHFCCNECKNPITENSFHTKDDFPYCTPCHTKLFASICHACDQPILDKCVQAMGVNWHEDHFLCEDCKTKLIGQQFMDVAGLPRCQKCYIAKHADKCKGCGKPIPDKAIVALDAKWHQMCFRCSKCSETYHERTSHSPSK

SEQ ID NO: 23670 - protein, 190 aa, Diabrotica virgifera
  misc_feature: Coding regions on vcDNA: vcDNA=SeqID_3367; Strand=+; Position=121-693
  misc_feature: Homolog annotation: Hit_ID=AAD53751.1; Match level="QueryCoverage =93%, HitCoverage=92%, E-value=1e-51, Identity=42%"; Hit description =death-associated LIM only protein DALP [Manduca sexta]
  misc_feature: Gene Ontology Annotation: Molecular function=transcription co -activator activity; Cellular component=focal adhesion; Biological process=integrin-mediated signaling pathway
  misc_feature: Pfam annotation: Pfam_ID=LIM; Match level="Score=140.7, E-value=3.4e -39, Copies=3"; Pfam description=LIM domain
MGASCCKGEDKSSAATEPKVCHKCKEQVKGGVLTALGKTWHPDHFCCNECKNPITENSFHTKDDFPYCTPCHTKLFASICHACDQPILDKCVQAMGVNWHEDHFLCEDCKTKLIGQQFMDVAGLPRCQKCYIAKHADKCKGCGKPIPDKAIVALDAKWHQMCFRCSKCSKPIMKDQSFQVDSGRPHCVKC

SEQ ID NO: 23671 - protein, 323 aa, Diabrotica virgifera
  misc_feature: Coding regions on vcDNA: vcDNA=SeqID_3368; Strand=+; Position=24-989
  misc_feature: Homolog annotation: Hit_ID=XP_315228.1; Match level="QueryCoverage =88%, HitCoverage=44%, E-value=1e-117, Identity=74%"; Hit description= ENSANGP00000021580 [Anopheles gambiae]
  misc_feature: Gene Ontology Annotation: Molecular function=pyruvate kinase activity; Cellular component=cellular_component unknown; Biological process=glycolysis
  misc_feature: Pfam annotation: Pfam_ID=PK; Match level="Score=389.8, E-value=3.6e -114, Copies=1"; Pfam description=Pyruvate kinase, barrel domain
  misc_feature (281)..(281): Xaa can be any naturally occurring amino acid
  misc_feature (305)..(305): Xaa can be any naturally occurring amino acid
MVFVTKFDEDVLKNVNNSMAQNVLPFQLQALEKKNHLDHLCALDINSRASFIRLSGIICTIGPASRDPEILVQMMESGMNCARLNFSHGSHEYHAETIANIRKAVEMYSKKIGMPYPLAIALDTKGPEIRTGLLEGGGSAEVELVKGQTIKLTTDKAYESKGTKDCIYVDYDNIQKVVKAGNRVYVDDGLISLVVDSIQGSFLTCTVENGGTLGSRKGCNLPGVPVDLPAVSEKDKSDLRFGVEQKVDIVFASFIRDGGALTEIRNILGEEGKRIIIFSKXENQQGMTNLDEIIEASDGLMVARXGDLGIEIPTEKVSSLKGH

SEQ ID NO: 23672 - protein, 337 aa, Diabrotica virgifera
  misc_feature: Coding regions on vcDNA: vcDNA=SeqID_3369; Strand=+; Position=150-1159
  misc_feature: Homolog annotation: Hit_ID=XP_315228.1; Match level="QueryCoverage =92%, HitCoverage=47%, E-value=1e-107, Identity=66%"; Hit description= ENSANGP00000021580 [Anopheles gambiae]
  misc_feature: Gene Ontology Annotation: Molecular function=pyruvate kinase activity; Cellular component=cellular_component unknown; Biological process=glycolysis
  misc_feature: Pfam annotation: Pfam_ID=PK; Match level="Score=312.7, E-value=5.7e -91, Copies=1"; Pfam description=Pyruvate kinase, barrel domain
  misc_feature (263)..(263): Xaa can be any naturally occurring amino acid
MAQNVLPFQLQALEKKNHLDHLCALDINSRASFIRLSGIICTIGPASRDPEILVQMMESGMNCARLNFSHGSHEYHAETIANIRKAVEMYSKKIGMPYPLAIALDTKGPEIRTGLLEGGGSAEVELVKGQTIKLTTDKAYESKGTKDCIYVDYDNIQKVVKAGNRVYVDDGLISLVVDSIQGSFLTCTVENGGTLGSRKGCNLPGVPVDLPAVSEKDKSDLRFGVEQKVDIVFASFIRDGGALTEIRNILGEEGKRIIIISKXENQQGMTNLGQNYLKVSEGNLGSFGENFGIENPTPKKVFFPSKKAKDLAQWTTGAGTYPVICGPPPICGKNLCI

SEQ ID NO: 23673 - protein, 545 aa, Diabrotica virgifera
  misc_feature: Coding regions on vcDNA: vcDNA=SeqID_3370; Strand=+; Position=52-1689
  misc_feature: Homolog annotation: Hit_ID=XP_315228.1; Match level="QueryCoverage =93%, HitCoverage=79%, E-value=0.0, Identity=74%"; Hit description =ENSANGP00000021580 [Anopheles gambiae]
  misc_feature: Gene Ontology Annotation: Molecular function=pyruvate kinase activity; Cellular component=cellular_component unknown; Biological process=glycolysis
  misc_feature: Pfam annotation: Pfam_ID=PK; Match level="Score=773.1, E-value=1.4e -229, Copies=1"; Pfam description=Pyruvate kinase, barrel domain
MKAIVRTGRMAQNVLPFQLQALEKKNHLDHLCALDINSRASFIRLSGIICTIGPASRDPEILVQMMESGMNCARLNFSHGSHEYHAETIANIRKAVEMYSKKIGMPYPLAIALDTKGPEIRTGLLEGGGSAEVELVKGQTIKLTTDKAYESKGTKDCIYVDYDNIQKVVKAGNRVYVDDGLISLVVDSIQGSFLTCTVENGGTLGSRKGCNLPGVPVDLPAVSEKDKSDLRFGVEQKVDIVFASFIRDGGALTEIRNILGEEGKRIIIISKIENQQGMTNLDEIIEASDGIMVARGDLGIEIPTEKVFIAQKAMIARCNKAGKPVICATQMLESMTKKPRPTRAESSDVANAVIDGADCVMLSGETAKGDYPLDCVRTMANICKEAEAAIWSGEFFGDLTSMIPVPLDMAQAIAISAVESANKTMAAAIVVITTSGKSAHLIAKFKPRCPIIAVTRIPQTARQCQMYRAILPLIYEAERKEDWLQDVDARLHYGITFGKSRGFVRTGDPVVVVTGWKQGSGYTNTLRIIYASDEVEGICLGSCAK

SEQ ID NO: 23674 - protein, 294 aa, Diabrotica virgifera
  misc_feature: Coding regions on vcDNA: vcDNA=SeqID_3371; Strand=-; Position=3-884
  misc_feature: Homolog annotation: Hit_ID=A32713; Match level="QueryCoverage=93%, HitCoverage=32%, E-value=2e-68, Identity=47%"; Hit description =reverse transcriptase homolog - fruit fly (Drosophila melanogaster)
  misc_feature: Pfam annotation: Pfam_ID=RVT_1; Match level="Score=114.4, E-value =2.8e-31, Copies=1"; Pfam description=Reverse transcriptase (RNA -dependent
MYLETPCQLSFPLTTFTPTEVRQQIKMLNPQKAPGYDLITGELLQKLPRKAVALLTVIYNSILRLRYFPIQWKLAQVTMIPKPGKPATQANSYRPISLLPIMSKVLERLLLHKIEQVVPINEIIPQHQFGFRREHSTIQQCHRIVIIIKTTLEEKKFRAGVFLDIQQAFDRVWQQVLLCKLKLHLTDQLYFILKSYLTDRYFQVKIEDNFSNYHIIQSGVPQGSVLGPFLYRIFTADVPTRNDTFLATFADDTGILLVDVDPNVASQKVQNHLDQLQNWLKRWKINVNASKSYK

SEQ ID NO: 23675 - protein, 291 aa, Diabrotica virgifera
  misc_feature: Coding regions on vcDNA: vcDNA=SeqID_3372; Strand=+; Position=17-892
  misc_feature: Homolog annotation: Hit_ID=XP_320660.1; Match level="QueryCoverage =92%, HitCoverage=42%, E-value=2e-57, Identity=42%"; Hit description =ENSANGP00000021162 [Anopheles gambiae]
  misc_feature: Gene Ontology Annotation: Molecular function=beta-glucuronidase activity; Cellular component=lysosome; Biological process =glycosaminoglycan catabolism
  misc_feature: Pfam annotation: Pfam_ID=Glyco_hydro_2_N; Match level="Score=145.5, E- value=1.2e-40, Copies=1"; Pfam description=Glycosyl hydrolases family 2, sugar b
MIPPTSVLLLACLIIGIEGGILYPRASKTRDLQYLDGLWHFSLNASASSQELSGNPNDKDIHLMPVPSSYNDILTSSEGRDHLGPVVYQKKFFSPSTWTKEGRKIWLRFGSVCYSAKVYINDKFAFAHAIGHLPFAGEITSLVNDDENTIKVIVDNTLTPTTIPQGSVTTLPGGRVAQTYTFDFFNYAGIDRPIALYTTPEVYIDDVTIHTSVRGTTGIVSYKINLNSNENSKNKLISYKVTVLDKNNNKVGENVEASGNISIPDAHLWWPYLMHDDPGYCYRLKVEIFVA

SEQ ID NO: 23676 - protein, 212 aa, Diabrotica virgifera
  misc_feature: Coding regions on vcDNA: vcDNA=SeqID_3373; Strand=+; Position=40-678
  misc_feature: Homolog annotation: Hit_ID=XP_311545.1; Match level="QueryCoverage =94%, HitCoverage=90%, E-value=9e-45, Identity=45%"; Hit description =ENSANGP00000010247 [Anopheles gambiae]
  misc_feature: Gene Ontology Annotation: Molecular function=glutathione peroxidase activity; Cellular component=cellular_component unknown; Biological process=glutathione conjugation reaction
  misc_feature: Pfam annotation: Pfam_ID=GST_N; Match level="Score=68.8, E-value=1.5e- 17, Copies=1"; Pfam description=Glutathione S-transferase, N-terminal
MPNYKLTYFNVTGRAEPARVMLHYGGIPFEDVRIEHADWPSIKPTTPFGQLPVLEVDGKKYTQGTPLARYVANVVGLVGKTNEENLEIEIAVNIVSELLITAYEFKYDPDEEKKKQHLKKLNELMAKYLPVLDEAARKNGGHLVENRLTWADIFFVTSYEDIRNILKNKDIVEDFSGLQHLKKNVLSEKNIRQYIQNRPKIPTFVYDLRSEV

SEQ ID NO: 23677 - protein, 404 aa, Diabrotica virgifera
  misc_feature: Coding regions on vcDNA: vcDNA=SeqID_3374; Strand=+; Position=50-1264
  misc_feature: Homolog annotation: Hit_ID=CAG32296.1; Match level="QueryCoverage =100%, HitCoverage=99%, E-value=1e-147, Identity=61%"; Hit description=hypothetical protein [Gallus gallus] ref|NP_001005841.1| similar to DnaJ homolog subfamily A member 2
  misc_feature: Gene Ontology Annotation: Molecular function=heat shock protein activity; Cellular component=cytosol; Biological process=G1 phase of mitotic cell cycle
  misc_feature: Pfam annotation: Pfam_ID=DnaJ; Match level="Score=128.1, E-value=2.2e- 35, Copies=1"; Pfam description=DnaJ domain
MADNTLYDILGVPRNAPANDIKKQYRKLAKEFHPDKNPAAGDKFKEISYAYEVLSDPKKRSLYDRVGLKGMQEGAHDGFGGDDLLSHLFGGGLFGGFGGGGPRRRLRGEDTVHPLKVSLEDMYNGKTSKLQLSKNVICNTCSGKGSKSGNTEKCSTCNGCGLKVTYRQVVPGMAQQTQTRCPDCHGEGEIIKEKDRCSSCKGKKVCNETKILEVHVDKGMKENQKIFFRGEGDQQPDVEPGDVVIILQQKPHERFQRNGDDLHVKHNISLTEALCGFSFVIHHLDGRDILVRQPPGEVIKPGGVKCVRGEGMPHYKNPFEKGNMYISFDVKFPENHFTSENNLKALETLLPPRSLFTMPVGEHVEEVDLQEVDPTDKGHSSRGEAYASDDEEQSHGPGLQCAHQ

SEQ ID NO: 23678 - protein, 413 aa, Diabrotica virgifera
  misc_feature: Coding regions on vcDNA: vcDNA=SeqID_3375; Strand=+; Position=48-1289
  misc_feature: Homolog annotation: Hit_ID=XP_310956.1; Match level="QueryCoverage =99%, HitCoverage=59%, E-value=1e-166, Identity=70%"; Hit description= ENSANGP00000019430 [Anopheles gambiae]
  misc_feature: Gene Ontology Annotation: Molecular function =amidophosphoribosyltransferase activity; Biological process=purine nucleotide biosynthesis
  misc_feature: Pfam annotation: Pfam_ID=GATase_2; Match level="Score=91.7, E-value =1.9e-24, Copies=1"; Pfam description=Glutamine amidotransferases class-II
  misc_feature (382)..(382): Xaa can be any naturally occurring amino acid
  misc_feature (390)..(390): Xaa can be any naturally occurring amino acid
MSEDKKPCGFEHKDEEDDLACALESVGMSKRKGRGRVTSGLTHECGVFGAIGCGEWPTNLEISQIICWGLVALQHRGQESAGIVTSEGRCSKYFNVVKGMGMISNIFNDEAIRKLKGSVGIGHTRYSTSAASEEVNCQPFVVHTAHGALAVAHNGELVNCDSLRRQVLEHGVGLSTHSDSELITQALCLNPPEGEPNGEPDWPARIKHLMDLAPLSYSLVIMLKNKIYAIRDPYGNRPLCLGKILPFNEPLDGECDDSREAEGWVVSSESCGFLSIGAQYVREVFPGEIIEMTRHGIRTIDVVARPEDKTQAFCIFEYVYFARADSIFEGQMVYAVRMQCGRQLAIEHPVEADIVSAVPESGNAAAHGFSRQSGITFAESLXKNRYGRKXFFQPRNRLRKLRIGKKFRGLGKE

SEQ ID NO: 23679 - protein, 145 aa, Diabrotica virgifera
  misc_feature: Coding regions on vcDNA: vcDNA=SeqID_3376; Strand=+; Position=82-519
  misc_feature: Homolog annotation: Hit_ID=XP_394057.1; Match level="QueryCoverage =98%, HitCoverage=98%, E-value=1e-56, Identity=70%"; Hit description =similar to CG1359-PA [Apis mellifera]
  misc_feature: Gene Ontology Annotation: Molecular function=molecular_function unknown; Cellular component=TRAPP; Biological process=intracellular protein transport
  misc_feature: Pfam annotation: Pfam_ID=Sybindin; Match level="Score=204.0, E-value =3e-58, Copies=1"; Pfam description=Sybindin-like family
MTIYNIYIFDKSGILLYYQEWNRVKQSGMTKEEEAKLMYGMLFSIKSFVSKISPTDPKEGFLFYKTSKYTLHFFETPSGLKFVLNTDTQSQGVREILQQLYSQIYVEYVIKNPLCRLSQPIDSDLFKTKLDAYIKQLSIYPSKVA

SEQ ID NO: 23680 - protein, 142 aa, Diabrotica virgifera
  misc_feature: Coding regions on vcDNA: vcDNA=SeqID_3377; Strand=+; Position=3-431
QKPAHIFSLYVRFTVVALLLCVALNEVHSGVILGKGLGRSFTACPDPLNPGILVSDNDISGGLFESINLRIPEIGLLETPISCILIVDKKKSSTDPIVSAGGVGSPYVEISIKPGFFESLHYRIEVYRKAPDTTPASTATTP

SEQ ID NO: 23681 - protein, 153 aa, Diabrotica virgifera
  misc_feature: Coding regions on vcDNA: vcDNA=SeqID_3378; Strand=+; Position=1-462
RTRGRTRGRTRAETYQIFKMYTKFTVVALLLCVALNEVHSGVILGKGLGRSFTACPDPLNPGILVSDNDISGGLFESINLRVPEIGLLETPISCILIVDKKKSSTDPIIGAGGVGSPYVEISIKPGFFESLHYRIEVYRKAPDTTPASTATTI

SEQ ID NO: 23682 - protein, 372 aa, Diabrotica virgifera
  misc_feature: Coding regions on vcDNA: vcDNA=SeqID_3379; Strand=+; Position=64-1179
  misc_feature: Homolog annotation: Hit_ID=XP_395582.1; Match level="QueryCoverage =92%, HitCoverage=69%, E-value=6e-59, Identity=42%"; Hit description =similar to CG1316-PA [Apis mellifera]
  misc_feature: Gene Ontology Annotation: Molecular function=single-stranded DNA binding; Cellular component=nucleolus; Biological process=ribosomal small subunit assembly and maintenance
  misc_feature: Pfam annotation: Pfam_ID=RRM_1; Match level="Score=73.0, E-value=8e -19, Copies=2"; Pfam description=RNA recognition motif. (a.k.a. RRM, R
MSDRRNADEDDAPYSRLFVVGARDLREDDIKNAFNKFGDVKDVWAVKDRNSGDYRGIFYVKYYKTSHAALALEEMRGTNLGGRPLKVMIAHNREAGQGQDFKPDIEEEDLKRLFIVVSKTADDNELHTHFKQFGPLAFASIVQDRETKQNKPFAYVKFHKFSDAAQAIEKCDKKYKAVFAKPRKSRAELESARPDPYRNIARPDFPSWPRNDRAPPPPLDVKEDGYFALGVIASYSVNQSQLWKLFDIVPSMDYCQVQYDENRGQSNKYEVVYKNEYWAEYALEKFHGFEYPPGERLIVKAIKSTEGGFSNGNRQKRSASSDFGNSYEIMRLAETIAQANSLIQEKTGMSADSGRLGLLPDPYESGSMCSKP

SEQ ID NO: 23683 - protein, 284 aa, Diabrotica virgifera
  misc_feature: Coding regions on vcDNA: vcDNA=SeqID_3380; Strand=+; Position=108-959
  misc_feature: Homolog annotation: Hit_ID=NP_609040.1; Match level="QueryCoverage =89%, HitCoverage=61%, E-value=1e-105, Identity=73%"; Hit description= CG9547-PA [Drosophila melanogaster] gb|AAF52395.1| CG9547-PA [Drosophila melanogaster]
  misc_feature: Gene Ontology Annotation: Molecular function=glutaryl-CoA dehydrogenase activity; Cellular component=mitochondrion; Biological process=regulation of transcription, DNA-dependent
  misc_feature: Pfam annotation: Pfam_ID=Acyl-CoA_dh_N; Match level="Score=60.8, E -value=3.8e-15, Copies=1"; Pfam description=Acyl-CoA dehydrogenase, N- terminal do
  misc_feature (258)..(258): Xaa can be any naturally occurring amino acid
  misc_feature (276)..(276): Xaa can be any naturally occurring amino acid
MSLNTLVKLSKVGAEIAVKNANKNIPIRCSSKFAPFNWQDPLNLESQLTDEEKLVRDQFRSYCQEKLMPRVIEANRKEVFHREIMNEIGELGVLGCTIKEYGCAGVSNVAYGLLTREVERVDSSYRSAVSVQSSLAMGAIYYYGSTEQKQQYLPKLAKGEYIGCFGLTEPNHGSDIGQMETRAKYDSSSKTYILNGSKTWITNSPISDIFIVWARCDDSKIRGFIINKKEHGKGLEAPKIEGKFSLRASTTGMILLDXVKVPEDHLLPNAVGYEWXPFGCLNNA

SEQ ID NO: 23684 - protein, 360 aa, Diabrotica virgifera
  misc_feature: Coding regions on vcDNA: vcDNA=SeqID_3381; Strand=+; Position=65-1143
  misc_feature: Homolog annotation: Hit_ID=XP_391920.1; Match level="QueryCoverage =99%, HitCoverage=65%, E-value=1e-132, Identity=66%"; Hit description= similar to RNA helicase [Apis mellifera]
  misc_feature: Gene Ontology Annotation: Molecular function=ATP dependent RNA helicase activity; Cellular component=nucleolus; Biological process =nucleobase, nucleoside, nucleotide and nucleic acid metabolism
  misc_feature: Pfam annotation: Pfam_ID=DEAD; Match level="Score=176.6, E-value=5.1e- 50, Copies=1"; Pfam description=DEAD/DEAH box helicase
  misc_feature (344)..(344): Xaa can be any naturally occurring amino acid
MSEDTDVKTVQFHEMELDDRLLKAIAKLGWLQPTVIQEKVIPLLLEGKDVLVRARTGSGKTAAFLLPVIQKLLNIKQTAAQQETKALILAPSRELCHQICGVIKDLTTKCSREVRYIDISLPVDLSIQKPLLVEKPDIVVGTPGRTLQHIKADNLNLKKSLELVVIDEADLVFSFGYEEEMKELITHFPKIYQAILASATLSDDVKSLKNSILHNPVSIKLEEPELAPSSQLTHYHLNAEEMDKATILYTLLKLHLIRGKTIIFVNSVDKCYKIKLFLEQFGIRTCVLNSELPATIRCHSVNQYNQGIYDIIIASDEHALEEPTIVSKKEGGKETKRRKDKESXVSRGIDFQHVANIINF

SEQ ID NO: 23685 - protein, 193 aa, Diabrotica virgifera
  misc_feature: Coding regions on vcDNA: vcDNA=SeqID_3382; Strand=+; Position=204-784
  misc_feature: Homolog annotation: Hit_ID=CAA10770.1; Match level="QueryCoverage =91%, HitCoverage=50%, E-value=2e-20, Identity=32%"; Hit description =reverse transcriptase-like [Bos taurus]
  misc_feature (87)..(87): Xaa can be any naturally occurring amino acid
VRINTNIRLADDTAIIAESIDDLQILLDIINRGNKKIELTLNINKTKFMVISKNPVDNIHLTFEGKPIERVDKYKYHGAIINSQLDXQDEEIKIRIEITRKGFIKYKSMFTNKKLSMDIRLRTVECYVWSQLLYGVKAWTLKAQLIKKMEAFQMWLHRRILKIPWTAKVSNKEMLRRIGHGRKPGPAQGNLAP

SEQ ID NO: 23686 - protein, 285 aa, Diabrotica virgifera
  misc_feature: Coding regions on vcDNA: vcDNA=SeqID_3383; Strand=+; Position=180-1037
  misc_feature: Homolog annotation: Hit_ID=XP_313256.1; Match level="QueryCoverage =97%, HitCoverage=45%, E-value=1e-106, Identity=70%"; Hit description= ENSANGP00000010460 [Anopheles gambiae]
  misc_feature: Gene Ontology Annotation: Molecular function=phenylalanine-tRNA ligase activity; Cellular component=phenylalanine-tRNA ligase complex; Biological process=phenylalanyl-tRNA aminoacylation
  misc_feature: Pfam annotation: Pfam_ID=B3_4; Match level="Score=42.3, E-value=1.4e -09, Copies=1"; Pfam description=B3/4 domain
  misc_feature (251)..(251): Xaa can be any naturally occurring amino acid
  misc_feature (266)..(266): Xaa can be any naturally occurring amino acid
IKIFLFIMPTIGVNRDLLFKSLGKTYTDDEFQVLCFEFGLELDEVTTEKQMITKEQGEDRQVTVNASEDVIYRIDIPANRYDLLCLEGLVQGILVFQGKVSPPKFRATKPAEGSLEKLIIKPDTAKIRPYAVSAILRNITFDKDRYNSFIELQDKLHHNICRKRSLVAIGTHDYDTIKGPFIYDAKPPKDIRFVPLNQEKEFSAEELMTLYSTHAQLKQYLPIIKDSPVYPVITDSNGGVLSLPPIINGNXSKITLDTKNVFLFGXTAPDLTKGKGVLDTINLYG

SEQ ID NO: 23687 - protein, 764 aa, Diabrotica virgifera
  misc_feature: Coding regions on vcDNA: vcDNA=SeqID_3384; Strand=+; Position=55-2345
  misc_feature: Homolog annotation: Hit_ID=NP_524841.1; Match level="QueryCoverage =99%, HitCoverage=97%, E-value=0.0, Identity=63%"; Hit description =CG10506-PA [Drosophila melanogaster] gb|AAF56434.2| CG10506-PA [Drosophila melanogaster]
  misc_feature: Gene Ontology Annotation: Molecular function=glutamine-tRNA ligase activity; Cellular component=soluble fraction; Biological process =glutaminyl-tRNA aminoacylation
  misc_feature: Pfam annotation: Pfam_ID=tRNA-synt_1c; Match level="Score=525.8, E -value=3.9e-155, Copies=1"; Pfam description=tRNA synthetases class I (E and Q), c
  misc_feature (471)..(471): Xaa can be any naturally occurring amino acid
  misc_feature (489)..(489): Xaa can be any naturally occurring amino acid
  misc_feature (539)..(539): Xaa can be any naturally occurring amino acid
  misc_feature (589)..(589): Xaa can be any naturally occurring amino acid
  misc_feature (597)..(597): Xaa can be any naturally occurring amino acid
  misc_feature (621)..(621): Xaa can be any naturally occurring amino acid
  misc_feature (641)..(641): Xaa can be any naturally occurring amino acid
  misc_feature (660)..(660): Xaa can be any naturally occurring amino acid
  misc_feature (680)..(680): Xaa can be any naturally occurring amino acid
  misc_feature (683)..(683): Xaa can be any naturally occurring amino acid
  misc_feature (695)..(695): Xaa can be any naturally occurring amino acid
  misc_feature (714)..(714): Xaa can be any naturally occurring amino acid
  misc_feature (744)..(744): Xaa can be any naturally occurring amino acid
  misc_feature (752)..(753): Xaa can be any naturally occurring amino acid
MTQNNEDTIKALMSLGLSEQKAKETLKNTTVTSTLLKILHEVRGVNISDGVGTLLYQLGTKIKPQISHHLPILVKYIASNKLDTTLRVDKAIEFALSHIKELNTNELETFCGVGVVITPEQIEKVVEKYIKDNKKDLLEKRYRFNTGPLMQKVRADLVWADGKAVKSEVDLQVFDLLGPKTEADLAPAPKPDKKASKVTKNEVKQTKDVQKVEQELDQGLTILDVMKKVNFHAPGENYKTDGYVVTENTERLLKEHLKITGGQVRTRFPPEPNGILHIGHAKAININFGYAAANNGICFLRYDDTNPEKEEEKFFTGIKDMVTWLGYTPYKITHSSDYFDQLYTWAIELIKKGLAYVCHQTADEMKGFNPQPSPWRDRPVEENLQLFEDMKNGKIDEGAATLRMKITLEEGKLDPVAYRVRFTPHHRTGDKWCIYPTYDYTHCLCDSIEHITHSLCTKEFQSRRSSYYWLXNALNIYCPVQWEYGRLNXNYTVVSKRKIAKLIDEQVVKDWDDPRLFTLTALRRRGFPSEAVNNFCAQXGVTGSQSTVDPSMLEAFVRDYLNNTAPRRMVVLEPLKITIENFPHSKPIXVSVPNFPXSQNSGNHDVILNRTIYIEKSDFMXVGDKGYRRLTKTQSVGIRHXAGFSFGSNWMLKKTARASXSYMASGTEVDQVKSKPKAFXHWXVSDPQEIEVRLXYSPLFKHKNPEDPNEVPGXGFLTDCNSDSLKVLKSLADRSLSTGKVVDXFQFERIGXXLVDPDSTKHNL

SEQ ID NO: 23688 - protein, 311 aa, Diabrotica virgifera
  misc_feature: Coding regions on vcDNA: vcDNA=SeqID_3385; Strand=+; Position=3-932
  misc_feature: Homolog annotation: Hit_ID=XP_394621.1; Match level="QueryCoverage =90%, HitCoverage=24%, E-value=1e-121, Identity=82%"; Hit description= similar to ENSANGP00000019991 [Apis mellifera]
  misc_feature: Gene Ontology Annotation: Molecular function=molecular_function unknown; Cellular component=AP-2 adaptor complex; Biological process= intracellular protein transport
  misc_feature (193)..(193): Xaa can be any naturally occurring amino acid
  misc_feature (220)..(220): Xaa can be any naturally occurring amino acid
  misc_feature (228)..(228): Xaa can be any naturally occurring amino acid
DAWAHEAVKKHQEVVILSMKMEKDVSVRQQAVDLLYAMCDKSNAEEIVQEMLNYLETADYSIREEMVLKVAILAEKYATDYTWYVDVILNLIRIAGDYVSEEVWYRVIQIVINRDEVQGYAAKTVFEALQAPACHENMVKVGGYILGEFGNLIAGDQRSSPLVQFQLLHSKYHLCSPMTRALLLSTYIKFINXLFPEIRTQVQEVFKQHSNLRSADAELXQQRASEYXLQLSIIWLALILLATLLKKNCLLFPKETRPFLAEQKKKHLEHMPENLTTVNANPGPQLISKMPYITQFWPGTRPALVLRRRLA

SEQ ID NO: 23689 - protein, 444 aa, Diabrotica virgifera
  misc_feature: Coding regions on vcDNA: vcDNA=SeqID_3386; Strand=+; Position=28-1359
  misc_feature: Homolog annotation: Hit_ID=EAL31972.1; Match level="QueryCoverage =93%, HitCoverage=100%, E-value=0.0, Identity=78%"; Hit description =GA15778-PA [Drosophila pseudoobscura]
  misc_feature: Gene Ontology Annotation: Molecular function=molecular_function unknown; Cellular component=AP-1 adaptor complex; Biological process= ommochrome biosynthesis
  misc_feature: Pfam annotation: Pfam_ID=Adap_comp_sub; Match level="Score=321.3, E -value=1.4e-93, Copies=1"; Pfam description=Adaptor complexes medium subunit fami
  misc_feature (302)..(302): Xaa can be any naturally occurring amino acid
  misc_feature (366)..(366): Xaa can be any naturally occurring amino acid
  misc_feature (389)..(389): Xaa can be any naturally occurring amino acid
MIHSLFIINAQGDVFLEKHWRSVIPKSVCDYYLEAQRSNGSDINPVIATPHHYLISIQRGGVSFVAVCMEEIPPLFVIEFLHRVVDIFQDYFSECTESIIKENYVVVYELLDEMLDNGFPLATESNILKELIKPPNILRTIANTMTGKTNVSDILPTGQLSNIPWRRSGVKYTNNEAYFDVIEEVDAIIDKSGSTVSAEIQGYIDCCIKLSGMPDLTLSFVNPRLFDDVSFHPCVRFKRWEAERLLSFIPPDGNFRLISYHISSQSVVAIPVYVRHNLSIKTGEQARLDLTVGPKQTMGRTXKVKLEVLMPKCILNCVLTANQGKYNFDPVSKILHWDIGKIDVTKLPNIRGSVSIASGSNTAEIXPSINVHFTISQLAVSGLKVNRLXDLYGEKYQPIPRVVKYITKGRGGFCVRMGILNSNSFKWGIGYFNLLKPLKKFFLF

SEQ ID NO: 23690 - protein, 294 aa, Diabrotica virgifera
  misc_feature: Coding regions on vcDNA: vcDNA=SeqID_3387; Strand=+; Position=42-926
  misc_feature: Homolog annotation: Hit_ID=EAL27664.1; Match level="QueryCoverage =92%, HitCoverage=55%, E-value=1e-40, Identity=36%"; Hit description =GA20528-PA [Drosophila pseudoobscura]
  misc_feature: Gene Ontology Annotation: Molecular function=enzyme regulator activity; Cellular component=extracellular; Biological process =biological_process unknown
  misc_feature: Pfam annotation: Pfam_ID=LRR_1; Match level="Score=59.3, E-value=1.1e- 14, Copies=7"; Pfam description=Leucine Rich Repeat
MEKWLIILLYIIHFATAGETNQNSSNICTRCKCNSKDEFLLDCTNQNFEHILAEWPPHNQSLVATFSYNNITNLGQLPATNQTAKFVFDHCRIKHLEDRMFFLIQNVEYIDLSHNLLTTEAISGEVFKGPYSDRQYRPIGVKTLNLAYNQIHSLNTKFFEHMPLLEDLYLQGNDFSVLDPSTQIALGSLTNIKVLNLADNELTVIEENVMRNVHSLRDLDLSSNHFDFVPKPLSYISKNLQILNLSNNYIFQLTDESFLGMNLSELYLNNLPRLKFVGPNTFATLRRLKKTTFA

SEQ ID NO: 23691 - protein, 471 aa, Diabrotica virgifera
  misc_feature: Coding regions on vcDNA: vcDNA=SeqID_3388; Strand=+; Position=238-1650
  misc_feature: Homolog annotation: Hit_ID=AAH82489.1; Match level="QueryCoverage =95%, HitCoverage=80%, E-value=1e-113, Identity=45%"; Hit description= MGC89002 protein [Xenopus tropicalis] ref|NP_001008171.1| MGC89002 protein [Xenopus tropicalis]
  misc_feature: Gene Ontology Annotation: Molecular function=cystathione beta -synthase activity; Cellular component=cytoplasm; Biological process =cysteine metabolism
  misc_feature: Pfam annotation: Pfam_ID=PALP; Match level="Score=324.1, E-value=2e -94, Copies=1"; Pfam description=Pyridoxal-phosphate dependent enzyme
MSQLIKEQDAGFLFRSPLEEKAVIPDKIPKCPWTKDLYKTEKSPHSKWDWKPYPSKVLPNIAKAVGKTPMVKLNGIPKAENLECEIYGKCEFLNPVGSIKDRMLIRCIEDGERSGILKPGATIIEVSSGNTGVALAWASSIKGYKCIVVLPDKYSMEKEFLIKAFGGQVVRVPMGAPYTSENGMYGKAHALHKQIPNSILLDQFSNPSNPLAHYDTTAEEIYHQCDGQVDMIVMGCGTGGTLTGISRKFKEISPNTIIIGADPYGSQYAQPAELNKTDVKAFDIEGIGYEIAPTVCDRSMVSKWYKFHDKESLNMCRRLIREEGLLVGTSSGVIMAGALKAIKDFNMGKGKKVVVLLPDGAKNYLTKFCCDQWMEQRNLLPAVNTHNHWWWDVNVMELSFKPCQTVEKSASPKDVLALMDKLNVDYLPAVSEGLIVGLATRRNTLNRMIADESPNDENHNCLVRMFSKLPK

SEQ ID NO: 23692 - protein, 309 aa, Diabrotica virgifera
  misc_feature: Coding regions on vcDNA: vcDNA=SeqID_3389; Strand=+; Position=1-930
  misc_feature: Homolog annotation: Hit_ID=Q24331; Match level="QueryCoverage=96%, HitCoverage=55%, E-value=1e-123, Identity=67%"; Hit description =Tumorous imaginal discs protein, mitochondrial precursor (Lethal(2)tumorous imaginal discs
  misc_feature: Gene Ontology Annotation: Biological process=protein folding
  misc_feature: Pfam annotation: Pfam_ID=DnaJ_C; Match level="Score=151.7, E-value =1.7e-42, Copies=1"; Pfam description=DnaJ C terminal region
GGGHSKGPQGFSQQWQYQSTIDPEELFRKIFGDAFTRGSSHFEDFAESNYGFGEAQEILLRITFTQAARGTTKDVNINVVDNCPKCRGARCEPGTQATKCQFCNGTGMESITTGPFVMRSTCRYCQGSRMYIKHKCTECEGKGSTVQRRKVSIPVPAGIEDGQTVRMSVGNKELFVTFRVDKSDYFKRDGPDVHTEADISVAQALLGGTIRIQGLYEDHTIQVMPGTSSHTRIRLSGKGMKKINGYGHGDHYVVLKIKTPKHLTEKQKALAMAYAELEQDTPGQILGITVKKDGAQYAGSRGTITSETF

SEQ ID NO: 23693 - protein, 416 aa, Diabrotica virgifera
  misc_feature: Coding regions on vcDNA: vcDNA=SeqID_3390; Strand=+; Position=87-1334
  misc_feature: Homolog annotation: Hit_ID=XP_308308.1; Match level="QueryCoverage =65%, HitCoverage=52%, E-value=1e-104, Identity=64%"; Hit description= ENSANGP00000010875 [Anopheles gambiae]
  misc_feature: Gene Ontology Annotation: Molecular function=co-chaperone activity; Cellular component=mitochondrial inner membrane; Biological process =protein folding
  misc_feature: Pfam annotation: Pfam_ID=DnaJ; Match level="Score=138.7, E-value=1.3e- 38, Copies=1"; Pfam description=DnaJ domain
ILRNLQHKVSFIMSFLFLKMGSARTLFGILGSKQILLCSNSQFTTKISRTFLHQCFRCHKSLLLNTWSANNLTQNSLLHKRTFHKSHSFNAARRDYYELLGVGKNASNSDIKKAYYKLAKKYHPDVNKNDPEASKKFQEVSEAYEILGDENKRKQYDTWGATADQMGGMGGGGGHSKGPQGFSQQWQYQSTIDPEELFRKIFGDAFTRGSSHFEDFAESNYGFGEAQEILLRITFTQAARGTTKDVNINVVDNCPKCRGARCEPGTQATKCQFCNGTGMESITTGPFVMRSTCRYCQGSRMYIKHKCTECEGKGSTVQRRKVSIPVPAGIEKRQTVPMPGGNKELFGWRSSRFSRASQKTHEICIDTANALPKTRVLLRGSKLRNPKDLKEKNTTKFPGKAPKKIPSPQTKKIFPY

SEQ ID NO: 23694 - protein, 467 aa, Diabrotica virgifera
  misc_feature: Coding regions on vcDNA: vcDNA=SeqID_3391; Strand=+; Position=119-1517
  misc_feature: Homolog annotation: Hit_ID=NP_650586.2; Match level="QueryCoverage =92%, HitCoverage=89%, E-value=0.0, Identity=73%"; Hit description =CG3590-PA [Drosophila melanogaster] gb|AAF55375.1| CG3590-PA [Drosophila melanogaster]
  misc_feature: Gene Ontology Annotation: Molecular function=adenylosuccinate lyase activity; Cellular component=cellular_component unknown; Biological process=purine base metabolism
  misc_feature: Pfam annotation: Pfam_ID=Lyase_1; Match level="Score=226.4, E-value =5.5e-65, Copies=1"; Pfam description=Lyase
  misc_feature (392)..(392): Xaa can be any naturally occurring amino acid
  misc_feature (405)..(405): Xaa can be any naturally occurring amino acid
  misc_feature (413)..(413): Xaa can be any naturally occurring amino acid
MAVPEGAAVLRTYKYRSPLSTRYASDEMQYNFSDHNKFSMWRKLWVNLAKAEQEQGLQITDEQIREMQNNVTDIDFEEAEAEEKLTRHDVMAHVHVFAKQCPLAAPIIHLGATSCFVGDNTDLIVIRDGLNILIPKLANVINNLARFANMYKDLPTLGYTHLQPAQLTTVGKRATLWLYDFLMDEVAMDRAINDLRFRGVKGTTGTQASFMQLFKNDSERVRALDRRVAELCGFERTYPVTGQTYSRKVDVELVSMLASLGTSIHKMCSDLRLLANFKEIEEPFESSQIGSSAMPYKRNPMRSERCCALARHLITLFSNAANTHAGQWLERTLDDSANKRLTLSEAFLTADAALMVLMNITQGLVVYPKVIQKRINQELPFMSAKNIIMTIXKKGGYRQICHEKXIRVLSHEXAGAQVQQFGKDNDFLDRVRADPYFKPIVPELQSLSGPFPPILGRAFLNKVTGIF

SEQ ID NO: 23695 - protein, 357 aa, Diabrotica virgifera
  misc_feature: Coding regions on vcDNA: vcDNA=SeqID_3392; Strand=+; Position=116-1189
  misc_feature: Homolog annotation: Hit_ID=XP_317136.1; Match level="QueryCoverage =98%, HitCoverage=88%, E-value=1e-157, Identity=74%"; Hit description= ENSANGP00000018254 [Anopheles gambiae]
  misc_feature: Gene Ontology Annotation: Molecular function=heat shock protein activity; Cellular component=cytosol; Biological process=G1 phase of mitotic cell cycle
  misc_feature: Pfam annotation: Pfam_ID=DnaJ; Match level="Score=128.6, E-value=1.5e- 35, Copies=1"; Pfam description=DnaJ domain
MNLEFLQTFLLLSVVSIAVVSAGRDFYQILGVDKSASLHDIKKAYRKLAKELHPDKNQDDPNSSQKFQDLGAAYEVLSDEDKRKKYDRCGEDCLQKDGMMDGGMDPFASFFGDFGFHFGGGEQKHETPRGADLVMDVYVTLEDLYTGTFIEITRNKPVLKPSRGTRKCNCRQEMITKSLGPGRFQMMQQTVCDECPNVKLVNEERLLEMEVEQGMIDGQETKFIAEGEPHLDGEPGDLILKIKTQPHKVFERRGDDLYTNITISLQDALTGFTMEIPHLDGHKVSIVRDKITWPGARIRKKGEGMPNYDNNNLHGILFITFDVEFPKQELTEEDKEALKKILNQSSNNKVYNGLRGY

SEQ ID NO: 23696 - protein, 247 aa, Diabrotica virgifera
  misc_feature: Coding regions on vcDNA: vcDNA=SeqID_3393; Strand=+; Position=71-814
  misc_feature: Homolog annotation: Hit_ID=XP_321081.1; Match level="QueryCoverage =93%, HitCoverage=80%, E-value=2e-17, Identity=24%"; Hit description =ENSANGP00000019088 [Anopheles gambiae]
  misc_feature: Gene Ontology Annotation: Molecular function=molecular_function unknown
  misc_feature: Pfam annotation: Pfam_ID=DUF233; Match level="Score=25.2, E-value =0.00011, Copies=1"; Pfam description=Odorant binding protein
MKVVIIFAFICNIAFAAHVYPEYLKQYRCKASSENYSECFLNKLRNTLPYYVKGIPELDIPPFDPFTLPIYSRNVNILGNKISATFKNSIVTGLRNSIIHNAKVDLNNNYAEISVTIPWLDMATEYDISGEFFQYPLDVKGTFKGNITDIQLFSKSTLQTFKNNGEDYYKFDKINQKVQIGGGHIEITTTDKDLMPIVQTIQEYFNEHPRGFFNLILPFTLEYAQDLLREFGNEYLANLPASEWLPQ

SEQ ID NO: 23697 - protein, 365 aa, Diabrotica virgifera
  misc_feature: Coding regions on vcDNA: vcDNA=SeqID_3394; Strand=+; Position=136-1233
  misc_feature: Homolog annotation: Hit_ID=XP_318072.1; Match level="QueryCoverage =73%, HitCoverage=41%, E-value=9e-41, Identity=37%"; Hit description =ENSANGP00000010699 [Anopheles gambiae]
  misc_feature: Gene Ontology Annotation: Molecular function=protein binding; Biological process=negative regulation of macrophage differentiation
MVKETTTSIKKKRKVSNPEHEGDNDIYKKVANFEEKESLNSQASLEANVYFELCEDIRNLLAKAMSLRQKDKKSNEIKDIHAEIVVKMCMVKKLNRTDKIRHVHGKETLTTEKQKCDSIKLTYQNLVYERHHLVTETNKCLAFRSKDEDIELVPFEEFMREAPESLSSKFSSYDPDDREQQHSLRLARLEWELTQRKNLAQLCKAFLEQKKKLSEDLLLRKDKLTALTPLLVNVINATKPLQDHLEMSPSGLRVEHKLAYLLPDPLYIFYVNVVSYKVVYDINLDVEIIGDEEEANRWKDLKIGMGFANDDESDTPETEQDAAKKEGVVEIKKRRHRRSGQQKNPMEGKKKAIRIPYKQVQLVTV

SEQ ID NO: 23698 - protein, 306 aa, Diabrotica virgifera
  misc_feature: Coding regions on vcDNA: vcDNA=SeqID_3395; Strand=+; Position=118-1036
  misc_feature: Homolog annotation: Hit_ID=XP_394621.1; Match level="QueryCoverage =99%, HitCoverage=27%, E-value=1e-160, Identity=92%"; Hit description= similar to ENSANGP00000019991 [Apis mellifera]
  misc_feature: Gene Ontology Annotation: Molecular function=molecular_function unknown; Cellular component=AP-2 adaptor complex; Biological process= intracellular protein transport
  misc_feature: Pfam annotation: Pfam_ID=Adaptin_N; Match level="Score=-54.7, E-value= 4.6e-06, Copies=1"; Pfam description=Adaptin N terminal region
  misc_feature (244)..(244): Xaa can be any naturally occurring amino acid
  misc_feature (268)..(268): Xaa can be any naturally occurring amino acid
  misc_feature (281)..(281): Xaa can be any naturally occurring amino acid
MPAVRGDGMRGLAVFISDIRNCKSKEAEIKRINKELANIRSKFKGDKTLDGYQKKKYVCKLLFIFLLGHDIDFGHMEAVNLLSSNKYSEKQIGYLFISVLVNTNSELIKLIIQSIKNDLASRNPIHVNLALQCIANIGSKEMAEAFGNDIPKLLVSGDTMDVVKQSAALCLLRLFRTSQDIIPGGEWTSRIIHLLNDQHMGVVTAATSLIDALVKKNPEEYKGCVSLAVSRLSRIVTASYTDLXDYTYYFVPAPWLSVKLLRLLQNYXPPAEDPGVRGRLXNECLETILNQSQEPPNPKKAQQLNG

SEQ ID NO: 23699 - protein, 455 aa, Diabrotica virgifera
  misc_feature: Coding regions on vcDNA: vcDNA=SeqID_3396; Strand=+; Position=1-1363
  misc_feature: Homolog annotation: Hit_ID=EAL29821.1; Match level="QueryCoverage =100%, HitCoverage=56%, E-value=1e-134, Identity=53%"; Hit description=GA20274-PA [Drosophila pseudoobscura]
  misc_feature: Gene Ontology Annotation: Molecular function=molecular_function unknown; Cellular component=nucleolus; Biological process=RNA processing
  misc_feature: Pfam annotation: Pfam_ID=DUF663; Match level="Score=10.3, E-value =3.3e-14, Copies=1"; Pfam description=Protein of unknown function (DUF663)
  misc_feature (439)..(439): Xaa can be any naturally occurring amino acid
  misc_feature (442)..(442): Xaa can be any naturally occurring amino acid
GNSILSSSFAQGLPTPLVVITDLESIVPKRRNDHKQQIQKLVNKWLPDEKVLVMDKYVDGVNVLRKIGSQKRKSVLYRDRRPHIFSERIEYVPDAEGTLGTLKISGYLRGTALSVNQLVHIPGLGDFQMSQIDAPNDPFKHEKKSRDTNTMESEEQQVIRVLERSDPLKQESLDAENVPDPMDAEQTWPTEEEMEAADKQQKLRKVKRVPKGWSDYQAAWIPEDDAEFQEHNSDEDESESDDEYMDAMSEEKSDVSGDEGEDKDFASVTESEVAVNDDKYDKEMDLYAEKQELDKLKAAKSDREFPDEIDTPFEVPARERFQKYRGLESFRTSPWDPKENLPSDYARIFQFQNFDRTKKRVLSEQDDKDGALPGWYITVHVKAVSQLLWETFQKTNAPVTLIGMFPHEHKMSVLNVVLRRTQNYSLPINRKERLVFQCXYRXRFVVNPIFSSHTN

SEQ ID NO: 23700 - protein, 308 aa, Diabrotica virgifera
  misc_feature: Coding regions on vcDNA: vcDNA=SeqID_3397; Strand=+; Position=115-1040
  misc_feature: Homolog annotation: Hit_ID=NP_608743.2; Match level="QueryCoverage =94%, HitCoverage=58%, E-value=1e-114, Identity=69%"; Hit description= CG17259-PA [Drosophila melanogaster] gb|AAF51155.1| CG17259-PA [Drosophila melanogaster]
  misc_feature: Gene Ontology Annotation: Molecular function=RNA binding; Cellular component=soluble fraction; Biological process=tRNA processing
  misc_feature: Pfam annotation: Pfam_ID=Seryl_tRNA_N; Match level="Score=69.0, E -value=1.3e-17, Copies=1"; Pfam description=Seryl-tRNA synthetase N -terminal doma
  misc_feature (271)..(271): Xaa can be any naturally occurring amino acid
MVLDLDLFRKDKGGNPELIKDNQKRRFKDVALVDTVIEKDTTWRSLRHKADTWNKLKNLCSKAIGEKMKKKEDQGSPTESLPENIIASFENLDLEGMKPLTVNQIKKIRTLIDEAIQSNEEALLRVEIERNSALKEVGNHLHESVPVDDNEDNNKVERTFGDCESRKKYSHVDLIVMIDGMDGERGAVVSGGRGYYLTGPAVFLEQAIIQLALRVLHKKGYKPLYTPFFMRKEIMQEVAQLSQFDEELYKVVGKGSEKSEEKEIEEKYLIXTSEQPIAAFHRDERIAEICYPPNIDLGVFPPGFWQKN

SEQ ID NO: 23701 - protein, 177 aa, Diabrotica virgifera
  misc_feature: Coding regions on vcDNA: vcDNA=SeqID_3398; Strand=+; Position=44-577
  misc_feature: Homolog annotation: Hit_ID=XP_395839.1; Match level="QueryCoverage =97%, HitCoverage=98%, E-value=5e-57, Identity=58%"; Hit description =similar to hypothetical protein MGC10540 [Apis mellifera]
  misc_feature: Gene Ontology Annotation: Molecular function=molecular_function unknown; Cellular component=endosome; Biological process=protein -vacuolar targeting
  misc_feature: Pfam annotation: Pfam_ID=DUF852; Match level="Score=234.7, E-value =1.7e-67, Copies=1"; Pfam description=Eukaryotic protein of unknown function
MPEVDIEWPWQYNFPPFFTLQPHPETRAKQVDAWKSLILNFCEQTKTYTLDVRDTNQSPLFNNSSINRKLEQNVIISILSELQKSGHASPVDKNKNRWEIYWHTQEEWASIVYDSICERGMQNTVVTLFELTQGEDVSDAIFFGMNQEVLIKVLRVLENERKCELILEDEIQGAKFF

SEQ ID NO: 23702 - protein, 348 aa, Diabrotica virgifera
  misc_feature: Coding regions on vcDNA: vcDNA=SeqID_3399; Strand=+; Position=56-1100
  misc_feature: Homolog annotation: Hit_ID=AAT36730.1; Match level="QueryCoverage =97%, HitCoverage=79%, E-value=2e-80, Identity=44%"; Hit description =carboxypeptidase A [Aedes aegypti]
  misc_feature: Gene Ontology Annotation: Molecular function=carboxypeptidase A activity; Cellular component=cellular_component unknown; Biological process=histone acetylation
  misc_feature: Pfam annotation: Pfam_ID=Peptidase_M14; Match level="Score=290.7, E -value=2.4e-84, Copies=1"; Pfam description=Zinc carboxypeptidase
  misc_feature (331)..(331): Xaa can be any naturally occurring amino acid
MKFTSLYILASLLVFSSAVVRYDNYTLYKIYPKSTNDLEFLQNLQKSKEYKLDFWNEPSTLRKFVNVLVSPKDKYSFEYIIGKNNLNFEVITDNIQDRIDEESRVHSLQTVKGVELTWDKYYDLEAINLWLKKLASEYHDKVTLIEGGKSYEGRDILGVKVSFGPQKGKRSVWLDSQIHAREWISGATTTYILNEILRSDDSRIRDIAESHDWYIFPVINPDGFEFTHTTNRMWRKTRTDYGQGEECRGADPNRNWDYKWNEGGSTDDPCDEIYAGPKAFSEVETRTLSEYMSTVVDELLLFITFHSFSELILLPYGTLTEHLDNYNGNLXVALKAAEALAKRYGTEY

SEQ ID NO: 23703 - protein, 374 aa, Diabrotica virgifera
  misc_feature: Coding regions on vcDNA: vcDNA=SeqID_3400; Strand=+; Position=1-1123
  misc_feature: Homolog annotation: Hit_ID=BAD00045.1; Match level="QueryCoverage =100%, HitCoverage=45%, E-value=0.0, Identity=92%"; Hit description =armadillo protein [Gryllus bimaculatus]
  misc_feature: Gene Ontology Annotation: Molecular function=transcription co -activator activity; Cellular component=intercellular junction; Biological process=Wnt receptor signaling pathway
  misc_feature: Pfam annotation: Pfam_ID=Arm; Match level="Score=145.4, E-value=1.3e -40, Copies=6"; Pfam description=Armadillo/beta-catenin-like repeat
  misc_feature (356)..(356): Xaa can be any naturally occurring amino acid
QAAMMVHQLSKKEASRHAIMNSPQMVAALVRAISNSNDLETTKGAVGTLHKLSHHRQGLLAIFKSGGIPALVKLLSSPVESVLVYAITTLHNLLLHQDGSKMAVRLAGGLQKMVALLQRNHVKFLSIVTDCLQILAYGNQESKLIILASQGPIELVRIMRSYDYEKLLWTTSRVLKVLSVCASNKPAIVEAGGMQALAMHLGNPSTRLVQNCLWTLRNLSDAATKVDGLESLLQSLVQVLASSDVNVVTCAAGILSNLTCNNQRNKVTVCQVGGVDALVRTIVSAGDREEITEPAVCALRHLTSRHVESEMAQNAVRLNYGMQIIVKLLNPPSRWPLVKAVIGLIKNLALCPANHXPLREHGAIHHLVQLLMRA

SEQ ID NO: 23704 - protein, 595 aa, Diabrotica virgifera
  misc_feature: Coding regions on vcDNA: vcDNA=SeqID_3401; Strand=+; Position=22-1809
  misc_feature: Homolog annotation: Hit_ID=AAL67868.1; Match level="QueryCoverage =92%, HitCoverage=97%, E-value=0.0, Identity=63%"; Hit description =NADH dehydrogenase subunit 5 [Crioceris duodecimpunctata] ref|NP _569067.1| NADH dehydrogenase subunit 5
  misc_feature: Pfam annotation: Pfam_ID=Oxidored_q1; Match level="Score=295.1, E -value=1.1e-85, Copies=1"; Pfam description=NADH -Ubiquinone/plastoquinone (comple
  misc_feature (88)..(88): Xaa can be any naturally occurring amino acid
  misc_feature (148)..(148): Xaa can be any naturally occurring amino acid
  misc_feature (191)..(191): Xaa can be any naturally occurring amino acid
  misc_feature (198)..(198): Xaa can be any naturally occurring amino acid
  misc_feature (218)..(218): Xaa can be any naturally occurring amino acid
  misc_feature (472)..(472): Xaa can be any naturally occurring amino acid
  misc_feature (500)..(500): Xaa can be any naturally occurring amino acid
  misc_feature (530)..(530): Xaa can be any naturally occurring amino acid
  misc_feature (559)..(559): Xaa can be any naturally occurring amino acid
MKLKKRCFLFFFFFFLCFFFPIQNKMCFLLPDPGPPPFFIFFIFFLFLSIIILILSSYFLIFDLVYVIEYLLLILNSRNFIFVILLDXISLIFIRFVLFISSIVIYYSEEYIRGDLFKNRFILLVVIFVFSIIILIISPNLISILLGXDGLGLVSYCLVIYYQNIKRFNAGILTALSNRIGDVALLIAIAXILNFGSXNFIFYLDVIKNDFIIQLITXLVILAAITKSAQIPFSSWLPAAIAAPTPVSSLVHSSTLVTAGVYLLIRFNFSFRDEIIIILLFISSITIFMSGLGANFEFDLKKIIALSTLSQLGLIIRILSLGEYKLAFFHLLIHALFKALLFMCAGNIIHNLNNCQDIRYIGGLIKHLPLTCTYLNICNLSLCGFPFMSGFYSKDLIVEILSFSYLNIYIYIIFYISIGLTVAYRFRLTYYSLTGRFNYLALNILSETGYLILKGIRGLILFVVFSGRLFSXLVFSTPIFICLPFLIKIITLIFIIVGVXLGYELAKFKISYNLLRLNNISRVLFFRIIXNIPFLSTLGINYYPIYFGIFYKKFFDIGXFEYYGSSGVIKQLNNRIFLQLFSLNHLKIYLLLLIF

SEQ ID NO: 23705 - protein, 605 aa, Diabrotica virgifera
  misc_feature: Coding regions on vcDNA: vcDNA=SeqID_3402; Strand=+; Position=110-1924
  misc_feature: Homolog annotation: Hit_ID=XP_394275.1; Match level="QueryCoverage =99%, HitCoverage=93%, E-value=0.0, Identity=71%"; Hit description =similar to Probable nucleolar GTP-binding protein 1 [Apis mellifera]
  misc_feature: Gene Ontology Annotation: Molecular function=ATP binding; Cellular component=nucleolus; Biological process=signal transduction
  misc_feature: Pfam annotation: Pfam_ID=NOG1; Match level="Score=130.2, E-value=4.8e- 36, Copies=1"; Pfam description=Nucleolar GTP-binding protein 1 (NOG1
  misc_feature (583)..(583): Xaa can be any naturally occurring amino acid
  misc_feature (587)..(587): Xaa can be any naturally occurring amino acid
  misc_feature (598)..(598): Xaa can be any naturally occurring amino acid
MSNMYNFKKIAVVPTAKDFIDIILSKTQRKTPTVVHKQYKISRIRAFYTRKVKFSQQSFHDRLTQILTEFPKLDDVHPFYADLMNVLYDKDHYKLALGQLNTARHLIDNVAKDYCRLLKYGDSLYRCKQLKRAALGRMATIMKRQAANLSYLEQVRQHLARLPSIDPYTRTIIICGFPNVGKSSFINKITRADVEVQPYAFTTKSLYVGHTDYKYLRWQVIDTPGILDHSLEERNVIEMQAVTALAHLRACVLYFLDLSEQCGHNLDEQVKLFESIKPLFANKPLLLVANKCDIIKLDELPKEKRKVLQEIEEDKQLTVIEMSTVDDTGVMEVKTEACEKLLSFRVDQKMRSKKVDGVLNRLHVATPKPRDDKARPPCIPESVLAKKQLIGEKRKRKLERDIEIEEGDDYVLDLKKHYVDIPEEERHDIIPEIWEGHNIADYIDPDIFEKLAELEKDEEYREETGMYLVPKMELDDTMKEIKKLALQIRHKKAIIKDEARINKQSRKPVMPRTAGAKVRGRSASRLRENMAELGVDLSDNEDAHYMNTKQRSRSMGPPAKKMRMEVSDSTSLNRSRSLSKPPXNEMXVKDVAMKKKLXQIAHRAI

SEQ ID NO: 23706 - protein, 279 aa, Diabrotica virgifera
  misc_feature: Coding regions on vcDNA: vcDNA=SeqID_3403; Strand=+; Position=91-930
  misc_feature: Homolog annotation: Hit_ID=XP_392102.1; Match level="QueryCoverage =97%, HitCoverage=97%, E-value=3e-82, Identity=48%"; Hit description =similar to ENSANGP00000017364 [Apis mellifera]
  misc_feature: Gene Ontology Annotation: Molecular function=electron transporter activity; Cellular component=endoplasmic reticulum; Biological process=protein folding
  misc_feature: Pfam annotation: Pfam_ID=Thioredoxin; Match level="Score=244.0, E -value=2.6e-70, Copies=2"; Pfam description=Thioredoxin
MGPHSVLSLMFASVVITLAHEDVYSIKYTTENFSQEVGKKNHFVMFYAPWCGHCQKFSPKWEQLAEMLNEDDTNNIKIAKVDCTTDSEVCSEQDITGYPTLKFYKVGDSEGVRFRGTRDLPSITNFINEQLREGDESHTEEAVSDEATAVDGLTELTEDNFHKHVKSGKHFIKFYAPWCGHCQKLAPAWEQLAKTLELDNEVTVGKVDCTQHRSVCNDFDVKGYPTLLWIENGAKVDKYQGDRSHVDLKQYVNKMLGSEKTEGATPKEAASDADLHQEK

SEQ ID NO: 23707 - protein, 100 aa, Diabrotica virgifera
  misc_feature: Coding regions on vcDNA: vcDNA=SeqID_3404; Strand=+; Position=11-313
HVKKLYIIKMLGQSQHTQASRNKMAKITFVLLAVVAVVVLATAEASPKAAHGVSVFKAVALGKVGASCDCDTCSQECESIGSDYVGGICYQDDCYCAYIN

SEQ ID NO: 23708 - protein, 513 aa, Diabrotica virgifera
  misc_feature: Coding regions on vcDNA: vcDNA=SeqID_3405; Strand=+; Position=34-1575
  misc_feature: Homolog annotation: Hit_ID=AAL29940.1; Match level="QueryCoverage =83%, HitCoverage=96%, E-value=2e-29, Identity=25%"; Hit description =lectin 1 [Girardia tigrina]
  misc_feature: Gene Ontology Annotation: Molecular function=receptor activity; Cellular component=integral to plasma membrane; Biological process =pinocytosis
  misc_feature: Pfam annotation: Pfam_ID=Lectin_C; Match level="Score=143.1, E-value =6.4e-40, Copies=3"; Pfam description=Lectin C-type domain
MLSRSAILVLLFSAFTFADEAPRAVLTPGHVLPLVKNGKYNYFMGTTFKATQLQALRFCKNINMTLLDIESEAENEAVYKLIKEKNEGDSYWSSGSRIIDGKSWLWLSTGKQIEQTYWDNGQPNTNNEYCLSLKIDNNRNKVFWHDDVCSYEKPFICKAAADENEKGQSEVWSNIFEGTKGLISDEFVYGNKYYYFARQFRGSFAQGFQFCDSIGMLPVSVLSQDENDRIYKHLRDTNAEEKWWSSGARSTDSVHWFWLSNGQLVNYTNWAVSEPNNRLSEQCIALDMNKDKGLYFFDIGCRVEHPVVCERPVKPSKLSKRETQQRWLKRAQSVKNQETLGKYYVEQDFEATHDEAVEYCKFLDMQLSEINSQQKTDGVTRELLLVADNGPFYISGKRSKADWVFDSNNQKMDYTNWQSGRPQEELKNGCIQMNEKGQWIDVNCDKESLFICERPGADNDLADDCPQPVINVYINNNMPALEHQSFIPIRVDDQSAGDEHSVLVQNRWDTCSN

SEQ ID NO: 23709 - protein, 269 aa, Diabrotica virgifera
  misc_feature: Coding regions on vcDNA: vcDNA=SeqID_3406; Strand=+; Position=23-832
  misc_feature: Homolog annotation: Hit_ID=AAP48569.1; Match level="QueryCoverage =31%, HitCoverage=12%, E-value=2e-14, Identity=38%"; Hit description =swan [Rattus norvegicus]
  misc_feature (243)..(243): Xaa can be any naturally occurring amino acid
MSTIEIELLNLSKSDLVSIIINKKVSDNIKISNELADFLANKSGSIEMTTQTPCEDIRFLLLNCELTVAKCEIKANKRVMAEMEKSSKHQDHIAKLLTGNIQTLKEEALKARNEAASRKTYSTTNNITDAMQYNNISSGASEDVRKVALLGDGTDQSGATSAQPEAAAAKPKKGGFLSKLTSKLPLGKLPLPAGGLPAGLPTGGLPAGGVPAGGLPAGGLPAGGLPAGGLPAGGLPAGSLPTXGLPAGLPAENLPSESLPTPPATVPKV

SEQ ID NO: 23710 - protein, 225 aa, Diabrotica virgifera
  misc_feature: Coding regions on vcDNA: vcDNA=SeqID_3407; Strand=+; Position=193-870
  misc_feature: Homolog annotation: Hit_ID=XP_391955.1; Match level="QueryCoverage =98%, HitCoverage=36%, E-value=4e-74, Identity=59%"; Hit description =similar to ENSANGP00000010338 [Apis mellifera]
  misc_feature: Gene Ontology Annotation: Molecular function=protein binding; Cellular component=transcription factor complex; Biological process =G1 phase of mitotic cell cycle
  misc_feature: Pfam annotation: Pfam_ID=Pkinase; Match level="Score=196.0, E-value =7.8e-56, Copies=1"; Pfam description=Protein kinase domain
MSADEPSYEPLNRIGRGAYGTVYKARDRKTGNLVALKRVCVHLTEDGISLNTLREISLLRQVNSFDHPNIVRLLDVCHGQQMEKELIMYLVFEHVEQDLATYIDRHPNGFSTIHIRNLCKEILRGVDFLHSIRVIHRDLKPQNLLVTHDGHIKLADFGLAKIYDCEMQLTSVVVTLWYRAPEVLLGLAYATPVDVWSIGCIIVELYNLKTLFCGTSDGDQLSKIF

SEQ ID NO: 23711 - protein, 86 aa, Diabrotica virgifera
  misc_feature: Coding regions on vcDNA: vcDNA=SeqID_3408; Strand=+; Position=473-733
WEEKFLKYLFVRVLLLLRRILHLKGNRVSSSLLLTQLGRFLISMAFGVDNSYRTFKTNFVSCLDHQTVLRRFLPFIWSWKEVFDTC

SEQ ID NO: 23712 - protein, 275 aa, Diabrotica virgifera
  misc_feature: Coding regions on vcDNA: vcDNA=SeqID_3409; Strand=+; Position=20-847
  misc_feature: Homolog annotation: Hit_ID=XP_315007.1; Match level="QueryCoverage =78%, HitCoverage=68%, E-value=3e-50, Identity=48%"; Hit description =ENSANGP00000021318 [Anopheles gambiae]
  misc_feature: Gene Ontology Annotation: Molecular function=receptor binding; Cellular component=extracellular space; Biological process =opsinization
  misc_feature: Pfam annotation: Pfam_ID=Fibrinogen_C; Match level="Score=270.4, E -value=3e-78, Copies=1"; Pfam description=Fibrinogen beta and gamma chains, C-t
MSVSTNYLKLALIVSLILSICGNYLDNDQQNRSVQEEIKESSPIFKRSAYYGKADGTPFKNCKEILESGVNISGIYEIQPIGSNKLINVTCDMETRGGGWTVIQRRIDGSVEFYRGWREYKFGFGDLNGELWLGLESIYHLTAFEANELLVELVDKDGISAYALYDSFAIGSEVEGYYLSTLKGYSGDAGDSLSNHLGQKFTTLDLDQDQKPDGNCAEIFIGAWWYNNCYESHLNGKFRNIRWPAAYKYKGIVWFGFKNNEYFLSQARMLIRPKY

SEQ ID NO: 23713 - protein, 169 aa, Diabrotica virgifera
  misc_feature: Coding regions on vcDNA: vcDNA=SeqID_3410; Strand=+; Position=2-510
  misc_feature: Homolog annotation: Hit_ID=XP_533970.1; Match level="QueryCoverage =98%, HitCoverage=33%, E-value=8e-35, Identity=45%"; Hit description =PREDICTED: similar to jerky homolog-like [Canis familiaris]
  misc_feature: Gene Ontology Annotation: Molecular function=molecular_function unknown; Cellular component=nucleus; Biological process=central nervous system development
  misc_feature: Pfam annotation: Pfam_ID=DDE; Match level="Score=-6.9, E-value=7.4e -06, Copies=1"; Pfam description=DDE superfamily endonuclease
  misc_feature (59)..(59): Xaa can be any naturally occurring amino acid
  misc_feature (75)..(75): Xaa can be any naturally occurring amino acid
  misc_feature (90)..(90): Xaa can be any naturally occurring amino acid
AAHDYKNKFLDFVREENLTADQIYYNADETGLFYRMLPSKTLTSKTEETAKGYKKAKTXLTIMACSNALGKHFLXLNRKSKKSVSTEKRXIGIIYQSQKNAWMDSTTFKNWFFDCFVPGVTKYLKDCGLPIKAVLIIDNAPLHPSADVLVSGDITVKILPPNVTALLHV

SEQ ID NO: 23714 - protein, 178 aa, Diabrotica virgifera
  misc_feature: Coding regions on vcDNA: vcDNA=SeqID_3411; Strand=+; Position=50-586
  misc_feature: Homolog annotation: Hit_ID=XP_533970.1; Match level="QueryCoverage =98%, HitCoverage=34%, E-value=2e-39, Identity=48%"; Hit description =PREDICTED: similar to jerky homolog-like [Canis familiaris]
  misc_feature: Gene Ontology Annotation: Molecular function=molecular_function unknown; Cellular component=nucleus; Biological process=central nervous system development
  misc_feature: Pfam annotation: Pfam_ID=DDE; Match level="Score=13.7, E-value=3.7e -07, Copies=1"; Pfam description=DDE superfamily endonuclease
  misc_feature (68)..(68): Xaa can be any naturally occurring amino acid
  misc_feature (83)..(83): Xaa can be any naturally occurring amino acid
  misc_feature (109)..(109): Xaa can be any naturally occurring amino acid
GESLSGDNNAAHDYKNFFLDFVREENLTADQIYYNADETGLFYRMLPSKTLTSKTEETAKGYKKSKDXLTIMACSNALGKHFXLVLIGKAKNPRALKNVNRDYLPVSKXAWMDSTTFKNWFFDCFVPGVTKYLKDCGLPIKAVLIIDNAPLHPSADVLVSGDITVKILPPNVTALLHV

SEQ ID NO: 23715 - protein, 93 aa, Diabrotica virgifera
  misc_feature: Coding regions on vcDNA: vcDNA=SeqID_3412; Strand=-; Position=0-278
KHRDVILKFTPVNRKSEISAQCRVSSGTNEPNMKHCDVVPKFTLVNCNSSIQLRTRGRICSRKSNLYTCITRKMLAKINFPFILITYRNGGGR

SEQ ID NO: 23716 - protein, 293 aa, Diabrotica virgifera
  misc_feature: Coding regions on vcDNA: vcDNA=SeqID_3413; Strand=+; Position=147-1026
  misc_feature: Homolog annotation: Hit_ID=NP_725681.1; Match level="QueryCoverage =92%, HitCoverage=46%, E-value=4e-81, Identity=54%"; Hit description =CG30104-PB, isoform B [Drosophila melanogaster] ref|NP_611218.1| CG30104-PA, isoform A [Drosophila
  misc_feature: Gene Ontology Annotation: Cellular component=integral to membrane
  misc_feature: Pfam annotation: Pfam_ID=Metallophos; Match level="Score=70.2, E -value=5.8e-18, Copies=1"; Pfam description=Calcineurin-like phosphoesterase
  misc_feature (270)..(270): Xaa can be any naturally occurring amino acid
  misc_feature (286)..(286): Xaa can be any naturally occurring amino acid
  misc_feature (289)..(289): Xaa can be any naturally occurring amino acid
MKYAALLFTFLNLLHLIFCDFDLVILHNNDIHGRFEQTERNSGTCQPKNRNTTCIGGFARTAHVIRKHREAAQNGTGPEVLYLYAGDTFIGTVWYTVHTWNISSTFMNLLRPDAQCLGNHEFDKGTKELGQYLSKLTFPTVTCNLDLSLEPNITPYVQKYIIIEKAGRKIGIIGYLTPETKKISSPEQTIFLDEIEEINKQAELLDQQGIKIIIAVGHSGYLKDKEIAEKVPLVDVVVGGHTNTFLWNGPAPDTDTIDGPYPTVINSPSXKKVPVVQAYAFIQILXKLXLKFD

SEQ ID NO: 23717 - protein, 253 aa, Diabrotica virgifera
  misc_feature: Coding regions on vcDNA: vcDNA=SeqID_3414; Strand=+; Position=58-819
  misc_feature: Homolog annotation: Hit_ID=NP_651183.3; Match level="QueryCoverage =93%, HitCoverage=58%, E-value=1e-60, Identity=51%"; Hit description =CG10374-PC, isoform C [Drosophila melanogaster] gb|AAF56182.2| CG10374-PC, isoform C [Drosophila
  misc_feature: Pfam annotation: Pfam_ID=Perilipin; Match level="Score=31.1, E-value =4e-08, Copies=1"; Pfam description=Perilipin family
MPSIHKKKAFDINDLESVARISHIPIVESGWSYAEGVYMKIKRSNSLIHWTLDTAEQSAQSVYEAASPAMILLKGPLSSLDQIVCKSLDIVEQTVPSINLPPEMIYWNTKQYVQEVGTKIAQPVLKRADSVKQIGNSVLSSKYTAIAADTLDGALVVAEKYVDKYLPAQDDQASEEVSVPVTEDGPKGKAISTIHHADRFSRKLRRRLTQRTIAEVKALKHQSAEAVHVLTYVLELIATDPVLAYQKKKKRAF

SEQ ID NO: 23718 - protein, 397 aa, Diabrotica virgifera
  misc_feature: Coding regions on vcDNA: vcDNA=SeqID_3415; Strand=+; Position=156-1349
  misc_feature: Homolog annotation: Hit_ID=NP_651183.3; Match level="QueryCoverage =80%, HitCoverage=81%, E-value=4e-83, Identity=50%"; Hit description =CG10374-PC, isoform C [Drosophila melanogaster] gb|AAF56182.2| CG10374-PC, isoform C [Drosophila
  misc_feature: Pfam annotation: Pfam_ID=Perilipin; Match level="Score=204.1, E-value= 2.8e-58, Copies=1"; Pfam description=Perilipin family
MAHRKRRNRIRKSYATKRLEKEILEQLTTTSQNTTKPVIAQPCYVTVGVQTEDELPSIHKKKAFDINDLESVARISHIPIVESGWSYAEGVYMKIKRSNSLIHWTLDTAEQSAQSVYEAASPAMILLKGPLSSLDQIVCKSLDIVEQTVPSINLPPEMIYWNTKQYVQEVGTKIAQPVLKRADSVKQIGNSVLSSKYTAIAADTLDGALVVAEKYVDKYLPAQDDQASEEVSVPVTEDGPKGKAISTIHHADRFSRKLRRRLTQRTIAEVKALKHQSAEAVHVLTYVLELIATDPVLAYQKGKDLWASLSQDEPENQARPENLEQLIVLLTRESARRVVHLINFSSTLISTLPKRISYSIGAVVNKFLALTDSAVKEQIAEDLSKRGETKLCFPFLK

SEQ ID NO: 23719 - protein, 123 aa, Diabrotica virgifera
  misc_feature: Coding regions on vcDNA: vcDNA=SeqID_3416; Strand=+; Position=95-466
  misc_feature: Homolog annotation: Hit_ID=AAS89344.1; Match level="QueryCoverage =62%, HitCoverage=85%, E-value=2e-11, Identity=45%"; Hit description =similar to C9 orf16 [Ctenopharyngodon idella]
  misc_feature: Pfam annotation: Pfam_ID=UPF0184; Match level="Score=44.8, E-value =2.4e-10, Copies=1"; Pfam description=Uncharacterised protein family (UPF018
MGEEEITPNNIKENQSENMNGNINGQEENPPPEEMDTNGENDVNEDDLDEDNDDMSPEEFAALDHQLDALNSALDDIEQKNDNIHSQLLELLHANREIRTQLQQDKASTDNREDVNKTNEPKA

SEQ ID NO: 23720 - protein, 282 aa, Diabrotica virgifera
  misc_feature: Coding regions on vcDNA: vcDNA=SeqID_3417; Strand=+; Position=135-982
  misc_feature: Homolog annotation: Hit_ID=NP_612051.1; Match level="QueryCoverage =90%, HitCoverage=56%, E-value=2e-79, Identity=55%"; Hit description =CG3344-PA [Drosophila melanogaster] gb|AAF47405.1| CG3344-PA [Drosophila melanogaster]
  misc_feature: Gene Ontology Annotation: Molecular function=carboxypeptidase D activity; Cellular component=Golgi trans face; Biological process =proteolysis and peptidolysis
  misc_feature: Pfam annotation: Pfam_ID=Peptidase_S10; Match level="Score=86.7, E -value=6e-23, Copies=1"; Pfam description=Serine carboxypeptidase
  misc_feature (195)..(195): Xaa can be any naturally occurring amino acid
  misc_feature (237)..(237): Xaa can be any naturally occurring amino acid
MGVVIRKRGFGPTDQEWGFSEVRPGANLFWWLHYTTADVSTPTDRPLLIWLQGGPGSSSTGYGNFEELGPLDSDLNPRNTTWVQWANVLFVDNPVGTGFGYVTSDDLYAKNNTQIATDFLEFMKDFYKQLPKFKTVPLYIFCESYGGKMAAEIALVLYQAIQKGEIESNLKGVALGDSWISPLDAELSYGPYLFXLGFIDRNGYDAIMEEAARVKKAIDKGDFDEALSLWYSMESVXVEVETRGIDWYNVFTGRVSNNIRGLDKQNTGASSVTDDLATIMNF

SEQ ID NO: 23721 - protein, 448 aa, Diabrotica virgifera
  misc_feature: Coding regions on vcDNA: vcDNA=SeqID_3418; Strand=+; Position=44-1389
  misc_feature: Homolog annotation: Hit_ID=XP_392686.1; Match level="QueryCoverage =93%, HitCoverage=97%, E-value=1e-110, Identity=48%"; Hit description= similar to CG3344-PA [Apis mellifera]
  misc_feature: Gene Ontology Annotation: Molecular function=carboxypeptidase D activity; Cellular component=Golgi trans face; Biological process =protein processing
  misc_feature: Pfam annotation: Pfam_ID=Peptidase_S10; Match level="Score=268.0, E -value=1.6e-77, Copies=1"; Pfam description=Serine carboxypeptidase
  misc_feature (403)..(403): Xaa can be any naturally occurring amino acid
MYTRIIRILLSYSVYCFDYKMRVLVVLCIILQVVLGKRGFGPTDQEWGFSEVRPGANLFWWLHYTTADVSTPTDRPLLIWLQGGPGSSSTGYGNFEELGPLDSDLNPRNTTWVQWANVLFVDNPVGTGFGYVTSDDLYAKNNTQIATDFLEFMKDFYKQLPKFKTVPLYIFCESYGGKMAAEIALVLYQAIQKGEIESNLKGVALGDSWISPLDAELSYGPYLFNLGFIDRNGYDAIMEEAARVKKAIDKGDFDEALSLWYSMESLVEVETRGIDWYNVFTGRVSNNIRGLDKQNTGASSVTDDLATIMNSKVAPALNITKEWVDQRSEVFDSLGNDFMRPVTHIVEELLNTTDLIVAVYNGQLDLIVDTPATYNWVENIAFKGKDEWEHAERIEIYNAVDYXPINGFYKRANKFAFYWVNLAGHMVPHDNPTAMEFILRDVTDNFKV

SEQ ID NO: 23722 - protein, 105 aa, Diabrotica virgifera
  misc_feature: Coding regions on vcDNA: vcDNA=SeqID_3419; Strand=-; Position=484-801
  misc_feature (28)..(28): Xaa can be any naturally occurring amino acid
  misc_feature (86)..(86): Xaa can be any naturally occurring amino acid
GEKNELQQEDGMVIEQSSDYVYLGTRIXQSGRTEFETEERIMKVKKLIGALNSLLWSKTKKKPKEKKTQLYNSIFKSEVLYGCETXQVNKRREQKLLALEMDFWR

SEQ ID NO: 23723 - protein, 185 aa, Diabrotica virgifera
  misc_feature: Coding regions on vcDNA: vcDNA=SeqID_3420; Strand=+; Position=118-675
  misc_feature: Homolog annotation: Hit_ID=XP_321607.1; Match level="QueryCoverage =87%, HitCoverage=57%, E-value=1e-44, Identity=58%"; Hit description =ENSANGP00000011761 [Anopheles gambiae]
MSACVNERVFVDSPLKSKVALFNKVADKHIQGQAVNPFSNGQQAGGLHRPTISKEEYGKPPKGSLSEIRAFKATIHVSREMLELCEVISQCGERLFSPEEKPNDPRIVISFGELFAIYTAISDKVVGILLRARKYNLVDFEGECLFQRQDDHVPIILVKPISEIRTFLKERIATATKALKETGEM

SEQ ID NO: 23724 - protein, 544 aa, Diabrotica virgifera
  misc_feature: Coding regions on vcDNA: vcDNA=SeqID_3421; Strand=+; Position=83-1712
  misc_feature: Homolog annotation: Hit_ID=NP_649835.1; Match level="QueryCoverage =88%, HitCoverage=88%, E-value=0.0, Identity=75%"; Hit description =CG8351-PA [Drosophila melanogaster] gb|AAF54292.2| CG8351-PA [Drosophila melanogaster]
  misc_feature: Gene Ontology Annotation: Molecular function=chaperone activity; Cellular component=actin filament; Biological process=reproduction
  misc_feature: Pfam annotation: Pfam_ID=Cpn60_TCP1; Match level="Score=314.6, E -value=1.5e-91, Copies=1"; Pfam description=TCP-1/cpn60 chaperonin family
  misc_feature (401)..(401): Xaa can be any naturally occurring amino acid
  misc_feature (441)..(441): Xaa can be any naturally occurring amino acid
MMQPQILLLKEGTDSSQGKPQLISNINACQNVTDAVRTTLGPRGMDKLIVQRQGHATISNDGATILKLLDIVHPAAKTLVDIAKSQDAEVGDGTTSVVLLAGEFLKQIKPYVDEGVHPRIIIKAVRRSFQICLEKISEIAVKINKSNADEFRSLLEKCAATAMSSKLINQQRSFFSKMVVDAVLLLDDLLPLNMIGIKKVQGGALEESLLVAGVAFKKTFSYAGFEMQPKVYKDCKIALLNIELELKAERDNAEVRVDNVKEYQKIVDAEWTILYNKLQKIYESGANVVLSKLPIGDVATQYFADRDMFCAGRVQEDDMKRTLKACGGAVMTTVNDISDSVLGKCELFEEKQIGGERFNFFKGCPNAKTCTLILRGGAEQFLKETGRSLPDAIMIVKRTIXKMTPFVAGGGGILKKGSKQKLDHSPTIAGKKQFLIGEITXGLKNHPQKICDKAGFCAPNFSNKIPQKTRRVPVWYGGDKKKKKNSSKTFKAWGMGTRPSLKTTPFYLSPTKIITCLDFLFVLSKKNKKKIKKSWRGPPPPTRG

SEQ ID NO: 23725 - protein, 350 aa, Diabrotica virgifera
  misc_feature: Coding regions on vcDNA: vcDNA=SeqID_3422; Strand=+; Position=67-1116
  misc_feature: Homolog annotation: Hit_ID=XP_311767.1; Match level="QueryCoverage =99%, HitCoverage=65%, E-value=1e-162, Identity=81%"; Hit description= ENSANGP00000014237 [Anopheles gambiae]
  misc_feature: Gene Ontology Annotation: Molecular function=chaperone activity; Cellular component=cytoplasm; Biological process=protein folding
  misc_feature: Pfam annotation: Pfam_ID=Cpn60_TCP1; Match level="Score=120.2, E -value=4.9e-33, Copies=1"; Pfam description=TCP-1/cpn60 chaperonin family
MAISLLNPKAEVARAAQALAVNISAAKGIQDVMKSNLGPKGTVKMLVSGAGDIKITKDGNVLLHEMQIQHPTASLIARASTAQDDMTGDGTTSTVLVIGELLKQADIYIAEGLHPRLLTDGFDKARTKALEVLEKMKISIEANKETLTDICRTSLRTKLHQKLADVLTDVCVDAVLAIKKDDKPVDLHMVELMEMQHKTETDTQLIKGLVLDHGSRHPDMPKSLNNCYILTCNVSMEYEKSEVNSGFFYKTAEEREKLVTAEREFIEQRVKKVIELKRSLCNGTDKTFVVINQKGIDPMSLDMLAKEGIIALRRAKRRNMERLSLACGGVAMNSFDDLQESQLGRGGHVY

SEQ ID NO: 23726 - protein, 142 aa, Diabrotica virgifera
  misc_feature: Coding regions on vcDNA: vcDNA=SeqID_3423; Strand=+; Position=2-430
RVYKVSYYYRFKIQKMLLRFLRIPKIKTVAIPIRELSNLSIGKATTAAKFIPVLETSTSTIQNPWIYRQNDNFNLPRCPNLKIDLPNTIKTIIPAIEPNKQDVIEAPAFDDSIKKEAVKMIVIRRKKMKKHKLKKFEKANEV

SEQ ID NO: 23727 - protein, 304 aa, Diabrotica virgifera
  misc_feature: Coding regions on vcDNA: vcDNA=SeqID_3424; Strand=+; Position=73-983
  misc_feature: Homolog annotation: Hit_ID=AAN73320.1; Match level="QueryCoverage =100%, HitCoverage=76%, E-value=2e-68, Identity=45%"; Hit description= serpin 6 [Ctenocephalides felis]
  misc_feature: Gene Ontology Annotation: Molecular function=serine protease inhibitor activity; Cellular component=cytoplasm; Biological process= regulation of proteolysis and peptidolysis
  misc_feature: Pfam annotation: Pfam_ID=Serpin; Match level="Score=204.0, E-value=3e- 58, Copies=1"; Pfam description=Serpin (serine protease inhibitor)
  misc_feature (276)..(276): Xaa can be any naturally occurring amino acid
MAEENKHLTAVLQGNGLFTRNAYQILAQEKGKNIFFSPISIHAILSLASQGSGGKTQKALTSALQVADIATLAEGYKAAMLKLNSVEDVTLLMANKVYVKNEYALKDEFKDKVVNHFFSEVQNVDFSQSAAAAKTINTWVEEKTKDKIKDLIQPDDLNDDTRLVLVNAIYFKGKWAAPFKPEDTKTEKFYLNDNDSIDVQMMHTKKKFFFKNDEALDAKVLELPYTNKDLSMIVILPNKRNGINELELKLANTDLTKITENMFRPDVIVALPKFKXETTINLEEPLTKLGLGVIFSDHADFTGM

SEQ ID NO: 23728 - protein, 562 aa, Diabrotica virgifera
  misc_feature: Coding regions on vcDNA: vcDNA=SeqID_3425; Strand=+; Position=11-1699
  misc_feature: Homolog annotation: Hit_ID=XP_318845.1; Match level="QueryCoverage =51%, HitCoverage=74%, E-value=2e-25, Identity=34%"; Hit description =ENSANGP00000014460 [Anopheles gambiae]
MKGLLIVCLAVLALTSAADKEDKKGKKRSFPAYSGYSSGYSGAVPAVQYNSASQLFGQSSSVYGGGLDSSSQLLGSGYGSGYGSGYGSGFGSGSGVENLNVQTYSQGLQGLQGLQSSQVLGEVQGFQSAHAQLPLAQTYSQEVQLPVVQTQSVQAQLPAVQSYTHEQHVHPTHSYNYINKAVPVYVPKPVPYEVTKTVQVPTPYKVTVPKPYAVPVQVRVPVDVPKPYEVKVEHKVPVPVPERVPVEIPRPYPVYKTKQVRVEVEKPVYVKEKVEVRVPVPKPYPVEVPTPVHIRVPQRILLKVPQIVGAHNHATPCEHAAAVQAGRVVNIPNYVYGQGQAYGHMEGQQNLLAGQSLSGLEQSSFGRSSLEQASFGQSVSSGLPSQASLEQSSIGQSLSNIAEQSLANSQAAYDQSVQGLGDNSNLGFGQESFGQQSFGASEGVQSFGDVNQQGLQSYEEFRRSHQGEGVVSVENESVSVESKTDNGVSGGIGSIFESRSGFVEGRSEETASVEPQPAAPAAEVSATNEPANEVEHNSAESKEESTVPSAHRYCLNCGIISI

SEQ ID NO: 23729 - protein, 318 aa, Diabrotica virgifera
  misc_feature: Coding regions on vcDNA: vcDNA=SeqID_3426; Strand=+; Position=27-984
  misc_feature: Homolog annotation: Hit_ID=EAA14515.3; Match level="QueryCoverage =50%, HitCoverage=81%, E-value=4e-17, Identity=36%"; Hit description =ENSANGP00000014460 [Anopheles gambiae str. PEST] ref|XP_553601.1| ENSANGP00000014460 [Anopheles gambiae st
  misc_feature: Pfam annotation: Pfam_ID=Collagen; Match level="Score=-42.4, E-value =0.043, Copies=1"; Pfam description=Collagen triple helix repeat (20 copi
  misc_feature (296)..(296): Xaa can be any naturally occurring amino acid
MKGLLIVCLAVLALTSAADKEDKKGKKRSFPAYSGYSSGYSGAVPAVQYNSASQLFGQSSSVYGGGLDSSSQLLGSGYGSGYGSGYGSGFGSGSGVENLNVQTYSQGLQGLQGLQSSQVLGEGQSFQSGQAFEQGYSQGLEGLQGVQGLQGVQGVQGLQGFQGVQGLQSSQVLGEVQGFQSAHAQLPLAQTYSQEVQLPVVQTQSVQAQLPAVQSYTHEQHVHPTHSYNYINKAVPVYVPKPVPYEVTKTVQVPTPYKVTVPKPYAVPVQVRVPVDVPKPYEVKVEHKVPVPVPRXVPVEIPRPYPVYKTKASPGLKE

SEQ ID NO: 23730 - protein, 470 aa, Diabrotica virgifera
  misc_feature: Coding regions on vcDNA: vcDNA=SeqID_3427; Strand=+; Position=11-1423
  misc_feature: Homolog annotation: Hit_ID=EAA00262.3; Match level="QueryCoverage =95%, HitCoverage=90%, E-value=1e-126, Identity=49%"; Hit description= ENSANGP00000015378 [Anopheles gambiae str. PEST] ref|XP_552299.1| ENSANGP00000015378 [Anopheles gambiae s
  misc_feature: Gene Ontology Annotation: Molecular function=basic amino acid transporter activity; Cellular component=integral to plasma membrane; Biological process=basic amino acid transport
  misc_feature: Pfam annotation: Pfam_ID=Alpha-amylase; Match level="Score=319.6, E -value=4.8e-93, Copies=1"; Pfam description=Alpha amylase, catalytic domain
MFKCITYLSAILVVAVVCSENDKDWWKTATFYQIYPKSFKDTNGDGVGDLKGIIEKLDYVKDLGVTGVWLSPIYKSPLVDEGYDISDFRDINPIFGDLETFVKLVNETHSRGLKIVLDYVPNHTSDQHPWFTKSENREEGYEDFFVWVDGKNGDKNEPPNNWRSVFKNSAWEWSDKRKQFYLHQFFKQQPDLNFFNDQVQKEMKDIINYWLEEYGIDGIRIDSMPYLVENQTWPDEPRSYDPSASEDEYEYLDHIYSRSQKESYDIIYDWRRHIDDISKNTSNTKVCMTEAVVDLKHIIPYYGTPDGSKLGAHFSFNFILLVLNTTSTASDLSTLINLWMDSLPKIYTSNWVLGNHDQHRIATKVGTEKVDGLNMLMAFLPGIQITYNGEEIGMENGEVNCETQGLDHAENCSDYYRISRDFQRTPFQWDSSEFAGFTSGNKTWLPVSSKKTKCNVADQINDERSHLNIY

SEQ ID NO: 23731 - protein, 612 aa, Diabrotica virgifera
  misc_feature: Coding regions on vcDNA: vcDNA=SeqID_3428; Strand=+; Position=49-1887
  misc_feature: Homolog annotation: Hit_ID=XP_317360.1; Match level="QueryCoverage =85%, HitCoverage=81%, E-value=1e-112, Identity=38%"; Hit description= ENSANGP00000010418 [Anopheles gambiae]
  misc_feature: Gene Ontology Annotation: Molecular function=sphingomyelin phosphodiesterase activity; Cellular component=extracellular; Biological process=ceramide biosynthesis
  misc_feature: Pfam annotation: Pfam_ID=Metallophos; Match level="Score=62.8, E -value=9.9e-16, Copies=1"; Pfam description=Calcineurin-like phosphoesterase
MKTVLVLSIATILLHFVICVSIGKEDAFKQMTKGLLEYRKTGTPPQYLKSAVEKYNKPNYFLVPTGTFDKSEVCYTCALIVDMFKHHRADGMSDEEFKKELLGFCNLYKVYPERVCKGRVDLNAPIFLYIMDNTPNLTGIDACGMALQYDDCALGTRYNWTVNVPPPTQTIKTKKVTAEKPFNILHITDIHYDPRYTVGKQNTCNEPVCCQDDQPNATTAGEACGYWSDYINADIPWRTVVNALEQTKNHNYDYVYFTGDIVPHRLWDTSVEDNSKIISQILDAFADYYKGPVYPSLGNHEANPVDNYSEETDPSLSSKWLYDLLFQKLSKWMPIDEVKDTILKGGYYTVSPKNGLRVVVLNNNVCNSGNWWIIHQPNDPYDQLKWLSNVLLKAEQDNERVHLLYHMPSGQDECYRVWSREYRKIIERFSTIIAVQFNGHTHRDEFYVYYSKSNSSKAINMAWNGASVVTYDKANPSYKVFSIDGNTFDALDFEEWTFNLTLANLNPNKNPEWYKLYSFKNAFGVKSLEAQEINDLVMRMTQKHELLDQYYRYKFRDGDIALKEGCDDDCKKDLLCRMVKTEYGDDEVCEKVKELYDRNKDIQVFGCITVYF

SEQ ID NO: 23732 - protein, 268 aa, Diabrotica virgifera
  misc_feature: Coding regions on vcDNA: vcDNA=SeqID_3429; Strand=+; Position=103-906
MDIFPHLFQDNFWAPNCPGRGADSGNLVQNITDVLNSIAIAKAMFCPEYDINNQDVNGNSEVPQPSTSATTDKTNLEANPGDNFKEDILNSIAIAKAMFCPEYDNNQDVNGNSEVPQPSSSATTDKTNFEANPGDDFKEDILNSIAIAKAMFCPEYDNNHDVSSNSEVPQPSTSATTDKTNFEANPGEDFKEDILNSIAIAKAMFCPEYDNNHDVSNNSEVPQPSTSSTTEQNQFLKPFKGTVLKKVILNSIEITKAMFLSREMTTTT

SEQ ID NO: 23733 - protein, 211 aa, Diabrotica virgifera
  misc_feature: Coding regions on vcDNA: vcDNA=SeqID_3430; Strand=+; Position=72-707
  misc_feature: Homolog annotation: Hit_ID=XP_311545.1; Match level="QueryCoverage =94%, HitCoverage=90%, E-value=7e-45, Identity=44%"; Hit description =ENSANGP00000010247 [Anopheles gambiae]
  misc_feature: Gene Ontology Annotation: Molecular function=glutathione peroxidase activity; Cellular component=cellular_component unknown; Biological process=glutathione conjugation reaction
  misc_feature: Pfam annotation: Pfam_ID=GST_N; Match level="Score=76.1, E-value=9.7e- 20, Copies=1"; Pfam description=Glutathione S-transferase, N-terminal
MAHTYKLIYFDVPGKGEAIRMILSYGEIPFEDKRIQMGDWPKLKPTTPLGQLPLLEVDGKAIPQSTAICRYLASIVKLDGKDAKENLALDVALETLFDLQKMNGEIKYEQDAAKKKEKLEKLLQQGLPLYFGKLDEYAKKHNGYIAFERLSWADILFVCVYEALVNLAGKEAVASYPSLQQVKKNVLATKGINKWIKNRPAVEGYDLKQDL

SEQ ID NO: 23734 - protein, 210 aa, Diabrotica virgifera
  misc_feature: Coding regions on vcDNA: vcDNA=SeqID_3431; Strand=+; Position=134-766
  misc_feature: Homolog annotation: Hit_ID=XP_311545.1; Match level="QueryCoverage =94%, HitCoverage=90%, E-value=3e-41, Identity=41%"; Hit description =ENSANGP00000010247 [Anopheles gambiae]
  misc_feature: Gene Ontology Annotation: Molecular function=glutathione peroxidase activity; Cellular component=cellular_component unknown; Biological process=glutathione conjugation reaction
  misc_feature: Pfam annotation: Pfam_ID=GST_N; Match level="Score=76.0, E-value=1e -19, Copies=1"; Pfam description=Glutathione S-transferase, N-terminal
MAHTYKLTYFDFPGKGEAIRMILSYGEIPFEDKRIQMGDWPKIKPTTPLGQLPILEVDGKEIPQSTAISRYLASKLNLDGKDLKENLALDVAVETLLDLQKVGVGIKYEQDAAKRAENVEKSKQVLPVYFGKLEEHAKKHNGYIVFDRMSWADILFVCVYEFLVPCVGKEAVSAYPSLQQVLKNVLAAKGINKYIKNRPAVEGYDLKQDL

SEQ ID NO: 23735 - protein, 212 aa, Diabrotica virgifera
  misc_feature: Coding regions on vcDNA: vcDNA=SeqID_3432; Strand=+; Position=110-748
  misc_feature: Homolog annotation: Hit_ID=XP_311545.1; Match level="QueryCoverage =91%, HitCoverage=89%, E-value=1e-40, Identity=41%"; Hit description =ENSANGP00000010247 [Anopheles gambiae]
  misc_feature: Gene Ontology Annotation: Molecular function=glutathione peroxidase activity; Cellular component=cellular_component unknown; Biological process=glutathione conjugation reaction
  misc_feature: Pfam annotation: Pfam_ID=GST_N; Match level="Score=76.1, E-value=9.7e- 20, Copies=1"; Pfam description=Glutathione S-transferase, N-terminal
MAHTYKLIYFDVPGKGEAIRMILSYGEIPFEDKRIQMGDWPKLKPTTPLGQLPLLEVDGKAIPQSTAICRYLASIVKLDGKDAKENLALDVALETLFDLQKMNVEIKYEQDAAKKAENVEKSKQVLPVYFGKLEEHAKKHNGYIVFDRMSWADILFVCVYEFLVPCVGKEAVSAYPSLQQVLKNVLAAKGINKYIKNRPAVATSIIKLDVIK

SEQ ID NO: 23736 - protein, 53 aa, Diabrotica virgifera
  misc_feature: Coding regions on vcDNA: vcDNA=SeqID_3433; Strand=-; Position=323-484
YIFIFLLFLFHCGRTKHATKNIFYWFKYFRSIRCFKSILDVINIEYIIVLNPF

SEQ ID NO: 23737 - protein, 70 aa, Diabrotica virgifera
  misc_feature: Coding regions on vcDNA: vcDNA=SeqID_3434; Strand=+; Position=659-871
ENIRFLYFNLAFFYLTVIILLQKGILRTMFCSHKEQKTMVGQLVSPYSRHKYIRMYSPVLILRFAIVILC

SEQ ID NO: 23738 - protein, 469 aa, Diabrotica virgifera
  misc_feature: Coding regions on vcDNA: vcDNA=SeqID_3435; Strand=-; Position=467-1876
  misc_feature: Pfam annotation: Pfam_ID=Sina; Match level="Score=-67.2, E-value =0.024, Copies=1"; Pfam description=Seven in absentia protein family
VNMENSEENNTTKTKPEFLLTSEVAKKLRCSFCGLYLSYPPINMTTQDERENKVKYKCGRCSIKTRFNFRNSLYEDLATYMKFPCIYKGCSETVDLESVRDHEKDCEHRTIPCLASDCKETVLEANFASHFKEKHKKLYHSEKIFIESFRGTGFAVLEKDNVCYILFYELSVDTYRFALCGIKNNDKQFEVVLRAKNSKNSVHLTENNIVLHNDRVYCYRCLKGDCKYEYHLYSSYRRGMLKYVYAKIEKPILKRTFGSDYSCTVNVVEVKAENENDIEDLLLGKDVVIDEVTEEDEIEEEKPSEPTKADALKNFLKCPGCEIPFTEPIFQCLKGHALCKDCKDKADGDGSKCFFCDAHIDNTRNYIVEETIANLKLNKDSPSTFQDAEVVGPTSKCHQKVKLSAISTHFKESHIENFHFNKFYLKNVYGYYNVEVLVKNEKTYLLFFDFDDQQFGVRVCSIERPWRNI

SEQ ID NO: 23739 - protein, 379 aa, Diabrotica virgifera
  misc_feature: Coding regions on vcDNA: vcDNA=SeqID_3436; Strand=+; Position=98-1234
  misc_feature: Homolog annotation: Hit_ID=EAL29286.1; Match level="QueryCoverage =99%, HitCoverage=82%, E-value=1e-141, Identity=58%"; Hit description= GA10247-PA [Drosophila pseudoobscura]
  misc_feature: Gene Ontology Annotation: Molecular function=transcription factor activity; Cellular component=nucleus; Biological process=mitosis
  misc_feature: Pfam annotation: Pfam_ID=RRM_1; Match level="Score=93.7, E-value=4.8e- 25, Copies=2"; Pfam description=RNA recognition motif. (a.k.a. RRM, R
MSIEYLQVAEDEGEEPIELPTEDDGTLLLSTLSAQFPGSSGLKYKNPETKTFRGVRLSEGRLHPPPDDGWGSHIFYCVFPKENKRKSDDNLENSTAKTKRMETKLRCTDLIVLGLPWKTTEQNLREYFETFGEVLMAQVKKDPKTGQSKGFGFIRFASYESQMRVLAQRHMIDGRWCDVKVPNSKEGLIQQVPCKVFIGRCTEDLTADDLRDYFGKFGEVTDVFIPKPFRAFSFVTFLDPEVAQSLCGEDHIIKGVSVHVSNAAPKSDTRGGNYRGDRNNGLQNRGGGVGPGGPDGPGMYNQRYNGAGPNQGNWGNQGGPRGNIDMPNLQALGITGQGQQGNNQGNCNPLGMGLNALGALPMNPAIVAAALNQAGWGLI

SEQ ID NO: 23740 - protein, 292 aa, Diabrotica virgifera
  misc_feature: Coding regions on vcDNA: vcDNA=SeqID_3437; Strand=+; Position=55-930
  misc_feature: Homolog annotation: Hit_ID=EAA14589.2; Match level="QueryCoverage =89%, HitCoverage=40%, E-value=2e-60, Identity=56%"; Hit description =ENSANGP00000018634 [Anopheles gambiae str. PEST] ref|XP_553944.1| ENSANGP00000018634 [Anopheles gambiae st
MGEETSTSVEVNTDYTPPKFFRINRSLLLLKSTLFFLHGATSSLVPYLTIHMQSIGLSMEQIAIIYLCLPFTTFLAPPATGYLVDKFGKYKPVVIGCFILTAILHHSLLFMPHQETPGTVPSGYIIRHPKKMYVEVWWSPCPSRECPDDEELDLVLDFCMDHCLLKEAKQAKNKKLIKANPPKRPCDDEDPGDKDDLNFHIKKKQRNDTATAFTLDMHPNLGDPVEQFGIEIEDEDDEDVTDFKKRFRLGMLKRHGVDINELETKDLRCGGIVLEANGTTRSLLPNILMIAF

SEQ ID NO: 23741 - protein, 91 aa, Diabrotica virgifera
  misc_feature: Coding regions on vcDNA: vcDNA=SeqID_3438; Strand=+; Position=67-342
  misc_feature: Homolog annotation: Hit_ID=EAA08876.2; Match level="QueryCoverage =95%, HitCoverage=95%, E-value=4e-15, Identity=45%"; Hit description =ENSANGP00000011072 [Anopheles gambiae str. PEST] ref|XP_562410.1| ENSANGP00000011072 [Anopheles gambiae st
MEKNLEHSMGQLINTPGVYGCVFADRHGLCLGMKGETSTNSAGIIGAIAEEALKIEPNSKPPVIHFENDNRSCTIQRIGTITGAIFKNLQN

SEQ ID NO: 23742 - protein, 310 aa, Diabrotica virgifera
  misc_feature: Coding regions on vcDNA: vcDNA=SeqID_3439; Strand=+; Position=68-995
  misc_feature: Homolog annotation: Hit_ID=NP_725652.1; Match level="QueryCoverage =95%, HitCoverage=54%, E-value=1e-102, Identity=59%"; Hit description= CG8946-PB, isoform B [Drosophila melanogaster] ref|NP_652032.1| CG8946-PA, isoform A [Drosophila
  misc_feature: Gene Ontology Annotation: Molecular function=sphinganine-1-phosphate aldolase activity; Cellular component=cellular_component unknown; Biological process=cellular response to starvation
  misc_feature (295)..(295): Xaa can be any naturally occurring amino acid
MDYLSVPINALKGTLNNHFQGKEAWQIVTSTTTTVLLSVWFYGFLFQDESLTERTKKTVFRLARRIPAIRRKIETELDTIAKSFEDDIKKSTSTVTYITELPQKGLTNDELIQCLDQNLSLGEYNWKGGKVSGAVYFYNQDLINLISGIYGKTAYTNPLHPDLFPGVCKMEAEVIRIASNLFHGDENVVGSMTSGGTESILMACKAYRDYAREVKGIKKPEIVVPTTVHSAFDKAAQYLKLKVRSIPVDPQTYQVNITKFRRAINSNTILLVGSAPNFPYGTMDNITAISEMGVXKYGIPVHVDSCLGGF

SEQ ID NO: 23743 - protein, 454 aa, Diabrotica virgifera
  misc_feature: Coding regions on vcDNA: vcDNA=SeqID_3440; Strand=+; Position=63-1424
  misc_feature: Homolog annotation: Hit_ID=NP_609305.1; Match level="QueryCoverage =98%, HitCoverage=71%, E-value=1e-167, Identity=63%"; Hit description= CG4364-PA [Drosophila melanogaster] gb|AAF52800.1| CG4364-PA [Drosophila melanogaster]
  misc_feature: Gene Ontology Annotation: Molecular function=molecular_function unknown; Cellular component=nucleolus; Biological process =embryogenesis and morphogenesis
  misc_feature: Pfam annotation: Pfam_ID=Pescadillo_N; Match level="Score=547.6, E -value=1.1e-161, Copies=1"; Pfam description=Pescadillo N-terminus
MVSKRKKKYTSGEGAQFMTRKAALKKLQLSLNDFRKLCILKGIYPREPRNRKRAQKGKAGIKTLYHVKDIQFLLHEPIIWRLRDYKIFNKKVGRARAVKDFEKLNKFLNNHPTLKLDHIVKERYPTFMDALKDLDDCLTLCFLFSTFPSLAHVPRDQSALCRRLTLEFLHAVVEGKALRKVFISIKGIYFQAEFKGQTITWVTPHHFSFTPQSKAEVDFKLMSTFVEFYTVMLGFVNFRLYHSLNLYYPPKFTAVQQSSSEKMLVDEDIFVSERVAALNFSLSKTSNEALEDDLEIDNFNADGSEVNEEKLEEIRKEAEQIKKLKTLFKGLKFFLNREVPREPLVFVIRCFGGEVSWDKTMFVGSTFNEDDECITHQIVDRPSMEKQFISRYYVQPQWVFDSGNARDLLPVQKYFMGGVLPPHLSPFIDKERDQQYIPPEARALYNENRIRKST

SEQ ID NO: 23744 - protein, 208 aa, Diabrotica virgifera
  misc_feature: Coding regions on vcDNA: vcDNA=SeqID_3441; Strand=+; Position=74-700
  misc_feature: Homolog annotation: Hit_ID=NP_010247.1; Match level="QueryCoverage =53%, HitCoverage=33%, E-value=9e-10, Identity=40%"; Hit description =Bsc1p [Saccharomyces cerevisiae] emb|CAA98596.1| unnamed protein product [Saccharomyces
  misc_feature: Gene Ontology Annotation: Molecular function=molecular_function unknown; Cellular component=cellular_component unknown; Biological process=biological_process unknown
  misc_feature: Pfam annotation: Pfam_ID=CBM_14; Match level="Score=32.2, E-value =1.6e-06, Copies=1"; Pfam description=Chitin binding Peritrophin-A domain
MYTINVLVIVFLCIGLCQGYFKIIADDGDLTCRPSGVECLTASTFTTCTNIGSVASLHAILRCPDGYHCDDSTSIPCKPSTEGSTTSSTITSSSTEISSSTSTRTTDTPNSTSSTITSSSTEEDITTSSTVIDTSTTKKKVPRPSGPPQCTAVGLYPAPRCNQYYECVQSTYLIFWTTYTAELRTCIDGDYYDTERKQCILASLSDCE

SEQ ID NO: 23745 - protein, 62 aa, Diabrotica virgifera
  misc_feature: Coding regions on vcDNA: vcDNA=SeqID_3442; Strand=-; Position=559-747
HKIDNFYIIIGTNLKNQTRMASHYMLLKVETCAPNSNKILIVKNGATEKLKKLYGLKCCVYQ

SEQ ID NO: 23746 - protein, 403 aa, Diabrotica virgifera
  misc_feature: Coding regions on vcDNA: vcDNA=SeqID_3443; Strand=+; Position=58-1269
  misc_feature: Homolog annotation: Hit_ID=XP_318516.1; Match level="QueryCoverage =98%, HitCoverage=98%, E-value=1e-144, Identity=62%"; Hit description= ENSANGP00000021249 [Anopheles gambiae]
  misc_feature: Gene Ontology Annotation: Molecular function=NADH dehydrogenase (ubiquinone) activity; Cellular component=mitochondrial matrix; Biological process=sodium ion transport
  misc_feature: Pfam annotation: Pfam_ID=3Beta_HSD; Match level="Score=-167.9, E -value=0.0015, Copies=1"; Pfam description=3-beta hydroxysteroid dehydrogenase/i
FNIVRMAVVILTGSKLITKQPGLVAVAYIRSNNYSTEDRAYNLASLKRGTGGRSSFNGIVATVFGATGFLGRYVCNRLGKIGSQIIIPYRGDNYEPFRLKLVGDLGQVYFHPYHLRDEESIAKCIKYSNVVVNLVGRDWETRNFKFDDVHVDGARRLARLAKQAGVERFIHLSSINADENPQRAGILKGGSNFLRSKARGEEAVLEEFPEATIFRPSDVYGQEDRFVRYYAHPWRRSANYFPLWHKGERTVKQPVYVSDVTSGIINAIKDPDTAGKIYQAVGPKRYLLSDLVDYFHRIMRKDDEWGYKRYDMRWDPLFQLRVSLTEKFSINWPIGHLHWEKIEREHLTDDVKSDIPTLEDLGVNLTAVENQMPWEFKPWTWGIYRGQDPDEPVAPAAPPKALV

SEQ ID NO: 23747 - protein, 135 aa, Diabrotica virgifera
  misc_feature: Coding regions on vcDNA: vcDNA=SeqID_3444; Strand=+; Position=2-409
  misc_feature: Homolog annotation: Hit_ID=XP_317855.1; Match level="QueryCoverage =98%, HitCoverage=35%, E-value=1e-41, Identity=60%"; Hit description =ENSANGP00000014920 [Anopheles gambiae]
  misc_feature: Gene Ontology Annotation: Molecular function=flap endonuclease activity; Cellular component=nucleus; Biological process =histogenesis and organogenesis
KRAIELIQKHKSIESIIQNIDKDKYPIPENWNYEGARELFKNPEVSEADDIELKWGEPDEEELVKYLCGDKNFSEDRVRNGVKKLMKAKGGSTQGRLDGFFTVLSTTPAKRKVDDKKNTPNKRGKATGKGRGRAK

SEQ ID NO: 23748 - protein, 391 aa, Diabrotica virgifera
  misc_feature: Coding regions on vcDNA: vcDNA=SeqID_3445; Strand=+; Position=66-1238
  misc_feature: Homolog annotation: Hit_ID=XP_315558.1; Match level="QueryCoverage =87%, HitCoverage=69%, E-value=1e-104, Identity=48%"; Hit description= ENSANGP00000017711 [Anopheles gambiae]
  misc_feature: Gene Ontology Annotation: Molecular function=electron transporter activity; Cellular component=nucleus; Biological process=DNA methylation
  misc_feature: Pfam annotation: Pfam_ID=zf-C2H2; Match level="Score=130.2, E-value =5.1e-36, Copies=6"; Pfam description=Zinc finger, C2H2 type
  misc_feature (379)..(379): Xaa can be any naturally occurring amino acid
MSATFSEPPTIKLEETSENVTEIQSYLEGFQKEIVGDSVVQPSSGSEEQEVENEQEEGTYFVDQAGHYYYQAKGSTQPVMTVVPTIATSGDTDEYVINQENDEEGEDGEEQIIQQSEDNQFVISSGNAYQRVTVVPSDNNSGELSYVLIVQDPLDIKEGDQTDGEQDMTVYDFDDAEDGGVVDSDEDDKSKIVKLLPRKSQVVAQAHMCNYCNYTSPKRYLLSRHMKSHSEERPHKCSVCERGFKTLASLQNHVNTHTGTKPHACRYCDAAFTTSGELVRHVRYRHTHEKPHKCTECDYASVELSKLKRHIRCHTGERPYQCPHCTYASPDTFKLKRHLRIHTGEKPYECDICHTRFTQSNSLKGPKLTHNIGDQPLFXCDLCPTTCGRKT

SEQ ID NO: 23749 - protein, 316 aa, Diabrotica virgifera
  misc_feature: Coding regions on vcDNA: vcDNA=SeqID_3446; Strand=+; Position=80-1026
  misc_feature: Homolog annotation: Hit_ID=XP_392348.1; Match level="QueryCoverage =98%, HitCoverage=64%, E-value=1e-121, Identity=65%"; Hit description= similar to CG8745-PA [Apis mellifera]
  misc_feature: Gene Ontology Annotation: Biological process=coenzymes and prosthetic group metabolism
  misc_feature: Pfam annotation: Pfam_ID=Aminotran_3; Match level="Score=-39.7, E -value=1.8e-11, Copies=1"; Pfam description=Aminotransferase class-III
  misc_feature (266)..(266): Xaa can be any naturally occurring amino acid
  misc_feature (274)..(274): Xaa can be any naturally occurring amino acid
  misc_feature (294)..(294): Xaa can be any naturally occurring amino acid
MPLSKQESLNLRQKLIGESCQLFFRQNPLKIVRAKGQYMYDEKDDSYLDCINNVAHVGHCHPKVVKAGSEQMASLSTNNRYLHDNILLCAQRILSTMPDELSVCYFVNSGSEANDLALRLAQIHTGNKDVIALEHAYHGHLTSLIDISHYKFNLPGGVGQRDHVHVAPLPDSYRGKYRDSEYPKENIGHAYADDVREICQKVQEKGDGVCAFIAESLISCGGQVIPPKNYFNEVYDSVRSAGGVCIADEVQVGFGRIGKHWWAFHXYDVVPDIXTMGKPMGNGHPGKWVSPAPXIKESTKKNIKKYFSPTRGGENF

SEQ ID NO: 23750 - protein, 211 aa, Diabrotica virgifera
  misc_feature: Coding regions on vcDNA: vcDNA=SeqID_3447; Strand=+; Position=122-758
  misc_feature: Homolog annotation: Hit_ID=EAL32688.1; Match level="QueryCoverage =83%, HitCoverage=96%, E-value=2e-40, Identity=43%"; Hit description =GA17094-PA [Drosophila pseudoobscura]
  misc_feature: Gene Ontology Annotation: Molecular function=general RNA polymerase II transcription factor activity; Cellular component=transcription factor complex; Biological process=transcription
  misc_feature: Pfam annotation: Pfam_ID=RRM_1; Match level="Score=12.1, E-value =0.0036, Copies=1"; Pfam description=RNA recognition motif. (a.k.a. RRM, R
  misc_feature (78)..(78): Xaa can be any naturally occurring amino acid
MTEEMENSDSEPTTSIEKSKKKPKRGIIYLSTIPPYMNVAKIREFFSDFGQVGRIYLELADKELKSKDKDKPKKKRKXQKKFSEGWVEFERKYIAKQVASLLNNTQVSNRKKSKQYDCMWNIKYLSNFKWTHLHERLAYEKAARRQKLRAEIQLAKKKSNFFASNVEKTKKNKTVVNKEFENIEEKVAEQMDAEEHKEKSGDRKEFLQSLF

SEQ ID NO: 23751 - protein, 528 aa, Diabrotica virgifera
  misc_feature: Coding regions on vcDNA: vcDNA=SeqID_3448; Strand=+; Position=199-1785
  misc_feature: Homolog annotation: Hit_ID=BAA78480.1; Match level="QueryCoverage =30%, HitCoverage=30%, E-value=2e-12, Identity=32%"; Hit description =56 kDa early-staged encapsulation-inducing protein [Tenebrio molitor]
MKWLVLLSVVTLSTALPTLRGRHLSIGDDGTVTLIGSNGFEIDIFKSVTDPSIVDVILRSPRGPTRSFQIDEVNNIREVSDRNVFGYSRYHDFNQADILAQIFRQYQGSIAENQYYSLLNRIQLLVEGGVLNEAIYDVLREWNQYNLQDVSDIVPSQHRENILPINEQWNLDRETLIQPLQSTLEEIREKRQLQQELLKSGKYFDLEDENLDLLLGEKYNTDKILKLIYKEQIGQLPINPSNVLLMRPNGEDKPLDVNFVDKFVKNEDSINLKIQEFIDNKDIASPYLIFKQRLLNIEVEKFIQQLAYHQNLINRQIEQYIGQSEVIPNELVYQQRLIFKQAYPLLQKLTEDVLFINRKIIELRGKGILAEREFFVQQKINSLLSQQLIKLLLVQQIHLKQQIQSLIPKADAVSRDLVLFQQATQEQLQDTIHSLIKQLLLEQSSFKDLVEKCIQEGTAIPQEFISHYYIIHKELLQLIAQGDTIPKAIWYQQYVMHQQIVFFLKQANLMTQPIFPLQPKNLLQQLPY

SEQ ID NO: 23752 - protein, 246 aa, Diabrotica virgifera
  misc_feature: Coding regions on vcDNA: vcDNA=SeqID_3449; Strand=+; Position=3-743
  misc_feature: Homolog annotation: Hit_ID=CAE74821.1; Match level="QueryCoverage =21%, HitCoverage=42%, E-value=1e-16, Identity=68%"; Hit description =Hypothetical protein CBG22657 [Caenorhabditis briggsae]
  misc_feature: Pfam annotation: Pfam_ID=Lectin_C; Match level="Score=28.9, E-value =1.3e-06, Copies=1"; Pfam description=Lectin C-type domain
ANGGHGANGGNGGSADNGGNGGNGSNGGNGGNGSNGGNGGHGGSENKDGDDFLSKLAQTVPGNIPTVLQEGRKFHVSRDLRVTQSQARAFCAYHKLKLPDIKDFEENTVLAKLLPYPVTTGPFWVDGEKVKGKWIWKQSDEPIEYFNWAIAHVDAESKSCLGLTNVGKYESASCDQKKPFICESASDESSTAKDKGDAIINVIMTNNLINENGKVTNAKELISSQYIEVKPEGGYHITVDNNAGKC

SEQ ID NO: 23753 - protein, 377 aa, Diabrotica virgifera
  misc_feature: Coding regions on vcDNA: vcDNA=SeqID_3450; Strand=+; Position=67-1200
  misc_feature: Homolog annotation: Hit_ID=AAL29940.1; Match level="QueryCoverage =83%, HitCoverage=97%, E-value=9e-25, Identity=28%"; Hit description =lectin 1 [Girardia tigrina]
  misc_feature: Gene Ontology Annotation: Molecular function=transmembrane receptor activity; Cellular component=cell surface (sensu Magnoliophyta); Biological process=pinocytosis
  misc_feature: Pfam annotation: Pfam_ID=Lectin_C; Match level="Score=177.7, E-value =2.4e-50, Copies=2"; Pfam description=Lectin C-type domain
MLGRCRLSLIFFSLFVCLNAAKLEKGWEDVFGNNPSSTLPVHKVGNKNYVVVTNTRLNFLQAMDFCENLHMNLVTIESAEENKAVEKFITDANGGNEYWTAGTRLLDGKTWLWFTTGDVIQYSAWNAGEPSGGNEYCLITIKSNNGLVWNDVKCDLEYPFVCERPIDEKREDLFANEEKDWQNILNVHKNQPNLDLLHVNGKEFYISQEYRGNYYEALDYCQVHNMRLASIDSKEENDRLYRHIRDISAGTDFWSSGTRLLDGRNWVWLPKGLPVGYTNWGPGQPDNNNDHCIRLHLDKNNGLFWDDINCNNVNRVICERSAGGNGANGGHGANGGNGGNAGNGRNGRNGMRKLVIATRKWGTWWQQCYAGLGNNVN

SEQ ID NO: 23754 - protein, 693 aa, Diabrotica virgifera
  misc_feature: Coding regions on vcDNA: vcDNA=SeqID_3451; Strand=+; Position=167-2248
  misc_feature: Homolog annotation: Hit_ID=XP_311440.1; Match level="QueryCoverage =94%, HitCoverage=90%, E-value=1e-176, Identity=48%"; Hit description= ENSANGP00000018533 [Anopheles gambiae]
  misc_feature: Gene Ontology Annotation: Molecular function=sulfate transporter activity; Cellular component=integral to plasma membrane; Biological process=sulfate transport
  misc_feature: Pfam annotation: Pfam_ID=Sulfate_transp; Match level="Score=301.6, E -value=1.3e-87, Copies=1"; Pfam description=Sulfate transporter family
MSVPGTPEIRIQRPLYENDQLRQDLNYEKDQTNFVNKLCKEKVSPKSIIKSTIPVLGWLPKYEWRTDILSDLASGYTVAIMHIPQGMAYALLGNVPPVVGIYMAIFPVLVYFFLGTSRHVSMGTFSIACLMTGKAVLEHADPSYFDTTNTNSTDVVIRGMGYSPVQVATTVTFIVSIIQLLMFALRLGAATNLLSDMLVSAFTCGSAFQIVVTQIKDLLGITMPKIKGNFLTIKILKVIFEEIGQTNYAAVIISAITIVVLIFNNEFLKQLVAKKSSIPIPIELIVVIIGTVSSQYLDFHKNYGIKIVGDIPTGFPQPEMPPLDLVPSVLVDGVSTAIVSYAISMSLAMILAQKANYEVDANQELLAMGVSNAVGSFFSCMPLCASLSRSMIQQVVGGKTQIRSIVSSMLLIVTVLWIAPFFESLPKAVLAGIIVVSLKGMLVQVTQLVSYYKLSKFDALVWITTFVSVVFISMEIALMVGISLSLLSIFIASFKPYTCLLGSVPHTDLYLDMNRYKGAKEIEGLKIFHYCGGINFATKGIFKTELYRLINLNPQKELISREKLDKIMNKDLPPTEFKEKVKKLESKINRDLKCIILDFSSVICLDPCSVTMLRNEMAEFKKLDITFYVAACSDDIYNLLNKCGLLSKEKESLRVFPSIHDAVQAASHAMNIPIELQILPIVLPNIMIENEES

SEQ ID NO: 23755 - protein, 72 aa, Diabrotica virgifera
  misc_feature: Coding regions on vcDNA: vcDNA=SeqID_3452; Strand=-; Position=186-404
RSNNRPLIRHFLTNWSVPAIGFPLRNRRNSKKHKIFCTILMEVQLLTCVQSTHTHILFFCINKSKNIYIKTI

SEQ ID NO: 23756 - protein, 123 aa, Diabrotica virgifera
  misc_feature: Coding regions on vcDNA: vcDNA=SeqID_3453; Strand=+; Position=67-438
  misc_feature: Homolog annotation: Hit_ID=NP_649128.1; Match level="QueryCoverage =73%, HitCoverage=72%, E-value=1e-24, Identity=52%"; Hit description =CG9231-PA [Drosophila melanogaster] gb|AAF49143.1| CG9231-PA [Drosophila melanogaster]
  misc_feature: Pfam annotation: Pfam_ID=DUF1075; Match level="Score=-3.8, E-value =2.2e-05, Copies=1"; Pfam description=Protein of unknown function (DUF1075)
MNYISNFFAKTQRLKPTTLVRFTHSLESSHKVNNLEKKFLVWTGKYKNVAEVPPYVTQSTMERCRNRMRIKIANYMMAATAVGCLAMVYLGKQDAKKGKTLSQENKDWHAKIKAEHEAKKDNA

SEQ ID NO: 23757 - protein, 748 aa, Diabrotica virgifera
  misc_feature: Coding regions on vcDNA: vcDNA=SeqID_3454; Strand=+; Position=123-2364
  misc_feature: Homolog annotation: Hit_ID=NP_723591.1; Match level="QueryCoverage =96%, HitCoverage=66%, E-value=0.0, Identity=54%"; Hit description =CG6206-PB, isoform B [Drosophila melanogaster] gb|AAN10754.1| CG6206- PB, isoform B [Drosophila
  misc_feature: Gene Ontology Annotation: Cellular component=Golgi membrane
  misc_feature: Pfam annotation: Pfam_ID=Glyco_hydro_38; Match level="Score=465.1, E -value=7.5e-137, Copies=1"; Pfam description=Glycosyl hydrolases family 38 N-termi
  misc_feature (383)..(383): Xaa can be any naturally occurring amino acid
MMKKELVILLTLLTTYVTSHPPATSTKPAPAVSNCGYDSCHPVKGGDFINVHIVPHTHDDVGWLKTVDQYFYGSKTLIQNAGVQYILDSVIDSLRKDPNRRFIYVETAFFWKWWIKQHDTVKSQVRKFVNNGQLEFISGGWSMNDEAATHYQSIIDQMTWGLRKLNDSFGECGRPKMGWQIDPFGHSREMASIFAQLGFDGLLLGRIDYQEKDFRLSTKTAEVVWRSSQNLGEKSNIFTGSMFNVYSPPRGFCFDLLCSDEPIIDDKKSPDYNVDERVNEFFRVLDNMTSVYDTHNLIITMGEDFNYQDAATWFKNLDKLISYANLRQSNGSRYNLIYSTPSCYVKAIYDETKGKKKWYVKQDDFFPYASDPHAFWTGYFTSXRPTLKRFEREGNNFLQVCKQLYSLADLDPVDRVDLNALREAMGVMQHHDAITGTEKQHVANDYARILSNGIKECEWITATALSKIVAPNMRSYLRDEPVPTIPFTTCPLANISQCAFTETNNDFVITVYNPLSRPVSKHVRVPVVGNKYTVKDPQGATVVTQIIPVPASLLRIPGRKSLAENELVFKAVDIPALGFKSYFIQKYESNDIPKGIPKGRSIDESPNTEFDIDPDTGMITEISINGHSINFTQDFLYYQGYVGDNEKFINRSSGAYIFRPYGDPFKVATKASFKVTRGPVVTEVHQTFNDWISQVIRVYEEENVIEFNWLVGPIPIDDVHGKEIITRYKTSIKSNATFYTDSNGRETL

SEQ ID NO: 23758 - protein, 301 aa, Diabrotica virgifera
  misc_feature: Coding regions on vcDNA: vcDNA=SeqID_3455; Strand=+; Position=90-995
  misc_feature: Homolog annotation: Hit_ID=CAH64516.1; Match level="QueryCoverage =95%, HitCoverage=51%, E-value=3e-83, Identity=52%"; Hit description =putative esterase [Tribolium freemani]
  misc_feature: Gene Ontology Annotation: Molecular function=carboxylesterase activity; Cellular component=extracellular space; Biological process= cholesterol catabolism
  misc_feature: Pfam annotation: Pfam_ID=COesterase; Match level="Score=117.4, E -value=3.5e-32, Copies=1"; Pfam description=Carboxylesterase
MILYYITFVFVLGVVICKESPPPTVTLPLGVVEGYIKKTVNGKEFNAFEGVPYASPPVGDLRFEKPVPVKPWTGIWKAETIMRCIQYDHMTPAGQDMVSGTEDCLYVNIYTPKKQSSKKLNVLLYIHGGAFMFNHGGLYGSEMIMDRDVIYVTINYRLGPLGFLSTEDNVIPGNGGMRDQILALKWIKDNIEYFGGNPDSITIMGMSAGGASVHTHYITPHSKGLFAKGFSQSGCVLNPWVLMEEPLNHAKKVASLVGCPTESNEEMVNCLKTKPAKQIVNTVKHFQPWLYNPFSSIRFGY

SEQ ID NO: 23759 - protein, 285 aa, Diabrotica virgifera
  misc_feature: Coding regions on vcDNA: vcDNA=SeqID_3456; Strand=+; Position=34-886
  misc_feature: Homolog annotation: Hit_ID=NP_004716.1; Match level="QueryCoverage =99%, HitCoverage=86%, E-value=1e-113, Identity=68%"; Hit description= BUB3 budding uninhibited by benzimidazoles 3 isoform a [Homo sapiens] gb|AAH22438.1| BUB3
  misc_feature: Gene Ontology Annotation: Molecular function=structural molecule activity; Cellular component=kinetochore; Biological process=mitotic checkpoint
  misc_feature: Pfam annotation: Pfam_ID=WD40; Match level="Score=79.2, E-value=1.1e -20, Copies=5"; Pfam description=WD domain, G-beta repeat
  misc_feature (261)..(261): Xaa can be any naturally occurring amino acid
  misc_feature (264)..(264): Xaa can be any naturally occurring amino acid
  misc_feature (275)..(275): Xaa can be any naturally occurring amino acid
MKSQTEYKLKSAPEDAISAVKFGPNTNQFLLVSSWDGYVRLYDVIANNMRHKYAHDDAAVLDCCFTDAVHSYSGGLDAVLKSFDFNSTKESSVGNHAAPIKCVEYCSEINAIITGSWDHHVKLWDPRQHACSGSYNQGERVYTMSVCGEKLVVGTAGRKILVWDIRNMSYTLQKRESNLKYQTRAIRCFPNKQGYVLSSIEGRVAVEYLDTNPEVQKKKYAFKCHRIKEDGLEKIYPVNAISFHPIHNTFATGGSDGYVIXWDXFHKKRLCQFHXYHTSVTSLSS

SEQ ID NO: 23760 - protein, 169 aa, Diabrotica virgifera
  misc_feature: Coding regions on vcDNA: vcDNA=SeqID_3457; Strand=+; Position=260-769
  misc_feature: Homolog annotation: Hit_ID=NP_650867.1; Match level="QueryCoverage =100%, HitCoverage=100%, E-value=7e-76, Identity=78%"; Hit description=CG5023-PA [Drosophila melanogaster] gb|AAG22158.1| CG5023-PA [Drosophila melanogaster]
  misc_feature: Gene Ontology Annotation: Molecular function=actin binding; Cellular component=intercellular junction; Biological process=cytoskeleton organization and biogenesis
  misc_feature: Pfam annotation: Pfam_ID=CH; Match level="Score=90.0, E-value=6.2e -24, Copies=1"; Pfam description=Calponin homology (CH) domain
MAKRNKDVEAEVLNWIFGCLGEPVPKGEFEDILKDGVVLCNLMNKLTPGCIKKIQSKGTNFQLMENIQRFQAAAKKYGLPEEEIFQTADLFERRNIAQVAISLFSLGRITQKHPEWNGPTLGPKMAEENKRTFTEEQLRAHEGQLNLQMGFNKGASQSGHGGFGNTRHM

SEQ ID NO: 23761 - protein, 417 aa, Diabrotica virgifera
  misc_feature: Coding regions on vcDNA: vcDNA=SeqID_3458; Strand=+; Position=151-1401
  misc_feature: Homolog annotation: Hit_ID=XP_310955.1; Match level="QueryCoverage =94%, HitCoverage=93%, E-value=1e-127, Identity=58%"; Hit description= ENSANGP00000019418 [Anopheles gambiae]
  misc_feature: Pfam annotation: Pfam_ID=AIRC; Match level="Score=157.6, E-value=2.8e- 44, Copies=1"; Pfam description=AIR carboxylase
  misc_feature (44)..(44): Xaa can be any naturally occurring amino acid
  misc_feature (60)..(60): Xaa can be any naturally occurring amino acid
  misc_feature (83)..(83): Xaa can be any naturally occurring amino acid
KQDNYVLSVPVYYILISKDRSTAGYGVKAHDWDGIPVISYKTNXEKIFEILYEQSGMKTXAYVKSVSDYAFLSKRCEMIPIEXVTRRLATGSFLRRHPGVKERFRFTPVKHETFFKKEHTYRLNISCWYHVTSRAMSRMTCNGKHEVDLMTKTSIIVFEILEKVWATRNCALIDMKIEFGVDDQGNLLVADVIDSDSWRLWPSGDKRLMVDKQVYRNLTTVTDKDLDTVKRNFEWIADQLDHLIPPNNHLVVIIMGSPADKDHCNKIKQQCEDLGLNVEIRVASAHKTTDFALELVSYYEGMNIPLIFIAVAGRSNGLGPVISGNTDYPVINCPPGSRDDLSRDIWSSVNVPSGLGCSTVIYPETAALCAATNIAMTNYIVWSRLRLRRLGYFESLQKPIGNEKYFKVFDVYILKYV

SEQ ID NO: 23762 - protein, 53 aa, Diabrotica virgifera
  misc_feature: Coding regions on vcDNA: vcDNA=SeqID_3459; Strand=-; Position=559-720
FCSLIYLARHQLTKCFLHYIKAMTKYLAQTFIDLAVYLNFTICAICVFCFKAI

SEQ ID NO: 23763 - protein, 330 aa, Diabrotica virgifera
  misc_feature: Coding regions on vcDNA: vcDNA=SeqID_3460; Strand=+; Position=97-1086
  misc_feature: Homolog annotation: Hit_ID=EAA06482.3; Match level="QueryCoverage =100%, HitCoverage=77%, E-value=1e-134, Identity=68%"; Hit description=ENSANGP00000019418 [Anopheles gambiae str. PEST] ref|XP _566221.1| ENSANGP00000019418 [Anopheles gambiae
  misc_feature: Gene Ontology Annotation: Biological process=purine nucleotide metabolism
  misc_feature: Pfam annotation: Pfam_ID=SAICAR_synt; Match level="Score=313.6, E -value=3.1e-91, Copies=1"; Pfam description=SAICAR synthetase
  misc_feature (325)..(325): Xaa can be any naturally occurring amino acid
MASVKEIGGYKLGNLIIEGKTKQVYDVPSVPGHCILLSKDRITAGDGVKAHDLAGKSVISNKTNGKVFEILRKVGMKTAYVKSVSDNAFLSKKCEMIPIEWVTRRLATGSFLRRHPGVKEGFRFTPVKHETFFKDDANHDPQWSEEQIISAEFKVNGVVIGKHEVDLMTKTSIIVFEILEKVWATRNCALIDMKIEFGVDDQGNLLVADVIDSDSWRLWPSGDKRLMVDKQVYRNLTTVTDKDLDTVKRNFEWIADQLDHLIPPNNHLVVIIMGSPADKDHCNKIKQQCEDLGLNVEIRVASAHKTTDFALELVSYYEGMNIPLXFIAVA

SEQ ID NO: 23764 - protein, 335 aa, Diabrotica virgifera
  misc_feature: Coding regions on vcDNA: vcDNA=SeqID_3461; Strand=+; Position=21-1025
  misc_feature: Homolog annotation: Hit_ID=EAA00819.2; Match level="QueryCoverage =93%, HitCoverage=75%, E-value=1e-31, Identity=29%"; Hit description =ENSANGP00000011548 [Anopheles gambiae str. PEST] ref|XP_551263.1| ENSANGP00000011548 [Anopheles gambiae st
  misc_feature: Gene Ontology Annotation: Molecular function=molecular_function unknown
  misc_feature: Pfam annotation: Pfam_ID=DUF227; Match level="Score=64.9, E-value =2.2e-16, Copies=1"; Pfam description=Domain of unknown function (DUF227)
MIPKDILDLLEESLGEKIENFKIQEHEGNQKGQGHLGEIVFLSLKNKNTGEDHHLVVKQCLTGSEETRKLMSMCFKNEVHFYKKVVPALQAFQKSYPRAEIFSHLPKCFATSSKGGKEKLVMENLKLQGYKVHPKKVPLNSKMYETIFKTYGKFHGISYAFKHYHPDQVTELGKGYQSTMKMFFDRGFMQQAITGCCNKTKEFLEEEGEIKILDSFKKYCDNGPQMFLDALDYKSPYSIFIHGDCWSNNMMFKYNKAGEIEDIKLFDFQLATVASPVLDLTYSFYSGADEESLSKLDHFLEIYYKSLSDTLKEYGCIAEKILPFTELKKEWKEQN

SEQ ID NO: 23765 - protein, 307 aa, Diabrotica virgifera
  misc_feature: Coding regions on vcDNA: vcDNA=SeqID_3462; Strand=+; Position=25-948
  misc_feature: Homolog annotation: Hit_ID=EAA00819.2; Match level="QueryCoverage =94%, HitCoverage=70%, E-value=5e-25, Identity=26%"; Hit description =ENSANGP00000011548 [Anopheles gambiae str. PEST] ref|XP_551263.1| ENSANGP00000011548 [Anopheles gambiae st
  misc_feature: Gene Ontology Annotation: Molecular function=molecular_function unknown
  misc_feature: Pfam annotation: Pfam_ID=DUF227; Match level="Score=44.7, E-value =2.7e-10, Copies=1"; Pfam description=Domain of unknown function (DUF227)
MIPKDICDLVEESLNDEKIENFEIEEHEGNQKGQGHLGEIVFLSLKHKNTGKEHHLVVKQCLTGSEETTKLMSMCFNNEVHFYKNVIPALEAFQKSYPKAEIFSHIPRCFATSSKKGKEKLVMENLKIEDYIIHPKKVPLNSKMYEIIFKTYGKFHGISSAFKHYHPEQVSELGKGYQSTLKTFFDGGLMQKAIIGNCNKIKEFLEEEDEIKILDSFKKYCDNGPQMFLDALDYKSPYSILIHGDSWSNNMMFKYNKSGEIEDIKLFDFQLATVASPVLDLTYSFYSGADEEAYLRWIISLNIFPKP

SEQ ID NO: 23766 - protein, 355 aa, Diabrotica virgifera
  misc_feature: Coding regions on vcDNA: vcDNA=SeqID_3463; Strand=+; Position=158-1225
  misc_feature: Homolog annotation: Hit_ID=S27163; Match level="QueryCoverage=98%, HitCoverage=63%, E-value=1e-108, Identity=52%"; Hit description =alpha,alpha-trehalase (EC 3.2.1.28) - yellow mealworm dbj|BAA01951.1| trehalase precursor
  misc_feature: Gene Ontology Annotation: Molecular function=alpha,alpha-trehalase activity; Cellular component=extrinsic to plasma membrane, GPI -anchored; Biological process=trehalose catabolism
  misc_feature: Pfam annotation: Pfam_ID=Trehalase; Match level="Score=155.4, E-value= 1.2e-43, Copies=1"; Pfam description=Trehalase
MGHHVTVLLAIAFIASTVYANSIPSCDSTIYCQGKLLHTIQMARLFPDSKTFVDMQQKHPAQVTLQNFEQLMSDKKDNPSREDLIKFVNDNFESTGELVDWTPPDLNKNPKFLRRIDDPRVKNFAQSLVNVWPKLARKVSDSVREHADQHSLIDIPNGFIIPGGRFKEIYYWDSYWIVEGLLVSEMTETVRGVLENFLSIVERFGFIPNGARVYYLNRSQPPLLAMMMGKYIDQTGNKTWLEKHVDTLEKEMNWWWSERKVTVKKDGANYDMFMYAVKSDTPRPESYYEDIITCQNFTESEQKACYRNLKSGAESGWDFSSRWLYNDDRNPSTNLSQIDIIDVIPVDLNAILCRA

SEQ ID NO: 23767 - protein, 105 aa, Diabrotica virgifera
  misc_feature: Coding regions on vcDNA: vcDNA=SeqID_3464; Strand=+; Position=8-371
  misc_feature: Homolog annotation: Hit_ID=BAD04856.1; Match level="QueryCoverage =80%, HitCoverage=7%, E-value=7e-12, Identity=43%"; Hit description =reverse transcriptase [Takifugu rubripes]
  misc_feature (38)..(38): Xaa can be any naturally occurring amino acid
MRTMEQSLEWQIKLYVNFIDFEKAFDRVERKALWKLLXKYGMPPKYITIIKLFYKRSTARIVHEGKFFFLWKQIDIGTGVRQGCMLSPTLFLIVIDWIMFKAISK

SEQ ID NO: 23768 - protein, 304 aa, Diabrotica virgifera
  misc_feature: Coding regions on vcDNA: vcDNA=SeqID_3465; Strand=-; Position=45-959
  misc_feature: Homolog annotation: Hit_ID=EAL29569.1; Match level="QueryCoverage =31%, HitCoverage=85%, E-value=7e-19, Identity=47%"; Hit description =GA16877-PA [Drosophila pseudoobscura]
  misc_feature: Pfam annotation: Pfam_ID=Chitin_bind_4; Match level="Score=82.3, E -value=1.3e-21, Copies=1"; Pfam description=Insect cuticle protein
MHLQYSVSLLFGLFMFCSGGQLDDSKNARILKFDYDDSGKGPYRFGYETSNGISREESSEVHYPGTKHEFLKVTGMFAYPGPDGVMYEVRYTADDQGFHPEGDHIKVPPFVPWIHHHSEDGSDGSDNNNIPDSGTDQQVINFVQTTARPSTEYLPSSTPTSTTYLPPTSSTPQPEYSSSNVNSIGIKSGNFAHSKAVPDGFAKSSNIDTLFTSRLNSVLPSDVNNLRSNVDNTQMFLQNLGTTPNPIMLPQPTLLDSLKSSPLMALVSNPQILKDLSPNAPITPVIIMPNMVLSSIQNNSPKPH

SEQ ID NO: 23769 - protein, 458 aa, Diabrotica virgifera
  misc_feature: Coding regions on vcDNA: vcDNA=SeqID_3466; Strand=+; Position=108-1483
  misc_feature: Homolog annotation: Hit_ID=XP_309498.1; Match level="QueryCoverage =100%, HitCoverage=64%, E-value=0.0, Identity=79%"; Hit description =ENSANGP00000021966 [Anopheles gambiae]
  misc_feature: Gene Ontology Annotation: Molecular function=ATPase activity; Cellular component=spliceosome complex; Biological process=mRNA splicing
  misc_feature: Pfam annotation: Pfam_ID=Helicase_C; Match level="Score=56.6, E-value= 7.1e-14, Copies=1"; Pfam description=Helicase conserved C-terminal domain
  misc_feature (417)..(417): Xaa can be any naturally occurring amino acid
  misc_feature (423)..(423): Xaa can be any naturally occurring amino acid
  misc_feature (430)..(430): Xaa can be any naturally occurring amino acid
  misc_feature (434)..(434): Xaa can be any naturally occurring amino acid
MSKRRIDVMDPFIKKKREERGISTAVTTTSVSVNPYSGLPFTQKYHELFRKRICLPVFEYRADFMRLLSDHQCIVLVGETGSGKTTQIPQWCVEYSRTVGQKGVCCTQPRRVAAMSVAQRVSEEMDVALGQEVGYSIRFEDCSSAKTILKYMTDGMLLREGMSDPMLDAYQCILLDEAHERTLATDILMGVLKEVIKQRKDLKLVIMSATLDAGKFQHYFDNAPLMNVPGRTHPVEIFYTPEPERDYLEAAIRTVIQIHMCEEIAGDILLFLTGQEEIEVACKRIKREIDNLGPEVGELKCIPLYSTLPPNLQQRIFEDPPPNKANGAIGRKVVVSTNIAETSLTIDGVVFVIDPGFAKQKVYNPRIRVESLLVSPISKASAQQRAGRAGRTKPGKCFRLYTEKAFKNEMQDNTYPXILRSNXGSVVLQXKKLXIDDLVHFDFMDPPAPRTLMRALEL

SEQ ID NO: 23770 - protein, 71 aa, Diabrotica virgifera
  misc_feature: Coding regions on vcDNA: vcDNA=SeqID_3467; Strand=+; Position=154-369
VLPRTYHEILKPPYNNTRARPHREKQSIGDQPGLFPHFLFFEYLQLLSNSFEYLQLLSTSLPLLYLQQDSC

SEQ ID NO: 23771 - protein, 121 aa, Diabrotica virgifera
  misc_feature: Coding regions on vcDNA: vcDNA=SeqID_3468; Strand=+; Position=612-977
QPDKRSSCLVIQVFGLNDLFLLIPIGIKTPPRISCFFFFDIGRLVVTPHCVFFSTYHEILKPPYNNTKARPHREKQSIGDQPGLFPHFLFFEYLQLLSNSFEYLQLLSTSLPLLYLQQDSC

SEQ ID NO: 23772 - protein, 303 aa, Diabrotica virgifera
  misc_feature: Coding regions on vcDNA: vcDNA=SeqID_3469; Strand=+; Position=39-946
  misc_feature: Homolog annotation: Hit_ID=XP_314731.1; Match level="QueryCoverage =98%, HitCoverage=41%, E-value=1e-115, Identity=67%"; Hit description= ENSANGP00000013143 [Anopheles gambiae]
  misc_feature: Gene Ontology Annotation: Molecular function=molecular_function unknown; Cellular component=actin filament; Biological process=cell organization and biogenesis
  misc_feature (294)..(294): Xaa can be any naturally occurring amino acid
HKTNNNKTMVRHNNQLPNNLPQLQNLIKRDAVSYHEEFMQQLKHFHNTLEVFKLAPNQNNKTLDELVMFLAQVAQCYTKELEKFPQLLIDLLQSHNTALDNNTRMTLCRALILLRNKKLLAPTDLLELFFQLLRCQDKSLRSFLENHIITDIKNINSKHKNAKLNTTLQNFMFTMLKDTNTRAAKMSVDIMIELYKKNIWNDVKTVNVIATGCFSKITKVMVTCLKFFLGKDPDEKDSDDSDSDNEVDPKEVMMANKFNKKTRKREKQLDKVKKLAKKAQKKKSQGPAFNFSAXHLLHDPQGM

SEQ ID NO: 23773 - protein, 167 aa, Diabrotica virgifera
  misc_feature: Coding regions on vcDNA: vcDNA=SeqID_3470; Strand=+; Position=3-503
  misc_feature: Homolog annotation: Hit_ID=CAA77014.1; Match level="QueryCoverage =98%, HitCoverage=43%, E-value=6e-45, Identity=49%"; Hit description =chitinase [Phaedon cochleariae]
  misc_feature: Gene Ontology Annotation: Molecular function=chitinase activity; Cellular component=extracellular space; Biological process=response to bacteria
  misc_feature: Pfam annotation: Pfam_ID=Glyco_hydro_18; Match level="Score=4.6, E -value=1.1e-06, Copies=1"; Pfam description=Glycosyl hydrolases family 18
RVQNQSLKKGNFTELLQKLSKVLKPQAYLLTHASPVTIEKIDEAYDIPAISKLLDLINVMVFDFHGAFDNYVGHISPLFPAKVDYDYYNNKTYNVDTGIQYWLNGGADPAKLNLGVVAYGRTFTLADKNNTALYAPVKGGSTVGPYTQQSGYLGYNEICRYYTDSTY

SEQ ID NO: 23774 - protein, 169 aa, Diabrotica virgifera
  misc_feature: Coding regions on vcDNA: vcDNA=SeqID_3471; Strand=+; Position=22-531
NSDISSSVARAVELKSNFHTSSNFVFVSSSSFIQRKNSNMSKFVVLLACLAVVGYASALECYFCDDCQGSPSSWPKRACGTVQPAAGMEWACSRIDYKSRATYKDAVDRGCAAVPKVNGKLNFNCPTTKGEPKSCAACQQDLCNSAPSIQFSFVALASVVLAVIVPKLL

SEQ ID NO: 23775 - protein, 165 aa, Diabrotica virgifera
  misc_feature: Coding regions on vcDNA: vcDNA=SeqID_3472; Strand=-; Position=12-509
AHINKIYYSRFGQPSCSLKKLSVLWNKSASEPHQSFLGNFHDHGNTVQELDALGSGSFSSADLGSSIFAASVGLGSSRGFSGSGSFSNLPSGSLGPSIGFSSATGTNSTGLISAGCCSKDFPSLGLASSTFCTFCSSGLGSSDLAFFSPSGFSSGFTGRVSRTSV

SEQ ID NO: 23776 - protein, 342 aa, Diabrotica virgifera
  misc_feature: Coding regions on vcDNA: vcDNA=SeqID_3473; Strand=+; Position=119-1147
  misc_feature: Homolog annotation: Hit_ID=EAA70400.1; Match level="QueryCoverage =93%, HitCoverage=24%, E-value=4e-18, Identity=25%"; Hit description =hypothetical protein FG10084.1 [Gibberella zeae PH-1] ref|XP _390260.1| hypothetical protein FG10084.1 [Gib
  misc_feature: Gene Ontology Annotation: Molecular function=structural constituent of muscle; Cellular component=sarcomere; Biological process=striated muscle contraction
MKLIVGLLLIATALAYPVAENEEKLAQPVIAQDAKPAEQELPLPDQLLPTSEKLLPQKQEPLPASSDSSSESSSESSDESGEKKSSSESSSSEKESSEVKIQEKKLAEPLPAIKEPIKEEVRPIDPLPVLKPSEPAQPDVLPEEPKLIDPVVPQIAAKAIPAEPEEKPLALPTLVAEEKPAEQAPKLVATEIKEDKILLSEQKVEASPVAEEKLPELKKAEEPAPQLEGKSVLELPEEKPQPAQPEGKLEPVQPVLAAVPAVELEVKPEEKPEGEKKAKSEEPKPEEQKGQKVEKAKPSEGKSFKSNNPAKNKLLHEIYHPETKKNRPRQPPQAQLKKRNFT

SEQ ID NO: 23777 - protein, 291 aa, Diabrotica virgifera
  misc_feature: Coding regions on vcDNA: vcDNA=SeqID_3474; Strand=+; Position=141-1016
  misc_feature: Homolog annotation: Hit_ID=XP_392951.1; Match level="QueryCoverage =91%, HitCoverage=38%, E-value=1e-77, Identity=52%"; Hit description =similar to CG9712-PA [Apis mellifera]
  misc_feature: Gene Ontology Annotation: Molecular function=transcription co -repressor activity; Biological process=ubiquitin cycle
  misc_feature: Pfam annotation: Pfam_ID=Tsg101; Match level="Score=154.6, E-value =2.3e-43, Copies=1"; Pfam description=Tumour susceptibility gene 101 protein
MVDTERLRTWLTAYHNPDVAYREIINITTQYRGLHPEQSVYTFNDGTRMDLINLTGTIPVRYKGNIYNIPICIWLIDTHPENAPICYVKPTSDMSIKVSMFVDQNGKVYLPYLHDWVPNESDLLGLIQVMIVTFGEQPPVFARAKDNESYPSNSFMPQPSGGYMPPYPTPYPPASGGFGGYPPYPPTSNNSFQGYPPYPSSQPQYPFNFPPGPQAGTGTIKEEHIRESLMTALEEKLLRRMKEQFQQNQAELETLKRTQEELKQGKLKVDGFLPPSAKKKKKGGPSKKNPI

SEQ ID NO: 23778 - protein, 197 aa, Diabrotica virgifera
  misc_feature: Coding regions on vcDNA: vcDNA=SeqID_3475; Strand=+; Position=2-595
  misc_feature: Homolog annotation: Hit_ID=XP_320031.1; Match level="QueryCoverage =100%, HitCoverage=43%, E-value=2e-14, Identity=28%"; Hit description= ENSANGP00000010505 [Anopheles gambiae]
  misc_feature: Pfam annotation: Pfam_ID=RnaseH; Match level="Score=-17.3, E-value =0.0079, Copies=1"; Pfam description=RNase H
AILKALEYVQQEEEQNAIIFSDSLSVLKILKSNSNKTHDISFNIQTIIKTLQDQNKFIKFFWVKAHVGITKNEIADKVAKESIEMGEQINCELTTDEQINISKHKMMIQWSYLWQEYTFTNPTRYTRLETKLRKKPWYNKYNYNRKSITTISRIKFGHTCYPAHLHKIKILESDLCEVCNKIGDLDHIFFDCQKYRA

SEQ ID NO: 23779 - protein, 127 aa, Diabrotica virgifera
  misc_feature: Coding regions on vcDNA: vcDNA=SeqID_3476; Strand=+; Position=150-533
MSYQPGRVRGRGRGSNFRNVRGNDRKLNTGYPTDTNTPSVSGTNISKHDNNCCSEITFSLELDEFSQSFFTELKNIWNMLKKSPPVVSKLHIHFNNTDNPYIQVLRLLYNCQEFHNAKNKSLPMFIN

SEQ ID NO: 23780 - protein, 411 aa, Diabrotica virgifera
  misc_feature: Coding regions on vcDNA: vcDNA=SeqID_3477; Strand=+; Position=256-1491
  misc_feature: Homolog annotation: Hit_ID=XP_309320.1; Match level="QueryCoverage =97%, HitCoverage=71%, E-value=1e-160, Identity=67%"; Hit description= ENSANGP00000017971 [Anopheles gambiae]
  misc_feature: Gene Ontology Annotation: Molecular function=acetyl-CoA C -acetyltransferase activity; Cellular component=mitochondrion; Biological process=lipid metabolism
  misc_feature: Pfam annotation: Pfam_ID=Thiolase_N; Match level="Score=429.5, E -value=3.9e-126, Copies=1"; Pfam description=Thiolase, N-terminal domain
MIMSKPTKVIQMSRRFYSSGSKNDIVIISAVRTPMGTFLGPLAPLSAPRLGAVAIQAAVERAGIPKEEVKEVFMGHVCQGGAGQAPARQATVFAGLPKSTICTTVNKVCSSGMKSVMFATQSLLLGDQDVILAGGMESMSNVPYYMRRGQTPYGGVHLADGVVADGLWDVYNKFHMGNCAENTAKKLNISRAEQDEYAINSYKKSAEAYKNNAFASELVSVNVPQRKGQPDLVVSVDEEYKRVNFEKFNKLPTVFQKENGTVTAGNASTLNDGAAALILTTAENAKRLNAKPLARVVGYQDGECDPIDFPIAPAVAIPKLLEKTGVSKDEVAMWEINEAFSVVVLANQKILGLNPDKVNIHGGAVSLGHPIGMSGARLITHLVHSLKAEEKGVGAICNGGGGASSMMIEKL

SEQ ID NO: 23781 - protein, 317 aa, Diabrotica virgifera
  misc_feature: Coding regions on vcDNA: vcDNA=SeqID_3478; Strand=+; Position=60-1013
  misc_feature: Homolog annotation: Hit_ID=NP_998249.1; Match level="QueryCoverage =94%, HitCoverage=92%, E-value=1e-113, Identity=65%"; Hit description= zgc:85615 [Danio rerio] gb|AAH67545.1| Zgc:85615 [Danio rerio]
  misc_feature: Gene Ontology Annotation: Molecular function=proteasome endopeptidase activity; Cellular component=proteasome regulatory particle (sensu Eukarya); Biological process=protein deubiquitination
  misc_feature: Pfam annotation: Pfam_ID=Peptidase_C12; Match level="Score=383.8, E -value=2.2e-112, Copies=1"; Pfam description=Ubiquitin carboxyl -terminal hydrolase
MAESAGNWCLIESDPGVFSELIREFGCKGVQVEELWGLDNDLFENLKPIHGLIFLFKWTKDDDPSGSLVQDSRLEKIFFAKQVIENACATQAILSVLLNCRHNDLKLGHTLTELKDFCQGFDANMKGLTISNSPVIRTVHNSFARQQLFEFDPTMANKNDDAFHFVSYVPIDGRLYELDGLKQGPIDLGAIPAEAEWTEIVRPIIEKRIQRYSEGEIHFNLMAIVSDRKMMYEKQIEELQKQSESSGMETDTQQAEITRLRLLIAEENNKRHQYQIENIRRKHSYLPLIVEILKNFGEKIFGEKKEKNFFPFFLKKI

SEQ ID NO: 23782 - protein, 600 aa, Diabrotica virgifera
  misc_feature: Coding regions on vcDNA: vcDNA=SeqID_3479; Strand=+; Position=1-1803
  misc_feature: Homolog annotation: Hit_ID=XP_308782.1; Match level="QueryCoverage =84%, HitCoverage=81%, E-value=7e-74, Identity=34%"; Hit description =ENSANGP00000015139 [Anopheles gambiae]
  misc_feature: Gene Ontology Annotation: Molecular function=transporter activity; Cellular component=Golgi apparatus; Biological process=meiotic spindle assembly
  misc_feature: Pfam annotation: Pfam_ID=Kinesin; Match level="Score=326.3, E-value =4.5e-95, Copies=1"; Pfam description=Kinesin motor domain
VESNDTEVEEQTESEEDKCINVYLRIRGDVNEYALYEIDGNSLICNVPEGSFTFRNVKSGDSMKRNYSFTKIFGPEYDQQTIFNYIIKPKVLSFINGRSSTIFTYGASGSGKTFTIVGTPEEPGLIPRALEYMFRSIPKVSQMPDVQLLPNGSTQYFSKSVMDMHEQYKNSIIDTTIVDDIRTYKRIQERLSSEPVAKVEDDPNVSVSVWVSFAEIYNEIIYDLLSLPAARNQPRQRLVLGKSQGNTFIKKLTYLNVRNGLEAYQILQYGLHNLNYAATAINSHSSRSHCIFTVSLLQTSKCSNDVYVSNFNFCDLAGSERLKKTNNFGDRLKESNNINTSLLVLGRCMENIRKCQQIKDSRLIPFRESKLTQIFQNALLGHENVEMIVNINPSRNMFDETVHVLNFSAIAKTVIVKEELPKPIKKETRFSLLMKAENSPRLKEIVSNKLEVEKLKKKYNRAKEEIRRLQTVVNRLNEELRDGLTSDEKSEEIKHLHRAIDKIIDERDSVIQIYEKKLVENTDHLSAVYEESIARYIEMHKKDKEEAIQRIRKEYEERIAEMQVITISSSDEEDDSPKKSNSKSQKEFKDRILHYQKSCR

SEQ ID NO: 23783 - protein, 420 aa, Diabrotica virgifera
  misc_feature: Coding regions on vcDNA: vcDNA=SeqID_3480; Strand=+; Position=2-1266
  misc_feature: Homolog annotation: Hit_ID=AAQ63487.1; Match level="QueryCoverage =100%, HitCoverage=70%, E-value=0.0, Identity=80%"; Hit description=5- aminoimidazole-4-carboxamide ribonucleotide formyltransferase/IMP cyclohydrolase [Leptinotarsa decemlinea
  misc_feature: Gene Ontology Annotation: Molecular function=IMP cyclohydrolase activity; Cellular component=cytosol; Biological process=nucleobase, nucleoside, nucleotide and nucleic acid metabolism
  misc_feature: Pfam annotation: Pfam_ID=AICARFT_IMPCHas; Match level="Score=502.2, E- value=5.1e-148, Copies=1"; Pfam description=AICARFT/IMPCHase bienzyme
  misc_feature (360)..(361): Xaa can be any naturally occurring amino acid
  misc_feature (383)..(383): Xaa can be any naturally occurring amino acid
  misc_feature (397)..(397): Xaa can be any naturally occurring amino acid
  misc_feature (403)..(403): Xaa can be any naturally occurring amino acid
TLALKAFTHTAEYDAAISDYFRKEFSSGISQLTLRYGTNPHQKPAQLYTTLEKLPLTVVNGSPGFINLCDALNGWQLVKELKAALGLPAATSFKHVSPAGAAVGVPLDETQAKVCMVDDLAGKLTPLAIAYARARGADRMSSFGDFVALSDVCDQVTARLVSREVSDGIIAPGYTPEALELLKKKKNGGYCILQMDPDYVPSPIERKILFGLTLEQKRNDAEINKSIFTNIVSENKNLPESAVRDLIVATIALKYTQSNSVCYAKDGQVIGIGAGQQSRIHCTRLAGDKADNWWLRQHPKVLNMKFKKTVKRAEISNAIDNYVNGSVGKDMDRSLFESMYAEVPLELTPTERQTWLSHLXXVVVSSDAFFPFRDNVDRARLSXVSYIGSPSGSTNEXEKYQAXHEHKIVLPTLILRVVHH

SEQ ID NO: 23784 - protein, 421 aa, Diabrotica virgifera
  misc_feature: Coding regions on vcDNA: vcDNA=SeqID_3481; Strand=+; Position=74-1336
  misc_feature: Homolog annotation: Hit_ID=AAQ63487.1; Match level="QueryCoverage =97%, HitCoverage=68%, E-value=1e-163, Identity=70%"; Hit description= 5-aminoimidazole-4-carboxamide ribonucleotide formyltransferase/IMP cyclohydrolase [Leptinotarsa decemlin
  misc_feature: Gene Ontology Annotation: Molecular function=IMP cyclohydrolase activity; Cellular component=cytosol; Biological process=nucleobase, nucleoside, nucleotide and nucleic acid metabolism
  misc_feature: Pfam annotation: Pfam_ID=AICARFT_IMPCHas; Match level="Score=276.7, E- value=3.8e-80, Copies=1"; Pfam description=AICARFT/IMPCHase bienzyme
MATGSGKGKIALLSVSNKLGLVEFGKNLHSLGFTLVGSGGTAAILRDAGLKIKDVSDVSGAPEILGGRVKTLHPVVHGGILARLLPSDQEDLKNQKIEMIRVVVCNLYPFVETVSNPKVTLDDAVENIDIGGVTLLRAAAKNHQRVTVITDPSDYSKVISELRNNPEKDTSLQTRQTLALKAFTHTAEYDAAISDYFRKEFSSGISQLTLRYGMNPHQKPAQLYTTLEKLPLTVVNGSPGFINLCDALNGWQLVKELKAALGLPAATSFKHVSPAGAAVGVPLDETQAKVCMVDDLAGKLTPLAIAYARARGADRMSSFGDFVALSDVCDQVTARLVSRKKANGIIVPGITPQTLKFFKKKKREGLFFFSNGFPFFSSPLTPKKKIFFFLVLKIIKKKNGSHGQKKKKKNFFFPPPLFPGG

SEQ ID NO: 23785 - protein, 255 aa, Diabrotica virgifera
  misc_feature: Coding regions on vcDNA: vcDNA=SeqID_3482; Strand=+; Position=129-896
  misc_feature: Homolog annotation: Hit_ID=XP_319412.1; Match level="QueryCoverage =76%, HitCoverage=87%, E-value=2e-33, Identity=38%"; Hit description =ENSANGP00000014488 [Anopheles gambiae] ref|XP_307101.1| ENSANGP00000012108 [Anopheles gambiae]
  misc_feature: Gene Ontology Annotation: Molecular function=KDEL sequence binding; Cellular component=integral to membrane; Biological process =intracellular protein transport
  misc_feature: Pfam annotation: Pfam_ID=ER_lumen_recept; Match level="Score=104.7, E- value=2.3e-28, Copies=1"; Pfam description=ER lumen protein retaining receptor
MLNFEKINVFIRIGDSLHTSAILYLLCSIIKEKSYAGISAKTQFLYAAVFITRYLDSFMVFRSYYNTLVEVTLVLVSVCTFLLSFKMRSTYERKYDFFWSEVLVAGALILAMFVNNSLEAIEVLRTFSHYLEAVVLIPQMYMMFQSKKITRPMILYLFFLVLYKIMYICNGIYLYNKHNQFDAISEIAGFVNVMLFFIALEIIWRCSKITSHEYEQKDVTKWKNIFFISGGLTKPETAKKDAPLITEQVYQPVVV

SEQ ID NO: 23786 - protein, 84 aa, Diabrotica virgifera
  misc_feature: Coding regions on vcDNA: vcDNA=SeqID_3483; Strand=+; Position=353-607
  misc_feature: Homolog annotation: Hit_ID=NP_726104.1; Match level="QueryCoverage =100%, HitCoverage=91%, E-value=9e-28, Identity=64%"; Hit description= CG9878-PB, isoform B [Drosophila melanogaster] ref|NP_611606.1| CG9878-PA, isoform A [Drosophila
  misc_feature: Pfam annotation: Pfam_ID=zf-Tim10_DDP; Match level="Score=92.1, E -value=1.5e-24, Copies=1"; Pfam description=Tim10/DDP family zinc finger
MSQKEVQNMQLIQELEIEMMADMYNRLTATCHKKCVPPVYGDAEIAKGEAVCLDRCVAKFLDIHERIGKKLGQMSMQDEALLKK

SEQ ID NO: 23787 - protein, 138 aa, Diabrotica virgifera
  misc_feature: Coding regions on vcDNA: vcDNA=SeqID_3484; Strand=+; Position=13-429
  misc_feature: Homolog annotation: Hit_ID=XP_318996.1; Match level="QueryCoverage =92%, HitCoverage=91%, E-value=1e-29, Identity=51%"; Hit description =ENSANGP00000014758 [Anopheles gambiae]
  misc_feature: Pfam annotation: Pfam_ID=Chitin_bind_4; Match level="Score=80.2, E -value=5.4e-21, Copies=1"; Pfam description=Insect cuticle protein
MKLILAVLAISAAYCVAAPAEPTKEPIPIVKFENEGVNADGSYSWNYETGNNIIAHEQGTVKAGGKPDESELEVVGGYEYTDNEGNKVQISYIANKDGFQPQGDVLPTPPPIPPAIVRLLEYLKAHPSEEDEKEQNKV

SEQ ID NO: 23788 - protein, 339 aa, Diabrotica virgifera
  misc_feature: Coding regions on vcDNA: vcDNA=SeqID_3485; Strand=+; Position=115-1134
  misc_feature: Homolog annotation: Hit_ID=XP_395615.1; Match level="QueryCoverage =57%, HitCoverage=68%, E-value=7e-18, Identity=26%"; Hit description =similar to ENSANGP00000021546 [Apis mellifera]
  misc_feature: Pfam annotation: Pfam_ID=DUF1397; Match level="Score=-67.7, E-value =1.7e-05, Copies=1"; Pfam description=Protein of unknown function (DUF1397)
MNLLGKALVFVLMGCASTQNFGQPPEGFGNQGRFDFGNNGNSPFGSGGNSPFGSGGNSPFGSGGNSPFGNSGNSPFGGNANGPFGDNPELNQVMMQGKSFFDLIPHLLKQKCDESGHSDVLQSIQEQLGQTQKCLKDKVNLDGEKLADEFAGASRTGELDNFFKKNCKVWPDIHGCVQPMVTSAEKCLTSDEKRTVEKLFSLADDTNTFFCENNADRLKKLLSGNLAQCMETVGKDVQECAAKTLQNRQKQQQQQQKQQTSDKKVIFSFDEETCSDFQSGRKCVTSKVAKCESKDTSKIVDDYLALVQDHVCSSASSLSWFSFANILLLVGTYLYSRMF

SEQ ID NO: 23789 - protein, 234 aa, Diabrotica virgifera
  misc_feature: Coding regions on vcDNA: vcDNA=SeqID_3486; Strand=+; Position=965-1669
  misc_feature: Homolog annotation: Hit_ID=XP_395615.1; Match level="QueryCoverage =67%, HitCoverage=55%, E-value=1e-12, Identity=25%"; Hit description =similar to ENSANGP00000021546 [Apis mellifera]
  misc_feature: Pfam annotation: Pfam_ID=DUF1397; Match level="Score=-100.5, E-value =0.0022, Copies=1"; Pfam description=Protein of unknown function (DUF1397)
RTSVYSETVRPNSKMPERLHRALAPTRPPTRPKVNLDGEKLADEFAGASRTGELDNFFKKNCKVWPDIHGCVQPMVTSAEKCLTSDEKRTVEKLFSLADDTNTFFCENNADRLKKLLSGNLAQCMETVGKDVQECAAKTLQNRQKQQQQQQKQQTSDKKVIFSFDEETCSDFQSGRKCVTSKVAKCESKDTSKIVDDYLALVQDHVCSSASSLSWFSFANILLLVGTYLYSRMF

SEQ ID NO: 23790 - protein, 279 aa, Diabrotica virgifera
  misc_feature: Coding regions on vcDNA: vcDNA=SeqID_3487; Strand=+; Position=124-963
  misc_feature: Homolog annotation: Hit_ID=NP_571341.1; Match level="QueryCoverage =78%, HitCoverage=36%, E-value=6e-70, Identity=57%"; Hit description =transcription factor cmyb [Danio rerio] gb|AAF05728.1| transcription factor cmyb [Danio rerio]
  misc_feature: Gene Ontology Annotation: Molecular function=transcription factor activity; Cellular component=chromatin; Biological process=anti -apoptosis
  misc_feature: Pfam annotation: Pfam_ID=Myb_DNA-binding; Match level="Score=167.5, E- value=3e-47, Copies=3"; Pfam description=Myb-like DNA-binding domain
MAEYYLNTNDHIYKQEIDSDIDISGNEDSDDSAGAEPTRLIKSINKGRWSKEEDARLKQLVEEYSEKWDVIAEHFPDRSDVQCQQRWTKVVNPDLVKGPWTKEEDEKVIELVNKYGAKKWTLIARHLKGRIGKQCRERWHNHLNPKIKKSAWTEQEDDIIYKAHQVLGNQWARIAKLLPGRTDNAIKNHWNSTMRRKYESENRDHGESKRGRQRRNMRPSENFYSHYGHQRTQETQVGQEGFPVKKENLILNLQDEDWTVEMFDHASSQSSYSPGAPTP

SEQ ID NO: 23791 - protein, 266 aa, Diabrotica virgifera
  misc_feature: Coding regions on vcDNA: vcDNA=SeqID_3488; Strand=+; Position=423-1219
  misc_feature: Homolog annotation: Hit_ID=AAH74365.1; Match level="QueryCoverage =89%, HitCoverage=74%, E-value=4e-57, Identity=47%"; Hit description =MGC84259 protein [Xenopus laevis]
  misc_feature: Pfam annotation: Pfam_ID=FAA_hydrolase; Match level="Score=124.4, E -value=2.8e-34, Copies=1"; Pfam description=Fumarylacetoacetate (FAA) hydrolase f
  misc_feature (229)..(229): Xaa can be any naturally occurring amino acid
  misc_feature (248)..(248): Xaa can be any naturally occurring amino acid
  misc_feature (254)..(254): Xaa can be any naturally occurring amino acid
  misc_feature (256)..(256): Xaa can be any naturally occurring amino acid
MVSAILHKARILFNSQTLKQLEHFQDTRKFSLSTAAKMRIVQYRLKKGGKQHLGAQLSSGGDIIDISAVDHSIPNSLVEFLGQGCGVYEKPSRIVAEGKSVTSLENGDLVSPITRPATRPPRVRNYSGHCSEQNIPEPKEPMIFSKFSSVIVGPYDNIEIPPVTDSVDWEVELAVVIGKKAKAIRQDQANDHIFGYTVAQDISARDWQKKRNNGQFLLGKSMDTFCPLXPVVVTKNKVDVNNLSIQSXVNGVLXQXGNTSELIFKI

SEQ ID NO: 23792 - protein, 294 aa, Diabrotica virgifera
  misc_feature: Coding regions on vcDNA: vcDNA=SeqID_3489; Strand=+; Position=75-956
  misc_feature: Homolog annotation: Hit_ID=EAA09458.3; Match level="QueryCoverage =97%, HitCoverage=51%, E-value=3e-95, Identity=57%"; Hit description =ENSANGP00000009992 [Anopheles gambiae str. PEST] ref|XP_558509.1| ENSANGP00000009992 [Anopheles gambiae st
  misc_feature: Gene Ontology Annotation: Molecular function=aldehyde dehydrogenase activity; Cellular component=integral to membrane; Biological process=acetaldehyde metabolism
  misc_feature: Pfam annotation: Pfam_ID=Aldedh; Match level="Score=-170.4, E-value =3.2e-09, Copies=1"; Pfam description=Aldehyde dehydrogenase family
MSDKNPEQVVNTARNAFNSGKTRSLDFRLKQLKAFIRLLDENTPQICDALNKDLRKNKIEAVLMEIGVVKKDINYFLKNLRELEKPVRPDKEVANIMDSVFIKHDPYGVVLIMGAWNYPITLSLQPVAGAIAAGNCVLLKPSEVAPATSKFLAEYIPKYLDTEAYQVFEGGVAETTELLKQRFDYILYTGSSAVGKIILEAAAKHLTPVTLELGGKSPVYLDKSADLEVAVKRLLWGKCANSGQTCIAPDYLLCSKDLQEKVVQIAKKVIKEFFGGNVKASPDYGRIINDRHFK

SEQ ID NO: 23793 - protein, 148 aa, Diabrotica virgifera
  misc_feature: Coding regions on vcDNA: vcDNA=SeqID_3490; Strand=+; Position=108-554
  misc_feature: Homolog annotation: Hit_ID=AAR09900.1; Match level="QueryCoverage =100%, HitCoverage=100%, E-value=7e-76, Identity=91%"; Hit description=similar to Drosophila melanogaster eIF-1A [Drosophila yakuba] ref|NP_996231.1| CG8053-PB, isoform B [Dro
  misc_feature: Gene Ontology Annotation: Molecular function=translation factor activity, nucleic acid binding; Cellular component=eukaryotic translation initiation factor 4 complex; Biological process =translational initiation
  misc_feature: Pfam annotation: Pfam_ID=eIF-1a; Match level="Score=238.2, E-value =1.5e-68, Copies=1"; Pfam description=Eukaryotic initiation factor 1A
MPKNKGKGGKNRRRGKNENETEKRELVFKEDGQEYAQVTKMLGNGRLEAMCFDGVKRLCHIRGKLRKKVWINQGDIILIGLREYQDAKADVILKYTPDEARNLKTYGEFPESVRINETVTFVEEGFDEDIEFGDDISSADEADPVDGI

SEQ ID NO: 23794 - protein, 150 aa, Diabrotica virgifera
  misc_feature: Coding regions on vcDNA: vcDNA=SeqID_3491; Strand=+; Position=259-711
  misc_feature: Homolog annotation: Hit_ID=AAR09900.1; Match level="QueryCoverage =98%, HitCoverage=100%, E-value=7e-76, Identity=91%"; Hit description= similar to Drosophila melanogaster eIF-1A [Drosophila yakuba] ref|NP _996231.1| CG8053-PB, isoform B [Dros
  misc_feature: Gene Ontology Annotation: Molecular function=translation factor activity, nucleic acid binding; Cellular component=eukaryotic translation initiation factor 4 complex; Biological process =translational initiation
  misc_feature: Pfam annotation: Pfam_ID=eIF-1a; Match level="Score=238.2, E-value =1.5e-68, Copies=1"; Pfam description=Eukaryotic initiation factor 1A
NKMPKNKGKGGKNRRRGKNENETEKRELVFKEDGQEYAQVTKMLGNGRLEAMCFDGVKRLCHIRGKLRKKVWINQGDIILIGLREYQDAKADVILKYTPDEARNLKTYGEFPESVRINETVTFVEEGFDEDIEFGDDISSADEADPVDGI

SEQ ID NO: 23795 - protein, 337 aa, Diabrotica virgifera
  misc_feature: Coding regions on vcDNA: vcDNA=SeqID_3492; Strand=+; Position=117-1129
  misc_feature: Homolog annotation: Hit_ID=AAD46853.2; Match level="QueryCoverage =93%, HitCoverage=93%, E-value=1e-128, Identity=74%"; Hit description= LD07532p [Drosophila melanogaster]
  misc_feature: Gene Ontology Annotation: Molecular function=electron carrier activity; Cellular component=mitochondrion; Biological process =electron transport
  misc_feature: Pfam annotation: Pfam_ID=ETF_alpha; Match level="Score=477.4, E-value= 1.5e-140, Copies=1"; Pfam description=Electron transfer flavoprotein alpha
  misc_feature (308)..(308): Xaa can be any naturally occurring amino acid
IIYQNYKYRKSVVSKIFTKMFSNYTRTLGTQLRRFQSTLVIAEHNNEVLSPITQNAITAAKKLGGEVSVLVAGTKCGPASSALSKAGGVSKVLVAENEAFKGFTAENLTPLILNAQKQFKFTHIIAGASAFGKALLPRVAAKLDVSPVTDIIAIKSPDTFVRTIYAGNAIQTLQVTDPIKILTIRGTNFEADPLDGGSAATENIPADGCANDLTTFVSQELSKSDRPELTSAKVVVSGGRGLKSGDNFKLLYDLADKLNAAVGASRAAVDAGYVPNDMQVGQTGKIVAPDLYIAVGISGAIQHLAGMXDSKTIVAINKDPEAPIFQVVDYGLGVAVL

SEQ ID NO: 23796 - protein, 620 aa, Diabrotica virgifera
  misc_feature: Coding regions on vcDNA: vcDNA=SeqID_3493; Strand=+; Position=1-1860
  misc_feature: Homolog annotation: Hit_ID=NP_996054.1; Match level="QueryCoverage =95%, HitCoverage=83%, E-value=4e-34, Identity=24%"; Hit description =CG18331-PA [Drosophila melanogaster] gb|AAS65029.1| CG18331-PA [Drosophila melanogaster]
  misc_feature: Gene Ontology Annotation: Cellular component=cornified envelope; Biological process=larval walking behavior
  misc_feature: Pfam annotation: Pfam_ID=Ice_nucleation; Match level="Score=18.3, E -value=0.024, Copies=6"; Pfam description=Ice nucleation protein repeat
LTSDENNGHGYGSSSTKTQTITQTSSSSIQGGNLEQSILNGHGNNGIGYGSGSKVIETTVTKHLGGNKGKHLGNLEQVVLGGHENNGHGYGSSSTKTQTITQTSSSSNQGGNLEQIILNGHGNNGSGSKVVETTVTRHLEGNNGKHLGNLEQVVLTGHENNGHGYGSSSTNTQTITQTSSSSSQGGNLEQSILNGHGNNGIGYGSGSKVIETTVTKHLGGNNGKHLGNLEQVVLTGHENNGHGYGSSSTNAQTITQTSSTSSSQIGELEQSILKIHGNNGIGYGSGSKVIETTVTKHLGANNGKHLGNLEQVVQTGHETLTQTSSSSNQGGNLEQIILNGHGNNGVGYGSGSKVVETTVTKHLGDNNGKHLGNLEQVVLTGHENNGHGYGSSSTKTHTITQTSSSSTQGGNLEQSILNGHGNNGIGYGSGSKVIETTVTKHLGGNNGKHLGNLEQVVLTGHENNGHGYGSSSTNAQTITQTSSTSSSQIGELEQSILKIHGNNGIGYGSGSKVIETTVTKHLGGNNGKHLGNLEQVVQTGHETLTQTSSSSNQGGNIDQSVFNGHGNNGIGYGSHSKVVKVLSSHSSSQQEGQSIHEGGHSFVKVMEIMALDMVVDEGGG

SEQ ID NO: 23797 - protein, 717 aa, Diabrotica virgifera
  misc_feature: Coding regions on vcDNA: vcDNA=SeqID_3494; Strand=+; Position=1-2154
  misc_feature: Homolog annotation: Hit_ID=NP_996054.1; Match level="QueryCoverage =99%, HitCoverage=81%, E-value=1e-44, Identity=24%"; Hit description =CG18331-PA [Drosophila melanogaster] gb|AAS65029.1| CG18331-PA [Drosophila melanogaster]
  misc_feature: Gene Ontology Annotation: Molecular function=structural molecule activity; Cellular component=cornified envelope; Biological process =larval walking behavior
  misc_feature: Pfam annotation: Pfam_ID=Ice_nucleation; Match level="Score=17.7, E -value=0.036, Copies=7"; Pfam description=Ice nucleation protein repeat
ETTVTKHLRGNNGKHLGNVEQVVLTGHENNGHGFGSSSTKTHTITQTSSSSSQGGKLEQIILNGHGNNGIGYGSGSKVIETTVTKHLGGNNGKHLGKLDQVVLTGHENNGHGYGSSSTKTQTITQTSSSSSQGGNLEQTILNGHGNNGIGYGSGSKVIETTVTKHLGGNNGKHLGKLDQVVLTGHENNGHGYGSSSTKTQTITQTSSSSSQGGNLEQSILNGHGNNGIGYGSGSKVIETTVTKHLGGNNGKHLGNLEQSVLTSHENNGHGYGSSSTKTQTITQTSSSSIQGGNLEQSILNGHGDNGIGYGSGSKVIETTVTKHLGGNKGKHLGNLEQVVLGGHENNGHGYGSSSTKTQTITQTSSSSNQGGNLEQIILNGHGNNGSGSKVVETTVTKHLGGNKGKHLGNLEQVVLTGHENNGHGYGSSSTKTQTITQTSSSSSQGGNLEQIILNGHGNNGVGYGSGSKVVETTVTKHLGGNNGKHLGNLEQVVLTGHENNGHGYGTKTQTITQTSSSSSQGGNLEQSILNGHGNNGIGYGSGSKVIETTVTKHLGGNNGKHLGNLEQVVLTGHENNGHGYGSSSTNAQTITQTSSTSSSQIGELEQSILKIHGNNGIGYGSGSKVIETTVTKHLGANNGKHLGNLEQVVQTGHETLTQTSSSSNQGGNLEQIILNGHGNGVGYGSGSKVVETTVTKHLGDNNGKHLGKPRTSSLNWS

SEQ ID NO: 23798 - protein, 402 aa, Diabrotica virgifera
  misc_feature: Coding regions on vcDNA: vcDNA=SeqID_3495; Strand=+; Position=26-1234
GDKTFCIKSIKRLTPVSEVLITANFDFSEALESVYPLLDIIFDYLDFNDLTRCCQVKNSWKEIAENILSKRAQASWFTCFKGSTTNCFEHSVNLNYNNVGFGIILYDFRRIKLNKFICVHTEWEELSRKTVPEYFEEEFVPQKTDYCVISCAKVISYFDSKSKNICKASYFDGLFFPKIPNVRMTMFYCNPVKKDGIQKVVDTYINPNEEVKCLLMFSTTDQKKPLYNLLKALIPENEAPSVAVAGGIIRGTKTFQQIHAAKRIYTNKDIFSIVFLKDKSEETDFNAFSCVIVGDDLSKDEFAEKLVKFRQQVLLRTQTVAIRICCSAKVDADEEPLIFNKIFPGIPVFGFHADGEIGWDCVLHPKASCDSEEHLPKKAKHRYPNVSHQWSTVFVLITAILS

SEQ ID NO: 23799 - protein, 76 aa, Diabrotica virgifera
  misc_feature: Coding regions on vcDNA: vcDNA=SeqID_3496; Strand=+; Position=440-670
HKVIRCHEFRGRSVHKTKHNCYRSIGNCSLTFSSPEYDHYFHSYDAKFCINITKFCDINHSNDLSYSIKTKCHNDS

SEQ ID NO: 23800 - protein, 205 aa, Diabrotica virgifera
  misc_feature: Coding regions on vcDNA: vcDNA=SeqID_3497; Strand=+; Position=135-752
  misc_feature: Homolog annotation: Hit_ID=XP_392599.1; Match level="QueryCoverage =99%, HitCoverage=98%, E-value=3e-69, Identity=66%"; Hit description =similar to ENSANGP00000003500 [Apis mellifera]
  misc_feature: Gene Ontology Annotation: Molecular function=transporter activity; Cellular component=integral to membrane; Biological process=proton transport
  misc_feature: Pfam annotation: Pfam_ID=ATP-synt_C; Match level="Score=40.2, E-value= 6.3e-09, Copies=2"; Pfam description=ATP synthase subunit C
MRYTLSYIGATLASTVTLIFALYYCLTGKGEQVSLAWLLLNVSPHMWAGLGIGLAVSLSVVGAAAGIHTTGVSIVGAGVKAPRIKTKNLISIIFCEAVAIYGLIMAIVLCGSWKNFDVDLFNLKTHNFAQNHYGSHVIFGSGLTVGFVNLLCGFCVGVVGSGAAISDAANSSLFVKILIIEIFGSAIGLFGLIVGVYLTSRGSMV

SEQ ID NO: 23801 - protein, 98 aa, Diabrotica virgifera
  misc_feature: Coding regions on vcDNA: vcDNA=SeqID_3498; Strand=+; Position=71-367
  misc_feature: Homolog annotation: Hit_ID=XP_316423.1; Match level="QueryCoverage =96%, HitCoverage=95%, E-value=2e-28, Identity=61%"; Hit description =ENSANGP00000021054 [Anopheles gambiae]
FKMPFCGPKLSLCGLIISAWGIIQLGFMGVFYYIGAVALAEDIPEVEFKGDLDKFYSDVNTGFTQNAYNCWIAALLYLITLAVSAHQFWANNRSSLNV

SEQ ID NO: 23802 - protein, 190 aa, Diabrotica virgifera
  misc_feature: Coding regions on vcDNA: vcDNA=SeqID_3499; Strand=+; Position=47-619
  misc_feature: Pfam annotation: Pfam_ID=GILT; Match level="Score=-13.9, E-value =0.00025, Copies=1"; Pfam description=Gamma interferon inducible lysosomal t
ILKMNHIIKEYLILCVLFFVRLNKSESYGPRIIANVYYESKCPYDKSFIEQQLLPIMEGNLTNYVNLTILPFGSPVPPHKFECFGPVDPLCSGHIDYSDNYYRPIPTGIQEWCFKKMICYLKKLKQRFEKRPITSKKQFCDLSDLSFGFLDNRCSIFNTLNFDKPNNSSEKKVKDNHSINLRTNVLNPMQ

SEQ ID NO: 23803 - protein, 261 aa, Diabrotica virgifera
  misc_feature: Coding regions on vcDNA: vcDNA=SeqID_3500; Strand=+; Position=1117 -1902
  misc_feature: Homolog annotation: Hit_ID=EAL31098.1; Match level="QueryCoverage =100%, HitCoverage=100%, E-value=1e-130, Identity=85%"; Hit description=GA10883-PA [Drosophila pseudoobscura]
  misc_feature: Gene Ontology Annotation: Molecular function=structural constituent of ribosome; Cellular component=cytosolic small ribosomal subunit (sensu Eukarya); Biological process=protein biosynthesis
  misc_feature: Pfam annotation: Pfam_ID=Ribosomal_S4e; Match level="Score=151.3, E -value=2.1e-42, Copies=1"; Pfam description=Ribosomal family S4e
MARGPKKHLKRLNAPKAWMLDKLGGVFAPRPSTGPHKLRESLPLVIFLRNRLKYALTNSEVTKIVMQRLIKVDGKVRTDSNYPAGFMDVITIEKTGEFFRLIYDVKGRFAIHRITAEEAKYKLCKVRRVQTGPKGIPFLVTHDGRTIRYPDPNIKVNDTIQLEIATSKILDYIKFESGNLCMITGGRNLGRVGTVINRERHPGSFDIVHVKDANGHVFATRLNNVFIIGKGAKAFVSLPRGKGVKLSIAEERDKRLAAKTH

SEQ ID NO: 23804 - protein, 294 aa, Diabrotica virgifera
  misc_feature: Coding regions on vcDNA: vcDNA=SeqID_3501; Strand=+; Position=195-1075
  misc_feature: Homolog annotation: Hit_ID=XP_321592.1; Match level="QueryCoverage =84%, HitCoverage=44%, E-value=1e-60, Identity=49%"; Hit description =ENSANGP00000011503 [Anopheles gambiae]
  misc_feature: Gene Ontology Annotation: Molecular function=sulfate transporter activity; Cellular component=membrane; Biological process=anion transport
  misc_feature: Pfam annotation: Pfam_ID=Sulfate_transp; Match level="Score=-135.1, E- value=0.0072, Copies=1"; Pfam description=Sulfate transporter family
  misc_feature (223)..(223): Xaa can be any naturally occurring amino acid
MGKQTDSDRSLGTKVKDVILQRLVILQWLPKYTKNDILADLIAGLTVGLTMMPQSIAYAGLAGLPAQYGLYTAFIGSFTYIFVGTIKEVSIGPTSLMSLLTFSYTVGKPIECVILLAFTAGCVELLMGILKLGFLVDFISPCLTSGFTSASTIIIISNQLKNLFGINIHSHDFVGVTKELFQKFNEIRMPDTILGVTCIVVLLFFKNLNRLVKTENKTVKKLXWLLSISKNAIVVLLATIVAGSWSKTGSTPFKIIGNVPKGVPVLAFPSLSTHVRNPDCKKLSRMCNLWAVEF

SEQ ID NO: 23805 - protein, 275 aa, Diabrotica virgifera
  misc_feature: Coding regions on vcDNA: vcDNA=SeqID_3502; Strand=+; Position=328-1155
  misc_feature: Homolog annotation: Hit_ID=NP_651349.1; Match level="QueryCoverage =97%, HitCoverage=38%, E-value=1e-28, Identity=30%"; Hit description =CG10244-PA [Drosophila melanogaster] gb|AAF56414.2| CG10244-PA [Drosophila melanogaster]
  misc_feature: Gene Ontology Annotation: Molecular function=protein tyrosine kinase activity; Cellular component=cellular_component unknown; Biological process=protein amino acid phosphorylation
  misc_feature: Pfam annotation: Pfam_ID=Cadherin; Match level="Score=7.7, E-value =0.03, Copies=1"; Pfam description=Cadherin domain
MCWNSCVVLLSFASLLMKAKAQYAENTPPSLWMDDRNWNIRENETIGTKISQAHGDDPEGVVLTYGLEPIMWHLGGKVEKLPFRIDNETGTVYLNESLTGRANENLHLYVTASDGQLTAKSEVNVNILPANSRFNPSMPIRPPSRGFINYPGIIPRPGQSPPLPPNFPNTNPSVINPPTFIPKQPYYPEIRTPPKNTNSNTNTVLKPVRIDDVKNTISERTTETTTSTTEKITTEKVSQNDVESTNELLTSDLPIRSSERLSGTVNSIAAVIGVF

SEQ ID NO: 23806 - protein, 621 aa, Diabrotica virgifera
  misc_feature: Coding regions on vcDNA: vcDNA=SeqID_3503; Strand=+; Position=68-1930
  misc_feature: Homolog annotation: Hit_ID=NP_728437.1; Match level="QueryCoverage =98%, HitCoverage=67%, E-value=0.0, Identity=54%"; Hit description =CG14476-PE, isoform E [Drosophila melanogaster] ref|NP_728436.1| CG14476-PD, isoform D [Drosophila
  misc_feature: Gene Ontology Annotation: Molecular function=protein binding; Cellular component=alpha-glucosidase complex; Biological process =protein modification
  misc_feature: Pfam annotation: Pfam_ID=Glyco_hydro_31; Match level="Score=212.6, E -value=7.5e-61, Copies=1"; Pfam description=Glycosyl hydrolases family 31
MAQNLLYISLILFIVLYASAVDKNNFKTCEQSSFCRRLRSVKPGESKYELDLESLEITDNSVESKLLNTEAGILFKFSLTAISGNIFRLQVDEASPLYARYRPQFALRGEPQVAKLKLLERNKEYVSIEYNNNKVIVHARPFKIEVFDKDELISVVNGRGLFKFEHFRKKPEQNNEGEQQQEVAEDPGTWEENFKSHHDSKPKGPSAVGLDISFPGALRVYGLPEHADRLPLRTTGPGGVDPYRLYNLDVFEYELDSTMAIYGAIPVVYAHSPKRTIGAFWLNAAETWVDINNSKDGNVMSSIVNLVSGSKSENNVDVHFMSESGVADLFILLGPTPKAAVKQYASLTGVHPLPQYYTLAYHQCRWNYNDEDDVTTVVQTFDANDMPVDFMWLDIEYTNGKKYFTWDPIKFPHPEIMVNNLTATGRKLIVIIDPHYKRESGYFVHEDCLANDYYVKTKDNNVYEGWCWPGSSSYIDFYKPEAAEYYKNLYRLENFKGTSHDVYIWNDMNEPSVFNGPEITMPKDTIHHGGWEHRDVHNEYALAHTYATFQGLLQRTPNKRPFILTRGHFPGSQRYTVVWTGDNAAEWSHLAVSYPMCLSEALGGMSFCGADVRRFLSPSLI

SEQ ID NO: 23807 - protein, 242 aa, Diabrotica virgifera
  misc_feature: Coding regions on vcDNA: vcDNA=SeqID_3504; Strand=+; Position=287-1015
KQLSEMFPVPLATSSEEIPVSVFWEVVLLYHNRPYLVNKLVTANTKISLYKIDCKGSFGHISELFKLSSILYERRKLKELSKESLNDDFIKSFVECYDKNFKLDKLNEETFLDSFSGVYISVQVLISRRSTDHRVLELAIFDKDTNSAIFLTAYENSEDMLTPNFPYEFNWKNGCFGLNLQNFEDADTSKAEWLALTLFPKLLKWSQDDGSKNTIRSLSLVPLDEYCVLYERLKKNLREKIC

SEQ ID NO: 23808 - protein, 225 aa, Diabrotica virgifera
  misc_feature: Coding regions on vcDNA: vcDNA=SeqID_3505; Strand=+; Position=199-873
  misc_feature: Homolog annotation: Hit_ID=XP_316830.1; Match level="QueryCoverage =100%, HitCoverage=40%, E-value=3e-60, Identity=48%"; Hit description= ENSANGP00000010214 [Anopheles gambiae]
  misc_feature: Pfam annotation: Pfam_ID=Tweety; Match level="Score=-137.1, E-value =8.1e-05, Copies=1"; Pfam description=Tweety
  misc_feature (187)..(187): Xaa can be any naturally occurring amino acid
  misc_feature (209)..(209): Xaa can be any naturally occurring amino acid
MGMISPDDAYSYPLIARFLHSLPHVNVSFQHVNSSFEPNNPVYLESLGILGSIPAIWLILTLFVLLIYLLTRCCDRKPRASKSIAALKLTLAVVSVLCCAGIGIGLYGNDDLHNGVVRTLSEGRQVDILISKIRNQTEDIERQLRIQAERQIKEIANVFGTHHSDKPLFNEIEGYFKKLVSNRNATXNAARDIRQPLVGVNLTSTIIIXEKIEAVRWPFTMGNLS

SEQ ID NO: 23809 - protein, 246 aa, Diabrotica virgifera
  misc_feature: Coding regions on vcDNA: vcDNA=SeqID_3506; Strand=+; Position=172-909
  misc_feature: Homolog annotation: Hit_ID=XP_316830.1; Match level="QueryCoverage =100%, HitCoverage=44%, E-value=3e-66, Identity=49%"; Hit description= ENSANGP00000010214 [Anopheles gambiae]
  misc_feature: Pfam annotation: Pfam_ID=Tweety; Match level="Score=-104.8, E-value =2.9e-06, Copies=1"; Pfam description=Tweety
  misc_feature (203)..(203): Xaa can be any naturally occurring amino acid
  misc_feature (234)..(234): Xaa can be any naturally occurring amino acid
MGMISPDDAYSYPLIARFLHSLPHVNVSFQHVNSSFEPNNPVYLESLGILGSIPAIWLILTLFVLLIYLLTRCCDRKPRASKSIAALKLTLAVVSVLCCAGIGIGLYGNDDLHNGVVRTLSEGRQVDILISKIRNQTEDIERQLRIQAERQIKEIANVFGTHHSDKPLFNEIEGYFKKLVSNRNATANAARDIRQPLVGVNLXPTIIIGEKIEAVRYAVRMGILSVLLILFQIXQVGVARHNRCAL

SEQ ID NO: 23810 - protein, 313 aa, Diabrotica virgifera
  misc_feature: Coding regions on vcDNA: vcDNA=SeqID_3507; Strand=+; Position=238-1178
  misc_feature: Homolog annotation: Hit_ID=EAL26439.1; Match level="QueryCoverage =86%, HitCoverage=46%, E-value=3e-32, Identity=30%"; Hit description =GA21348-PA [Drosophila pseudoobscura]
  misc_feature: Gene Ontology Annotation: Molecular function=beta-N -acetylhexosaminidase activity; Cellular component=extracellular space
  misc_feature: Pfam annotation: Pfam_ID=Glyco_hydro_20b; Match level="Score=56.0, E -value=1e-13, Copies=1"; Pfam description=Glycosyl hydrolase family 20, domain
  misc_feature (296)..(296): Xaa can be any naturally occurring amino acid
MSTLSREYEFSRVSSGAFGVDVGVRRRSRREVIKMTGLISLIVFALVITVVYGVHYSESDGPTFRYFQRVESANENDKYQKISNSTIWTYECRSEQCERRPADTNEIRVSLEQCNMLCSNPSLWPKPRSVYVSNKSVSSFLKNQIKLKINSPSSIKDDLKQAFRIFLNTIPDERKFRTQDEVDVADIFINLTVTKDDNKPKQDTDESYTLSVTKSNSNITVNISSTTYFGARHGLETLSQLIWLDSVSQKLLIYHDISIRDKPMFPHRGLMVDTARNFFPMKQLLKVVDGMAANKXNVFHLHLTDSVSFPLYF

SEQ ID NO: 23811 - protein, 398 aa, Diabrotica virgifera
  misc_feature: Coding regions on vcDNA: vcDNA=SeqID_3508; Strand=-; Position=1-1194
  misc_feature: Homolog annotation: Hit_ID=XP_395642.1; Match level="QueryCoverage =75%, HitCoverage=17%, E-value=3e-38, Identity=26%"; Hit description =similar to CCAAT/enhancer binding protein zeta; CCAAT-box-binding transcription factor [Apis
HFRVRVLDLIDIYLDSNPSMIITLEIMLPLLKTVEFSVRDEHEARRSRRLKSCLKKLSNLKKFENTDGVDDAVLCDLLKSLLDKGTKNTWIVQDMREQISHCCIFTIKCSDLLSNAEATPKKVKKRLKNSIVELIRNELDTYFNKRECATPFLVFKNLLKISWDGNLTLVTTILKYLFDANVKVFKKSQGLELVLSFYTNQRYLRSNTEKIREALNESHEEFSNNAITLFKSLCETERKVPSEKFLCNMFKLLVALKTSVLNIECMKWPAIAESVREFMSTVTLSKEAKTAFNKLCACLNVSNIVRHNPVVTSSTNNDEKATKGAKEKKKNKKTKNKEKLKLKKEAKELRLQSLSEGFKSLDFAVADDEVTMETNEESEEDSSNKSKKKKKGTRAGRK

SEQ ID NO: 23812 - protein, 135 aa, Diabrotica virgifera
  misc_feature: Coding regions on vcDNA: vcDNA=SeqID_3509; Strand=+; Position=1-408
  misc_feature: Homolog annotation: Hit_ID=XP_396791.1; Match level="QueryCoverage =82%, HitCoverage=8%, E-value=4e-17, Identity=37%"; Hit description =similar to beta-1,4-endoglucanase [Apis mellifera]
  misc_feature: Pfam annotation: Pfam_ID=Elongin_A; Match level="Score=-29.4, E-value= 0.081, Copies=1"; Pfam description=RNA polymerase II transcription facto
ITNAGVTNLVKLAEQIFDSNFIEWHFINSPPIVEVILKVLKAFMKPELYNRLRYHHTLDTLPDYIPLEVLPKDYGGNERSLEELRELYLKKLEEHQPYFDRLETLKVDEARRPRSENAPTGMQAMFNNINSLLFG

SEQ ID NO: 23813 - protein, 307 aa, Diabrotica virgifera
  misc_feature: Coding regions on vcDNA: vcDNA=SeqID_3510; Strand=+; Position=74-997
  misc_feature: Homolog annotation: Hit_ID=XP_312380.1; Match level="QueryCoverage =85%, HitCoverage=79%, E-value=4e-29, Identity=27%"; Hit description =ENSANGP00000012173 [Anopheles gambiae]
  misc_feature: Pfam annotation: Pfam_ID=CRAL_TRIO; Match level="Score=-23.9, E-value= 0.0026, Copies=1"; Pfam description=CRAL/TRIO domain
MNSFPFAVDKKTKLSLLKGLDKNEEHLEECVECIKSWVASQPHLPEVPSDKMIEFFIFTTKFDIEAAQKTIDNYYTLRSSLTRVFQYANPSSHAMKAAVDCAYIVPLPNLVNDRNGVVVIRELPNVPSGFDGHWWLGAVMNVYEVRMQEGAHTTGNILLYDHQHLSMKHVFHVTPAFVMNLVKLAEQIFDSNFIEWHFINSPPIVEVILKVLKAFMKPELYNRLRYHHTLDTLPDYIPLEVLPKDYGGNERSLEELRELYLKKLEEHQPYFDRLETLKVDEARRPRSETLLRVCRACLTTLTVCSFG

SEQ ID NO: 23814 - protein, 293 aa, Diabrotica virgifera
  misc_feature: Coding regions on vcDNA: vcDNA=SeqID_3511; Strand=+; Position=125-1004
  misc_feature: Homolog annotation: Hit_ID=EAA11343.2; Match level="QueryCoverage =87%, HitCoverage=80%, E-value=6e-67, Identity=45%"; Hit description =ENSANGP00000018286 [Anopheles gambiae str. PEST] ref|XP_556196.1| ENSANGP00000018286 [Anopheles gambiae st
  misc_feature: Gene Ontology Annotation: Molecular function=binding; Cellular component=soluble fraction; Biological process=vitamin A metabolism
  misc_feature: Pfam annotation: Pfam_ID=CRAL_TRIO; Match level="Score=-0.6, E-value =4.4e-05, Copies=1"; Pfam description=CRAL/TRIO domain
  misc_feature (277)..(277): Xaa can be any naturally occurring amino acid
MTTSELIMVNSWNDHYNTDSCNIKIKNKKLKKELYEIASRELRESESSRKECLEHLRNWIKQNPDIENCLTDDTFLLRFLRVKKFSIPMAEQTLLKYLNYRKRFKYFMHNLDCCEPNVSEIIGDGFLYVSPFRDTCGRRVVLYDVSKFNLEKFNGADLAKVFSITYETLTDDEENQILGVKHVGNLEGASLNYIPLFTISDFAVMIRWGEQSMPMRHKEINVINFPPYIKFVYEFMLSIASEKLKSRVNIHSSLEQLHKKVSKHCLPAELGGDMPRXEMIKLWKARIGIEKEN

SEQ ID NO: 23815 - protein, 255 aa, Diabrotica virgifera
  misc_feature: Coding regions on vcDNA: vcDNA=SeqID_3512; Strand=+; Position=9-776
MKVFLVLAAFATLCAAKPTFLLDSLVIHKVAKGLGLGNVISVDGDARAKLGQNEIGVDLAGGIGGDVVGYHAKVDGNVLGQKVNVHGDIYDGDKVDAKNHQVYTDENGLQYILVRQYVGTNSLLVRKYLISGKMVIDGTNQPLDINARYPDTTVDVRYPNINVNVERPGYKIVQITYPDGTLRPMYVRIEEPNLPPGYIRVYDPTVPIGYRIVRIETPEVPVDPIRYTVIRTPNVQVNPIQIERVQPEYKTIRIL

SEQ ID NO: 23816 - protein, 370 aa, Diabrotica virgifera
  misc_feature: Coding regions on vcDNA: vcDNA=SeqID_3513; Strand=+; Position=48-1160
  misc_feature: Homolog annotation: Hit_ID=NP_608924.1; Match level="QueryCoverage =93%, HitCoverage=59%, E-value=1e-80, Identity=43%"; Hit description =CG12512-PA [Drosophila melanogaster] gb|AAF52246.1| CG12512-PA [Drosophila melanogaster]
  misc_feature: Gene Ontology Annotation: Biological process=embryogenesis and morphogenesis
  misc_feature: Pfam annotation: Pfam_ID=AMP-binding; Match level="Score=-36.3, E -value=9.8e-06, Copies=1"; Pfam description=AMP-binding enzyme
MRRSLCTTVKLTLNVHVRKGRNHHEIRKLSTKPSYYHCVGEDPLSHLTLGQLSEKCSYSFGDRTAVVSCHQKKKLTFRSLLEEADRLAAGFLKLGFQKEDRIGIWAPNLVEWYIAFIACARGGFVMVSMNPFYQANEAENLIKQVKIKGLICGDVFRKQDYYHLLKSICPELEDSKPGKIYSDRVPSLRTVVHITEENKKGTFKFTDIQNMADEDTMLQIKNFQNKIKFDDPCNIQFTSGTTGMPKAPVQSHFNIVNNGYFSGKRVGLHQKHHTICLQNPLFHVFGTIASLTAAVNHGATIVLPNDTYNPEKNLSAIVQEGCTVIYGTPTMYVDLVSQQRKRNENMKAEIALCGGALCPSVLFKDMLDIL

SEQ ID NO: 23817 - protein, 93 aa, Diabrotica virgifera
  misc_feature: Coding regions on vcDNA: vcDNA=SeqID_3514; Strand=+; Position=718-999
YILLAQNFIDYGTYVPVKPRLANRDRKVPLWASCVVISCIIIISSSLAPQPMVGLDLFQNQLPIPHLGFQFRTPNHNNKYNCVYVYVMHTFLS

SEQ ID NO: 23818 - protein, 62 aa, Diabrotica virgifera
  misc_feature: Coding regions on vcDNA: vcDNA=SeqID_3515; Strand=+; Position=158-346
LTNQHNFFRHFRTLLFFFSSIHRWEVLIAATDKRRIQDIRWSARGDAVNVTWHHYKEILVTL

SEQ ID NO: 23819 - protein, 701 aa, Diabrotica virgifera
  misc_feature: Coding regions on vcDNA: vcDNA=SeqID_3516; Strand=+; Position=57-2163
  misc_feature: Homolog annotation: Hit_ID=XP_320387.1; Match level="QueryCoverage =100%, HitCoverage=96%, E-value=0.0, Identity=59%"; Hit description =ENSANGP00000013937 [Anopheles gambiae]
  misc_feature: Gene Ontology Annotation: Molecular function=translation initiation factor activity; Cellular component=eukaryotic 48S initiation complex; Biological process=nucleobase, nucleoside, nucleotide and nucleic acid metabolism
  misc_feature: Pfam annotation: Pfam_ID=RRM_1; Match level="Score=21.3, E-value =0.00033, Copies=1"; Pfam description=RNA recognition motif. (a.k.a. RRM, R
  misc_feature (574)..(574): Xaa can be any naturally occurring amino acid
MAKKKPEDKNNQSDDDTKNESDYSSNEEEPNFSDPEDYEDDVSDEELLGDVLKEKPKETDGVESVIVVDGVPQVGPNRIEKLKSVIVKIFVKFGTIVNEFYPVNSEGHTKGYIFIEYSSPSEAAEAVKLTNNFKLDKHHTFQVNLFTDFSKYDQIPNKWDPPEPQPYQGQADLHSYLLEPDAYDQFAVVVAQTQAVQIWQNTQPDPSLIEARNSWSQTYIKWSPLGTFLCTFHRLGVALWAGPGFLQYKKFTHSNVQFIDFSPCEKYLVTYSPQGDPHNPEQKRIIIWDIRTGLEKRSFNPEGPTAWPIFRWSHDDKYFARIGQNNDALQVYETPSFGLLDKKSIKINGIRDFNWSPTDNVVAYWVAEDKDVPASVTLLELPNRNEIRKKNLFNVADCKIHWQKSGDYLCVKVDRYSKVRKEKNETKYSGMYCNFEIFHMKEKQIPVDSVECKEPIQAFAWEPVGSKFAMIHGESPSISASFYEVRIGQAPILLKKFEKRACNHLFWSPSGQFIVLAGLGSNGGGSLEFVDTHEFLIMNTTDHFQLSDVEWDPTGRYVITGVSFWKTKVDTGYXIWSFQGKILKRINLEKFSQILWRPRPPSLLSDEKQKEVKKSLKKYYPQFESKDRMRQSKASKELIEKRAALMEKFQAYREERIEEYLDQKSRRLQLRNNIDTDELNAENVEEEIVEFFIKEEVIPVD

SEQ ID NO: 23820 - protein, 250 aa, Diabrotica virgifera
  misc_feature: Coding regions on vcDNA: vcDNA=SeqID_3517; Strand=+; Position=18-770
  misc_feature: Homolog annotation: Hit_ID=XP_321429.1; Match level="QueryCoverage =94%, HitCoverage=94%, E-value=2e-64, Identity=58%"; Hit description =ENSANGP00000022064 [Anopheles gambiae]
  misc_feature: Gene Ontology Annotation: Molecular function=structural constituent of eye lens
  misc_feature: Pfam annotation: Pfam_ID=Chitin_bind_4; Match level="Score=107.4, E -value=3.5e-29, Copies=1"; Pfam description=Insect cuticle protein
MAFKFVIFAACVAVARAGVLSSPLAYSAPLAAPLAYAAPVSHVAKVAVAAPLAKAVIAEDFDHNPQYSFGYDVQDSLTGDSKSQVETRSGNVVQGSYSLTDPDGTRRTVDYSADDVNGFNAVVRKEPLVAKAVVAAPAVAKLAAPAVAYAAPVAKLAAPAFAYQAHAAPALAYSAPLAKYAAPAVAYTAPAVAKYSYAAPALSYSAYSAPAVSYAAPAVSYAAPALSYSAPSLAYHAAPAQYAYSSNLIH

SEQ ID NO: 23821 - protein, 144 aa, Diabrotica virgifera
  misc_feature: Coding regions on vcDNA: vcDNA=SeqID_3518; Strand=+; Position=60-494
  misc_feature: Homolog annotation: Hit_ID=AAD47084.1; Match level="QueryCoverage =91%, HitCoverage=87%, E-value=3e-31, Identity=46%"; Hit description =prefoldin subunit 2 [Homo sapiens]
  misc_feature: Gene Ontology Annotation: Molecular function=chaperone activity; Cellular component=cytosol; Biological process=protein folding
  misc_feature: Pfam annotation: Pfam_ID=KE2; Match level="Score=101.9, E-value=1.7e -27, Copies=1"; Pfam description=KE2 family protein
MASNSKKKSDKGPTPEEILTGFQNLRAEQRALSGKLSEFELDLNEHKMVIETLKNVNEDRKCFRLIGGILTERKVKDVLPVLVTNQEKLKEFIEKLQEQITKKGSEINEYREKHNIKFRGLEPTKQDEQPVASTTEARGNVLVS

SEQ ID NO: 23822 - protein, 289 aa, Diabrotica virgifera
  misc_feature: Coding regions on vcDNA: vcDNA=SeqID_3519; Strand=+; Position=33-902
  misc_feature: Homolog annotation: Hit_ID=XP_308175.1; Match level="QueryCoverage =97%, HitCoverage=98%, E-value=2e-60, Identity=43%"; Hit description =ENSANGP00000021524 [Anopheles gambiae]
  misc_feature: Pfam annotation: Pfam_ID=DHDPS; Match level="Score=71.4, E-value=2.5e- 18, Copies=1"; Pfam description=Dihydrodipicolinate synthetase family
MVSFTYRGLCAPVFTIFNKDSSVNVAAIPEYARFLAKNGIDGVLVHGTSGEGVSMTVAERKAVVEVWAKVVKETKQHLMVQVGGCPLPDAVEMARHAESVGADSLLCHSELFFKPTNPTELVNYLKYVAAAAPRTPLLYYHIPGWTGININMEKFITEALQKIPNFRGIKYTSTDLEGGIAALRASGSQSAVFLGADTLLASAYTMGFDSAIATSLNMMPQHAIKIVKAIRENNIDEAKRLQNLLTDAVNIIIKDGAWVPTMKAAMNLLTPINVGQSRPPLVNLTRGTN

SEQ ID NO: 23823 - protein, 431 aa, Diabrotica virgifera
  misc_feature: Coding regions on vcDNA: vcDNA=SeqID_3520; Strand=+; Position=1-1296
  misc_feature: Homolog annotation: Hit_ID=EAA09195.2; Match level="QueryCoverage =96%, HitCoverage=77%, E-value=0.0, Identity=74%"; Hit description =ENSANGP00000003971 [Anopheles gambiae str. PEST] ref|XP_562278.1| ENSANGP00000003971 [Anopheles gambiae str.
  misc_feature: Gene Ontology Annotation: Molecular function=transcriptional activator activity; Cellular component=nucleoplasm; Biological process=establishment and/or maintenance of chromatin architecture
  misc_feature: Pfam annotation: Pfam_ID=SKIP_SNW; Match level="Score=404.7, E-value =1.2e-118, Copies=1"; Pfam description=SKIP/SNW domain
HGKDKIVYSKLSDLLPVEVVDENDPSLERPDQEEIDDLTERTRQALMKITNSKIAAAMPVRAADKLAPAEFIRYTPSQQGAAFNSGAKQRVIRLVDAQVDPMEPPRFKINKKIPRGPPSPPAPVLHSPTRRVTVKEQKEWKIPPCISNWKNAKGYTVPLDKRLAADGRGLQQLHINENFAKLAEALYIADRKAREAVETRAQLEKKLAQKEKEAKEEHLRQLAQRARDERAGIKAAPSHSKGGVDEEEHERDLLRQDRHKERARDRNLARAAPDKRSKLQRERERDISEQIALGMPAKGAPSNDTQFDQRLFGQAQGLGHGYGDDEAYNVYDKPWRDGGSMANHIYRPSKNIDKDMYGGEDIEKAIRTNRFVPDKEFGGTDRSGAGRSGPVQFEKEEDPFGLDQFLSQAKRASKRKEPEKRDDRDKRKRRE

SEQ ID NO: 23824 - protein, 318 aa, Diabrotica virgifera
  misc_feature: Coding regions on vcDNA: vcDNA=SeqID_3521; Strand=+; Position=107-1061
  misc_feature: Homolog annotation: Hit_ID=XP_394096.1; Match level="QueryCoverage =97%, HitCoverage=44%, E-value=1e-103, Identity=60%"; Hit description= similar to ENSANGP00000022233 [Apis mellifera]
  misc_feature (238)..(238): Xaa can be any naturally occurring amino acid
MALLGAQLVITLVMISVIQKLGPHYSLARWLLCSTGLVRYLYPTDSELRELANIPKEKSKNRKNSKAQTNGKTTVDTFHIPRSLDIKLDSIKITRQDVIHIRYYTEYQWLVDFSVYAAVIYGATELYQVWFPLKNEINLSMVWCFLVILFAIKLLLGLTVQYFKGEESIGERSTCIVMGFIYLLISMMILIVDEKTLEIGLEDAYDSFNKSASVFLEKQGLSSTGPASKIVLKFFMAXGIGVLGALFTFPGIRLAKMHWVLLKYFQDNKLKQLLLHFPSPLPFILIIFWVKPGVQKLTLTFEFFTDRIGPPCLKRKVF

SEQ ID NO: 23825 - protein, 177 aa, Diabrotica virgifera
  misc_feature: Coding regions on vcDNA: vcDNA=SeqID_3522; Strand=+; Position=76-609
  misc_feature: Homolog annotation: Hit_ID=XP_346039.1; Match level="QueryCoverage =89%, HitCoverage=84%, E-value=3e-34, Identity=50%"; Hit description =hypothetical protein XP_346038 [Rattus norvegicus]
  misc_feature: Gene Ontology Annotation: Molecular function=molecular_function unknown; Cellular component=synaptic junction; Biological process =protein targeting
  misc_feature: Pfam annotation: Pfam_ID=Ank; Match level="Score=98.0, E-value=2.4e -26, Copies=3"; Pfam description=Ankyrin repeat
IPIIIKGRIPKTQKRCVHNGNCPANQLASQSLNEMDSERGIWYAAQYGDLERVRKLANERRCADEKDSAGYTALHYAARNGHLTVCLFLLDNGADVNAVTKGGATALCRAATAGKEDVVDLLLSKKADPFIQDSDGKTALHRATENKHFEICKRLLNVAPSLCEVADNRGNKAAVRN

SEQ ID NO: 23826 - protein, 213 aa, Diabrotica virgifera
  misc_feature: Coding regions on vcDNA: vcDNA=SeqID_3523; Strand=+; Position=176-815
  misc_feature: Homolog annotation: Hit_ID=XP_314131.1; Match level="QueryCoverage =90%, HitCoverage=27%, E-value=5e-70, Identity=68%"; Hit description =ENSANGP00000015785 [Anopheles gambiae]
  misc_feature: Gene Ontology Annotation: Molecular function=ATP binding; Cellular component=cellular_component unknown; Biological process=signal transduction
  misc_feature (178)..(178): Xaa can be any naturally occurring amino acid
MSDNRESLSSFVEKQERPPEYDKILGRKVLVAPSEEQYDLLLKRLKQQLGEGRGEVILEIGGSDDGSENGLLDDELEAAVATLQSLANTLECSCVRLRERKETRGVVVQYLIRRVLDQSDFLEIRVAVVGNVDAGKSTLLGVLTHGELDNGRGHARQRLFRHKHEMESGRTSSVGNDXILGFDEEGNIVNKPEHGSLDWVKICERSSKVITFY

SEQ ID NO: 23827 - protein, 293 aa, Diabrotica virgifera
  misc_feature: Coding regions on vcDNA: vcDNA=SeqID_3524; Strand=+; Position=93-970
  misc_feature: Homolog annotation: Hit_ID=XP_392669.1; Match level="QueryCoverage =90%, HitCoverage=63%, E-value=1e-40, Identity=38%"; Hit description =similar to venom protease precursor [Apis mellifera]
  misc_feature (222)..(222): Xaa can be any naturally occurring amino acid
  misc_feature (238)..(238): Xaa can be any naturally occurring amino acid
MGVSGTLVVSTLLILYISRMAAAIDSVCDYRQQLTTGASYTFNNYGSPNSYPIGSDCRWWVQGDVDTRVYLTCTIDIPLTSNCGGDKFRVSLIGDGTYFSDARNYCGLQTISLVSTRNTLAVEMYSTIYSSGGVFSCSIKAVRNPVTTTTPAPTCDCGWKQATRIVGGDDTGVHEYPSMAALLDNSILEVICGAVILNQRYVMTAAHCPTIVTMDKMSILVXGWDMSQVDSTKEYEVXNYWKHPQYDANTQINDIAIVQSRYLIAFSFGRGPFVYHYIRNIYFTTQVYFIRMG

SEQ ID NO: 23828 - protein, 266 aa, Diabrotica virgifera
  misc_feature: Coding regions on vcDNA: vcDNA=SeqID_3525; Strand=+; Position=111-911
  misc_feature: Homolog annotation: Hit_ID=XP_392669.1; Match level="QueryCoverage =99%, HitCoverage=64%, E-value=6e-61, Identity=45%"; Hit description =similar to venom protease precursor [Apis mellifera]
  misc_feature: Gene Ontology Annotation: Molecular function=plasma kallikrein activity; Cellular component=integral to plasma membrane; Biological process=proteolysis and peptidolysis
  misc_feature: Pfam annotation: Pfam_ID=Trypsin; Match level="Score=186.0, E-value =7.8e-53, Copies=1"; Pfam description=Trypsin
IKAVRNPVTTTTPAPTCDCGWKQATRIVGGDDTGVHEYPSMAALLDNSILEVICGAVILNQRYVMTAAHCPTIVTMDKMSILVGGWDMSQVDSTKEYEVSNYWKHPQYDANTQINDIAIVQSRYLIAFSLDVGPICLPFIYEQYNFNYQSVTLLGWGQTFYNGPSSDILQKVNVQVTNNSYCQKMMPGNQITQAQICTYASGKDACQHDSGGPVIWQDSVSRRLYAVGVISYGLGCATNRPAVNTRVTSYLDWIVNIIQDYGFCMK

SEQ ID NO: 23829 - protein, 310 aa, Diabrotica virgifera
  misc_feature: Coding regions on vcDNA: vcDNA=SeqID_3526; Strand=+; Position=17-946
  misc_feature: Homolog annotation: Hit_ID=XP_393207.1; Match level="QueryCoverage =91%, HitCoverage=48%, E-value=2e-43, Identity=36%"; Hit description =similar to Glucosylceramidase precursor (Beta-glucocerebrosidase) (Acid beta-glucosidase)
  misc_feature: Gene Ontology Annotation: Cellular component=extracellular space
  misc_feature: Pfam annotation: Pfam_ID=Glyco_hydro_30; Match level="Score=-139.1, E- value=6.3e-05, Copies=1"; Pfam description=O-Glycosyl hydrolase family 30
MIFSGRVFLKLGVLLAGGIFLVRSEKCVSKDFGNGGTVCVCNSTYCDTYEPVKPVPSNQYIVITSNKAGLRFNKDIRNFTSNTSGKQCVIPKDDKVCETVRTTDYKVCGASPKSLLTSGSTIYIDSSIGYQEIKGFGGAITDAAMVNVANMSASLKKHLLRSYFSHDGLNYTIARVPMGSTDFSTRLYSYIDSDTNEVNCVDHTLKNFKLAPEDINLKIPFIHEALKLQKNLKLFTSTWVIPKAYKENNSYMGFVGFVRKEVYQLLANYYVKFFDLYKQHNLTFWGLYTSNEPFIAMAEYVGTPGTLWYP

SEQ ID NO: 23830 - protein, 378 aa, Diabrotica virgifera
  misc_feature: Coding regions on vcDNA: vcDNA=SeqID_3527; Strand=+; Position=52-1189
  misc_feature: Homolog annotation: Hit_ID=NP_509589.1; Match level="QueryCoverage =90%, HitCoverage=74%, E-value=4e-69, Identity=37%"; Hit description =putative protein, with at least 6 transmembrane domains (53.0 kD) (XK70) [Caenorhabditis elegans]
  misc_feature (309)..(309): Xaa can be any naturally occurring amino acid
  misc_feature (335)..(335): Xaa can be any naturally occurring amino acid
MVFRTGIELSEVKYNGFWDWFVHVSDVQTLWKLQPTYLIVQAVYCLGALLTLIHALINKGRLPYLWIGVLLHGIYVEVITYFLPDIDNFWHSQTPIIFVGRRLPLHIMLLYPCFIYNAQIAAAKLKLPKWSEPFLVGLLVVLIDLPYDIVSVKYVHWTWHDTDPNLFDRHYWVPWNSYFFHTTFAAGFTFWFHFLREKICNSGDRWVADKSVFKELICTILPAVLGFPTGIIGFILIYHPLHDLYNIHSEITYIILFVICLLLSWTGERVTAQREGANSVVGKLHGSSYLTLFHLVVHYATFMLMLIFXHPEDEVSTGMKEPIGPCDEYSPLQTXFGMTLQKRKWVCPTDYNEDYFDFTAYRTENPINVPCGHIWEHV

SEQ ID NO: 23831 - protein, 393 aa, Diabrotica virgifera
  misc_feature: Coding regions on vcDNA: vcDNA=SeqID_3528; Strand=+; Position=7-1188
  misc_feature: Homolog annotation: Hit_ID=EAL25715.1; Match level="QueryCoverage =81%, HitCoverage=33%, E-value=1e-151, Identity=81%"; Hit description= GA20098-PA [Drosophila pseudoobscura]
  misc_feature: Gene Ontology Annotation: Molecular function=ATP binding; Cellular component=cytoplasm; Biological process=protein kinase cascade
  misc_feature: Pfam annotation: Pfam_ID=Pkinase; Match level="Score=255.0, E-value =1.4e-73, Copies=1"; Pfam description=Protein kinase domain
MAQGVLSSDISRRNPQDDYELIQRIGSGTYGDVYKAKRLSTNDFAAIKVIKLEPGDDFGIIQQEILMMRDCLHPNIIAYYGSYLRRDKLWICMEYCGGGSLQDIYHITGPLAENQIAYMCRETLLGLQYLHTMGKMHRDIKGANILLTECGDVKLDDFGVSAQITATINKRKSFIGTPYWMAPEVAAVERKGGYNQLCDIWAIGITAIELAELQPPMSDLHPMRALFLMSKSGFKPPTLKDKEKWSPTFHHFVKIALVKNPKKRPTAEKLLQHAFFQGDMHRRLALELLQKVNNPSHMFADLEPDEDGAVPNVPQRIASRLTSRPKPQNAVLSNSDVDRIDEANNTLQRSDIPTVIVEEKQPQWDLMDIMNNATTVYNCIEHQNQKWWNWKCF

SEQ ID NO: 23832 - protein, 279 aa, Diabrotica virgifera
  misc_feature: Coding regions on vcDNA: vcDNA=SeqID_3529; Strand=+; Position=60-896
  misc_feature: Homolog annotation: Hit_ID=XP_395882.1; Match level="QueryCoverage =75%, HitCoverage=77%, E-value=2e-35, Identity=38%"; Hit description =similar to CG1102-PA [Apis mellifera]
  misc_feature: Gene Ontology Annotation: Molecular function=serine-type endopeptidase activity; Cellular component=extracellular; Biological process=Tl signaling pathway
MVSSSMALLWKSLLLITCFLVVVKSQGFFIGYNPYIGYAIPNNNRNKWARATHINPLLLPDFNDWVVDDDGCRTPTGGTGDCIPVRQCKAMMDVLRTVKRPLSPSIRKQLNAYFCSFANGMANVCCPQEPIIIHDDSVPEVPQPPPDVSNHRNLNLLPSDCGYLDPNDRIRNGQNADLNEFPWMALLSYRTRRGPDFKCGGTVINNRYILTAAHCISNLDTPLLGVRVGEYNTRTRRDCVIGKDGSEKCNKDPVQDLAIEEIIPHPQFDATVISNDIGL

SEQ ID NO: 23833 - protein, 413 aa, Diabrotica virgifera
  misc_feature: Coding regions on vcDNA: vcDNA=SeqID_3530; Strand=+; Position=66-1307
  misc_feature: Homolog annotation: Hit_ID=XP_395882.1; Match level="QueryCoverage =86%, HitCoverage=99%, E-value=7e-80, Identity=41%"; Hit description =similar to CG1102-PA [Apis mellifera]
  misc_feature: Gene Ontology Annotation: Molecular function=serine-type endopeptidase activity; Cellular component=extracellular; Biological process=Tl signaling pathway
  misc_feature: Pfam annotation: Pfam_ID=Trypsin; Match level="Score=209.1, E-value =8.6e-60, Copies=1"; Pfam description=Trypsin
  misc_feature (368)..(368): Xaa can be any naturally occurring amino acid
MVSSSMALLWKSLLLITCFLVVVKSQDWVVDDDGCRTPTGGTGDCIPVRQCKAMMDVLRTVKRPLSPSIRKQLNAYFCSFANGMANVCCPQEPIIIHDDSVPEVPQPPPDVSNHRNLNLLPSDCGYLDPNDRIRNGQNADLNEFPWMALLSYRTRRGPDFKCGGTVINNRYILTAAHCISNLDTPLLGVRVGEYNTRTRRDCVIGKDGSEKCNKDPVQDLAIEEIIPHPQFDATVISNDIGLLRVAQINLGVENARPVCLPLGEHRTEKLKRVTVTGWGVTDTQTGATSDILQKVDLPVVDLDYCRNVYKNQSRARITYKQVCAGGKNKQDSCPGDSGGPLHVAGLIDDNARYIQQGVVSFGPRECGXEGFPGVYTRVGYYWDWKLNNLNLNFIKSYFPLCERDGVFGLRKTC

SEQ ID NO: 23834 - protein, 300 aa, Diabrotica virgifera
  misc_feature: Coding regions on vcDNA: vcDNA=SeqID_3531; Strand=+; Position=44-946
  misc_feature: Homolog annotation: Hit_ID=XP_312912.1; Match level="QueryCoverage =79%, HitCoverage=30%, E-value=5e-65, Identity=49%"; Hit description =ENSANGP00000014764 [Anopheles gambiae]
  misc_feature: Gene Ontology Annotation: Molecular function=monocarboxylic acid transporter activity; Cellular component=integral to plasma membrane; Biological process=monocarboxylic acid transport
  misc_feature: Pfam annotation: Pfam_ID=MFS_1; Match level="Score=13.7, E-value =0.0011, Copies=1"; Pfam description=Major Facilitator Superfamily
MAKAKISKKEEARLREELQTAENQNSVPAPPDGGYGWVIVFASFISNMVVDGIGLSFGLILPYLVEEYGTTKGVAAWVGSVMVGFQMGAGPLVSAVANKFSCRTASIFGCLLASSCMALSTFCPSIPIMMVIYGVLGGTGYSFIYLPAVVMVGYYFESKRSLATGIAVCGTGVGAFAFAPLVNFLVNSYGWKKTNLFLAGITLACALFGALMKPLTYEEVTEEVVQQVPAKPGVMRTRTSEGNISTPGVYNSTLSMTKRKGSLPMGRKDVYIQDPFRISKNSNRESHLLSIEIASTVSKT

SEQ ID NO: 23835 - protein, 333 aa, Diabrotica virgifera
  misc_feature: Coding regions on vcDNA: vcDNA=SeqID_3532; Strand=+; Position=92-1095
  misc_feature: Homolog annotation: Hit_ID=XP_393097.1; Match level="QueryCoverage =90%, HitCoverage=43%, E-value=6e-27, Identity=31%"; Hit description =similar to CG14650-PA [Apis mellifera]
  misc_feature (289)..(289): Xaa can be any naturally occurring amino acid
MSEKRITLSNEAMEKIIGNMTAEMQNVDGQYVPLGFTPPSSTSEPLNWNQQTNYMNRYSPEVEQYPQQRYNFIPQAQHMFDANGYKKEYDLYKSMQNGTADMGLFETEYPYIPQMMNNIPEHPLLHSHHDAMPHVSNPSQLIDLVGNWMVPNNSGTYSPFGTSENYKPNVFDLPTDLNTSTSIHLKDETRYKTADQMEDIQFQFNRDSRKPRMVAEVKPMRPSYSDVLTKAVPQTLSKPLKCETKDSKPKKDSKKNNKNEKNQKMNSTLGRSSTNNDMKGNIDLKDVPXKNLNQTKSDKKTAKGGNFSKKWASLDNIADPSIKVEKTKKKKKR

SEQ ID NO: 23836 - protein, 463 aa, Diabrotica virgifera
  misc_feature: Coding regions on vcDNA: vcDNA=SeqID_3533; Strand=+; Position=2-1393
  misc_feature: Homolog annotation: Hit_ID=XP_311133.1; Match level="QueryCoverage =93%, HitCoverage=19%, E-value=1e-166, Identity=62%"; Hit description= ENSANGP00000004748 [Anopheles gambiae]
  misc_feature: Gene Ontology Annotation: Molecular function=signal transducer activity; Cellular component=nucleus; Biological process =neurotransmitter secretion
  misc_feature: Pfam annotation: Pfam_ID=zf-TAZ; Match level="Score=134.6, E-value =2.3e-37, Copies=1"; Pfam description=TAZ zinc finger
  misc_feature (15)..(15): Xaa can be any naturally occurring amino acid
FVRGQKKAKKSTKSXANQRKNSKKSNTPQTGNDLSAKIFATMEKHKEVFFVIRLHSVQSAASLKPIQDPDPFINCDLMDGRDAFLTLAREKHYEFSSLRRAKYSTLSMLYELHNQGQDKFVYTCNSCKAHVETRYHCTVCEDFDLCIQCYEKEGHPHKMEKLGLDIDDGSSPSDSKANPGEARKLSIQRCIHSLVHACQCRDANCRLPSCQKMKRVTNHTKLCKRKTNGGCPICKQLIALCCYHAKHCPENKCPVPFCSNIKHKLKQQQLQQRLQQAQLLRRRMAVMTRTAPAANPIPGGANVTMGGAGVQSVVPGAVSPANSMSTGLPNPQMGIPSPHQPGIGLKPQTPPANVLQVVKQVQEEAARQQAPHVGYGKVNPGQVPGQNMPPPQIRNMGHLGAGQSGGNLLPMEQWQQRYPSGVAPGIRQQGPPVMAKPDGSNTHADQSGCQGRVLRPISVSWKV

SEQ ID NO: 23837 - protein, 404 aa, Diabrotica virgifera
  misc_feature: Coding regions on vcDNA: vcDNA=SeqID_3534; Strand=+; Position=112-1326
  misc_feature: Homolog annotation: Hit_ID=EAL32792.1; Match level="QueryCoverage =100%, HitCoverage=100%, E-value=0.0, Identity=97%"; Hit description =GA13327-PA [Drosophila pseudoobscura]
  misc_feature: Gene Ontology Annotation: Molecular function=proteasome endopeptidase activity; Cellular component=proteasome regulatory particle (sensu Eukarya); Biological process=proteolysis and peptidolysis
  misc_feature: Pfam annotation: Pfam_ID=AAA; Match level="Score=305.2, E-value=1.1e -88, Copies=1"; Pfam description=ATPase family associated with various
MTVINKMEVDGGPKGEGFRSYYITKIEELQLIVAEKSQNLRRLQAQRNELNAKVRMLREELMLLQEQGSYVGEVVKPMDKKKVLVKVHPEGKFVVDIDKNIDINDVTPNCRVALRNESYTLHKILPNKVDPLVSLMMVEKVPDSTYEMVGGLDKQIKEIKEVIELPVKHPELFDALGIAQPKGVLLYGPPGTGKTLLARAVAHHTECTFIRVSGSELVQKFIGEGSRMVRELFVMAREHAPSIIFMDEIDSIGSSRIESGSGGDSEVQRTMLELLNQLDGFEATKNIKVIMATNRIDILDPALLRPGRIDRKIEFPPPNEEARLDILKIHSRKMNLTRGINLRKIAELMPGASGAEVKGVCTEAGMYALRERRVHVTQEDFEMAVAKVMQKDSEKNMSIKKLWK

SEQ ID NO: 23838 - protein, 225 aa, Diabrotica virgifera
  misc_feature: Coding regions on vcDNA: vcDNA=SeqID_3535; Strand=+; Position=247-920
  misc_feature: Homolog annotation: Hit_ID=XP_307926.1; Match level="QueryCoverage =95%, HitCoverage=77%, E-value=2e-99, Identity=77%"; Hit description =ENSANGP00000021770 [Anopheles gambiae]
  misc_feature: Gene Ontology Annotation: Molecular function=signal transducer activity; Cellular component=integral to membrane; Biological process=N-linked glycosylation
  misc_feature: Pfam annotation: Pfam_ID=Tetraspannin; Match level="Score=181.7, E -value=1.6e-51, Copies=1"; Pfam description=Tetraspanin family
  misc_feature (213)..(213): Xaa can be any naturally occurring amino acid
MATAYRRDYYRRQPTSNFTYVSPCVKYLIFILNFIFWLFGGLLIGIGLYAFVDKWQLTGWVRLENVYDVILNISLVMVIMGGVVFIVSFAGCVGALRENTCLLKFYSLCLLIFFLLEMGIAIVGFVFPHSMQSVLEENFTDKIIHTYRDDPDLQNFVDFAQQEFRCCGLSSEGYMDWSKNEYFNCSSPSVEHCGVPFSCCINATDLSSRLVNXMCGYGVQTLSGA

SEQ ID NO: 23839 - protein, 317 aa, Diabrotica virgifera
  misc_feature: Coding regions on vcDNA: vcDNA=SeqID_3536; Strand=+; Position=43-991
  misc_feature: Homolog annotation: Hit_ID=XP_312782.1; Match level="QueryCoverage =100%, HitCoverage=86%, E-value=1e-116, Identity=66%"; Hit description=ENSANGP00000020452 [Anopheles gambiae]
  misc_feature: Gene Ontology Annotation: Molecular function=DNA clamp loader activity; Cellular component=DNA replication factor C complex; Biological process=sister chromatid cohesion
  misc_feature: Pfam annotation: Pfam_ID=AAA; Match level="Score=52.1, E-value=1.6e -12, Copies=1"; Pfam description=ATPase family associated with various
  misc_feature (272)..(272): Xaa can be any naturally occurring amino acid
  misc_feature (283)..(283): Xaa can be any naturally occurring amino acid
MHSFLKSGKLGEPASKSGTSKSVKKPKSVPWVEKYRPKTVADVVEQSEAVAVLEQCISGADLPNLLFYGPPGTGKTSTILAAARQLFGDIYKERILELNASDERGIQVIRDKVKTFAQLTASGTRPDGKPCPPFKIVILDEADSMTHAAQAALRRTMEKETRTTRFCLICNYVSRIIEPLTSRCTKFRFKPLNESMIFERLTLICKEEGVQCDDDALNGLVETSGGDMRRAITCLQSCAKLKGTQEKIDVESVLEVTGVVPTNWLDEFLSVXCKNLVDYNNVXNFIQKLMVGAYAASQIWEQLNEKLINCDEFNDKQ

SEQ ID NO: 23840 - protein, 245 aa, Diabrotica virgifera
  misc_feature: Coding regions on vcDNA: vcDNA=SeqID_3537; Strand=+; Position=200-935
  misc_feature: Homolog annotation: Hit_ID=XP_319867.1; Match level="QueryCoverage =82%, HitCoverage=45%, E-value=2e-61, Identity=59%"; Hit description =ENSANGP00000005253 [Anopheles gambiae]
  misc_feature (218)..(218): Xaa can be any naturally occurring amino acid
MSYLKLLARFGSAGYRSCLQTYRNAPNTIAILHIQDFKYDQKRYYKDFGHKREKEPTITKIYYTFLFTMCLIPMIDWVWLKKLLSVKAESENIREGIHIPREELDDSAEDDTKKKKHRREKIGFRDRKIIEYENRIRHYSTPDKVFRYFATLQVQGPTVDQHEIYMTPDDFLRSMTPGLKQPDGLGLDQYRRYDPKTVHQKLELTLDEDSIFYKLGKXGLITFSDYIFLLTVLSTSRRHFEIAFR

SEQ ID NO: 23841 - protein, 249 aa, Diabrotica virgifera
  misc_feature: Coding regions on vcDNA: vcDNA=SeqID_3538; Strand=+; Position=253-999
  misc_feature: Homolog annotation: Hit_ID=XP_319867.1; Match level="QueryCoverage =82%, HitCoverage=46%, E-value=5e-59, Identity=57%"; Hit description =ENSANGP00000005253 [Anopheles gambiae]
MSYLKLLARFGSAGYRSCLQTYRNAPNTIAILHIQDFKYDQKRYYKDFGHKREKEPTITKIYYTFLFTMCLIPMIDWVWLKKLLSVKAESENIREGIHIPREELDDSAEDDTKKKKHRREKIGFRDRKIIEYENRMRAYSTPDKIFRYFATVKLLYHDVTEVFMTPDDFLRAITPGMKQPDGLGLDQYRRYDPKTVHHQKLELTLDEDSIFYKLGNSGLITFSDYIFLLTVLSTSRRPFEIAFACLTLT

SEQ ID NO: 23842 - protein, 422 aa, Diabrotica virgifera
  misc_feature: Coding regions on vcDNA: vcDNA=SeqID_3539; Strand=+; Position=1-1269
FRPRPQSNVPRNVGTNDRTITSSGTSNTHSTATTYSTSYNFEAYRRTLEENKNTQDVMQTHSKDTNLEAPQKRPSVSQRRKLWRMRKQGIDTSKVIFPPKPQKITIDNAEIAQAVEQTVFNLLQKRRPTTSSSASNTSTEAYWRSPKQNKPTPSGYKYSEHVTQTHSTDTDRSKLSGSQRRILQRMRSEGIDTTNFKLPPRPRNTPYAAYYAEVTKGLKRTRETTEKELTKRSKPAPIKTAVIPREYPDKIVAENDVGAIQDALTKLIDEAPSAPVYEKNRLMDGYYGLICADEESFRITKDYLEENTPWKVVKTEELPKSTKYVRMLMYLPNTKNDDLTAPLARLEKQNPGLRTNLWMILSSEATADEGLHVSLRIDKESEEVLKRLEWKPYFLLQRARSYWEKRLRERRRNTSTKTARNE

SEQ ID NO: 23843 - protein, 271 aa, Diabrotica virgifera
  misc_feature: Coding regions on vcDNA: vcDNA=SeqID_3540; Strand=+; Position=46-861
  misc_feature: Homolog annotation: Hit_ID=XP_396168.1; Match level="QueryCoverage =79%, HitCoverage=11%, E-value=2e-09, Identity=23%"; Hit description =similar to RE58116p [Apis mellifera]
MINKSVFTIFLLGVISLAQGFNTKYFDTEFLTSNGKLKLAKLVKYEPEKFDNYGVSGITANMNEYAEKIFFNIGRYALTHGLDPVNIANVTEDFMLASIKFKNGKLHGISTLKRYQDVLANYVHSSRTLIVTLPIEFVDLKFTYDYDVRIFGLGPSGSMDGEIKEFKFYLQFSLDLEHFVLSIKQLKTTDSGHISVQFHGNITDIIVNILSEFITTFLHPLLQGIIEAIIKLIAGGVVSEINKLLQQLVNPNATEFIIEELLVQLNKTLVN

SEQ ID NO: 23844 - protein, 375 aa, Diabrotica virgifera
  misc_feature: Coding regions on vcDNA: vcDNA=SeqID_3541; Strand=+; Position=535-1662
  misc_feature: Homolog annotation: Hit_ID=BAB21511.1; Match level="QueryCoverage =82%, HitCoverage=19%, E-value=4e-18, Identity=27%"; Hit description =ORF of non-LTR retrotransposon~composed of two sections ORF1 and ORF2 separated by translational frameshif
  misc_feature: Pfam annotation: Pfam_ID=zf-CCHC; Match level="Score=19.9, E-value =0.00077, Copies=1"; Pfam description=Zinc knuckle
MSTKGSTQHMHEREEDESFSTHLNLRLSSNSAEEPTFEENMKELMEFINNEMDPSNRLNKAGREGLKDRITAIAMNMANLAGQNKILREEVERLRKECKNTERMSYARVTAQPAMAIKTDKKSEQERKIEMRKEENTLFITCDKATTGRKVQEELTKVLNPRTEKIRINRMKTIGKALIIEAATKEDLEKIKNNANVTRNFKCELPKKRKPLVILYDVSSSAKEDDIKEDIRAQNFENMSKEEFEDSFKIRFKTGPRGKSTVHYVAEVSPGLRKALIRDKIYIGFSAINAKDYIVVPKCLKCQDLGHVAKHCTKETACSHCGGAHEKKECNKTEQRRTCIPCKARGKPECNKDLKDCPTHKMLIDRQILKTDWGK

SEQ ID NO: 23845 - protein, 321 aa, Diabrotica virgifera
  misc_feature: Coding regions on vcDNA: vcDNA=SeqID_3542; Strand=+; Position=88-1052
  misc_feature: Homolog annotation: Hit_ID=NP_651218.1; Match level="QueryCoverage =94%, HitCoverage=42%, E-value=4e-76, Identity=50%"; Hit description =CG6159-PA [Drosophila melanogaster] gb|AAF56241.1| CG6159-PA [Drosophila melanogaster]
  misc_feature: Gene Ontology Annotation: Cellular component=exocyst; Biological process=synaptic vesicle docking
  misc_feature: Pfam annotation: Pfam_ID=Sec10; Match level="Score=-290.1, E-value =0.00027, Copies=1"; Pfam description=Exocyst complex component Sec10
  misc_feature (235)..(235): Xaa can be any naturally occurring amino acid
  misc_feature (252)..(252): Xaa can be any naturally occurring amino acid
  misc_feature (264)..(264): Xaa can be any naturally occurring amino acid
  misc_feature (278)..(278): Xaa can be any naturally occurring amino acid
MMQQYMKELEQEPFDAEEFVERLAWRTLAESKGDGEEHEINPALLHESFVQAIKDLNLLHERQQKKCEKLEVVVREDEATFFQEIYNLLEQNKQAMDTFQELDGKINHVATKVLHLGDQLDSVNGPRSRVVDALKLMIHLTEFLSDESVLSPIFTRPELIDDAADVIQKLYLISQDLPPKFDVAKRKIERKYSDIEKSLIEEFVLAMDNEDLNRMKEIATVLSQFKGYSQCVDAXYIDHSQMGCLSSKDVIXLTFLTLCKYNHXIIAKVFNNPEQAMXKFCTETYFHLKLRQYLIQRLIPRKEPRVFKALLSYIITTQSRI

SEQ ID NO: 23846 - protein, 174 aa, Diabrotica virgifera
  misc_feature: Coding regions on vcDNA: vcDNA=SeqID_3543; Strand=+; Position=2-526
  misc_feature: Homolog annotation: Hit_ID=AAG17127.1; Match level="QueryCoverage =100%, HitCoverage=50%, E-value=2e-55, Identity=63%"; Hit description= cathepsin L-like cysteine proteinase CAL1 [Diabrotica virgifera virgifera]
  misc_feature: Gene Ontology Annotation: Molecular function=cathepsin K activity; Cellular component=extracellular space; Biological process =proteolysis and peptidolysis
  misc_feature: Pfam annotation: Pfam_ID=Peptidase_C1; Match level="Score=41.6, E -value=9.4e-14, Copies=1"; Pfam description=Papain family cysteine protease
  misc_feature (146)..(146): Xaa can be any naturally occurring amino acid
LLDCSSDYGNGDCEEGGLMTNAFEYIQDNGIESESSYPYTGRQGNCRRSASKSELKIKGYKEPANNEEALRQAVGTVGPISAAIYAEPIQFYNSGIFNSKQCVNNVNYLDHGILVVQYGEENNTPYSSILNSFGAIQKFLLTEGFXFFIDEVILSFKRNIALCGLAQMASYPVL

SEQ ID NO: 23847 - protein, 324 aa, Diabrotica virgifera
  misc_feature: Coding regions on vcDNA: vcDNA=SeqID_3544; Strand=+; Position=57-1031
  misc_feature: Homolog annotation: Hit_ID=AAG17127.1; Match level="QueryCoverage =99%, HitCoverage=100%, E-value=0.0, Identity=98%"; Hit description =cathepsin L-like cysteine proteinase CAL1 [Diabrotica virgifera virgifera]
  misc_feature: Gene Ontology Annotation: Molecular function=cathepsin S activity; Cellular component=extracellular space; Biological process =proteolysis and peptidolysis
  misc_feature: Pfam annotation: Pfam_ID=Peptidase_C1; Match level="Score=373.1, E -value=3.8e-109, Copies=1"; Pfam description=Papain family cysteine protease
MKLFIAFAAVILSASALSLNQHWESFKVQHGKVYKNPIEERVRFSVFQANLKTINEHNAKYEQGLVGYTMAVNQFADMTPEEFKAKLGMQAKNMPKIKKSRHVQNVNAEVPDSIDWRQKGAVLGVKDQGQCGSCWAFSATGSLEGQNYIVNGKSEPLSEQELLDCSVEYGNGDCDEGGLMTLAFEFVEENGIVSEASYPYEAIQGDCRTTNDKAVLHIQGYNEVYPSEEALRQAVGTVGPISAAIWAEPIQFYSSGIYDDPNCLNYVEYLDHGILVVGYGEENGTPYWIVKNSWGATWGEEGYFRLKRNIALCGLAQMASYPVL

SEQ ID NO: 23848 - protein, 323 aa, Diabrotica virgifera
  misc_feature: Coding regions on vcDNA: vcDNA=SeqID_3545; Strand=+; Position=49-1020
  misc_feature: Homolog annotation: Hit_ID=AAG17127.1; Match level="QueryCoverage =99%, HitCoverage=100%, E-value=1e-147, Identity=77%"; Hit description=cathepsin L-like cysteine proteinase CAL1 [Diabrotica virgifera virgifera]
  misc_feature: Gene Ontology Annotation: Molecular function=cathepsin K activity; Cellular component=extracellular space; Biological process =proteolysis and peptidolysis
  misc_feature: Pfam annotation: Pfam_ID=Peptidase_C1; Match level="Score=382.9, E -value=4.2e-112, Copies=1"; Pfam description=Papain family cysteine protease
MKLFVAFAAIILSVSALSLNDHWENFKVKHGKAYKNPIEERVRFSVFQSNLKLINEHNAKYEQGLVGYTMAVNQFADMTQEEFKAKLGMQAKNIPNIKTTRHVQDVNAEVPDSIDWRQKGAVLGVKDQGQCGSCWAFSATGSLEGQNYIINGKSVGLSEQELLDCSSDYGNGDCDYGGLMTSAFEYIEDHGIESESSYPYEAEQRECRRSSGKAAVNIQGYKEVAANEESLRQAVGTVGPISAAINANPIQFYSSGVFDGQCANSRNDLDHGILVVGYGEENNSPYWIIKNSWGADWGEQGYFRLERNVNMCGLDLVTSYPVL

SEQ ID NO: 23849 - protein, 238 aa, Diabrotica virgifera
  misc_feature: Coding regions on vcDNA: vcDNA=SeqID_3546; Strand=+; Position=124-840
  misc_feature: Homolog annotation: Hit_ID=XP_313371.1; Match level="QueryCoverage =100%, HitCoverage=84%, E-value=2e-29, Identity=35%"; Hit description= ENSANGP00000011377 [Anopheles gambiae]
  misc_feature: Gene Ontology Annotation: Molecular function=molecular_function unknown; Cellular component=cellular_component unknown; Biological process=cell proliferation
MADLDDFFAKKDRKKSKSTKKYATTEEVAKKLEDTAKKTDKLKKERVNEGEDSIVTEQDQDEWKDFEEEKKDYTGLKIGNLTIGQNSESSTTGAKESTEQQQEDEPGQDVDKKSGPWKRIDVGEAAEVEKVEYKPEPILPNVSKTGTYIPPSLRSSGQTQVQSTRLNRTKAAPDIHNEEFFPSLSGDHKKNRSEGSFEVVQSNRSTSHRQAEQSKINSAQGPRWNLANRYNTLSSNES

SEQ ID NO: 23850 - protein, 216 aa, Diabrotica virgifera
  misc_feature: Coding regions on vcDNA: vcDNA=SeqID_3547; Strand=+; Position=7-658
  misc_feature: Homolog annotation: Hit_ID=XP_395300.1; Match level="QueryCoverage =93%, HitCoverage=52%, E-value=2e-27, Identity=36%"; Hit description =similar to La autoantigen homolog [Apis mellifera]
  misc_feature: Gene Ontology Annotation: Molecular function=tRNA binding; Cellular component=nucleus; Biological process=histone mRNA metabolism
  misc_feature (58)..(58): Xaa can be any naturally occurring amino acid
MHIDQSYHPVVDPPKTIKLKSSHFTISKDVVTCKKFVEAESIKYGETELIRKFQQVYXARQLKVIQDRKNEKAASKVAAKSGTPLQFPKGAIIHFSGIEEGVKLLREDLKEKVKEVGKIEVKFVDFNQGDLEGYLRFAEENEAVEFFKTVDNDTLEIKDQKVKLRVLEGDEEEEYLKKTSDSILNMRKHKKQNSNNRKRKGNFGGGRRDAKVSKRD

SEQ ID NO: 23851 - protein, 317 aa, Diabrotica virgifera
  misc_feature: Coding regions on vcDNA: vcDNA=SeqID_3548; Strand=+; Position=118-1071
  misc_feature: Homolog annotation: Hit_ID=Q26457; Match level="QueryCoverage=93%, HitCoverage=77%, E-value=3e-66, Identity=43%"; Hit description=La protein homolog (La ribonucleoprotein) (La autoantigen homolog) gb|AAB35931.1| La
  misc_feature: Gene Ontology Annotation: Molecular function=tRNA binding; Cellular component=nucleus; Biological process=histone mRNA metabolism
  misc_feature: Pfam annotation: Pfam_ID=La; Match level="Score=100.2, E-value=5.3e -27, Copies=1"; Pfam description=La domain
MANDLEQKIIKQIEYYFGDINLPRDKFLQEKIKEDEGWITLDVLLTFKRLSSLSTDQELIAKAVEKSENGLVMVSEDRKKLRRNPEKPSPELNEERRKEIMGRTAYAKGFPLDEEFNNIITFLDAYGPVESCSRRSTKDHKFKGSCFIIFKDVETCKKFVEAESIKYGETELIRKFQQVYFDDKKKEIQDRKNEKAASKVAAKSGTPLQFPKGAIIHFSGIEEGVKLLREDLKEKVKEVGKIEVKFVDFNQGDLEGYLRFAEENEAVEFFKTVDNDTLEIKDQKVKLRVLEGDEEEEYLKKTSDSILTVKKLRKRNS

SEQ ID NO: 23852 - protein, 419 aa, Diabrotica virgifera
  misc_feature: Coding regions on vcDNA: vcDNA=SeqID_3549; Strand=+; Position=86-1346
  misc_feature: Homolog annotation: Hit_ID=NP_610724.1; Match level="QueryCoverage =88%, HitCoverage=94%, E-value=1e-106, Identity=52%"; Hit description= CG8888-PA [Drosophila melanogaster] gb|AAF58586.1| CG8888-PA [Drosophila melanogaster]
  misc_feature: Gene Ontology Annotation: Molecular function=oxidoreductase activity; Cellular component=cellular_component unknown; Biological process =androgen biosynthesis
  misc_feature: Pfam annotation: Pfam_ID=adh_short; Match level="Score=78.5, E-value =1.8e-20, Copies=1"; Pfam description=short chain dehydrogenase
  misc_feature (368)..(368): Xaa can be any naturally occurring amino acid
MSGPFKRRSSIKTLPAMSLPVDSMRRASIRRASVALGQQTKTAGQQEVPWDILDRCLLPVVFCHAAAVIASNALNVLKIWQVTTFTLFIWFTIVTIGAVLFYHNLKVTAAGKAVLITGCDSRIGSALARQLDEQGFTVFAGFQNAAGSSAAEELKEVCSARLHVLQLDVSSETQILAASLYAVEHLPDGAPGLWAVVHAQSWVALGEIEWIPPQVIKKAADINFIGPTRVTQIMLPLVRRAKGRIVMITSGLCRVASPVRGIHCGLLAALESQAECLRKELKSRGVDVVVVAPGELTAGSSWLSDQHIIDQAKDMWKQLGQEQKTEYGENYFENALRSLEKHTKNQEVDLFPVLRSLNDACIRTFPLXEYTPDSRKEKAQVFIAEYLPRPGYERILPLKVKKFKNLPLHFTTYNLMYWV

SEQ ID NO: 23853 - protein, 116 aa, Diabrotica virgifera
  misc_feature: Coding regions on vcDNA: vcDNA=SeqID_3550; Strand=-; Position=799-1149
  misc_feature: Homolog annotation: Hit_ID=XP_533970.1; Match level="QueryCoverage =85%, HitCoverage=19%, E-value=3e-19, Identity=48%"; Hit description =PREDICTED: similar to jerky homolog-like [Canis familiaris]
  misc_feature: Gene Ontology Annotation: Molecular function=molecular_function unknown; Cellular component=nucleus; Biological process=central nervous system development
  misc_feature (63)..(63): Xaa can be any naturally occurring amino acid
  misc_feature (75)..(75): Xaa can be any naturally occurring amino acid
ITYLCLSLLTEKCLPPNTTALVQPMDQGVIASMKRNYRTKLLSSKIEGYDLKLFWKSFTILDXYEITSAWESVKXSTIVKSWRKLLQNIENCVKLAVGEDENEQPALSALTSLMNF

SEQ ID NO: 23854 - protein, 407 aa, Diabrotica virgifera
  misc_feature: Coding regions on vcDNA: vcDNA=SeqID_3551; Strand=+; Position=170-1390
  misc_feature: Homolog annotation: Hit_ID=EAA03988.3; Match level="QueryCoverage =98%, HitCoverage=85%, E-value=6e-84, Identity=37%"; Hit description =ENSANGP00000023525 [Anopheles gambiae str. PEST] ref|XP_565119.1| ENSANGP00000023525 [Anopheles gambiae st
  misc_feature (375)..(375): Xaa can be any naturally occurring amino acid
MSQTFSKIIPITSPIAATCMEYVHPWTDSCAQATCGLYLYCIYDSLRIYGTVYMLTLLMKGRIPTKDDLKKTFFGIIQSTAFLSGTGFGYSLFLCLLRKTFGNYNILTVSAIPVFLSSVFSILIERPSRRILLALYVSNVATETLWNMAKSRNMISSIRYGDVAIYSISMAILSMYFKGGYHKSSDCPDSHDDAMFRVMRFVIGPYEEKGYMRSPSQSNTFYREVHKDDEPSTSSGAGSSRSWQTTRRKNGVYRIVCQMLRVYSRIINKLKSCSRHPSCKHPFSCLYYTIEGAGRMFSLGLGLQVTLKLVLNLKRVLQSPQNIKSILFRKETFNLAMFLGLYNGVFRACLCILRRVRGGDSPVHALPAGILAGMXVSRYPDSTVSLYVLWKVAQITYNFGIDKGILP

SEQ ID NO: 23855 - protein, 299 aa, Diabrotica virgifera
  misc_feature: Coding regions on vcDNA: vcDNA=SeqID_3552; Strand=+; Position=4-903
  misc_feature: Homolog annotation: Hit_ID=XP_311354.1; Match level="QueryCoverage =88%, HitCoverage=32%, E-value=2e-60, Identity=45%"; Hit description =ENSANGP00000021373 [Anopheles gambiae]
  misc_feature: Gene Ontology Annotation: Molecular function=oxidoreductase activity; Cellular component=integrin complex; Biological process=muscle development
  misc_feature: Pfam annotation: Pfam_ID=Integrin_beta; Match level="Score=-60.1, E -value=1.7e-18, Copies=1"; Pfam description=Integrin, beta chain
  misc_feature (171)..(171): Xaa can be any naturally occurring amino acid
  misc_feature (253)..(253): Xaa can be any naturally occurring amino acid
MKSYVRNSFLLLFIITSVIAQFDPKFIIPNRCAPKETCSECIQIPDCSWCFDPNFGNGPRCFDAEIQFPQHKKCPEEFVFFPENIQNVVTNLELTKARKWDTDGDETITEGVVASYKTGGTRDQMVQVAPQRIRLKLRPGAVHTIAMKYTQAEDYPLDIYYLMGLSKSTSXNEKLLSLGETLATMKKLTSNLQVGFGTFSDKALMPHDNNLTENFLHSAPYGYKHVLRLSTDAELFSRTVKQANVSGNLMAPXGGFDAVLPALQCTDQIGWRQEARKLLVGCTDANFHVAGDGKLGGYY

SEQ ID NO: 23856 - protein, 435 aa, Diabrotica virgifera
  misc_feature: Coding regions on vcDNA: vcDNA=SeqID_3553; Strand=+; Position=132-1439
  misc_feature: Homolog annotation: Hit_ID=NP_788358.1; Match level="QueryCoverage =92%, HitCoverage=31%, E-value=1e-102, Identity=50%"; Hit description= CG30084-PD, isoform D [Drosophila melanogaster] gb|AAO41385.1| CG30084-PD, isoform D [Drosophila
  misc_feature: Gene Ontology Annotation: Molecular function=structural constituent of muscle; Cellular component=actin cytoskeleton; Biological process= actin filament organization
  misc_feature: Pfam annotation: Pfam_ID=PDZ; Match level="Score=55.9, E-value=1.1e -13, Copies=1"; Pfam description=PDZ domain (Also known as DHR or GLGF
MASLITVHLNKGGSPNLGFRLQGGKDFGTPLLIQKVNVGSPAERAGLVAGDAVIKINNTDVYNLRHKDAQDVVVRAGPSFEISVQRGGSTWIPSVIPTGPLSAPSPYVNSSGPVTRTSLAANKSENIGSIGTGHNLSAKPFSPQLNGSVNGGPKLVNKQYNTPLKLYSEESIAETLSAQTEVLSTGALGVNFKKNERNYDSSNSEVLRALKEAENEPSYPDHEADSGVVTSPNSGIAGLRHVQAPENRPQPPQPQLPPGQNICADCERLIVGVFVRIKDKNLHVECFKCSTCGSSLKNVGYYNINNKLYCDVHAKSAALKNQTNPNLVPITIPPGGRAPAHAISSALSSHSYPISSPLSPKLNTAGTQYQTNYSGPKPFSSVNAPLSPHNTLPRAAPLSPVAPAPSFNSHSYTPSAYSPSSDYANSLCHARESEI

SEQ ID NO: 23857 - protein, 64 aa, Diabrotica virgifera
  misc_feature: Coding regions on vcDNA: vcDNA=SeqID_3554; Strand=-; Position=945-1139
PNKKNPFYLKQKKLCFVNTFFSFFLFFISSLFFLSKRGIFFWIPCTLVNCFKYICPSFETLFVC

SEQ ID NO: 23858 - protein, 173 aa, Diabrotica virgifera
  misc_feature: Coding regions on vcDNA: vcDNA=SeqID_3555; Strand=+; Position=3-524
  misc_feature: Homolog annotation: Hit_ID=EAA00085.2; Match level="QueryCoverage =96%, HitCoverage=48%, E-value=2e-31, Identity=41%"; Hit description =ENSANGP00000017945 [Anopheles gambiae str. PEST] ref|XP_552574.1| ENSANGP00000017945 [Anopheles gambiae st
  misc_feature: Gene Ontology Annotation: Molecular function=triacylglycerol lipase activity; Cellular component=extracellular; Biological process =triacylglycerol metabolism
  misc_feature: Pfam annotation: Pfam_ID=Lipase; Match level="Score=-37.3, E-value =7.5e-10, Copies=1"; Pfam description=Lipase
RIDPRLRISTMNIVGHSLGAHVAGVPGRILNGQLDHIMGLDPAGPLFTTENTRNRLMPGSAQFVHVIHTCGGLIGRLNPRVRADYYPNGGKNHQPGCEMDVLGNCAHFLSIKFYIESILTGNFKARKCGSYDDFTKGKCNDSPISYMGQYKVDKGAQGSYFLQTNRKPPYAKI

SEQ ID NO: 23859 - protein, 254 aa, Diabrotica virgifera
  misc_feature: Coding regions on vcDNA: vcDNA=SeqID_3556; Strand=+; Position=123-883
  misc_feature: Homolog annotation: Hit_ID=XP_394265.1; Match level="QueryCoverage =88%, HitCoverage=23%, E-value=1e-36, Identity=35%"; Hit description =similar to ENSANGP00000001667 [Apis mellifera]
  misc_feature: Gene Ontology Annotation: Molecular function=kainate selective glutamate receptor activity; Cellular component=integral to plasma membrane; Biological process=synaptic transmission
  misc_feature (238)..(238): Xaa can be any naturally occurring amino acid
MFKCARVVIFVILVVAIEGIRRKPVNIAIFLNDDDQYEISSIAVISVIRRVNLYHRVESFLHPHIFKVQKHEVLRAGQLVCQLVEKGIAAIFGPESPEINDMIQSVSSTLQIPQFQTFWNPKLATLAYRQPVADRPNQVFNLHPSPKALSKALATLVRENDWKSYTILYENDNGLLRLQETLKQLNPRDPVVAFKALGPKENLRSVLKEVKASGVSHFILDCEADRIMDILRLAQNFXLLSEFHSYILTNLDSH

SEQ ID NO: 23860 - protein, 279 aa, Diabrotica virgifera
  misc_feature: Coding regions on vcDNA: vcDNA=SeqID_3557; Strand=+; Position=140-979
  misc_feature: Homolog annotation: Hit_ID=NP_723346.1; Match level="QueryCoverage =85%, HitCoverage=78%, E-value=4e-36, Identity=37%"; Hit description =CG31605-PG, isoform G [Drosophila melanogaster] gb|AAN10661.1| CG31605-PG, isoform G [Drosophila
  misc_feature: Pfam annotation: Pfam_ID=ig; Match level="Score=31.7, E-value=2.2e -06, Copies=2"; Pfam description=Immunoglobulin domain
MKNFVFCVTLNFLFFISSVFSIQLAAKEKTVIFTPKHQFTISCNVSEAEGTPEIIWTRNDVEVTKIDALKNVKSSYSKEKSQVTLTLSDPKDDFAGNYKCVANPGKPDEVYAEIRVTRAVLVKVPANINVVEEEKLRIQCKVLGDAKLSWTFNNQTYNISEGRVTLENYTEDGKVVVNGMFIVEGITKDDRGIVTCIGGVDAATNKSIQSECMVRIKDKYAALWPFLGICAEVIILCAIIIVYEKKRNKTELEESDTDQSPDQKNTPDHGKDANLRHRQ

SEQ ID NO: 23861 - protein, 292 aa, Diabrotica virgifera
  misc_feature: Coding regions on vcDNA: vcDNA=SeqID_3558; Strand=+; Position=30-1051
  misc_feature: Homolog annotation: Hit_ID=XP_319491.1; Match level="QueryCoverage =90%, HitCoverage=80%, E-value=4e-91, Identity=64%"; Hit description =ENSANGP00000020204 [Anopheles gambiae]
  misc_feature: Gene Ontology Annotation: Molecular function=solute:cation symporter activity; Cellular component=integral to plasma membrane; Biological process=transport
  misc_feature: Pfam annotation: Pfam_ID=Mito_carr; Match level="Score=181.6, E-value= 1.6e-51, Copies=2"; Pfam description=Mitochondrial carrier protein
  misc_feature (161)..(161): Xaa can be any naturally occurring amino acid
  misc_feature (250)..(250): Xaa can be any naturally occurring amino acid
  misc_feature (271)..(271): Xaa can be any naturally occurring amino acid
IIVKSGKSAVCQLFQDISLQISSPMAEKQASFSLVPKIVNGGIAGIIGVTCVFPLDLVKTRLQNQQIGPNGEKMYNNKLDAFKKTFKTEGFFALYRGAGVNLLLITPEKALKLAANDFFRYHLSTGGVLPVYKQVIAGGLAGLCQLIITTPMELLKIQMQXAGRVEAATKMGSQGQQIKEKLTATKLALNIIKTDGIFGFYKGTGATALRDVSFSMVYFPLFFALNELGPKRADSDTIFWATFFAGLGAXGGVSALSVIPFDVVKTRLQTXKKAAGEDFYTGIPDAFRRIFL

SEQ ID NO: 23862 - protein, 75 aa, Diabrotica virgifera
  misc_feature: Coding regions on vcDNA: vcDNA=SeqID_3559; Strand=+; Position=206-433
ELILVIGLLYFINILIVVVIVWNCSCTYYKFSFVIFCTIVGNPQCYFDVAAMISYSFIIFNIHSCSAAMKSSFVY

SEQ ID NO: 23863 - protein, 89 aa, Diabrotica virgifera
  misc_feature: Coding regions on vcDNA: vcDNA=SeqID_3560; Strand=+; Position=304-573
  misc_feature: Homolog annotation: Hit_ID=AAK92171.1; Match level="QueryCoverage =98%, HitCoverage=95%, E-value=2e-41, Identity=87%"; Hit description =ribosomal protein L37 [Spodoptera frugiperda] sp|Q962S7|RL37_SPOFR 60S ribosomal protein L37
  misc_feature: Pfam annotation: Pfam_ID=Ribosomal_L37e; Match level="Score=127.9, E -value=2.5e-35, Copies=1"; Pfam description=Ribosomal protein L37e
MTKGTSSFGKRRNKTHTLCRRCGRSSYHIQKSQCAQCGYPSAKLRSYNWSIKAKRRKTTGTGRLRHLKIVRRRFRNGFREGTKPVKKST

SEQ ID NO: 23864 - protein, 478 aa, Diabrotica virgifera
  misc_feature: Coding regions on vcDNA: vcDNA=SeqID_3561; Strand=+; Position=122-1558
MKNLIFFLYAILVPSLNAIPVDVIQRNIPVEVRYDQILPGIVSREQVLMHGRRNLDAKVQLSSDELPQVLKHLPIPLESDLVPEIVSEEKVQVASEVENNAVKSLIQPEDQESVEVLPEKPIDLPIEVPETPFVKSLLAPEPLSDSNTVLQKAAPKPAQTLDSVLQETQNIIRVGLKNLRDSFKPNKGELGPTAEQWATLEKQVDEYFSEEKHKLAIRQSQPVEGGSTAAPVAQQPQNNWVQNIVNGINGIASNFVQSIQSIGSATSGGAQPPNGQADEGAAGAPPSNGFQGFVQFFNNGISNIVSTITGTNNNQPTTSNNNLSDPGSGATQAPGNVIGGFFGTIVSNVQNAFGIQPPPQGAQGDTGSQQQNGPVQVIQSVGNAISNFFGGNRPPSNSQGDEGASAQPGNSNIIQNIQNAIQNSPLNPFRPQNGQTQVNTNPVQQAVQSIGYSSTTTYLHAGGSGASPPPHPVTSSGI

SEQ ID NO: 23865 - protein, 170 aa, Diabrotica virgifera
  misc_feature: Coding regions on vcDNA: vcDNA=SeqID_3562; Strand=+; Position=105-617
  misc_feature: Homolog annotation: Hit_ID=XP_311903.1; Match level="QueryCoverage =74%, HitCoverage=76%, E-value=3e-52, Identity=73%"; Hit description =ENSANGP00000018267 [Anopheles gambiae]
  misc_feature: Gene Ontology Annotation: Molecular function=transcription factor activity; Biological process=response to stress
  misc_feature: Pfam annotation: Pfam_ID=SelR; Match level="Score=248.9, E-value=8.8e- 72, Copies=1"; Pfam description=SelR domain
MLKIVLRNLQSTRTDYRCLISRTIKQNLHTGAVAMANEKIDKEEIRKKLTPLQYHVTQEKGTERPFTGSYNKVYDAGTYVCIVCEVSLFSSDTKYDSGCGWPAFNDVLDQGKVKLTPDTSGGRIRTEVTCAECGAHLGHVFGDGPPPTRKRFCINSASLNFIPHEKKDES

SEQ ID NO: 23866 - protein, 301 aa, Diabrotica virgifera
  misc_feature: Coding regions on vcDNA: vcDNA=SeqID_3563; Strand=+; Position=3-908
  misc_feature: Homolog annotation: Hit_ID=XP_319323.1; Match level="QueryCoverage =96%, HitCoverage=26%, E-value=1e-111, Identity=69%"; Hit description= ENSANGP00000012364 [Anopheles gambiae]
  misc_feature: Gene Ontology Annotation: Molecular function=ATP citrate synthase activity; Cellular component=citrate lyase complex; Biological process=ATP catabolism
PEEAYIADLDSKSGASLKLTILNKSGRIWTMVAGGGASVIYSDTICDLGGASELANYGEYSGAPTEQQTYEYAKTILSLMTQEKHPKGKVLVTGGGIANFTNVAATFRGIITALVEFRERLIEHKISIFVRRAGPNYQEGLRRMREVGQTLGIPLYVFGPETHMTAICGMALGTRPIPSENHVETATANFALPSGEIEPNKQQLASKDGAAKPAAPPARNMVMDHIYSILKFGAKDANQGDSKALPMFTNNTKAIIWGMQNRAIQSMLDFDFVCNRKSPSVVAIIYPFTGDPSKILLRTQR

SEQ ID NO: 23867 - protein, 113 aa, Diabrotica virgifera
  misc_feature: Coding regions on vcDNA: vcDNA=SeqID_3564; Strand=+; Position=442-788
  misc_feature: Homolog annotation: Hit_ID=NP_648641.2; Match level="QueryCoverage =89%, HitCoverage=32%, E-value=7e-25, Identity=51%"; Hit description =CG10222-PA [Drosophila melanogaster] gb|AAF49823.2| CG10222-PA [Drosophila melanogaster]
  misc_feature: Gene Ontology Annotation: Molecular function=molecular_function unknown; Cellular component=cellular_component unknown; Biological process=biological_process unknown
  misc_feature: Pfam annotation: Pfam_ID=ATP_bind_1; Match level="Score=-68.6, E -value=0.041, Copies=1"; Pfam description=Conserved hypothetical ATP binding pr
  misc_feature (32)..(32): Xaa can be any naturally occurring amino acid
  misc_feature (45)..(45): Xaa can be any naturally occurring amino acid
  misc_feature (76)..(76): Xaa can be any naturally occurring amino acid
MALERVKKAESFYGQVVIGPPGSGKTTYCGKXMRFTKKKLNRESXSLILNPANENMGYSPEINIMQLVTVENVMAXIKLGPNGALMDCMEYLEKNFDWLFKKINKIKNSYLIF

SEQ ID NO: 23868 - protein, 440 aa, Diabrotica virgifera
  misc_feature: Coding regions on vcDNA: vcDNA=SeqID_3565; Strand=+; Position=145-1467
  misc_feature: Homolog annotation: Hit_ID=XP_309558.1; Match level="QueryCoverage =98%, HitCoverage=98%, E-value=1e-130, Identity=55%"; Hit description= ENSANGP00000022280 [Anopheles gambiae]
  misc_feature: Gene Ontology Annotation: Molecular function=poly(A) binding; Cellular component=cytoplasm; Biological process=mRNA metabolism
  misc_feature: Pfam annotation: Pfam_ID=PABP; Match level="Score=144.3, E-value=2.7e- 40, Copies=1"; Pfam description=Poly-adenylate binding protein, uniqu
MNPGAPNYPMASLYVGDLHSDITEAMLFEKFSTAGPVLSIRVCRDLITRRSLGYAYVNFQQPADGKELMEGKPLYVGRAQKKAERQQELKRRFEALKMERLNRYQGVNLYVKNLDDTIDDERLRKEFSPFGTITSAKVMMEEGRSKGFGFVCFSSPEEATKAVTEMNGRIVGTKPLYVALAQRKEDRKAHLTSQYMQRMANMRMHQMGQFIQPGASSGYFVPTIPTAQRFYGPAQMAQIRTSPRWPAQTPVRPGAQGGATAYTGMPNTYRAATRPPNQSTTMRSNISVPRPITGQQPQSMQGRPLAGQGGVVPSAGRTANFKYTSNMRNPPQSLGGIPGTAAPVQQAVHIQGQEPLTATMLAAAPPQEQKQMLGERLFPLIQRMYADMAGKITGMLLEIDNTELLHMLEHQESLKNKVEEAVAVLQAHQAKQAATQIKKD

SEQ ID NO: 23869 - protein, 603 aa, Diabrotica virgifera
  misc_feature: Coding regions on vcDNA: vcDNA=SeqID_3566; Strand=+; Position=565-2376
  misc_feature: Homolog annotation: Hit_ID=XP_309558.1; Match level="QueryCoverage =98%, HitCoverage=98%, E-value=0.0, Identity=58%"; Hit description =ENSANGP00000022280 [Anopheles gambiae]
  misc_feature: Gene Ontology Annotation: Molecular function=poly(A) binding; Cellular component=cytoplasm; Biological process=mRNA metabolism
  misc_feature: Pfam annotation: Pfam_ID=RRM_1; Match level="Score=325.1, E-value=1e -94, Copies=4"; Pfam description=RNA recognition motif. (a.k.a. RRM, R
KGKWYVVEAMLFEKFSTAGPVLSIRVCRDLITRRSLGYAYVNFQQPADAERALDTMNFDLIKGRPIRIMWSQRDPSLRKSGVGNVFIKNLDRSIDNKAMYDTFSAFGNILSCKVAQDENSSSKGYGFVHFETEEAANKSIEKVNGMLLNGKKVYVGRFIPHKEREKELGEKAKLFTNVYVKNFGEDFAEEQLKVMFEKYGKITSYKIMSKEDGKSKGFGFVAFESSEAAEAAVEALNGKELVEGKPLYVGRAQKKAERQQELKRRFEALKMERLNRYQGVNLYVKNLDDTIDDERLRKEFSPFGTITSAKVMMEEGRSKGFGFVCFSSPEEATKAVTEMNGRIVGTKPLYVALAQRKEDRKAHLTSQYMQRMANMRMHQMGQFIQPGASSGYFVPTIPTAQRFYGPAQMAQIRTSPRWPAQTPVRPGAQGGATAYTGMPNTYRAATRPPNQSTTMRSNISVPRPITGQQPQSGVVPSAGRTANFKYTSNMRNPPQSLGGIPGTAAPVQQAVHIQGQEPLTATMLAAAPPQEQKQMLGERLFPLIQRMYADMAGKITGMLLEIDNTELLHMLEHQESLKNKVEEAVAVLQAHQAKQAATQIKKD

SEQ ID NO: 23870 - protein, 621 aa, Diabrotica virgifera
  misc_feature: Coding regions on vcDNA: vcDNA=SeqID_3567; Strand=+; Position=584-2448
  misc_feature: Homolog annotation: Hit_ID=XP_309558.1; Match level="QueryCoverage =99%, HitCoverage=98%, E-value=0.0, Identity=69%"; Hit description =ENSANGP00000022280 [Anopheles gambiae]
  misc_feature: Gene Ontology Annotation: Molecular function=poly(A) binding; Cellular component=cytoplasm; Biological process=mRNA metabolism
  misc_feature: Pfam annotation: Pfam_ID=RRM_1; Match level="Score=366.4, E-value=4e -107, Copies=4"; Pfam description=RNA recognition motif. (a.k.a. RRM, R
  misc_feature (288)..(288): Xaa can be any naturally occurring amino acid
MNPGAPNYPMASLYVGDLHSDITEAMLFEKFSTAGPVLSIRVCRDLITRRSLGYAYVNFQQPADAERALDTMNFDLIKGRPIRIMWSQRDPSLRKSGVGNVFIKNLDRSIDNKAMYDTFSAFGNILSCKVAQDENGSSKGYGFVHFETEEAANKSIEKVNGMLLNGKKVYVGRFIPRKEREKELGEKAKLFTNVYVKNFGEDLSEEELRNMFEKYGKITSYKIMSKDDGKSKGFGFVAFENPEAAETAVEALNGKKLMEGKPLYKENPKKKLTPRKKKKRPNFDLKIXRVNRYQGVNLYVKNLDDTIDDERLRKEFSPFGTITSAKVMMEEGRSKGFGFVCFSSPEEATKAVTEMNGRIVGTKPLYVALAQRKEDRKAHLTSQYMQRMANMRMHQMGQFIQPGASSGYFVPTIPAAQRFYGPAQMTQIRASTRWAAQTTVRQGAQGGTTVYPGMQNTYRATARPPNQSTTMRSNMSVPRQITGQQPQNAIVPAAVNRTANFKYTSNMRNPPQPLGGLPGAAAPVQQAVHIQGQEPLTATMLAAAPPQEQKQMLGERLFPLIQRMYPDMAGKITGMLLEIDNTELLHMLEQQESLKNKVEEAVAVLQAHQAKQAATTQIKKE

SEQ ID NO: 23871 - protein, 408 aa, Diabrotica virgifera
  misc_feature: Coding regions on vcDNA: vcDNA=SeqID_3568; Strand=+; Position=117-1343
  misc_feature: Homolog annotation: Hit_ID=XP_309558.1; Match level="QueryCoverage =98%, HitCoverage=61%, E-value=0.0, Identity=83%"; Hit description =ENSANGP00000022280 [Anopheles gambiae]
  misc_feature: Gene Ontology Annotation: Molecular function=poly(A) binding; Cellular component=cytoplasm; Biological process=blood coagulation
  misc_feature: Pfam annotation: Pfam_ID=RRM_1; Match level="Score=360.7, E-value=2e -105, Copies=4"; Pfam description=RNA recognition motif. (a.k.a. RRM, R
KSKKYPTKMNPAAPNYPMASLYVGDLHSDITEAMLFEKFSTAGPVLSIRVCRDLITRRSLGYAYVNFQQPADAERALDTMNFDLIKGRPIRIMWSQRDPSLRKSGVGNVFIKNLDRSIDNKAMYDTFSAFGNILSCKVAQDENSSSKGYGFVHFETEEAANKSIEKVNGMLLNGKKVYVGRFIPHKEREKELGEKAKLFTNVYVKNFGEDFAEEQLKVMFEKYGKITSYKIMSKEDGKSKGFGFVAFESSEAAEAAVEALNGKELVEGKPLYVGRAQKRAERQQELKRRFEALKMERLNRYQGVNLYVKNLDDTIDDERLRKEFTPFGTITSAKVMMEEGRSKGFGFVCFSSPEEATKAVTEMNGRIVGSKPLYVALAQSKEDRKAHLTSQYMQRIYEYMSSSFRYVY

SEQ ID NO: 23872 - protein, 89 aa, Diabrotica virgifera
  misc_feature: Coding regions on vcDNA: vcDNA=SeqID_3569; Strand=-; Position=961-1230
KFFEAPPHKGRYIRRIALFMGKRIRIRKQVSQPFFYRHKLIKFGNLMARLNFPRAKKLPSFFAFFTSGVEPFSQFFFFLSLYEVYSFKF

SEQ ID NO: 23873 - protein, 216 aa, Diabrotica virgifera
  misc_feature: Coding regions on vcDNA: vcDNA=SeqID_3570; Strand=-; Position=37-687
NHIFPLQKTFSYWDPLHLALLPGWNPIDLALLPGWNPLHLALLPGWNPLDFTLLPGWNPLHLALLPGWNPLHVGIFPGILYHVGLLISSFFLALLHLALLPAMLCTCWSIDLLYSWTSSTSSSSWMETSSRWSFSWTPFHPVLLTGCKNHLPRSSFSWQPYPMLVFFLGSYFMFLFLESSSYMQSFFFPGIRSMLVFLESYPSYSSFHGDTPHVVS

SEQ ID NO: 23874 - protein, 290 aa, Diabrotica virgifera
  misc_feature: Coding regions on vcDNA: vcDNA=SeqID_3571; Strand=+; Position=263-1132
  misc_feature: Homolog annotation: Hit_ID=XP_319318.1; Match level="QueryCoverage =94%, HitCoverage=64%, E-value=6e-62, Identity=43%"; Hit description =ENSANGP00000012410 [Anopheles gambiae]
  misc_feature: Pfam annotation: Pfam_ID=Cyt-b5; Match level="Score=58.9, E-value =1.4e-14, Copies=1"; Pfam description=Cytochrome b5-like Heme/Steroid bindin
MPPNTDFVPPSSLGIKPIPSRGKGRVVTTHMWIKEKQIDDGAEGLWRVHDKIYDLTDFIHKHPGGSDWLTLTKGTDITEAFEVHHLTEFPNEILKKYFVKNATSERNSPYTFEEDGLYRILKKKIQPVLRNCPKESYTKSKLIIDSLLVLSFLFSIFAVKFWNFGLGVFGGVSLGMVTVAAHNYFHMKDNFRMYYFQFSLLQVREWRISHALSHHLYTNTITDLEISMFEPLLNYLPVEKKPLQKVVSVMLAPIMWLTFFHKPAIERIINLPNQYKELRFTDLLGLLLPS

SEQ ID NO: 23875 - protein, 548 aa, Diabrotica virgifera
  misc_feature: Coding regions on vcDNA: vcDNA=SeqID_3572; Strand=+; Position=119-1762
  misc_feature: Homolog annotation: Hit_ID=NP_523784.2; Match level="QueryCoverage =92%, HitCoverage=78%, E-value=0.0, Identity=75%"; Hit description =CG17725-PA, isoform A [Drosophila melanogaster] gb|AAF57676.1| CG17725-PA, isoform A [Drosophila
  misc_feature: Gene Ontology Annotation: Molecular function=phosphoenolpyruvate carboxykinase activity; Cellular component=mitochondrion; Biological process=glucose metabolism
  misc_feature: Pfam annotation: Pfam_ID=PEPCK; Match level="Score=1162.4, E-value=0, Copies=1"; Pfam description=Phosphoenolpyruvate carboxykinase
MRPLLAVFNNGNLLFCRFPKEFGRLTKTFGTPEVVFVSRQVRGISVVHGDLKDLPEKVQSYVQENVNLCQPDKLHICDGTDAENEKLIQLMLQQGTIKPLPKYENCWLASTNPADTARVESKTFICTDSKSETIPTPKNGVQGTLGNWLSPKDMDVAVKERFTSCMSGRTMYIVPFSMGPIGSPLSKIGIEITDSPYVVASMRIMTRMGAPVLRKLRESQEFVKCLHSVGTPSNGVLENPSWPCDPERTIILHRPKNNEIVPYGSGYGGNSLLGKKCFALRIGSTIARREGWLAEHMLILGITSPSGKKRYIAAAFPSACGKTNLAMMTPTLPGYKIECVGDDIAWMRFDKHGQLRAINPENGFFGVAPGTSRSSNPIAMDTVFKNTMFTNVGSTSDGGVYWEGMEKEVSDNIAITDWKGVPWTKGQKTPAAHPNSRFCTPANQCPIIDPAWEDPEGVPISAILFGGRRPAGVPLVYEARDWKHGVFIGSTMRSEATAAAEHKGKVIMHDPFAMRPFFGYNFGHYLSHWLSMEQKSSNLPKIFHVNWF

SEQ ID NO: 23876 - protein, 324 aa, Diabrotica virgifera
  misc_feature: Coding regions on vcDNA: vcDNA=SeqID_3573; Strand=+; Position=63-1030
  misc_feature: Homolog annotation: Hit_ID=XP_315722.1; Match level="QueryCoverage =96%, HitCoverage=70%, E-value=1e-128, Identity=72%"; Hit description= ENSANGP00000024488 [Anopheles gambiae]
  misc_feature: Gene Ontology Annotation: Molecular function=phenylalanine 4 -monooxygenase activity; Cellular component=cellular_component unknown; Biological process=phenylalanine catabolism
  misc_feature: Pfam annotation: Pfam_ID=Biopterin_H; Match level="Score=321.5, E -value=1.3e-93, Copies=1"; Pfam description=Biopterin-dependent aromatic amino ac
  misc_feature (295)..(295): Xaa can be any naturally occurring amino acid
  misc_feature (311)..(311): Xaa can be any naturally occurring amino acid
MMGPMSQPTNIIKNNEKKTVDMPMGSPPDIPKLMPGGNYIRIGKDSAHSTCIVFAPPAEEVGVLAKFLSIFKKHEVNLLHIESRPSSKTPDNYEFMVECAPTGNLGAAIADMKEISEYFQIISRDYRDNKDTVPWFPRRIRDLDRFANQILSYGAELDSDHPGFTDPVYRARRKYFADIAFNYKHGQKLPHVDYTKEETETWGKVFRQLTTLYPTHACKEHNHVFPLLVENCGYRADNIPQLEDISNFLKDCTGFTLRPVAGLLSSRDFLAGLAFRVFHSHPYIRHPSKPYYTPXEPDVCHELLGHVPLFXADPEFAQFSQEIG

SEQ ID NO: 23877 - protein, 281 aa, Diabrotica virgifera
  misc_feature: Coding regions on vcDNA: vcDNA=SeqID_3574; Strand=+; Position=340-1184
  misc_feature: Homolog annotation: Hit_ID=NP_730842.2; Match level="QueryCoverage =89%, HitCoverage=70%, E-value=1e-65, Identity=44%"; Hit description =CG31522-PD, isoform D [Drosophila melanogaster] ref|NP_730841.2| CG31522-PB, isoform B [Drosophila
  misc_feature: Gene Ontology Annotation: Molecular function=G-protein coupled photoreceptor activity; Cellular component=integral to membrane; Biological process=fatty acid biosynthesis
  misc_feature: Pfam annotation: Pfam_ID=ELO; Match level="Score=-38.5, E-value=3.9e -09, Copies=1"; Pfam description=GNS1/SUR4 family
  misc_feature (235)..(235): Xaa can be any naturally occurring amino acid
MENSTNIFDELHKVINVHEDSRTKDFFLIASPIPSIALSVVYLISVTVLIPTFMKNRKPYELKNFVIFYNGFQVLFSAWLFYAFLVGGWYSPVFTGKCFLPGSGSNMVLAAYCYFLSKFTEFVDTILFALRKKDNQITRLHLYHHSIMPFGSWLAAKYAPDGPMTFLGLINSWVHIVMYSYYMLSAMGPKVQKYLWWKKYITIMQLIQFVLTLTQSILTFFYGCNLPTAISIFIXTQSVVFFRMFFDFYMQSYKKKSSSKLATNEVAKTVPVEGIGEPVNL

SEQ ID NO: 23878 - protein, 246 aa, Diabrotica virgifera
  misc_feature: Coding regions on vcDNA: vcDNA=SeqID_3575; Strand=+; Position=332-1069
  misc_feature: Homolog annotation: Hit_ID=XP_313656.1; Match level="QueryCoverage =92%, HitCoverage=61%, E-value=1e-57, Identity=44%"; Hit description =ENSANGP00000013077 [Anopheles gambiae]
  misc_feature: Gene Ontology Annotation: Molecular function=G-protein coupled photoreceptor activity; Cellular component=cellular_component unknown; Biological process=fatty acid biosynthesis
  misc_feature: Pfam annotation: Pfam_ID=ELO; Match level="Score=-74.0, E-value=3e -07, Copies=1"; Pfam description=GNS1/SUR4 family
MENVSTSLLDGFHEMFDRNQDHRTKDYFLMSSPIPTMITVAIYLYTIKVLLPAYMKNKKPYDLKNVILIHNFIQVLISTALFLGFLFAGWYPIKYDLKCQSPRLPDLIEGAGIKIMHVSYGYYLSKFVELFDTVFFVLRKKDQHVSFLHVYHHAVMPLWCWGAVKYFPESQMTLYGMINCFIHIVMYTYYMLSAVGPSVQKYLWWKKHITVLQLIQFAIGAVHSLHLLIKGCMVPRLLSISLVFGS

SEQ ID NO: 23879 - protein, 272 aa, Diabrotica virgifera
  misc_feature: Coding regions on vcDNA: vcDNA=SeqID_3576; Strand=+; Position=200-1018
  misc_feature: Homolog annotation: Hit_ID=NP_523515.1; Match level="QueryCoverage =97%, HitCoverage=96%, E-value=6e-54, Identity=39%"; Hit description =CG9494-PA [Drosophila melanogaster] gb|AAF52719.2| CG9494-PA [Drosophila melanogaster]
  misc_feature: Gene Ontology Annotation: Molecular function=signal transducer activity; Cellular component=integral to membrane; Biological process=protein complex assembly
  misc_feature: Pfam annotation: Pfam_ID=Tetraspannin; Match level="Score=204.8, E -value=1.7e-58, Copies=1"; Pfam description=Tetraspanin family
MNLSCGSRTIKYLIFTFNFFFVITGIILIAVGASIHTYYTKYDFFLNSEYFSLPNMLIATGTFIFLICFLGCYGAIKNSWIMLMAFSLLLGIIFIFEFSAGIAGYVLRDKTEKYLTDSLTTAMDKYNSSSSTATMWDLVQTTFTCCGVNSYKDWEPVMKNTDLPISCCPTKAGTSGSFYCNAVTPTISTTTNETSTQHPNPKTGARKRRDVSQPATTTSPYNIGCETAFGKWVKAHAVDIGAVCFTLAVLQLIGIGFSCHLSKQLKNSYYST

SEQ ID NO: 23880 - protein, 354 aa, Diabrotica virgifera
  misc_feature: Coding regions on vcDNA: vcDNA=SeqID_3577; Strand=+; Position=84-1145
  misc_feature: Homolog annotation: Hit_ID=NP_608834.1; Match level="QueryCoverage =100%, HitCoverage=64%, E-value=1e-172, Identity=81%"; Hit description=CG15433-PA [Drosophila melanogaster] gb|AAF51012.1| CG15433-PA [Drosophila melanogaster]
  misc_feature: Gene Ontology Annotation: Molecular function=Pol II transcription elongation factor activity; Cellular component=DNA-directed RNA polymerase II, holoenzyme; Biological process=establishment and/or maintenance of chromatin architecture
  misc_feature: Pfam annotation: Pfam_ID=Radical_SAM; Match level="Score=63.6, E -value=5.4e-16, Copies=1"; Pfam description=Radical SAM superfamily
  misc_feature (346)..(346): Xaa can be any naturally occurring amino acid
MGKKKNEFSHLAVEERKVITVAEVVQELIKAHQDRKDVNLNSLKNKIASKYNLETAPRLVDIIAAVPIDYKKILVPKLLAKPIRTASGIAVVAVMCKPHRCPHINLTGNICVYCPGGPDSDFEYSTQSYTGYEPTSMRAIRARYDPYLQTRHRVEQLKQLGHSVDKVEFIVMGGTFMSLPDEYRDYFIRNLHDALSGHKSSSVEEAVIYSERSNTKCIGITIETRPDYCLEKHLSDMLKYGCTRLEIGVQSVYEDVALDTNRGHTVKAVCGTFHLAKDAGFKVVAHMMPDLPNVDLERDIEQYIEFFENPAFRSDGLKIYPTLVIRGTGLYELWKTGRYNSYPPSXLVDLIAKI

SEQ ID NO: 23881 - protein, 81 aa, Diabrotica virgifera
  misc_feature: Coding regions on vcDNA: vcDNA=SeqID_3578; Strand=+; Position=898-1140
KRRPGKNLRKKKKNPLGNPPPPLGGGRKKEGGAARPPPPPPPPPGGGVGAPPPHLFIPRGGGGGGAFSNTLLLHQTPPARP

SEQ ID NO: 23882 - protein, 229 aa, Diabrotica virgifera
  misc_feature: Coding regions on vcDNA: vcDNA=SeqID_3579; Strand=+; Position=74-763
IFFCYRKLYYCTTMEWKIITMAIILFQVSCVSPAVIPEEYNSQLHSLHEEIVTEITEFSLILVNGKDRLKSIVYGAKESLESELEQLKQYMRETKVDAADENKDISSCLDENVLDTIDISNIDICDHIPFTQRIEGMANDLDIRQKEFYSDMNSCTKEKTEEGTNDCLDGKIDEWKRNLKSCKLLETTLLETAYELSLRCTEISLNQIDKNIIFIARNFTSCVDEILEY

SEQ ID NO: 23883 - protein, 270 aa, Diabrotica virgifera
  misc_feature: Coding regions on vcDNA: vcDNA=SeqID_3580; Strand=+; Position=87-947
  misc_feature: Homolog annotation: Hit_ID=EAA11477.3; Match level="QueryCoverage =82%, HitCoverage=91%, E-value=9e-33, Identity=39%"; Hit description =ENSANGP00000010771 [Anopheles gambiae str. PEST] ref|XP_556661.1| ENSANGP00000010771 [Anopheles gambiae st
MFGFGLLLTVCVVFGQSHGSAIPMWEYLSKQEKTSFLYSMFATQVEKICESSSIQNCNRELLKYGLNKLKNLPEEYLDSMDPYQRGGSSIVWDTMMAGHPLANAIPRPRSTTTAKPNSYEDEPFSDFDFAAPKDILNQYRVQPSGYRPQNIFSYLNSIGSDKKGPYRRFQEQYQTTTTSTTTERALVDPMDEGMYDDAPLTGPMVVRVYPDGTPVKEDLPLPQDDDLRQYQMSQVKIPNFLSFIMQKLVVKNCDIFVNIYFRWLYEWMDG

SEQ ID NO: 23884 - protein, 229 aa, Diabrotica virgifera
  misc_feature: Coding regions on vcDNA: vcDNA=SeqID_3581; Strand=+; Position=32-721
  misc_feature: Homolog annotation: Hit_ID=XP_310832.1; Match level="QueryCoverage =96%, HitCoverage=64%, E-value=7e-49, Identity=46%"; Hit description =ENSANGP00000012484 [Anopheles gambiae]
MVKAKVWKQIRPFDGLPERSDFELVEENLRPIEDGEFLVKAMYLSVDPCTAGPHIDKNNNTTRQTQIARIIQSKNEDFPEGKLVVVRSSWRTYSIVDGTVDPAIPEPYLLPNMGGLCPSVALGMLGVPGNIAYFTFLELCDPKKGETVVVSGAASLVGSIVCQIAKIKECTVIGIVETDDEGKWLKDLGIDHFINRNNQDVDKELTGIAKQGVDCYFDNVGGKSFCSSL

SEQ ID NO: 23885 - protein, 379 aa, Diabrotica virgifera
  misc_feature: Coding regions on vcDNA: vcDNA=SeqID_3582; Strand=+; Position=60-1199
  misc_feature: Homolog annotation: Hit_ID=XP_311258.1; Match level="QueryCoverage =91%, HitCoverage=26%, E-value=1e-36, Identity=29%"; Hit description =ENSANGP00000001591 [Anopheles gambiae]
  misc_feature: Gene Ontology Annotation: Molecular function=cell adhesion molecule activity; Cellular component=plasma membrane; Biological process =neuronal cell adhesion
  misc_feature: Pfam annotation: Pfam_ID=fn3; Match level="Score=61.8, E-value=2e-15, Copies=2"; Pfam description=Fibronectin type III domain
MWRTDVVVCLVLVKLVGCYANRELIPLDPPGNLRLIEFEEKDVLIEWDGIEPASVRGTFKGYLVRIWNHVWSQVYAIPPEMNKTAIQFYPYSRNFITVAVRNDKYVGPRSNAISFDAPQTEPNMPFLFEHFQLGASSVLLQWNKPTQPNGVLLGYNIYCSEMDGDIVNEKSTIRYFVTGVDNFQAKLTGLKEGTKYFVEIGALNCAGESERKSIEVDLEMHIPYAPAMPSFKYTIDFNSTDLKQATKDNCHKSRSFYLYDFNATSAPGEINYPNDNEKRPTTHNVTHKDWVHINTNCLVNTMIKWIPDIDNNPGEHFYIKYKIKGEQEYLKAGPELEEDYLILENFNACVNYEIILVAVDGEFETESEMQETPAVMFKF

SEQ ID NO: 23886 - protein, 244 aa, Diabrotica virgifera
  misc_feature: Coding regions on vcDNA: vcDNA=SeqID_3583; Strand=+; Position=65-799
  misc_feature: Homolog annotation: Hit_ID=NP_080804.1; Match level="QueryCoverage =99%, HitCoverage=99%, E-value=8e-43, Identity=40%"; Hit description =RIKEN cDNA 2700060E02 [Mus musculus] gb|AAH48357.1| RIKEN cDNA 2700060E02 [Mus musculus]
MSKRLLLALEYPNADNVNLDDENTFKSIIIWLETNKIRKAPNDVVNQLKNNNRDWHNTFSKYKDGIGCPPLKNRTEELQWILGYAVQLETQKNKNVYLKHAVENLQAKNVPAVVAENILDKLDFRSPEFAEGIKELAKVLNVVCHPDPLVTLKAVRKVVIQRMSPDCVEHPEKYVLKGTPFPIQDADLGFDLNDPVLNQAAKILRMIYIQDMRNLQTRANELIVAVQSVTANPKTDTKLGKVGF

SEQ ID NO: 23887 - protein, 248 aa, Diabrotica virgifera
  misc_feature: Coding regions on vcDNA: vcDNA=SeqID_3584; Strand=+; Position=9-755
  misc_feature: Homolog annotation: Hit_ID=XP_319271.1; Match level="QueryCoverage =95%, HitCoverage=94%, E-value=5e-41, Identity=42%"; Hit description =ENSANGP00000012324 [Anopheles gambiae]
  misc_feature: Gene Ontology Annotation: Molecular function=structural constituent of eye lens
  misc_feature: Pfam annotation: Pfam_ID=Chitin_bind_4; Match level="Score=108.1, E -value=2.3e-29, Copies=1"; Pfam description=Insect cuticle protein
MAAKFLVLAAFVVVASGYEHHDENFGHGAQHAISTYSTVQHHAPAVHAYAAHVPAVQTYAAQPLVQQYAAPVVHAYAAPVAKTVYAEPSAPAHYDFAYGVADPHTGDSKHQHESRRGDFVHGSYSLLESDGTKRVVDYTADPHHGFNAVVHNEPAVHAVAPVVAKAIVPNVAYSAPVHQAYAAPVAHTTYSVPTHAYAAPVAHAAYAAPLAQTYSTSVAHGYAAPLGHAKAGHYGYAAQAPVVSYNVY

SEQ ID NO: 23888 - protein, 281 aa, Diabrotica virgifera
  misc_feature: Coding regions on vcDNA: vcDNA=SeqID_3585; Strand=+; Position=13-858
  misc_feature: Homolog annotation: Hit_ID=BAB32480.1; Match level="QueryCoverage =87%, HitCoverage=97%, E-value=2e-50, Identity=45%"; Hit description =cuticle protein [Bombyx mori]
  misc_feature: Gene Ontology Annotation: Molecular function=structural constituent of eye lens
  misc_feature: Pfam annotation: Pfam_ID=Chitin_bind_4; Match level="Score=118.1, E -value=2.2e-32, Copies=1"; Pfam description=Insect cuticle protein
MATKFLVLAAFIAVANAGSCGSGFGYAAPAVVAHGSHDAISTYSTVQHHAPAVHSYAAHAPLVHAPVAHSYAAPLVQAPVAHAYAAPVAHVHAEPSAPAHYDFAYGVSDPHTGDAKSQHESRRGDVVHGSYSLVESDGTKRTVDYTADPHHGFNAVVHKEPTVHAVAPVVAKIVAPVAHAAPVAHAAYAAPAVHAAYSAPAVHAAYSAPAVHAAYSAPVVHAAHAAPVAHAAYAGPVAHAAYAAPALHGYASSVAHGYAAPLAHGHHAYAAHAPVLSHNLW

SEQ ID NO: 23889 - protein, 315 aa, Diabrotica virgifera
  misc_feature: Coding regions on vcDNA: vcDNA=SeqID_3586; Strand=+; Position=38-985
  misc_feature: Homolog annotation: Hit_ID=CAE47497.1; Match level="QueryCoverage =100%, HitCoverage=100%, E-value=3e-95, Identity=52%"; Hit description=cathepsin L-like proteinase [Diabrotica virgifera virgifera]
  misc_feature: Gene Ontology Annotation: Molecular function=cysteine-type peptidase activity; Cellular component=extracellular space; Biological process= protein catabolism
  misc_feature: Pfam annotation: Pfam_ID=Peptidase_C1; Match level="Score=301.9, E -value=1e-87, Copies=1"; Pfam description=Papain family cysteine protease
MKLLLAIACLVAGITADLNDYDQYVHFKAKHSKQYRITEDKLRFQIFQNNLQEIEEHNARYAKGEVGWFKGVTPFADWTKEEFKALLTRQAASKPKLTYRQSCIADSNVTLPLSVDWRLKDVVLPVRDQGKCGSCWAFSVVGALEGQVAIHQNQRVPLSPQYLVDCSRTNYGCSGGIQEDAFEEIRNIGICADADYPYEGQNQDCRKDVKKAISSISGYKECNPTEEDLISAVATVGPISSTVDASTWSLYAGGILDDTNCGDWLNHAVLAVGYTDDYILIKNSWGEDWGEEGYIKLARGHNICAINEDNSYPVL

SEQ ID NO: 23890 - protein, 316 aa, Diabrotica virgifera
  misc_feature: Coding regions on vcDNA: vcDNA=SeqID_3587; Strand=+; Position=142-1092
  misc_feature: Homolog annotation: Hit_ID=CAE47497.1; Match level="QueryCoverage =100%, HitCoverage=100%, E-value=5e-98, Identity=52%"; Hit description=cathepsin L-like proteinase [Diabrotica virgifera virgifera]
  misc_feature: Gene Ontology Annotation: Molecular function=cysteine-type peptidase activity; Cellular component=extracellular space; Biological process= protein catabolism
  misc_feature: Pfam annotation: Pfam_ID=Peptidase_C1; Match level="Score=304.9, E -value=1.3e-88, Copies=1"; Pfam description=Papain family cysteine protease
MKVIVVIACLIVAITAKLNNYDHWVSFKAKHSKQYKLLEDKLRFQIFQDNLREIEEHNARYAKGEVGWFKGVTKFADWTKEEFEALLKRQSASKPKLDKSLGVYTADPNVKVPSSVDWRTENAVLPVRDQGSCGSCWAFSSVGALEGQLAINYNQRVPLSPQYLVDCSEENNGCGGGDQRLAFRFLKHNRMPSEEDYPYTMKDDVCREDVKMSLGPISGYTHLNATEESLISALATVGPIAVSADATKWSLYGGGVFDDEECGKNINHAILATGYTDEYIVIKNSWGADWGEDGYMKLARGQNTCQINVDNSYPTL

SEQ ID NO: 23891 - protein, 107 aa, Diabrotica virgifera
  misc_feature: Coding regions on vcDNA: vcDNA=SeqID_3588; Strand=-; Position=939-1262
PYFKPSNHLVNPVSSQPRLFYAIIIILLLLLLSQKRCICGRAGPGTDKLYLSTEYRVLFIFEERVQSTEYIAQKKYSEYNTQSTITRISRVLISSPFECRARKKVRR

SEQ ID NO: 23892 - protein, 369 aa, Diabrotica virgifera
  misc_feature: Coding regions on vcDNA: vcDNA=SeqID_3589; Strand=-; Position=310-1419
  misc_feature: Homolog annotation: Hit_ID=AAC24982.2; Match level="QueryCoverage =71%, HitCoverage=26%, E-value=2e-27, Identity=31%"; Hit description =reverse transcriptase [synthetic construct]
  misc_feature: Gene Ontology Annotation: Molecular function=molecular_function unknown; Cellular component=cellular_component unknown; Biological process=biological_process unknown
  misc_feature: Pfam annotation: Pfam_ID=RVT_1; Match level="Score=116.8, E-value =5.4e-32, Copies=1"; Pfam description=Reverse transcriptase (RNA -dependent
TPDLIVIYVIIWSGEKEYKHYLRLWLLSLVTTQHANHSHIPTRPSPRDLNEHIFVAKIKLPFVLLYPFLIKFRNSPIGISLISHALNIFLRIIQNRVFLLCESRMGNKQFGFRDGLGTREALFCMRVLLQKSCEFRKNVYVCFIHFEKAFDRVQHDILFNCLQAAGLDHYDIRLLKYLYYNQVASIQVGDSRTEKLPIKRGVRQYCVLSPTLFNLYSEEIFSEALDDRQEGVRPGGEVINNIRYADDTAFLAENLKDLQTLLNLVSEASYRRGLKINISKTKWMVVGKINIDQGQLSLDGEELERVNNFKYLGSWLNVNCDSDEEIITKIEISRKAFMTWKQVLCNRNLFDEYSKECTEMLCVVYLIWL

SEQ ID NO: 23893 - protein, 252 aa, Diabrotica virgifera
  misc_feature: Coding regions on vcDNA: vcDNA=SeqID_3590; Strand=+; Position=136-892
  misc_feature: Homolog annotation: Hit_ID=NP_524870.1; Match level="QueryCoverage =84%, HitCoverage=41%, E-value=1e-76, Identity=66%"; Hit description =CG5725-PE, isoform E [Drosophila melanogaster] gb|AAN12126.1| CG5725- PE, isoform E [Drosophila
  misc_feature: Gene Ontology Annotation: Molecular function=molecular_function unknown; Cellular component=plasma membrane; Biological process =membrane organization and biogenesis
  misc_feature: Pfam annotation: Pfam_ID=Fumble; Match level="Score=125.8, E-value=1e- 34, Copies=1"; Pfam description=Fumble
  misc_feature (209)..(209): Xaa can be any naturally occurring amino acid
MAPHSCKGCLRDVMAARMSKKNTDPPMEVNGVDEAHTVHNLSMPWFGMDIGGSLCKLVYFEPKELPGTREEAASQVETLMNIRRYLTKNSAYGKTGHRDMHLQMDNVKIRGILGTLHFIRFPTSGMKNFLSLAKYKGMAKLVTTVSATGGGAYKFEEDFRREVNLKLAKFDEFDSLLAGLHYIDRNNPSECYYWANSTDEERCSKVNYXFSRPYPFLIVNIGSGVSVLAVYSETQYKRISGTSIGGRTFLGL

SEQ ID NO: 23894 - protein, 275 aa, Diabrotica virgifera
  misc_feature: Coding regions on vcDNA: vcDNA=SeqID_3591; Strand=+; Position=223-1050
  misc_feature: Homolog annotation: Hit_ID=NP_524870.1; Match level="QueryCoverage =84%, HitCoverage=45%, E-value=7e-78, Identity=62%"; Hit description =CG5725-PE, isoform E [Drosophila melanogaster] gb|AAN12126.1| CG5725- PE, isoform E [Drosophila
  misc_feature: Gene Ontology Annotation: Molecular function=molecular_function unknown; Cellular component=plasma membrane; Biological process =membrane organization and biogenesis
  misc_feature: Pfam annotation: Pfam_ID=Fumble; Match level="Score=159.0, E-value =1.1e-44, Copies=1"; Pfam description=Fumble
  misc_feature (271)..(271): Xaa can be any naturally occurring amino acid
MAPHSCKGCLRDVMAARMSKKNTDPPMEVNGVDEAHTVHNLSMPWFGMDIGGSLCKLVYFEPKELPGTREEAASQVETLMNIRRYLTKNSAYGKTGHRDMHLQMDNVKIRGILGTLHFIRFPTSGMKNFLSLAKYKGMAKLVTTVSATGGGAYKFEEDFRREVNLKLAKFDEFDSLLAGLHYIDRNNPSECYYWANSTDEERCSKVNYDFSRPYPFLIVNIGSGVSVLAVYSETQYKRISGTSIGGGTFFRTLCLLLAVYIRRSIGLAAEXDIET

SEQ ID NO: 23895 - protein, 410 aa, Diabrotica virgifera
  misc_feature: Coding regions on vcDNA: vcDNA=SeqID_3592; Strand=+; Position=321-1553
  misc_feature: Homolog annotation: Hit_ID=CAC12696.1; Match level="QueryCoverage =98%, HitCoverage=98%, E-value=1e-148, Identity=63%"; Hit description= prophenoloxidase activating factor [Tenebrio molitor]
  misc_feature: Gene Ontology Annotation: Molecular function=serine-type endopeptidase activity; Cellular component=plasma membrane; Biological process=cytoskeleton organization and biogenesis
  misc_feature: Pfam annotation: Pfam_ID=Trypsin; Match level="Score=179.2, E-value =8.7e-51, Copies=1"; Pfam description=Trypsin
MVSPLVGIAVLCLVCSINGQQGEDLDSLINSVFSRPAEDKPTTEATKPVTSSPGINLQPVESHGGETGIPGIGECNCVPYYLCNNGSINTNGEGIIDIRINEGPCGNQYIDVCCDKKNTVDEPITPTPNTNTVGCGHRNSRGAGVRITGATDGEAEFGEFPWMVAILREESVEGNPLKLNVYQCGGSLIHPQVALTAAHCVAGKNKVFKVRAGEWDTQHEKELYPFQDREVQSIVVHPQFYAGALYNDIALLFLKSPVSAAEHISTVCLPSQNQAPSGSGFATGWGKDQFGKKGKYQVILKKIELPVVSNNICQDKLRTTRLGRFFELHNSFMCAGGEPGKDTCKGDGGSPFVLSTGTEEDKFYQAGIVAWGIGCGENGTPGVYVNIAKFRSWIDEQMAKQNLDTSTYKY

SEQ ID NO: 23896 - protein, 463 aa, Diabrotica virgifera
  misc_feature: Coding regions on vcDNA: vcDNA=SeqID_3593; Strand=+; Position=2-1388
  misc_feature: Homolog annotation: Hit_ID=EAL39934.1; Match level="QueryCoverage =98%, HitCoverage=59%, E-value=1e-113, Identity=46%"; Hit description= ENSANGP00000028171 [Anopheles gambiae str. PEST] ref|XP_556470.1| ENSANGP00000028171 [Anopheles gambiae s
  misc_feature: Gene Ontology Annotation: Molecular function=molecular_function unknown; Cellular component=cellular_component unknown; Biological process=biological_process unknown
  misc_feature: Pfam annotation: Pfam_ID=RVT_1; Match level="Score=150.3, E-value =4.2e-42, Copies=1"; Pfam description=Reverse transcriptase (RNA -dependent
  misc_feature (212)..(212): Xaa can be any naturally occurring amino acid
  misc_feature (346)..(346): Xaa can be any naturally occurring amino acid
VNKELQELQELSRSTETRKFYQKLNKSRKDFKPRTTMCRDKEGNILTEQQEILRRWTEHFTEKLEGDGSETNPDIPLDQADNREKSPPTIAEIRTAVDKLKNNKSPGSDQVASELLKEGGDALQKTIHVLITKIWSNKQLPAEWNSGIIVPLHKKGNQLECGNYRGITLLNAAFKIMSNVIYERLRPHSEKIVGRYQSCFCRQKSTIDQIFXLRQILEKTSEHNIDTHHLFIDFESAYDNINREFLIKAMKEFNIPTQLIELIKESLKVESKIRIQNELTETDVKKGLRQRDVLSCILFNIVLEKIMRDTTLNTRGTIINKSVQILAFADDVDIIARSRREMIEAXQSKERAAQNSGLKINQNKTKYMQLSKNAEIRQPQNITIVEYNIEGVKNFTYLGSLVTSDNNAAEEVKRRIFIANKSYHGLIRQLRSDNVARKTKFQIYKTLIRPVLTYGSETWTLDT

SEQ ID NO: 23897 - protein, 574 aa, Diabrotica virgifera
  misc_feature: Coding regions on vcDNA: vcDNA=SeqID_3594; Strand=+; Position=53-1771
  misc_feature: Homolog annotation: Hit_ID=XP_312421.1; Match level="QueryCoverage =91%, HitCoverage=63%, E-value=0.0, Identity=75%"; Hit description =ENSANGP00000021964 [Anopheles gambiae]
  misc_feature: Gene Ontology Annotation: Molecular function=glutamate 5-kinase activity; Cellular component=cytoplasm; Biological process=amino acid biosynthesis
  misc_feature: Pfam annotation: Pfam_ID=AA_kinase; Match level="Score=158.9, E-value= 1.1e-44, Copies=1"; Pfam description=Amino acid kinase family
  misc_feature (513)..(513): Xaa can be any naturally occurring amino acid
  misc_feature (517)..(517): Xaa can be any naturally occurring amino acid
  misc_feature (546)..(546): Xaa can be any naturally occurring amino acid
  misc_feature (555)..(555): Xaa can be any naturally occurring amino acid
MWAYLKVPVKITGFRPAIWSTSQMVFTSISSRSITHQAAFEKKGLVDRKPSSFIDRSQLKYARRLVVKLGSAVITREDEHGLALGRLASIVEQVAECQNEGRECIMVTSGAVAFGKQRLTQELLMSLSMRETLSPTDHTREEAPTLVEPRAAAAVGQSGLMSLYDAMFSQYGVKIAQVLVTKADFYNEETRKNLISTLTELISLNIVPIINTNDAVSPPPQIDEPIGGKAGKKGISLKDNDSLAAMLAAEIQSDLLILMSDVDGIYDKPPWEAGAKFLHTFTSNLSHTIEFGQKSKVGTGGMDSKVTSATWALERGVSVIICNGTLDKAIRSIMAGRKVGTFFTEHSLGGPVSSEVVAENARLGGRILATLTPDQRASCVHNLADLLISRQAEILDANQKDLQEGAKMGLAKPLMSRLSLTPAKLRNLSIGLKQIADSSHNNVGRILKRTKLADGLILKQITVPIGVLLVIFESRPDSLPQVAALAIASGNGLLLKGGKEAMHSNKALMQLVXDSLXTIGADNAISLVSSREEISDLLTMENPIDXLIIPRGSNXLIRRIQIKATYTSGWARLE

SEQ ID NO: 23898 - protein, 267 aa, Diabrotica virgifera
  misc_feature: Coding regions on vcDNA: vcDNA=SeqID_3595; Strand=+; Position=85-886
  misc_feature: Homolog annotation: Hit_ID=XP_321348.1; Match level="QueryCoverage =86%, HitCoverage=62%, E-value=1e-67, Identity=54%"; Hit description =ENSANGP00000011582 [Anopheles gambiae]
  misc_feature: Gene Ontology Annotation: Molecular function=structural constituent of ribosome; Cellular component=mitochondrial large ribosomal subunit; Biological process=protein biosynthesis
  misc_feature (238)..(238): Xaa can be any naturally occurring amino acid
MNFLSLRTFQTTVFQTLQNNVIRSAPESLNIIQARCYAARKGTRDRKKKAKVKVEIQKVGFIPHNQRNREKFLASRPKLKFDDSGMRDPVDDVFVCKYYKWVVYPFQEAVKAHRETHHPEMYNRPETDLHVTVELNMEGEKKTRLLDNFTRTVGIPHRFDQGEIPSVAAFAKTQEIQKLAIDAGAQLVGGFDMIKKIQVGELNLNDFKYIVAHPEILPEMVVLRGLLKKKFPNPKSGXLDVNLGTAREKVLYGINYTASKDEYEKDY

SEQ ID NO: 23899 - protein, 66 aa, Diabrotica virgifera
  misc_feature: Coding regions on vcDNA: vcDNA=SeqID_3596; Strand=+; Position=155-355
MNWFLNHGNHQPVKYKFILHMQILHLLKLHYKKNILITNYHISFTIFKFINLNLLKMNNHFQFINL

SEQ ID NO: 23900 - protein, 603 aa, Diabrotica virgifera
  misc_feature: Coding regions on vcDNA: vcDNA=SeqID_3597; Strand=+; Position=133-1943
  misc_feature: Homolog annotation: Hit_ID=NP_610355.1; Match level="QueryCoverage =95%, HitCoverage=99%, E-value=1e-76, Identity=34%"; Hit description =CG2158-PA [Drosophila melanogaster] gb|AAF59131.1| CG2158-PA [Drosophila melanogaster]
  misc_feature: Gene Ontology Annotation: Molecular function=structural molecule activity; Cellular component=nuclear pore; Biological process=NLS -bearing substrate-nucleus import
  misc_feature: Pfam annotation: Pfam_ID=Ran_BP1; Match level="Score=-32.3, E-value =0.00014, Copies=1"; Pfam description=RanBP1 domain
  misc_feature (334)..(334): Xaa can be any naturally occurring amino acid
  misc_feature (535)..(535): Xaa can be any naturally occurring amino acid
MAGKRGATSDLNHENWDKEEPPEDAGTFQRASEDSLKSRVIKTARRRNPISSVRDGGDGEKKSAFTSFTGFGKAAPPTSTAFSFLSNLAKPNTPPKVNGTGGISEKSKNDASAFKYSSSPITGSGKLNEKVTTNVFGASTANTGNKDNNPTNSPSEKSNEYYSKLKGLNESVSKWIKSHVDANPLINLQPIFRDYEKYFAELEKEKDLKPPDTNNKTDSSMSSFAFKPTTNVPDSTTEKFQSISKNESSKTSENNIPKLTFGTSSTSSATPTFSFGSKASTDSGNKSFSFASTNNEASKTTAAIPSFSFGAKPSISTAVTTSEPAKSISTTTPXFSFGAQQASKEIPSFSFGSKASPVSSPVGSGASTTVPPVSLGTESSAKEATKPIPSFSFGTSMSSSTSAGTTANDTTKTTAIPSFSFGKSVTPFSSATPFTFANAVKPVSTDNKDKDAEEDEEPPTNEFTPVVEKDHVFTTRCKVFVKKEDKFGDRGVGNLYLKPIPDSEKVQMIVRADTNLGNLLLNCILSESIPTEETXGRKDVMLVCVPTPESEPPPVPVLLRVKSSEEADKLLETLNERYEKELLIFDSFYFSCDYGRMIRMIVF

SEQ ID NO: 23901 - protein, 564 aa, Diabrotica virgifera
  misc_feature: Coding regions on vcDNA: vcDNA=SeqID_3598; Strand=+; Position=40-1734
  misc_feature: Homolog annotation: Hit_ID=XP_319430.1; Match level="QueryCoverage =98%, HitCoverage=97%, E-value=1e-128, Identity=44%"; Hit description= ENSANGP00000014465 [Anopheles gambiae]
  misc_feature: Gene Ontology Annotation: Molecular function=gamma-glutamyl transferase activity; Cellular component=integral to plasma membrane; Biological process=spermatogenesis
  misc_feature: Pfam annotation: Pfam_ID=G_glu_transpept; Match level="Score=645.9, E- value=2.8e-191, Copies=1"; Pfam description=Gamma -glutamyltranspeptidase
MPVLQGLLLLLLAGSLTAMPNPLSTSGLEGAVVSNAPGCAEVGRDILKKGKNAIDAVIATAFCEGVGNPTTMGVGGGFLATYYNRAENIVYSINSREMAPSGATEDMFVSNQSLAQRGGLSVAVPGETRGYWILYNKFGGGVPWSALVEPTIKICEEGIEMNELTYNNVRDQIDVVRADPGLREIFINPATNQVYKKGETYKRVKLAQTLRVIAREGGNALHNGSLTKKFVADIKANGGIITAKDLADFKVEFLTPVNTTISGKQIYSVPLPGAGIIMTYILNILENYLPRNDHLSVKTYQRIVEALKYGYAMRSSLGDQDFVPGLDDLITKLSSKRYAADTRKKITDLKTFNEATHYGATFQSIQDHGTANLCVWGPNGDGISLTSSINYILGAGFVSESTGIILNDSMDDFSTPGLVNEYGYPPSPSNFIRPGKRPQSSMCPTIILDGRNDLFMVVGGAGGSKITSSVMQVILNRLYFNMDVESASGLQRVHHQLFPMTLDMEDEWIYENPEIVKGLQSKGHNITFSYPDGFVAVTAISLDKDSRHLVGVHDKRRRGSVAYM

SEQ ID NO: 23902 - protein, 309 aa, Diabrotica virgifera
  misc_feature: Coding regions on vcDNA: vcDNA=SeqID_3599; Strand=+; Position=2-930
  misc_feature: Homolog annotation: Hit_ID=AAH83665.1; Match level="QueryCoverage =91%, HitCoverage=43%, E-value=8e-69, Identity=43%"; Hit description =Unknown (protein for MGC:94507) [Rattus norvegicus]
  misc_feature: Gene Ontology Annotation: Molecular function=beta-galactosidase activity; Cellular component=lysosome
  misc_feature: Pfam annotation: Pfam_ID=Glyco_hydro_35; Match level="Score=287.8, E -value=1.8e-83, Copies=1"; Pfam description=Glycosyl hydrolases family 35
  misc_feature (294)..(294): Xaa can be any naturally occurring amino acid
ALAALPTSYEYYTDGGITAGLSDKQPYFTLNNKNITIYSGAFHYFRVPRAYWRDRLRKMRAAGLNTVETYVPWNLHEPQSGVYDFGNGGSDFEDFLHVEEFLKIAKEEDLFALVRAGPYICSEWEFGGLPSWILRNTSSVRNSKDQNYLSYVKRYFNILLPLLALLQFQKGGPIIGFQIENEYGNTGNDDVEYLKYIQQIFEDNNLIELYYTSDPPSANGLGAIPGILQTANFNSNSKWQLDKLNQLQHNKPTMTMEFWTGWFDHWLEDHHTVSAQQFKSLLEEIFDYPSSVTXYMFCSSTNFGFTNGS

SEQ ID NO: 23903 - protein, 119 aa, Diabrotica virgifera
  misc_feature: Coding regions on vcDNA: vcDNA=SeqID_3600; Strand=+; Position=1-360
PKMKLTGVCFLIVAFCAINALASPSDPDDPSPDEQTNAPSVSTSDSPPDTVTDSSSTAPTDSTPDPATDSSSTAPTDSPPNPATDSSASPTDSPCVRSQLRKVQLQVYLQARNILWLHL

SEQ ID NO: 23904 - protein, 151 aa, Diabrotica virgifera
  misc_feature: Coding regions on vcDNA: vcDNA=SeqID_3601; Strand=+; Position=123-578
  misc_feature: Homolog annotation: Hit_ID=AAK92160.1; Match level="QueryCoverage =88%, HitCoverage=83%, E-value=3e-42, Identity=65%"; Hit description =ribosomal protein L22 [Spodoptera frugiperda]
  misc_feature: Gene Ontology Annotation: Molecular function=structural constituent of ribosome; Cellular component=cytosolic ribosome (sensu Eukarya); Biological process=protein biosynthesis
  misc_feature: Pfam annotation: Pfam_ID=Ribosomal_L22e; Match level="Score=241.0, E -value=2.2e-69, Copies=1"; Pfam description=Ribosomal L22e protein family
FCCGFQTKTAVPVTKPQGKKPQIRGKGLKKKKVALKFVIDCTHPSEDNLLDVANFENYLKERIKINGKTGNFGAGKSGQHSVTVSRDKNVKIALSAEIPFSKRYLKYLTKKYLKKNNLRDWLRVVASGKDSYELRYFQIDSQEDDDEEDNE

SEQ ID NO: 23905 - protein, 147 aa, Diabrotica virgifera
  misc_feature: Coding regions on vcDNA: vcDNA=SeqID_3602; Strand=+; Position=21-464
  misc_feature: Homolog annotation: Hit_ID=AAK92160.1; Match level="QueryCoverage =90%, HitCoverage=83%, E-value=3e-42, Identity=65%"; Hit description =ribosomal protein L22 [Spodoptera frugiperda]
  misc_feature: Gene Ontology Annotation: Molecular function=structural constituent of ribosome; Cellular component=cytosolic ribosome (sensu Eukarya); Biological process=protein biosynthesis
  misc_feature: Pfam annotation: Pfam_ID=Ribosomal_L22e; Match level="Score=241.0, E -value=2.2e-69, Copies=1"; Pfam description=Ribosomal L22e protein family
MPTKTAVPVTKPQGKKPQIRGKGLKKKKVALKFVIDCTHPSEDNLLDVANFENYLKERIKINGKTGNFGAGKSGQHSVTVSRDKNVKIALSAEIPFSKRYLKYLTKKYLKKNNLRDWLRVVASGKDSYELRYFQIDSQEDDDEEDNE

SEQ ID NO: 23906 - protein, 429 aa, Diabrotica virgifera
  misc_feature: Coding regions on vcDNA: vcDNA=SeqID_3603; Strand=+; Position=23-1309
  misc_feature: Homolog annotation: Hit_ID=NP_523475.3; Match level="QueryCoverage =95%, HitCoverage=91%, E-value=2e-64, Identity=29%"; Hit description =CG3047-PA [Drosophila melanogaster] gb|AAF50957.4| CG3047-PA [Drosophila melanogaster]
  misc_feature: Gene Ontology Annotation: Molecular function=signal transducer activity; Cellular component=plasma membrane; Biological process =invasive growth
MKLTGACFLIVALCAINASARTISNKWESGNNQDDLPTSIVTNPPDPATDSSSVSPSDSPPEPVTDSSSTAPTDSPPDPATNQSSTAPTDSPPAPVTDSSSTAPTDSPPDPATDSASTAPTDSPPEPVTDSSSTAPTDSPPDPATDPSSTAPTDSPPEPVTDSSSTAPTDSPPDPATDSSSTAPTDSSPEPVTDSSSTAPTDSPPDPATDPSSTAPTDSTSEPVTDSSSTAPTDSPPDPATDSSSTAPTNSPPEPVTDSSSTAPTDSPPDPATDSSSTAPTAPVREPVTDSSSTAPTDSPPEPVTDSSSTAPTDSPPEPVTDSSSTAPTDSPPDPVTDSSSTAPTDSPPDPATDPSSTAPTDTPPEPVTDSSSTAPTYSPPEPITDSSSTAPTDSPPEPVTDSSSTAPTDSPPEPVTDSSSTAPTDSPP

SEQ ID NO: 23907 - protein, 147 aa, Diabrotica virgifera; identical to SEQ ID NO: 23905
  misc_feature: Coding regions on vcDNA: vcDNA=SeqID_3604; Strand=+; Position=354-797
  misc_feature: Homolog annotation: Hit_ID=AAK92160.1; Match level="QueryCoverage =90%, HitCoverage=83%, E-value=3e-42, Identity=65%"; Hit description =ribosomal protein L22 [Spodoptera frugiperda]
  misc_feature: Gene Ontology Annotation: Molecular function=structural constituent of ribosome; Cellular component=cytosolic ribosome (sensu Eukarya); Biological process=protein biosynthesis
  misc_feature: Pfam annotation: Pfam_ID=Ribosomal_L22e; Match level="Score=241.0, E -value=2.2e-69, Copies=1"; Pfam description=Ribosomal L22e protein family

SEQ ID NO: 23908 - protein, 78 aa, Diabrotica virgifera
  misc_feature: Coding regions on vcDNA: vcDNA=SeqID_3605; Strand=+; Position=329-565
  misc_feature: Homolog annotation: Hit_ID=AAK95148.1; Match level="QueryCoverage =75%, HitCoverage=44%, E-value=5e-15, Identity=61%"; Hit description =ribosomal protein L22 [Ictalurus punctatus]
  misc_feature: Pfam annotation: Pfam_ID=Ribosomal_L22e; Match level="Score=2.9, E -value=1.5e-05, Copies=1"; Pfam description=Ribosomal L22e protein family
FCCGFQTKTAVPVTKPQGKKPQIRGKGLKKKKVALKFVIDCTHPSEDNLLDVANFENYLKERIKINGKTGNFGAGIIQ

SEQ ID NO: 23909 - protein, 366 aa, Diabrotica virgifera
  misc_feature: Coding regions on vcDNA: vcDNA=SeqID_3606; Strand=+; Position=72-1169
  misc_feature: Homolog annotation: Hit_ID=CAG31761.1; Match level="QueryCoverage =95%, HitCoverage=77%, E-value=3e-51, Identity=31%"; Hit description =hypothetical protein [Gallus gallus] ref|NP_001006538.1| similar to diptheria toxin resistance protein
  misc_feature: Gene Ontology Annotation: Molecular function=molecular_function unknown; Cellular component=cellular_component unknown; Biological process=peptidyl-diphthamide biosynthesis from peptidyl-histidine
  misc_feature: Pfam annotation: Pfam_ID=Diphthamide_syn; Match level="Score=92.6, E -value=1e-24, Copies=1"; Pfam description=Putative diphthamide synthesis protei
  misc_feature (332)..(332): Xaa can be any naturally occurring amino acid
MTSFYSNEENSLEKVVVSNHPLIETKADDIDEVYEIKRCAEWIQSNGFKKVCLQFPDYLLQDASEVVLKLESIVNETIYLLGDTVYESCCIDFIAAAHINADAIIHFGPVCFSKFAENVPFMYVYEKRPLDIAHLKKIVETNFDDYHVAFLVDFGYLHLFDKLVEAFKDYKYLEFIRIDNLKDVRQGHTIFFYGKDERKMFNITSLITPLAVFYYDIGKSRVQAFADDIKSLTKRRYYLIERIKDSDTIGIIVGSIGIQNCLKLIDRLKSLISRSGKKYYLLNIGKPAVEKLANFPEFDVYVVIACSMSEIYDRRDFYKPIATPFDVETALXVDLETNPEWIHKFSYDFTDYLDICGDISTTYKQL

SEQ ID NO: 23910 - protein, 252 aa, Diabrotica virgifera
  misc_feature: Coding regions on vcDNA: vcDNA=SeqID_3607; Strand=+; Position=25-783
  misc_feature: Homolog annotation: Hit_ID=XP_311760.1; Match level="QueryCoverage =79%, HitCoverage=95%, E-value=9e-45, Identity=44%"; Hit description =ENSANGP00000013622 [Anopheles gambiae]
  misc_feature: Pfam annotation: Pfam_ID=DUF1676; Match level="Score=80.7, E-value=4e- 21, Copies=1"; Pfam description=Protein of unknown function (DUF1676)
MWFARASFAIALLTCVFAEELKHNSDRSDYKRSFAKDCDNTFSLTCLKLNIVGWVDKLNENENLSVFPGVSIVRENASAAGNNAEVVADLAREFPNDPDKRLDAFLLNKVQGFLNSHSIKVNFGGEEPEDENAVVGRKKKGRRGGGMGMMFAAAAMMKSTLFAIGMGALAALAGKALMTSLIALMLSAIIGLKSLSGGDSKTTYEVVSKPVYTHSSSHSSGHEDYHHGSGGYGRSFDVMPLPLGLQPGYKPA

SEQ ID NO: 23911 - protein, 77 aa, Diabrotica virgifera
  misc_feature: Coding regions on vcDNA: vcDNA=SeqID_3608; Strand=+; Position=944-1177
TVNDELCDVFSAGSSKKSTHQKTYKTSRHRGDIKVHTRPPCRGSQTNIERRCFLNCCNSYLLKTVIFGFGVNRYRSG

SEQ ID NO: 23912 - protein, 372 aa, Diabrotica virgifera
  misc_feature: Coding regions on vcDNA: vcDNA=SeqID_3609; Strand=+; Position=77-1195
  misc_feature: Homolog annotation: Hit_ID=XP_313154.1; Match level="QueryCoverage =99%, HitCoverage=64%, E-value=1e-171, Identity=83%"; Hit description= ENSANGP00000013382 [Anopheles gambiae]
  misc_feature: Gene Ontology Annotation: Molecular function=chaperone activity; Cellular component=cytosol; Biological process=protein folding
  misc_feature: Pfam annotation: Pfam_ID=Cpn60_TCP1; Match level="Score=167.2, E -value=3.6e-47, Copies=1"; Pfam description=TCP-1/cpn60 chaperonin family
MSILASPLSVAGSRTTGASVRTQNVMAASTIANVVKSSLGPVGLDKMLVDDIGDVTVTNDGATILRLLEVEHPAARVLVELAQLQDEEVGDGTTSVVIIAAELLKNADELVKQKIHPTSIISGYRLACKEACRYIQDHLTIPVEELGKECIINVAKTSMSSKIIGADADLFSQIVVDAANAVKVTDSRGNSMYPIKAVNVLKAHGKSARESFLVPGYALNCTVASQAMPKKIVNAKIACLDFSLQKAKMKMGVQVLITDPNQLEAIRTRELDITKERIQKILSTGVNVILASGGIDDLCLKYFVENGAMGVRRVKKADLKRIAKATGATFLTSLSNMEGDESFDSSMVGEAAEVVQERISDDELIIIKGPNI

SEQ ID NO: 23913 - protein, 121 aa, Diabrotica virgifera
  misc_feature: Coding regions on vcDNA: vcDNA=SeqID_3610; Strand=+; Position=128-493
  misc_feature: Homolog annotation: Hit_ID=CAH04341.1; Match level="QueryCoverage =100%, HitCoverage=100%, E-value=1e-56, Identity=90%"; Hit description=S20e ribosomal protein [Dascillus cervinus]
  misc_feature: Gene Ontology Annotation: Molecular function=structural constituent of ribosome; Cellular component=cytosolic ribosome (sensu Eukarya); Biological process=protein biosynthesis
  misc_feature: Pfam annotation: Pfam_ID=Ribosomal_S10; Match level="Score=186.4, E -value=5.8e-53, Copies=1"; Pfam description=Ribosomal protein S10p/S20e
MASVEKANPEKPGQESAPIHHIRITLTSRNVRSLEKVCSDLIDAAKRQKLKVKGPVRMPTKILRITTRKTPCGEGSKTWDRFQMRIHKRVIDLHSPSEIVKQITSINIEPGVEVEVTIADA

SEQ ID NO: 23914 - protein, 277 aa, Diabrotica virgifera
  misc_feature: Coding regions on vcDNA: vcDNA=SeqID_3611; Strand=+; Position=281-1110
  misc_feature: Homolog annotation: Hit_ID=XP_394905.1; Match level="QueryCoverage =94%, HitCoverage=97%, E-value=2e-50, Identity=37%"; Hit description =similar to ENSANGP00000020421 [Apis mellifera]
  misc_feature (250)..(250): Xaa can be any naturally occurring amino acid
MVSLSRSFNTNSGGATFFSESVNMDDRQHLQPILDSYGGFKPLKTVSLFSVHLLVIFILDLLAIGYAVKHPDEKSRCREYFVVIYLHIGLWFATLIVDQVAKCQHHGLRLNGYLDFYHQTKLHISLPFYIVSLWSVALMFVQALMQHFYPDDFAERCVKGGSLSPMSYLCAIITLETCLIFGVNVNYIAKVIKFNKHKPLPDVQKEDWISTTAPDTVTPNEVGYSQLGGKIYDLLEKQADLIRFLKENNXTISEKNMVLTAQYNNYGLKERLKFFGK

SEQ ID NO: 23915 - protein, 46 aa, Diabrotica virgifera
  misc_feature: Coding regions on vcDNA: vcDNA=SeqID_3612; Strand=-; Position=172-312
YLTPIRPQLVTILQKIYYLKNYTQIPNLEINTFTCENFLVFFEIAY

SEQ ID NO: 23916 - protein, 468 aa, Diabrotica virgifera
  misc_feature: Coding regions on vcDNA: vcDNA=SeqID_3613; Strand=+; Position=42-1448
MPLLTEADAGLPGGERISKRSLFTEADPALPGFERISKRSLLTEAESALPGGERISKRSLFSEADPALPSSERISKRSLLTEAEPGLPGGEHISKRSLFREADYGLIGSEKISKRSTDEGVERISKRAVEEDQEAAEQFWLPKFARKNLERARRSDDSLEAAESTFAFRPNFARREFRRIKRNIGFLPGFARKGIRGIRSAELEDTEQENNERSKRNIGFLPGFARKGIRSRRSAELDDAVEENNERSKRNIGFLPGFARKGIRSRRSAELEDTEEENNERSKRNIGFLPGFARKGIRSRRSAELDDAEEENNERSKRNIGFLPGFARKGIRNRRSVEIEDDEEENNERSKRNIGFLPGFARKGIRSRRSAELEQPEENNERAKRNIGFLPGFARKGIRSRRSIYLEDTEDEESGNRERRNIGFLPGFARKGIRSKRSVDDEEEKDSERTKRNIWIFTRFLLEKEIRS

SEQ ID NO: 23917 - protein, 442 aa, Diabrotica virgifera
  misc_feature: Coding regions on vcDNA: vcDNA=SeqID_3614; Strand=+; Position=51-1379
KSAMKLFVLALVAGAATLSLCNPFEGLEEDRWRRSLLTDADTSLTGGEKISKRSLLTEADAGLPGGERISKRSLFTEADPALPGFERISKRSLLTEAESALPGGERISKRSLFREADPALPSFERISKRSLLTEAEPGLPGGEHISKRSLFREADYGLIGSEKISKRSTDEGVERISKRAVEEDQEAAEQFWLPKFARKNLERARRSDDSLEAAESTFAFRPNFARREFRRIKRNIGFLPGFARKGIRSRRSAELEDTEQENNERSKRNIGFLPGFARKGIRSRRSAELDDAEEENNERSKRNIGFLPGFARKGIRSRRSAELEDTEEENNERSKRNIGFLPGFARKGIRSRRSAELDDAEEENNERSKRNIGFLPGFARKGIRSRRSVEIEDDEEKNMKEVNEFLASYRICKKGLRDKKSAENIFKAGLRTSKFFYIGPQN

SEQ ID NO: 23918 - protein, 387 aa, Diabrotica virgifera
  misc_feature: Coding regions on vcDNA: vcDNA=SeqID_3615; Strand=-; Position=140-1303
  misc_feature: Homolog annotation: Hit_ID=S64682; Match level="QueryCoverage=83%, HitCoverage=77%, E-value=1e-39, Identity=32%"; Hit description=acid phosphatase (EC 3.1.3.2) Acph-1 precursor, lysosomal - fruit fly (Drosophila melanogaster)
  misc_feature: Gene Ontology Annotation: Molecular function=acid phosphatase activity; Cellular component=integral to membrane; Biological process=regulation of cell cycle
  misc_feature: Pfam annotation: Pfam_ID=Acid_phosphat_A; Match level="Score=-37.9, E- value=7.4e-06, Copies=1"; Pfam description=Histidine acid phosphatase
MGFKKRVKSLVTCVNFLLAQVFTIRMTTWLSLVVPLVYLWCRCKAEDELVSVVEIFRHGDRTPAFFYPNDPYQDPKYWNGLKEGDLTEKGSQQLYNLGQQFKDRYKDFLGNAYNPDEIIVMSTHMSRTENSAKSFMSGLYGGIEIPIKKETAVANQIITCLKFDYLYKRSELSDPDIVDINEKNKDLYQYLSNHTKLPVGGLFRASGVLDTLKIEQDANLELPEWANNVMGDTMQQVSKTAAEFFCYTKEMQKLGLGSLMNHIIENFDSIISGKKEAKTLIFSLHDLNLICFLQSFKYPEIAQPGFASSIFFELKKSKTNGPYYVNTFYKPSVEQTPIPINVAGCDLDCDLDEFKNIFRDLRLSAGQWYSECYAFGLFDKLFPTKEH

SEQ ID NO: 23919 - protein, 521 aa, Diabrotica virgifera
  misc_feature: Coding regions on vcDNA: vcDNA=SeqID_3616; Strand=+; Position=207-1772
  misc_feature: Homolog annotation: Hit_ID=XP_421546.1; Match level="QueryCoverage =66%, HitCoverage=16%, E-value=6e-39, Identity=28%"; Hit description =PREDICTED: similar to ankyrin 3 isoform 1; ankyrin-3, node of Ranvier; ankyrin-G [Gallus gallus]
  misc_feature: Gene Ontology Annotation: Molecular function=structural constituent of cytoskeleton; Cellular component=synaptic junction; Biological process=protein targeting
  misc_feature: Pfam annotation: Pfam_ID=Ank; Match level="Score=258.8, E-value=9.5e -75, Copies=10"; Pfam description=Ankyrin repeat
MAQNEFPLHSATKIGQLKKVKQLIEGGAIINEVDSNGFTSLHIAANAKARHIKVVKYLLAQGADVNAIETSEGRSALHFATRKNDLEMVRLFTEAGANIQCSNIYGHMPIHVAAEVGYVEIVKHFLERGIDVDILNESSKMTPLHMAACGGYIEVVDYLLLNNANVRLKDCQKRGSIHHGVLGGNAKIVHGLIEKGVNINAKDIFKMTPLDLACRDGNLEIVQLLLETGAVFNLQERCRNYSPLHWASETCSLDVVKYFISLGVDANFGTIQEFTLLHVAVKWDHITMVKYLVEIGADVNKKTIPKGATPLYYAIKNIYTDVAEFLILNGADLKEAEYKGKSTLSIALKDVSSDYPESDQTEYMVLAKLIIKYTVLIYSPIETFIPKGCPFFKELSQYYNDCQKEITSMSGVTIKNSTVSLHKIICGSNKGNAFVQYLCNDNIKNELENIEDYLKDFLIYGNILPLVQLRVKKGFQRMALLTDADLIMKKVSPKLPSEIRWRVFDYLDMTDLKTVIQSDFI

SEQ ID NO: 23920 - protein, 126 aa, Diabrotica virgifera
  misc_feature: Coding regions on vcDNA: vcDNA=SeqID_3617; Strand=+; Position=829-1211
  misc_feature: Homolog annotation: Hit_ID=XP_307144.1; Match level="QueryCoverage =88%, HitCoverage=31%, E-value=7e-14, Identity=37%"; Hit description =ENSANGP00000024852 [Anopheles gambiae]
  misc_feature (68)..(68): Xaa can be any naturally occurring amino acid
  misc_feature (87)..(87): Xaa can be any naturally occurring amino acid
QLFKNRKYFSSEERMYRMTFGPQRDEVTGRKAELVTLYGTQNIVRHIKANRIKWAGHVVRSEEDSVKXVFFEKPDSRRSVGRIRKRXKDDVLADLSRIGVQRWQMEAQDRRRWKAIVDVVKSHPEL

SEQ ID NO: 23921 - protein, 285 aa, Diabrotica virgifera
  misc_feature: Coding regions on vcDNA: vcDNA=SeqID_3618; Strand=+; Position=320-1175
  misc_feature: Homolog annotation: Hit_ID=NP_729244.1; Match level="QueryCoverage =99%, HitCoverage=43%, E-value=3e-24, Identity=26%"; Hit description =CG8588-PB, isoform B [Drosophila melanogaster] gb|AAN12058.1| CG8588- PB, isoform B [Drosophila
  misc_feature (269)..(269): Xaa can be any naturally occurring amino acid
MLANGLDNSSQSNEMTSEAFQKIMADRLGDRDYDSFAFDQHDLLKKKIGYALFGQPVQEIGNGYDEAQNSQIEHLFKAILKHNNLYAEYQDQVELAFIYVVLEPTDKQATDRRKQDPNYNPRTDISPIPIFVLRKCRVERGEACRIFIDHGGRVYSDWQDFLKNNKLPESVMVLPLNGRYQVEDDRVLLERHETPSCGVLNTVLRVGDISSAVAGLGSGTLMFAGAVTSVIGAPLLMGAAAVGATAGVYSITRSAFGLADKYTHDEGLXISNSEARGIYINILAG

SEQ ID NO: 23922 - protein, 210 aa, Diabrotica virgifera
  misc_feature: Coding regions on vcDNA: vcDNA=SeqID_3619; Strand=+; Position=113-745
VKQTKAGIPPVSCLTCWFHHIVSLTYEKFVGVLYSINFSTGKMISNIRNITNDFLHNERNIFGEVGCVQNESEGVMIQTIESKTVETVNTDVIQREESMLSNDCLETSEINITIDERTDYSGETPKRFTTKCYLTPKTVPYWYNENLLLFLNSTKRVYEERIYCKEKFFPRKWSERMWTEVMYKERPTHFVSSVDIPVPDIYIPLGKVAA

SEQ ID NO: 23923 - protein, 399 aa, Diabrotica virgifera
  misc_feature: Coding regions on vcDNA: vcDNA=SeqID_3620; Strand=+; Position=2-1199
  misc_feature: Homolog annotation: Hit_ID=XP_394434.1; Match level="QueryCoverage =100%, HitCoverage=38%, E-value=1e-173, Identity=73%"; Hit description=similar to CG1782-PA [Apis mellifera]
  misc_feature: Gene Ontology Annotation: Molecular function=ubiquitin activating enzyme activity; Cellular component=nucleus; Biological process=DNA replication
  misc_feature: Pfam annotation: Pfam_ID=ThiF; Match level="Score=198.3, E-value=1.5e- 56, Copies=1"; Pfam description=ThiF family
  misc_feature (290)..(290): Xaa can be any naturally occurring amino acid
  misc_feature (350)..(350): Xaa can be any naturally occurring amino acid
  misc_feature (379)..(379): Xaa can be any naturally occurring amino acid
FKSFKDSLENPEIPITDYSKMDFPTQLHLAFTTLHKFVEKSARLPKPWNNEDATEFVNLAKSLAAKGDSEGEVNVDLLDTFAKVSAGDLNPINATIGGIVAQEVMKACSGKFHPIFQWFYYDAIECLPQDKSEITEELAAPTGSRYDGQVAVFGKEFQKKLASLKYFIVGAGAIGCELLKNFAMMGVGTQGEVTVTDMDLIEKSNLNRQFLFRPHNVQQPKSATAAKVIKKMNPDINVVAHENRVGPETESVYNDDFFEKLDGVANALDNVDARIYMDRRCVYYRKPLLXSGTLGTKGNTQVVAPFLSESYSSSQDPPEKSIPICTLKNFPNAIEHTLQCARDMFEGLFXQNAENASLYITDPDFLDRTVKLPGVQPLXVLESVEAALIDDRPRDLYDC

SEQ ID NO: 23924 - protein, 304 aa, Diabrotica virgifera
  misc_feature: Coding regions on vcDNA: vcDNA=SeqID_3621; Strand=+; Position=76-990
  misc_feature: Homolog annotation: Hit_ID=AAO51124.1; Match level="QueryCoverage =51%, HitCoverage=19%, E-value=3e-10, Identity=33%"; Hit description =similar to Dictyostelium discoideum (Slime mold). MkpA protein
MNIRLLTLLLVTVGSSYGGLLFGKNSILQKVGDAVGIGNLVSVSADAEANLLGNKVGVDGAVGVGSEGIGAHLAGDADVLGQKVNVHGDILDGHAIDQHQHEVYRDSRGRQYTLQRQYIGSNSVLVRKYLDDGQIYVEGKDDDNEIQHRQSDAGNYWDDRTGQVVLIDPSKLAQNNNINVGGQNLVWDPASNGYIVIGGNSNVVYDRDSNGQLVIRQPSNNQVVYERDANGNIVVRQISSGNPGNIIIRDDGAPASSAQDQQYLQWLLQQQQQQQQQQQQQQQQYYPQQQQQLQQQWTIQRVAK

SEQ ID NO: 23925 - protein, 117 aa, Diabrotica virgifera
  misc_feature: Coding regions on vcDNA: vcDNA=SeqID_3622; Strand=+; Position=58-411
DDILAIIAINLLYKMKYLSVLSIFCFVGIAFAAISFSKENGLGSISDCLFCTGVGNQVRLLQKHNLSIEEIRDVIFQECTLPTDWIFFVSCEAYIGEIINGVFNSTNLEVHEACQNI

SEQ ID NO: 23926 - protein, 144 aa, Diabrotica virgifera
  misc_feature: Coding regions on vcDNA: vcDNA=SeqID_3623; Strand=+; Position=517-945
  misc_feature: Homolog annotation: Hit_ID=XP_393950.1; Match level="QueryCoverage =96%, HitCoverage=20%, E-value=2e-21, Identity=41%"; Hit description =similar to ENSANGP00000016470 [Apis mellifera]
  misc_feature (103)..(103): Xaa can be any naturally occurring amino acid
  misc_feature (124)..(124): Xaa can be any naturally occurring amino acid
  misc_feature (134)..(134): Xaa can be any naturally occurring amino acid
MGMLYRKRSLLLKLAVIVTTAWFTIAFLLYTDNSSPQSDVVALPLDGEHIRKNEVAPERVIPFQESRRTSSKSVNKNNNNNNDYGGVLVPPDNVAGEMGKPVXLPTNLSADIKKLVDEGWMKTXLHQYASDLIXVHKSLPDPRD

SEQ ID NO: 23927 - protein, 441 aa, Diabrotica virgifera
  misc_feature: Coding regions on vcDNA: vcDNA=SeqID_3624; Strand=+; Position=293-1613
  misc_feature: Homolog annotation: Hit_ID=XP_393950.1; Match level="QueryCoverage =98%, HitCoverage=64%, E-value=1e-172, Identity=68%"; Hit description= similar to ENSANGP00000016470 [Apis mellifera]
  misc_feature: Gene Ontology Annotation: Molecular function=polypeptide N -acetylgalactosaminyltransferase activity; Cellular component =integral to membrane; Biological process=O-linked glycosylation
  misc_feature: Pfam annotation: Pfam_ID=Glycos_transf_2; Match level="Score=115.1, E- value=1.8e-31, Copies=1"; Pfam description=Glycosyl transferase
  misc_feature (403)..(403): Xaa can be any naturally occurring amino acid
  misc_feature (425)..(425): Xaa can be any naturally occurring amino acid
  misc_feature (430)..(430): Xaa can be any naturally occurring amino acid
  misc_feature (435)..(435): Xaa can be any naturally occurring amino acid
MGMLYRKRSLLLKLAVIVTTAWFTIAFLLYTDNSSPQSDVVALPLDGEHIRKNEVAPERVIPFQESRRTSSKSVNKNNNNNNDYGGVLVPPDNVAGEMGKPVVLPTNLSADIKKLVDEGWMKNAFNQYASDLISVHRSLPDPRDEWCKEDGRFLDVSKLPSTSVIICFHNEAWSVLLRTVHTVLDRSPRDLIEEVILVDDYSDMPHTKKQLEDYWKDEPKVKIVRAQKREGLIRARLLGAKHANGKVLTYLDSHCECTVGWLEPLLDRIARDSTTVVCPVIDVIDDSTLEYHYHDSSGVNVGGFDWNLQFNWHAVPEHEKKRHKNTAEPVWSPTMAGGLFSIDKEFFEKLGTYDDGFDIWGGENLEISFKTWMCGGTLEIIPCSHVGHIFRKRSPYKWRSGVXVLRRNSVRLAESLVDEYAPYYXYDRIXREKGXTMGDLS

SEQ ID NO: 23928 - protein, 52 aa, Diabrotica virgifera
  misc_feature: Coding regions on vcDNA: vcDNA=SeqID_3625; Strand=+; Position=389-547
IVFTGVTKAGNTFVVEIFVTIFYILNFNFLTEKFLDMTFVLGETIRNYYQLL

SEQ ID NO: 23929 - protein, 273 aa, Diabrotica virgifera
  misc_feature: Coding regions on vcDNA: vcDNA=SeqID_3626; Strand=+; Position=156-974
  misc_feature: Homolog annotation: Hit_ID=XP_317842.1; Match level="QueryCoverage =85%, HitCoverage=60%, E-value=2e-67, Identity=50%"; Hit description =ENSANGP00000014909 [Anopheles gambiae]
  misc_feature: Pfam annotation: Pfam_ID=DUF829; Match level="Score=51.4, E-value =2.6e-12, Copies=1"; Pfam description=Eukaryotic protein of unknown functio
MALTFTRSFVGKGLKCLSKLQETSSKKKLTSVLIFSAQMRFISTIEVSKNISLISNEKKNCKVINFELSEPQDKPLVVLISWLLAKKKYSYKYADIYLKQGFDVLNINVSPWQFLWPTKGTQMVAKDIVKFLDVNASYSPLLLHGFSVAAYLWGEALVLMSAERQKYDHIINRIVGQVWDSAADVTEIPVGFPKAVFPNNSVLQNTLKQYILYHLKTFDKTVTVHYVRSSQMFHTNIVRAPALVVVSKSDPIGSENSNRRVTDNWGNMGMQVT

SEQ ID NO: 23930 - protein, 322 aa, Diabrotica virgifera
  misc_feature: Coding regions on vcDNA: vcDNA=SeqID_3627; Strand=+; Position=305-1273
  misc_feature: Homolog annotation: Hit_ID=EAL24979.1; Match level="QueryCoverage =86%, HitCoverage=71%, E-value=2e-77, Identity=47%"; Hit description =GA15913-PA [Drosophila pseudoobscura]
  misc_feature: Pfam annotation: Pfam_ID=DUF829; Match level="Score=154.2, E-value =2.9e-43, Copies=1"; Pfam description=Eukaryotic protein of unknown functio
MALTFTRSFVGKGLKCLSKLQETSSKKKLTSVLIFSAQMRFISTIEVSKNISLISNEKKNCKVINFELSEPQDKPLVVLISWLLAKKKYSYKYADIYLKQGFDVLNINVSPWQFLWPTKGTQMVAKDIVKFLDVNASYSPLLLHGFSVAAYLWGEALVLMSAERQKYDHIINRIVGQVWDSAADVTEIPVGFPKAVFPNNSVLQNTLKQYILYHLKTFDKTVTVHYVRSSQMFHTNIVRAPALVFVSKSDPIGSETSNRRVTDNWENMGMQVTFKTWENTPHVGHYQAHPKEYLSELNSFLGSLNIKQPSKIEEKVKASAKL

SEQ ID NO: 23931 - protein, 261 aa, Diabrotica virgifera
  misc_feature: Coding regions on vcDNA: vcDNA=SeqID_3628; Strand=+; Position=67-852
  misc_feature: Homolog annotation: Hit_ID=EAL28950.1; Match level="QueryCoverage =76%, HitCoverage=19%, E-value=1e-42, Identity=42%"; Hit description =GA16147-PA [Drosophila pseudoobscura]
  misc_feature: Pfam annotation: Pfam_ID=Ank; Match level="Score=43.8, E-value=5.1e -10, Copies=3"; Pfam description=Ankyrin repeat
  misc_feature (221)..(221): Xaa can be any naturally occurring amino acid
MASKLWSVRTALQFLHRTSRSKENQEQQQDEDNLAAKLFYLPKLNEVQDPSDEFIDCGPSPPTENLPLIWDTYEVPENGNEVKICYHTIEQNILEHMSNAYGRISLLDEISSKRVDSKNIVGVFFGASHIELNIAFLWAAFVKRYDILENLLYLGAEINYFEPAQGLSALHLAAFSNCISGMQFLISKGCDINALYKFYTPLHCAAFGDSIEATLFLIRHXVKIDQFTNTIYEENESALHCAVRANSNNCVKNSYLSWCKC

SEQ ID NO: 23932 - protein, 131 aa, Diabrotica virgifera
  misc_feature: Coding regions on vcDNA: vcDNA=SeqID_3629; Strand=+; Position=173-568
  misc_feature: Homolog annotation: Hit_ID=XP_308182.1; Match level="QueryCoverage =60%, HitCoverage=17%, E-value=9e-10, Identity=44%"; Hit description =ENSANGP00000021543 [Anopheles gambiae]
  misc_feature: Pfam annotation: Pfam_ID=RRM_1; Match level="Score=57.1, E-value=5.1e- 14, Copies=1"; Pfam description=RNA recognition motif. (a.k.a. RRM, RB
MYRTDKQFMKNPATAACRIYIGGLAKTVIANDLEEKFKPHGTIAGLSLNTGFAFIQFESENEAQAAIKGENGTMLCGRKIIVKQAMDKSKPNQNQQRPNQGPPQRSPIQNVPPKTYSTKDATTTSTKFEVR

SEQ ID NO: 23933 - protein, 243 aa, Diabrotica virgifera
  misc_feature: Coding regions on vcDNA: vcDNA=SeqID_3630; Strand=+; Position=1-732
  misc_feature: Homolog annotation: Hit_ID=NP_702697.1; Match level="QueryCoverage =77%, HitCoverage=28%, E-value=2e-10, Identity=24%"; Hit description =hypothetical protein [Plasmodium falciparum 3D7] emb|CAD49135.1| hypothetical protein [Plasmodium
YTRVLVGPKDNNGKERITKLPKKHNQDKTESRKSFTAPLDDDDENDGDNEESDVKPTDNDRKEIITKLPNSHNRDKMENRKSFTEPLDEDAENDEDNEANDMQNKNNEAETVTKPSHKSNKQKNNEETDEDEIVVPVHPRKPNKNHKKTTQKNGWMVDDNEENKKADNSKPNIKYVEVCNNKTAKQTKNAEDLFKNKLDKMAMKVIQISPSGFVVLSMLLGVMVGVIASNTGKSGDLKKRINN

SEQ ID NO: 23934 - protein, 167 aa, Diabrotica virgifera
  misc_feature: Coding regions on vcDNA: vcDNA=SeqID_3631; Strand=+; Position=104-607
  misc_feature: Homolog annotation: Hit_ID=XP_320031.1; Match level="QueryCoverage =89%, HitCoverage=33%, E-value=6e-09, Identity=27%"; Hit description =ENSANGP00000010505 [Anopheles gambiae]
MENAMNIMKTVSVSNWGADPNISILLYRNLIRSILDYGSIFYGSASNSVLHEMQRIKNKARRLCTGYLRSTPILVMECELNEPPFSLRREYLSEKFIVKIAVNDKLLLNKIVHLTTSYLTHYYWEKKKLFLVVESFLNVSNSIGDIHQIEQSSSRKLNYEDYLSPVI

SEQ ID NO: 23935 - protein, 98 aa, Diabrotica virgifera
  misc_feature: Coding regions on vcDNA: vcDNA=SeqID_3632; Strand=+; Position=719-1012
KITTDSVLSLFTISIINTQEIRLLLKGFYLCSVVPLIKRYFYRVIQRCLKKSKMHILYIRLSMKTSYLILQERQKTSFLHTHKILSVRIFNSEYVKDR

SEQ ID NO: 23936 - protein, 568 aa, Diabrotica virgifera
  misc_feature: Coding regions on vcDNA: vcDNA=SeqID_3633; Strand=+; Position=49-1755
  misc_feature: Homolog annotation: Hit_ID=XP_312564.1; Match level="QueryCoverage =95%, HitCoverage=93%, E-value=2e-72, Identity=34%"; Hit description =ENSANGP00000014256 [Anopheles gambiae]
  misc_feature: Gene Ontology Annotation: Molecular function=carboxylesterase activity; Cellular component=synaptic junction
  misc_feature: Pfam annotation: Pfam_ID=COesterase; Match level="Score=469.0, E -value=4.9e-138, Copies=1"; Pfam description=Carboxylesterase
FNSTNVKFSKTFICVILCLNFVRADDLIVQTLNGKVRGRMEYSLRKPGVPFYAFQQIPYGKAPVGHLRFKEPQPVNYWWGVLDATKNTKTCYQVQNFLGLEKLQTEDCLFLNVYTPKKPVHQKNLPVLVWIYGGGFITGSSNFDISGPHYLMENEVIVVSINYRLGAFGFLATDDLSSPGNYGLKDQRLALKWIQNNIEYFGGDPNKVTIMGTSAGAASVTYHFMNPRSKGLFWAGIAGSGSLLTPWAYQKDSKAIAYKLAKAINPSFNPYASTAELVAYLRSVPADVLNNASATAVSETVGNEQIVQGYFYAPVIEPKHRNAFITENMYTAVEQGKMNQVPLLMGIESEEGLARALDPNWTSVLPILDNDVKLLVNHNMRISCNKTLDEVGQKIREIVTNGLLQNNHSAAIRYFSDMSFNRPLIRHGELQSKFSDVYFYQFSYDGKLGGGGFKHYVEGADRVLHSEDTNYFLTSGNRSNLNTYDPEDILTSDRWRLLLTNFAKYRNPTPEESKILQNITWPKVQPNNFVYLNLNNSLSIVQDHPKSNTYFKWVELYEQYARKPYINF

SEQ ID NO: 23937 - protein, 422 aa, Diabrotica virgifera
  misc_feature: Coding regions on vcDNA: vcDNA=SeqID_3634; Strand=+; Position=49-1314
  misc_feature: Homolog annotation: Hit_ID=XP_315181.1; Match level="QueryCoverage =96%, HitCoverage=72%, E-value=1e-119, Identity=53%"; Hit description= ENSANGP00000025090 [Anopheles gambiae]
  misc_feature: Gene Ontology Annotation: Molecular function=sulfate transporter activity; Cellular component=membrane; Biological process=anion transport
  misc_feature: Pfam annotation: Pfam_ID=Sulfate_transp; Match level="Score=169.5, E -value=7.1e-48, Copies=1"; Pfam description=Sulfate transporter family
MVPCTRTVENSSIRNLAKKRLPILTWLPSYDLETFSQDLLAGFTVGLTEIPQGIAYAVVAGLPSQYGLYAGFMGCFMYFVIGSCKDINIGPTAIMALMIQPYVTALGVAGGILITFLSGCLIFLCGLFNLGFIVEFFSYPVIAGFTTAAALNIASSQIKSLLGITGKSDTFLTAWISVFENIKQTRLADSLMGLFTIIFLVMAKEIRRFGSLKRRSDWSRRRNIFGISIFMFSLASNALVVIFCSLLAYIYKQNGETPFKLTGEVKGGLPSFGLPPFSTDFNGTHFSFKDMMNEYGSLVVFCPLIAVLEHIAIAKAFSKGRSLDATQEMLALGICNIMGSLIQSMPVTGSFTRTAVNHASGAKTPTCGIITGIMVLLALGFLTSTFQYIPKSTLAGVIMVAMYYLCDFAAFKLLWKSKKLDL

SEQ ID NO: 23938 - protein, 364 aa, Diabrotica virgifera
  misc_feature: Coding regions on vcDNA: vcDNA=SeqID_3635; Strand=+; Position=16-1111
  misc_feature: Homolog annotation: Hit_ID=AAV91015.1; Match level="QueryCoverage =99%, HitCoverage=98%, E-value=3e-81, Identity=39%"; Hit description =hemolymph proteinase 17 short form [Manduca sexta]
  misc_feature: Gene Ontology Annotation: Molecular function=serine-type endopeptidase activity; Cellular component=extracellular; Biological process=Tl signaling pathway
  misc_feature: Pfam annotation: Pfam_ID=Trypsin; Match level="Score=221.4, E-value =1.7e-63, Copies=1"; Pfam description=Trypsin
  misc_feature (318)..(318): Xaa can be any naturally occurring amino acid
MFKFVSILCCINLFVVRVYGQEGSQCYTSRKEFGSCINIKTCNYMVQLLINRKQDPEILNYLRSSTCGFIGKDPLICCPQTKEEEESEENLIVSNGNQNTKLPLKPQCGLSNVTNPRIVGGVPAKLNEFPFMVILGYRNKLNPTIPKWLCGGTLITEKHVLTAAHCAYNRNDLYLVRVGELILYDDMDSASPEDISISKIKMHESFSPTEFTNDIAIITLSSKPKNPLVWPVCLPVEDPMKSSSYIGENGVVAGWGSLYFDGPRSSSLQVADMPVLNQNSCQRVFGQNTVIDNRIICAGWLSGAKDTCQGDSGGPLMXAVKEQKHFWYYQIGIISYGFRCAEIGYPGVFTRVTNYLDWIQTNVV

SEQ ID NO: 23939 - protein, 296 aa, Diabrotica virgifera
  misc_feature: Coding regions on vcDNA: vcDNA=SeqID_3636; Strand=+; Position=2-892
  misc_feature: Homolog annotation: Hit_ID=XP_394730.1; Match level="QueryCoverage =98%, HitCoverage=49%, E-value=2e-74, Identity=46%"; Hit description =similar to CG14934-PA [Apis mellifera]
  misc_feature: Gene Ontology Annotation: Molecular function=basic amino acid transporter activity; Cellular component=integral to plasma membrane; Biological process=basic amino acid transport
  misc_feature: Pfam annotation: Pfam_ID=Alpha-amylase; Match level="Score=66.7, E -value=6.5e-17, Copies=1"; Pfam description=Alpha amylase, catalytic domain
KEAHKRGIKVVLDYVPNHTSDQHEWFKKSENGEKPYDEYYIWKDGKNGSKTEPPNNWLSVFGHSGWTWSEKRQQFYYHAFLKEQPDLDYRNPLVRQEMKDVLSFWLDTHNVDGVRMDAVSKLVEDAAFLDEPKSNAPGVADFMYDYLTHTYTENQPEGYDVVYEWRSHLESISKKKESSRICMAEDGANFTLTLPYYGTLNGSVLGAHFPFNFFFLPLNTTSNGGQIANIINEWLIRLPKIYTLNWVLGNHDLHRIASRVGKEKVDALNMLTAVLPGIQITYNGEEIGMEEWRSDL

SEQ ID NO: 23940 - protein, 300 aa, Diabrotica virgifera
  misc_feature: Coding regions on vcDNA: vcDNA=SeqID_3637; Strand=+; Position=85-987
  misc_feature: Homolog annotation: Hit_ID=XP_320158.1; Match level="QueryCoverage =94%, HitCoverage=46%, E-value=7e-82, Identity=49%"; Hit description =ENSANGP00000008952 [Anopheles gambiae] gb|EAA00179.1| ENSANGP00000008952 [Anopheles gambiae
  misc_feature: Gene Ontology Annotation: Molecular function=basic amino acid transporter activity; Cellular component=integral to plasma membrane; Biological process=basic amino acid transport
  misc_feature: Pfam annotation: Pfam_ID=Alpha-amylase; Match level="Score=186.5, E -value=5.7e-53, Copies=1"; Pfam description=Alpha amylase, catalytic domain
KVYEIENMWKLTIFFYLWICCLQSSKAYHLSTDDEWWKTATFYQIYPKSFKDSDGNGIGDLQGVIEKLDYIKDLGVTGVWLSPIFKSPQADNGYDISDYRDIDPQFGTLEIFLELLKEAHKRGIKVVLDYVPNHTSDQHEWFKKSENGEKPYDEYYIWKDGKNGSKTEPPNNWLSVFGHSGWTWSEKRQQFYYHAFLKEQPDLDYRNPLVRQEMKDVLSFWLDTHNVDGVRMDAVSKLVEDAAFLDEPKSNAPGVADFMYDYLTHTYTENQPEGYDVVYEWRSHLESISKKKESSSKCFF

SEQ ID NO: 23941 - protein, 191 aa, Diabrotica virgifera
  misc_feature: Coding regions on vcDNA: vcDNA=SeqID_3638; Strand=+; Position=69-644
  misc_feature: Homolog annotation: Hit_ID=AAV34822.1; Match level="QueryCoverage =98%, HitCoverage=96%, E-value=4e-95, Identity=92%"; Hit description =ribosomal protein L11 [Bombyx mori]
  misc_feature: Gene Ontology Annotation: Molecular function=structural constituent of ribosome; Cellular component=mitochondrion; Biological process =protein biosynthesis
  misc_feature: Pfam annotation: Pfam_ID=Ribosomal_L5_C; Match level="Score=211.2, E -value=2e-60, Copies=1"; Pfam description=ribosomal L5P family C -terminus
MAPVAKPKDGKEKREVKDKTKNSMRELHIRKLCLNICVGESGDRLTRAAKVLEQLTGQQPVFSKARYTVRSFGIRRNEKIAVHCTVRGAKAEEILERGLKVREYELRRDNFSASGNFGFGIQEHIDLGIKYDPSIGIYGLDFYVVLGRPGFNVAHRRSKTGKVGFSHRLTKEDAMKWFQQKYDGIILASKK

SEQ ID NO: 23942 - protein, 283 aa, Diabrotica virgifera
  misc_feature: Coding regions on vcDNA: vcDNA=SeqID_3639; Strand=+; Position=82-929
  misc_feature: Homolog annotation: Hit_ID=AAH64887.1; Match level="QueryCoverage =97%, HitCoverage=58%, E-value=5e-93, Identity=57%"; Hit description =Hypothetical protein MGC76291 [Xenopus tropicalis] ref|NP_989409.1| hypothetical protein MGC76291 [Xenopus
  misc_feature: Gene Ontology Annotation: Molecular function=ATP dependent RNA helicase activity; Cellular component=nucleolus; Biological process =ribosome biogenesis
  misc_feature: Pfam annotation: Pfam_ID=DEAD; Match level="Score=229.9, E-value=4.9e- 66, Copies=1"; Pfam description=DEAD/DEAH box helicase
  misc_feature (194)..(194): Xaa can be any naturally occurring amino acid
  misc_feature (274)..(274): Xaa can be any naturally occurring amino acid
MAQKPSFSDLKLNNWIIRQCATIGVKSPTPIQSNCIPQILEARDCVGAAKTGSGKTLAFALPIIQKLCEDPYGVYALVLTPTRELAYQIAEQFAVIGKPMNLRHCVVVGGIDMVDQGIQLSKHPHIVVATPGRLADHLESCKTFSLSKIKFLVLDEADRLLSGQFDEQIKTIFKELPKSRQNLFFSATITDTLXELKEVSNKDMFYYEAPSISDAVTVEQLEQKYVLCPKDVKDAYLAQVIREFRAENEDGNIMIFTDTCKNCQVLSMTFTDVXFENVSLHAM

SEQ ID NO: 23943 - protein, 288 aa, Diabrotica virgifera
  misc_feature: Coding regions on vcDNA: vcDNA=SeqID_3640; Strand=+; Position=1-864
  misc_feature: Homolog annotation: Hit_ID=XP_395398.1; Match level="QueryCoverage =100%, HitCoverage=32%, E-value=9e-29, Identity=28%"; Hit description= similar to ENSANGP00000019185 [Apis mellifera]
  misc_feature: Gene Ontology Annotation: Biological process=regulation of cell cycle
DFYSNWCGFCRRAVPRVKAFGTDIKGWNDLVVLAVLDCANERNAPVCEFFGITRYPTFRYIHEHYMEGPENIGLPVVADSHTNFSEHRKNLVDILIKEQREGRAKMLPNLQPFKSSAISNIYSTNGGNPDLAFLIVQEPGDDTGPSIIMDFHSVKEIVIRYTHNNETNVTTEELPALYLIYKSGDLQHLNISSPNREGIKFKLRELLFSRNIEVPPAVLRNITITDEVTEPVNLTEEYLEFEKKIRAAGDTVFQLDLENALRYSLKREVGGIQKSRERIRCFKKYMNV

SEQ ID NO: 23944 - protein, 323 aa, Diabrotica virgifera
  misc_feature: Coding regions on vcDNA: vcDNA=SeqID_3641; Strand=+; Position=2-970
  misc_feature: Homolog annotation: Hit_ID=EAL31604.1; Match level="QueryCoverage =81%, HitCoverage=43%, E-value=9e-55, Identity=41%"; Hit description =GA15266-PA [Drosophila pseudoobscura]
  misc_feature: Gene Ontology Annotation: Molecular function=serine-type peptidase activity; Cellular component=extracellular space; Biological process= proteolysis and peptidolysis
QNNNVPVQNFRPASQNSNSYNQERYYVREPNVNYPRFDSSANRANQNTYNRGGSYARPAGVNTVVSSGSFLTGSDDARGSNQGSSANFNVEVDDNELRQFSEDLLNKDTVNNAPQYVTINWQGLTTSRSTRDEAPLPLLSVSPAAYSLTTISKLLPLYDNYILEANKNEVTSQQEKNEEGDLLNAIVQTPVMQYTRNFLMSKGKIGRDVQEFKDLLNLIWFNMYSRQGGKLGSSAFEHVFLAEIKNNQVSGLHNWVYFNEEENKNHANYLGYMKKIDLGGKGYIVKFHFTLNGVDKPVNSMFIGNSPELEMGVYPTCFLLRPD

SEQ ID NO: 23945 - protein, 363 aa, Diabrotica virgifera
  misc_feature: Coding regions on vcDNA: vcDNA=SeqID_3642; Strand=+; Position=91-1179
  misc_feature: Homolog annotation: Hit_ID=EAL31604.1; Match level="QueryCoverage =53%, HitCoverage=31%, E-value=2e-22, Identity=35%"; Hit description =GA15266-PA [Drosophila pseudoobscura]
  misc_feature (306)..(306): Xaa can be any naturally occurring amino acid
  misc_feature (312)..(312): Xaa can be any naturally occurring amino acid
MSARAIVIFVFTIFATNAICADNSFKQNPWQNVNNSSYNYNTQDKNFVTPWPALGGRRNQQNNLQSTRAPQWVRPNNGPNWVRNTSPTNSQGSNQNNNVPVQNFRPASQNSNSYNQERYYVREPNVNYPRFDSSANRANQNTYNRGGSYARPAGVNTVVSSGSFLTGSDDARGSNQGSSANSNVEVDDNELRQFSEDLLNKDTVNNAAQYVTINWQGLTTSRSTRDEAPLPLLSVSPAAYSLTTISKLLPLYDNYILEANKNEVTSQQEKNEEGDLLNAIVQTPVMQYTRNFLMSKGKIERDVKNXRPLIYXSCLKLYSRQGGKFGSSAFELGFLGKKKKNPRGGFTLIGGAFQQKKKKKKLW

SEQ ID NO: 23946 - protein, 227 aa, Diabrotica virgifera
  misc_feature: Coding regions on vcDNA: vcDNA=SeqID_3643; Strand=-; Position=1-679
  misc_feature: Homolog annotation: Hit_ID=NP_525120.1; Match level="QueryCoverage =97%, HitCoverage=45%, E-value=8e-87, Identity=70%"; Hit description =CG3333-PA [Drosophila melanogaster] gb|AAF47178.1| CG3333-PA [Drosophila melanogaster]
  misc_feature: Gene Ontology Annotation: Molecular function=RNA binding; Cellular component=nucleolus; Biological process=rRNA processing
  misc_feature: Pfam annotation: Pfam_ID=TruB_N; Match level="Score=146.2, E-value =7.6e-41, Copies=1"; Pfam description=TruB family pseudouridylate synthase
  misc_feature (183)..(183): Xaa can be any naturally occurring amino acid
  misc_feature (209)..(209): Xaa can be any naturally occurring amino acid
MEDTTKTKKKKSKQLDISKIQTEKDFALESSEKTAKLDASNWPLLLKHFDRLNIRTNHYVPLPNGASPLKRDISEYVKSGFINLDKPSNPSSHEVVAWIKRILRVDKTGHSGTLDPKTTGCLIVCIERATRLVKSQQAAGKEYVSVFKLHSAVEFKKVVQSLEKLKGALFQRPPLISAVKRQXLRVRTVYDSKLLDYDERKILGVFWVXCEAGSYIKGPCVAHSWLW

SEQ ID NO: 23947 - protein, 293 aa, Diabrotica virgifera
  misc_feature: Coding regions on vcDNA: vcDNA=SeqID_3644; Strand=-; Position=80-961
  misc_feature: Homolog annotation: Hit_ID=NP_525120.1; Match level="QueryCoverage =95%, HitCoverage=57%, E-value=1e-114, Identity=71%"; Hit description= CG3333-PA [Drosophila melanogaster] gb|AAF47178.1| CG3333-PA [Drosophila melanogaster]
  misc_feature: Gene Ontology Annotation: Molecular function=RNA binding; Cellular component=nucleolus; Biological process=rRNA processing
  misc_feature: Pfam annotation: Pfam_ID=PUA; Match level="Score=95.3, E-value=1.6e -25, Copies=1"; Pfam description=PUA domain
HGKRIILFWRSEGTVYDSKLLDYDETRNMGVFWVKCEAGSYIRTMCVHLGLLSGVGGQMLELRRVRSGIQGEMDQTATLHDVLDAQWIFDNHKDETYLRRVIKPLEGLLIQHKRIIMKDSSINAVCYGAKILIPGILRYEDGIELNEEIVIVTTKGEAIALGIALMTTSTIASCSHGIAAKIKRVIMERDLYPRKWGLGPRASQKKILIAQGQLDQHGKPNENTPKEWLNSYVDYSASKDKQDTDTQESSEEKKRKLSNSVLDTTTEDSEVRTEKKKKKKRKVDAEEEAESVS

SEQ ID NO: 23948 - protein, 80 aa, Diabrotica virgifera
  misc_feature: Coding regions on vcDNA: vcDNA=SeqID_3645; Strand=+; Position=23-265
MFKSFALFFFAAVLALATAAPQPGPAPKAQPNPYLVSPVAYSAVPAYSAYSYAAPVAYSAYSAPAVVGYSGYPAYGAYYV

SEQ ID NO: 23949 - protein, 587 aa, Diabrotica virgifera
  misc_feature: Coding regions on vcDNA: vcDNA=SeqID_3646; Strand=+; Position=3-1766
  misc_feature: Homolog annotation: Hit_ID=EAL32408.1; Match level="QueryCoverage =100%, HitCoverage=65%, E-value=0.0, Identity=93%"; Hit description =GA18143-PA [Drosophila pseudoobscura]
  misc_feature: Gene Ontology Annotation: Molecular function=structural constituent of cytoskeleton; Cellular component=nucleus; Biological process =muscle contraction
  misc_feature: Pfam annotation: Pfam_ID=Spectrin; Match level="Score=197.6, E-value =2.5e-56, Copies=3"; Pfam description=Spectrin repeat
LAGVQKKLQEYRTYRRKHKPPRVEQKAKLETNFNTLQTKLRLSNRPAYMPTEGKMVSDIANAWKGLEHAEKSFEEWLLSEMMRLERLEHLAQKFKHKADAHEEWTRGKEEMLQSQDFRQCRLNELKALKKKHEAFESDLAAHQDRVEQIAAIAQELNTLEYHDSVSVNARCQRICDQWDRLGALTQRRRQALDEAERILEKIDILHLEFAKRAAPFNNWLDGTREDLVDIFIVHTVEEIQGLIDAHHHFKATLGEADKEYQSIVGLVREVESIVKQHQVPGGLENPYTTLTAHDLTRKWGEVRQLVPQRDATLQAELRKQQNNEMLRRQFAEKANGVGPWIERQLDAVTAIGMGLHGTLEDQLHRLKEYEQGVYAYKPHIEELEKIHQAVQESMIFENRYTQYTMETLRVGWEQLLTSINRNINEVENQILTRDSKGITQEQLNEFRSSFNHFDKNRTGRLTPEEFKSCLVSLGYSIGKDRQGDIDFQRILAVVDPNSTGYVHFDAFLDFMTRESTDTDTAEQVIDSFRILAADKPYILPDELRRELPPDQAEYCIQRMPPYKGPNGVPGALDYMSFSTALYGESDL

SEQ ID NO: 23950 - protein, 67 aa, Diabrotica virgifera
  misc_feature: Coding regions on vcDNA: vcDNA=SeqID_3647; Strand=-; Position=67-270
NEVFGSLIVRHQSHPVEESARCCFLVVDSRYHSSSAALLMDFFLHRIEVINPLVVSVGNQVVTKVFI

SEQ ID NO: 23951 - protein, 63 aa, Diabrotica virgifera
  misc_feature: Coding regions on vcDNA: vcDNA=SeqID_3648; Strand=-; Position=982-1173
CSTYLASALHIRNGNYAYSEHILFLKSMFYGSTKNMKLLCGMCPVHLNRYVLMNVTICGALKS

SEQ ID NO: 23952 - protein, 243 aa, Diabrotica virgifera
  misc_feature: Coding regions on vcDNA: vcDNA=SeqID_3649; Strand=+; Position=84-815
MLSVSIHLLLSLTDSNNVDVIDYAEALLRKFVETVQRLYGKQIMSHNFHNLLHLADDCRKFGSLENFSNFSSENFLQSLLKQVRKHDKPLQQIIRRNYELNTNKIQFTPQNRNKEIPFQFCLEREYVGGVLIDDTTGPEFKKICFEKFALSLSLKDSCCILKDKSIIEIKNIVYCPRLHQNVVIGSEYQSKSDFFNIPCNSSNLDIFLVENLSTLKYWPISDIALKCCRMPYNNKFVVAPLLH

SEQ ID NO: 23953 - protein, 443 aa, Diabrotica virgifera
  misc_feature: Coding regions on vcDNA: vcDNA=SeqID_3650; Strand=+; Position=167-1497
  misc_feature: Homolog annotation: Hit_ID=AAT38514.1; Match level="QueryCoverage =96%, HitCoverage=85%, E-value=1e-73, Identity=34%"; Hit description =antennae-rich cytochrome P450 [Phyllopertha diversa]
  misc_feature: Gene Ontology Annotation: Molecular function=cytochrome P450 activity; Cellular component=membrane; Biological process=electron transport
  misc_feature: Pfam annotation: Pfam_ID=p450; Match level="Score=72.5, E-value=1.1e -18, Copies=1"; Pfam description=Cytochrome P450
  misc_feature (397)..(397): Xaa can be any naturally occurring amino acid
  misc_feature (416)..(416): Xaa can be any naturally occurring amino acid
MLFTSSWFMDILLALSFVCFLVYKYLTRHFDYWKKRNVQHPPPIPLFGNMYNVLAMKSVTPEYIQSIWNEIDAPYFGMFMFDEPVLVLKSPKLIKDVLIKHSSTFYNRRIAIPAHPDMARGLFFLKDEQWKTMRNTISPLFTSGMIKQLEPHFIETNRILSEFLIKNSGVFDTSKIARNLTSEFLIRSFFNVEAKSFEDQPSVIMEQIDKMFKYSLRNVLVQNSFFFKPGLISAFKLNFIPESVIMFFEGIFKNSMMARESYIGKPQNLVDIANKSLRDNPNGGYTSDVEVFVSNALLFLIAGQDTTSTTVKFSLYELAMNQKIQNKLRNEVRANVQKYGSLTFEGVQENKYLGMCIDETLRKYPALPFIDRTARTDFQFEDTDLIVEKNMSVLIPXFSLQRDENLFSNPELFDPXERFSDDRINSDGLSFIPFGRKDKILYK

SEQ ID NO: 23954 - protein, 130 aa, Diabrotica virgifera
  misc_feature: Coding regions on vcDNA: vcDNA=SeqID_3651; Strand=+; Position=65-457
  misc_feature: Homolog annotation: Hit_ID=XP_315090.1; Match level="QueryCoverage =96%, HitCoverage=70%, E-value=2e-35, Identity=62%"; Hit description =ENSANGP00000011457 [Anopheles gambiae]
  misc_feature: Gene Ontology Annotation: Molecular function=selenium binding
YSQLSIIKMRLVAIGLFVVLPSLVLSEFSTEDCWALGFHKANLLCSSCDQLVKFQLDELVNHCKECCHPDEVNSSEKVYYKAVLEVCTCKFGAYPQIQAFIKSDRPDKFPNLQIKYLRGLDSIIKLYDKE

SEQ ID NO: 23955 - protein, 162 aa, Diabrotica virgifera
  misc_feature: Coding regions on vcDNA: vcDNA=SeqID_3652; Strand=-; Position=787-1274
  misc_feature: Homolog annotation: Hit_ID=XP_313621.1; Match level="QueryCoverage =70%, HitCoverage=27%, E-value=7e-11, Identity=37%"; Hit description =ENSANGP00000024261 [Anopheles gambiae]
  misc_feature (82)..(82): Xaa can be any naturally occurring amino acid
YGNLFISYLYTKRQKKIKIYLCCMSPVVTYRMETTNIQKKEEDSLLKFERKIIGTILGHNVTREREIRMKTNAEIEEEKEEXNIVRYIKPLRLKWIDMLRRVTNWTPLQPRCRGIPKRRWLDDVEEDIRAMKLESSVQGEEEMEKSHNSSKDTQQAINDAEE

SEQ ID NO: 23956 - protein, 139 aa, Diabrotica virgifera
  misc_feature: Coding regions on vcDNA: vcDNA=SeqID_3653; Strand=-; Position=136-555
  misc_feature: Homolog annotation: Hit_ID=EAA21331.1; Match level="QueryCoverage =75%, HitCoverage=90%, E-value=2e-21, Identity=59%"; Hit description =hypothetical protein [Plasmodium yoelii yoelii]
  misc_feature (66)..(66): Xaa can be any naturally occurring amino acid
  misc_feature (105)..(105): Xaa can be any naturally occurring amino acid
VGPPLRAKPTGRTSHDTPVDTAYDEPATWDTDSTTSFLTATTLIYAIGAGITAAAGTRLALQLILXKGLECTHSDYGASDESRIVIFRHYLPVPGVGNLRACCLXLDVVAVSQAPSPESNPDSPLPVTTMVGAEPTIDS

SEQ ID NO: 23957 - protein, 272 aa, Diabrotica virgifera
  misc_feature: Coding regions on vcDNA: vcDNA=SeqID_3654; Strand=+; Position=121-936
  misc_feature: Homolog annotation: Hit_ID=EAL32656.1; Match level="QueryCoverage =73%, HitCoverage=38%, E-value=1e-93, Identity=77%"; Hit description =GA18350-PA [Drosophila pseudoobscura]
  misc_feature: Gene Ontology Annotation: Molecular function=carboxypeptidase D activity; Cellular component=membrane fraction; Biological process =transport
  misc_feature: Pfam annotation: Pfam_ID=Peptidase_M14; Match level="Score=200.8, E -value=2.8e-57, Copies=1"; Pfam description=Zinc carboxypeptidase
MKHIFIWVLSAHCLASLAQNVPETSDQKDFLNQNIHGTVIQTEVNSLGDVQGKNFENFPAKFNVDGSQYPEPYNIEYKYHNYEKMTSFLRQTTARYPELTALYSIGKSVQGRDLWVMVVSASPYEHMIGKPDVKYIANMHGNEAVSRELMLQLIHYLVTNYSSDSYIRWLLDNTRIHIMPSMNPDGFEVSKEGNCDGSQGRYNARGFDLNRNFPDYFKQNNKRTQPETEAVKEWISKIQFVLSGSLHGGALVARYPFDSTPNSLFQSFSTPS

SEQ ID NO: 23958 - protein, 524 aa, Diabrotica virgifera
  misc_feature: Coding regions on vcDNA: vcDNA=SeqID_3655; Strand=+; Position=3-1575
  misc_feature: Homolog annotation: Hit_ID=NP_572598.1; Match level="QueryCoverage =93%, HitCoverage=47%, E-value=2e-23, Identity=24%"; Hit description =CG2989-PA [Drosophila melanogaster] gb|AAF46544.1| CG2989-PA [Drosophila melanogaster]
  misc_feature: Gene Ontology Annotation: Molecular function=signal transducer activity; Cellular component=plasma membrane; Biological process =invasive growth
  misc_feature (248)..(248): Xaa can be any naturally occurring amino acid
  misc_feature (489)..(489): Xaa can be any naturally occurring amino acid
ESPSNNNAEVTTKSSISKSLYERVLSKAIKNTPTSTGKNRNTIFRNSRGPQSEKTEDELKEETKPKVERGKLQYTSISRFRPSVAREKKAESVENDEDIEDNEDQTTKRSSDKFPAYTNIRRARISTTSEPSSDRNKILGELPEESDDEDSEEDDDDEDDDDIKSVYTPTTKKANIPHYINIRRQRPSTTEESSTSQYNEIKRGSTAEATSKEENSPTTAKYKQIRRGTTTASTTTTNTPSTSENTTXSTATENSTETSSASSISDSELGSSVEAVTENRSTEDIRNDYVSSVITTTGTYVTSTDDINAIKSENNVSKSPNKSSSLTKPHFLNSIQRKRPQLFEPRPFTKPTESTTSRASTSQVTKIPFRNFLRGTNRRSPFTTRSPTTKTPITNTTATAAITSSPSSTRFSRPTGPSRRKFLTRTTTATILESQESTSSTTKRPRPNIFDGTSRRPFLRRTAKTTTTTENPTSGILPQTTLFENDSVXKPIELRDVVVAIQKLQNAPVPSRTLRPLMEQNLID

SEQ ID NO: 23959 - protein, 163 aa, Diabrotica virgifera
  misc_feature: Coding regions on vcDNA: vcDNA=SeqID_3656; Strand=+; Position=32-523
  misc_feature: Pfam annotation: Pfam_ID=Attacin_C; Match level="Score=3.5, E-value =0.00019, Copies=1"; Pfam description=Attacin, C-terminal region
MKSIVIFAFCISAVVSLPLDVIEDESGQEYLLVPVHRERRDLTWGANQNGYTLGQKGNLWENGAHKFDGAYTGSKAWDSHGLKPDSFGGRVEYTNKPTKTTAFVGADRTPGYGTDVNAGVKYNFVQDKKLNIDLTGQVSQHHGGPGGNGKPEAGVFLNFEARP

SEQ ID NO: 23960 - protein, 486 aa, Diabrotica virgifera
  misc_feature: Coding regions on vcDNA: vcDNA=SeqID_3657; Strand=+; Position=17-1474
  misc_feature: Homolog annotation: Hit_ID=XP_311743.1; Match level="QueryCoverage =90%, HitCoverage=46%, E-value=6e-36, Identity=26%"; Hit description =ENSANGP00000013596 [Anopheles gambiae]
  misc_feature: Gene Ontology Annotation: Molecular function=microtubule motor activity; Cellular component=kinesin complex; Biological process =microtubule-based movement
  misc_feature (461)..(461): Xaa can be any naturally occurring amino acid
MRKDSLEESGSDLENAVKQLSVTESEITSKQKEYQDLLNNFDQLQVEYESLKRELEEVKENLVFTDEENSELKSANEKLKTDNENMEYQLSELNINSDSMKDEIQEYKQKFKMILSENSNIKLQSDENLKKYLDFESKINVLEEKLASEEHDKKALESQVESITEKLKNAKMTETTLKLQLEQKNKELASQAEERYNIEIALDKTNRDVAEFQNNFVELQNQNDKLLIEQEQLRTLKDNDQQRIEELEHLVTDLEKQLEVAKTESVQKVQNVTEDISENIDYNNLKLMLDQTVLEKANLQAELNKLTQIQSQLKETTEKISVLQNQLQEITNSRNELINMVTMKHQENVTYHNEIQKLNQVLIAEAEKYKNLEVQLKAAVSPEDIEAKNNEIEKLTDQNSFLKEKCEVLAKNLLEEQAQTQKLLAERSVPSEKETSLQKKVDRLQAHLIELEEHYTQELLXAEQKNASLKAKVADIEEREKSPVHV

SEQ ID NO: 23961 - protein, 488 aa, Diabrotica virgifera
  misc_feature: Coding regions on vcDNA: vcDNA=SeqID_3658; Strand=+; Position=150-1608
  misc_feature: Homolog annotation: Hit_ID=NP_610333.1; Match level="QueryCoverage =90%, HitCoverage=78%, E-value=1e-153, Identity=62%"; Hit description= CG8728-PA [Drosophila melanogaster] gb|AAF59168.1| CG8728-PA [Drosophila melanogaster]
  misc_feature: Gene Ontology Annotation: Molecular function=protein binding; Cellular component=mitochondrial inner membrane; Biological process =proteolysis and peptidolysis
  misc_feature: Pfam annotation: Pfam_ID=Peptidase_M16; Match level="Score=142.4, E -value=1.1e-39, Copies=1"; Pfam description=Insulinase (Peptidase family M16)
  misc_feature (383)..(383): Xaa can be any naturally occurring amino acid
  misc_feature (414)..(414): Xaa can be any naturally occurring amino acid
  misc_feature (424)..(424): Xaa can be any naturally occurring amino acid
  misc_feature (438)..(438): Xaa can be any naturally occurring amino acid
  misc_feature (448)..(448): Xaa can be any naturally occurring amino acid
  misc_feature (455)..(455): Xaa can be any naturally occurring amino acid
MALQTGYKLTRALLPKNQHQLWNASKTVEYCLAKQYTSTDRTDLTGGAKSKVTDMPPMSEAVKGLPQAVYANFKEEDQKTKVTILSNGLTVASENRFGAFCTVGVVIDSGSRYEVAYPSGISHFLEKLAFNSTKFYPDKDEMINKLEKHGGICDSQASRDTFIYAASAYTSGLNDVIQLLAEATLRPNITSEELLNAKQAINFELETLNMRPEQETILMDMIHAAAYNDNTLGLPKLCPYENVNTINRNVILTYLKNHYTPKRIVVAGVGVEHSKLVDAVQKFFVDIKPIWTESNSEVIKDVSVDLSVSQYTGGIVHEECEIPQFASAGLPVLSHVVVGLESCSHQDKDFIATCVLNIMMGGGGSFSAGGPGKGMYTRLYTKXVLNRYHWMYSATACNHAYSDSGLFCIHASAXPPTHVRDMVXVIVKEISEHAEEIXTDEKLRRAKXQLQSMLXLMNLESRPVMFEDNRKNKYSAFRPKKGDPKHFY

SEQ ID NO: 23962 - protein, 115 aa, Diabrotica virgifera
  misc_feature: Coding regions on vcDNA: vcDNA=SeqID_3659; Strand=+; Position=80-424
  misc_feature: Homolog annotation: Hit_ID=AAH84423.1; Match level="QueryCoverage =100%, HitCoverage=46%, E-value=1e-49, Identity=80%"; Hit description= Unknown (protein for MGC:86412) [Xenopus laevis]
  misc_feature: Gene Ontology Annotation: Molecular function=endopeptidase activity; Cellular component=cytosol; Biological process=proteolysis and peptidolysis
MSRGSSAGFDRHITIFSPEGRLYQVEYAFKAINQAGPTSVAVRGVDAAACVTQRKIPDKLIDPNTITHLFQLTEHTGCVMTGMIADSKSQVQRARYEAAEFKYKFGYEMPIDALC

SEQ ID NO: 23963 - protein, 308 aa, Diabrotica virgifera
  misc_feature: Coding regions on vcDNA: vcDNA=SeqID_3660; Strand=+; Position=2-928
  misc_feature: Homolog annotation: Hit_ID=AAO85806.1; Match level="QueryCoverage =96%, HitCoverage=44%, E-value=2e-62, Identity=38%"; Hit description =integrin beta 1 [Pseudoplusia includens]
  misc_feature: Gene Ontology Annotation: Molecular function=cell adhesion receptor activity; Cellular component=integrin complex; Biological process =muscle development
  misc_feature: Pfam annotation: Pfam_ID=Integrin_beta; Match level="Score=-196.4, E -value=2.8e-10, Copies=1"; Pfam description=Integrin, beta chain
TRPTRPARHLLIFSTDAEFHIAGDGKLGGVTEPNPGTCYSSDDEFLIYDYPSVSHINYVAQQNKVNIIFAIVKKGSGIKASYQQLSNNIDNSKFGEISEGKDSNIIKLIVDNYNTIAQTVSFRSNATDEVDVTFSSSCGTGHTNRCSNVTVGQIIDFTATIELRQCPQDGQKTKIIAIQPDGINESLMIELNLLCDCPCSETNIEQNSGKCNGTGALTCGVCDCPPGKSGKFCECDLLTQSKVENVTKCMKEGSNEVCSGAGICKCEQCVCNIIPQSNDPKYTGKYCECDNLSCKREKGLLCSNRRKL

SEQ ID NO: 23964 - protein, 291 aa, Diabrotica virgifera
  misc_feature: Coding regions on vcDNA: vcDNA=SeqID_3661; Strand=+; Position=924-1798
  misc_feature: Homolog annotation: Hit_ID=XP_393278.1; Match level="QueryCoverage =83%, HitCoverage=84%, E-value=5e-88, Identity=64%"; Hit description =similar to CG6972-PA [Apis mellifera]
  misc_feature (267)..(267): Xaa can be any naturally occurring amino acid
MADTEAVNGQTQLPSDQALAMEEEERREEEAKKKARDPPIVYKDIIDVKAEFDALVALIDGKLTPEEQRATEELQQYMIGDEGSWALSDGFLDFVGRLLNDPQLSVDVRVKTVNVLAMAALKDDVILVLHQDRKDHVLMNYAFEIDRLSMPEQEAIAVFMANMFENLSSSEWLLYISEWSYNNQQTSNIRVTTKVAVHSLLSDSPVLQDRGSAIIHNLACKEVKTVVFDDVAVELTMALLQYFNSQPPEEQLFRRLKALGKFVKVSXEEVAQLIKLIGPDPRRFKARLTKN

SEQ ID NO: 23965 - protein, 359 aa, Diabrotica virgifera
  misc_feature: Coding regions on vcDNA: vcDNA=SeqID_3662; Strand=+; Position=136-1244
  misc_feature: Homolog annotation: Hit_ID=AAU95195.1; Match level="QueryCoverage =91%, HitCoverage=87%, E-value=1e-104, Identity=54%"; Hit description= putative delta-9 desaturase [Oncometopia nigricans]
  misc_feature: Gene Ontology Annotation: Molecular function=stearoyl-CoA desaturase activity; Cellular component=integral to membrane; Biological process=lipid metabolism
  misc_feature: Pfam annotation: Pfam_ID=FA_desaturase; Match level="Score=223.7, E -value=3.5e-64, Copies=1"; Pfam description=Fatty acid desaturase
  misc_feature (245)..(245): Xaa can be any naturally occurring amino acid
MPPLRDDPVLHHREIPTNNVSAQLPEKQKKRNGYFEQDLVLPNVSVYIILHALTIYGFYRITTTEVKGSAILFSTFIGMLAILGVTAGAHRLWAHRTYKAKLPLRVFLMLLQTAALQNDLFIWVRDHRMHHKYTDTNADPHNSNRGFFFCHVGWLLMKKHPDVINKGKNIDMSDVANDPVVKFQRKYYTLLILALTFILPTIAMVHFFHETTVNALLICIGKLVLTLNGTWCVNSFAHMYGWRPXDSSINPVENLTVSIVGLGEGWHNYHHTFPWDYKAAELGNYRANLTTGFLDLMAYLGQAYDLKTVSPEMIKKRAARTGDGSYNFDKTPQLHEDCVWGWDDKDMKEEFKKLLFHIK

SEQ ID NO: 23966 - protein, 470 aa, Diabrotica virgifera
  misc_feature: Coding regions on vcDNA: vcDNA=SeqID_3663; Strand=+; Position=2-1414
  misc_feature: Homolog annotation: Hit_ID=XP_308003.1; Match level="QueryCoverage =99%, HitCoverage=80%, E-value=1e-108, Identity=43%"; Hit description= ENSANGP00000013416 [Anopheles gambiae]
  misc_feature: Gene Ontology Annotation: Cellular component=signal recognition particle; Biological process=protein targeting
  misc_feature (419)..(419): Xaa can be any naturally occurring amino acid
  misc_feature (466)..(466): Xaa can be any naturally occurring amino acid
AERNWAYAMQLRQEANTEPRKKFHLVQKMRKACVYALQLDELCKQDRCDVRTKLESQAYLAWIQGSLQFELQLWQQAAENLKKAQVIYEKISSTLPEEEQLPYKQRVEEISPSLRYCAYNIGDEKAVDLLELRSQGVLENFDALVSQNKEKNEDVLYEVKWFNLNIPVRIERIRLFLVSIEGLNESLNHAEDNQGKIKILENLFIDLRDIISLARDNSRSDKLTAKQTKEYQQLIAYLLSIRIERTSQRNVLLILQTRKSQDCVRLLDINIQQTNELSQNDIIKDNTNAQKYYESQIAAYKTLRYYYLAKSQGAQKRWKEAAVLFDTAYNSAQVLKQGKFELEVKEILQRIEDKSQIEIATAKANMVLDLKQDESTIQFPQSQKTYKSKKPLVERLDEFREDPQLLSKNPNLVTLPPAXGPVPAKPLFFDLALNFAEFPDLSEKLDDGKPQQKQGAGISGFVKGLXGWGK

SEQ ID NO: 23967 - protein, 309 aa, Diabrotica virgifera
  misc_feature: Coding regions on vcDNA: vcDNA=SeqID_3664; Strand=+; Position=2-931
  misc_feature: Homolog annotation: Hit_ID=XP_308003.1; Match level="QueryCoverage =94%, HitCoverage=47%, E-value=1e-100, Identity=59%"; Hit description= ENSANGP00000013416 [Anopheles gambiae]
GRGTSGNVSLIKLNKIQMGTENIDNVSGDTQNKPVQQEPLLPFTLEILKLIKDCQQQHGLRHGDYQRYRGYCSRRISRLRKVLKIPQGDRRHFKKRDVTEAHIINPKSDDRFLHIPLILAERNWAYAMQLRQEANTEPRKKFHLVQKMRKACVYALQLDELCKQDRCDVRTKLESQAYLAWIQGSLQFELQLWQQAAENLKKAQVIYEKISSTLPEEEQLPYKQRVEEISPSLRYCAYNIGDEKAVDLLELRSQGVLENFDALVSQNKEKNEDVLYEVKWFNLNIPVRIERIRLFLVRIEGVKRIFKPC

SEQ ID NO: 23968 - protein, 97 aa, Diabrotica virgifera
  misc_feature: Coding regions on vcDNA: vcDNA=SeqID_3665; Strand=-; Position=303-596
GTQHTSIIRFSLVLKKYCGTIGVYCLGRMIYTYLILYELKTNRLNLIECIKVHSPCRKEWTDRSRLTTRQSQHFTVHKKKLGSTTEQNNNKCARIAH

SEQ ID NO: 23969 - protein, 229 aa, Diabrotica virgifera
  misc_feature: Coding regions on vcDNA: vcDNA=SeqID_3666; Strand=+; Position=108-794
  misc_feature: Homolog annotation: Hit_ID=XP_393164.1; Match level="QueryCoverage =98%, HitCoverage=28%, E-value=4e-63, Identity=54%"; Hit description =similar to ENSANGP00000019635 [Apis mellifera]
  misc_feature: Pfam annotation: Pfam_ID=ABC_tran; Match level="Score=165.2, E-value =1.4e-46, Copies=1"; Pfam description=ABC transporter
MNTMNNHLALYVKDVEKSFGSNKVLDKLCLNVQKGTIYGLLGSSGCGKTTLLRCIIGRSNVNKGDIYVLGEKQDGSVVLADRVGYMPQDISLVGELSARDSIYFFGRIYNLKDDIIKSRCDELIELLDLPTDNRCVRDCSGGEQRRVSFAVTLVHKPELLILDEPTVGTDSILRNRIWKYLTKITEEDKTTVIITTHYIEETRQADKIALMRKGKLLTEEHPETLLERY

SEQ ID NO: 23970 - protein, 307 aa, Diabrotica virgifera
  misc_feature: Coding regions on vcDNA: vcDNA=SeqID_3667; Strand=+; Position=3-922
  misc_feature: Homolog annotation: Hit_ID=EAL28885.1; Match level="QueryCoverage =95%, HitCoverage=22%, E-value=9e-65, Identity=42%"; Hit description =GA18260-PA [Drosophila pseudoobscura]
  misc_feature: Gene Ontology Annotation: Molecular function=15-hydroxyprostaglandin dehydrogenase (NAD+) activity; Cellular component=cellular_component unknown; Biological process=biological_process unknown
  misc_feature: Pfam annotation: Pfam_ID=ABC_tran; Match level="Score=41.2, E-value =3.1e-09, Copies=1"; Pfam description=ABC transporter
  misc_feature (77)..(77): Xaa can be any naturally occurring amino acid
FAKLIEFIRKKEIDQIRHTSIIKALTITFNIALSRAAILVCILTYILSGNVLTASYAFTVTSYYTYMRAIITLQFPXAMTQFAETLVSISRIQKFLLFEELDVKYTPMHKQINNNEILQNNKPDVIEVRPVGIKIKNAAVKWIKKHPENTIEQINFEARSNQLVALVGPVGAGKSTLLQVILKELKPLEGTVKVTGTVSFASQEPWVFASSVRQNILFGETYNENKYYEVLRVRALEKDLKLFPHGDRTLIGERGTSLRGGQRARNHLARAIYKETGLYLLYDPLSPDDIRRGTNKITDAFATISGK

SEQ ID NO: 23971 - protein, 250 aa, Diabrotica virgifera
  misc_feature: Coding regions on vcDNA: vcDNA=SeqID_3668; Strand=+; Position=217-967
  misc_feature: Homolog annotation: Hit_ID=XP_393243.1; Match level="QueryCoverage =99%, HitCoverage=53%, E-value=1e-100, Identity=63%"; Hit description= similar to CG33094-PB [Apis mellifera]
  misc_feature: Gene Ontology Annotation: Molecular function=cytoskeletal protein binding; Cellular component=cytosol; Biological process=signal transduction
  misc_feature: Pfam annotation: Pfam_ID=FCH; Match level="Score=85.9, E-value=1.1e -22, Copies=1"; Pfam description=Fes/CIP4 homology domain
  misc_feature (230)..(230): Xaa can be any naturally occurring amino acid
MSHHSDDNMLIATSDSFWEPGNYKKTTKRIEDGYKLCQELISLVGERADIERNYAKSLKAWSKKWNDAIEKGPEYGTTEAAWKGALVEADRRCDLHSRIRDSLTNDVINKVKQWQKDSYHKSMMNIKEKKDMDDNFKKAQKPWTKLLQKVEKTKNDYHTACKTEKSASNQERNATGDTSFSADQVKKMQERVQKSKDEVQKCREKYELSLQEINQYNPKYMEDMTVVFDXCQEKEGFNGFHFIKNSFFSK

SEQ ID NO: 23972 - protein, 326 aa, Diabrotica virgifera
  misc_feature: Coding regions on vcDNA: vcDNA=SeqID_3669; Strand=+; Position=2-982
  misc_feature: Homolog annotation: Hit_ID=XP_321445.1; Match level="QueryCoverage =97%, HitCoverage=84%, E-value=1e-103, Identity=58%"; Hit description= ENSANGP00000008550 [Anopheles gambiae]
  misc_feature: Gene Ontology Annotation: Molecular function=endopeptidase activity; Cellular component=proteasome regulatory particle (sensu Eukarya); Biological process=proteolysis and peptidolysis
  misc_feature: Pfam annotation: Pfam_ID=PCI; Match level="Score=3.4, E-value=0.063, Copies=1"; Pfam description=PCI domain
  misc_feature (314)..(314): Xaa can be any naturally occurring amino acid
  misc_feature (322)..(322): Xaa can be any naturally occurring amino acid
AAAVVQQSNVNDYLLKKQQESPKELGSEWAELEELHNKKLWHQLTLKLLNFIKKPELQKNDNLIQLYNNFIQSFENKINPLSLVEIVAIVVQQFKNPKDAVAFLEKTEPKVKINSDAQNLCKVLAGQIYIEKLNDLDATKKIIEEVESTLDNADGVTPVHGRFYLLASQYYRIQGNHAQYYRTALRYLGCIELDTITSEVKVQHAFFLGLAALLGEGVYNLGELLAHPVLESLKSTENAWLVELLYAFNSGNIKKFESMKPQWEAIADLAAEELFLRQKISLLCLMEMTFNRPSHNRQLTFAEIAKETKLPLNXNELFDMKXVSQD

SEQ ID NO: 23973 - protein, 622 aa, Diabrotica virgifera
  misc_feature: Coding regions on vcDNA: vcDNA=SeqID_3670; Strand=+; Position=1-1869
  misc_feature: Homolog annotation: Hit_ID=NP_611382.1; Match level="QueryCoverage =98%, HitCoverage=66%, E-value=0.0, Identity=57%"; Hit description =CG15100-PA [Drosophila melanogaster] gb|AAF57625.2| CG15100-PA [Drosophila melanogaster]
  misc_feature: Gene Ontology Annotation: Molecular function=methionine-tRNA ligase activity; Cellular component=cytoplasm; Biological process=amino acid activation
  misc_feature: Pfam annotation: Pfam_ID=WHEP-TRS; Match level="Score=59.3, E-value =1.1e-14, Copies=2"; Pfam description=WHEP-TRS domain
  misc_feature (354)..(354): Xaa can be any naturally occurring amino acid
  misc_feature (393)..(393): Xaa can be any naturally occurring amino acid
ISFDYFGRTSEPQQTQIVQDMFFTLNSNGFMFTQSVEQLHCEKCNKFLADRFVEGGCPNVGCNYEDARGDQCDGCGKLVNAVELKNPRCKICNNTPALKCSDQFYIDLPKLEPLLYHWIKLRNSGWSHNSQVIAKAWLKEGLKPRCITRDLKWGVPVPLDGYRDKVFYVWFDAPLGYISITKAYTEDYARWWTPTKGEEVTLYQFMAKDNVPFHSVLFPAMLLGANQGYITVNHLMATEYLNYEDGKFSKSRGVGVFGTDAQSTGIPSDVWRFYLLYVRPESQDSSFSWNDLVTKNNSELLNNLGNFINRALVFAKNNFKGTVPAIKPTEEDFNLLALCTRELKGYVEALEKSXLRDGIRHILSISRLGNQYMQSNQPWVLLKGSDDEKVRAXTVIGMCCNLSCLIATLLQPYMPETSENLKKQLNTSNIVLIPSDPEIVNMLPAGHKLGEPSPLFAKIEPSVAEELKKKFAGKQQSKETSPSGDFKSAADLEAAVASQGDKVRQLKSSGVEKSVWQPEVKILLDLKKQLESLKISSAPQSAPTKTDVVDSNAVQKIEEEVAKQALVVRTLKEGGAEKSKWQPEVDKLLALKKQLASASGTPVAAPQKKAKRARNKNKNNIS

SEQ ID NO: 23974 - protein, 311 aa, Diabrotica virgifera
  misc_feature: Coding regions on vcDNA: vcDNA=SeqID_3671; Strand=+; Position=47-982
  misc_feature: Homolog annotation: Hit_ID=AAT95010.1; Match level="QueryCoverage =72%, HitCoverage=99%, E-value=5e-26, Identity=33%"; Hit description =allergen Pol d 5 precursor [Polistes dominulus]
  misc_feature: Gene Ontology Annotation: Molecular function=molecular_function unknown; Cellular component=extracellular space; Biological process =biological_process unknown
  misc_feature: Pfam annotation: Pfam_ID=SCP; Match level="Score=99.1, E-value=1.1e -26, Copies=1"; Pfam description=SCP-like extracellular protein
PQGLLSFFRIDEVIIRAFPPIETTIIKMKYLLCTVLFVSTVAFSSASVLCDLKWPRCGLTVENTVCEKDEKCLPEPGCQDVPTDPEFLKFILHEHNRLRNQVASGAETRGYTGVAANMMALSYDKDLEYTARCHINSCKFEHDKCRGTSKFLLAGQNLYYTSESQEALKEAVNTWYEEIQQMTPDVIDNFPKGRHDIGHFSQSIWATTTHVGCALSKSVPTEEDEEVKYYIACNYGPIGNKIGKTVYERGAGCSKCPLGVACNAEFPALCGEVDETQIYANVSSGGDVLNIGNTGVSDAATVTVGGDNTLM

SEQ ID NO: 23975 - protein, 268 aa, Diabrotica virgifera
  misc_feature: Coding regions on vcDNA: vcDNA=SeqID_3672; Strand=-; Position=426-1226
  misc_feature: Homolog annotation: Hit_ID=AAF87758.1; Match level="QueryCoverage =92%, HitCoverage=55%, E-value=5e-98, Identity=74%"; Hit description =cytochrome oxidase subunit I [Diabrotica porracea]
  misc_feature: Pfam annotation: Pfam_ID=COX1; Match level="Score=13.7, E-value=1.1e -11, Copies=1"; Pfam description=Cytochrome C and Quinol oxidase polyp
  misc_feature (31)..(31): Xaa can be any naturally occurring amino acid
  misc_feature (52)..(52): Xaa can be any naturally occurring amino acid
  misc_feature (102)..(102): Xaa can be any naturally occurring amino acid
  misc_feature (119)..(119): Xaa can be any naturally occurring amino acid
  misc_feature (137)..(137): Xaa can be any naturally occurring amino acid
  misc_feature (154)..(154): Xaa can be any naturally occurring amino acid
  misc_feature (210)..(210): Xaa can be any naturally occurring amino acid
  misc_feature (219)..(219): Xaa can be any naturally occurring amino acid
LQTIPFFYYLYPFLAGAFTIILTIENLNASXFFDPTGEGIPFFYHHLFWFFXGHPEVFILIFPGFELISHFVRQERGKKETFGSLGIFYAIIAIALLGFIVXAHHIFAGWNGCCSRAYXSSATIIIGFHLELKYLDXLATYHGTAITYSPVTLXALGFIFLFTVGGLAGVVLANSSIDIVLHDTYYVVAHFHYVLSIGAVFAIIAGFIQXFPLFTGITXLNNFYLKIQFFIIFIGVNLTFFPQHFLGLIGIPRRYSDYYIVKIYILKY

SEQ ID NO: 23976 - protein, 519 aa, Diabrotica virgifera
  misc_feature: Coding regions on vcDNA: vcDNA=SeqID_3673; Strand=+; Position=64-1623
  misc_feature: Homolog annotation: Hit_ID=XP_316448.1; Match level="QueryCoverage =98%, HitCoverage=97%, E-value=1e-112, Identity=40%"; Hit description= ENSANGP00000020485 [Anopheles gambiae]
  misc_feature: Gene Ontology Annotation: Molecular function=chitinase activity; Cellular component=extracellular space; Biological process=chitin catabolism
  misc_feature: Pfam annotation: Pfam_ID=Glyco_hydro_18; Match level="Score=441.6, E -value=9.1e-130, Copies=1"; Pfam description=Glycosyl hydrolases family 18
MWVKLVLVLVATQLSSEIVSATTSRVVCYHGTWARYRNGKGSYQLTDIPTSLCTHLIYSFIGLSASGEMVSLDSYLDNDLNNLNKFTGLKSSNSNLKTLVAIGGWNEGSVKFSTLAASASLRSTFIQNALQYCQNHNFDGLDFDWEYPAQRGGAAADKENFITLLKETKAVFEANGLLVSVAVAAGSASVALSYDIPRISQYVDMINVMTYDLHGSWDGVLGHNAPLYASSVDTTAASKQLNVDAAISNWIAQGADPQKINLGVPLYGRTFTITSSTNVAVGAVSSGAGISGPYTLEAGYLGYNEIVEKELQGGWTYVWDNEQQVPHMYKGDQWVGFDDPKAVQVKTKYAQDKGLGGVMAWAIETDDFQGLSGVKNPLLRAINEQLATSSNAAAETNEIAAAAAESSASAAESSASAAESSASAAESSASAAESSASNTNSEAASNTSNNEAASNSKVQNSVCSKAGYVRDPSDCSKFYYCAANTSGVLVGVQMSCYGGLYFDTNSNVCNWKALVTNCN

SEQ ID NO: 23977 - protein, 252 aa, Diabrotica virgifera
  misc_feature: Coding regions on vcDNA: vcDNA=SeqID_3674; Strand=+; Position=28-786
  misc_feature: Homolog annotation: Hit_ID=BAB32476.1; Match level="QueryCoverage =44%, HitCoverage=48%, E-value=3e-20, Identity=48%"; Hit description =cuticle protein [Bombyx mori]
  misc_feature: Gene Ontology Annotation: Molecular function=structural constituent of eye lens
  misc_feature: Pfam annotation: Pfam_ID=Chitin_bind_4; Match level="Score=80.4, E -value=4.8e-21, Copies=1"; Pfam description=Insect cuticle protein
MISKTLTTLLLVTYVVAVEDIPTSYANYNDYHNTVKHIQSAYAKKAEPVQYAYAQPQQYSKPEAPSKAYSSHSSGYATQPLLTLQSNPAPAIKYTHSQVPSQERDYTVGLGAYGQQASSLGGYEQYSADLSSHNVQYAVPAQAVQYSAPKQQILQYAAPQQPQYSGHKYEEENTHPKYEFSYGVEDHHSGDIHSHKESRDGDVTQGEYSLHEADGTVRTVKYRVDKHSGFQAVVEKSGHPQQQAHQAKNAYY

SEQ ID NO: 23978 - protein, 309 aa, Diabrotica virgifera
  misc_feature: Coding regions on vcDNA: vcDNA=SeqID_3675; Strand=+; Position=169-1095
  misc_feature: Homolog annotation: Hit_ID=XP_392973.1; Match level="QueryCoverage =95%, HitCoverage=69%, E-value=1e-140, Identity=81%"; Hit description= similar to cdc2-related kinase [Apis mellifera]
  misc_feature: Gene Ontology Annotation: Molecular function=protein kinase activity; Cellular component=nucleus; Biological process=apoptosis
  misc_feature: Pfam annotation: Pfam_ID=Pkinase; Match level="Score=238.7, E-value =1e-68, Copies=1"; Pfam description=Protein kinase domain
  misc_feature (249)..(249): Xaa can be any naturally occurring amino acid
  misc_feature (282)..(282): Xaa can be any naturally occurring amino acid
  misc_feature (284)..(284): Xaa can be any naturally occurring amino acid
MATEVLRKSPQKSKEPENGAEPFAPITKKGILTSFLTGKQMNIPEADLLGRCRFVSEFDKLNRIGEGTYGIVYRAKDQSSDKIVALKKVRMDLERDGIPISSLREIQVLLNCQHENIVHLKEVVVGRSLESIFLVMEYCEQDLASLLDNMQTPFTESQVKCIMLQVLRGLKYLHHNFVVHRDLKVSNLLMTDKGCVKIADFGLARWFGVPLKPMTPHVVTLWYRAPELLLQAPTQTTSVDMWAAGCILXELLGHKPLLPGRSEIQQLELIVDLLGTPSDAIXAXFSQLPALQNYTLKQQPYNNFESKGF

SEQ ID NO: 23979 - protein, 430 aa, Diabrotica virgifera
  misc_feature: Coding regions on vcDNA: vcDNA=SeqID_3676; Strand=+; Position=12-1304
  misc_feature: Homolog annotation: Hit_ID=XP_312880.1; Match level="QueryCoverage =99%, HitCoverage=37%, E-value=1e-109, Identity=52%"; Hit description= ENSANGP00000014710 [Anopheles gambiae]
  misc_feature: Gene Ontology Annotation: Molecular function=ATP dependent RNA helicase activity; Cellular component=cytoplasm; Biological process =regulation of translation
  misc_feature: Pfam annotation: Pfam_ID=DEAD; Match level="Score=108.8, E-value=1.4e- 29, Copies=1"; Pfam description=DEAD/DEAH box helicase
MEAPPILASVESELKKYILSPENLPIHQYEKNQKFWSREPIPKELLWFEESPSITTLQVQRDPNSGQIMDFKEVSLQSAGATAKNSMSLNRAPAPPSEATRGSASFKPFWPGSFPAPESYENEQTLCESEPLLTVPPGFDRGLTFGKDNRTLRTEDETLDEIQEIKNDSPNVVNLLKTVLKEEELLGAFESEYAVESNSKTVEELLPEEEEIMSKETPVLIISKTVPKNLYTHGSEWAILLDTSEPVTDFKERIPEMAIEYPFELDTFQKLAILQLEQHNHVFVAAHTSAGKTVVAEYAIALSQKHMTKSIYTSPIKALSNQKYRDFKEKFNDVGLITGDFQINQKASCLIMTTEILRSMLYCGSDITRDLEYVIFDEVHYINDRERGHVWEQVLIMLPAQVCVVLLSATVPKNIEFADWVGSNHLPQVM

SEQ ID NO: 23980 - protein, 51 aa, Diabrotica virgifera
  misc_feature: Coding regions on vcDNA: vcDNA=SeqID_3677; Strand=-; Position=218-373
  misc_feature (25)..(25): Xaa can be any naturally occurring amino acid
KFRHNFKIKVIELSAQKLKAPLKLXSNVQTGFENFNIQDAVSRSQWIYNFV

SEQ ID NO: 23981 - protein, 288 aa, Diabrotica virgifera
  misc_feature: Coding regions on vcDNA: vcDNA=SeqID_3678; Strand=+; Position=157-1019
  misc_feature: Homolog annotation: Hit_ID=NP_788055.2; Match level="QueryCoverage =96%, HitCoverage=31%, E-value=1e-79, Identity=49%"; Hit description =CG33090-PB [Drosophila melanogaster] gb|AAO41192.2| CG33090-PB [Drosophila melanogaster]
  misc_feature (257)..(257): Xaa can be any naturally occurring amino acid
MSKVNHTLPPKYGLKLSLDYVYPEKRTQNYTPSLRVIWNMLPLILRYLLYYIKSKWKGHKVVMDYISPRKPEQIYGVPIGGIGCGTIGRGYKGQFCRFQLKPGIYEWNTVDADDFLVVIKDENGFTLFESWISTYQKRSLSSCISKIPEYKIKYTGLYPRSWTEYDLTEFNGISVGIKLTCRQISPVIPHNYKDSALPCAVFVWTVENVCSSDRTVTIAFTFENGTGSKDDKKSACSSKLFSYENTEGVILYHMINXMPCAYALAAKTNQDVSISKCLYFDPNPNGFD

SEQ ID NO: 23982 - protein, 692 aa, Diabrotica virgifera
  misc_feature: Coding regions on vcDNA: vcDNA=SeqID_3679; Strand=+; Position=109-2182
  misc_feature: Homolog annotation: Hit_ID=NP_524471.2; Match level="QueryCoverage =99%, HitCoverage=45%, E-value=0.0, Identity=50%"; Hit description =CG5394-PA, isoform A [Drosophila melanogaster] gb|AAF56211.1| CG5394- PA, isoform A [Drosophila
  misc_feature: Gene Ontology Annotation: Molecular function=proline-tRNA ligase activity; Cellular component=soluble fraction; Biological process =protein complex assembly
  misc_feature: Pfam annotation: Pfam_ID=WHEP-TRS; Match level="Score=472.5, E-value =4.5e-139, Copies=5"; Pfam description=WHEP-TRS domain
  misc_feature (664)..(664): Xaa can be any naturally occurring amino acid
MVTSKSATYLNNEIIKQGDAVRKLKEQKAAKADIDTAVKVLLTLKAEYKAVANTDWKPGCVPPTASVSKNDSAIGDEINAKIAAQGEKVRQLKSQKADKAAVEAEVRQLLSLKAEYKSATGKDWTPSQASSTNKITNQTSSTTKPKQENVSLDENSILQQIALQGEKVRTLKSQKADKSTVDHEVKALLSLKADYKTLTGKDWKPGAVAAPPSLNTSTSSASANVTVDENSLLLDISSQGDVVRKLKSEKADKSQVDVEVKKLLNLKENFKNLTGKDWKPNMKPEPAVPNNQNVSAGGDNAKEVLTAKITDQGNLVRDLKTQKADKEKVDAAVKILLALKVEYKNLTGTDFPVAGRTPKETKPAAPKEKVVKQKPAAKEKKPEVVEANDSGAKKQTRLGLEAKKEEQLSDWYSQVITKGELIEYYDVSGCYIFRPWSFAIWEAIKDWFDGEIKKLGVQNCYFPIFVSKAALEKEKTHIEDFAPEVAWVTKSGDSDMAEPIAVRPTSETVMYPAYAKWIQSYRDLPIKLNQWNNVVRWEFKHPQPFLRTREFLWQEGHTAFALEEEADVEVRQILDLYARVYTDLLAIPVVKGRKTEKEKFAGGDYTLTVEAYVSASGRAIQGATSHHLGQKLFKMFDITYEHPDSQEKTHVYQNFLGITTRTIXGVVVMIHGDNQRLGIPPRVAAIQIVIVP

SEQ ID NO: 23983 - protein, 275 aa, Diabrotica virgifera
  misc_feature: Coding regions on vcDNA: vcDNA=SeqID_3680; Strand=+; Position=354-1180
  misc_feature: Homolog annotation: Hit_ID=XP_392504.1; Match level="QueryCoverage =81%, HitCoverage=48%, E-value=2e-95, Identity=78%"; Hit description =similar to Protein kinase shaggy (Protein zeste-white 3) [Apis mellifera]
  misc_feature: Gene Ontology Annotation: Molecular function=glycogen synthase kinase 3 activity; Cellular component=cellular_component unknown; Biological process=mitotic spindle orientation
  misc_feature: Pfam annotation: Pfam_ID=Pkinase; Match level="Score=54.7, E-value =2.7e-13, Copies=1"; Pfam description=Protein kinase domain
  misc_feature (178)..(178): Xaa can be any naturally occurring amino acid
  misc_feature (208)..(208): Xaa can be any naturally occurring amino acid
MASKSKRGKSKEMEDDISKLVSTLKVRPGKDGSKVTTVVATPGQGPDRPQEVSYTDTKVIGNGSFGVVYQAKLCETSELVAIKKVLQDKRFKNRELQIMRKLEHCNIVKLKYFFYSSGDKKDEVYLNLVLEYIPETVYKSARHYSKSKQTIPISFIKLYMYQLVRSLAYIHSLGILHXRNIKPQNLFVDPETGVLNYCDFERAKHLVXGKPNVSYFCSQYYKAPKVNISEGSTTPQKINEWKRWGGFLPQLPFWVTPNFPRENPGGKNQLGKKIF

SEQ ID NO: 23984 - protein, 735 aa, Diabrotica virgifera
  misc_feature: Coding regions on vcDNA: vcDNA=SeqID_3681; Strand=+; Position=302-2509
  misc_feature: Homolog annotation: Hit_ID=XP_310384.1; Match level="QueryCoverage =93%, HitCoverage=80%, E-value=0.0, Identity=50%"; Hit description =ENSANGP00000018903 [Anopheles gambiae]
  misc_feature: Gene Ontology Annotation: Molecular function=actin binding; Cellular component=transcription factor complex; Biological process=mRNA splicing
  misc_feature: Pfam annotation: Pfam_ID=Kelch_1; Match level="Score=318.6, E-value =9.4e-93, Copies=6"; Pfam description=Kelch motif
  misc_feature (480)..(480): Xaa can be any naturally occurring amino acid
  misc_feature (482)..(482): Xaa can be any naturally occurring amino acid
MSYGTLNGTTKEIPENGDIQEIEEEEEEEEIIHLEYFDEALQVHLLKSLNRMRKSRHFCDVILHVGNTEVHAHRSVLASISPYLFELFTTDQDQKRTENVITYRLNGGFDTTALQILIDYAYTGKLRVHYNNVKAVFSSANNLKMERVTRICAQHLIKHLSAENCVEIRSLPGIARNKEFIQQVDTFIAKEFAEISKSSTVLNLYCARIEVLNQSREEMSLVNENSLCRLVLEWIRRQISDEHLLISDLSEKTFMLYLALDNSLQDCSSLPSGDISDTEMVQDYKKLSLKDKQGVSKPKRKVLGQPSKPRVLIYNREIGEELDNEMEPDWNLIATTAVSEHSFLGLVTLAGKLSTLSIQLKLNTPSTPSPVQTPDASRSASEDKPDLYCAVANMLCHRCAHGCGNYNNTLIVCGGYDRTECLRSAEQYIPETNTWKNLPPMRESRGRFKIAVLDDKIYAIGGSNGTTELDSVEMLDFSVXKXVKLPRMPLARSNLGVCTLDKKIYCIGGWNGQVGIKQCHVYNPETAAWTSIASLNAGRYQAGVTAYNNLVYAIGGSDAWNCLSSVEYYNPVDNTWHLSKPIITARRGCGLTVFNNKMYVIGGSDGSHSLNTTEIFDDETQTWTFGPAMTTSRANMEVAVVGDRLYAVGGFSGKTFLNTIEYLDLNSNEWTTFVPKGTCEFLNRRKPRSRKNSRKSMSEDKKSLNSPSTPSDIMENPMVSQAIQLSMEEAVIDNS

SEQ ID NO: 23985 - protein, 379 aa, Diabrotica virgifera
  misc_feature: Coding regions on vcDNA: vcDNA=SeqID_3682; Strand=+; Position=149-1288
  misc_feature: Homolog annotation: Hit_ID=Q26486; Match level="QueryCoverage=100%, HitCoverage=100%, E-value=2e-97, Identity=47%"; Hit description=46 kDa FK506-binding nuclear protein (Peptidyl-prolyl cis-trans isomerase) (PPIase) (Rotamase)
  misc_feature: Gene Ontology Annotation: Molecular function=FK506 binding; Cellular component=nucleus; Biological process=protein folding
  misc_feature: Pfam annotation: Pfam_ID=FKBP_C; Match level="Score=151.9, E-value =1.5e-42, Copies=1"; Pfam description=FKBP-type peptidyl-prolyl cis -trans i
MFWGLIMEPQRRYLHVVKKAFHISMASLDVGTSSDEPAQVMCSFEGRNYLLCTLSKTVLQCPLDLNFEVGDEIALTTNGKCHIHLTGYFVEEAQDFLGEEEEEEEIEEEVEEKEVKKKNKKRNKQELNGPSPKKVKKEQKQEESEDDDDSEMDVTDLLENTLDSDDDDESFNGEENAEEEESGDGGEEEDDDEDESGDEQEQESESDDESEEEVVENKKKAQLNGHVKKQEQQTPKQKDKKNKKQQQNKEEKSSPTKENQSPKKDSPKKVVQGGMIIEDLKEGQGQPAKNGRFVHVYYEGRLKNNNKMFDSHKQGQGFAFKLGSGEVIKGWDVGLVGMKVGGKRRITCPPQMAYGVKGSPPAIPGNSTLVFEVELKKIR

SEQ ID NO: 23986 - protein, 157 aa, Diabrotica virgifera
  misc_feature: Coding regions on vcDNA: vcDNA=SeqID_3683; Strand=+; Position=65-538
  misc_feature: Pfam annotation: Pfam_ID=Ly-6_related; Match level="Score=-39.4, E -value=0.023, Copies=1"; Pfam description=Caenorhabditis elegans ly-6- related pr
VSIINMANLLGTIILFGFFALGFATQELISCYDCKPSADKPDECVYPEKNLAPVSNCQPPSNGTAVCVSSYVQNINAARTGVYRGCFNITAEIGNACDLFVEELSSNTSTIKFCRSCTTDRCNTDYLNEKGAANYNYNLESLIIINILAILVASIWK

SEQ ID NO: 23987 - protein, 363 aa, Diabrotica virgifera
  misc_feature: Coding regions on vcDNA: vcDNA=SeqID_3684; Strand=+; Position=92-1183
  misc_feature: Homolog annotation: Hit_ID=XP_312456.1; Match level="QueryCoverage =98%, HitCoverage=39%, E-value=1e-130, Identity=66%"; Hit description= ENSANGP00000022086 [Anopheles gambiae]
  misc_feature: Gene Ontology Annotation: Molecular function=proteasome endopeptidase activity; Cellular component=proteasome regulatory particle (sensu Eukarya); Biological process=proteolysis and peptidolysis
MGDTKVEPTKVDKTKGTEDKNKNELSEEDKQLQDELNLCVEKLQDNDEKRYLLALQALSNHIQASTTSMTSVPKPLKFMRPHYETMKTVHEKITDPDTKKVCADIISVLAMTMGEGRECLKYRLLSNLDKIGEWGHEYVRHLAGEIAGEWAETDFIVNTEIREKLILLTKQIVPYNMAHNAEAEACDLLMEIERLDLLEQYVDENIYHRVCLYLTSCVPYVADPENTTLLQTALLLFRKFDQYPQALRLAMQLNDFGLIEEIFVNCPDSDVQKQLAFMLGRQQIYVEIPEHTPEYEDLIEIMANCHLNNHFLNLARELDIMDPKTPEDVYKSHLKNSRPPFGGNPVDSSPNKTLAASFVNGFW

SEQ ID NO: 23988 - protein, 64 aa, Diabrotica virgifera
  misc_feature: Coding regions on vcDNA: vcDNA=SeqID_3685; Strand=+; Position=2-196
HITCDDDRPVFGSSSLSIILCLGNITSQYIYFWQYVCYSCRYCWLLSLPIELSIPIVIKLAMIY

SEQ ID NO: 23989 - protein, 335 aa, Diabrotica virgifera
  misc_feature: Coding regions on vcDNA: vcDNA=SeqID_3686; Strand=+; Position=34-1041
  misc_feature: Homolog annotation: Hit_ID=XP_322067.1; Match level="QueryCoverage =88%, HitCoverage=51%, E-value=2e-50, Identity=38%"; Hit description =ENSANGP00000020497 [Anopheles gambiae]
  misc_feature: Gene Ontology Annotation: Molecular function=cholinesterase activity; Cellular component=synaptic junction
  misc_feature: Pfam annotation: Pfam_ID=COesterase; Match level="Score=95.4, E-value= 1.4e-25, Copies=1"; Pfam description=Carboxylesterase
MAYLRLLVFCAIIYFAKTGVTSPADGSTNDDLIVTLSTGSKVRGHVLQSFEGSDFHAFENIPYAEPPTGKRRFQPPIPKTPWEGIFNATSTNKVCPQYGYDTAEEDCLVVNVYRPVKSNHQELLPVFFWIYGGGFTNGLGSLYDPKFFIDYDIVIVTFNYRVGALGFLTTIDDNIPGNLGLKDQLLALQWVHDNINVFGGDPKQVTVGGESAGSMSAGFHLLSKLARGLYSGIIQQSGSPLYSGFYPSNNREKAFEFGRQLNSSFTSSKSSDLLTLLQEVPLSEIMKHQSTQPMSWAPVMEEKTHDNVFCSGPMYSSVLNGEIKFCSILIVGINF

SEQ ID NO: 23990 - protein, 355 aa, Diabrotica virgifera
  misc_feature: Coding regions on vcDNA: vcDNA=SeqID_3687; Strand=+; Position=23-1090
  misc_feature: Homolog annotation: Hit_ID=NP_732874.1; Match level="QueryCoverage =74%, HitCoverage=42%, E-value=8e-47, Identity=41%"; Hit description =CG10175-PA, isoform A [Drosophila melanogaster] gb|AAF56142.2| CG10175-PA, isoform A [Drosophila
  misc_feature: Gene Ontology Annotation: Molecular function=cholinesterase activity; Cellular component=synaptic junction
  misc_feature: Pfam annotation: Pfam_ID=COesterase; Match level="Score=130.5, E -value=4e-36, Copies=1"; Pfam description=Carboxylesterase
MAHLKLFIHCVLIFFVHEGLTSPVAESTDDDLIVTLSTGSKVRGHVLQSFEGNDFQAFENIPYAEPPTGKNRFQPAIPKTPWEGVFNATFAYKFCPQFGVVAAVEDCLVLNVYKPVNANDQQLLPVFFWIHGGSFINGAGSLYDPKLLIDYDIVIVTINYRLGALGFLTTLDDNIPGNLGLKDQLLALQWVHDNINAFGGDPKQVTVGGESAGSMSAGFHLLSRLAHGLYSGIIQQSGSPLSSAFYPNKNREQAFEFGRKLNSSFASSKSSDLLKLLQEAPLSDIVTQQALSPTACIPTMEKKFNDKAFVSGAMQQKNPSPRGKIQFFFLVLKKIKIPKKNSGVCLGGATRGAIF

SEQ ID NO: 23991 - protein, 464 aa, Diabrotica virgifera
  misc_feature: Coding regions on vcDNA: vcDNA=SeqID_3688; Strand=+; Position=239-1629
  misc_feature: Homolog annotation: Hit_ID=XP_313307.1; Match level="QueryCoverage =99%, HitCoverage=30%, E-value=1e-159, Identity=59%"; Hit description= ENSANGP00000010474 [Anopheles gambiae]
  misc_feature: Gene Ontology Annotation: Molecular function=protein degradation tagging activity; Cellular component=nuclear membrane; Biological process=protein modification
  misc_feature: Pfam annotation: Pfam_ID=UDP-g_GGTase; Match level="Score=374.3, E -value=1.6e-109, Copies=1"; Pfam description=UDP-glucose:Glycoprotein Glucosyltran
  misc_feature (12)..(12): Xaa can be any naturally occurring amino acid
  misc_feature (444)..(444): Xaa can be any naturally occurring amino acid
KMLRIYCQRVLXMKESRRSVIANGRGLGPLEENEEFTSEDFSLLYRFSSSTYWEKIKAALDKNSDDEDDISSNSLMKLISLLIARPQSRSRFEINFSGDEHSVIKIPPAHPDRVAFDIAAIVDPVSRGAQKLGPILQVLQEVLNCRIRVFLNSVEKNSDMPVKSFYRFVLEPEIQFGEDGKQLPGPIARFNNMPTSPLLTQNYHVPENWLVEVVRSVYDLDNIRLENVESNVHSEYELEYLLLEGHCFEQSSGSPPRGLQITLGTESQPVIVDTIVMANLGYFQLKANPGAWLLRLRQGRSADIYDIVSHEGSDTPENSTDIKVLISSLRSHIVKLRVQKKPDKANVDLLSDDDNNNGIWSSITSSFKGSEDESDEKLNIFSLASGHLYERFLRIMMLSVLKHTKRPVKFWFLKNYLSPQVKDFLPYMAKEYGFEYELVQYKWXPRWVHQQTEKQRNYFGVTKY

SEQ ID NO: 23992 - protein, 67 aa, Diabrotica virgifera
  misc_feature: Coding regions on vcDNA: vcDNA=SeqID_3689; Strand=-; Position=942-1145
GTPPFFFFRFGFLFGKKKPLFFGNLFLNMERRGFNEKKNFGKGKLIKKRKVLPKMENFYLTFFGFRT

SEQ ID NO: 23993 - protein, 357 aa, Diabrotica virgifera
  misc_feature: Coding regions on vcDNA: vcDNA=SeqID_3690; Strand=+; Position=87-1159
  misc_feature: Homolog annotation: Hit_ID=NP_788360.1; Match level="QueryCoverage =89%, HitCoverage=77%, E-value=6e-26, Identity=28%"; Hit description =CG12970-PB, isoform B [Drosophila melanogaster] gb|AAO41387.1| CG12970-PB, isoform B [Drosophila
  misc_feature (280)..(280): Xaa can be any naturally occurring amino acid
  misc_feature (298)..(298): Xaa can be any naturally occurring amino acid
MVDAEEKKRYNVLENVLKDINQKYISFPEEMRKRNNKILLELLDALIPKMKEKNTLFKQLYFTTFFGGSFYDGLRVGAPDEFDLDLLMTLPKMLNIDLNVSNIPGFVHVKITNLLELFNQPHLKERFNGLEKLVDNQHHLDNLKVRQWMERIVTLTINDFPQEKGSHVINIKSGKFLAKFSKAGPAFTLKVNGRVGKDNVVLDIDLVPCFRFAQDKWPKSPFRPNPTPAKSTFFIVPKPQKNGNLVGEHYWRLSFPEQERELIDKKQYLKPSIKFLKKNXRDTSNPACIASYYLQTIXLWEKEKRPEAFWSSSLRYVFLTLPKTYYESIKNGKDFFITWNKNKNLIMGASAPPLTKG

SEQ ID NO: 23994 - protein, 155 aa, Diabrotica virgifera
  misc_feature: Coding regions on vcDNA: vcDNA=SeqID_3691; Strand=+; Position=463-928
  misc_feature: Homolog annotation: Hit_ID=XP_393553.1; Match level="QueryCoverage =85%, HitCoverage=57%, E-value=1e-33, Identity=52%"; Hit description =similar to ENSANGP00000020909 [Apis mellifera]
  misc_feature: Gene Ontology Annotation: Molecular function=monocarboxylic acid transporter activity; Cellular component=integral to plasma membrane; Biological process=monocarboxylic acid transport
  misc_feature (78)..(78): Xaa can be any naturally occurring amino acid
MESPTKEAPLATLSGVAPSLESSPKKSEELILINPYEKPEVTFKTDSLCSSSSSSSSASESGDEAAKPKIPDGGWGWXVVFSSLLVSMIADGVSLSFGLLFSEFLIEFKASSSDTAWIGSLFLAVPLISGPIMSALVDKYGCRMMTCVSGTIAAA

SEQ ID NO: 23995 - protein, 360 aa, Diabrotica virgifera
  misc_feature: Coding regions on vcDNA: vcDNA=SeqID_3692; Strand=+; Position=130-1213
  misc_feature: Homolog annotation: Hit_ID=NP_958877.1; Match level="QueryCoverage =94%, HitCoverage=76%, E-value=2e-99, Identity=48%"; Hit description =FK506 binding protein 4 [Danio rerio] gb|AAH45387.1| FK506 binding protein 4 [Danio rerio]
  misc_feature: Gene Ontology Annotation: Molecular function=FK506 binding; Cellular component=cytoplasm; Biological process=biological_process unknown
  misc_feature: Pfam annotation: Pfam_ID=FKBP_C; Match level="Score=260.0, E-value=4e- 75, Copies=2"; Pfam description=FKBP-type peptidyl-prolyl cis-trans i
  misc_feature (316)..(316): Xaa can be any naturally occurring amino acid
MASPVDISPNKDGGVLKEILQEGTGEELPPQGSKVTVHYTGTLTDGTKFDSSRDRNDPFQFDLGKGNVIKAWDIGVATMKKGERAMLTCAPQYAYGESGSPPTIPPNSTLKFDVEVLSWKGEDLSPNRDGGIERIQITAGEGYSTPNDGAQVEVHLIGKHDGRIFDERDAAFAVGEASEANVISAIDIAIQKFKKNETSRLIVHPKYAFGANASQEFNIPANATVEYTVTLRNFEKLKESWSLDSEEKIQQCKLFKEKGTNYFKNGKYESAVKLYKRIHSYLEKDTDTDTQEDRNALLLAAHLNIALCQLKLKEYXEARSAATSAFNIDPDHEKALFRPRTAYISFARARNGPGKTLPGG

SEQ ID NO: 23996 - protein, 307 aa, Diabrotica virgifera
  misc_feature: Coding regions on vcDNA: vcDNA=SeqID_3693; Strand=+; Position=302-1225
  misc_feature: Homolog annotation: Hit_ID=EAL30951.1; Match level="QueryCoverage =90%, HitCoverage=51%, E-value=4e-54, Identity=38%"; Hit description =GA19282-PA [Drosophila pseudoobscura]
  misc_feature: Gene Ontology Annotation: Cellular component=integral to membrane; Biological process=spermatogenesis
MNMNYQMWHVVCVLFTTSVLQGCVLADYWSDREDLIENDRSYGLGATLKLTEKEQRVNNVLMKYKLSEYDAGLEDLDTFLAAQHYFKVKDKIQYSKVFDIIKRIPKGASLHSHDEALVSEDYLFSLTFRDNLYGCIDGDDFKLYFFQKNNISDSCNWKLLSDIRKSDARFNRFLKTKLTIITDDPEKSYPDINKVWKTFQAIFKSINGLITYKPVFEDYFYMALKELYNDNIKYMELRGFLPTLYDLEGNIYSQEEVVGIYSDVLKRFQRDFPDFFGAKFIYAPSRHCDNSTMDTFVETFRKSKTVS

SEQ ID NO: 23997 - protein, 352 aa, Diabrotica virgifera
  misc_feature: Coding regions on vcDNA: vcDNA=SeqID_3694; Strand=+; Position=71-1126
  misc_feature: Homolog annotation: Hit_ID=AAN73320.1; Match level="QueryCoverage =92%, HitCoverage=81%, E-value=2e-48, Identity=33%"; Hit description =serpin 6 [Ctenocephalides felis]
  misc_feature: Gene Ontology Annotation: Molecular function=serine protease inhibitor activity; Cellular component=cytoplasm; Biological process= regulation of proteolysis and peptidolysis
  misc_feature: Pfam annotation: Pfam_ID=Serpin; Match level="Score=194.4, E-value =2.2e-55, Copies=1"; Pfam description=Serpin (serine protease inhibitor)
MKRAIILALAIATTLAAPSDVQGPLQQLAIGNQQLTSNVYKEILKTKNGSIIFSPFSAETVLALTSEGAKGDTRSQLISALHLPESQETIQQGFKELLPQLNINNEYAVLASANKIYVANGIKLEDDFKKTAESIYASGLEQVDFSNSAKAANIINQWVESQTNKKIKDLIKPEYITSDTIMALINALYLSAEWSTVFQDYNTVTDKFYITASEQIDQPTMAMTEIFKYSENKDLDTQFLEIPFKANGLVFSVALPNKKDGIAALENNIEKVFEPQQYTHKPVHLRLPKFTVETELNLKTILKSLGVQKLFNFDADLSGLAKNAQRVRVSEGFKKKLSSWLKWRRSSGSDSP

SEQ ID NO: 23998 - protein, 338 aa, Diabrotica virgifera
  misc_feature: Coding regions on vcDNA: vcDNA=SeqID_3695; Strand=+; Position=72-1085
  misc_feature: Homolog annotation: Hit_ID=NP_608885.1; Match level="QueryCoverage =99%, HitCoverage=99%, E-value=1e-104, Identity=57%"; Hit description= CG3756-PA [Drosophila melanogaster] gb|AAF52185.1| CG3756-PA [Drosophila melanogaster]
  misc_feature: Gene Ontology Annotation: Molecular function=DNA-directed RNA polymerase activity; Cellular component=DNA-directed RNA polymerase I complex; Biological process=growth
  misc_feature: Pfam annotation: Pfam_ID=RNA_pol_A_bac; Match level="Score=129.1, E -value=1e-35, Copies=1"; Pfam description=RNA polymerase Rpb3/RpoA insert domai
  misc_feature (299)..(299): Xaa can be any naturally occurring amino acid
  misc_feature (310)..(310): Xaa can be any naturally occurring amino acid
  misc_feature (322)..(322): Xaa can be any naturally occurring amino acid
MNSANDEKPRVILEEYKTSKNLPTAPTVLNEVFSVKNFKKKFRIVVVRNENYEMEFDMIGIHPFLANTFRRLMLSDVPSMAIEKVYIHNNTSIIQDEVLAHRLGLIPLKADARLFEYKEDSSAASNENDSLEYELKIKCSYNKEANKKDSSREEDMYKNNNVYSKHIKWVPVGNQKERFKEADVGPIETDILIAKMRPGHELDLKLVAVKGVGRDHAKFSPVATAFYRLMPDIKLVREVTGDAAYKLPSCFSPGVIGIRNKKDGRKIAVVNNARYDTGSRNVFRYDDLKDTVSMTKIQXHFIFTIESVGXMQADVFFKEVVXTFKEKCSLLLKELNSF

SEQ ID NO: 23999 - protein, 285 aa, Diabrotica virgifera
  misc_feature: Coding regions on vcDNA: vcDNA=SeqID_3696; Strand=+; Position=85-942
  misc_feature: Homolog annotation: Hit_ID=CAA08918.2; Match level="QueryCoverage =98%, HitCoverage=64%, E-value=1e-54, Identity=39%"; Hit description =dimethylallyltransferase; farnesyl pyrophosphate synthase [Agrotis ipsilon]
  misc_feature: Gene Ontology Annotation: Molecular function=dimethylallyltransferase activity; Cellular component=cytosol; Biological process=cholesterol biosynthesis
MMSSKNLMFNRSSRELLKNIRRHISKTSSAPNSDAISRQDHKLGVKNLDLNGSEQKFANEKWSVHSKQNNIRALSTIQTKAKPSVNNTPMFSKEESREFMAIFPDIVRDLTDAGRHTDIPEVTKRFAKVLQYNVPTGKKTRGLSTVIAYKMLERPENLTPENIRLANILGWCVELLRACGQVLDDMIDRSEIRHNKLSWYKNDQVGFNAIADSTMMENSVYAILRKYFSDHSLYVPLLELFQDITIRSALGKSLEGEIYHGNRHDLSKMTMTNFSLISKYRNRIL

SEQ ID NO: 24000 - protein, 205 aa, Diabrotica virgifera
  misc_feature: Coding regions on vcDNA: vcDNA=SeqID_3697; Strand=+; Position=3-620
  misc_feature: Homolog annotation: Hit_ID=NP_573117.2; Match level="QueryCoverage =91%, HitCoverage=67%, E-value=9e-09, Identity=20%"; Hit description =CG9917-PA [Drosophila melanogaster] gb|AAF48590.1| CG9917-PA [Drosophila melanogaster]
  misc_feature: Pfam annotation: Pfam_ID=DUF1397; Match level="Score=-89.3, E-value =0.00042, Copies=1"; Pfam description=Protein of unknown function (DUF1397)
QLPYFILLGLSHSIYYCEIANYNDDVCTPEKVQAKQLLLNECLNRREGAYAFSQTLMRPSGSIAEFLKKRCAMKPHLDDCLDLWLDLIKECVNADDLRGLEVWKKIDAEIINYVCAHDAEAMTSLLKNRYHSCRQGLSRILTDCSRSLGITVPFYQVDKVRQKCNKIGTMESCVTSKLERNCMRNATELAKPLFHIVKTNLCSNN

SEQ ID NO: 24001 - protein, 548 aa, Diabrotica virgifera
  misc_feature: Coding regions on vcDNA: vcDNA=SeqID_3698; Strand=+; Position=244-1889
  misc_feature: Homolog annotation: Hit_ID=EAL27465.1; Match level="QueryCoverage =94%, HitCoverage=68%, E-value=0.0, Identity=75%"; Hit description =GA19195-PA [Drosophila pseudoobscura]
  misc_feature: Gene Ontology Annotation: Molecular function=peroxidase activity; Cellular component=integral to plasma membrane; Biological process =thyroid hormone generation
  misc_feature: Pfam annotation: Pfam_ID=An_peroxidase; Match level="Score=413.0, E -value=3.6e-121, Copies=1"; Pfam description=Animal haem peroxidase
  misc_feature (535)..(535): Xaa can be any naturally occurring amino acid
MEMTRVMMPCVRWLTLLGLISSNVVFGIQLQSLDVPFNGEGECALILDGPGKSSNFDYSLNLLRGSSLNYDGPNTCITFDAINAAYLDARKRIHVASPDDAHFKNEYVASVGELVFDISLNLAKTYGLSYQEIEKGLPLIDTSKTLIRDVCPAFLSNVECRAGKYRRYDGLCTNLEHPTWGASHTPFTRLLGPVYADGIQAPRISITGRPLPLARVVSRTIHPDEGYHDHAGTVMIIAWGQFMDHDYTLQGTPLDPLNKNDPEECCNRPAHLKHPYCNEIYIPEDDFFYKLFKVNCIDFVRTFPAPRPGCRLGSKVPFNTLTGVLDGNTVYGVTESHAKKLRMFEGGLLRMHPAFEHFGLKDLLPLKVEIPDEGCTRPNSSMYCFEAGEIRVNEQLVLACMHTLMAREHNRLAKGLAEINPHWDDETLFQEARRINIAIIQHVTYNEFLPILLGKDVMEKFGLTLQKQGYWDGYDSNVNPGVIDAFAAAAFRFGHSLLPTAVERWSKAHKFISSKRLSDLIRRPYDLFRAGVFDXYSMGLMNKLPGYG

SEQ ID NO: 24002 - protein, 94 aa, Diabrotica virgifera
  misc_feature: Coding regions on vcDNA: vcDNA=SeqID_3699; Strand=+; Position=741-1025
VLLYFNKLLRFQDFFRRSGEREIGKNFFTYLRFHSLIYSHLKYEIICVLLLYFIAVEIVKHLLICYSITSLFIINKFIFKLYKIMISLYYEHKF

SEQ ID NO: 24003 - protein, 258 aa, Diabrotica virgifera
  misc_feature: Coding regions on vcDNA: vcDNA=SeqID_3700; Strand=+; Position=124-900
  misc_feature: Homolog annotation: Hit_ID=BAD52258.1; Match level="QueryCoverage =99%, HitCoverage=100%, E-value=1e-123, Identity=84%"; Hit description=proteasome alpha 4 subunit [Plutella xylostella]
  misc_feature: Gene Ontology Annotation: Molecular function=endopeptidase activity; Cellular component=proteasome core complex (sensu Eukarya); Biological process=ubiquitin-dependent protein catabolism
  misc_feature: Pfam annotation: Pfam_ID=Proteasome; Match level="Score=223.3, E -value=4.6e-64, Copies=1"; Pfam description=Proteasome A-type and B -type
MARRYDTRTTIFSPEGRLYQVEYAMEAISHAGTCLGILANDGILLAAERRNTNKLLDEVFISEKIYKLNDDMVCSVAGITSDANVLTNELRLIGQRYLFQYAESIPCEQLVSWLCDVKQAYTQYGGKRPFGVSILYMGWDKHYGYQLYQSDPSGNYSGWKATCIGNNSSAAISSLKQEYKEGQMTLKDAKTLAVKVLAKTLDMAKLTSEKVEMATLTRKNDKTMIKILSGKEVEELISEYEKSEAAAEASKKEQKASA

SEQ ID NO: 24004 - protein, 264 aa, Diabrotica virgifera
  misc_feature: Coding regions on vcDNA: vcDNA=SeqID_3701; Strand=+; Position=230-1021
  misc_feature: Homolog annotation: Hit_ID=XP_313674.1; Match level="QueryCoverage =99%, HitCoverage=35%, E-value=9e-78, Identity=52%"; Hit description =ENSANGP00000012684 [Anopheles gambiae]
  misc_feature: Pfam annotation: Pfam_ID=Neurochondrin; Match level="Score=-278.1, E -value=0.028, Copies=1"; Pfam description=Neurochondrin
MGEVSDAVKKCCNILKNSASDTEKFAALFMVTKLVKGKHATPNAKKAIFESIGFDFLRRLLLTTDVPVDCPPSIYKSVALSIISVFCNEEELATKKEMLEFVPAFLEIVKAADDDANDDSLMAIGEAYNCLKGIASYEPGQKKLIESQAVDKLGEIYSQGSFQSDEALNIMAVLIAKYPTSWTNKDPKAYHALLNKIAVDFETDQDKRKFEICEVLHALVYNCPKTQISEFSASETWPQSIYKGLSDILQRKIGAAQRNPALLL

SEQ ID NO: 24005 - protein, 454 aa, Diabrotica virgifera
  misc_feature: Coding regions on vcDNA: vcDNA=SeqID_3702; Strand=+; Position=402-1765
  misc_feature: Homolog annotation: Hit_ID=XP_313674.1; Match level="QueryCoverage =92%, HitCoverage=57%, E-value=1e-126, Identity=50%"; Hit description= ENSANGP00000012684 [Anopheles gambiae]
  misc_feature: Pfam annotation: Pfam_ID=Neurochondrin; Match level="Score=76.4, E -value=7.5e-20, Copies=1"; Pfam description=Neurochondrin
  misc_feature (412)..(412): Xaa can be any naturally occurring amino acid
MVRCLVPGVSSEIVKAADDDANDDSLMAIGEAYNCLKGIASYEPGQKKLIESQAVDKLGEIYSQGSFQSDEALNIMAVLIAKYPTSWTNKDPKAYHALLNKIAVDFETDQDKRKFEICEVLHALVYNCPKTQISEFSASETWPQSIYKGLSDILQSKIGAAQRNPALLLTSSVLELLGIDWIFSDEEKGKQIFLLLIQLAAIEVRMQLEGKNLKSLAPQQNLITACYLILEVCINFITDDQIDLEQKERQTVYTGLKGAFTAVVNLLIKIDADKSKPSAEDKLFICATVRVLAAWLAQETTAMRPQIYQLLPFILNLANETFYAYRDRRVAEKANQPHDNHPLSNINLLRVMLPSLCHLAVEDDARKLMLKIKEEKVLLDVLKFHWTIVHYKRPPVPRSERLKVNNQPAPQXTPENLEDMKELRTAMISTCNLKTIFIFCFLTVFKKKQIHRKI

SEQ ID NO: 24006 - protein, 180 aa, Diabrotica virgifera
  misc_feature: Coding regions on vcDNA: vcDNA=SeqID_3703; Strand=+; Position=130-673
  misc_feature: Homolog annotation: Hit_ID=CAF89513.1; Match level="QueryCoverage =88%, HitCoverage=73%, E-value=1e-65, Identity=75%"; Hit description =unnamed protein product [Tetraodon nigroviridis]
  misc_feature: Gene Ontology Annotation: Molecular function=RAB small monomeric GTPase activity; Cellular component=early endosome; Biological process=endocytosis
  misc_feature: Pfam annotation: Pfam_ID=Ras; Match level="Score=239.9, E-value=4.7e -69, Copies=1"; Pfam description=Ras family
  misc_feature (147)..(147): Xaa can be any naturally occurring amino acid
MANSSNNVDSFNFKVVLLGEGCVGKTSLVIRYIEDKFNPKHISTIQASFLTKKLNLDGNRVNLSIWDTAGQEKFHALGPIYYRSSNGAVLVYDITDEDSFQKVKSWVKELRKMLGTDISLVIVGNKSDLEKDRHVDVEEAKSYAEKXKAMHFQTSAKLNRKASKKCSWRLTQKDAKRSEG

SEQ ID NO: 24007 - protein, 128 aa, Diabrotica virgifera
  misc_feature: Coding regions on vcDNA: vcDNA=SeqID_3704; Strand=+; Position=708-1094
YNLFYFFSSICYFPVFLFISVSSLSDLPLMIIILPFSRLFPFLGLLFAPPIYPLLISYSSQNLLLILSVVRRHKDSIFTAGNYGNPLLSPRWVGSYFKGFFINSVPQAFPPNNLAFPFRGQKGWLLRV

SEQ ID NO: 24008 - protein, 232 aa, Diabrotica virgifera
  misc_feature: Coding regions on vcDNA: vcDNA=SeqID_3705; Strand=+; Position=2-700
  misc_feature: Homolog annotation: Hit_ID=EAA05848.2; Match level="QueryCoverage =96%, HitCoverage=39%, E-value=4e-49, Identity=40%"; Hit description =ENSANGP00000005452 [Anopheles gambiae str. PEST] ref|XP_559703.1| ENSANGP00000005452 [Anopheles gambiae st
  misc_feature: Pfam annotation: Pfam_ID=GMC_oxred_C; Match level="Score=123.4, E -value=5.6e-34, Copies=1"; Pfam description=GMC oxidoreductase
EGLIYMKSKISTDPDPLYPDMELILLGGNLASDNGHLLRRMFNIPRDIYEKVWKIYESKPMYQIMPMLVHPKSVGYVKLASKNPFHFPKFYANFFSDPENKDIKTFIAALREVQRMSQSPTIKKLGTRLIQTPIPGCETMPFDSDEYWECALRSLTSSLWHQVATCKMGPKSDPEAVVDNTGKVHGLKHLRVADTSIIPMPLTAHTAGPSYMVGERISDFIKEEWRSNKYFK

SEQ ID NO: 24009 - protein, 435 aa, Diabrotica virgifera
  misc_feature: Coding regions on vcDNA: vcDNA=SeqID_3706; Strand=+; Position=239-1547
  misc_feature: Homolog annotation: Hit_ID=XP_310329.1; Match level="QueryCoverage =89%, HitCoverage=70%, E-value=4e-96, Identity=44%"; Hit description =ENSANGP00000005580 [Anopheles gambiae]
  misc_feature: Gene Ontology Annotation: Biological process=reproduction
  misc_feature: Pfam annotation: Pfam_ID=GMC_oxred_N; Match level="Score=341.5, E -value=1.2e-99, Copies=1"; Pfam description=GMC oxidoreductase
  misc_feature (403)..(403): Xaa can be any naturally occurring amino acid
MYYLIITGVLWQICFVSTLIPPSYINVQIDNAFSKSITNQTFDFIVIGSGPTGSVIANRLSEVPEWNVLLIEAGTIPSAISDIPAICGHFQFTGYDWGYRTERQNGFCKGCIRNSLKYGHGKVLGGTSIINFMIHVRGNRRDYDRWAKMGNPGWSYQEVLPYFLKSEDAHIERADAGYHKKGGYLTISDVPFRTKMIDALVQSAQECGHPYVDYNGKEQLGVSYVQTHTRNGRRCSAEKAFLRPVAHRSNLKILTNSKVVKILIDPTTKSAYGVQYARKKKYYNAFASKEVIVSAGGLNSPQLLMLSGIGPKEHLQEFDIPVIANLPVGKKMYDHPSFMGMGFEIDEEIVLRQDEVLTNVTEILTFLKLGNGTMTSIGGVEGLIYMKSKISTDPDPLYPDMEXFLLGGNLASDNGHLLRRMFNIPRDIYQKVWKN

SEQ ID NO: 24010 - protein, 73 aa, Diabrotica virgifera
  misc_feature: Coding regions on vcDNA: vcDNA=SeqID_3707; Strand=-; Position=784-1005
  misc_feature: Homolog annotation: Hit_ID=XP_484274.1; Match level="QueryCoverage =89%, HitCoverage=32%, E-value=3e-14, Identity=48%"; Hit description =similar to regulator of sex-limitation candidate 18 [Mus musculus]
  misc_feature: Gene Ontology Annotation: Molecular function=specific RNA polymerase II transcription factor activity; Cellular component=nucleus; Biological process=zinc ion homeostasis
  misc_feature: Pfam annotation: Pfam_ID=zf-C2H2; Match level="Score=33.8, E-value =5.1e-07, Copies=2"; Pfam description=Zinc finger, C2H2 type
  misc_feature (25)..(25): Xaa can be any naturally occurring amino acid
  misc_feature (30)..(30): Xaa can be any naturally occurring amino acid
MSILYKYMRLHTGEKPYKCEICFKXVLPKXLKNHMRTHTGEKPFECEICSKQSSKKSNLNKYMIAHWRDTLQI

SEQ ID NO: 24011 - protein, 291 aa, Diabrotica virgifera
  misc_feature: Coding regions on vcDNA: vcDNA=SeqID_3708; Strand=+; Position=10-882
  misc_feature: Homolog annotation: Hit_ID=XP_395098.1; Match level="QueryCoverage =87%, HitCoverage=69%, E-value=6e-68, Identity=52%"; Hit description =similar to CG12175-PB [Apis mellifera]
  misc_feature: Gene Ontology Annotation: Molecular function=DNA binding; Cellular component=nucleus; Biological process=induction of apoptosis
  misc_feature: Pfam annotation: Pfam_ID=zf-C2H2; Match level="Score=16.8, E-value =0.068, Copies=1"; Pfam description=Zinc finger, C2H2 type
  misc_feature (217)..(217): Xaa can be any naturally occurring amino acid
  misc_feature (247)..(247): Xaa can be any naturally occurring amino acid
MVTCVETPTTNSTKTSLEKIEGFMNEASYNEAIESSSNFNTRLCIERRLRLPFIDTQTGVAQNHCSLFMNKRQRIPGLHPGQIYSYPRQRWRKKRRQYLSMNARAFARAADHLLDGPDTDMHSISQIENPALQDTDSKDSQLLKDEVSKEWFYDEADMLEMDAYDEPDPDSDLDYEECYSKRRRGRRGVGRGRSGTDSPSTPNKRKGAGRGRKKVKXNFEPTPGDPDKPFACELCGARYKTRPGLTXHYGHSHKEGASDENSRDSNAPHPPLREKHPPPPPLLLRGGGGVC

SEQ ID NO: 24012 - protein, 233 aa, Diabrotica virgifera
  misc_feature: Coding regions on vcDNA: vcDNA=SeqID_3709; Strand=+; Position=68-769
  misc_feature: Homolog annotation: Hit_ID=XP_315096.1; Match level="QueryCoverage =96%, HitCoverage=95%, E-value=4e-87, Identity=68%"; Hit description =ENSANGP00000011435 [Anopheles gambiae]
  misc_feature: Gene Ontology Annotation: Molecular function=endopeptidase activity; Cellular component=proteasome core complex (sensu Eukarya); Biological process=ubiquitin-dependent protein catabolism
  misc_feature: Pfam annotation: Pfam_ID=Proteasome; Match level="Score=126.6, E -value=6e-35, Copies=1"; Pfam description=Proteasome A-type and B-type
MMQTANNAYYPDYSTAPMQRQINPYADNGGSVVAIAGEDFVIIGADTRLSTGFSIYTREQNKLFPLSGTTVLGCAGCWCDTLTLTRILKSRMQMYQQEHNKTMSTTACAQMLSTMLYYKRFFPYYISNILVGLDNEGKGCVYSYDPIGHCEKATYRAGGSAGALLQPLLDNQIGQKNMLKTSGEPLSQEKALSTLKDVFISAAERDIYTGDSVLINIITKDGVKEESFQLRRD

SEQ ID NO: 24013 - protein, 493 aa, Diabrotica virgifera
  misc_feature: Coding regions on vcDNA: vcDNA=SeqID_3710; Strand=+; Position=144-1625
  misc_feature: Homolog annotation: Hit_ID=EAA05748.2; Match level="QueryCoverage =96%, HitCoverage=94%, E-value=1e-179, Identity=63%"; Hit description= ENSANGP00000015158 [Anopheles gambiae str. PEST] ref|XP_559834.1| ENSANGP00000015158 [Anopheles gambiae s
  misc_feature: Gene Ontology Annotation: Molecular function=ubiquitin-specific protease activity; Cellular component=proteasome regulatory particle (sensu Eukarya); Biological process=protein modification
  misc_feature: Pfam annotation: Pfam_ID=UCH; Match level="Score=216.7, E-value=4.6e -62, Copies=1"; Pfam description=Ubiquitin carboxyl-terminal hydrolase
MPQYKIKVKWGKESYPDIEVNTEEPPLLFKAQLFALTGVQPERQKVMIKGVTLKDSDWNNFKLKDGVTILLMGSKEEDVPKEPVEKTVFMEDMNESELATALELPAGLTNLGNTCYMNATVQCLKAVPELREALQSYQEAIKLTGSNVVPAQSITAALRDLYSNMDKGNTVPPILLLQVMHMAFPRFAEKNEHGTLSQQDANECWTEMVRMLQQKLPARKNGGASAEQFKSFIDQYFGGTFDVELKCVEAEDEPVSKNKEQFLQLSCFISQDVRYMHSGLKNKLQEQITKNSSMLDRDAVYTKTSKISRLPAYLTVQFVRFYYKEKESINAKILKDVKFPLDFDAYDLCSPQLQEKLAPMRAKFKEFEDAQVERASKEKDKAVQGDSKEVKQYAPYSFEDDLGSNNSGYYTLQAVLTHRGRSSSSGHYVGWVRQSGDKWIMCDDDNVSPVTTEDILKLSGGGDWHCAYGLLYGPKLLGISLPIKKKISIIKPN

SEQ ID NO: 24014 - protein, 334 aa, Diabrotica virgifera
  misc_feature: Coding regions on vcDNA: vcDNA=SeqID_3711; Strand=+; Position=124-1128
  misc_feature: Homolog annotation: Hit_ID=XP_318434.1; Match level="QueryCoverage =94%, HitCoverage=95%, E-value=2e-84, Identity=52%"; Hit description =ENSANGP00000014198 [Anopheles gambiae]
  misc_feature: Gene Ontology Annotation: Cellular component=extracellular space; Biological process=lipid metabolism
  misc_feature: Pfam annotation: Pfam_ID=adh_short; Match level="Score=147.9, E-value= 2.3e-41, Copies=1"; Pfam description=short chain dehydrogenase
MILLTILIVSGIAFIIFALAVQPLRKKSINGKHVVVIGGSSGIGKSVAKLAAREGAHVTIIARNVDRLEEAKQEIQQHVVDANQQIISRVSVDVADYASLDNNITQIEDQVGPIYMMVNCAGMAICGVIEDLTLQEIKQLIDVNYLGSIYSVKSILPRLKERKDGIVVLTGSQASLMGIYGFSIYSGCKFAVRGLAEAVHMEAKPYNVSVTLALPPDTDTPGFANENKNKPEETRIISEAGGLANPDDVAKRLLDDALVGKFFSYYGFESSVLTTLCVGMTPPLRCIDVIVQTLVLGPLRLLGCYYVTTFHKVVQNCYNDRKNRELEQDTQKVQ

SEQ ID NO: 24015 - protein, 710 aa, Diabrotica virgifera
  misc_feature: Coding regions on vcDNA: vcDNA=SeqID_3712; Strand=+; Position=130-2262
  misc_feature: Homolog annotation: Hit_ID=AAK69205.1; Match level="QueryCoverage =98%, HitCoverage=91%, E-value=1e-177, Identity=44%"; Hit description= transglutaminase [Pacifastacus leniusculus]
  misc_feature: Gene Ontology Annotation: Molecular function=protein-glutamine gamma -glutamyltransferase activity; Cellular component=cellular_component unknown; Biological process=protein amino acid polyamination
  misc_feature: Pfam annotation: Pfam_ID=Transglut_core; Match level="Score=151.7, E -value=1.7e-42, Copies=1"; Pfam description=Transglutaminase-like superfamily
MSLGTDMFYMYPKENAKLHKTDQYELVDEEDVPVLRRGQKFTVALRFSRDYDPKTDMIRISFNFGPRPHPIKGTAGIFVVDPAKRSNIDTEKPMWFGNVLEARGQSLTLEIYSPPGIPVGLWAVKVETRVRNSSEEPVVYDYPGDLYFICNPWNCHDMVYMPETRLLEEYILNDTGKIWVGPLGTTKGREWIFGQFDSCTLPAIQLMFEKSGLPWASRGDPIKLTRIISKMVNSNDDDGILVGRWDGQYEDGTAPSAWTGSVPILQQYLDTEQPVSYGQCWVFSGVCTTIARALGIPSRVVSNLVSAHDANSTLTVDKYFNEHNEELPFDPNNPEGEDSIWNYHVWNDVYMARPDLPPGYGGWQAIDATPQEPSSGFYQCGPASLEAIKKGQVGYNFDVGFMVASVNADLMRWKVDHSNVLGYKRIYCNKYHVGRYILTKQPFMYDYNGDRDRQDITRLYKPEEGSKAERLSLLNAVRGTEAAKRFFDMPDEETEDCEFTLQDLDQIKIGENFSVVVKIKNNSNSQRHIKVHLSAGTVYYNGLKAHPISKDEGEFNLKPHSTEELRLNVTADEYLDKLVEYCIMKIYAIASVSETNQTWADEDDFQVVRPNIDIKVPHTIVNKKPTTVGLKFVNPLKKALTNGKFHISGASLLKNQVIGVPDVKPGTVIRIETSIVPKYEGEQKLVATFTSRELLDITGTAKVEVVSEEE

SEQ ID NO: 24016 - protein, 134 aa, Diabrotica virgifera
  misc_feature: Coding regions on vcDNA: vcDNA=SeqID_3713; Strand=+; Position=341-745
  misc_feature: Homolog annotation: Hit_ID=NP_477067.2; Match level="QueryCoverage =83%, HitCoverage=5%, E-value=2e-09, Identity=40%"; Hit description =CG8274-PA [Drosophila melanogaster] gb|AAF58615.1| CG8274-PA [Drosophila melanogaster]
  misc_feature: Gene Ontology Annotation: Cellular component=nuclear pore
MGPPAVAGTSSEGAQQHEQAEEMLEGDDGVSSEGEKPPIAEEGEEEGREAEASPSSNSRGVAQRGSNSARRSTRSSLPRGANQRSGPTPIVWSDRSPQRHQHPQDRNRSPQGYQSRTVARRARNRGQRPFDRRF

SEQ ID NO: 24017 - protein, 282 aa, Diabrotica virgifera
  misc_feature: Coding regions on vcDNA: vcDNA=SeqID_3714; Strand=+; Position=41-886
  misc_feature: Homolog annotation: Hit_ID=XP_311849.1; Match level="QueryCoverage =71%, HitCoverage=78%, E-value=2e-77, Identity=53%"; Hit description =ENSANGP00000018251 [Anopheles gambiae]
  misc_feature: Gene Ontology Annotation: Molecular function=transcription factor activity; Cellular component=integral to plasma membrane; Biological process=N signaling pathway
  misc_feature: Pfam annotation: Pfam_ID=EGF; Match level="Score=24.5, E-value =0.00032, Copies=4"; Pfam description=EGF-like domain
  misc_feature (276)..(276): Xaa can be any naturally occurring amino acid
MRNLLNFFSVLLVLHCYSVVLGEPSYYRQYRVLGDYPYQTYYGNPYADHPYRYASNSDVYITDRYGRTSLRSGDSYRVSSYSSTTCTSGTCGQNAQCQVVGGRPVCSCLRGHSGDPLSLCRREECLDDGECRGQLACRGGKCIDPCVGTCGVNANCEARRGVPVCTCPAGYTGDPITSCRRFNPEELCHPSPCGPNTHCEVKNEVPTCSCLPGFHGSPLAGCRHECESDVECGPTLACIEFKCQNPCLSQCGKNAECETISNHRAVCKCPKNYFGXPYSSCQ

SEQ ID NO: 24018 - protein, 303 aa, Diabrotica virgifera
  misc_feature: Coding regions on vcDNA: vcDNA=SeqID_3715; Strand=+; Position=478-1385
  misc_feature: Homolog annotation: Hit_ID=XP_311849.1; Match level="QueryCoverage =93%, HitCoverage=80%, E-value=1e-119, Identity=56%"; Hit description= ENSANGP00000018251 [Anopheles gambiae]
  misc_feature: Gene Ontology Annotation: Molecular function=transcription factor activity; Cellular component=integral to plasma membrane; Biological process=N signaling pathway
  misc_feature: Pfam annotation: Pfam_ID=EGF; Match level="Score=24.7, E-value =0.00028, Copies=4"; Pfam description=EGF-like domain
  misc_feature (292)..(292): Xaa can be any naturally occurring amino acid
MRNLLNFFSVLLVLHCYSVVLVSSYSSTTCTSGTCGQNAQCQVVGGRPVCSCLRGHSGDPLSLCRREECLDDGECRGQLACRGGKCIDPCVGTCGVNANCEARRGVPVCTCPAGYTGDPITSCRRFNPEELCHPSPCGPNTHCEVKNEVPTCSCLPGFHGSPLAGCRHECESDVECGPTLACIEFKCQNPCLSQCGKNAECETISNHRAVCKCPKNYFGNPYSSCQPECYGDVDCPSSKPACYYGICKSPCEGACGVGANCELRGLTPVCSCPKDMTGDPFIRCRPFEPRDXCEPNPWGSNAH

SEQ ID NO: 24019 - protein, 297 aa, Diabrotica virgifera
  misc_feature: Coding regions on vcDNA: vcDNA=SeqID_3716; Strand=+; Position=5-895
  misc_feature: Homolog annotation: Hit_ID=NP_031559.2; Match level="QueryCoverage =98%, HitCoverage=67%, E-value=1e-104, Identity=61%"; Hit description= branched chain ketoacid dehydrogenase E1, alpha polypeptide [Mus musculus] gb|AAH03787.1|
  misc_feature: Gene Ontology Annotation: Molecular function=3-methyl-2-oxobutanoate dehydrogenase (lipoamide) activity; Cellular component=alpha -ketoglutarate dehydrogenase complex (sensu Eukarya)
  misc_feature: Pfam annotation: Pfam_ID=E1_dh; Match level="Score=185.3, E-value =1.3e-52, Copies=1"; Pfam description=Dehydrogenase E1 component
MVVNRSFLLFGKTVVRRFQHKVDVIGRQYSTEGPLFPGAKTTWTENLEFTGSHSYKPIPVYRVLDRQGNVINPENDPKLPDNILVKMYKDMTLLGALDKVLYEAQRQGRISFYLTNYGEEATQVGSAAALDTSDVVYGQYREVGVLMWRGYSLQQFVDQCYGNIDDPGQGKQMPVHYGSKELNFVTISSPLSTQIPQAAGSAYALRGKNRVVACYFGDGGASEGDAHAAFNFAATLNCPVIFICRNNGYAISTPVEEQYQGDGIAARGPGYGIYTLRVDGNDVLAMYNVTKMAKEYA

SEQ ID NO: 24020 - protein, 704 aa, Diabrotica virgifera
  misc_feature: Coding regions on vcDNA: vcDNA=SeqID_3717; Strand=+; Position=188-2302
  misc_feature: Homolog annotation: Hit_ID=NP_494132.1; Match level="QueryCoverage =85%, HitCoverage=77%, E-value=3e-29, Identity=22%"; Hit description =mutator-like transposase family member (2C224) [Caenorhabditis elegans] gb|AAB94979.1|
  misc_feature: Pfam annotation: Pfam_ID=zf-C2H2; Match level="Score=25.2, E-value =0.00019, Copies=2"; Pfam description=Zinc finger, C2H2 type
MDSIYRSTTSRSLQSTSTSSEFVSGACHLCSKIFKNVKLRNRHIKRIHKIDVSIKKIDHIVCPLCEQETSLQTHENLRKHIKENHQVSIELITLEFSSKQEYETWKDMQKIETSYATSRTGNAKEHKILYYECNRSDTYGYKPHSKIRTEKSGGSIRIKGVCPSRLICKLTNQGQVSVSYWKTHAGHKEELRAIHLSKAEEKTIVEKLTAGVPPSRILKDSRKLEIPQLDRLALSTSKDLVNLSTKYNIHKKRDQNDMVAVALKVQEWNTNNKNYAFLFKKEGEEHDVLRTEDFAIGFMNKIMEDKLREFPNIICVDGTHGTNKRRMDLTIMLIKDDRNQGFPVAFLLSNRLDQQVQEVFLGALKNRMKTEIRADHFMSDDDPKYYNAWVNTMGNQPNKLLCTWHVIKNWNFQGKSKIKDTTIKKEMKNDLRQIITETDEEKFMELRDIYLTKLKNANETEFCNYLEKKYFKSMKRTKTWAHCYRRNSGINTNMSLESLNNLLKTNYLNRTATGGIEKLLDTMDELVEVKMWKRIVDIKRPNANNYQDRTIIQAHRGAERIKRKMEVTKNMEVYGQYQVRSLTDPNILQNVTLRQVCESECKMLFCRVCKICIHRYQCDCRVYAVRNTLCQHVHLVRMYEESVGTNSVLDDAARCLGETSIIKSRHEEEINEFIRGTLEQTNLTPGKNPKRNLPQEYVNNMMNN

SEQ ID NO: 24021 - protein, 76 aa, Diabrotica virgifera
  misc_feature: Coding regions on vcDNA: vcDNA=SeqID_3718; Strand=+; Position=115-345
  misc_feature: Pfam annotation: Pfam_ID=THAP; Match level="Score=36.7, E-value=6.7e -08, Copies=1"; Pfam description=THAP domain
MAARKSGISCVVRGCQTRSGEQISLFSIPRDRSRAELWLKAAIREDLLSKDVNELHKNYRMCEKHFQPHFISKGET

SEQ ID NO: 24022 - protein, 742 aa, Diabrotica virgifera
  misc_feature: Coding regions on vcDNA: vcDNA=SeqID_3719; Strand=+; Position=208-2436
  misc_feature: Homolog annotation: Hit_ID=NP_502868.1; Match level="QueryCoverage =60%, HitCoverage=49%, E-value=6e-29, Identity=24%"; Hit description =predicted CDS, C2H2 type zinc finger containing protein family member (4Q281) [Caenorhabditis
  misc_feature: Pfam annotation: Pfam_ID=zf-C2H2; Match level="Score=23.2, E-value =0.00082, Copies=2"; Pfam description=Zinc finger, C2H2 type
MDSTYPSTSTSSLPGACHLCSKIFKNVELRNRHIKRIHKTDVPPRANNKMNQNHIICPLCDQETNFESHEKLRKHLQDCHQLSIELITFEFSSKQEYDTWKDMQKIETSYACSRTIRGKEHKIMYYDCNRSDIHGYKPNYKIRTEKSGGSIRIKGVCPSRLACKLRDQGQVSVSYWKTHVGHKEELRTMHLSKAEEKTVVEKLMAGVPPTRILKDSRKLEVPQLDRLAVITSQDLRNLTRKYNIHKKRDQNDMIAAALKVQEWNANNKNYAFLFKKEGEDHDILRKEDFAVGFMNAVMEEKLLEFPNIICVDGTHGTNKKGLDLTILLVKDDRNAGFPVAFLLSNRLDQRIQEVFLDALKNKIQTEVNAEYFMSDDDPKYYNAWKKIMRQEPRRLLCTWHVVKNWNIRGKKKLQDPTLKAQMKNELRQIIREPDEDKFKELCDKYVSKLEEANEIEFVDYLKKQYLAEHRKKLWPYCYRRNAGINTNMAIESLNNLLKTNYLKRNAALGIEKLLDTMDELVEEKMWTRIVDIIRPSANNYQDRLSIRAHKRAASMKGKLEELVKETAYGHYEVKSFKGMNILRYVNFRQVCESECKTLFCRVCKICIHRYWCSCDDYMVRNTLCQHVHLVRMYEERLGSNSVVDDAARCLGEMSTIKSRHEEEINEFVRGKLEQTNVTQEKTKRSLQQEYLNNVLNGLDDQGFTEFIRRTQGILEEVNNKAKNITKKRKMETQEYFPSKKKN

SEQ ID NO: 24023 - protein, 280 aa, Diabrotica virgifera
  misc_feature: Coding regions on vcDNA: vcDNA=SeqID_3720; Strand=+; Position=100-943
  misc_feature: Homolog annotation: Hit_ID=XP_393051.1; Match level="QueryCoverage =100%, HitCoverage=61%, E-value=1e-138, Identity=88%"; Hit description=similar to pontin [Apis mellifera]
  misc_feature: Gene Ontology Annotation: Molecular function=ATPase activity; Cellular component=chromatin remodeling complex; Biological process =regulation of transcription from Pol II promoter
  misc_feature: Pfam annotation: Pfam_ID=TIP49; Match level="Score=149.8, E-value =6.1e-42, Copies=1"; Pfam description=TIP49 C-terminus
  misc_feature (264)..(264): Xaa can be any naturally occurring amino acid
MKVEEVKSTVKTQRISAHSHIKGLGLDEAGFAIPSAAGLVGQEQAREAAGIVVDMIKSKKMAGRAVLLAGPPGTGKTAIALAIAQELGNKVPFCPMVGSEVYSSEIKKTEVLMENFRRAIGLRIRETKEVYEGEVSELTPVETENPAGGYGKTVSHVIIGLRTAKGSKQLKLDPGIYEALQKEKVEVGDVIYIEATSGAVKRQGRSDAYATEFDLEAEEYVPLPKGDVHKKKEVIQDVTLHDLDAANAKPQGGQDVLSMMGQLXKPRNRITDKLRKEINK

SEQ ID NO: 24024 - protein, 478 aa, Diabrotica virgifera
  misc_feature: Coding regions on vcDNA: vcDNA=SeqID_3721; Strand=+; Position=3-1437
  misc_feature: Homolog annotation: Hit_ID=NP_995772.1; Match level="QueryCoverage =99%, HitCoverage=95%, E-value=1e-140, Identity=52%"; Hit description= CG11140-PE, isoform E [Drosophila melanogaster] gb|AAM68898.2| CG11140-PE, isoform E [Drosophila
  misc_feature: Gene Ontology Annotation: Molecular function=aldehyde dehydrogenase activity; Cellular component=cytoplasm; Biological process=epidermal differentiation
  misc_feature: Pfam annotation: Pfam_ID=Aldedh; Match level="Score=2.5, E-value=2.8e- 17, Copies=1"; Pfam description=Aldehyde dehydrogenase family
  misc_feature (42)..(42): Xaa can be any naturally occurring amino acid
  misc_feature (52)..(52): Xaa can be any naturally occurring amino acid
  misc_feature (221)..(221): Xaa can be any naturally occurring amino acid
  misc_feature (253)..(253): Xaa can be any naturally occurring amino acid
  misc_feature (349)..(349): Xaa can be any naturally occurring amino acid
KTLSISFRKKQLKGLLDFLTNEEEIICKALYDDLRKPRQESXLIGEIEIVKXEIKTTLKNLDSWAKPHKVKASVVNFFDDLLIASDPYGVVLVIGAWNYPIFVLFQPVVGAIAAGNCVVIKPSEVAQATSNLIAKYLPKYIDTNCYPVYTGGPKETSELLEQRFDYIFYTGSTEVGKIVHKAASKYLTPTTLELGGKNPVYVDKSANLKATAKRILWGKFXTCGQICISPDYILCTPEVQVKLLGFMEDVIKXFFGSVKTTDYARIINSRHFNRLVGLLKNQNIAIGGHLDADERYISTNIIVDVHPEDPVMQEEIFGPILPFINIKDEEEAINFINSREKPLALYVFXHKVKVKKTFMERTSSGAMVVNDSVMHIITEGLPFGGVGYSGMGSYKGKKTFDTFSHQKSVLSKSFNVIADKIESVRYPPNINFTTSFLKGVLKYITTIPTQLLASVFSFALGVAVTVSGYYINKSIREE

SEQ ID NO: 24025 - protein, 346 aa, Diabrotica virgifera
  misc_feature: Coding regions on vcDNA: vcDNA=SeqID_3722; Strand=+; Position=6-1047
  misc_feature: Homolog annotation: Hit_ID=NP_995772.1; Match level="QueryCoverage =88%, HitCoverage=61%, E-value=3e-92, Identity=55%"; Hit description =CG11140-PE, isoform E [Drosophila melanogaster] gb|AAM68898.2| CG11140-PE, isoform E [Drosophila
  misc_feature: Gene Ontology Annotation: Molecular function=aldehyde dehydrogenase activity; Cellular component=cytoplasm; Biological process =acetaldehyde metabolism
  misc_feature: Pfam annotation: Pfam_ID=Aldedh; Match level="Score=-171.9, E-value =3.8e-09, Copies=1"; Pfam description=Aldehyde dehydrogenase family
  misc_feature (322)..(322): Xaa can be any naturally occurring amino acid
MDSKLPRVKLNQSSVIYVDKVNSNSSAAQLVYHTRDVFKSGKTLSISFRKKQLKGLLDFLTNEEEIICKALYDDLRKPRQECLIGEIEIVKAEIKTTLKNLDSWAKPHKVKASVVNFFDDLLIASDPYGVVLVIGAWNYPIFVLFQPVVGAIAAGNCVVIKPSEVAQATSNLIAKYLPKYIDTNCYPVYTGGPKETSELLEQRFDYIFYTGSTEVGKIVHKAASKYLTPTTLELGGKNPVYVDKSANLKATAKRILWGKFQNCGQICISPDYILCTPEVQVKLLGFMEDVIKEFFKWSAVKTSNDYARIIKSRYFDRLKGLXKPRTLAIGGSFPRPTRAIYFPTNS

SEQ ID NO: 24026 - protein, 54 aa, Diabrotica virgifera
  misc_feature: Coding regions on vcDNA: vcDNA=SeqID_3723; Strand=-; Position=70-234
YVFFCVLCTTANNDMYHQWYIYHRLKTAGYYTVYQHLIVRDPNIGRPASHLLCG

SEQ ID NO: 24027 - protein, 277 aa, Diabrotica virgifera
  misc_feature: Coding regions on vcDNA: vcDNA=SeqID_3724; Strand=+; Position=111-945
  misc_feature: Homolog annotation: Hit_ID=AAH46035.1; Match level="QueryCoverage =98%, HitCoverage=95%, E-value=1e-93, Identity=59%"; Hit description =Unknown (protein for IMAGE:5602050) [Danio rerio]
  misc_feature: Gene Ontology Annotation: Molecular function=5'-methylthioadenosine phosphorylase activity; Cellular component=cellular_component unknown; Biological process=phosphorylation
  misc_feature: Pfam annotation: Pfam_ID=Mtap_PNP; Match level="Score=355.5, E-value =7.3e-104, Copies=1"; Pfam description=Phosphorylase family 2
  misc_feature (213)..(213): Xaa can be any naturally occurring amino acid
MALSIKVGIIGGTGFDDPDILKNRKEKAVSTPFGNPSDSLILGEIDGVPCVLLARHGRKHDIMPSDVNYRANIWALKEEGCTHIIATTAVGSLQEHYKPGSLALTDSFIDRTTNRKQTFYDGEPGHPVGVSHIPMEPAYCPKTRELILEVAEKLGISIIKTGTMVIIEGPRFSTKAESKMYRSLGGDIIGMTQVPESVLAKEAAICYANVSTXRPYDCWRDSGVKVCVPEVMKTFRENISKVIKLVLSVVPKIGETDWHKTITELKEVQQSSVMLPH

SEQ ID NO: 24028 - protein, 315 aa, Diabrotica virgifera
  misc_feature: Coding regions on vcDNA: vcDNA=SeqID_3725; Strand=+; Position=2-947
  misc_feature: Homolog annotation: Hit_ID=XP_392715.1; Match level="QueryCoverage =99%, HitCoverage=47%, E-value=2e-98, Identity=54%"; Hit description =similar to ENSANGP00000013083 [Apis mellifera]
  misc_feature: Gene Ontology Annotation: Molecular function=enzyme activator activity; Cellular component=nucleus; Biological process=protein sumoylation
  misc_feature: Pfam annotation: Pfam_ID=UBACT; Match level="Score=122.4, E-value =1.1e-33, Copies=1"; Pfam description=Repeat in ubiquitin-activating (UBA) p
  misc_feature (303)..(303): Xaa can be any naturally occurring amino acid
TQCYECLPKPPQKTFPGCTIRNTPSEPVHCIVWAKHLFNQLFGEFDPDQDVSPDTEDPEAKVEGEGHTYTESGNIQRTSTRSWAESNDYDPEQLFNKFFQTDIEYLLKMENLWKTRKPPVPLSWQQALSLGGTAESDAESGTAANMQVWSISKCAKVFESTVSILKKDLSGKSFLVWDKDDQPGMDFVTACANVRAHIFSIPTKSRFEIKSIAGNIIPAIATANAIIAGLVVLHAFRVLLKNYEKCPAIYLRQKSIHSKFVLAADKQIAQANPNCYVRSHSPSVNVFVNTTVMTVKEFETEVXKKFNMVAPDVCW

SEQ ID NO: 24029 - protein, 319 aa, Diabrotica virgifera
  misc_feature: Coding regions on vcDNA: vcDNA=SeqID_3726; Strand=+; Position=148-1103
  misc_feature: Homolog annotation: Hit_ID=XP_486434.1; Match level="QueryCoverage =97%, HitCoverage=86%, E-value=2e-39, Identity=28%"; Hit description =similar to hypothetical protein FLJ14345 [Mus musculus]
  misc_feature: Gene Ontology Annotation: Molecular function=zinc ion binding; Cellular component=nucleus; Biological process=regulation of transcription, DNA-dependent
  misc_feature: Pfam annotation: Pfam_ID=zf-C2H2; Match level="Score=131.2, E-value =2.5e-36, Copies=7"; Pfam description=Zinc finger, C2H2 type
  misc_feature (295)..(295): Xaa can be any naturally occurring amino acid
  misc_feature (306)..(306): Xaa can be any naturally occurring amino acid
MDEEILDTWECIVCFESFACKIQLAAHLRTHVGLKSFVCVICSKLFMKNSQLEEHLKSHEREEKIKKEVIDDSDYVEDIKGELQFEDDEEEIEHIKFELVEDDDQFGETSDIEEYSSQCVVCCKDFSSLNELSLHLKKHIGLKPFDCTSCLKSFCSKLDLIEHVKYCEDKIKQVNYPTIDEGFLGFKEEEKYDVEKEKEKLAEIIRKQETSKGVKRRPAGTRIKCPNCPLTFDNICHFRIHYRKYTGEKPYKCPICYRAFAKNSNLTSHLTIHTGEKRFQCPYCPKKADHKSALXVHIRVHTGERXYKCHICHESFVHK

SEQ ID NO: 24030 - protein, 295 aa, Diabrotica virgifera
  misc_feature: Coding regions on vcDNA: vcDNA=SeqID_3727; Strand=+; Position=42-929
  misc_feature: Homolog annotation: Hit_ID=XP_321935.1; Match level="QueryCoverage =98%, HitCoverage=88%, E-value=3e-84, Identity=50%"; Hit description =ENSANGP00000013956 [Anopheles gambiae]
  misc_feature: Pfam annotation: Pfam_ID=RRM_1; Match level="Score=72.6, E-value=1.1e- 18, Copies=1"; Pfam description=RNA recognition motif. (a.k.a. RRM, RB
  misc_feature (205)..(205): Xaa can be any naturally occurring amino acid
KLIIVFRNLLQASYSFYTWPSAPVLAWFIWENREEFCGKKVVELGAGTALPGIVAAKCGADVILTESATLPKSLSHTRRSCQVNNLVVNQHIKVIGLTWGLFLGNLDLLGPLDYIIGSDCFFEPATFEDILVTVAYLLDININAKFFCTYQERSSDWSIEHLLSKWDLECIVHNINNLGNSIGLNIHDLIGDHSIHLLEISRKSXVMATNGVRQLYRLYVSNIPWTVGSKELRTYFSKFGHLQQATVVFDRKTGLSKNYGFITFSNREGLESATKNNLHKLEGNTIRVQPSNPEN

SEQ ID NO: 24031 - protein, 322 aa, Diabrotica virgifera
  misc_feature: Coding regions on vcDNA: vcDNA=SeqID_3728; Strand=+; Position=77-1042
MKFLIYVLATVFVASVSSFGGNDEKFLKKYAMMKIYESCFGEEVVRQIRQELKKACAKCSSLEAPPSSPLPVPSVPEERPLHPHPLQETAGQHPLQPSFEAEKLHQAILAFRPNPTPQQFKPFYPGYGNSPATFYGSPYGNPQISPVQMPFFYPGYPQVPFSPYQLPASVGQQLYGNRLSRNMDVRNQLEILTARMSGRVRNITCVMQELGYLDENLEPNYVRINERISNLPISEELKKDMQEGVGFCQQFSQCVPEVKKDKSPLSRELIRPMFFFQCYKHKKLEACIMKDVREKFSGVSDEEFDSDLDLRRRKDMKFPKLT

SEQ ID NO: 24032 - protein, 379 aa, Diabrotica virgifera
  misc_feature: Coding regions on vcDNA: vcDNA=SeqID_3729; Strand=+; Position=904-2043
  misc_feature: Homolog annotation: Hit_ID=EAL24912.1; Match level="QueryCoverage =98%, HitCoverage=95%, E-value=1e-139, Identity=65%"; Hit description= GA20974-PA [Drosophila pseudoobscura]
  misc_feature: Gene Ontology Annotation: Cellular component=signalosome complex; Biological process=S phase of mitotic cell cycle
  misc_feature: Pfam annotation: Pfam_ID=PCI; Match level="Score=83.7, E-value=5e-22, Copies=1"; Pfam description=PCI domain
KSINGNADQAQELRVYLKSLGAEISEEKSPKGIEDDLHKIIGVCDSCFKEGQENDVEMVLNDIVSIMVLIPLERSENIILAFCEKLTKAQGQKLGLVCLRALWLLFQSLDDRSPMRYPVYYHLIQIAKQTESVKLVFQDINHLKQQFANCLPSNEQLQKLYRLLHEVLVKSNQSEQAALVMIELLGTYTDKNASHAREDAIRCIVSALADPNTFLLDPLLSLKPVRFLEGDLIHDLLNIFVSENLSTSLKFYNEHKEFVSAQGLNHEQNMQKMRLLSFMQLAESNPEISFDVIEKELQMKPDEVESFIIEVLKTKLVRARMDQSSRKVFVSSTMHRTFGLKVMKTSLSLLHSWRGNISSVQDGMKTIAAAQLELMNQQQ

SEQ ID NO: 24033 - protein, 302 aa, Diabrotica virgifera
  misc_feature: Coding regions on vcDNA: vcDNA=SeqID_3730; Strand=+; Position=93-1001
  misc_feature: Homolog annotation: Hit_ID=EAL24912.1; Match level="QueryCoverage =98%, HitCoverage=76%, E-value=1e-117, Identity=68%"; Hit description= GA20974-PA [Drosophila pseudoobscura]
MQVPPVFIDMSLEDQAQELRVYLKSLGAEISEEKSPKGIEDDLHKIIGVCDSCFKEGQENDVEMVLNDIVSIMVLIPLERSENIILAFCEKLTKAQGQKLGLVCLRALWLLFQSLDDRSPMRYPVYYHLIQIAKQTESVKLVFQDINHLKQQFANCLPSNEQLQKLYRLLHEVLVKSNQSEQAALVMIELLGTYTDKNASHAREDAIRCIVSALADPNTFLLDPLLSLKPVRFLEGDLIHDLLNIFVSENLSTYLKFYNEHKEFVSAQGLNHEQNMQKMRLLSFMQLAESNPEISFDVIEKE

SEQ ID NO: 24034 - protein, 97 aa, Diabrotica virgifera
  misc_feature: Coding regions on vcDNA: vcDNA=SeqID_3731; Strand=+; Position=240-533
VVLIKSNGLHFLNLQSVQKASFQTATVQGQLKLLVRQKNVIIDRVIHLKRNAIKNGFYVPVVFAFLSNKNTDTYFNSFRIIEEKCRSLNLKLIQKIS

SEQ ID NO: 24035 - protein, 96 aa, Diabrotica virgifera
  misc_feature: Coding regions on vcDNA: vcDNA=SeqID_3732; Strand=+; Position=170-460
  misc_feature: Homolog annotation: Hit_ID=EAA12088.3; Match level="QueryCoverage =92%, HitCoverage=100%, E-value=6e-38, Identity=82%"; Hit description= ENSANGP00000010395 [Anopheles gambiae str. PEST] ref|XP_555844.1| ENSANGP00000010395 [Anopheles gambiae s
  misc_feature: Gene Ontology Annotation: Molecular function=protein tagging activity; Cellular component=kinetochore; Biological process=cell organization and biogenesis
  misc_feature: Pfam annotation: Pfam_ID=ubiquitin; Match level="Score=49.7, E-value =8.1e-12, Copies=1"; Pfam description=Ubiquitin family
MGDEKKASDSEHINLKVLGQDNAVVQFKIKKHTPLKKLMTAYCERAGISTQVVRFRFDGNPINDTDTPNSLEMDEGDTIEVYQQQTGGFFYRFLFI

SEQ ID NO: 24036 - protein, 101 aa, Diabrotica virgifera
  misc_feature: Coding regions on vcDNA: vcDNA=SeqID_3733; Strand=+; Position=41-346
ELDGVKQNNNGQNVKKFFPNILCACANLKPPRTLDFVMRRISPFGYVRVVQREQSCYNYSIQRFRLRTERCLDRPMYVLWRIEARRCQVVLIRLNRISAIE

SEQ ID NO: 24037 - protein, 87 aa, Diabrotica virgifera
  misc_feature: Coding regions on vcDNA: vcDNA=SeqID_3734; Strand=-; Position=101-364
TITIQSFLSDKVLRIVYWIILFRIIYFRLYILCSFIFLQCMTICLSTPASFILTSWATCLWISVAIFEVYPSILFGLILYPVYILFK

SEQ ID NO: 24038 - protein, 87 aa, Diabrotica virgifera
  misc_feature: Coding regions on vcDNA: vcDNA=SeqID_3735; Strand=-; Position=651-914
TITIQSFFSDKVLRIVYWIILFRIIYFRLYILCSFIFLQCMTICLSTPASFILTSWATCLWISVAIFEVYPSILFGLILYPVYILFK

SEQ ID NO: 24039 - protein, 197 aa, Diabrotica virgifera
  misc_feature: Coding regions on vcDNA: vcDNA=SeqID_3736; Strand=+; Position=45-638
MKNFLVLAAVFAVAYANQDDYLRWVSYDGTIPDNAVPAGEDANNNTIYIGRVYLNTNTNQSSWNYTTDAKGYVPGNLREGVVSLDTVLFQKVHTATEGIEILTVVNGARIEWKFVKNYQFPQLFDTEAYHVARVGWEYEGMEFNSTTYLGTVNFNDQPNIGKIFNAAVLWAENHVLYFPSQGTVLSGYSYYALVYYY

SEQ ID NO: 24040 - protein, 302 aa, Diabrotica virgifera
  misc_feature: Coding regions on vcDNA: vcDNA=SeqID_3737; Strand=+; Position=2-910
KPGESRNSRFFKSSFRNFYKKLNESTEDSVKFFLEFYESCNKFENSVHRLNRTKALSGTGGADVTETVIKSILAESMPFFDLGLNIVEDEFVFEISLPGVNYLKTKVKGWSVVEQSKDFCIAAEAGTISQDVIELKKRSENINSCIKEITNGYINEFLIEMQELTSSLSSGKDNLEAIVKSGQSSNDLIAILDSIQESWKVYRSDKDPSVKQKMMTLTELSTKYALGFDWIAVLSKVTTGAIAGDTKVYFSEYLDQPFTTLASKTAGLKDMLDLWYSVQMYKKRCYGETDRQSRTLLHATYF

SEQ ID NO: 24041 - protein, 291 aa, Diabrotica virgifera
  misc_feature: Coding regions on vcDNA: vcDNA=SeqID_3738; Strand=+; Position=11-886
MAGSGSYTVNRRKDASFKNFICALVAFLAMLILISILLWALRNRGSGSESLLSTTPVPTNDTGEHSAHLNGFITGEKSKNVSTTTHRNTHKPEEKDPNNQESAKTPAFVPGNTCEEGVCKRAASVMLAMMNHEDNPKVCDDTQNMDYFSVICDKPGESRNSRFFKSSFRNFYKKLNESTEDSVKFFLEFYESCNKFENSVHRLNRTKALSGTGGADVTETVIKSILAESMPFFDLGLNIVEDEFVFEISLPGVNYLKTKVKGWSVVEQSKDFCIAAEAGTISQDVIELNKS

SEQ ID NO: 24042 - protein, 308 aa, Diabrotica virgifera
  misc_feature: Coding regions on vcDNA: vcDNA=SeqID_3739; Strand=+; Position=103-1029
  misc_feature: Homolog annotation: Hit_ID=XP_312380.1; Match level="QueryCoverage =99%, HitCoverage=92%, E-value=1e-107, Identity=60%"; Hit description= ENSANGP00000012173 [Anopheles gambiae]
  misc_feature: Gene Ontology Annotation: Molecular function=tocopherol binding; Cellular component=cytosol; Biological process=transport
  misc_feature: Pfam annotation: Pfam_ID=CRAL_TRIO; Match level="Score=25.6, E-value =4.6e-07, Copies=1"; Pfam description=CRAL/TRIO domain
SKMTLVQPSPELQIHIRHELNEDVNTRESDLEHIKEWLRKQPHLPDTWDENRLMTFLRGCKFSLEKCKSKLDMYFTMRTACPELFSNRDITNPELKLIRELGHIPPLPGLTANGRRVVVLRSKKVDVDTYDIADIMKVVLMIGDVRLAAEEVGVAGDVYILDATVATAAHFSRINPAMIRKFLVIVQEAYPVKLKEVHVVNVSPLVDKIITWVKPFLKEKIRERIHVHSNFESLHKFIPKDVLPEEFDGTAGPLQVFHDQWMEKLKEYTPWFKEQENIKADESKRPGKPTNYDDLFGVDGSFKQLTID

SEQ ID NO: 24043 - protein, 219 aa, Diabrotica virgifera
  misc_feature: Coding regions on vcDNA: vcDNA=SeqID_3740; Strand=+; Position=155-814
  misc_feature: Homolog annotation: Hit_ID=XP_425222.1; Match level="QueryCoverage =75%, HitCoverage=45%, E-value=7e-16, Identity=32%"; Hit description =PREDICTED: similar to insulin-like growth factor binding protein, acid labile subunit;
  misc_feature: Gene Ontology Annotation: Molecular function=insulin-like growth factor binding; Cellular component=soluble fraction; Biological process=signal transduction
  misc_feature: Pfam annotation: Pfam_ID=LRR_1; Match level="Score=34.9, E-value=2.4e- 07, Copies=4"; Pfam description=Leucine Rich Repeat
  misc_feature (207)..(207): Xaa can be any naturally occurring amino acid
MRATVIWTFIILVQSTSSLAPWPPAQMSCFYGPRGSLTARCVNATAYYFKLTNYRFDYLDETLQCINCSLKSLEQGTFDIPGNEIKTLDIRNSSIVKIWPKAFIGMIYMEQLLLAHNPIEVVYPEAFLGVRKVKYLDMEDTVHNLEPKVFQDLYLLESLILKNNKLQDIKPGTFDGLRNLRTLDLSDNELKHVNNSFDPLVNLKVLXLRNNFIKTVYAR

SEQ ID NO: 24044 - protein, 222 aa, Diabrotica virgifera
  misc_feature: Coding regions on vcDNA: vcDNA=SeqID_3741; Strand=+; Position=158-823
  misc_feature: Homolog annotation: Hit_ID=XP_425222.1; Match level="QueryCoverage =68%, HitCoverage=43%, E-value=8e-15, Identity=30%"; Hit description =PREDICTED: similar to insulin-like growth factor binding protein, acid labile subunit;
  misc_feature: Gene Ontology Annotation: Molecular function=insulin-like growth factor binding; Cellular component=soluble fraction; Biological process=signal transduction
  misc_feature: Pfam annotation: Pfam_ID=LRR_1; Match level="Score=45.4, E-value=1.7e- 10, Copies=4"; Pfam description=Leucine Rich Repeat
MRATMRKEIWMLLILMLVERTVQTSVGPGDLSKCSYGERGSLTSTCVNAYPAYFRSTPYRFDQLDETVKCEHCTLTVIDSGTFDISGNQIKNLWLNNSKIEKINPKGFVGLIFLERLIISYNSVRSIYPGTFTGVKKIKTIDLSHNQLDILSDDGFLELVNLEELNMEANNIKTIARKAFNGLTNILILIILKNQISGMKGAVLNMTELLSMNLEGTHIQTL

SEQ ID NO: 24045 - protein, 172 aa, Diabrotica virgifera
  misc_feature: Coding regions on vcDNA: vcDNA=SeqID_3742; Strand=+; Position=79-594
  misc_feature: Homolog annotation: Hit_ID=NP_572448.1; Match level="QueryCoverage =97%, HitCoverage=34%, E-value=8e-41, Identity=50%"; Hit description =CG2263-PA [Drosophila melanogaster] gb|AAF46332.1| CG2263-PA [Drosophila melanogaster]
  misc_feature: Gene Ontology Annotation: Molecular function=phenylalanine-tRNA ligase activity; Cellular component=soluble fraction; Biological process=phenylalanyl-tRNA aminoacylation
MAQLIENILKYISDNGDINTLKLASAFNEDHQKVIGALKSIQAHGDLVVAEPVSNKKLELTEEGKTIAEKGSYEAMIYNSLGENGLPQAEVMKLPNAKIGFSKAMSAGWVEVDKSVTPPMVKRKVPQIKDVVHEHLKQILAEDISSISDKEKQEYKKRKLISEVGVKSFDLK

SEQ ID NO: 24046 - protein, 214 aa, Diabrotica virgifera
  misc_feature: Coding regions on vcDNA: vcDNA=SeqID_3743; Strand=+; Position=211-857
  misc_feature: Homolog annotation: Hit_ID=XP_313929.1; Match level="QueryCoverage =86%, HitCoverage=69%, E-value=3e-55, Identity=52%"; Hit description =ENSANGP00000021775 [Anopheles gambiae]
  misc_feature: Gene Ontology Annotation: Biological process=cell cycle
  misc_feature (143)..(143): Xaa can be any naturally occurring amino acid
  misc_feature (157)..(157): Xaa can be any naturally occurring amino acid
SRRKTTSHPPFKHKLIASSALYLAGKVKDDPLKIRDIINVAHNTLHRGSSLLEIGDEYWSMRDAIVQAELLIMRILKFEVSTTHPHKFMLHYLRSMEGWLGKEQLESVPVARAAATFLQDYHHDPSILDYDPRHVAIACISLXFQCYGIQLPLIEDXDDEAWHNIFVKDLPQEKNWEIMEKKLEEVYQQTNRIIYILRNCGPTQSNFSNGSNLG

SEQ ID NO: 24047 - protein, 69 aa, Diabrotica virgifera
  misc_feature: Coding regions on vcDNA: vcDNA=SeqID_3744; Strand=+; Position=278-487
FVWLCQPHNIEFKFYRLHSLFSILLDCVYSSHLKFVPKASIFLKIYNTLHYPIPFLIIKKIPFIDIFFR

SEQ ID NO: 24048 - protein, 127 aa, Diabrotica virgifera
  misc_feature: Coding regions on vcDNA: vcDNA=SeqID_3745; Strand=+; Position=466-846
  misc_feature: Homolog annotation: Hit_ID=CAG09495.1; Match level="QueryCoverage =71%, HitCoverage=19%, E-value=2e-12, Identity=34%"; Hit description =unnamed protein product [Tetraodon nigroviridis]
MKKPGDFQEIASAEEKIKLNGHAEFAIAYKKNAMETDKFYLAHIVFLVFGIMHLLPVSFFVTANDYWMYKFRNTTSDNTDPNYRSILQSNFASGTNVAQSVPTVICMVLAVVFAYKIKVKIKILTSL

SEQ ID NO: 24049 - protein, 254 aa, Diabrotica virgifera
  misc_feature: Coding regions on vcDNA: vcDNA=SeqID_3746; Strand=-; Position=99-863
  misc_feature: Homolog annotation: Hit_ID=AAT38514.1; Match level="QueryCoverage =96%, HitCoverage=49%, E-value=3e-34, Identity=28%"; Hit description =antennae-rich cytochrome P450 [Phyllopertha diversa]
  misc_feature: Gene Ontology Annotation: Molecular function=cytochrome P450 activity; Cellular component=membrane; Biological process=electron transport
MLLTSSPFLDGLIYLSILCIAAYCYATRDFNYWKRRNVQFLKPVPFFGNLYDVMMFKTTTQECIKKIWDGINAPYFGMFIFDEPVLVLKSPKLIKDVLIKDASTFCNRRVATPSHPNMAHGMFFLKYNEWRKVRKMLSPVFTSGMLRYLQPHIIEINQTMLDFVHKNCGIFDVTNIGEDFAIEFLVRCFYEANPRCFNEKPSVFKKCIHTMFAFNFRNGVVQNLFFLKPALADALKLNFVAKNCMKFFEDVFNA

SEQ ID NO: 24050 - protein, 265 aa, Diabrotica virgifera
  misc_feature: Coding regions on vcDNA: vcDNA=SeqID_3747; Strand=-; Position=110-907
  misc_feature: Homolog annotation: Hit_ID=XP_319412.1; Match level="QueryCoverage =73%, HitCoverage=88%, E-value=4e-41, Identity=43%"; Hit description =ENSANGP00000014488 [Anopheles gambiae] ref|XP_307101.1| ENSANGP00000012108 [Anopheles gambiae]
  misc_feature: Gene Ontology Annotation: Molecular function=KDEL sequence binding; Cellular component=integral to membrane; Biological process =intracellular protein transport
  misc_feature: Pfam annotation: Pfam_ID=ER_lumen_recept; Match level="Score=194.4, E- value=2.3e-55, Copies=1"; Pfam description=ER lumen protein retaining receptor
LFILVHSDLFLFSKFEDMNVFRIAGDASHTLAMLYLLWSILKEKSYAGVSAKTQLLYTAVFITRYLDLFSYFISYYNTIMKVFFILVSAITFLLAFKMESTYEKKYDSFWSEVLIAGALIFAVFFSHSLDAIEILWTFSEYLEAVVIIPQIYMIFHSKKITRHMKVYLFLLVLYKTMYICNWIYRYNMENRVDLTSDISGFVDVMIFFLGVVILRCSKITIHEYEQKDVTKWKNIFLISSGFASPRATQKDAPLVTEHVYQPVVV

SEQ ID NO: 24051 - protein, 242 aa, Diabrotica virgifera
  misc_feature: Coding regions on vcDNA: vcDNA=SeqID_3748; Strand=+; Position=95-823
  misc_feature: Homolog annotation: Hit_ID=EAL28092.1; Match level="QueryCoverage =89%, HitCoverage=44%, E-value=6e-19, Identity=28%"; Hit description =GA11424-PA [Drosophila pseudoobscura]
MEKNNKELYEVKYICEEPETTPEFNSNNESKKPETAFLYFTIITAILTWIAGGSAIAWSSSAVLKLTSNDTSINPLGRPISTVEISTLLAIPGVMGIIGSLVFPKLGDIIGRKRSLYLAGWLMIVSFGGAAFSTRMDVLVCFITLLNFFFSAVLGIVPIYLTEVCENHNRAKFGCFMSLCIPLGQLYSYCIGPIFSFALFTFMSSASLIPFLLCFPFVPESPVYVLSKERNVECINIIKKFT

SEQ ID NO: 24052 - protein, 230 aa, Diabrotica virgifera
  misc_feature: Coding regions on vcDNA: vcDNA=SeqID_3749; Strand=+; Position=228-917
  misc_feature: Homolog annotation: Hit_ID=XP_317446.1; Match level="QueryCoverage =100%, HitCoverage=33%, E-value=2e-61, Identity=48%"; Hit description= ENSANGP00000011863 [Anopheles gambiae]
  misc_feature: Gene Ontology Annotation: Molecular function=acyl-CoA oxidase activity; Cellular component=peroxisome; Biological process=fatty acid metabolism
  misc_feature (214)..(214): Xaa can be any naturally occurring amino acid
MDVEDNKLVFRDLPVGPLTPYRRLSKFDWRKLKLFFEDAEMLKVQIQVWKTLEADPLFQRPRVEISTDEKQRIAALQLKKYIDYNFVNPDINKVPYKKRTRIQLACNQAIAVTFPDVSIKLAIGQGLFTNTIVTLGTERHFKYAYAGNKMLSCLALTEISHGSNTKQMRTTATYDPQNQEFVINTPDFEAAKCWVGNLGKQCTHALLFAQLYTXGECHGLHAFIVPIRNP

SEQ ID NO: 24053 - protein, 699 aa, Diabrotica virgifera
  misc_feature: Coding regions on vcDNA: vcDNA=SeqID_3750; Strand=+; Position=183-2282
  misc_feature: Homolog annotation: Hit_ID=XP_317446.1; Match level="QueryCoverage =97%, HitCoverage=98%, E-value=0.0, Identity=52%"; Hit description =ENSANGP00000011863 [Anopheles gambiae]
  misc_feature: Gene Ontology Annotation: Molecular function=acyl-CoA oxidase activity; Cellular component=peroxisome; Biological process=fatty acid metabolism
  misc_feature: Pfam annotation: Pfam_ID=ACOX; Match level="Score=55.8, E-value=1.2e -13, Copies=1"; Pfam description=Acyl-CoA oxidase
MDVEDNKLVFRDLPVGPLTPYRRLSKFDWRKLKLFFEDAEMLKVQIQVWKTLEADPLFQRPRVEISTDEKQRMAALQLKKYIDYNFVNPDINKVPYKKRTRIQLACNQAIAVTFPDVSIKLALGQGLFTNTIVTLGTERHFKYAYAGNKMLSCLALTEISHGSNTKQMRTTATYDPQNQEFVINTPDFEAAKCWVGNLGKQCTHALLFAQLYTKGECHGLHAFIVPIRNPKTMSPYPGITVGDMGEKIGLNGIDNGFIMFNNFRIPRENLLNRTADVTPSGDYESSFTDPGKILGAALENLSMGRVGIMQESSNNLICAITIALRYAAVRKQFAPNGEGNNNMNELPIIEYPLHQWRLFPYMAAAAVLRVFVSGFTETYLTVVEKSATSIELENLSEMVSEMHALVSSAKPLMTWACRDATQECREACGGHGFLKASRLGELRSIIDPCVTYEGDNNVLVQQTSNWLLRQWQAILSGDRLSTPLESCKFFLDHKRIMSTKCIARSISEVQTKEFVMTSYQWLIIYLVNETHKKQEEVLRRGLDRFTARNESQVYRAALLSKAYGEYTALSYFWEKVSKADKTLQAVLHNLGLLYGLSCLDKNLVYFYQGEYTRGPEFSQNIKEAILDLCKHLKPDALTVIDGLAPPDYVVHSVLATSDGKLYQNLQKLLMGNPQSLSRPSWWQENAYEHPNLSHFPSKL

SEQ ID NO: 24054 - protein, 240 aa, Diabrotica virgifera
  misc_feature: Coding regions on vcDNA: vcDNA=SeqID_3751; Strand=+; Position=105-826
  misc_feature: Homolog annotation: Hit_ID=EAL39852.1; Match level="QueryCoverage =95%, HitCoverage=73%, E-value=2e-69, Identity=55%"; Hit description =ENSANGP00000027407 [Anopheles gambiae str. PEST] ref|XP_556168.1| ENSANGP00000027407 [Anopheles gambiae st
  misc_feature: Gene Ontology Annotation: Molecular function=molecular_function unknown; Cellular component=integral to membrane; Biological process= biological_process unknown
  misc_feature: Pfam annotation: Pfam_ID=UPF0005; Match level="Score=99.5, E-value =8.3e-27, Copies=1"; Pfam description=Uncharacterised protein family UPF000
  misc_feature (110)..(110): Xaa can be any naturally occurring amino acid
METKQDSHDIEAQTVKGFEFNDTSIRRGFIRKVYAILSLQVAITTGVISWFIFHEPTKLYVQRHPVLLLIALVLILVTIIALACCGQLRRQYPANLIFLFIFTIAESFLXGTISSYYDIDVVAIAAGATVIICLGLTVFAFQSRIDFSVCSGILVALSLVILSFGITAIFYQNDKFRLLIAAFIVIFFSIYLVVDTQLIIGGAGKISLSPEEYIFAALNLYLDVINIFLYILLIVGRAAR

SEQ ID NO: 24055 - protein, 64 aa, Diabrotica virgifera
  misc_feature: Coding regions on vcDNA: vcDNA=SeqID_3752; Strand=-; Position=76-270
SKYFYIYRSIYISHTLRLCKIFVQTTKTLLKISTKIFLIFQHSLIISILLINSVRSCLKHNPYV

SEQ ID NO: 24056 - protein, 375 aa, Diabrotica virgifera
  misc_feature: Coding regions on vcDNA: vcDNA=SeqID_3753; Strand=+; Position=3-1385
  misc_feature: Homolog annotation: Hit_ID=BAC82199.1; Match level="QueryCoverage =99%, HitCoverage=94%, E-value=1e-107, Identity=44%"; Hit description= acaloleptin A precursor [Acalolepta luxuriosa]
  misc_feature (211)..(211): Xaa can be any naturally occurring amino acid
GRPTRQAKPTWHVRGSFRFKRSPKPDWEVQPGANGDGNGNTNAGVEVRNKGKDHDFQAGWNKVVHGPNRAKPTWHVGGSFRFKRSPKPDWEVQPGANGDGNGNTNAGVEVRNKGKDHDFQAGWNKVVHGPNRAKPTWHVGGSFRFKRSPKPDWEVQPGANGDGNGNTNAGVEVRNKGKDHDFQAGWNKVVHGPNRAKPTWHVGGTFRFKNXAKPTWHVGGTWRFKRSPKPDWEVNPGANRDDDGNTNAGVQVKNHGNDHDFEAGWSKVVSGPDRAKPTWHVGGTWRFKRSPKPDWEVNPGANGDGNGGTWRFKRSPKPDWEVNPGANRDDDGNTNAGVQVKNHGNDHDFEAGWSKVVSGPDRAKPTWHVGGTWRF

SEQ ID NO: 24057 - protein, 158 aa, Diabrotica virgifera
  misc_feature: Coding regions on vcDNA: vcDNA=SeqID_3754; Strand=-; Position=412-888
  misc_feature: Homolog annotation: Hit_ID=ZP_00357698.1; Match level="QueryCoverage =55%, HitCoverage=56%, E-value=1e-09, Identity=52%"; Hit description =hypothetical protein Chlo02002738 [Chloroflexus aurantiacus]
PPPPPPRFYIWRRYRGGGPPLSPFRGAEVVWGGGAVGGGFFLIFPPLGERRGGCSKRDIFLGPPAFFPPLPSFLKSGAREFFFVGPFKRNLVRPPPGLKNCFFLGPPPHIYLLSYFCFFRCIFLFVLFVFFFFFFCFFLFFFFFFFFFFFFFLQMKKI

SEQ ID NO: 24058 - protein, 354 aa, Diabrotica virgifera
  misc_feature: Coding regions on vcDNA: vcDNA=SeqID_3755; Strand=+; Position=152-1216
  misc_feature: Homolog annotation: Hit_ID=CAC51700.1; Match level="QueryCoverage =94%, HitCoverage=100%, E-value=2e-82, Identity=48%"; Hit description= NADH dehydrogenase subunit 2 [Tribolium castaneum] ref|NP _203156.1|ND2_15766 NADH dehydrogenase subunit 2
  misc_feature: Pfam annotation: Pfam_ID=Oxidored_q1; Match level="Score=125.8, E -value=1e-34, Copies=1"; Pfam description=NADH -Ubiquinone/plastoquinone (comple
  misc_feature (44)..(44): Xaa can be any naturally occurring amino acid
  misc_feature (48)..(48): Xaa can be any naturally occurring amino acid
  misc_feature (106)..(106): Xaa can be any naturally occurring amino acid
  misc_feature (130)..(130): Xaa can be any naturally occurring amino acid
  misc_feature (140)..(140): Xaa can be any naturally occurring amino acid
  misc_feature (149)..(149): Xaa can be any naturally occurring amino acid
  misc_feature (202)..(202): Xaa can be any naturally occurring amino acid
  misc_feature (214)..(214): Xaa can be any naturally occurring amino acid
  misc_feature (277)..(277): Xaa can be any naturally occurring amino acid
  misc_feature (332)..(332): Xaa can be any naturally occurring amino acid
LSYWVHTPLIKVLILFFLIYKLYKIFFINFLISGTLITVSAYSXLRMXIGLEINLLRFIPLMKSHNNIFPAEATLKYFITQALASAIVLFSILLTLNSSDFILRNXNLTYNLILNSALITKIGAAPFHAXFPEVVEGLNXINNLILITXQKIAPIIIIIYNYNSLFFRIIIVICSLIRGILGLNQIRLRKLIAYSSINHIAXILASILTYKIIXFIYFIIYSIILISIILLFNYLKIFYIKQLFINLNSNKILKLFFIFNFLSLGGLPPFLGFLPKXLVINNLVENNFYAVRLILIILTLITLFFYLRITFSTITIIINEIYRKSIKINNNXLIFFNAFTLIRLILCTEIFRIL

SEQ ID NO: 24059 - protein, 310 aa, Diabrotica virgifera
  misc_feature: Coding regions on vcDNA: vcDNA=SeqID_3756; Strand=+; Position=2-931
  misc_feature: Homolog annotation: Hit_ID=EAL30161.1; Match level="QueryCoverage =100%, HitCoverage=6%, E-value=1e-151, Identity=85%"; Hit description= GA20400-PA [Drosophila pseudoobscura]
  misc_feature: Gene Ontology Annotation: Molecular function=microtubule motor activity; Cellular component=microtubule associated complex; Biological process=oocyte cell fate determination (sensu Insecta)
  misc_feature: Pfam annotation: Pfam_ID=Dynein_heavy; Match level="Score=-64.3, E -value=3.1e-12, Copies=1"; Pfam description=Dynein heavy chain
KQLSAVGRAMYQLLVIQAFRPDRVIAAAHNFVSVVLGADFMYLAEKELEFAACVEKEIRSNVPALLCSVPGFDASGRVDDLAAELNKQISSIAIGSAEGFNQADRAINMACKTGRWVMLKNVHLAPQWLVQLEKKLHSLQPHANFRLFLTMEINPKLPVNLLRAGRIFVFEPPPGIRANLLRTFSTVPASRMMKAPNERARLYFLLAWFHAIVQERLRYCPLGWAKHYEFSESDLRVACDTLDTWIDTTAMGRTNLPPEKVPWDTLVTLLSQSIYGGKIDNDFDQRLLHSFLNLLFTPISFESDFRFKSN

SEQ ID NO: 24060 - protein, 283 aa, Diabrotica virgifera
  misc_feature: Coding regions on vcDNA: vcDNA=SeqID_3757; Strand=+; Position=142-989
  misc_feature: Homolog annotation: Hit_ID=EAA12902.2; Match level="QueryCoverage =100%, HitCoverage=33%, E-value=1e-151, Identity=89%"; Hit description=ENSANGP00000010081 [Anopheles gambiae str. PEST] ref|XP _555544.1| ENSANGP00000010081 [Anopheles gambiae
  misc_feature: Gene Ontology Annotation: Molecular function=glycogen phosphorylase activity; Biological process=glycogen catabolism
  misc_feature: Pfam annotation: Pfam_ID=Phosphorylase; Match level="Score=-364.0, E -value=9.1e-13, Copies=1"; Pfam description=Carbohydrate phosphorylase
  misc_feature (274)..(274): Xaa can be any naturally occurring amino acid
MATPQSDIERRKQISVRGIAELDDVNEIKKTFNRHLHYTLVKDRNVATTRDYYFALAHTVKSHLVSRWIRTQQYYYEKDPKRVYYLSLEFYMGRSLQNTMINLGIQTPVDEALYQLGLDIEELEDVEEDAGLGNGGLGRLAACFLDSMATLGMAAYGYGIRYEYGIFAQKIVNGEQQEEPDDWLRYGNPWEKARPEYMLPVNFYGNVIDTPEGKKWVNTQVVFALPYDNPIPGYQNNVVNTLRLWSAKSPVDFNLKFFNDGDYISAVLDRNLAXNISRVLYPN

SEQ ID NO: 24061 - protein, 139 aa, Diabrotica virgifera
  misc_feature: Coding regions on vcDNA: vcDNA=SeqID_3758; Strand=+; Position=285-704
NVYLATKVYLGVRFCFYLKKETTSIDCSFRYNYSIMNKLISKPYKFKMRGFPLYCHICYFRKRENQGIKLDDEVEINYILCFYILIIKQICRIYCNANILAQESLITVLPNFFESDCIKKFKTVVLFFVFHRIRRRIVS

SEQ ID NO: 24062 - protein, 659 aa, Diabrotica virgifera
  misc_feature: Coding regions on vcDNA: vcDNA=SeqID_3759; Strand=+; Position=1-1980
  misc_feature: Homolog annotation: Hit_ID=NP_722762.1; Match level="QueryCoverage =96%, HitCoverage=75%, E-value=0.0, Identity=84%"; Hit description =CG7254-PA [Drosophila melanogaster] gb|AAF51303.1| CG7254-PA [Drosophila melanogaster]
  misc_feature: Gene Ontology Annotation: Molecular function=glycogen phosphorylase activity; Biological process=glycogen metabolism
  misc_feature: Pfam annotation: Pfam_ID=Phosphorylase; Match level="Score=1365.2, E -value=0, Copies=1"; Pfam description=Carbohydrate phosphorylase
PTRPVDDIAVEVYWKHVFGTPEGKKWVNTQVVFALPYDNPIPGYQNNVVNTLRLWSAKSPVDFNLKFFNDGDYIQAVLDRNLAENISRVLYPNDNFFEGKELRLKQEYFMCAATLQDIIRRFKSAKFGTREATRTNFDLLPSKVAIQLNDTHPSLAIPELMRILIDIEGLPWEKAWDITVKTCAYTNHTVLPEALERWPVSMLESILPRHLQIIYHINFLHMQAVEKRWPKDMDRMRRMSLIEEDGEKRVNMAHLSIVGSHAVNGVARIHSDIIKADLFKDFYELSPEKFQNKTNGITPRRWLLLCNPGLSDLISDKIGEDWTVHLDQLQKLKKWAKDPNFQRAVMKVKQENKLRLAQLLEKDYGVKINPSSMFDIQVKRIHEYKRQLLNCLHIITLYNRIKKNPSAKFTPRTIMIGGKAAPGYYTAKKIIKLINMVGNVVNNDPIVGDKLKVIYLENYRVTLAEKIMPAADLSEQISTAGTEASGTGNMKFQLNGALTIGTLDGANVEMAEEMGNENIFIFGMTVDEVEALHKKGYNAMDYYNAIPELKQVVDQIQNGFFSPGNPDEFKDIADILLKYDRFLLLADYEAYIKKQDEVSAVYQNQAKWLEMAINNIASSGKFSSDRTIIEYGKDIWGVTPNYEKLPDPSVPRELALKDN

SEQ ID NO: 24063 - protein, 296 aa, Diabrotica virgifera
  misc_feature: Coding regions on vcDNA: vcDNA=SeqID_3760; Strand=+; Position=45-931
  misc_feature: Homolog annotation: Hit_ID=XP_318327.1; Match level="QueryCoverage =100%, HitCoverage=34%, E-value=1e-111, Identity=63%"; Hit description=ENSANGP00000001712 [Anopheles gambiae]
  misc_feature: Gene Ontology Annotation: Molecular function=molecular_function unknown; Cellular component=cellular_component unknown; Biological process=signal transduction
  misc_feature: Pfam annotation: Pfam_ID=Pkinase; Match level="Score=-61.4, E-value =5.4e-05, Copies=1"; Pfam description=Protein kinase domain
  misc_feature (262)..(262): Xaa can be any naturally occurring amino acid
  misc_feature (266)..(266): Xaa can be any naturally occurring amino acid
  misc_feature (286)..(286): Xaa can be any naturally occurring amino acid
MWSFFSRDPSKDFNFEIGELVPSLEDKSVWNLHKGKKKGSSEEVSVFVFDLKSNPESQLEVVKAAVKRLKTLRHPSVLTYLDSLESEKVLYLATEHVDPLKEHLEKLPLEAPQRDLYIAWGIFQITRALSFLNNDGNLRHNNVNIWSVFVNSSGEWKLGGFEYVSSTQETNLPSKVISTLDIYSPPEKNDPTKQRAMTKCSSDMWGLGCLIWEVFNGPLYQHSSLRNPDKIPKQLGPLYFELLNTNPSSRPNPADVITRCRXLGGXFKNDLVDTLLFLEKSKIKTXMKKIDFFSNL

SEQ ID NO: 24064 - protein, 341 aa, Diabrotica virgifera
  misc_feature: Coding regions on vcDNA: vcDNA=SeqID_3761; Strand=+; Position=63-1089
  misc_feature: Homolog annotation: Hit_ID=AAC63079.1; Match level="QueryCoverage =97%, HitCoverage=65%, E-value=6e-47, Identity=28%"; Hit description =putative juvenile hormone esterase [Leptinotarsa decemlineata]
  misc_feature (166)..(166): Xaa can be any naturally occurring amino acid
  misc_feature (285)..(286): Xaa can be any naturally occurring amino acid
  misc_feature (289)..(289): Xaa can be any naturally occurring amino acid
  misc_feature (334)..(334): Xaa can be any naturally occurring amino acid
MSRPNTNCFQVLPNNSRWLSTQDSGIFPKRHTDYYVFNMGRQEVLVEGWWGTKLGWTGVLDGVNLAPGNGYRIVVSDKPYFVTAVKITNKTNVRALMHCSKINGYPLRSQGTDSIRPDISSIAKYFIPFGVGKISEINMGFKSLENFFWPKGGESVWDKIAKQIVXLLNEATQKRIKQILREDILLVQENLSLLQSQINSFQPSVVKAEFFIKMAEQLVFLEKKFSDCGDSDIDLNFHLLPLYSATVNFKVLLYTIACERHREVGLNDEQIGKIIQFSEKLINDXXSFXSVAHITKTFERQFHLEYRTCDQELIYNILATVRTWCGINGEEYVXFWRSLLE

SEQ ID NO: 24065 - protein, 333 aa, Diabrotica virgifera
  misc_feature: Coding regions on vcDNA: vcDNA=SeqID_3762; Strand=+; Position=153-1154
  misc_feature: Homolog annotation: Hit_ID=XP_312568.1; Match level="QueryCoverage =90%, HitCoverage=65%, E-value=4e-48, Identity=35%"; Hit description =ENSANGP00000014917 [Anopheles gambiae]
  misc_feature: Gene Ontology Annotation: Molecular function=acid phosphatase activity; Cellular component=integral to membrane; Biological process=regulation of cell cycle
  misc_feature: Pfam annotation: Pfam_ID=Acid_phosphat_A; Match level="Score=-12.8, E- value=4.2e-07, Copies=1"; Pfam description=Histidine acid phosphatase
MNFLCVLSPTLFLVFFDGRLTSAYNVSNPQVGKLIAVAAVYRHGDRAPVISFPHDKYYDPSYWPMGMGQLTQDGIKKLYNLGQSFRQRYQNFLSDIYSPNEIYVHSSQVDRCLMSAAANLAGLYPPKSFQLWNQNILWQPIPIHTTNIKDDHIITEKRHCRKSRIIMEHLKNQTYPPLYRKYSKVIEYLSLKTGWNPISLSNIKTLNSVINTYKSYNKSFVPEWLSKLETGVLEYFSDIVYGIQSSTPEIARLRIGPFFNYIIQNFDSFLDSQAAPTPKFLAISAHGTMISSTLGAMQRNRTKIIKFGDSVLWELRQRNNGSYYGNVVYKNET

SEQ ID NO: 24066 - protein, 165 aa, Diabrotica virgifera
  misc_feature: Coding regions on vcDNA: vcDNA=SeqID_3763; Strand=+; Position=44-538
  misc_feature: Homolog annotation: Hit_ID=XP_394902.1; Match level="QueryCoverage =92%, HitCoverage=32%, E-value=4e-21, Identity=37%"; Hit description =similar to CG17119-PA [Apis mellifera]
  misc_feature: Gene Ontology Annotation: Molecular function=cystine transporter activity; Cellular component=integral to membrane; Biological process=cystine transport
  misc_feature: Pfam annotation: Pfam_ID=PQ-loop; Match level="Score=16.3, E-value =0.00048, Copies=1"; Pfam description=PQ loop repeat
MEVLSSSKIALTILSVLFLCQHTLSKITVSTHDARIKLHDTFLIEITLPGADINKDDTISLVSQHADIISPNVSEIILKDVTDGEKFPVSINTSRAGHSDLYANASSNQTDVSDVYVRFTVYKNDGLDTFSAIIGWIYFVAWAVSFYPQIYINWKRKSVVGLNFE

SEQ ID NO: 24067 - protein, 209 aa, Diabrotica virgifera
  misc_feature: Coding regions on vcDNA: vcDNA=SeqID_3764; Strand=+; Position=113-742
  misc_feature: Homolog annotation: Hit_ID=XP_310224.1; Match level="QueryCoverage =68%, HitCoverage=42%, E-value=2e-12, Identity=34%"; Hit description =ENSANGP00000023903 [Anopheles gambiae]
MRGTLAVIALLGYLCCTTALPATSKQIDDDIELFSPKETHVEQPVIDTDAGFGFDGFSNHFSGLFDNFESILTKIKQQMDQLMNSFPVFRTGNSTGDFPDFPNFGGDLPQIPQFGDIDLSKGNTTSETKIIDGHKVVINNTQYHKDGENGSAFFQVRVIDVQPTEAEDATASANAMPKDREDVENSIDNEIIKNKEVGTQSAPEKLRAI

SEQ ID NO: 24068 - protein, 307 aa, Diabrotica virgifera
  misc_feature: Coding regions on vcDNA: vcDNA=SeqID_3765; Strand=+; Position=86-1009
  misc_feature: Homolog annotation: Hit_ID=XP_310224.1; Match level="QueryCoverage =46%, HitCoverage=42%, E-value=5e-12, Identity=34%"; Hit description =ENSANGP00000023903 [Anopheles gambiae]
MRGTLAVIALLGYLCCTTALPATSKQIDDDIELFSPKETHVEQPVIDTDAGFGFDGFSNHFSGLFDNFESILTKIKQQMDQLMNSFPVFRTGNSTGDFPDFPNFGGDLPQIPQFGDIDLSKGNTTSETKIIDGHKVVINNTQYHKDGENGSAFFQVRVIDVQPTEAEDATASANAMPKDREDVENSIDNEIIKNKEAVYYQPLDLDELDSGSKFRPTGLSYLVDNSEWDDLNKIESIDDNALNFNGNQPEFDLSRDTYVNELLAKSGAPVNPDAEISKPIRVSTQRVQPDAEIIKPISSILLREFHL

SEQ ID NO: 24069 - protein, 249 aa, Diabrotica virgifera
  misc_feature: Coding regions on vcDNA: vcDNA=SeqID_3766; Strand=-; Position=80-829
IVQTFIRISAALTNISVEFWESFPTAPKIIEIFINYYQSIFAIFNKTSLKIVINFLTSVDDGRYLVSRFISQIAGFPKNLPIPKLPFLPYYSLDDVFNWIIELVELAEKNFWSLPIPDIFLKIATKCIEFIGNVHASFQFLAEFSFEGFLNIKNSILDALPGLLGGDAFYLSNDIGKLISSITSKLFPNLGIPVISIGTTDSYPATTATVPPTSWVPWTKPTPVTYPTRSIWPIFPNFTMPTFPKPWYQ

SEQ ID NO: 24070 - protein, 265 aa, Diabrotica virgifera
  misc_feature: Coding regions on vcDNA: vcDNA=SeqID_3767; Strand=+; Position=144-941
  misc_feature: Homolog annotation: Hit_ID=XP_315007.1; Match level="QueryCoverage =80%, HitCoverage=67%, E-value=3e-45, Identity=47%"; Hit description =ENSANGP00000021318 [Anopheles gambiae]
  misc_feature: Gene Ontology Annotation: Molecular function=lectin; Cellular component=microfibril; Biological process=opsinization
  misc_feature: Pfam annotation: Pfam_ID=Fibrinogen_C; Match level="Score=178.9, E -value=1.1e-50, Copies=1"; Pfam description=Fibrinogen beta and gamma chains, C-te
MFKRNAIELASFTPYFNCNEVCTTLVGLSKRPYCPILKQTETMRTKFLPKSCKEIFNKGITMTGIYEIRPKGKTIQVLCDMETEGGGWTVLQKRFDGSEEFYRDWRDYKFGFGTLQGEFWLGLENFYMITGSQSTELLIELTDKDLVKHVVRYRQFEIGPEIDGYPLKTASGFSGAAGDGLNWILGQKFSTKDLDQDAWKEGDCSDFSLGAWWYNNCYTSNLNGKYRHMAHAEGIDRKGMNWDPLTKSENSFFLSGSRMLVRPNN

SEQ ID NO: 24071 - protein, 378 aa, Diabrotica virgifera
  misc_feature: Coding regions on vcDNA: vcDNA=SeqID_3768; Strand=+; Position=2-1138
  misc_feature: Homolog annotation: Hit_ID=S08405; Match level="QueryCoverage=98%, HitCoverage=31%, E-value=1e-71, Identity=41%"; Hit description =hypothetical protein 2 - silkworm transposon mag
  misc_feature: Pfam annotation: Pfam_ID=rve; Match level="Score=105.2, E-value=1.7e -28, Copies=1"; Pfam description=Integrase core domain
RSIPKMSANRIQRWALFLSSFDYSIEHIKGINNPVADYLSRSPVQVTGTVEEPAEGMTYIHFTESIEYWPINNKVLREETDKDGILRAIKMYIKTERWPKHLSDEIMPFYHKRQELYLDEHIIMWGHRIVVPSSLRPQILDELHAGHFGIVRCKSLARSYVYWPKIDSDIEHRVKSCGPCLKNRDNPPSEFSPWPEVDKVFDRVHIDFLQLKSKLCLILVDAYSKWVEVFPMSRATAAETQEKLREVFARMGLPRLCVSDNGPQLVDKTMEIFFKKNGIKHLTGAPYHPSSNGAAERYVRTFKMKLKTALDDPRNSGIPLSTLISRYLLTYRNTKHPVTEKSPAELVYNRSLRTRNIMMAEKPSKEQQNISIKEEKMF

SEQ ID NO: 24072 - protein, 166 aa, Diabrotica virgifera
  misc_feature: Coding regions on vcDNA: vcDNA=SeqID_3769; Strand=+; Position=132-632
  misc_feature: Homolog annotation: Hit_ID=NP_732083.1; Match level="QueryCoverage =84%, HitCoverage=97%, E-value=2e-13, Identity=28%"; Hit description =CG9734-PD, isoform D [Drosophila melanogaster] ref|NP_732082.1| CG9734-PC, isoform C [Drosophila
  misc_feature: Gene Ontology Annotation: Molecular function=oxygen transporter activity; Cellular component=cytoplasm; Biological process=oxygen transport
  misc_feature: Pfam annotation: Pfam_ID=Globin; Match level="Score=100.4, E-value =4.5e-27, Copies=1"; Pfam description=Globin
MGPIWSAFGATNTGRTDDADSTTGLTSRDRYLLKSSWAGVMKNPTDNGVALLLLMFKKFPETKTVFPFKDIPNEELANNVRFRAHCNSVVYAITSMVDAIDDPSLLVGILEKVGRDHKRRSIPQKYFEGLQETIIELFSTFMKPNEINSWNKALGVIFKVVADNVK

SEQ ID NO: 24073 - protein, 217 aa, Diabrotica virgifera
  misc_feature: Coding regions on vcDNA: vcDNA=SeqID_3770; Strand=+; Position=2-655
NKLVVMQRFLLLTFYGIVHYYFLSYEAWSDNCIKRKFPNHTNEVYEGCLKNKSIDAYHFNQILIFPLMPPAELLRLRCSAKPYFEECVDVGNNDIRECLNSTVLEGLKVWKQIDKEISEQVCQPAVIEFLANQTNGLSECDKKLKEVFNVCSRKIGNPDANSIEIFNIPQTRGYCKKIAAYESCVTDSLPSMCEAVVKNTLSKVISSIRRNICDVPL

SEQ ID NO: 24074 - protein, 402 aa, Diabrotica virgifera
  misc_feature: Coding regions on vcDNA: vcDNA=SeqID_3771; Strand=+; Position=1-1204
  misc_feature: Homolog annotation: Hit_ID=XP_393409.1; Match level="QueryCoverage =100%, HitCoverage=18%, E-value=1e-165, Identity=71%"; Hit description=similar to ENSANGP00000022340 [Apis mellifera]
  misc_feature: Gene Ontology Annotation: Biological process=regulation of transcription, DNA-dependent
  misc_feature: Pfam annotation: Pfam_ID=HEAT; Match level="Score=20.9, E-value =0.004, Copies=2"; Pfam description=HEAT repeat
  misc_feature (80)..(80): Xaa can be any naturally occurring amino acid
  misc_feature (321)..(321): Xaa can be any naturally occurring amino acid
LAKCVAVITVTRHSQAHPIVPQFINEIQTAATDSQQIFALSVVGEIGRKIDLTSISNLKLVIFQSFSAISEEVKSAASYXALGSICIGNLPQYLPFILKESQEQPRRQYLLLHSLKEVITCLSQTPDGIQQLLPFVTPIWQQLYKHCECAEEGTRNVVAECLGKLTLIDPTNVLPKLKRSLNSPSPLTRTTVVTAVKFTISDQPASIDPLLRQCIGEFLNTLQDPDLNVRRVALVAFNTAAHNKPSLIRDLLDTTLPQLYGETIIKRDLIREVEMGPFKHTVDDGLDIRKAAYECMYTLLDSCLDKVDIFEFINHVETGLXDHYDIKMLTYLMVARLSQICPGAVFQMLDKLVEPLRATLTMKVKANSVKQEYEKTDELKKSAMRAVAALLSIPDADKNPHL

SEQ ID NO: 24075 - protein, 431 aa, Diabrotica virgifera
  misc_feature: Coding regions on vcDNA: vcDNA=SeqID_3772; Strand=+; Position=61-1353
  misc_feature: Homolog annotation: Hit_ID=CAG12901.1; Match level="QueryCoverage =96%, HitCoverage=69%, E-value=9e-21, Identity=22%"; Hit description =unnamed protein product [Tetraodon nigroviridis]
  misc_feature: Gene Ontology Annotation: Molecular function=structural molecule activity; Cellular component=actin cytoskeleton; Biological process =intracellular protein transport
  misc_feature: Pfam annotation: Pfam_ID=BTB; Match level="Score=53.5, E-value=6.1e -13, Copies=1"; Pfam description=BTB/POZ domain
CVIDNFDGLLLYNMSCSEEVILEIEGTPVKCKKDVLISNSDYFKAMLEGNFIEKDQETICIKDVDLKAINIILTLLWDPTIYIEDEDVLMVLHAACMLQFCEIRNMCLDKLIQILCVQNCLKIWIITEQLDIKPLFLKAKRLALAEFMMIKETDSINDLNLEQLIRYIGSLHLVTDSELTVFQTLMKWWYDHSKDHTSDDFIKLLSCINYKQLLPDHFREILTYPDLANTEVEDILKCLYNILNNISNGSCSEKYVEVATKLSQSNDRKIDSVPCLLVLNSYDDVPNKKRLVENNQTVVDKSNLHLVYYDRKLDIFRGFINIFKRLEGFRLRGYKEYIFLFGGEYVLGKGEWNYTFWVYDSIKDMWRTKSRMPFPRRHFETCIVGSKVFISGGIGQFRIIQSNVFWYDYKTDEWATYQFPPNVLGDRINAV

SEQ ID NO: 24076 - protein, 533 aa, Diabrotica virgifera
  misc_feature: Coding regions on vcDNA: vcDNA=SeqID_3773; Strand=+; Position=8-1605
  misc_feature: Homolog annotation: Hit_ID=XP_311945.1; Match level="QueryCoverage =99%, HitCoverage=56%, E-value=0.0, Identity=65%"; Hit description =ENSANGP00000011065 [Anopheles gambiae]
  misc_feature: Gene Ontology Annotation: Molecular function=pre-mRNA splicing factor activity; Cellular component=nucleoplasm; Biological process =reproduction
  misc_feature (459)..(459): Xaa can be any naturally occurring amino acid
  misc_feature (465)..(465): Xaa can be any naturally occurring amino acid
  misc_feature (481)..(481): Xaa can be any naturally occurring amino acid
  misc_feature (488)..(488): Xaa can be any naturally occurring amino acid
ETLEEARRLAALQKRRELRAAGIEVTSRRKKKRGVDYNAEVPFEKRPAIGFYDTSNEVLDPMAPDFSKMRQQHLDGELRSEQEERERKKDKQKLKQRKENDIPQAMLQNQEPAKKRSKLVLPEPQISDQEMHQVVKLGKASEAAREIVTESGVETTDTLLNDYTFNPQAAATPRTPAPQTDRILQEAQNMMALTHVDTPLKGGINTPLHNSDFSGVLPQAQTVSTPNTVLATPFRSSRSDGAGTPGSSVGFMTPRSGALVPVGKTPVGMTPSVRDKLSINPEEAMDVGSTPAEHRMYQMSMKDQLKMGLSSLPQPKNDYEIVVPENEDQEEPEQAQSQMIEDQADVDARKQEELKAKAARELALRSQVIQRDLPRPQEVNMTVLRPSHESYSLSDLQRAEELIKREMVTMLHFDNLKNPVPTQSKRSNMSQAHQLAFLEQHPYESFRKEDLGVAKGILXEEMEVXRNGMNHGELPIEVYTXVWGRMLXHSSGPPEQTRYTRANLASKKDRLESAGKRLEQNRSHMAKEAKRAA

SEQ ID NO: 24077 - protein, 447 aa, Diabrotica virgifera
  misc_feature: Coding regions on vcDNA: vcDNA=SeqID_3774; Strand=+; Position=173-1516
  misc_feature: Homolog annotation: Hit_ID=EAA06455.3; Match level="QueryCoverage =96%, HitCoverage=89%, E-value=3e-96, Identity=58%"; Hit description =ENSANGP00000008121 [Anopheles gambiae str. PEST] ref|XP_566260.1| ENSANGP00000008121 [Anopheles gambiae st
  misc_feature: Gene Ontology Annotation: Biological process=positive regulation of cell proliferation
  misc_feature: Pfam annotation: Pfam_ID=LIM; Match level="Score=67.1, E-value=5e-17, Copies=1"; Pfam description=LIM domain
MWKCHKCHKPVYFAERKQSLGYNWHPECLRCEECGKRLNPGQHAEHKGVPYCHVPCYGALFGPQLFGHGTRVESHKSFGAQNNSPKFNNGPVLPRSHLESKIKVYNQFYEGKSGEIRSREVNGRFILEGSLRIHWGIQGVIHLKENDDQRTVVTVRKRNSYRSPSPEYDTDDDIQNISRDSSYNEISSCSDDLTRSDTGIESGSESLDISVTDSASSSPQNVIKSVTLPSKLDVKNMEWDELDELLCVERKVDVSEHIYQTMPVTLPSQVSTESASGSSNSTKTESVSQTIRNDSTDVTIRNDTTYTDSTLKAPLTNGTNSQEKVPLLSPSLSKEDAWMMQSNHLNGSMSGPDCVGRVRDAQSPEFDKSIMASMESTVTEQAEEVALRIPYKGSTAIKRRPGKRLSRNKVKRRCSINGHFYDRETSFFTPPHGRSDERVSHITSQYQ

SEQ ID NO: 24078 - protein, 296 aa, Diabrotica virgifera
  misc_feature: Coding regions on vcDNA: vcDNA=SeqID_3775; Strand=+; Position=17-904
  misc_feature: Homolog annotation: Hit_ID=NP_611395.1; Match level="QueryCoverage =93%, HitCoverage=44%, E-value=2e-60, Identity=43%"; Hit description =CG15117-PA, isoform A [Drosophila melanogaster] gb|AAF57602.2| CG15117-PA, isoform A [Drosophila
  misc_feature: Gene Ontology Annotation: Molecular function=beta-glucuronidase activity; Cellular component=lysosome; Biological process =glycosaminoglycan catabolism
  misc_feature: Pfam annotation: Pfam_ID=Glyco_hydro_2_N; Match level="Score=149.7, E- value=6.7e-42, Copies=1"; Pfam description=Glycosyl hydrolases family 2, sugar b
MNIAWVLFFAIYHCINGGILYPRLSKTRDLLSLDGIWRFSLVINGSVDPSGGLSNLPGDKDLHLMPVPSSFNDIPTTKTSRDHYGPVYYERNFEVPSSWKGKRIWLRFGSVCYSAQVYLNDEEILSHEIGHLPFQAEVTQYIEDDQENNIRVIVDTTLTNSTIPQGSATVLPGTGRVIQSVPFDFFNYGGIDRPVILYTTPLTYIDDVTITTHVKGTTGVVQYTVDLGGTNDKVVTKVTVLDKHKKALISTDSLSGQIEITDAKLWWPFLMNSDPGYLYNLKVDLYDGKQLLDTYT

SEQ ID NO: 24079 - protein, 258 aa, Diabrotica virgifera
  misc_feature: Coding regions on vcDNA: vcDNA=SeqID_3776; Strand=+; Position=1-777
VKCKNYYREKDITIMTCTPHYHQSNGLAEKAVNISKQILRKSNEENVDFRDLVMEYNNTCIINLDASPAQILQSRILRGQLPTTANKLEPTIQKQVYKNLCKEKEKLQVRYDKTARRKPVEFRKGDRVVIRSSKDNYWRKAIVLEKANEPRSYWVKKEDNNKIIRRNSHQMKHSYTTTLEKELILEPELYPDIQSQSVHKDTTHINVNDSVNKTISCPSPNVKSVPTLSHKVNPNIETSNSYKTRVGRNIKTPYRYRS

SEQ ID NO: 24080 - protein, 688 aa, Diabrotica virgifera
  misc_feature: Coding regions on vcDNA: vcDNA=SeqID_3777; Strand=+; Position=2-2068
  misc_feature: Homolog annotation: Hit_ID=S08405; Match level="QueryCoverage=98%, HitCoverage=57%, E-value=1e-97, Identity=31%"; Hit description =hypothetical protein 2 - silkworm transposon mag
  misc_feature: Pfam annotation: Pfam_ID=RVT_1; Match level="Score=70.9, E-value=3.5e- 18, Copies=1"; Pfam description=Reverse transcriptase (RNA-dependent
EPVSYPPVNVPVAIRDNLKNELDRLTKRGAIVKVNEIDPRASINRIVIVEKQNGKLRLCLDPLDLNKQIVRKPRVVHKLEDVCAQMIGKKIFSVFDLSEGYHHLELDETSSWKCCFATSYGIFRYKVLPYGLSNSQDLFQEVVEDKFKGIENLLICHDDMIVMGTTKEEHDTTVKKVLERAKEVGAKFNGDKFQYCQEEVRFMGQVFSHKGMQIDPDRVESLCKLEKPNSKVELQRILGAFNYVRRYIPNMAEHIQPLCQLLKNNVEWVWLPSHQKCFDNLKNIICKSPALVPYDPNQKIILQCDASKNGLGVCMFQKYDSILKLVACASRNMNDSEINYSQTEKELLAIYYATQKFHNFIYNFDVDVQSDHKPIISIMKKPISKIGSVRLQRLRLKLLKYRLNVYFVPGKDIHFADMLSRSSLNIETHDPEMFEMVHSVSKHLPMSQEKQSELRLATSQDEALAVIFDFYYNGWPKEKNVPQVCKKYYGIRDSLYFEAGIAFIDDKIIIPKKLRLDMIKLLHKGHIGVSKTINKARSIYYWPGLNDEVTNYIKKCRICEKYRPNNFKEPMMPHDIPRLRFNKVGTDILEYGSKAYLVIVDYFSHWLDISILKDKTSSSVINSFQDTFSRFGYPEILIADNLPFTSVKCKNYYREKDITIMTCTPHYHQSKGLAEKAVNISKQILKKE

SEQ ID NO: 24081 - protein, 250 aa, Diabrotica virgifera
  misc_feature: Coding regions on vcDNA: vcDNA=SeqID_3778; Strand=+; Position=136-885
  misc_feature: Homolog annotation: Hit_ID=EAL28357.1; Match level="QueryCoverage =96%, HitCoverage=61%, E-value=2e-19, Identity=27%"; Hit description =GA10727-PA [Drosophila pseudoobscura]
  misc_feature: Pfam annotation: Pfam_ID=Arrestin_N; Match level="Score=63.8, E-value= 4.9e-16, Copies=1"; Pfam description=Arrestin (or S-antigen), N -terminal d
MACRIILSSPPICAPGDAIKGTIICIFEKEEKIRGIKCRFRGQEHVEWTVGSGRHKQYINKIRNFIKADTEFVDKGTMMPGRYEYNFEYILPPSDIPSSFDHEFGSIRYFLYAFVDRPWAFDYEHEVEVQVIAPILHPPNQTRPIPVEVNNKSRLCCWPSKPSTMEIQLEKNHYALGEPINFRVLINNMSSSAVSNVLVQLSRKMKFSDTRRNHKKEKVILAQTGRTGVEAGCSQLYTFSLAVPQTTVIP

SEQ ID NO: 24082 - protein, 341 aa, Diabrotica virgifera
  misc_feature: Coding regions on vcDNA: vcDNA=SeqID_3779; Strand=+; Position=30-1052
  misc_feature: Homolog annotation: Hit_ID=NP_523783.1; Match level="QueryCoverage =100%, HitCoverage=68%, E-value=1e-151, Identity=76%"; Hit description=CG5519-PA [Drosophila melanogaster] gb|AAF57684.1| CG5519-PA [Drosophila melanogaster]
  misc_feature: Gene Ontology Annotation: Molecular function=pre-mRNA splicing factor activity; Cellular component=ubiquitin ligase complex; Biological process=mRNA splicing
  misc_feature: Pfam annotation: Pfam_ID=WD40; Match level="Score=55.9, E-value=1.2e -13, Copies=3"; Pfam description=WD domain, G-beta repeat
MALCCAISNEVPEYPVVSPSSGAIFEKRIIEKYIQENGVDPISGKELTIDDLIEIKTPPVVKPKPPSATSIPATLKLLQDEWDAVMLYSFTQRQQLQTARQELSHALYQHDAACRVIARLNKEVTAAREALATLKPQAGITTVPQPAVAAEAAGVANQPTEQAGMSEEIIEKLQEKATVLTLERKQKGKTVPEDLTTPEQLRNFRTLSSLIGLHSASIPGILALDVHLSDTSKVLTGGNDKNATVFNKDTEQVVAILKGHTKKVTKVIYHPDEDLVLTASPDATIRVWNVPTSQTTLLLRPHEGPITGLSLHPTRDYVLSTSEDQYWAFSDIRTGTLLAKL

SEQ ID NO: 24083 - protein, 492 aa, Diabrotica virgifera
  misc_feature: Coding regions on vcDNA: vcDNA=SeqID_3780; Strand=+; Position=47-1521
  misc_feature: Homolog annotation: Hit_ID=AAO41464.1; Match level="QueryCoverage =92%, HitCoverage=46%, E-value=1e-131, Identity=51%"; Hit description= LP02833p [Drosophila melanogaster]
  misc_feature: Gene Ontology Annotation: Molecular function=aminopeptidase activity; Cellular component=cytosol; Biological process=pathogenesis
  misc_feature: Pfam annotation: Pfam_ID=Peptidase_M1; Match level="Score=513.1, E -value=2.7e-151, Copies=1"; Pfam description=Peptidase family M1
  misc_feature (456)..(456): Xaa can be any naturally occurring amino acid
MEKNNCEKNCNRDQLAKYRLPDTVKPLLYDLYLYPDLKTGLFTGKVNISLEILKETESVSLHSKGLNIANVKVASQPGTFITEKTYDLLNIKRQDNSKFIPGFDNIEIEFNGDMKNRIVGLYTSSYTTSSGEKRQIATSKFEPTFARQAYPCFDEPNLKAKYKVHLLKPKDSSYIALSNYPVENVTDYDNDHQLVTFDETVSMSTYLSCFIVSDFTHTETSFNNSGKIVPLKVFASPENLDKTRYAGEVGKKVIEYYVQYFQMPYPLPKLDLVAIPDFVSGAMEHWGLVTFRETALLYTNTTHSSLNKQRVATVVAHELAHSWFGNLVTMNWWNDLWLNEGFASYIEYKGVLAAEPTWGMLEQFIITDLHPVLSFDAKLSSHPIVKHVVTPDQITEIFDVISYNKGASILRMLEATVGDEVFQNGVKNYLNRYAFGNAVTKDLLSELQLLVGINWXVTEMMDTFTLQMGLSYITWLAYRGDPYAFDSGRGFW

SEQ ID NO: 24084 - protein, 453 aa, Diabrotica virgifera
  misc_feature: Coding regions on vcDNA: vcDNA=SeqID_3781; Strand=+; Position=129-1489
  misc_feature: Homolog annotation: Hit_ID=XP_310211.1; Match level="QueryCoverage =98%, HitCoverage=92%, E-value=0.0, Identity=80%"; Hit description =ENSANGP00000011012 [Anopheles gambiae]
  misc_feature: Gene Ontology Annotation: Molecular function=hydrogen-transporting ATPase activity, rotational mechanism; Cellular component=hydrogen -transporting ATPase V1 domain; Biological process=hydrogen transport
  misc_feature: Pfam annotation: Pfam_ID=V-ATPase_H; Match level="Score=814.0, E -value=7.2e-242, Copies=1"; Pfam description=V-ATPase subunit H
  misc_feature (438)..(439): Xaa can be any naturally occurring amino acid
MIVPDMLAATSVLQQRATDIRNQHVNWQSYFQSQMISQEDYNFIVAFDVTDSAKREALLKSDRNQCAQTLLNLLGHVSKDQTLQYILVLVDDMLQENRSRVEIFHEYANQKKESVWGPFLNLLNRQDGFITNMTSRIIAKIACWSQTLMDRSDLHFYLTWLKDQLKTQNNEYIQSVARCLQMMLRIDDYRFAFVSVDGISTLLSVLSGRVNFQVQYQLIFCLWVLTFNPLLAEKMNKFNVIPILADILSDSVKEKVTRIILAVFRNLIEKPEDQQVSKEHCIAMVQCKVLKQLAILEQRKFDDEDVTADVEFLTEKLQSSVQDLSSFDEYSTEVKSGRLEWSPVHKSKFWRENAQRLNEKNYELLRILIHLLETSKDPLVLSVASFDIGEYVRHYPRGKHIIEQLGGKQLVMQLLAHEDPNVRYEALLAVQKLMVHNXXKYLGRQLEKKSKYR

SEQ ID NO: 24085 - protein, 524 aa, Diabrotica virgifera
  misc_feature: Coding regions on vcDNA: vcDNA=SeqID_3782; Strand=+; Position=77-1651
  misc_feature: Homolog annotation: Hit_ID=XP_310211.1; Match level="QueryCoverage =97%, HitCoverage=98%, E-value=0.0, Identity=73%"; Hit description =ENSANGP00000011012 [Anopheles gambiae]
  misc_feature: Gene Ontology Annotation: Molecular function=hydrogen-transporting ATPase activity, rotational mechanism; Cellular component=hydrogen -transporting ATPase V1 domain; Biological process=hydrogen transport
  misc_feature: Pfam annotation: Pfam_ID=V-ATPase_H; Match level="Score=791.8, E -value=3.4e-235, Copies=1"; Pfam description=V-ATPase subunit H
  misc_feature (522)..(522): Xaa can be any naturally occurring amino acid
MASNLVAGANPKIQDIMSSLDDDKTDMLAATSVLQQRATDIRNQHVNWQSYFQSQMISQEDYNFIVAFDVTDSAKREALLKSDRNQCAQTLLNLLGHVSKDQTLQYILVLVDDMLQENRSRVEIFHEYANQKKESVWGPFLNLLNRQDGFITNMTSRIIAKIACWSQTLMDRSDLHFYLTWLKDQLKTQYEALAASQAVSDTLKGAATEHYTESGFDQQSSSQEISNNEYIQSVARCLQMMLRIDDYRFAFVSVDGISTLLSVLSGRVNFQVQYQLIFCLWVLTFHPLLAEKMNKFNVIPILADILSDSVKEKVTRIILAVFRNLIEKPEDQQVSKEHCIAMVQCKVLKQLAILEQRKFDDEDVTADVEFLTEKLQSSVQDLSSFDEYSTEVKSGRLEWSPVHKSKFWRENAQRLNEKNYELLRILIHLLETSKDPLVLSVASFDIGEYVRHYPRGKHIIEQLGGKQLVMQLLAHEDPNVRYEALLAVQKLMVHNWEYLGRQLEKEQSTDKNAPKGGAPVAXKA

SEQ ID NO: 24086 - protein, 480 aa, Diabrotica virgifera
  misc_feature: Coding regions on vcDNA: vcDNA=SeqID_3783; Strand=+; Position=92-1528
  misc_feature: Homolog annotation: Hit_ID=XP_392581.1; Match level="QueryCoverage =88%, HitCoverage=91%, E-value=0.0, Identity=75%"; Hit description =similar to ENSANGP00000011012 [Apis mellifera]
  misc_feature: Gene Ontology Annotation: Molecular function=hydrogen-transporting ATPase activity, rotational mechanism; Cellular component=hydrogen -transporting ATPase V1 domain; Biological process=hydrogen transport
  misc_feature: Pfam annotation: Pfam_ID=V-ATPase_H; Match level="Score=717.7, E -value=6.7e-213, Copies=1"; Pfam description=V-ATPase subunit H
  misc_feature (355)..(355): Xaa can be any naturally occurring amino acid
  misc_feature (370)..(370): Xaa can be any naturally occurring amino acid
  misc_feature (379)..(379): Xaa can be any naturally occurring amino acid
  misc_feature (422)..(422): Xaa can be any naturally occurring amino acid
MASNLVAGANPKIQDIMSSLDDDKTDMLAATSVLQQRATDIRNQHVNWQSYFQSQMISQEDYNFIVAFDVTDSAKREALLKSDRNQCAQTLLNLLGHVSKDQTLQYILVLVDDMLQENRSRVEIFHEYANQKKESVWGPFLNLLNRQDGFITNMTSRIIAKIACWSQTLMDRSDLHFYLTWLKDQLKTQNNEYIQSVARCLQMMLRIDDYRFAFVSVDGISTLLSVLSGRVNFQVQYQLIFCLWVLTFNPLLAEKMNKFNVIPILADILSDSVKEKVTRIILAVFRNLIEKPEDQQVSKEHCIAMVQCKVLKQLAILEQRKFDDEDVTADVEFLTEKLQSSVQDLSSFDEYSTEXVKSGRLEWSPVHKSXKFWRENAHXLNEKNYKLLRILIHLVKTHKGPPWELDVTNFPIWKELFPHLPXGKPINEKVGRKKKLYFCNFLSPQKTPKGSKYKHFLVGEAPKNIWGPPQMREKKIWGPA

SEQ ID NO: 24087 - protein, 465 aa, Diabrotica virgifera
  misc_feature: Coding regions on vcDNA: vcDNA=SeqID_3784; Strand=+; Position=116-1510
  misc_feature: Homolog annotation: Hit_ID=CAG82488.1; Match level="QueryCoverage =41%, HitCoverage=43%, E-value=5e-10, Identity=29%"; Hit description =unnamed protein product [Yarrowia lipolytica CLIB99] ref|XP _502168.1| hypothetical protein [Yarrowia lipol
MKGTLLFLVLLISSTIAQHRIVRAKLGNLGAPQTIDLPDLGFAQGFLPSSLANAKHVNIKISKAKSSGFGAGSGNAEHGENIGFTARGAFSDNSGANINGIRGGFGFSSNGGSTASAGNTGFGVKAQLSANNAGVRGGFDFSSNRGNAVNAGNTAFGATGLDNSAKDSANFHQNTGKINNEIRGGFGFSSQGSLSGNTGFGFTSNEGNTGTTSNGNLDTGVTLDSFEFFDKHLHEAGPHLSPFPIIPSNISHEDRGSQHQSGFSGGFTKLPGTSIPQPFNHNQGAFNDFPGTRPPTKTTTKPTTTTTTTTPRPFEFSGHIPTLPVHDFTASAPRPVQDFENNLPQPVQDFRNNPHPPVQDFRNNIPPPVQDFGNNPPQHTQNVNQLSADFPQVPALSGQSFEEVIEQEWSSFTTRFNKVYASQDEARFRREVFIENRAKIMRFNMDYAEGRRNFVFKITSLPICC

SEQ ID NO: 24088 - protein, 377 aa, Diabrotica virgifera
  misc_feature: Coding regions on vcDNA: vcDNA=SeqID_3785; Strand=+; Position=71-1202
  misc_feature: Homolog annotation: Hit_ID=NP_726263.1; Match level="QueryCoverage =65%, HitCoverage=32%, E-value=6e-66, Identity=56%"; Hit description =CG3499-PB [Drosophila melanogaster] gb|AAM71132.2| CG3499-PB [Drosophila melanogaster]
  misc_feature: Gene Ontology Annotation: Molecular function=ATP-dependent peptidase activity; Cellular component=mitochondrial inner membrane; Biological process=proteolysis and peptidolysis
  misc_feature: Pfam annotation: Pfam_ID=FtsH_ext; Match level="Score=-11.5, E-value =0.02, Copies=1"; Pfam description=FtsH Extracellular
  misc_feature (346)..(346): Xaa can be any naturally occurring amino acid
  misc_feature (357)..(357): Xaa can be any naturally occurring amino acid
MFSLQNPNQAFATLSQFSSKINTRHSVHLKKTSAKKSKHAQSFICLDSFLEAVKNCDFSFAKHLNTKDLFGKQFINNFKVSYTSSNTFFENKHGFSESDLNKTVPTIIFKKDCIYVPTTLYQKLVDGLLFQHQSLFKTQLRTFKTDRSIKAELNRNPPLTDRVKQALGITGSDATSTISSKLPNSPEKLKHMLTSEDGVNETEKQRLKVAFAEGYLMGNNATPKAGKSTRYLKVTTQILTVFIFLAIIFSLIASASGSVFRIQLGNQVEVDPEEIHVTFEDVKGVDEAKQDLKDVVEFLRSPEKFSPLGGKLPKGSLLVGPPGTGKTLLAKAGGGKAGGPFFPGSXGPKFDEKLTGXGAKRVKKLFKGSEKNVPPWG

SEQ ID NO: 24089 - protein, 410 aa, Diabrotica virgifera
  misc_feature: Coding regions on vcDNA: vcDNA=SeqID_3786; Strand=+; Position=467-1699
  misc_feature: Homolog annotation: Hit_ID=AAM50570.1; Match level="QueryCoverage =85%, HitCoverage=87%, E-value=6e-46, Identity=30%"; Hit description =AT24407p [Drosophila melanogaster]
  misc_feature: Gene Ontology Annotation: Molecular function=molecular_function unknown
  misc_feature: Pfam annotation: Pfam_ID=DUF227; Match level="Score=39.2, E-value =1.2e-08, Copies=1"; Pfam description=Domain of unknown function (DUF227)
MSVKNIETLLELHIGEGKKIKETQTTNLVNPGENYGGELFKIDVTLEDSDTQKEEVLHIVGKIIPADDNSQEIFNVQNTFKSEIGFYEKIVPALQNFQRKHKIEEILDIFPKFYGSRINLDGSDKVDRDGVLLLENLKIEGYDNLDRYIGYNLEDAKILLRDLAVFQSTVVALKIKQPDVFNKEIKPFCNNNLATPEDDPFRNMILVIDEILEDSEEFRQFIPKVNVAWEKQEMKTEVREPFATIVHRDLWVNNVMIKYEKGKPAKNKFIDFQLYDYGSPASDVLNFIFTSVKTEVSRLHFDDLIEHYHTEFVNNLKRFKCDTEPFNYPNFLRELKMESEIILGWTIGFVTIVVFGKKNESFMDDPNPDFHDPKYRQKVRDGLMPEALERLFFILRQCHKCNDLNGKTNG

SEQ ID NO: 24090 - protein, 130 aa, Diabrotica virgifera
  misc_feature: Coding regions on vcDNA: vcDNA=SeqID_3787; Strand=+; Position=1-393
  misc_feature: Homolog annotation: Hit_ID=XP_392710.1; Match level="QueryCoverage =93%, HitCoverage=23%, E-value=1e-40, Identity=61%"; Hit description =similar to ENSANGP00000021942 [Apis mellifera]
  misc_feature: Gene Ontology Annotation: Biological process=TGFbeta receptor signaling pathway
SLPGLTLSPKTALPDVELALRLLQENANHMNPLEALFILPDNIPVSRLHKFLLVAMQKVTQERRNMQLMKGLLYAEHLQCQEMKLKLQSQHVLVTEFNVCPVCRKRFGNQSALVRYPNGDVVHYSCQDKK

SEQ ID NO: 24091 - protein, 551 aa, Diabrotica virgifera
  misc_feature: Coding regions on vcDNA: vcDNA=SeqID_3788; Strand=-; Position=318-1973
  misc_feature: Homolog annotation: Hit_ID=NP_477123.1; Match level="QueryCoverage =98%, HitCoverage=66%, E-value=1e-105, Identity=42%"; Hit description= CG8912-PB, isoform B [Drosophila melanogaster] gb|AAF57942.2| CG8912 -PB, isoform B [Drosophila
  misc_feature: Gene Ontology Annotation: Molecular function=transcription factor activity; Cellular component=nucleus; Biological process =spermatogenesis
  misc_feature: Pfam annotation: Pfam_ID=KH_1; Match level="Score=143.5, E-value=5e -40, Copies=2"; Pfam description=KH domain
GRVGEKPLVISGEPQKVEHAKQLVYDLMAEKEMKSFNRGGPRGRQNQGQNDGGGYGNNDYGGGGGGGEQMEVLVPRPAVGVVIGKGGDMIKKIQAETGAKVQFQQARDEGPGDRRCYLSGNPKQVEQARQRIDELIDSVLQRDGDGGGMGAPMGGGMRGGRGGGRGGRGGHHGGRGGGGQGGFDRGDRNGGGGDFGGGGNQWEDRRGGGGGPGGQGNGQQDVVSFTVPANKCGVIIGRGGETIKQINQQSGAYCELDRRAQNQNPTANDKVFNIKGDPDSIETAKRIIQEKVQMPLTFVSQSGGGGGGPPMNSTMPTAYPGMTPQNYNPQNNWGMQGGGGGGGVAGAGGYQQQQQWGGQPQGADSQPGQPNKVQVNPSTGQPDYSMQWAEYYRSLGMHREAEMIEQQAKAKTAGGSMQTAPTPAQPAASTQSANPSSQADYSAQWAEYYRSMGKHKEAEAIETQMKTKGPMPGAAGGAATGQTPAAPGTQPGGYSQAQAPYGGYQPQAAAGGYYGGQPQSAPVPGGVPQGGYGFPSYGYGGQQQAPPQSQD

SEQ ID NO: 24092 - protein, 256 aa, Diabrotica virgifera
  misc_feature: Coding regions on vcDNA: vcDNA=SeqID_3789; Strand=-; Position=184-952
  misc_feature: Homolog annotation: Hit_ID=AAC46947.1; Match level="QueryCoverage =99%, HitCoverage=79%, E-value=3e-44, Identity=38%"; Hit description =mariner transposase gb|AAA28265.1| mariner transposase
  misc_feature: Gene Ontology Annotation: Molecular function=transposase activity; Cellular component=cellular_component unknown; Biological process =DNA transposition
  misc_feature: Pfam annotation: Pfam_ID=Transposase_1; Match level="Score=0.4, E -value=0.00033, Copies=1"; Pfam description=Transposase
  misc_feature (45)..(45): Xaa can be any naturally occurring amino acid
  misc_feature (60)..(60): Xaa can be any naturally occurring amino acid
  misc_feature (65)..(65): Xaa can be any naturally occurring amino acid
  misc_feature (88)..(88): Xaa can be any naturally occurring amino acid
  misc_feature (99)..(99): Xaa can be any naturally occurring amino acid
  misc_feature (133)..(133): Xaa can be any naturally occurring amino acid
  misc_feature (167)..(167): Xaa can be any naturally occurring amino acid
  misc_feature (209)..(209): Xaa can be any naturally occurring amino acid
DDVKEIRDIIWQKRRPKVHETVGISKYRVSHILHEILGIRTLVGXWVPRLLTPDSKRNPXDHLRXCMRLFQCNTNEFLRCFITAHETXFHWYTPETKKXSRYQWTSPRECSSKREKTVQWTGKVNGEKGHHFXDSQGVLYVNFLEKGKTVKGLYYAVLLGRFGAELXEKQPRLIELGYELLFYPLFSPDLTLCDFCLFLNLKVARPGRXFKSNNEFIIATEASVADLEKTYFSDEIKKVEHHWVKCIELKEDYVQK

SEQ ID NO: 24093 - protein, 162 aa, Diabrotica virgifera
  misc_feature: Coding regions on vcDNA: vcDNA=SeqID_3790; Strand=+; Position=135-623
  misc_feature: Homolog annotation: Hit_ID=EAA05686.2; Match level="QueryCoverage =78%, HitCoverage=99%, E-value=2e-29, Identity=50%"; Hit description =ENSANGP00000015050 [Anopheles gambiae str. PEST] ref|XP_559908.1| ENSANGP00000015050 [Anopheles gambiae st
  misc_feature: Pfam annotation: Pfam_ID=RTP801_C; Match level="Score=139.2, E-value =9.7e-39, Copies=1"; Pfam description=RTP801 C-terminal region
MEVLPFVDIKQHSGLEGCEPEYNEFFRLEETSLIEALSKRLEGELRTAKRTHLSVGEVLLPNGLTHSIAKDLFYLADSEPCGLRGCTLYIDFENNDLKTNLSQVKCDASTPSTFEVYLTLKQATTGWNSFLPQFLKKITSSGALMISAEYGLTKKQLYRSSY

SEQ ID NO: 24094 - protein, 82 aa, Diabrotica virgifera
  misc_feature: Coding regions on vcDNA: vcDNA=SeqID_3791; Strand=+; Position=386-634
TAWLFNIQVNVGLTSFSLVFETVVVASTSMASGYTGSSHELKDSADRYGKAVLLITFPKATSTQYYHKIFWSARRPAAWFPY

SEQ ID NO: 24095 - protein, 300 aa, Diabrotica virgifera
  misc_feature: Coding regions on vcDNA: vcDNA=SeqID_3792; Strand=+; Position=25-923
  misc_feature: Homolog annotation: Hit_ID=XP_319519.1; Match level="QueryCoverage =78%, HitCoverage=36%, E-value=4e-44, Identity=38%"; Hit description =ENSANGP00000017807 [Anopheles gambiae]
  misc_feature (268)..(268): Xaa can be any naturally occurring amino acid
MHSFLNFCRFKYSENNLRNACSILCLKKTSKYKTVRHFSVENKIVKDEKPEKFIPFLQRINLRRSEARRSMVVQVQSTQSFKELYSYCNAIGKIKYMFHYSVGIEPLHFIIVEFETDTDITNIKKSSIFVEGSLGLPTQSHFVWFRAAHKKLPKLKQIKSACLTVEHGTAIKEEETIKEMLSKSENISDQIKTLHEITKLNDVGTRLRFLTALQIEDAVNGMFPHAVAYPFGSSVNGYGKMGCDLDLFLKVAADKHNNENGRLAFPLXTLNGPEKNMNQRSMETLGDLIYFFFPREGAKY

SEQ ID NO: 24096 - protein, 268 aa, Diabrotica virgifera
  misc_feature: Coding regions on vcDNA: vcDNA=SeqID_3793; Strand=-; Position=608-1414
  misc_feature: Pfam annotation: Pfam_ID=GILT; Match level="Score=-21.4, E-value =0.0015, Copies=1"; Pfam description=Gamma interferon inducible lysosomal
MNETRIKMEYLVSYLLISLMFFVSLNKCESPWPAGINATVYYETGCPYDKSFIEQQLNPILEGNLSNYVNLQLLSFDSKGQPYKHGCLGPRDRQCSGQIDYSDKYFTPIPTGVNEWCFKDMICILRELKKRFEKQPIASKEEFCDLSDLSFFFNPTLCWNPGTELHFKKPNNTFGDETLDKIDLKSNLKPEEKNVAITTINWEMKSVCMDRVNRAKASERGVQSDRLKAEKVKLDESSAGTHALININTLVLGFFVYLIIHFYYNKVE

SEQ ID NO: 24097 - protein, 83 aa, Diabrotica virgifera
  misc_feature: Coding regions on vcDNA: vcDNA=SeqID_3794; Strand=+; Position=33-284
  misc_feature: Pfam annotation: Pfam_ID=CBM_14; Match level="Score=56.9, E-value =5.7e-14, Copies=1"; Pfam description=Chitin binding Peritrophin-A domain
MLLKIVVVCCCISIALSQAVGKCPSVDGRYPVYLPDATSCSTFYECSNGTPYQFKCAYGTYFDSQSRICRHKRDVNCGSRRRD

SEQ ID NO: 24098 - protein, 208 aa, Diabrotica virgifera
  misc_feature: Coding regions on vcDNA: vcDNA=SeqID_3795; Strand=+; Position=3-629
  misc_feature: Homolog annotation: Hit_ID=XP_235561.2; Match level="QueryCoverage =89%, HitCoverage=22%, E-value=1e-25, Identity=36%"; Hit description =similar to hypothetical protein BC002942 [Rattus norvegicus]
  misc_feature: Pfam annotation: Pfam_ID=DUF1222; Match level="Score=65.7, E-value =1.3e-16, Copies=1"; Pfam description=Protein of unknown function (DUF1222)
SPFTTFPAGNGRREIVFEGADKVDGPWKEYNFLYKPGNPNASLPFVAPHSPQLDWHLATAAYVSYDQQPWLVSFAHRILAHKPAVLALIDFRDSPYRNVPPKYLRALVYKYQYTGWNQRSQRAWWTREKISEYLPVVSLDSPFLTDYLKARSLLPLTSKGNVNPLWTQALDFIRYIVNHLEATLLFWSVVSAGFAVICTTSSVSHGKK

SEQ ID NO: 24099 - protein, 298 aa, Diabrotica virgifera
  misc_feature: Coding regions on vcDNA: vcDNA=SeqID_3796; Strand=+; Position=192-1085
  misc_feature: Homolog annotation: Hit_ID=AAH46858.1; Match level="QueryCoverage =97%, HitCoverage=44%, E-value=2e-56, Identity=38%"; Hit description =Loc89944-prov protein [Xenopus laevis]
  misc_feature: Gene Ontology Annotation: Molecular function=beta-galactosidase activity; Cellular component=lysosome
  misc_feature: Pfam annotation: Pfam_ID=Glyco_hydro_35; Match level="Score=253.8, E -value=3e-73, Copies=1"; Pfam description=Glycosyl hydrolases family 35
MALAANSLPTLYEYYTGNGITQGLSDNQPYFTLNEKNITLYSGAFHYFRVPRKYWRDRLRKMRAAGLNTVETYVPWNLHEPQPGVYDFGQGGTDMEDFLHIDEFLRTAKEEDILVLVRPGPYICAEWEFGGFPSWLLRNVTTVRSSKDKNYMTYIQRWFNVLLPILALFQFQRGGSIVGFQVENEFASLSIDDPVYLNTLKKLFIDNGITELLYTADAPDYTHGIIPGVLQTANVGSMSQIINGIKTMHKRQPNKPNMVMETYTGWFDHWGETHHTTSAEGYLPYLKAILDFPSSNNM

SEQ ID NO: 24100 - protein, 155 aa, Diabrotica virgifera
  misc_feature: Coding regions on vcDNA: vcDNA=SeqID_3797; Strand=+; Position=1-468
  misc_feature: Homolog annotation: Hit_ID=XP_316161.1; Match level="QueryCoverage =100%, HitCoverage=91%, E-value=1e-39, Identity=49%"; Hit description= ENSANGP00000019735 [Anopheles gambiae]
SRADTRLKNVSAYYWVDTTARGGVPSSALRGGTDVDGYEIYVGRAHYEGDWLPAKVIPGKDIAYVSYNGSEIGVHRFQVLCEQQFDWVPCHGGNIPPDAVEGGRTSDGEPLYIGRAYHEGSQTVGKVHPSHGCCYVPFNGGEHSHSNYEILVLRH

SEQ ID NO: 24101 - protein, 269 aa, Diabrotica virgifera
  misc_feature: Coding regions on vcDNA: vcDNA=SeqID_3798; Strand=+; Position=107-916
  misc_feature: Homolog annotation: Hit_ID=AAL05409.1; Match level="QueryCoverage =97%, HitCoverage=97%, E-value=3e-19, Identity=27%"; Hit description =peritrophin [Aedes aegypti]
  misc_feature: Pfam annotation: Pfam_ID=CBM_14; Match level="Score=139.1, E-value=1e- 38, Copies=3"; Pfam description=Chitin binding Peritrophin-A domain
MRNTINFILVLACVLGVIPYTTARHAKSKFDYSAINLIRDIVEDCKNGLETFEYYPYDCQKYYSCSKGAPQVNTCDNGLYWNDKVKACDVKEDVDCSNIIPFPAHIIPEPDSTSVAPQPSTDVTEPSTAVPNPSTVNPDLHCDIDLEYFADPYNCQGYYQCLNGIKQHEFCNEGLLWNVHIPGCDENSDCSQLLVSTEKTDAPTAAPTESTTSSVCQEGDRNEYIPDCHRFFECQNNRWVGPFQCPADLYWSQANKRCVVLAQSDCNKH

SEQ ID NO: 24102 - protein, 324 aa, Diabrotica virgifera
  misc_feature: Coding regions on vcDNA: vcDNA=SeqID_3799; Strand=+; Position=80-1054
  misc_feature: Homolog annotation: Hit_ID=NP_648530.1; Match level="QueryCoverage =87%, HitCoverage=88%, E-value=3e-22, Identity=25%"; Hit description =CG7248-PA [Drosophila melanogaster] gb|AAF49982.1| CG7248-PA [Drosophila melanogaster]
  misc_feature: Pfam annotation: Pfam_ID=CBM_14; Match level="Score=195.4, E-value =1.2e-55, Copies=4"; Pfam description=Chitin binding Peritrophin-A domain
MRNTINFILVLACVLGVIPYTTARHAKSKFDYSAINLIRDIVEDCKNGLETFEYYPYDCQKYYSCSKGAPQVNTCDNGLYWNDKVKACDVKEDVDCSNIIPFPDPDCKDGKNTYYPYPYDCKKFYECLDSIRYILSCPGDFLWNEKLNKCDDKDTVDCSHIIPEPDSTSVAPQPSTDVTEPSTAVPNPSTVNPDLHCDIDLEYFADPYNCQGYYQCLNGIKQHEFCNEGLLWNVHIPGCDENSDCSQLLVSTEKTDAPTAAPTESTTSSVCQEGDRNEYIPDCHRFFECQNNRWVGPFQCPADLYWSQANKRCVGLAQSDCNKH

SEQ ID NO: 24103 - protein, 552 aa, Diabrotica virgifera
  misc_feature: Coding regions on vcDNA: vcDNA=SeqID_3800; Strand=+; Position=58-1715
  misc_feature: Homolog annotation: Hit_ID=XP_392327.1; Match level="QueryCoverage =98%, HitCoverage=68%, E-value=0.0, Identity=67%"; Hit description =similar to vacuolar protein sorting 35 [Apis mellifera]
  misc_feature: Gene Ontology Annotation: Molecular function=protein binding; Cellular component=integral to membrane; Biological process=vacuolar protein processing/maturation
  misc_feature: Pfam annotation: Pfam_ID=Vps35; Match level="Score=448.0, E-value =1.1e-131, Copies=1"; Pfam description=Vacuolar protein sorting -associated p
  misc_feature (543)..(543): Xaa can be any naturally occurring amino acid
MPTTPPQISPVEEQEKYLHDALGIVKAQAFQMKRSLDKNKLMDALKNASAMLAELRTSLLSPKSYYELYMAISDELRHLELFLVDEFQKGVKVPDLYELVQYAGNIVPRLYLLITVGLVYIKTNSSLRRDLLKDLVEMCRGVQHPLRGLFLRNYLLQCTRNVLPDTPDCDGDCPEGTVKDSIDFVLMNFAEMNKLWVRMQHQGHSRDRQNREREREELRILVGTNLVRLSQLETVTLDKYQKSVLPRTRGQVVSCRDAIAQEYLMECIIQVFPDEFHIQTLNPFLKSCAELEAGVNVKNIVICLMERLASFSQRSDAIGGKGGNILKEVQLFEVFSNQVSSIIETRQYLPPEDMIALQVALINLALKCYPDKIEYIDQVMLSSVEILQRLAIENIEPHSSVAKELQKLLKIPLDHYNNLLLVLKLKHYAGLMEHLDYFGRKSLSIYILNNALENETIVPSPEEAEQALTLFGTLVTDKNDHPIGELDMDELTEEQCLLARFIHQMMSSSPDDQFLILTGARKILSTGGPLRIKYTLPPLVSQXYQLAYNIRT

SEQ ID NO: 24104 - protein, 494 aa, Diabrotica virgifera
  misc_feature: Coding regions on vcDNA: vcDNA=SeqID_3801; Strand=+; Position=185-1774
  misc_feature: Homolog annotation: Hit_ID=EAL26527.1; Match level="QueryCoverage =99%, HitCoverage=99%, E-value=1e-91, Identity=38%"; Hit description =GA20963-PA [Drosophila pseudoobscura]
  misc_feature: Gene Ontology Annotation: Molecular function=apoptosis inhibitor activity; Cellular component=cytosol; Biological process=anti -apoptosis
  misc_feature: Pfam annotation: Pfam_ID=BIR; Match level="Score=312.4, E-value=7e -91, Copies=3"; Pfam description=Inhibitor of Apoptosis domain
  misc_feature (249)..(249): Xaa can be any naturally occurring amino acid
  misc_feature (256)..(256): Xaa can be any naturally occurring amino acid
NQSFKMHQEINRLQTFSEWPSDAQVSPQRIAKAGFFATKQGLEVECFACHAKISEWNYGDQVMTRHIALNRDCPFVLNPSTSGNVPITSSRVPSTSINMYRSSETRLASFENWPAADIVTPDSLVQAGFYYLKEGDNTQCAFCKGVVRAWEVGDDPDTEHQRHFPNCPFVMAVINPRLQARRGIGTEQNLGELGVQAHRGPKKSNFATVEARLRSYVGWSSDLIQTPEVLAEAGFYYEGMGDQVRCFHXDGGLRTXDPHDDPWTEHARWFPNCSFVKLVKDKIFVRPSAQRIQTTRIRREVTEREIQSYLTSPQALAALSIGLNVERVKRAIREKLEQTGRAYSQPDALVEAALNLQHEEEDPNSHEHYTPIDRSLRNVVCAAMEECIDRQPEQVQQPEPAQQPEMDEAFEVSPTTAPDGTPQLHYQLVKTVSLEEENRILKEARLCKICMDSEVGIVFLPCGHLATCVNCAPNLEDCPVCRSTIKATVRTFFS

SEQ ID NO: 24105 - protein, 106 aa, Diabrotica virgifera
  misc_feature: Coding regions on vcDNA: vcDNA=SeqID_3802; Strand=+; Position=352-672
RFATFCIVFRMVSEKRYTIEKWVEMTPGAQKSSTLQKTTCLSSDLGHQVVHPEGDVTIDMFKSLDTKSLKSLGAVFKSRFIPMFLVLMVYMFQHYIMPKTRHNNVF

SEQ ID NO: 24106 - protein, 188 aa, Diabrotica virgifera
  misc_feature: Coding regions on vcDNA: vcDNA=SeqID_3803; Strand=+; Position=102-668
  misc_feature: Homolog annotation: Hit_ID=XP_321820.1; Match level="QueryCoverage =85%, HitCoverage=65%, E-value=9e-66, Identity=74%"; Hit description =ENSANGP00000020393 [Anopheles gambiae]
  misc_feature: Gene Ontology Annotation: Molecular function=thioredoxin peroxidase activity; Cellular component=peroxisomal membrane; Biological process=cell organization and biogenesis
  misc_feature: Pfam annotation: Pfam_ID=AhpC-TSA; Match level="Score=47.4, E-value =4.3e-11, Copies=1"; Pfam description=AhpC/TSA family
MNVTVNVLKRLPVGSAGIKSQFFQRLLHISSAKMVKVGDSIPSVDLFEDSPTNKVNLAQLSSGKKVILFAVPGAFTPGCSKTHLPGYVNKADDLKSQGVSEIVCVSVNDPFVMAAWGKEHKTSGKVRMLADPSAALAKALDLSVDIAPLGGTRSKRYSMVVENGKITSLQVEPDGTGLSCSLAEAIKL

SEQ ID NO: 24107 - protein, 223 aa, Diabrotica virgifera
  misc_feature: Coding regions on vcDNA: vcDNA=SeqID_3804; Strand=+; Position=128-799
  misc_feature: Homolog annotation: Hit_ID=Q00690; Match level="QueryCoverage=44%, HitCoverage=16%, E-value=1e-13, Identity=38%"; Hit description=E -selectin precursor (Endothelial leukocyte adhesion molecule 1) (ELAM- 1) (Leukocyte-endothelial
  misc_feature: Gene Ontology Annotation: Molecular function=selectin; Cellular component=extracellular space; Biological process=inflammatory response
  misc_feature: Pfam annotation: Pfam_ID=Lectin_C; Match level="Score=64.4, E-value =3.1e-16, Copies=1"; Pfam description=Lectin C-type domain
MYLFIAADWISNMDASETYDETSDVISTPDTSTQIETSPETITADWNSSMDESETYDETSDVIFTPDISTQIVTSPETIIINGNSVEDTRDVISCPKIFYRILYNIKVSYDDAVKKCKKRGMSLVSIQSKEKSNSLNTVLQASSYGRNTFWTSGNKEDNKWTWLKGEPLEFTNWNAGEPNNGRGNEDCLTVTVFKSDNHSLWNDEPCGWGYTPAGEKVVECSE

SEQ ID NO: 24108 - protein, 186 aa, Diabrotica virgifera
  misc_feature: Coding regions on vcDNA: vcDNA=SeqID_3805; Strand=+; Position=404-964
  misc_feature: Homolog annotation: Hit_ID=NP_725856.1; Match level="QueryCoverage =92%, HitCoverage=53%, E-value=2e-14, Identity=27%"; Hit description =CG15111-PB, isoform B [Drosophila melanogaster] gb|AAM68437.1| CG15111-PB, isoform B [Drosophila
MGLGRRNGSSCCRKWLIGTCLYIFILLLLIFLIVFVVVPVVFKYSVGIQRSIIFPSWVIDPKNYSNIDQFGIKGVKNFYVNLQEDDNSTLNNAENITLGVWQILPHEMLSELIDNNDYNYDGVLSNGNYSVLLYMHGNGQDRTDSVGTYEVLRKFFHIFSVDYRKYGDSTGELTEANVVDDMVKFY

SEQ ID NO: 24109 - protein, 124 aa, Diabrotica virgifera
  misc_feature: Coding regions on vcDNA: vcDNA=SeqID_3806; Strand=+; Position=590-959
  misc_feature: Homolog annotation: Hit_ID=XP_309438.1; Match level="QueryCoverage =99%, HitCoverage=25%, E-value=9e-57, Identity=86%"; Hit description =ENSANGP00000011246 [Anopheles gambiae]
  misc_feature: Gene Ontology Annotation: Molecular function=translation initiation factor activity; Cellular component=cytosol; Biological process =regulation of translational initiation
  misc_feature: Pfam annotation: Pfam_ID=eIF-5_eIF-2B; Match level="Score=203.3, E -value=4.9e-58, Copies=1"; Pfam description=Domain found in IF2B/IF5
  misc_feature (107)..(107): Xaa can be any naturally occurring amino acid
MSVNVNRGVSDVFYRYKMPRLMAKVEGKGNGIKTVIVNMAEVAKALGRPPTYPTKYFGCELGAQTQFDFKNERFIVNGSHDASKLQDLLDGFIRKFVLCPECDNPEXTDLLVSVKKKHISQGCK

SEQ ID NO: 24110 - protein, 443 aa, Diabrotica virgifera
  misc_feature: Coding regions on vcDNA: vcDNA=SeqID_3807; Strand=+; Position=343-1674
  misc_feature: Homolog annotation: Hit_ID=XP_309438.1; Match level="QueryCoverage =99%, HitCoverage=96%, E-value=1e-169, Identity=64%"; Hit description= ENSANGP00000011246 [Anopheles gambiae]
  misc_feature: Gene Ontology Annotation: Molecular function=translation initiation factor activity; Cellular component=cytosol; Biological process =regulation of translational initiation
  misc_feature: Pfam annotation: Pfam_ID=eIF-5_eIF-2B; Match level="Score=246.2, E -value=5.9e-71, Copies=1"; Pfam description=Domain found in IF2B/IF5
MSVNVNRGVSDVFYRYKMPRLMAKVEGKGNGIKTVIVNMAEVAKALGRPPTYPTKYFGCELGAQTQFDFKNERFIVNGSHDASKLQDLLDGFIRKFVLCPECDNPETDLLVSVKKNTISQGCKACGYHGLLESNHKLMTFILKNPPNSNPASQGSSLTEGKRSKRSKRNGEANGDQENDSTLDSSAMENSTDNNGGSDDDQTEWAVDVSEEAVRQRMQDLSDGAKNMTISDDLEKSEKERMDILYNMVKVKRDTGLLGNVQTQKEVLSEAERLEIKTKAPLVLAELLFDQNILAQAKKYRMLFLRFTLNEKKAQKYLIGGLEQVIALHKDKLMSKVPGLLKIFYDMDILGEECIIEWSEKVSKKYVAKEVSQEIHDKAEPFIKWLKEAESEDSDNDDDEEDDDVEIEYNDRAQIQLKITPQSKPKPVASNDDDGQDDVDIDAI

SEQ ID NO: 24111 - protein, 225 aa, Diabrotica virgifera
  misc_feature: Coding regions on vcDNA: vcDNA=SeqID_3808; Strand=+; Position=224-898
  misc_feature: Homolog annotation: Hit_ID=XP_314040.1; Match level="QueryCoverage =100%, HitCoverage=88%, E-value=1e-30, Identity=38%"; Hit description= ENSANGP00000003608 [Anopheles gambiae]
  misc_feature: Pfam annotation: Pfam_ID=BCNT; Match level="Score=-3.0, E-value =0.014, Copies=1"; Pfam description=Bucentaur or craniofacial development
  misc_feature (208)..(208): Xaa can be any naturally occurring amino acid
MNNDDLPDDSDSSDEDYVPNEKVEDLPSEIDEDDSISESEETSGKSSRKKKKSRKKIVKDKVDNKNEAIEETKSEETKANVDDLWADFVKDTGFKTKGSIKSTQPTSLKPKENIIKSSSSSQSSSTESKPANKVKVTQIFEFAGEEVKVEKEVSADSAEARLLGTNTEQNVSGGKSKRSAGLGGIGNVLNQLTKKPKISTLEKTKLDXDSYKREHDIEEEIQTFN

SEQ ID NO: 24112 - protein, 417 aa, Diabrotica virgifera
  misc_feature: Coding regions on vcDNA: vcDNA=SeqID_3809; Strand=+; Position=44-1297
  misc_feature: Homolog annotation: Hit_ID=XP_308965.1; Match level="QueryCoverage =94%, HitCoverage=90%, E-value=1e-175, Identity=73%"; Hit description= ENSANGP00000020214 [Anopheles gambiae]
  misc_feature: Gene Ontology Annotation: Molecular function=isovaleryl-CoA dehydrogenase activity; Cellular component=mitochondrial matrix; Biological process=energy pathways
  misc_feature: Pfam annotation: Pfam_ID=Acyl-CoA_dh_M; Match level="Score=214.1, E -value=2.6e-61, Copies=1"; Pfam description=Acyl-CoA dehydrogenase, middle domain
MALGGCQLLRFLNKVKHIHSRSVSQHYPIDEHIFGLSDDQIQLRETIFNFAQKELAPIANEIDKKNKFENLRSFFKKLGNLGALGITVNPEYGGTGGSYTDHVIIMEELSRASGAIGLSYGAHSNLCVNQIHRNGSDYLKKKYLPKLCSGEHIGALAMSEAGSGSDVVSMRLKAEKKGDHYMLNGNKFWITNGPDADVLVVYAKTDAKCKKSQHGISAFVIEKHFKGFKAGPKLDKLGMRGSNTSELIFEDCVVPKENLLGSENKGVYVLMSGLDLERLVLAGGPLGIMQACCDVAFSYAHVRKQFNQRIGEFQLLQGKLADMYTTLSACRSYLYNVAKSCDKKKVNSKDCAGVILYCGEKATQMALDSIQILGGNGFINDYPTGRFLRDAKLYEIGAGTSEVRRLVIGRVINSEYS

SEQ ID NO: 24113 - protein, 281 aa, Diabrotica virgifera
  misc_feature: Coding regions on vcDNA: vcDNA=SeqID_3810; Strand=+; Position=76-921
  misc_feature: Homolog annotation: Hit_ID=EAL30452.1; Match level="QueryCoverage =98%, HitCoverage=42%, E-value=2e-29, Identity=28%"; Hit description =GA21682-PA [Drosophila pseudoobscura]
MAKLGSFYSLCPLIDNKGILDVSNDREEGVVIVTLGKNIASRYKVSNQKQITCWRTKEKFSSPVLYDKQKNQYVAVFNQTHIKFWNLDDSLDKLKKYKFTKPIHTILNVGKNYLILFQNGYLHDLDDAIENRKSLIPPSTDVTQIDHVLCESMNEHIYIGLITGNNFYWTIYTGGSPKYSKIELSRDGLDVRGRMFHAMGNVLYLFTLWSDGSIFAKSLENENSSENDLGELYTIVDSVSSKHFVAMISLDENYIGLYGANTNEEGAMLAIYNLQFKSYPI

SEQ ID NO: 24114 - protein, 92 aa, Diabrotica virgifera
  misc_feature: Coding regions on vcDNA: vcDNA=SeqID_3811; Strand=+; Position=3-281
  misc_feature: Homolog annotation: Hit_ID=XP_393522.1; Match level="QueryCoverage =98%, HitCoverage=17%, E-value=3e-24, Identity=64%"; Hit description =similar to Zgc:85806 [Apis mellifera]
  misc_feature: Gene Ontology Annotation: Molecular function=protein binding; Biological process=protein folding
  misc_feature: Pfam annotation: Pfam_ID=DnaJ; Match level="Score=-0.2, E-value =0.0042, Copies=1"; Pfam description=DnaJ domain
YRHANATEDEKKEQEKKFKEVGEAYGILSDPKKKARYDSGQDMDDFDGGMSDIDPTQVFQTFFGGGGGGHHHGGAQEFSFGNFPGSFTFQFG

SEQ ID NO: 24115 - protein, 306 aa, Diabrotica virgifera
  misc_feature: Coding regions on vcDNA: vcDNA=SeqID_3812; Strand=+; Position=1-921
NSHVDAQRGACVPLLKNLSCDLDSDSEFLDLHERCLTPKPSQVPEVQETPVKSSLKLDAAFLGDIPGQYTICAVEPHQLPVVGVYIDPRVVPGFKYRIRPLPEVGRPSTTNKCLFDNKALTLQSIGRGYARRFTFEADENQLNNNENYFWSDNRPEGYAFELELLSEGDKFTFFNPNGEAEGTVEVLSIEAPQIEIFSSLAKGVIDKKATVAFTGKVEYYETGVAKPVNLTGTVLSRKVKGRSSAEIVKITKVSINKHRCYLLPGIQKNSQKNLLLEEKILTMVPTKYTKDWDWESFEIPVGRYLR

SEQ ID NO: 24116 - protein, 932 aa, Diabrotica virgifera
  misc_feature: Coding regions on vcDNA: vcDNA=SeqID_3813; Strand=+; Position=179-2977
  misc_feature: Homolog annotation: Hit_ID=EAL48061.1; Match level="QueryCoverage =69%, HitCoverage=84%, E-value=1e-20, Identity=20%"; Hit description =Viral A-type inclusion protein repeat, putative [Entamoeba histolytica HM-1:IMSS]
  misc_feature: Gene Ontology Annotation: Molecular function=kinetochore motor activity; Cellular component=membrane fraction; Biological process =vesicle-mediated transport
  misc_feature: Pfam annotation: Pfam_ID=DUF827; Match level="Score=-115.7, E-value =0.07, Copies=1"; Pfam description=Plant protein of unknown function (DU
MKQLLFVLVSVAIYGTLEAANCARPNLNRANVYIYSSIGKVPVRVSRCLFNDTKDAYSDISDNCVKAFQSGTFIDKWQDKNILAEKGSPIVLEEYVSKADLVKNEISLRTGKICRYDRGFCYDPTETNTYAVVWEILDKSKVQCPNQLFKVFQGDVDFWEFKQQGLNYLFHYDALEDKAFYLSLENRAQCQDTDVWYTEEGYIVSTKPLKSKDMESKGLALRTKGGVKGGVKGGAIKAGASVSHDYFTVRTKKIVSENILKHCDIKSLSFEELIEAVDSDYLQNPHNLHLILERYYNLIMDTKQEVIELIYKESTVNITKELKQQLIILQELLEKTRVEVTQIQETLLAAGDLKGIRIDVDTLAKQIALLLKTNEHYDEIIKEIYESIKKNTVLINDQSKEITTLYEKVEKIQQIINTQLPEFITKQEVYEKITQIEQDFHGKLRDLAMNVTMLIMEGGGGGSGGVRGGPKAKEELEGLVLEKLKTFKLDELESKIDRLSEKIQLELNQYRHESYSNSTLLEERILKKLADLEAKNKPILDRLNKYEEQINNLFSEVSVIKETAEHFKESVEKVFKEFDSKHESILKTFEDYDKLINQVRSDLKVLSEKEIDFTPAIEKAKQLLQEALRSRDIRLETLETLAVKLGDSVEKSEHEFDNVENQIKGLQESLSRIDRVKEEISEVIDRKSAQCEKNLSELKEIVEQISAKRDQTDKDLQASKEASKTRIDEVYEECRSSIEHINATLGEDRQLIDQIQSEDTRINGVIDNLRKEIGGHKDSISKLESLITEKSFACEAKGKQNRELIDELKKKVTELYEIVKKQEDLILELKKSTEKASFTKGGTKGGTKGGTKVKEDTVNNLKLAKTSITRVNGTMVKRLSHNKHLMIGNNKTNNSVEVTATLKLQRLLFILRYLTTATFTNKPHITPIPTPR

SEQ ID NO: 24117 - protein, 244 aa, Diabrotica virgifera
  misc_feature: Coding regions on vcDNA: vcDNA=SeqID_3814; Strand=+; Position=164-898
MLSQNMQEEAKLDAMQRHWQILRRGPSSSTAFFEEANETEDLLTLPLQNSHVDAQRGACVPLLKNLSCDLDSDSEFLDLHERCLTPKPSQVPEVQETPVKPSLKLDAAFLGDIPGQYTICAVEPHQLPVVGVYIDPRVVPGFKYRIRPLPEVGRPSTTNKCLFDNKALTLQSIGRGYARRFTFEADENQLNNNENYFWSDNRPEGYAFELELLSEGDKFTFFNPNGEAEGTVEVLSIEVSLFFL

SEQ ID NO: 24118 - protein, 253 aa, Diabrotica virgifera
  misc_feature: Coding regions on vcDNA: vcDNA=SeqID_3815; Strand=+; Position=652-1413
IWKDFYQNHGLEEKEERFSDKRPPKTRQKRCFVSLYNEKFFYSQCYLYLLYSLFQAPQIEIFSSLAKGVIDKKATVTFTGKVEYYETGVAKPVNLTGTVLSRKVKGRSSAEIVKITKVSINKHRCYLLPGIQKIHRRFTVRGKDINDVPTKYTMTGLESFEIPVVGTYVDSRIIPGFCYKVRPNDRKDHLFGGRALKLLSIGMGYAKRLTFQPDSLVEPDNYLWSDNHPDRLGLDQEQYTRVWNSSSKLAKLS

SEQ ID NO: 24119 - protein, 337 aa, Diabrotica virgifera
  misc_feature: Coding regions on vcDNA: vcDNA=SeqID_3816; Strand=+; Position=446-1459
IRKDFYQNHGLEDQEERFSDKRPPKTRQKRCFAPQIEIFSSLAKGVIDKKATVAFTGKVEYYETGVAKPVNLTGTVLSRKVKGRSSAEIVKITKVSINKHRCYLLPGIQKIHRRFTVRGKDINDVPTKYTMTGLESFEIPVVGTYVDSRIIPGFCYKVRPNDRKDHLFGGRALKLLSIGMGYAKRLTFQPDSLVEPDNYLWSDNHPDGLGLEPRAVHKGMEFIVKAGDIVLGEAQVFRDDLPQFEQHMEKIQTPSGVAIQKYIHVDVFCHIRLEATVGASIENDLHLMRISGLAVVRKEPRASEAHVIRVENVGFDSQLALLFTQTYMELTFVPKHY

SEQ ID NO: 24120 - protein, 451 aa, Diabrotica virgifera
  misc_feature: Coding regions on vcDNA: vcDNA=SeqID_3817; Strand=+; Position=2-1357
  misc_feature: Homolog annotation: Hit_ID=NP_499742.1; Match level="QueryCoverage =17%, HitCoverage=7%, E-value=3e-15, Identity=50%"; Hit description =kinesin-like protein (123.1 kD) (klp-19) [Caenorhabditis elegans] emb|CAA16335.1| Hypothetical
  misc_feature: Gene Ontology Annotation: Molecular function=motor activity; Cellular component=kinesin complex; Biological process=embryogenesis and morphogenesis
NINRGLLSIGQVMTALSNNSTFIPYRQSVITSILKDSLNKNNFVSLIACVSPIAEDTTETVQTLEFAQRVKRIKSKPEVNEVISQFRKENPLLFQLKMNTPFKRPLFMNTPKPPKQQKLSIISEPSYSSIITDQSHSPKSLSSSVASSITNTLRSSLDSVSAPQALSPIIRKYMTAMESSLMDKIGSVIQSTLKTESREQVMEKENPRTPGLTWALIKNEVSKIVKSEVAQLTGNEVRATSSPLGEHLDDVRKILNYDISPLAEPGTSTTEYEFKVPELPAEQKSTSFALSPIENIMPRRSMRLSMRRRSRCSISNNNKSSVVDLEVSIESSLSFREDIKLLEQTLIDNIENSVECSTWKPPVAPRRSMRIRKAVNPLQNKLQGKTKMQLNVLNTPAGKRLLKTTQKDSPHTSHTKGVLHTINYGSSREIKVPSVGTKTAQHISPFQGYQR

SEQ ID NO: 24121 - protein, 544 aa, Diabrotica virgifera
  misc_feature: Coding regions on vcDNA: vcDNA=SeqID_3818; Strand=+; Position=94-1728
  misc_feature: Homolog annotation: Hit_ID=NP_610418.1; Match level="QueryCoverage =100%, HitCoverage=100%, E-value=0.0, Identity=71%"; Hit description =CG8258-PA [Drosophila melanogaster] gb|AAF59029.3| CG8258-PA [Drosophila melanogaster]
  misc_feature: Gene Ontology Annotation: Molecular function=chaperone activity; Cellular component=actin filament; Biological process=cell organization and biogenesis
  misc_feature: Pfam annotation: Pfam_ID=Cpn60_TCP1; Match level="Score=601.8, E -value=5.2e-178, Copies=1"; Pfam description=TCP-1/cpn60 chaperonin family
MALHVPKAPGFAQMLKEGARHYSGLEEAVIRNIIACKEFAQSVKTAYGPNGMNKMVINHIEKQFVTSDAATIMRELDIEHPAAKLMILGSQMQDSEVGDGTNFVIILAGALLEHAEELIRLGVTPTEIAEGYEKALDKCLEILPNLICYTIKDFRNIEEVKKGIQTSIQSKQYGNEEFLSKLIAEACVSILPEETTFNVDNVRICKVLGSGLHNSQVVQGMVFKRQVEGEITKAEKAKIAVFSCAVDIMQTETKGTVLIKTADELMNFSRGEENLLELQIKCIADAGAKVVVAGAKFGDMALHYLHKYGMMVVRLNSKFDLRRLCKTVGATCLPRLTAPTSQELGYADIVCVEELGDTPIVSFRLEGKESRISTIVIRGATDNYMDDIERAIDDGVNTFKGISRDGRFVPGAGAVEAELAVQLTKYADTLPGLEKYAVRKFASALESFPKTLADNSGHKSTAVLEKILEAHQNGQKNVGVDIEAESAVCDALEKNILDLYQCKYWGLKYAVGAAATILRVDQIIMAKRAGGPKVRQPKGSDDES

SEQ ID NO: 24122 - protein, 301 aa, Diabrotica virgifera
  misc_feature: Coding regions on vcDNA: vcDNA=SeqID_3819; Strand=+; Position=3-908
  misc_feature: Homolog annotation: Hit_ID=BAA97657.1; Match level="QueryCoverage =97%, HitCoverage=45%, E-value=1e-100, Identity=59%"; Hit description= ecdysteroid-inducible angiotensin-converting enzyme-related gene product [Bombyx mori]
  misc_feature: Gene Ontology Annotation: Molecular function=peptidyl-dipeptidase A activity; Cellular component=integral to membrane; Biological process=proteolysis and peptidolysis
  misc_feature: Pfam annotation: Pfam_ID=Peptidase_M2; Match level="Score=-10.3, E -value=1.3e-14, Copies=1"; Pfam description=Angiotensin-converting enzyme
ELKHVWVEWRKALSKCKADYIPHASLSNQAAKLNNFTDNAELWLLNYEDDTFKDQVQALWEQVKPLYLELHAYVRFKLRQKYGDVVPEKGPIPAHLLGNMWAQTWNNIASFTLPYPDVVDYDITAEMLKQNFTAKKIFETAESFFKSINLTAMPDLFWQRSIIEKPKDREIVCHASAWDFYDGKDFRIKMCTDVNYEDMNTAHHEMGHIEYFLQYRNQPTPYRTGANDGFPEAVGDLISLSFSSTKHLRKIGLITFQKLITMNSFSKNLYKIGFEKIPFLPFGYLIDLWGWGLYLCRKNYS

SEQ ID NO: 24123 - protein, 240 aa, Diabrotica virgifera
  misc_feature: Coding regions on vcDNA: vcDNA=SeqID_3820; Strand=+; Position=1-723
RTRGFSYKYYNSSAIMKFCIISILLCVALSNAEYALEKRSAHYRLIRDISSSNRNRFLVNSRSDIIENCKRNGITAEARTKLEEAFDEVESCAGKKNIYAVPEAEFTQNINDCSKEVVRLSKACLKESQSYFPDLLISMRNSVTHFLYANKDVLRSDEVQQCYKKVESSRAVSKYRQCVEAAAVGVDKVELPHSKAEACRVLVGVSKCFPKLFTDQCDASANLDKFLKIYDESISGPCAA

SEQ ID NO: 24124 - protein, 218 aa, Diabrotica virgifera
  misc_feature: Coding regions on vcDNA: vcDNA=SeqID_3821; Strand=+; Position=75-731
  misc_feature: Homolog annotation: Hit_ID=P29522; Match level="QueryCoverage=100%, HitCoverage=100%, E-value=4e-84, Identity=71%"; Hit description =Elongation factor 1-beta' pir||S35514 translation elongation factor eEF-1 beta chain -
  misc_feature: Gene Ontology Annotation: Molecular function=translation elongation factor activity; Cellular component=eukaryotic translation elongation factor 1 complex; Biological process=translational elongation
  misc_feature: Pfam annotation: Pfam_ID=EF1_GNE; Match level="Score=182.7, E-value =7.6e-52, Copies=1"; Pfam description=EF-1 guanine nucleotide exchange doma
MAFGDLKTEKGVKELNSFLEDKSYVGGYILSQADVNAFNQLPKAPAANLPHALRWYNHIKSFSADELKQAGVSGNPLKSAPTTTAPAKDDDDDDVDLFASDEEEDAEAAKVREERLKAYAEKKSKKPELIAKSSIVLDVKPWDDETDMKELEKVTRTIEMDGLIWGASKLMPVGYGINKLQIMCVVEDAKVSIDELVEKIQEFEDYVQSVDIAAFNKI

SEQ ID NO: 24125 - protein, 266 aa, Diabrotica virgifera
  misc_feature: Coding regions on vcDNA: vcDNA=SeqID_3822; Strand=+; Position=20-820
  misc_feature: Homolog annotation: Hit_ID=AAR84629.1; Match level="QueryCoverage =98%, HitCoverage=97%, E-value=1e-70, Identity=48%"; Hit description =putative alcohol dehydrogenase [Gryllotalpa orientalis]
  misc_feature: Gene Ontology Annotation: Molecular function=electron transporter activity; Cellular component=cellular_component unknown; Biological process=biological_process unknown
  misc_feature: Pfam annotation: Pfam_ID=adh_short; Match level="Score=162.2, E-value= 1.1e-45, Copies=1"; Pfam description=short chain dehydrogenase
MVFDVQGRSAVITGGAQGIGLSIAVELLKSGLKGVVLADIESQLGNEAITKLSNQFGSNKAVFLKTDVTKADQLEAAFKLAVSTFGAVDIVVNNAGMLKDSQWELEIAVNCNAVVQGSLLGIKYMGKNNGHKGGVIVNVASIYGFQEVEAAPVYGATKHFVVGLNKCFGAKYYYDLTGIKFLTMCPGITDTTLVNESAGFTFQGFPNLGKMLSEGLASMPQQTPEYVGQGTVTAITKGEHGSIWVSEGKEPAYELDVPDRRTMRKH

SEQ ID NO: 24126 - protein, 294 aa, Diabrotica virgifera
  misc_feature: Coding regions on vcDNA: vcDNA=SeqID_3823; Strand=+; Position=17-901
MGVSILLFLVTVTFICVNSQLQQYQYALPDYSLQNVEPNYNQLLQQQVPYYLQAPQEQTYYPVSQQQPVYPTNGLSNVYPTNGQGVYYPYPYQYAVPDQPQFTSEQLQQIALQQLPQSLVLPQQIGNAKNNTEPQPVAVKTEQPNSFANVKTEIIDLNPQDFRRVMQRLNARPIIVSYERRVVGSGSGRPHYTVTTNSKQTNETDVPKSIETYKTTSKVYSFNKTFVLHPTDGQKVVNLHFVNGEQVSDSPESDESETTTIGTTEAPTTTTESENPDLLISGFRYSLLTSIKQS

SEQ ID NO: 24127 - protein, 254 aa, Diabrotica virgifera
  misc_feature: Coding regions on vcDNA: vcDNA=SeqID_3824; Strand=+; Position=21-785
MGVSILLFLVTITFICVNSQLQQYQYALPDYSLQNVEPNYNQLLQQQVPYYLQAPQEQTYYPVSQQQPVYPTNGLSNVYPTNGQGVYYPYPYQYAVPDQPQFTPEQLQQIALQQLPQSLVLPQQIGNAKNNTEPQPVAVKTEQPNSFANVKTEIIDLNPQDFRRVMQRLNARPIIVSYERRVVGSGSGRPHYTVTTNSKQTNETDVPKSIETYKTTSKINNTTPAPQQKFGKTIYGRTWRMSRGDAIFCYRRMF

SEQ ID NO: 24128 - protein, 271 aa, Diabrotica virgifera
  misc_feature: Coding regions on vcDNA: vcDNA=SeqID_3825; Strand=-; Position=115-930
  misc_feature: Homolog annotation: Hit_ID=AAV34835.1; Match level="QueryCoverage =98%, HitCoverage=99%, E-value=2e-82, Identity=51%"; Hit description =ribosomal protein L23A [Bombyx mori]
  misc_feature: Gene Ontology Annotation: Molecular function=structural constituent of ribosome; Cellular component=cytosolic large ribosomal subunit (sensu Eukarya); Biological process=ribosomal large subunit assembly and maintenance
  misc_feature: Pfam annotation: Pfam_ID=Ribosomal_L23; Match level="Score=100.1, E -value=5.7e-27, Copies=1"; Pfam description=Ribosomal protein L23
ILIPAAGAAGASSSSSKTPAPAPKAAAKAASKPADKKASSSKTPAPAPKAASAKSSAKAQAAAPKPKAAAAKAGKAAGKGAAKPAAKAAGKKPAAAGKAKAPATLIAKPKKNVPVKQQQKGVGKKPAASAVQVARALKIQKKVIKGPNGTHSRKIRNSVHFRRPKTLRPPRSPKYPKRSVPHRSRMDAYNIIKFPLTTEAAMKKIEDNNTLVFLVHTRANKHHIKAAVKKLYDINVAKVNTLIRPDGKKKAYVRLARDYDALDVANKIGII

SEQ ID NO: 24129 - protein, 257 aa, Diabrotica virgifera
  misc_feature: Coding regions on vcDNA: vcDNA=SeqID_3826; Strand=+; Position=244-1014
  misc_feature: Homolog annotation: Hit_ID=NP_612103.1; Match level="QueryCoverage =100%, HitCoverage=39%, E-value=4e-88, Identity=66%"; Hit description= CG9165-PA [Drosophila melanogaster] gb|AAF47484.1| CG9165-PA [Drosophila melanogaster]
  misc_feature: Gene Ontology Annotation: Molecular function=hydroxymethylbilane synthase activity; Cellular component=cellular_component unknown; Biological process=heme biosynthesis
  misc_feature: Pfam annotation: Pfam_ID=Porphobil_deam; Match level="Score=416.3, E -value=3.7e-122, Copies=1"; Pfam description=Porphobilinogen deaminase, dipyrometh
MSGDHKVIRVGSRKSELALIQTRHVISLLKDCFPDKEFEIVTMSTLGDKVLDIALPKIGEKSLFTKELETALATDCVDFVVHSLKDLPTCLPLGMAIGAVLTREDPRDALVLRKGLTGLSLETLPENSIIGTSSLRRTAQLAKKYPHLIVENIRGNLNTRLKKLDDLEHYQAIILAAAGLKRIGWEERISKILIEDDLLYAVGQGALAVECRADNEEIINLLQPLYDLETALQVAAEREFLKTLGGGCSAPVAVGSN

SEQ ID NO: 24130 - protein, 99 aa, Diabrotica virgifera
  misc_feature: Coding regions on vcDNA: vcDNA=SeqID_3827; Strand=-; Position=1087 -1386
VHNPQNLDCTNQLFKIFKYIDIMSVFDVTYLVKHVARFKNGRWTKNILERRPRHDAYRNRGRPPLQQSSRTTSDIQDNLIEGAQYGMQWNYLREMMMMI

SEQ ID NO: 24131 - protein, 288 aa, Diabrotica virgifera
  misc_feature: Coding regions on vcDNA: vcDNA=SeqID_3828; Strand=+; Position=414-1280
MKILGKILVILFIGYSNTQNNDFNRFDTQGIDFANLDRRINGIEENPPNTQGLNFKPYESFDIKQFDNSVTFDGRRFWEDVPTDPDAYLAYLHRECDKSGHPEILNMDNEVYRQAKVCLGSRADYIKTTVRQFFNESGLSAIRQIDYKEACKVWPEVHNCINPLVSSIKQCLKSDVQKIFDTFLEFIDVSQSFFCDNNADRISSLVSDGSVQCFSLVDKDLKECQTNFKKKLGDSINAINIWGDVDSYKVMTGKNLADETCSTFKSYRNCITSKLAKCKSKYTSKNCR

SEQ ID NO: 24132 - protein, 255 aa, Diabrotica virgifera
  misc_feature: Coding regions on vcDNA: vcDNA=SeqID_3829; Strand=+; Position=82-846
MKQTIKISQTIIDRLGRTPNSCDGNLYGISHQNDLFILVLQADSENEIDFSSFLPTGIELCGRFQKAEITDLNIQIPAQSVLVTSSIGKENNVNLYQEQNGKLNKSEYQIITEQEINSTFLFIRLKGEVVLKSEFTVQALKDAFQIIKKSLPLDSVFGLLKSNLFLQEHGTINAESNSAINEFYEDVNGANDEGSRKKNKVVSIKPRVLDFNYLQQLTRDKSIDSIKEHAISNKNPLTIIDTLLPLCISMVHEQT

SEQ ID NO: 24133 - protein, 477 aa, Diabrotica virgifera
  misc_feature: Coding regions on vcDNA: vcDNA=SeqID_3830; Strand=+; Position=194-1626
  misc_feature: Homolog annotation: Hit_ID=CAH64510.1; Match level="QueryCoverage =99%, HitCoverage=99%, E-value=1e-120, Identity=44%"; Hit description= putative esterase [Tribolium castaneum]
  misc_feature: Gene Ontology Annotation: Molecular function=carboxylesterase activity; Cellular component=synaptic junction
  misc_feature: Pfam annotation: Pfam_ID=COesterase; Match level="Score=473.3, E -value=2.5e-139, Copies=1"; Pfam description=Carboxylesterase
  misc_feature (376)..(376): Xaa can be any naturally occurring amino acid
  misc_feature (454)..(454): Xaa can be any naturally occurring amino acid
  misc_feature (465)..(465): Xaa can be any naturally occurring amino acid
MSGPIVTVKEGKLLGIQEKDDDGNQYYSFLGIPYAKPPIGELRFKAPQPPEKWEGIRDATQEGDECFSKQFQAYTGSEDCLILNVFTKEISSSKLRPVMFWIHGGGFTKGSNTLKLYGPDYLLREDIVLVTINYRLGPLGFMAFKDPDVGVPGNAGFKDAVMALRWVQNNIKQFSGDPNNVTIFGESAGAVAVHLLVLSPMAKGLFHKAILQSGCATSCWGTMNRIEPNLFAERAGIHSNDDNVILKHLQNMTLEELEATMEKTPELYPVGTLFPNGPVVETNSKEPAFLPSDPRDIVKSGNYNKVPMMMGCVSREGMFIYSIVAQENLVLVHETLLPRTLNLRIGSNLHTQAANKVKKFYFGDNDPLEDRDKIYXGVSHADDCGYLFKTHFVTEIEKDSPEDKAIRRTVRLWTNFAKFGKPTVNKDDQILPVDWLPISKDKFRVYDIGRKKVXYTIVIPRLELXQFWDEMHTINPF

SEQ ID NO: 24134 - protein, 252 aa, Diabrotica virgifera
  misc_feature: Coding regions on vcDNA: vcDNA=SeqID_3831; Strand=+; Position=20-778
  misc_feature: Homolog annotation: Hit_ID=NP_647734.1; Match level="QueryCoverage =36%, HitCoverage=42%, E-value=4e-17, Identity=51%"; Hit description =CG14949-PA [Drosophila melanogaster] gb|AAF47671.1| CG14949-PA [Drosophila melanogaster]
MLRLSFLFVALLILSAELDSAVLKDDFDYIPDRPQDPKEVTSSSSVDPLSPENGEIDILEGNLTDFNGTGKDLFVIKTVVYEIGILTDVGNDTNFDNETHEQIDVSFFDPTHNGSIIDLSQIPIPIQTNVSGVSITGLLPANFGDLNLLKNGTPTVQGSHFPLFPNKQVRVTHNVSTSDRDRTNDVLSGLPELLGLKDFIKYDSSSEESKDQSSGESKDSGESKEKKHKKYKESSDSSESNESKEDDKEKKH

SEQ ID NO: 24135 - protein, 258 aa, Diabrotica virgifera
  misc_feature: Coding regions on vcDNA: vcDNA=SeqID_3832; Strand=+; Position=18-794
  misc_feature: Homolog annotation: Hit_ID=NP_647734.1; Match level="QueryCoverage =36%, HitCoverage=42%, E-value=5e-17, Identity=50%"; Hit description =CG14949-PA [Drosophila melanogaster] gb|AAF47671.1| CG14949-PA [Drosophila melanogaster]
MLRLSFLFVALLIFSTVLDAAVLKDDFDYIPDRPQDPKGPQDPKEVTSSSSVDPLSPENGEIDILEGNLTDFNGTGKDLFVIKTVVYEIGILTDIGNDTNFDNETHEQIDVSFFDPAHNGSIIDLSQIPIPIQTNVSGVSITGLLPANFGDLNLLKNGTPTVQGSHFPLFPNKQVRVTHNVSTSDRDRTNDVLSGLPELLGLKDFIKYDSSSEESKDQSSGESKDSGESKEKRHKKHKESNDSSESKESKEDDKEKKH

SEQ ID NO: 24136 - protein, 66 aa, Diabrotica virgifera
  misc_feature: Coding regions on vcDNA: vcDNA=SeqID_3833; Strand=+; Position=271-468
IRIRQTVYFYVAPTNQVKLLKSSQFQVPFSFFFCFSIYTVYSTNIGLFWVVATANILVCNIRSTKV

SEQ ID NO: 24137 - protein, 171 aa, Diabrotica virgifera
  misc_feature: Coding regions on vcDNA: vcDNA=SeqID_3834; Strand=+; Position=118-633
  misc_feature: Homolog annotation: Hit_ID=P11418; Match level="QueryCoverage=81%, HitCoverage=92%, E-value=6e-44, Identity=58%"; Hit description =Superoxide dismutase [Cu-Zn] pir||S04623 superoxide dismutase (EC 1.15.1.1) (Cu-Zn) - blue
  misc_feature: Gene Ontology Annotation: Molecular function=copper, zinc superoxide dismutase activity; Cellular component=cytoplasm; Biological process= neurogenesis
  misc_feature: Pfam annotation: Pfam_ID=Sod_Cu; Match level="Score=243.4, E-value =4.1e-70, Copies=1"; Pfam description=Copper/zinc superoxide dismutase (SOD
MFKIALCAAILAIAYAEDGIVYLMDPTGKSGVTGTVRFLKLPSGINVIGDIRGLTPGKHGFHIHQEGNIQPSCLAAGGHFNPFNKQHGGPDDADRHVGDLGNIEADQNGVAVFDFLDNKISFDGPTNMIGRSVVVHEKVDDLGKGGHPDSLKTGNAGGRLACGVVGVVTVK

SEQ ID NO: 24138 - protein, 69 aa, Diabrotica virgifera
  misc_feature: Coding regions on vcDNA: vcDNA=SeqID_3835; Strand=-; Position=264-473
KGLYRHMEKEHVVLSPSVSVNNSVLFIDYLPMMYPYLYVCIRFVQGANLLNVLYLFCTGDFLRGQVLSL

SEQ ID NO: 24139 - protein, 280 aa, Diabrotica virgifera
  misc_feature: Coding regions on vcDNA: vcDNA=SeqID_3836; Strand=+; Position=25-867
  misc_feature: Homolog annotation: Hit_ID=AAD09328.1; Match level="QueryCoverage =65%, HitCoverage=40%, E-value=4e-09, Identity=27%"; Hit description =virulent strain associated lipoprotein [Borrelia burgdorferi]
MEDPLSFGFKQLKVSVLNKLDHINSSTNGYVPTEKPSRKNQVGIPVPKDNLKKSSPQSNQSEIQFQSLMDVFEHNRRQEVINKVQARLKKFEDFTVQQELNKKEQWFKKQQEFIEDLQQQENNINQALQEYDKNSSHSQAQLALYYKDLELKRQVQENEIKRREYEKQLLYKCIDKIKKLQPEFSSLYEKILKTIKRCQKIEDLKAQHAEDFQLLNSLPSSFDVIIKSCKNAKVTDDDVKNAQDMFIQLQNIERKINETVDSINKTHEHESIPKPTPFAS

SEQ ID NO: 24140 - protein, 480 aa, Diabrotica virgifera
  misc_feature: Coding regions on vcDNA: vcDNA=SeqID_3837; Strand=-; Position=806-2248
  misc_feature: Homolog annotation: Hit_ID=XP_319018.1; Match level="QueryCoverage =99%, HitCoverage=92%, E-value=1e-132, Identity=50%"; Hit description= ENSANGP00000014757 [Anopheles gambiae]
  misc_feature: Gene Ontology Annotation: Molecular function=hydrogen:amino acid symporter activity; Cellular component=plasma membrane; Biological process=alanine transport
  misc_feature: Pfam annotation: Pfam_ID=Aa_trans; Match level="Score=214.1, E-value =2.6e-61, Copies=1"; Pfam description=Transmembrane amino acid transporter
MSGYDNQGFAGDGTYGNHNEYPGTETNKNQLARHSKDNGFFTVELNDRKKSLEAGEYDPYRWRDVEHPTTDTETFLHLLKGSLGTGILAMPMAFYHSGYLLGAVGTAIIGFLCTHCIHLLIRAEYELCKRRKVAVMSYPETALAGFQEGPPFQRRIAFIAPHMVNIFLLIYQLGSGAVYTIFIGDNISGVFAAHGITVNVKLVMLAALLPLILINCVKNLKYLAPLSTFANIITMVSFGIIAYYMFSRDFTFDGKEPFGEVKNYPLFFGTVLFALEAIGVIMPLENEMKTPQNFGSPFGVLNKGMVVITILYTSMGFFGYIAYGSSVQGSISLSIGDDIPGQICRILLSMSIYVTHGLQLYPAIKTVWDIYLLPLLTGSNHLVLLEYVTRVFLVTFCFVLAVAVPYIDLFISLFGALTLSGLGLFIPAMVDMGTYWHQRTGKTRIFTMIKNCLIILLGFFGLIVGTSTSLNEIINKFSNE

SEQ ID NO: 24141 - protein, 243 aa, Diabrotica virgifera
  misc_feature: Coding regions on vcDNA: vcDNA=SeqID_3838; Strand=+; Position=231-959
  misc_feature: Homolog annotation: Hit_ID=XP_395263.1; Match level="QueryCoverage =95%, HitCoverage=49%, E-value=1e-103, Identity=77%"; Hit description= similar to ENSANGP00000022109 [Apis mellifera]
  misc_feature: Gene Ontology Annotation: Molecular function=glycine hydroxymethyltransferase activity; Cellular component=cytosol; Biological process=serine catabolism
  misc_feature: Pfam annotation: Pfam_ID=SHMT; Match level="Score=279.7, E-value=4.8e- 81, Copies=1"; Pfam description=Serine hydroxymethyltransferase
MANADISKTLNANLWDSDPELWDIIKKEKRRQITGIELIASENFTTLSVLQCLSTCLHNKYSEGLPGERYYGGNEYIDEIERLAQKRSLEAFNLDPEQWGVNVQPYSGSPTNFAVYTAVAEPHGRIMGLDLPDGGHLTHGFYTPSKKVSATSLFFESLPYKVNPETGLIDYDKLQESARLFKPKIIVAGTSCYSRPLDYKRFKEICDEVGAYLMSDMAHIFWFSWQPGVTPSPFGYSDIVTTT

SEQ ID NO: 24142 - protein, 500 aa, Diabrotica virgifera
  misc_feature: Coding regions on vcDNA: vcDNA=SeqID_3839; Strand=+; Position=152-1654
  misc_feature: Homolog annotation: Hit_ID=XP_318298.1; Match level="QueryCoverage =95%, HitCoverage=83%, E-value=0.0, Identity=69%"; Hit description =ENSANGP00000022109 [Anopheles gambiae]
  misc_feature: Gene Ontology Annotation: Molecular function=glycine hydroxymethyltransferase activity; Cellular component=cytosol; Biological process=serine catabolism
  misc_feature: Pfam annotation: Pfam_ID=SHMT; Match level="Score=918.0, E-value=3.3e- 273, Copies=1"; Pfam description=Serine hydroxymethyltransferase
MKSVKIFFQPQVQKVLFTQLVPRSFSTATNRMANADISKTLNANLWDSDPELWDIIKKEKRRQITGIELIASENFTTLSVLQCLSTCLHNKYSEGLPGERYYGGNEYIDEIERLAQKRSLEAFNLDPEQWGVNVQPYSGSPTNFAVYTAVAEPHGRIMGLDLPDGGHLTHGFYTPSKKVSATSLFFESLPYKVNPETGLIDYDKLQESARLFKPKIIVAGTSCYSRPLDYKRFKEICDEVGAYLMSDMAHISGLVAAGVTPSPFEYSDIVTTTTHKSLRGPRAGVIFFRKGVRKVTPKGEKIMYDLENKINQAVFPGLQGGPHNNSIAGIATSMKASKTPEFVAYAKQIVANAKRLSDGLQSKGYKVVTGGTDLHVLLVDLRSAGLTGSKGEYVLEEVNIACNKNTVPGDKSAFNPSGIRLGTPAMTTRNMKEKDIDQVVDFIDRALKIAKEATALSGPKLADFKKVIHENADISKKVATLKDEINRYSEKFPLPGYPEY

SEQ ID NO: 24143 - protein, 304 aa, Diabrotica virgifera
  misc_feature: Coding regions on vcDNA: vcDNA=SeqID_3840; Strand=+; Position=66-977
  misc_feature: Homolog annotation: Hit_ID=XP_392593.1; Match level="QueryCoverage =100%, HitCoverage=97%, E-value=1e-85, Identity=38%"; Hit description= similar to annexin B13b [Apis mellifera]
  misc_feature: Gene Ontology Annotation: Molecular function=protein binding; Cellular component=nuclear membrane; Biological process=skeletal development
  misc_feature: Pfam annotation: Pfam_ID=Annexin; Match level="Score=338.4, E-value =1e-98, Copies=4"; Pfam description=Annexin
MAPTVVPYPDFNAEEDAKALKQAFKGFGTDEEAVIEIITKRSNEQRREIAITFKTMYGKDLIKELKSELRGNFEDAIVALMTEPIEFQAKQLHKAISGLGTDESTIVEILSVHNNDEIIRISQAYEGLYQRSLESDIKGDTSGTLKRLLVGLSTGCRDESGVLDEESAFKDAQSLLQAGELLFAGTEESVFNAVFCQRNKPQLNLIFDKYEEIVGHPIEKAIENEFSGNAKQAMLHLIQSVRDQVAYLVTRLHDSMAGVGTDDRTLIRIVVSRSEIDLEEIKQCYEEIYSKTLADRIADDTSGD

SEQ ID NO: 24144 - protein, 316 aa, Diabrotica virgifera
  misc_feature: Coding regions on vcDNA: vcDNA=SeqID_3841; Strand=+; Position=8-954
  misc_feature: Homolog annotation: Hit_ID=CAH64510.1; Match level="QueryCoverage =99%, HitCoverage=59%, E-value=2e-84, Identity=51%"; Hit description =putative esterase [Tribolium castaneum]
  misc_feature: Gene Ontology Annotation: Molecular function=carboxylesterase activity; Cellular component=synaptic junction
  misc_feature: Pfam annotation: Pfam_ID=COesterase; Match level="Score=146.4, E -value=6.6e-41, Copies=1"; Pfam description=Carboxylesterase
  misc_feature (297)..(297): Xaa can be any naturally occurring amino acid
  misc_feature (305)..(305): Xaa can be any naturally occurring amino acid
  misc_feature (307)..(307): Xaa can be any naturally occurring amino acid
MESPVITVTEGQLRGYRRKNLDGKEFYAFLGVPYAKPPVGELRYQAPEPAEKWNGVRDATEDGQPSYQWDGQNNKLIGSEDCLHLGIHTKTLPSEDSCLKPVMVWIHGGGFAFGSNSSTEYGPEYLMLEDIVLVSVNYRLGFLGCLHFEDTSLNVPGNALLKDQQLALKWIQKNIHNFNGDPNNVTIFGESAGGASVHYHVLSPSSKGLFHKAVLQSGVTCCPWARVTELNVGLQFAQIVDQHIQTEREALKMLRSLTAEELFEAQRKFIAKYGRQLKIAPKIEKPNDSAIITSLSXDIIVKGQXHXVPLMIGFIL

SEQ ID NO: 24145 - protein, 147 aa, Diabrotica virgifera
  misc_feature: Coding regions on vcDNA: vcDNA=SeqID_3842; Strand=+; Position=917-1360
  misc_feature: Homolog annotation: Hit_ID=XP_315724.1; Match level="QueryCoverage =95%, HitCoverage=48%, E-value=6e-49, Identity=53%"; Hit description =ENSANGP00000015902 [Anopheles gambiae]
  misc_feature: Gene Ontology Annotation: Molecular function=integrin binding; Cellular component=soluble fraction; Biological process=cell-matrix adhesion
  misc_feature: Pfam annotation: Pfam_ID=EGF; Match level="Score=55.1, E-value=2e-13, Copies=3"; Pfam description=EGF-like domain
MEQAKDKDLKKNEHNVRDIDECKTNNGGCERECVNQIGSYSCKCPTGLTIAEDRKSCQDINECLLRNGHGPCQDTCRNTFGSYNCSCVGLKGTKLGIDGHSCEDIDECKNNNGGCSHNCINALGRSFCSCPDGMELSSDWKTCQDIK

SEQ ID NO: 24146 - protein, 226 aa, Diabrotica virgifera
  misc_feature: Coding regions on vcDNA: vcDNA=SeqID_3843; Strand=+; Position=24-704
  misc_feature: Homolog annotation: Hit_ID=NP_499028.1; Match level="QueryCoverage =80%, HitCoverage=17%, E-value=6e-15, Identity=27%"; Hit description =NHL domain containing (109.1 kD) (nhl-1) [Caenorhabditis elegans] emb|CAA79562.1| Hypothetical
  misc_feature: Pfam annotation: Pfam_ID=zf-C3HC4; Match level="Score=38.3, E-value =2.2e-08, Copies=1"; Pfam description=Zinc finger, C3HC4 type (RING finger)
MSNFKKVVKRAESSRVQKGNSRAARPNSLISENRNAGIKDGSLAVLEELVQCGICLEKMKEPRMLTCQHTFCKSCLKNLVTAKNLVLKSGPSSKVTLSSELKNAKCPVCQTEIVLRNGLESLEELPKNFHIETLLKLLEGDPTVPTPVVKAPADYRCVKCQTICEEQAHVCQHCMQVYCSICWIDHMAELDSNLSLLIKQVEESRDRLNHKAQNFSGRCDQLERNN

SEQ ID NO: 24147 - protein, 216 aa, Diabrotica virgifera
  misc_feature: Coding regions on vcDNA: vcDNA=SeqID_3844; Strand=+; Position=123-773
  misc_feature: Homolog annotation: Hit_ID=XP_393316.1; Match level="QueryCoverage =98%, HitCoverage=13%, E-value=6e-65, Identity=53%"; Hit description =similar to CG8213-PA [Apis mellifera]
MKSILVFSILCLVGQKVNAWGGLFNRFSPEMLANMGYGGHGGGGGLMRNDGDENALEEPLGEGGDDDPCYMKACSANEYCCPNQICVDVDGIHGTCLYFFGRRVGELCRRDNDCESGLVCAEAQAGVSTRVCRPPLRQDKQYSEPCNMSSECDISRGLCCQLQRRHRQAPRRVCSYFKDPLVCVGPVAADQVKNTIEHTAGEKRLTSLGSFKRPMH

SEQ ID NO: 24148 - protein, 334 aa, Diabrotica virgifera
  misc_feature: Coding regions on vcDNA: vcDNA=SeqID_3845; Strand=+; Position=3-1004
  misc_feature: Homolog annotation: Hit_ID=XP_392386.1; Match level="QueryCoverage =100%, HitCoverage=76%, E-value=4e-69, Identity=41%"; Hit description= glucose oxidase [Apis mellifera]
  misc_feature: Pfam annotation: Pfam_ID=GMC_oxred_N; Match level="Score=-50.3, E -value=2e-08, Copies=1"; Pfam description=GMC oxidoreductase
  misc_feature (293)..(293): Xaa can be any naturally occurring amino acid
  misc_feature (298)..(298): Xaa can be any naturally occurring amino acid
  misc_feature (300)..(300): Xaa can be any naturally occurring amino acid
  misc_feature (306)..(306): Xaa can be any naturally occurring amino acid
YLHDIAKAVVEGAAEAGFPISKDLNGKDYTGFANPQSYVKDGSRVSMAKAFLRPQRNNPNLHVMLNSTATRILFDGNKTAYAVEFVYNNQTFTVKANKEIILSAGTMNSPKILLQSGVGPKDALDAVGIEQIHNLPGVGQNLSNHVAFSMNYWVNSTVDTRIITWQTLQDYILRRTGPLASSGLAVTSRLPSKYATADDPDIQMFFTVSQTTCSPDGEVDEPIDPTDPQKPQHVSISAVNLHTKSRGRITLKSNDPLAPPHMVGNYLTVKEDQDRLIDAIRLVQKLYSSPTLXRQWQXVXENVTHXTCADQYTFDSDDYWRCAIPLHTGPENHQ

SEQ ID NO: 24149 - protein, 613 aa, Diabrotica virgifera
  misc_feature: Coding regions on vcDNA: vcDNA=SeqID_3846; Strand=+; Position=36-1877
  misc_feature: Homolog annotation: Hit_ID=XP_312382.1; Match level="QueryCoverage =99%, HitCoverage=97%, E-value=1e-132, Identity=43%"; Hit description= ENSANGP00000012169 [Anopheles gambiae]
  misc_feature: Pfam annotation: Pfam_ID=GMC_oxred_N; Match level="Score=325.9, E -value=5.9e-95, Copies=1"; Pfam description=GMC oxidoreductase
MADCGCINPGYYGPYLGNNCGAGSFIVFMSLVDAIIRNTCDISDVCGRVQPIEEPDSSYDFIVIGGGSGGSAVTGRLAEHKKSRVLLIEAGVDEPETYQVPGLILKYYNNPIVDWSYRTSDEPVACRATNGSCNCLRAKMLGGCSSINGMMFTRGTPPDFDKRWSGEGIKGWTWNDVLPFFRKFEHNLQPSEYDSHYHGYSGPVAVSDQYYVHDISKSILKGAAEAGFPISKDINGKDYTGFANSQSYIKDGVRVSMAKAYLRPQRNNPHLHVMLNSTVTRILFDGHKKAYAVEFLYNNQTFTVKAKKEIILAAGTINSPKLLLQSGVGPKDALDAVGIKQIHNLPGVGQNLTNHVSFKVNYWINSTVDTRIITWKSLEDYLNDRTGPLSTIGITVTCRLPSKYTTADDPDIQMFFSLSQNTCSPDGAVDEPVDPTNPQKPQHVAISVVNLHTKSRGRITLKSKDPLAPPHLVGNYLTVKEDEDRIIDGIRLAQRLVNSTTLKDTVQFVFDNVTQGTCADQYTWDSDDYWRCAIRYNTFAENHQSSTLRMGSTDDEWSVVDEELRVIGLHNLRVADASAMPVVTSSNTNAPIVMLAERCADFIHHRWGHYGKN

SEQ ID NO: 24150 - protein, 247 aa, Diabrotica virgifera
  misc_feature: Coding regions on vcDNA: vcDNA=SeqID_3847; Strand=+; Position=55-795
  misc_feature: Homolog annotation: Hit_ID=XP_313477.1; Match level="QueryCoverage =91%, HitCoverage=28%, E-value=2e-19, Identity=29%"; Hit description =ENSANGP00000021233 [Anopheles gambiae]
  misc_feature: Gene Ontology Annotation: Molecular function=aminopeptidase activity; Cellular component=integral to plasma membrane; Biological process =cell-cell signaling
  misc_feature: Pfam annotation: Pfam_ID=Peptidase_M1; Match level="Score=-133.7, E -value=4.8e-05, Copies=1"; Pfam description=Peptidase family M1
MAIKTNLFNTFLVPLIFFGAAVIIITDAVDTTLLKHISPTMYTLWLNIPSAYDENYSGTVNIVFTATETSEYILLHSSEEHIAISKIYLNGDTKRPCRWKYVQNSLDLLNITCNSHVEIKEANSLSIDYKAKLSARYDGGLYNITYDDNNLKQIAIFSQLYPTFARRVFPCFDEPNFKSVFHIFISYPGTFEIIGNTPIVGKVHTSDGITTQFDETPIMSTQSLGFFISNFAQITTTDQEYTYSIFT

SEQ ID NO: 24151 - protein, 244 aa, Diabrotica virgifera
  misc_feature: Coding regions on vcDNA: vcDNA=SeqID_3848; Strand=+; Position=146-877
  misc_feature: Homolog annotation: Hit_ID=XP_509995.1; Match level="QueryCoverage =81%, HitCoverage=49%, E-value=2e-15, Identity=26%"; Hit description =PREDICTED: similar to small nuclear RNA activating complex, polypeptide 1, 43kDa [Pan
  misc_feature: Gene Ontology Annotation: Biological process=transcription from Pol II promoter
MEQNARLPMYTLDKELASAFQIDCEDLLNEFESYQSFRIQDFQKVWHNQKFSYVFAGQTYALLLKDFCENCFYIVKKFIYFPRTLYTQVGAFYLLAILYYKQPVRTWVKIRLTSEEYEKIHGLILEMVNKKVYEPVYMFSKLKADEAFTYVCQRKPLGPEDRFVKDFHLYINDTFVASKTSSALTKFKNSFGSTDMLFNKLKETSTEYSQLMHKFAEKCPDITPFSNLVRDITANLLLSSDKKP

SEQ ID NO: 24152 - protein, 222 aa, Diabrotica virgifera
  misc_feature: Coding regions on vcDNA: vcDNA=SeqID_3849; Strand=+; Position=42-710
  misc_feature: Homolog annotation: Hit_ID=NP_651619.1; Match level="QueryCoverage =96%, HitCoverage=68%, E-value=3e-23, Identity=32%"; Hit description =CG14064-PA [Drosophila melanogaster] gb|AAF56790.3| CG14064-PA [Drosophila melanogaster]
  misc_feature: Gene Ontology Annotation: Biological process=defasciculation of motor neuron
  misc_feature: Pfam annotation: Pfam_ID=ig; Match level="Score=25.6, E-value =0.00015, Copies=2"; Pfam description=Immunoglobulin domain
MLTYVFGIAIVLLSSTDCEASDDHTVNVSLPRYVEVGKNVTLHCDYSPDNNIYSVKWYMGQYEIFRWIPNDVPHKQVFPLNGVSVDINNSSGNILVLNNLQTIATGRYICEVTWEAPLFQSINRGKLMFVIEKPKGEPVLTVDNDKVSCTSPPVHPRPSIIWFLNGVQTMGTPPRTKQNDRQLKNFFSLFTVGNETSTHDHANLTCVVQIGDIYRAQKSIIL

SEQ ID NO: 24153 - protein, 330 aa, Diabrotica virgifera
  misc_feature: Coding regions on vcDNA: vcDNA=SeqID_3850; Strand=+; Position=180-1172
  misc_feature: Homolog annotation: Hit_ID=XP_319591.1; Match level="QueryCoverage =99%, HitCoverage=91%, E-value=1e-123, Identity=68%"; Hit description= ENSANGP00000016770 [Anopheles gambiae]
  misc_feature: Gene Ontology Annotation: Molecular function=electron transporter activity; Cellular component=cellular_component unknown; Biological process=brain development
  misc_feature: Pfam annotation: Pfam_ID=2-Hacid_dh_C; Match level="Score=163.1, E -value=6.2e-46, Copies=1"; Pfam description=D-isomer specific 2 -hydroxyacid dehyd
MDIKTVLVADAVDAACVELLKKYSIQVVCKYKLPKEQLIAEIATYDALIVRSDTKVTAEVIQAGKNLKVIGRAGAGVDNIDIPAATAKNIIVLNTPGGNAISACELTCSLITTLARNVVPAAASLKAGRWDRKLYSGHELYGKTLGILGLGRIGKEVAIRMQAWGMTTIGYDPIVPASEAKKFNVEALELEQIWPRVDYITVHTPLIPETRNLICEAVLNKCKKGVKIVNVARGGIINESDLLKALKSGQCGGAALDVFEQEPPKDPVTLDLIQHEKVVATPHLGASTDEAQVRVAVEISEQIIALTGRSKEYTSTPGVVNRSVLVNLSK

SEQ ID NO: 24154 - protein, 292 aa, Diabrotica virgifera
  misc_feature: Coding regions on vcDNA: vcDNA=SeqID_3851; Strand=+; Position=3-880
  misc_feature: Homolog annotation: Hit_ID=EAL27994.1; Match level="QueryCoverage =98%, HitCoverage=54%, E-value=2e-59, Identity=43%"; Hit description =GA21905-PA [Drosophila pseudoobscura]
  misc_feature: Gene Ontology Annotation: Cellular component=nucleus; Biological process=DNA repair
  misc_feature (223)..(223): Xaa can be any naturally occurring amino acid
  misc_feature (268)..(268): Xaa can be any naturally occurring amino acid
GELTTVGRSVETKVDDVYVSKEQIECIADTDSCTVKVKPVGKSICGVDGYAVVKDKTYTLGPGHVIEFRLGFHPFEVVFEYLEEKLEQTAKRPKLEVMYAEPNNSAFFNGAGKWEDIDQRELLIYTPDNIQSQNKIAAFDIDGTIIKTQSGARFPKDFDDWAMLFSDIPSKLQKLYNDNFKIVFFTNQSGIGKDPSKVKGFKRKIENILKKIALPIQVYIALXRSKYRKPITGMWDLLKTQKNDNVKINMKSSFYVGDAAGRKKNWAXKKTKNHSSADRLFPLNIEKKFYTP

SEQ ID NO: 24155 - protein, 296 aa, Diabrotica virgifera
  misc_feature: Coding regions on vcDNA: vcDNA=SeqID_3852; Strand=+; Position=151-1041
  misc_feature: Homolog annotation: Hit_ID=AAF90148.1; Match level="QueryCoverage =95%, HitCoverage=95%, E-value=2e-45, Identity=36%"; Hit description =tetraspanin D76 [Manduca sexta]
  misc_feature: Gene Ontology Annotation: Molecular function=signal transducer activity; Cellular component=integral to plasma membrane; Biological process=cell adhesion
  misc_feature: Pfam annotation: Pfam_ID=Tetraspannin; Match level="Score=174.9, E -value=1.7e-49, Copies=1"; Pfam description=Tetraspanin family
MSKDRELQMGMRCVKYMIFVANFMFMLVGLLLISIGYTIKAIYTDFDAFLSSHSYKASDLAIAVGFIILVVALFGCAGAIKESVLLVNLYALLLLVIVILELTVSIIAYKSRSHLEETLSQDMWISMEYYIADTGYIWDATQYSLHCCGVHGPNDWDRFNSSDYNLTVIYSLQDDSTSSDSQQINYPGVYQVPESCCRNTKCQSIASLYTRGCLPKIHYIISQSALLLGVGAMCITFIQLLGATFAHLLARSIRKLKTQIEVERTIRRQQLYESLAKSNTQEKVSPVLYVAESSEA

SEQ ID NO: 24156 - protein, 478 aa, Diabrotica virgifera
  misc_feature: Coding regions on vcDNA: vcDNA=SeqID_3853; Strand=+; Position=41-1477
  misc_feature: Homolog annotation: Hit_ID=XP_317161.1; Match level="QueryCoverage =99%, HitCoverage=73%, E-value=1e-135, Identity=50%"; Hit description= ENSANGP00000018282 [Anopheles gambiae]
  misc_feature: Gene Ontology Annotation: Molecular function=molecular_function unknown; Cellular component=cellular_component unknown; Biological process=growth
  misc_feature: Pfam annotation: Pfam_ID=PGM_PMM_I; Match level="Score=179.7, E-value= 6.1e-51, Copies=1"; Pfam description =Phosphoglucomutase/phosphomannomutase
  misc_feature (419)..(419): Xaa can be any naturally occurring amino acid
  misc_feature (450)..(450): Xaa can be any naturally occurring amino acid
  misc_feature (458)..(458): Xaa can be any naturally occurring amino acid
MCDIDTGCAALDQKVAEWLALDKNETTSNAMRTLLHEKKFQEINKILTKRLGFGTAGLRGKMGVGYACMNDLVIIQTAQGFFNYLVKLDEKLLKSNGIVIGYDGRHNSRRWAELTASVFLHAGYPVKLFSTICPTPFIPYAIRQFGCASGVMVTASHNPKEDNGYKVYGSNGAQIVSPVDEHIQNSILQNLQPLESSWDTSIISSSPLISDPRSDVFCRYMNVIDRDNSEECKELNRKMNLTFTYTPMHGVAYEYIKKVFEIVNAKFVVVPEQRDPHPDFPTVKFPNPEEGKSSLDLSFKCADENNSSIILANDPDADRLAMAEKSPKTGEWRIFNGNETGALIGWWMLTTFKKRNPSFPLSKVYMLSSTVSSMILNTMSKKEGFKFVDTLTGFKWLGNKALELEKEGNKVIFAFEEAXGFMCSTEVLDKDGVSAAAHFASMVSYVYSQXKTVADQLXKIYDTYGLHISFDSYYICTE

SEQ ID NO: 24157 - protein, 78 aa, Diabrotica virgifera
  misc_feature: Coding regions on vcDNA: vcDNA=SeqID_3854; Strand=+; Position=75-311
  misc_feature: Homolog annotation: Hit_ID=EAL31717.1; Match level="QueryCoverage =62%, HitCoverage=58%, E-value=2e-11, Identity=57%"; Hit description =GA14967-PA [Drosophila pseudoobscura]
MAGCLPCFIIPLLLFIFHRFIQPILLKFWNPWEKSSIKKDGEKENCTFSCECAWMKKKPVEDKDKEAVTTPEDKIKAS

SEQ ID NO: 24158 - protein, 411 aa, Diabrotica virgifera
  misc_feature: Coding regions on vcDNA: vcDNA=SeqID_3855; Strand=+; Position=32-1263
  misc_feature: Homolog annotation: Hit_ID=AAG42838.1; Match level="QueryCoverage =86%, HitCoverage=64%, E-value=1e-173, Identity=85%"; Hit description= inducible heat shock 70 kDa protein [Leptinotarsa decemlineata]
  misc_feature: Gene Ontology Annotation: Molecular function=protein binding; Biological process=reproduction
  misc_feature: Pfam annotation: Pfam_ID=HSP70; Match level="Score=249.1, E-value=8e -72, Copies=1"; Pfam description=Hsp70 protein
  misc_feature (315)..(315): Xaa can be any naturally occurring amino acid
  misc_feature (325)..(325): Xaa can be any naturally occurring amino acid
  misc_feature (339)..(339): Xaa can be any naturally occurring amino acid
MTKYALFEGIDFYTKISRARFEELCSDLFRGTLQPVEKALNDAKLDKGQIHDIVLVGGSTRIPKIQQLLQNYFSGKALNLSINPDEAVAYGAAVQAAVLSGETDSKIQDVLLVDVAPLSLGIETAGGVMTNIITRNSRIPCKQSQMFTTYADNQPAVTIQVFEGERAMTKDNNRLGTFDLTGIPPAPRGVPKIEVTFDLDANGILNVSAKDTSSGNTRNITIKNDKGRLSQQEIDRMLSEAEKYKEEDERQKEKIAARNQFEGYVFQLKQAVQDCGDKLSCEDKSTIERECESCLKWLDSNTLADKEEYEEKRKXLTKVCSPIMXQLYQGSQNNIQQSXNATGLGQKMVGFGGGRKGPPQKKGVNFFITTFFSYIGGIKFIFGRAGYYFFFFFFFLFCGRKKKKKIFIFFL

SEQ ID NO: 24159 - protein, 363 aa, Diabrotica virgifera
  misc_feature: Coding regions on vcDNA: vcDNA=SeqID_3856; Strand=+; Position=461-1549
  misc_feature: Homolog annotation: Hit_ID=CAF94542.1; Match level="QueryCoverage =99%, HitCoverage=47%, E-value=7e-13, Identity=22%"; Hit description =unnamed protein product [Tetraodon nigroviridis]
MVNLALQYLRLATQRSNIKLDIWFISRCLHHKVFPTFCRVRTSNNVHPNIRTSMQIKLMKKEICKHYSKLNYIECKLKVTYDSLLETLQFINLNSFMSDVQDKVDHSHSVKFNRVNNKLKHLINNKIRLDQQKASRNKNYSNFRFHPRIKNLSNVQFSDDELKLLNLGLKHSIPSNLSIKDLESLSIETDMVIQNLSISLTQKTSIRNSCIQTINKFKTKLLSNNNSSLTNISSPSTSTQTSSSLSFPNFSYNKSKSLLSTLKSIKNKIQNHHLIFSKADKGNCLVILDQQLYIDKVTSFLDNNNFTLLPVDPSKSFVSKMKTNLKQFTEFFSEFEAPYTKIPSNPLTPRLYGLPKIHKGDIP

SEQ ID NO: 24160 - protein, 86 aa, Diabrotica virgifera
  misc_feature: Coding regions on vcDNA: vcDNA=SeqID_3857; Strand=-; Position=181-441
IYNKMSNPTIRIERWLKFLKARKVWLDYLRAYLLNSPRTKQWLNLKFDLHYLKIILNRLNADVTGYCLWEHGETLPKPQSTILGQL

SEQ ID NO: 24161 - protein, 91 aa, Diabrotica virgifera
  misc_feature: Coding regions on vcDNA: vcDNA=SeqID_3858; Strand=-; Position=976-1251
QNFCPLCGTSCFCRLCNYYSDDCCVNYDFHFFSDIFISTLANFVKNYFKIGIRMDFSTYNSAFLRAINAPNFKGNYFILKKFFEKVLFLIT

SEQ ID NO: 24162 - protein, 266 aa, Diabrotica virgifera
  misc_feature: Coding regions on vcDNA: vcDNA=SeqID_3859; Strand=+; Position=2-802
  misc_feature: Homolog annotation: Hit_ID=EAL25252.1; Match level="QueryCoverage =97%, HitCoverage=54%, E-value=1e-71, Identity=48%"; Hit description =GA13492-PA [Drosophila pseudoobscura]
  misc_feature: Gene Ontology Annotation: Molecular function=epoxide hydrolase activity
  misc_feature (249)..(249): Xaa can be any naturally occurring amino acid
GAEIVGLNCAEIAIIMKNLMDRLGFKQYYLQGGDWGAAIAADLAILFPEKVIGIHSNLCFVNTPMSNFKYFLSGFIPYLFVDEGKEHLVSPVWDKIEFLMLEFGYTHIQSTKPDTIGVALRDSPVGLAAYLLEKFTTWTNAAYKDLDSGGLTKKFTMEQLIDNVMIYWITRSSTTAMRLYAESVNRKHLTTNMEGIPVQPPSGCSRFEKEILWFPESVLTERFVNMVHISTHRDGGHFAAFEVPDVLAXDILQFTEIVERIIKEKS

SEQ ID NO: 24163 - protein, 294 aa, Diabrotica virgifera
  misc_feature: Coding regions on vcDNA: vcDNA=SeqID_3860; Strand=+; Position=101-985
MSKSQVAIPENKTVALGAGNREEEIEETEETTLSETHKDLGHTQVAEKKATFDSTIDKSIVEDHRQQQIHSTKNVQQSESVEVSANKKPETTESNLEASSVPLSNLGYDRVGPIKTFEPLQPFAPLQFELPQSFELVKQANSSLQKSEYSHNQDEQANIAPQSERKLVIPELKIDSPTVIEKQTKVYDIPIQQELYTEPELPKPYEAPRLPQVPKISEVPKVTEIPLFPELRLSSEVSSSTQSNIFETLGYTTSSAVSSIRYQLAIFTCTKPAEWNKSENKDRNIRNSLKEKFI

SEQ ID NO: 24164 - protein, 112 aa, Diabrotica virgifera
  misc_feature: Coding regions on vcDNA: vcDNA=SeqID_3861; Strand=+; Position=90-428
MSKSQVAIPENKTVALGAGNREEEIEETEETTLSETHKDLGHTQVAEKKATFDSTIDKSIVEDHRQQQIHSTKNVQQSESVEVSANKKVFSSHFESSQSFESEEFEEYEIQG

SEQ ID NO: 24165 - protein, 153 aa, Diabrotica virgifera
  misc_feature: Coding regions on vcDNA: vcDNA=SeqID_3862; Strand=+; Position=129-590
  misc_feature: Homolog annotation: Hit_ID=CAD55597.1; Match level="QueryCoverage =98%, HitCoverage=99%, E-value=7e-73, Identity=89%"; Hit description =troponin C [Lethocerus indicus]
  misc_feature: Pfam annotation: Pfam_ID=efhand; Match level="Score=111.9, E-value =1.6e-30, Copies=4"; Pfam description=EF hand
MSADELPPEQIAVLRKAFEAFDSQKSGSIPCDMVADILRLMGQPFDKKILEELIEEVDADKSGRLEFEEFVTLAAKFIVEEDDEAMQKELKEAFRLYDKDGNGYIPTTCLKEILRELDDQLTDKELDMMIEEIDTDGSGTVDFDEFMEMMTGE

SEQ ID NO: 24166 - protein, 157 aa, Diabrotica virgifera
  misc_feature: Coding regions on vcDNA: vcDNA=SeqID_3863; Strand=+; Position=60-533
  misc_feature: Homolog annotation: Hit_ID=CAD55597.1; Match level="QueryCoverage =96%, HitCoverage=100%, E-value=2e-73, Identity=89%"; Hit description= troponin C [Lethocerus indicus]
  misc_feature: Pfam annotation: Pfam_ID=efhand; Match level="Score=111.9, E-value =1.6e-30, Copies=4"; Pfam description=EF hand
PTKKHKMDELPPEQIAVLRKAFEAFDSQKSGSIPCDMVADILRLMGQPFDKKILEELIEEVDADKSGRLEFEEFVTLAAKFIVEEDDEAMQKELKEAFRLYDKDGNGYIPTTCLKEILRELDDQLTDKELDMMIEEIDTDGSGTVDFDEFMEMMTGE

SEQ ID NO: 24167 - protein, 490 aa, Diabrotica virgifera
  misc_feature: Coding regions on vcDNA: vcDNA=SeqID_3864; Strand=+; Position=2-1473
  misc_feature: Homolog annotation: Hit_ID=XP_392460.1; Match level="QueryCoverage =99%, HitCoverage=74%, E-value=0.0, Identity=34%"; Hit description =similar to BMKETTIN [Apis mellifera]
  misc_feature: Gene Ontology Annotation: Molecular function=structural constituent of muscle; Cellular component=sarcomere; Biological process=mitotic chromosome condensation
  misc_feature: Pfam annotation: Pfam_ID=I-set; Match level="Score=192.4, E-value =9.4e-55, Copies=3"; Pfam description=Immunoglobulin I-set domain
  misc_feature (21)..(21): Xaa can be any naturally occurring amino acid
  misc_feature (444)..(444): Xaa can be any naturally occurring amino acid
  misc_feature (463)..(464): Xaa can be any naturally occurring amino acid
  misc_feature (471)..(471): Xaa can be any naturally occurring amino acid
NLHQDDDTGRPPEFITSPSDXMNENGLAHFECRLIPVNDQSMRVEWFHNGKPLWAGSRIKTINDFGFVILEVSGVYQRDSGLYTCKATNRHGEATVSCQLQVKGRQGIIMEPQLPSNFRTGTQSIQKLEEMLHKKEELLTEEEQPNPPRFTVEVKDNIDVPEGGPIHFDCRVEPVNDPTMRIDWFHNGRPFATGSRVHQINDFGFISLDIDYSYSRDAGEYICRASNKWGTATTKATVTSKTKKSIDTESQLPSGMSAEKLKELEKGPVSQAPEKEKTYSPPRFVTQIESSTVEESESVHFECTVEPKDDPKLRVEWYRNGKLLPSGHRYRTVFDLGFVSLDILYVYAEDSGEYVCRAVNDYGEDFTKASVSCKKLPNIILQNQVPKGMKKSETLMQMEAAIKKYTSEIHLTEDDLYDVEKRQPPRFVTQIKDQTDLVEMQTTXFECQLAPVGDPNMKVEWFXXGKPLPHXNRFTPIYDFCYVAMNFGWY

SEQ ID NO: 24168 - protein, 525 aa, Diabrotica virgifera
  misc_feature: Coding regions on vcDNA: vcDNA=SeqID_3865; Strand=+; Position=75-1649
  misc_feature: Homolog annotation: Hit_ID=CAH64510.1; Match level="QueryCoverage =97%, HitCoverage=89%, E-value=1e-125, Identity=45%"; Hit description= putative esterase [Tribolium castaneum]
  misc_feature: Gene Ontology Annotation: Molecular function=carboxylesterase activity
  misc_feature: Pfam annotation: Pfam_ID=COesterase; Match level="Score=439.4, E -value=4.1e-129, Copies=1"; Pfam description=Carboxylesterase
MSEELVVTTEIGKLRGKAQKDYHGDKFYSFSGVPYAKPPIGELRFKAPEPIESWEGVKDCTKEGWECPSLDIYFKHHIGNEDNCLNMNIYTKELPSHNPNMKKRPVMVFIHGGGFIYGSNKSMHVGPNYLMTGDIVLVCINYRLGVFGFLSLEDQSLGVPGNAGLKDQTMALKWIQKHIANFGGDPNNVTIFGESAGSASVHFLLVSPLTKGLFHKAIMQSGCAFNPWAKGRRNFAVISKAMGYKDVDEKTLFQKLCRASTRSLVTASFKIEDSFFASIVRPFIPVVEYPHEGAFLTEDPEEIMKAGRHHHVPVIIGYNSMEGLMYELIRKTRTDADLPETLERDIPFDLNIPEKTERAKEVAEKMQKFYYQDKDLSEKNINNRYRMVSDVHFLYGIQKTITLLQRHSKAPVYVYRMSIISNLNFFKKFCEVKYLKTMLALSLLTKLSGGSSMKNVFQSLREKLPVRQIEGVSHADDIFYLFSTFLAPTIAKGSVEDRNIQKFVKPWTTFAECGNPTPEPTELLD

SEQ ID NO: 24169 - protein, 459 aa, Diabrotica virgifera
  misc_feature: Coding regions on vcDNA: vcDNA=SeqID_3866; Strand=+; Position=75-1454
  misc_feature: Homolog annotation: Hit_ID=NP_731021.1; Match level="QueryCoverage =97%, HitCoverage=90%, E-value=8e-69, Identity=36%"; Hit description =CG1213-PC, isoform C [Drosophila melanogaster] ref|NP_731020.1| CG1213-PB, isoform B [Drosophila
  misc_feature: Gene Ontology Annotation: Molecular function=glucose transporter activity; Cellular component=plasma membrane; Biological process =glucose transport
  misc_feature: Pfam annotation: Pfam_ID=Sugar_tr; Match level="Score=151.6, E-value =1.8e-42, Copies=1"; Pfam description=Sugar (and other) transporter
  misc_feature (379)..(379): Xaa can be any naturally occurring amino acid
  misc_feature (403)..(403): Xaa can be any naturally occurring amino acid
MSGKTNYFLHWAAFTVNILTLATGIAMAWASPSLIKLESLDPDVNPLGRPITTAEKSLIASLPTFTSVPGTIIAGYVSQKLGRKKTLILFSLPFLFCYIGIALAKSVTVFYITRFFLGLSCGCTLAVLPSYVAEISEDSNRGFLGCIMGIMGAIGYFIVYAIGPVVSIQMFAYLQLFPIILFYVMFVPFIPESPYYFLAKKLDKEAEACLKKIRTTSKVHEELAYLEEVINENKEKKSDWREIYSTKAARKGLTITCGLLMFQQLLGFMAVLNYMQSIFEAAKTSINSNTASLILGGVQIISNIFSTLLVDRLGRKVLLLASNVGCTISLAALGAFFFCLENNYNTDSIFWLPILSLIVFFVSFNFGFGTLPLTVCGRXFPVTSKAMAASLPTCVCLLLGLFXSYFKVFPYLFLNEVCYARTPFSGISSVHLILFVVFIVPETKGKSFKEIQHVLEGRR

SEQ ID NO: 24170 - protein, 72 aa, Diabrotica virgifera
  misc_feature: Coding regions on vcDNA: vcDNA=SeqID_3867; Strand=-; Position=137-355
LVTPSSPFNYSLFRNKDFEPKKLTDHINNIFTSKAVTNNFLWDANQGAIFMICLPKKGTNFILGETCLFLKL

SEQ ID NO: 24171 - protein, 259 aa, Diabrotica virgifera
  misc_feature: Coding regions on vcDNA: vcDNA=SeqID_3868; Strand=+; Position=145-923
  misc_feature: Homolog annotation: Hit_ID=NP_525010.1; Match level="QueryCoverage =89%, HitCoverage=31%, E-value=8e-58, Identity=46%"; Hit description =CG4625-PA [Drosophila melanogaster] gb|AAF56473.2| CG4625-PA [Drosophila melanogaster]
  misc_feature: Gene Ontology Annotation: Molecular function=acyltransferase activity; Cellular component=peroxisome; Biological process =histogenesis and organogenesis
  misc_feature: Pfam annotation: Pfam_ID=Acyltransferase; Match level="Score=47.8, E -value=3.1e-11, Copies=1"; Pfam description=Acyltransferase
  misc_feature (221)..(221): Xaa can be any naturally occurring amino acid
  misc_feature (240)..(240): Xaa can be any naturally occurring amino acid
MSVQRRYENFLEYRRKEKLNFLWISKRWDPVIAFKQGGSRRPTPHSHKVAVLRSPKIQELLDQISRIDNIPKATLETQVRDILDEIGYDRNLKIVRWLGLVLTKICLKVLSGIYVNIDQVEKIKSRMGNCPVIFVPTHRSYGDFMMLSYANFNYDIEIPAITAGMDFHGMWGVGKVLRDTGAFFMRRTYTNDNLYWTTFREYVYQLVTKGDLPMEFFIEGXTRSRSNKSLPPKYGVLSMXLKAFFFSHVPDILFGPNGN

SEQ ID NO: 24172 - protein, 133 aa, Diabrotica virgifera
  misc_feature: Coding regions on vcDNA: vcDNA=SeqID_3869; Strand=-; Position=3-401
  misc_feature: Homolog annotation: Hit_ID=CAE59812.1; Match level="QueryCoverage =37%, HitCoverage=60%, E-value=1e-13, Identity=81%"; Hit description =Hypothetical protein CBG03276 [Caenorhabditis briggsae]
KKKKKKKKKKKKKKKKKKKKKKKKKKKKKKKKIKKKKRGGPFKRTKFYKGGLGSKNFFKGAPKLNFRGGVLKRRGGENPGVTQFNPLGKIPPFPRWGKKKKAPPHPPSQKLANLKGKGEPPLKGPLRGGGWGG

SEQ ID NO: 24173 - protein, 160 aa, Diabrotica virgifera
  misc_feature: Coding regions on vcDNA: vcDNA=SeqID_3870; Strand=+; Position=45-527
  misc_feature: Homolog annotation: Hit_ID=NP_728587.1; Match level="QueryCoverage =87%, HitCoverage=76%, E-value=3e-23, Identity=37%"; Hit description =CG9134-PC, isoform C [Drosophila melanogaster] ref|NP_728586.1| CG9134-PA, isoform A [Drosophila
  misc_feature: Gene Ontology Annotation: Molecular function=selectin; Cellular component=extracellular space
  misc_feature: Pfam annotation: Pfam_ID=Lectin_C; Match level="Score=47.4, E-value =4.1e-11, Copies=1"; Pfam description=Lectin C-type domain
MKVVYLILVLAVVTQAFSDVTRNETGRHWFTLRGKEYFIEENVKANFWTAVQYCYHHNMQLVSLGTQEENDALYNEVDQFLAGQAEFWSSGSRIANDDDWIWLTTGRPIKVFNWGDGEPNNKDKKERCISLYYRHYQNGWWNDENCDNELGVICETKCQD

SEQ ID NO: 24174 - protein, 275 aa, Diabrotica virgifera
  misc_feature: Coding regions on vcDNA: vcDNA=SeqID_3871; Strand=+; Position=84-908
  misc_feature: Homolog annotation: Hit_ID=XP_415553.1; Match level="QueryCoverage =93%, HitCoverage=31%, E-value=1e-70, Identity=51%"; Hit description =PREDICTED: similar to NADPH dependent diflavin oxidoreductase 1; NADPH-dependent FMN and FAD
  misc_feature: Gene Ontology Annotation: Molecular function=molecular_function unknown; Cellular component=cellular_component unknown; Biological process=biological_process unknown
  misc_feature: Pfam annotation: Pfam_ID=Flavodoxin_1; Match level="Score=141.3, E -value=2.2e-39, Copies=1"; Pfam description=Flavodoxin
  misc_feature (242)..(242): Xaa can be any naturally occurring amino acid
RFEIYRNLIALYNQFLKRRIAVLYGSQTGNAQDLAERIWRESKRFYFKGSVKALDDYDVLHLIQETCVIFVCATTGQGEEPDNMKSFWRFLLRKNLPPDILCRLKFGVFGLGDSSYAKYNFTAKRLYKRLLQLGANPLVPLGLGDDQHDLGYDAAADPWIENLWSSILRFHPLPVGIEPLSKQYKIEPRWNVVSHFSTIKEESRRPHSIYSYIRKPSDFVATVIENSRLTSSDHFQDVRLIXLKCPNQKYNPGDVVSLRPRNLDWKIEEFRQVLS

SEQ ID NO: 24175 - protein, 97 aa, Diabrotica virgifera
  misc_feature: Coding regions on vcDNA: vcDNA=SeqID_3872; Strand=+; Position=127-420
  misc_feature: Homolog annotation: Hit_ID=XP_392446.1; Match level="QueryCoverage =100%, HitCoverage=100%, E-value=9e-20, Identity=57%"; Hit description=similar to Death-associated protein 1 (DAP-1) [Apis mellifera]
MSSPKQDSALKAGHPPAVKAGGMRITQHKTRKDSGGITEDVTGITVSGSPPKTTTVSGAVVKGHADFPAEAVQSFHKEKPPAIHPNKPVAHIQQPRK

SEQ ID NO: 24176 - protein, 293 aa, Diabrotica virgifera
  misc_feature: Coding regions on vcDNA: vcDNA=SeqID_3873; Strand=+; Position=169-1047
  misc_feature: Homolog annotation: Hit_ID=XP_395718.1; Match level="QueryCoverage =99%, HitCoverage=11%, E-value=1e-123, Identity=69%"; Hit description= similar to fetal Alzheimer antigen isoform 1; bromodomain and PHD domain transcription
  misc_feature: Gene Ontology Annotation: Molecular function=histone acetyltransferase activity; Cellular component=SAGA complex; Biological process=histone acetylation
  misc_feature: Pfam annotation: Pfam_ID=PHD; Match level="Score=110.8, E-value=3.5e -30, Copies=2"; Pfam description=PHD-finger
MREVTEELAARTKIERTKQDEVRTGSSKRKSAATATTAAITPPQPKTSTSSSSSRHKKTSKHGTPVKQGPSPPTATTPAKGHNKREKVYCICRTPYDETKFYVGCDLCNNWFHGDCVGITEESSKTLTEFICNECKQARDSQKLYCLCQQPYDDSQFYICCDRCQDWFHGRCVGILQSEADNIDEYVCPRCQRNNSVNFANMKDLQPKDHEGLRKLIKQLQVHKSAWPFMEPVDPNEAPDYYKVIKEPMDLQMIETKINDQVYTKLSEFIGDMTKIFDNCRYYNPKESPFYKC

SEQ ID NO: 24177 - protein, 498 aa, Diabrotica virgifera
  misc_feature: Coding regions on vcDNA: vcDNA=SeqID_3874; Strand=+; Position=2-1494
  misc_feature: Homolog annotation: Hit_ID=XP_392311.1; Match level="QueryCoverage =99%, HitCoverage=37%, E-value=1e-160, Identity=29%"; Hit description= similar to Short stop/Kakapo long isoform [Apis mellifera]
  misc_feature: Gene Ontology Annotation: Molecular function=structural constituent of cytoskeleton; Cellular component=cytoskeleton; Biological process= microtubule-based process
  misc_feature: Pfam annotation: Pfam_ID=Spectrin; Match level="Score=94.0, E-value =3.9e-25, Copies=3"; Pfam description=Spectrin repeat
  misc_feature (476)..(476): Xaa can be any naturally occurring amino acid
  misc_feature (482)..(482): Xaa can be any naturally occurring amino acid
  misc_feature (493)..(493): Xaa can be any naturally occurring amino acid
KSKWNSVCHKSVDRQRKLEEALLYSGQFKDAIAALVQWLQKAEKDLSKDSPVHGDLDTVNHLVEAHKVFEKELEKRNDQMESVIKNGQELERTASKTDAIQIRAQLNELTELWETVTDLTRIRADKLRDALKEAEKLHRSVNMILDWLSEAEMKLRFVGNQPEDEATAYEQVKALDQFRAQLNEKEIEKDHTLELAHSILAKAHPDSINVIKNWIKVIQSRWDEVSQWALQRHQKLSQHLQSLRDMDDTLEELIQWLMGLENTLIALKREELPMDIPATEQLIADHKEFMENTQKRQAEVDRVCKAKQVKPAAGVKDPKKFVKGKGQIRGSQLDIHDSTQDIYGALGRKQSFKGSRNDLQRGSEPEFRSPRVKFLYDKWRHVWMLSWERQRELYDHLAYLKEKEKADNFSWDDWRKRFLKFMNYKKSRLTDLFRKMDKDNNELIPRDDFIEGIIKTKFDTSRLEMKHVADMFDENXRGLIDXKEVIAALRPDXEEKGA

SEQ ID NO: 24178 - protein, 264 aa, Diabrotica virgifera
  misc_feature: Coding regions on vcDNA: vcDNA=SeqID_3875; Strand=+; Position=43-837
  misc_feature: Homolog annotation: Hit_ID=AAT09846.1; Match level="QueryCoverage =87%, HitCoverage=83%, E-value=3e-36, Identity=36%"; Hit description =trypsin-like serine proteinase [Anthonomus grandis]
  misc_feature: Gene Ontology Annotation: Molecular function=serine-type endopeptidase activity; Cellular component=extracellular; Biological process=proteolysis and peptidolysis
  misc_feature: Pfam annotation: Pfam_ID=Trypsin; Match level="Score=145.0, E-value =1.7e-40, Copies=1"; Pfam description=Trypsin
MSGLKYFVLFALVTVTCARHVSRKSTGLKINGGSQAKSGQFPFVASLELGIFGIYENECEGVILNENWVLTSGECAKEVSRVVAGVTDLHGNETSRQVAEVEHAYVHPEYDSNGPSPNDIALVKLKTPLVFNQFVGNVSLPEQDAVFNGTANLTGWGWSFLPDFNKLSFVADLPLIDIEECNRVVDSILEENTLDKKSNICAGDLDKGANNCDGDVGGSLTQNGVLIGIVTWYIEPCDIEGTPDIFTNVANFVDWINQTIDKHQ

SEQ ID NO: 24179 - protein, 226 aa, Diabrotica virgifera
  misc_feature: Coding regions on vcDNA: vcDNA=SeqID_3876; Strand=+; Position=284-959
  misc_feature: Homolog annotation: Hit_ID=XP_396379.1; Match level="QueryCoverage =98%, HitCoverage=66%, E-value=2e-63, Identity=56%"; Hit description =similar to ENSANGP00000006910 [Apis mellifera]
  misc_feature: Gene Ontology Annotation: Cellular component=nucleus
  misc_feature: Pfam annotation: Pfam_ID=DUF618; Match level="Score=109.8, E-value =6.6e-30, Copies=1"; Pfam description=Protein of unknown function, DUF618
  misc_feature (196)..(196): Xaa can be any naturally occurring amino acid
  misc_feature (208)..(208): Xaa can be any naturally occurring amino acid
MMAGGFTEAAFINKLSDLNNSSGSIQTLSLWLIHHRKHHGKVVQIWFRELIKAKDSKKLTFMYLANDVIQNSRKKGPEYGQEFSLILDKAFEHMSKSDTKTKNSLNRLIKIWNERGIYDNKLILEFQRIMASSPEENEPPIKKVKVTVTKERRKFDSEKIVEHSDGSIETHIQLSPHTPAGDPPEPEELIKAIQDXLEVNIASSDEWXEREFAKLPREVSEVSLIS

SEQ ID NO: 24180 - protein, 62 aa, Diabrotica virgifera
  misc_feature: Coding regions on vcDNA: vcDNA=SeqID_3877; Strand=+; Position=145-333
LGRIRLHFTKLLFTHIILLLFYDELSKKKVTTKKVFFYQNILFTFSVTTFKKMVISLLITNK

SEQ ID NO: 24181 - protein, 186 aa, Diabrotica virgifera
  misc_feature: Coding regions on vcDNA: vcDNA=SeqID_3878; Strand=+; Position=216-776
  misc_feature: Homolog annotation: Hit_ID=EAL40355.1; Match level="QueryCoverage =91%, HitCoverage=31%, E-value=6e-11, Identity=29%"; Hit description =ENSANGP00000026909 [Anopheles gambiae str. PEST] ref|XP_558110.1| ENSANGP00000026909 [Anopheles gambiae st
MAKKIKRENCPHSLKCFRKNPHHFKEFDHPHLLKLIDMGSPVEIPSDFPQPQQVYLEQIEMLQSLLKTSHLKDIQNLPGSSTSAEKKPEKQEKSNSSTKTSPAKTQKGKNIAPKSSTVLEEDPVEVVHILDSPILKKSCHETMMEKIERMAPYSVFFTTIIKAPETKRQENAITFTEFTVAKFRKS

SEQ ID NO: 24182 - protein, 473 aa, Diabrotica virgifera
  misc_feature: Coding regions on vcDNA: vcDNA=SeqID_3879; Strand=+; Position=25-1446
  misc_feature: Homolog annotation: Hit_ID=XP_392724.1; Match level="QueryCoverage =78%, HitCoverage=42%, E-value=1e-125, Identity=56%"; Hit description= similar to CG31716-PG [Apis mellifera]
  misc_feature: Gene Ontology Annotation: Molecular function=transcriptional repressor activity; Cellular component=CCR4-NOT core complex; Biological process=regulation of transcription, DNA-dependent
  misc_feature: Pfam annotation: Pfam_ID=RRM_1; Match level="Score=20.1, E-value =0.00045, Copies=1"; Pfam description=RNA recognition motif. (a.k.a. RRM, R
FKQRKFFDFYRVITTETIKMSVLNQSGEEQVECPLCMEPLEVDDLTFFPCTCGYQICRFCWHRIRTDENGLCPACRKAYSEDPADFIPLSQEQIAKLKAEKRQRDQQRKAKLTESRKHLASVRVVQRNLVFVVGLPMRLADPEVLKKHEYFGKFGKIHKVVINQSTSYAGSQGPSASAYVTYMKSDDALRAIQSVNNITIDSRVIKSSLGTTKYCSHFMKNQTCPKPDCMYLHDFGDPEASFTKEQMHAGKHQEYEKKLHENLLLRTANNNNQSNTCDNSKPSIPIPTTNSTYKSSSKDNMTAALSSSVSSSSSTTSNSSGTNKENWPHLNTEKEKKDKEKGKKSKGKGESGSRKGERKESYSSGKSEVKFDSGFRTDSKDKNTSPPLSEPAETPSPPMLLESQLSVPKLTTPMMDDNTSFFSLNSFQKLPSNSSAQEHATETDGEAHPSSILTDTLPNINTSEDWGAVFGFF

SEQ ID NO: 24183 - protein, 46 aa, Diabrotica virgifera
  misc_feature: Coding regions on vcDNA: vcDNA=SeqID_3880; Strand=-; Position=584-724
FSSRKKFVLKCCLNCSQLNKKKLIFPQICCLIHRMQCYTPILSFND

SEQ ID NO: 24184 - protein, 113 aa, Diabrotica virgifera
  misc_feature: Coding regions on vcDNA: vcDNA=SeqID_3881; Strand=+; Position=93-434
  misc_feature: Homolog annotation: Hit_ID=AAL62467.1; Match level="QueryCoverage =100%, HitCoverage=100%, E-value=2e-43, Identity=82%"; Hit description=60S acidic ribosomal protein P2 [Spodoptera frugiperda]
  misc_feature: Gene Ontology Annotation: Molecular function=structural constituent of ribosome; Cellular component=cytosolic large ribosomal subunit (sensu Eukarya); Biological process=protein biosynthesis
  misc_feature: Pfam annotation: Pfam_ID=Ribosomal_60s; Match level="Score=104.3, E -value=3.1e-28, Copies=1"; Pfam description=60s Acidic ribosomal protein
MRYVAAYLLAVLGGKASPNAADLEKILGSVGVEAEGERVKKVISELSGKSVEELIAQGREKLSSMPVGGGAPAAAGGAAAAAPAAEEKKEAKKEEKKVESESEDDDMGFALFD

SEQ ID NO: 24185 - protein, 104 aa, Diabrotica virgifera
  misc_feature: Coding regions on vcDNA: vcDNA=SeqID_3882; Strand=-; Position=1243 -1557
YFFFFLFPPGGVFFFFFFLKKIGGGPLPFLFLGFCSPSPSPPFVGKTPPPPPPPQQKKNKILAPPCSFICGVSPPREPVGGQLFHRRGFYRKIFFRVISPANPV

SEQ ID NO: 24186 - protein, 318 aa, Diabrotica virgifera
  misc_feature: Coding regions on vcDNA: vcDNA=SeqID_3883; Strand=+; Position=145-1101
  misc_feature: Homolog annotation: Hit_ID=NP_648484.1; Match level="QueryCoverage =93%, HitCoverage=94%, E-value=1e-117, Identity=65%"; Hit description= CG6084-PA, isoform A [Drosophila melanogaster] gb|AAF50039.2| CG6084 -PA, isoform A [Drosophila
  misc_feature: Gene Ontology Annotation: Molecular function=electron transporter activity; Cellular component=cytoplasm; Biological process=glucose metabolism
  misc_feature: Pfam annotation: Pfam_ID=Aldo_ket_red; Match level="Score=513.6, E -value=1.9e-151, Copies=1"; Pfam description=Aldo/keto reductase family
MVQVPTVKFNNGNEIPIFGLGTWKSKPGEVAQAVKDAIDIGYRHIDCAFVYGNEKEVGEALAAKFADGTVKREDIFITSKLWNTYHRPDLVEKCLQQTLSNLGIQYLDLYLIHWPMAYKEDLDIFPRREDGSIIFSDVDYVDTWKEMEKVQQKGLVKSIGVSNFNEKQIERVLKIAKIKPVNNQVECHPYLNQKKLIDFCRSKDITVTAYSPLGSPDRPFAKPGDVELLHDPKLKDLAAKHNKSPAQILLRFQVERGVIVIPKSVNKGRLEQNIDIFDFSLSKEDLATLESFDCDGKLIRLDAVLELPPPHFFQSIIY

SEQ ID NO: 24187 - protein, 327 aa, Diabrotica virgifera
  misc_feature: Coding regions on vcDNA: vcDNA=SeqID_3884; Strand=-; Position=182-1165
  misc_feature: Homolog annotation: Hit_ID=NP_651780.1; Match level="QueryCoverage =98%, HitCoverage=96%, E-value=1e-76, Identity=45%"; Hit description =CG15531-PA [Drosophila melanogaster] gb|AAF57021.1| CG15531-PA [Drosophila melanogaster]
  misc_feature: Gene Ontology Annotation: Molecular function=stearoyl-CoA desaturase activity; Cellular component=integral to membrane; Biological process=lipid metabolism
  misc_feature: Pfam annotation: Pfam_ID=FA_desaturase; Match level="Score=87.8, E -value=2.8e-23, Copies=1"; Pfam description=Fatty acid desaturase
MSTTVVQTVVQDEETKLSKTRDVNWMKVLFQLQITLMSLFTIHFLLYDSQWKTLLFTLALVLLGQLGVTAGAHRLWAHNTYTADGILRAFLIFCQTLSGTGSVYEWVQWHRLHHKYFQTDLDPYNPSRGWFFAQIQSTTLHLSEAQEAELKKIDMSDLEKDKLVMWQKKYYIALYLIVTLLLPINAPVEYWNEGLYSSVFILGFLRGFINLNLAWLINSAITIWGLKKGEKFPCDTNLVFILNKSNWLAYHYIAPWDYQVSEYGQYANDTISKTIRIFQVLECASNLKTIDSDTVRRALTNSVVQKRDITECLEELCDYSQKAPVFN

SEQ ID NO: 24188 - protein, 272 aa, Diabrotica virgifera
  misc_feature: Coding regions on vcDNA: vcDNA=SeqID_3885; Strand=+; Position=65-881
  misc_feature: Homolog annotation: Hit_ID=EAA09168.2; Match level="QueryCoverage =98%, HitCoverage=29%, E-value=7e-81, Identity=53%"; Hit description =ENSANGP00000012199 [Anopheles gambiae str. PEST] ref|XP_562312.1| ENSANGP00000012199 [Anopheles gambiae st
  misc_feature: Gene Ontology Annotation: Molecular function=molecular_function unknown; Cellular component=nucleolus; Biological process=rRNA processing
  misc_feature: Pfam annotation: Pfam_ID=WD40; Match level="Score=28.3, E-value=2.3e -05, Copies=4"; Pfam description=WD domain, G-beta repeat
  misc_feature (246)..(246): Xaa can be any naturally occurring amino acid
  misc_feature (254)..(254): Xaa can be any naturally occurring amino acid
MTGSKVFLPSRGLGYVSNHIPLQVRYIKSRQENLIITCVGKSFHTYGISHFGLLSVSGLHHDDINCMTADAYHVYTAVDNVIYAWRRGTELKHTYKGHKKKVRLMIPFGAHLISVDESNNVKIWDIKAETVYLELLFSLETFNISAILHPSTYINKILLASDTGGMQLWNINNAKIIHTFSSWKAGVSCLAQAPAIDVVAVGLVTGRIILHNLKYDENVMEFTQDWGIVTSISFRTDGNPIMATGXSCGHIVFXDLEERKVSTQLLAAHDGS

SEQ ID NO: 24189 - protein, 253 aa, Diabrotica virgifera
  misc_feature: Coding regions on vcDNA: vcDNA=SeqID_3886; Strand=+; Position=20-777
  misc_feature: Homolog annotation: Hit_ID=AAH20792.1; Match level="QueryCoverage =99%, HitCoverage=77%, E-value=1e-101, Identity=70%"; Hit description= HGD protein [Homo sapiens]
  misc_feature: Gene Ontology Annotation: Molecular function=homogentisate 12 -dioxygenase activity; Biological process=phenylalanine catabolism
  misc_feature: Pfam annotation: Pfam_ID=HgmA; Match level="Score=251.3, E-value=1.8e- 72, Copies=1"; Pfam description=homogentisate 1,2-dioxygenase
  misc_feature (208)..(208): Xaa can be any naturally occurring amino acid
  misc_feature (242)..(242): Xaa can be any naturally occurring amino acid
MTELTYMSGFGSELQSEDPRCPGSLPPDQNSPQKCPYGLYAEQLSGSAFTAPRSENKRTWFYRIRPSVLHKPFESIKSSDVSHNWDEEEPNPNQLLWDPFEMPPNSKKVDFVEGLHTVAGAGDSKCKTGLAIHVFSCNTSMKNKAFYNSDGDFLIVPQTGNLHIKTEFGKIKAIPNEIVVIQQGIRFQIEVETASRGYILEVFGRHFXELPDLGPIGANGLGNPRDFLHPTAWYEDVEENFXVVSKYKGKLFV

SEQ ID NO: 24190 - protein, 176 aa, Diabrotica virgifera
  misc_feature: Coding regions on vcDNA: vcDNA=SeqID_3887; Strand=+; Position=2-532
  misc_feature: Homolog annotation: Hit_ID=XP_392060.1; Match level="QueryCoverage =98%, HitCoverage=21%, E-value=5e-56, Identity=56%"; Hit description =similar to ENSANGP00000013993 [Apis mellifera]
  misc_feature: Gene Ontology Annotation: Molecular function=phosphatidylethanolamine binding; Cellular component=cytoplasm; Biological process=biological _process unknown
  misc_feature: Pfam annotation: Pfam_ID=PBP; Match level="Score=189.7, E-value=5.9e -54, Copies=1"; Pfam description=Phosphatidylethanolamine-binding prote
KEQVVPDVIDQVPEHVVEVQYPGGEKVDFGNELTPTQVKPQPTITWPADSDSYYTVLMVDPDAPSRKEPKYREILHWSVGNVLGNDVAKGETFTDYVGSGAPKGSGLHRYIFLIYKQNGKIEFNEPRIDNRTKTGRLNFSTRKYAEKYNLGQPIAGNFFQAQFDEWVLEMERTIKG

SEQ ID NO: 24191 - protein, 329 aa, Diabrotica virgifera
  misc_feature: Coding regions on vcDNA: vcDNA=SeqID_3888; Strand=+; Position=68-1057
  misc_feature: Homolog annotation: Hit_ID=XP_309670.1; Match level="QueryCoverage =97%, HitCoverage=67%, E-value=4e-45, Identity=34%"; Hit description =ENSANGP00000024638 [Anopheles gambiae] ref|XP_309669.1| ENSANGP00000023240 [Anopheles gambiae]
  misc_feature: Gene Ontology Annotation: Molecular function=glucose transporter activity; Cellular component=integral to plasma membrane; Biological process=glucose transport
  misc_feature: Pfam annotation: Pfam_ID=Sugar_tr; Match level="Score=54.5, E-value =2.9e-13, Copies=1"; Pfam description=Sugar (and other) transporter
GYVIQITFISEIASKNTRGFVSTIAAMMLGVGALASYCIGPYVPVTTLNIILAVNPLLVILVAILFCEESPYYYLMKNQTEKAKNALKVYRNPGVNVDEEIKEIKENIEEQNSGKLIEVLKTKAFIKSFIIANMLLIFQQFTGINGITMYSQTIFNKTGSNLSPEICSIILGALNLASGSIAPFVAERFTRRFLLNLSAAGMIICESVLGIYCVLDDAGKVSSSLKFLPIVSLAGFMFTYNFGVGPLCWVVISEIFVTRVKTFAMSFSVFIYYIIGFFIAQYFNPVSEAIGIGAVFLIFAGLWNAFILFVGFNVIQTNAQTVEGNSRTI

SEQ ID NO: 24192 - protein, 219 aa, Diabrotica virgifera
  misc_feature: Coding regions on vcDNA: vcDNA=SeqID_3889; Strand=+; Position=238-894
  misc_feature: Homolog annotation: Hit_ID=XP_392183.1; Match level="QueryCoverage =100%, HitCoverage=55%, E-value=5e-68, Identity=59%"; Hit description= similar to ENSANGP00000010528 [Apis mellifera]
MNKLCRQVSIESPGPVIKDCVFNFEIPVPNVPPNGARIRVVCAGACYRMRNRSSSTSSVSSISSVQSTEDTGYGPAHHGVRDGALFPGYEVAGVIDELDSAVSSNDFKVGTRVILYPYEGIPHGYAEYIVVPDLEYLVKVPDSLPMSVAAMLPTGALLAKNAVVTAHQHVTDLLKDRAADHIVRILIVGTGGLALWALKIAEYHFKTPEYKDRVKITVA

SEQ ID NO: 24193 - protein, 316 aa, Diabrotica virgifera
  misc_feature: Coding regions on vcDNA: vcDNA=SeqID_3890; Strand=+; Position=38-988
  misc_feature: Homolog annotation: Hit_ID=AAM52017.1; Match level="QueryCoverage =74%, HitCoverage=29%, E-value=4e-16, Identity=25%"; Hit description =RE53177p [Drosophila melanogaster]
  misc_feature (260)..(260): Xaa can be any naturally occurring amino acid
MVQYIFLLLFLVPNGVFCEKGFNFDIPPDFHQKLMHFKEQAIQVLDTAGGGTQCAKDLKEVINDTYAMKKWAIEMLDAMAKFPSGILSGNIFVMGAYDQCVNINIFNDTAIHGEYCPVLLQPKTKEGKITIANVLDFFNLKTNFQKNVLDQAMRLPYGICVPSSCREETLQVIWDHAETVFKPPVSLELLDGLCTSLDRSPSPFPVDTYIQAFFIFYIALLVFCTWYDVCIDRFKQEHESNSFLVSFSFFSNAKKLIKLXDSDQDDIQVDCMCGIKVFCMLSVIHGHRVATNTLTGTHYAIRIESVILVRVLGATR

SEQ ID NO: 24194 - protein, 155 aa, Diabrotica virgifera
  misc_feature: Coding regions on vcDNA: vcDNA=SeqID_3891; Strand=+; Position=2-469
PRVRPRVRVNRYFRRLQQISIMKSTSFCVSLSIFVLFVVAQNLPVGYALECYQCEANAGIGCEKNFTSVLHENCTTGFSCGKTVWKVNDVTRYERRCAASTYCEDQKAIATRENRTLVSCSLCNATLCNSGNHVNIPIFTLIISFLVSLKVVCNF

SEQ ID NO: 24195 - protein, 466 aa, Diabrotica virgifera
  misc_feature: Coding regions on vcDNA: vcDNA=SeqID_3892; Strand=+; Position=52-1452
  misc_feature: Homolog annotation: Hit_ID=XP_393931.1; Match level="QueryCoverage =89%, HitCoverage=92%, E-value=1e-111, Identity=49%"; Hit description= similar to ENSANGP00000009426 [Apis mellifera]
  misc_feature: Gene Ontology Annotation: Molecular function=carboxypeptidase C activity; Cellular component=vacuole; Biological process=proteolysis and peptidolysis
  misc_feature: Pfam annotation: Pfam_ID=Peptidase_S10; Match level="Score=428.5, E -value=8e-126, Copies=1"; Pfam description=Serine carboxypeptidase
MKVFLSISIGLFVLCSIESRSLNSKLSKKPIFKDFYGKLNIEVRGNPGEPLILTDLIKAGKLDEAQNQSLVQGLDTEVKSYSGYFTVDKNHDSNIFFWFFPSQSDPSSDPVVLWLQGGPGSTSMFGLFQENGPLTLKDGELGIRPTSWNRNHSVIYIDQPAGTGWSYTNGGYAKDQHKVATDLYEALQQFFTLFYQYQEREFFVTGESYGGKYVPAISYKIHQENEDAKLKINLKGLAIGNGFTDPKVQVRYSDYVYQHGLIDLKTKNALHKKENKAVQDITSGEYYNAFELWNEIVGTIQEYTELDIYNYLSLKGSAADEEELNEFFSKEQVRKAIHVGSTEFGDGEVYTNLEEDIPKSEAHKVAELLKHYRVLIYNGQTDLIVPYALTVNYLQQLHFPGSEEYAEADRTVWHDDNDSDVVAGYVKTAGKLTEIMVRNSGHMVPTDQPEWALQLINKFTRNIPFN

SEQ ID NO: 24196 - protein, 309 aa, Diabrotica virgifera
  misc_feature: Coding regions on vcDNA: vcDNA=SeqID_3893; Strand=+; Position=99-1024
  misc_feature: Homolog annotation: Hit_ID=EAL41141.1; Match level="QueryCoverage =99%, HitCoverage=39%, E-value=1e-122, Identity=65%"; Hit description= ENSANGP00000025653 [Anopheles gambiae str. PEST] ref|XP_559443.1| ENSANGP00000025653 [Anopheles gambiae s
  misc_feature: Gene Ontology Annotation: Molecular function=protein binding; Cellular component=ubiquitin ligase complex; Biological process =signal transduction
  misc_feature: Pfam annotation: Pfam_ID=WW; Match level="Score=100.2, E-value=5.3e -27, Copies=2"; Pfam description=WW domain
  misc_feature (286)..(286): Xaa can be any naturally occurring amino acid
  misc_feature (288)..(289): Xaa can be any naturally occurring amino acid
  misc_feature (293)..(293): Xaa can be any naturally occurring amino acid
  misc_feature (297)..(297): Xaa can be any naturally occurring amino acid
  misc_feature (301)..(301): Xaa can be any naturally occurring amino acid
MPQYQLNLQDANGNGADDDESDDQPDSLSNNSSRRDSTVSTSTSNSQNNLDGLSEGLPAGWSIQRAPNGRLFFIDHNERTTSWVDPRTGRASPMPNQPAAPVITKRPDDDLGPLPEGWEERVHSDGRIFFIDHNTRTTQWEDPRLSNPQIAGPAIPYSRDYKRKYEYMKTQLKKPNNVPNKFEIKIRRRSILEDSYRVITSVSRIELLKTKLWVEFEGEVGLDYGGLAREWFYLLSKEMFNPYYGLFEYSAMDNYTLQINPFSGLCNEDHLSYFKFIGRVAGMAVXHXXILDXVFIXDFYXNDVTKSID

SEQ ID NO: 24197 - protein, 365 aa, Diabrotica virgifera
  misc_feature: Coding regions on vcDNA: vcDNA=SeqID_3894; Strand=+; Position=180-1275
  misc_feature: Homolog annotation: Hit_ID=NP_730282.1; Match level="QueryCoverage =100%, HitCoverage=43%, E-value=1e-106, Identity=54%"; Hit description=CG7555-PC, isoform C [Drosophila melanogaster] gb|AAN11694.1| CG7555-PC, isoform C [Drosophila
  misc_feature: Gene Ontology Annotation: Molecular function=protein binding; Cellular component=ubiquitin ligase complex; Biological process =signal transduction
  misc_feature: Pfam annotation: Pfam_ID=WW; Match level="Score=148.6, E-value=1.4e -41, Copies=3"; Pfam description=WW domain
  misc_feature (16)..(16): Xaa can be any naturally occurring amino acid
KSYRKRTFFGASDPYXVRIDLNSVNGDETIDSVLTKTKKRTLSPEWNEEFIFRVKPGEHKLVLQVFDENRLTRDDFLGMVELPLLNLPKEQPERNIPPVKYLLQPRSDFSARSRVRGHLELYHAFLFDSNLPPIAAPEEPSDERDWEIVHEGREEEAAQPLYITPTTDSQPSPLPSGWEERQDANGRTYYVNHIARTTQWERPTLSNQDIHSGETEEQREVFERRFHISADEESNDRGDVNQSDDQPDSLSNNSSRRDSTVSTSTSNSQNNLDGLSEGLPAGWSIQRAPNGRLFFIDHNERTTSWVDPRTGRASPMPNQPAAPVITKRPDDDLGPVPEGWEERVLSDGRIFFIDYYTRTTQWEKP

SEQ ID NO: 24198 - protein, 254 aa, Diabrotica virgifera
  misc_feature: Coding regions on vcDNA: vcDNA=SeqID_3895; Strand=+; Position=130-890
  misc_feature: Homolog annotation: Hit_ID=CAG02360.1; Match level="QueryCoverage =87%, HitCoverage=68%, E-value=2e-48, Identity=48%"; Hit description =unnamed protein product [Tetraodon nigroviridis]
  misc_feature: Gene Ontology Annotation: Molecular function=electron transporter activity; Cellular component=nucleus; Biological process=steroid metabolism
  misc_feature: Pfam annotation: Pfam_ID=adh_short; Match level="Score=49.4, E-value =1e-11, Copies=1"; Pfam description=short chain dehydrogenase
  misc_feature (179)..(179): Xaa can be any naturally occurring amino acid
  misc_feature (203)..(203): Xaa can be any naturally occurring amino acid
  misc_feature (222)..(223): Xaa can be any naturally occurring amino acid
  misc_feature (228)..(228): Xaa can be any naturally occurring amino acid
  misc_feature (231)..(232): Xaa can be any naturally occurring amino acid
  misc_feature (239)..(239): Xaa can be any naturally occurring amino acid
  misc_feature (247)..(247): Xaa can be any naturally occurring amino acid
MIAEILLGTALTASIAALSLVSFKLYIKLTTGICQSQVCLAGKTAIVTGANTGIGYETALDFAKRGAKVILACRDEVKAKEAVDTIITETHNKNVVYRLVDLTSFNSVRRFANDINSNEDRLDILVNNAGAGRLGNKETEDGISIVMQTNYFSHFLLTYLLIDLMKKHPSRIVNVSAIXAKVGHIYFRKLTSFTTEANQYITXKLCQVLFTMELASRLSGTXXTAYSXHPXXYKTEIFXNIYTFDRXFILFFID

SEQ ID NO: 24199 - protein, 74 aa, Diabrotica virgifera
  misc_feature: Coding regions on vcDNA: vcDNA=SeqID_3896; Strand=-; Position=155-379
TFVVALHLVKIFSNLFRHCSTLALLYWRALDDVLRNEKYARRCFIFSHKNGAPYEKNTRKVLFHKLNVEYKNNS

SEQ ID NO: 24200 - protein, 86 aa, Diabrotica virgifera
  misc_feature: Coding regions on vcDNA: vcDNA=SeqID_3897; Strand=+; Position=456-716
HLLLVYNVRSLLKNYAFILLNLKTFGDHILIHSKLHIYREIFSSSIPTNLSSNVELYESLRQSIYMVESLHVLYTFIIIQLQRYFG

SEQ ID NO: 24201 - protein, 118 aa, Diabrotica virgifera
  misc_feature: Coding regions on vcDNA: vcDNA=SeqID_3898; Strand=+; Position=165-521
  misc_feature: Homolog annotation: Hit_ID=XP_309973.1; Match level="QueryCoverage =91%, HitCoverage=62%, E-value=5e-57, Identity=98%"; Hit description =ENSANGP00000015970 [Anopheles gambiae]
  misc_feature: Pfam annotation: Pfam_ID=Skp1_POZ; Match level="Score=97.3, E-value =3.9e-26, Copies=1"; Pfam description=Skp1 family, tetramerisation domain
MADSTTEINQERVYGGCEGPDAMYVKLISSDGHEFIVKREHALTSGTIKAMLSGPGQFAENEANEVNFREIPSHVLQKVCMYFTYKVRYTNSSTEIPEFPIAPEIALELLMAANFLDC

SEQ ID NO: 24202 - protein, 112 aa, Diabrotica virgifera
  misc_feature: Coding regions on vcDNA: vcDNA=SeqID_3899; Strand=+; Position=47-385
  misc_feature: Homolog annotation: Hit_ID=CAB99192.1; Match level="QueryCoverage =91%, HitCoverage=11%, E-value=1e-13, Identity=37%"; Hit description =endonuclease/reverse transcriptase [Drosophila melanogaster]
  misc_feature (59)..(59): Xaa can be any naturally occurring amino acid
  misc_feature (71)..(71): Xaa can be any naturally occurring amino acid
PPRQYRFRKGNSAADAINRIKREISICRNKWVVTFFLDIKNAFNSGRWKIIVRLLGNLXISPYLQNLVWDXFTDRYINITRGDSMRSMADVLQGSVLGPLLWNVLLTRFWRS

SEQ ID NO: 24203 - protein, 247 aa, Diabrotica virgifera
  misc_feature: Coding regions on vcDNA: vcDNA=SeqID_3900; Strand=+; Position=58-801
  misc_feature: Homolog annotation: Hit_ID=NP_650438.2; Match level="QueryCoverage =87%, HitCoverage=84%, E-value=2e-69, Identity=57%"; Hit description =CG4299-PA [Drosophila melanogaster] gb|AAF55155.1| CG4299-PA [Drosophila melanogaster]
  misc_feature: Gene Ontology Annotation: Molecular function=protein binding; Cellular component=chromatin; Biological process=cell proliferation
  misc_feature: Pfam annotation: Pfam_ID=NAP; Match level="Score=200.3, E-value=4e -57, Copies=1"; Pfam description=Nucleosome assembly protein (NAP)
MSGDTPRKLKRFSESDRTSEFDAATQKALEEIDICQNEIDSINEKSSEEILKIEQKYNQLRKPFFEKRNNLISNIPNFWITAIQNHPDLSELLDNEEEDCLHFLIKIEVQEFEDIKSGYCIKFYFEENPYIDNTVITKTYHLDCATPTSQSTRIIWKEGCNIGQNIEPPKSGRKRRIERSKTFFGWFVDNVDPYTDDIAEVIKDDLWLNPLQYYLVADVEGDAHVSEISSSNDEEEEEGEEERSQNN

SEQ ID NO: 24204 - protein, 256 aa, Diabrotica virgifera
  misc_feature: Coding regions on vcDNA: vcDNA=SeqID_3901; Strand=+; Position=214-984
  misc_feature: Homolog annotation: Hit_ID=XP_319864.1; Match level="QueryCoverage =83%, HitCoverage=45%, E-value=8e-49, Identity=42%"; Hit description =ENSANGP00000010645 [Anopheles gambiae]
  misc_feature: Gene Ontology Annotation: Molecular function=nucleoside transporter activity; Biological process=nucleoside transport
MAYSVNTTPLLQEQYDSDGEDDGNDILVPQDRPLFKAEPIDKFYATYIIFYILGIISLLPWNFFITADDYWMYKFRNVTNITNIRDAPPKRSPLQAEFTSYLTLTSCYPNLVFLILNTAISQRVSLNKRVLGSLSCMLALMLLTLVFVNINTDSWQQWFFVITLMTSFLLNVFSPIFCGSLIGVVGKFSPIYITAVVGGQALGGVFAAVTQIASLAIGASSSHTALVYFVIGNITIALGIVLYIVLSRSVFLRTHI

SEQ ID NO: 24205 - protein, 442 aa, Diabrotica virgifera
  misc_feature: Coding regions on vcDNA: vcDNA=SeqID_3902; Strand=+; Position=42-1370
  misc_feature: Homolog annotation: Hit_ID=AAC47415.1; Match level="QueryCoverage =97%, HitCoverage=78%, E-value=1e-109, Identity=47%"; Hit description= carboxypeptidase E-1 gb|AAC47413.1| carboxypeptidase E-1
  misc_feature: Gene Ontology Annotation: Molecular function=carboxypeptidase activity; Cellular component=plasma membrane; Biological process =neuropeptide signaling pathway
  misc_feature: Pfam annotation: Pfam_ID=Peptidase_M14; Match level="Score=252.3, E -value=8.6e-73, Copies=1"; Pfam description=Zinc carboxypeptidase
MLRCFALVLALLSAQSFQFEFKHHNNDDLVAVLQDVNARCPNITRIYTLSENSVLGLPLYFIEFSTNPGRHEILKPEFKYIANMHGNEVLGRELLLKLADFLCDEYTKGNKQIRSLIRTTRIHLMPSMNPDGWQLATDTGGQDYLTGRTNNNSVDLNRNFPNLDRIIFTNEEQHLNHNNHLLEDLTHLDQPLQPETKAVIRLIMQVPFVLSANLHGGDLVANYPYDDSRSGRQNGEYTATPDDETFRHLALSYSSYHADMANPKRKGCGDYESQDFPKQGGITNGAKWYALQGGMQDFNYLSSNDMEITLELGCEKYPPASELEPEWERNKDALINFIWQAHIGVKGVVYDNQSKRGIPGAVIHVRNITDLEKSYDIEHDVTSVHDGDYYRLLTPGKYKLTAYRDGFLPRSKIVTGLNKPLRGAPRVDFPLKPITKIEKPFA

SEQ ID NO: 24206 - protein, 258 aa, Diabrotica virgifera
  misc_feature: Coding regions on vcDNA: vcDNA=SeqID_3903; Strand=+; Position=58-829
  misc_feature: Homolog annotation: Hit_ID=NP_732009.2; Match level="QueryCoverage =99%, HitCoverage=61%, E-value=6e-33, Identity=36%"; Hit description =CG4898-PI, isoform I [Drosophila melanogaster] ref|NP_732008.1| CG4898-PC, isoform C [Drosophila
  misc_feature (250)..(250): Xaa can be any naturally occurring amino acid
MSTTRAAGSAKKRGHQHHPRNEGTRKRLALELTPDKPLSEYSVNNVVTAQKSTIINKNTVIKDSAFPENSSKNVIASQSQSPTESTINKCDIEVIDLTNCDDDDVKVISIKEPSPTKTDSYESCSKSLKDDRNSKIRKLKKSRSSKNETQSETKEKQDMSLVQRPEAEGSSQSDIENEQGPVDPEIEELSKLRCTSEMTEVVAEREKRRRRCADYPGLAFASSIFSSDTLMKFSIIKNELHNIMNTQLKXRAESEVAA

SEQ ID NO: 24207 - protein, 268 aa, Diabrotica virgifera
  misc_feature: Coding regions on vcDNA: vcDNA=SeqID_3904; Strand=+; Position=84-890
  misc_feature: Homolog annotation: Hit_ID=XP_319708.1; Match level="QueryCoverage =95%, HitCoverage=93%, E-value=4e-90, Identity=65%"; Hit description =ENSANGP00000019464 [Anopheles gambiae]
  misc_feature: Gene Ontology Annotation: Molecular function=ubiquinol-cytochrome c reductase activity; Cellular component=respiratory chain complex III (sensu Eukarya); Biological process=electron transport
  misc_feature: Pfam annotation: Pfam_ID=UCR_TM; Match level="Score=120.6, E-value =3.9e-33, Copies=1"; Pfam description=Ubiquinol cytochrome reductase transm
MLKPANVPGYFRAVSQVVSNQLNTGKQVAILPQKSVVHIPWSSSSPSALSKALPTGNIAVSVGPAVSSQVRCAHTDITVPDFSHYRRDGTKDPAKSSHDSEDARKNFTYLMAGGLGVGAAYGAKSVVSQFISSMSASADVLALAKIEIKLSDIPEGKSVTFKWRGKPLFIRHRSASEIQAEQSVAVSSLRDPQHDNDRVQNPSFLIVIGVCTHLGCVPIANAGDFGGYYCPCHGSHYDASGRIRKGPAPLNLEVPPYNFPSEDLLVVG

SEQ ID NO: 24208 - protein, 231 aa, Diabrotica virgifera
  misc_feature: Coding regions on vcDNA: vcDNA=SeqID_3905; Strand=+; Position=171-866
MEVFGTFLEDFFNHTIDGLVLTDNWPANEEFKMDNDSFPYFTKALQDAMSYTIQWNTTANDILHIQKHNSYGGYQYKSLKDYFKSKEIFILSATKSISQVEPMIIENVETSWTNLRKYLDSVLFDSIIGNHLVSIPVCGDTNVFDTSIQMKLCLRWYLIAATMPMFRISAPKPWRNPDDLSASYDQQTAQSALDTRNMLLAYYNGLISSNEPVIRPMFYDFYENTTTFFSV

SEQ ID NO: 24209 - protein, 98 aa, Diabrotica virgifera
  misc_feature: Coding regions on vcDNA: vcDNA=SeqID_3906; Strand=-; Position=1-294
  misc_feature: Homolog annotation: Hit_ID=ZP_00262423.1; Match level="QueryCoverage =78%, HitCoverage=19%, E-value=3e-30, Identity=85%"; Hit description =COG1960: Acyl-CoA dehydrogenases [Pseudomonas fluorescens PfO-1]
KSQGLTCRLPGYAPAHHEESRVTAKPNSVLPSPLQTAKVLAAEFALTAVERDERGGTPKTERDALRQSGLLALSIPTQYGGLGARWSETLEIVREFAK

SEQ ID NO: 24210 - protein, 228 aa, Diabrotica virgifera
  misc_feature: Coding regions on vcDNA: vcDNA=SeqID_3907; Strand=+; Position=87-773
NSIKHKDSIMEVLYFKYNTQDDIKFIDVTDSMTTSKEHFVDHIKETFVPRLNGSFYRIQASNGAIQLLEKHLYMNSEQTEAAQNLVIELYRCLRNCVTNKSTQDYVAEQTNILAFTKTYIQKLDQHNVCLKIILQFLTNLISSNPEVTRKVHTNFSDVFSKIIENKLCLYESAALIYYSALVVPPDLNSIKCMFQLDEKDNEIEYVLFFFDKCITYNVWWEFIHSFEI

SEQ ID NO: 24211 - protein, 89 aa, Diabrotica virgifera
  misc_feature: Coding regions on vcDNA: vcDNA=SeqID_3908; Strand=+; Position=1-270
FASDIFSTILSLNRPFFSSFSIHHLNFLWSSPIFLFSCAFYFDVQNKQLMLLAYCLTNYYLAVLAFTYAFFPYPEVVYLGLMLSTFVGT

SEQ ID NO: 24212 - protein, 101 aa, Diabrotica virgifera
  misc_feature: Coding regions on vcDNA: vcDNA=SeqID_3909; Strand=+; Position=1295 -1597
SSHNLSISYDAWGICFFFKKNGKKGTFYPPFSRKGKTFLKWDPGFFKNKPNKKGNPQGGVFPSKKKNFLSLNPPHSFFSYNGLPPPPPPENKNNNTAPTGA

SEQ ID NO: 24213 - protein, 110 aa, Diabrotica virgifera
  misc_feature: Coding regions on vcDNA: vcDNA=SeqID_3910; Strand=+; Position=13-345
  misc_feature: Homolog annotation: Hit_ID=AAN77412.1; Match level="QueryCoverage =76%, HitCoverage=49%, E-value=1e-14, Identity=47%"; Hit description =digestive cysteine protease intestain [Leptinotarsa decemlineata]
  misc_feature: Gene Ontology Annotation: Molecular function=molecular_function unknown; Cellular component=cellular_component unknown; Biological process=biological_process unknown
MFKYFLLFVIAVALAADTYLSDDEEFEKFKKDFNRNYATPNEEQHRKGIFVNTLNKIKEHNAKFEKGEISYSLGINQFADLTHEEFQSRYTMKNWVEQRGKLAQKTATHN

SEQ ID NO: 24214 - protein, 287 aa, Diabrotica virgifera
  misc_feature: Coding regions on vcDNA: vcDNA=SeqID_3911; Strand=+; Position=3-866
  misc_feature: Homolog annotation: Hit_ID=XP_318329.1; Match level="QueryCoverage =78%, HitCoverage=29%, E-value=2e-10, Identity=27%"; Hit description =ENSANGP00000014151 [Anopheles gambiae]
  misc_feature: Pfam annotation: Pfam_ID=zf-CCHC; Match level="Score=16.0, E-value =0.0032, Copies=2"; Pfam description=Zinc knuckle
VISGANSSQSLEVLEIQKQKKHQSNRNQQPKSAPQYTADPGQSYRNHPQTSGNQKISNNFIKNCYKCGSNHSLNKCPAYGLRCKICNKFNHFAKVCNANSYRNRVHNVNVHQSDTDSDSDFSPDQFFLNNINEKSSEKWYEDCFINNKIIVSFRLDSGADCCVLPYTYFKKLNIQTSELTSSTNKITDYNGKIINTVGSVYLKVRQCKNKENIAKLKFYIVKTHNDAILGLDACIMLNLIQKNNINVINDNLHNDIESISQIIHEYDDAFRGVGCLKGNIPIKLMRK

SEQ ID NO: 24215 - protein, 110 aa, Diabrotica virgifera
  misc_feature: Coding regions on vcDNA: vcDNA=SeqID_3912; Strand=+; Position=80-412
  misc_feature: Homolog annotation: Hit_ID=NP_651614.1; Match level="QueryCoverage =89%, HitCoverage=88%, E-value=2e-32, Identity=63%"; Hit description =CG17856-PA [Drosophila melanogaster] gb|AAF56781.1| CG17856-PA [Drosophila melanogaster]
  misc_feature: Gene Ontology Annotation: Molecular function=ubiquinol-cytochrome c reductase activity; Cellular component=respiratory chain complex III (sensu Eukarya); Biological process=electron transport
  misc_feature: Pfam annotation: Pfam_ID=UCR_14kD; Match level="Score=141.4, E-value =2.1e-39, Copies=1"; Pfam description=Ubiquinol-cytochrome C reductase compl
MAVSFAQKRFMSSGLQKWAYNLAGFNRYGLWRDDLLYEDSDVAEALKRVPQKTIDERNYRILRATQLSLSHSILPKEQWTKLEDDKLYLTPFVNQVIKEKKEQEEWNKVY

SEQ ID NO: 24216 - protein, 115 aa, Diabrotica virgifera
  misc_feature: Coding regions on vcDNA: vcDNA=SeqID_3913; Strand=+; Position=2-349
  misc_feature: Homolog annotation: Hit_ID=XP_395106.1; Match level="QueryCoverage =94%, HitCoverage=26%, E-value=8e-14, Identity=37%"; Hit description =similar to RAB3 GTPase-activating protein [Apis mellifera]
LNPAKNIIEEIDAFVMKLVTGQEVEIQNKSHSDIGKRIIAMFGDAQKSILGDQTGDDRNRENAAFPTPSSREFVMRVNAVKPAIYSAKCPQLLRAVLSKDEFRLVGAFSEDTAFF

SEQ ID NO: 24217 - protein, 142 aa, Diabrotica virgifera
  misc_feature: Coding regions on vcDNA: vcDNA=SeqID_3914; Strand=+; Position=494-918
  misc_feature: Homolog annotation: Hit_ID=XP_392376.1; Match level="QueryCoverage =99%, HitCoverage=5%, E-value=5e-47, Identity=63%"; Hit description =similar to ENSANGP00000002892 [Apis mellifera]
  misc_feature (119)..(120): Xaa can be any naturally occurring amino acid
FQSYCKGINVGLNDDTLGGIIKCSIAQYLALEITKGNGRDNRAVTRYFPWLCSTSITQQSPREFIECIGHIRLLSWLLLGSLTHTALQGNNNNNCQILSQPIPQEASCQIADHIQVIMXXGLPNNQKASIIHMSSLFHTFIL

SEQ ID NO: 24218 - protein, 298 aa, Diabrotica virgifera
  misc_feature: Coding regions on vcDNA: vcDNA=SeqID_3915; Strand=+; Position=1-894
  misc_feature: Homolog annotation: Hit_ID=XP_320946.1; Match level="QueryCoverage =99%, HitCoverage=43%, E-value=1e-89, Identity=55%"; Hit description =ENSANGP00000017538 [Anopheles gambiae]
  misc_feature: Pfam annotation: Pfam_ID=Na_H_Exchanger; Match level="Score=-127.3, E- value=0.00076, Copies=1"; Pfam description=Sodium/hydrogen exchanger family
TTLPALVGMLFTGIALQNLNIVNIDSSFSHLNKHLSAVALVIILTRAGLDLDPTAVNRLKFTVLKLSVIPWTAEACLTVILAKFWLGTSWKYSILLGSIIAAVAPAVVVPCLFRLRSKGYGVVKGIPTLIIAVAGIDDALSVAIFGVVLGIIFTGASVAKGIIFGSLSILAGIGIGVIWGIICNITPERNDPFASPLRILLLLSGGLAGVFGSELVGYGGAGPLICVTAAFVALTNWSKQGWHVEENPAALAFEIFWMIFQPILFGITGSRIKINEMDGNVVLVSLGILAIVVVVRIA

SEQ ID NO: 24219 - protein, 405 aa, Diabrotica virgifera
  misc_feature: Coding regions on vcDNA: vcDNA=SeqID_3916; Strand=+; Position=96-1310
  misc_feature: Homolog annotation: Hit_ID=XP_396896.1; Match level="QueryCoverage =98%, HitCoverage=69%, E-value=1e-146, Identity=68%"; Hit description= similar to AT23067p [Apis mellifera]
  misc_feature: Gene Ontology Annotation: Molecular function=molecular_function unknown; Cellular component=mitochondrion; Biological process=growth
  misc_feature: Pfam annotation: Pfam_ID=MMR_HSR1; Match level="Score=68.3, E-value =2e-17, Copies=1"; Pfam description=GTPase of unknown function
  misc_feature (371)..(371): Xaa can be any naturally occurring amino acid
  misc_feature (385)..(385): Xaa can be any naturally occurring amino acid
MAKFHLRKKSKRQPARLRYKIEKKVREHNRKLKKENKNNPKKKKEIMQIPNICPFKEDILKEVEALKKQKEEEKLKLREAAKLERQKEKEESKKEKLTAGLQGLVQNAELRSKLHEHLTPDNNVKQHETNNEQSLKQYYKEFKKVIEAADVILEVVDARDPLGTRCKQVEQAVLDTKGNKRLVLVLNKADLVPREILDQWLKYLKKTTPTIAFKASTQNQSKKLGQRKLGKGNKVLQSSNSVGAELLMSLLANYCRNKGIKTSIRVGIVGLPNVGKSSIINSLKRSRACNVGATPGVTRAMQEVQLDSKIKLLDSPGIVFASGNDSSASLRNAVRISALSDPVTPANAILQRVTKQQMMEMYDVTEYSTPXEFYSLKAARTGRFXRKGGGPDAIALPKFIKKWKK

SEQ ID NO: 24220 - protein, 191 aa, Diabrotica virgifera
  misc_feature: Coding regions on vcDNA: vcDNA=SeqID_3917; Strand=+; Position=115-690
  misc_feature: Homolog annotation: Hit_ID=EAL32634.1; Match level="QueryCoverage =89%, HitCoverage=80%, E-value=1e-68, Identity=75%"; Hit description =GA12984-PA [Drosophila pseudoobscura]
  misc_feature: Gene Ontology Annotation: Cellular component=mitochondrial inner membrane; Biological process=electron transport
  misc_feature: Pfam annotation: Pfam_ID=COQ7; Match level="Score=300.1, E-value=3.5e- 87, Copies=2"; Pfam description=Ubiquinone biosynthesis protein COQ7
MFAISRRSIAALTQIRSKTDKAVLDEIIRVDHAGELGADRIYAGQMFILGSTSKAPLIRHMWEQEKHHKATFEDLIRKKRVRPTVMTPIWNVAGFALGAGSALLGDKAAMACTVAVETVIVDHYNDQLRTLLEDPECDKELVETIKKFRDEEQEHHDHGIDQGAKQTPFYEAFTNVIKAGCKAAIAISKVV

SEQ ID NO: 24221 - protein, 185 aa, Diabrotica virgifera
  misc_feature: Coding regions on vcDNA: vcDNA=SeqID_3918; Strand=+; Position=192-749
  misc_feature: Homolog annotation: Hit_ID=NP_728855.1; Match level="QueryCoverage =100%, HitCoverage=97%, E-value=4e-46, Identity=51%"; Hit description= CG14968-PE, isoform E [Drosophila melanogaster] ref|NP_728854.1| CG14968-PD, isoform D [Drosophila
  misc_feature: Pfam annotation: Pfam_ID=PID; Match level="Score=-2.8, E-value=0.004, Copies=1"; Pfam description=Phosphotyrosine interaction domain (PT
NFKMSDSEPAIAFKDLPLTFKVKYLGRHPAKGLWGMKHTRKPVDYLVSQAKNLPPDVILPIIDFKVTQDGVSYVESANKKVESEPVKFAVDKISYGVQDLVYTRVFSMIVVTDDTLDNGIPFVCHSFVCESRDQARRITYALAAAFQDYGRKVKSENGERTVKKFAIDLRTPEEQAAASDGETDA

SEQ ID NO: 24222 - protein, 417 aa, Diabrotica virgifera
  misc_feature: Coding regions on vcDNA: vcDNA=SeqID_3919; Strand=+; Position=90-1339
  misc_feature: Homolog annotation: Hit_ID=XP_312924.1; Match level="QueryCoverage =96%, HitCoverage=90%, E-value=0.0, Identity=94%"; Hit description =ENSANGP00000014726 [Anopheles gambiae]
  misc_feature: Gene Ontology Annotation: Molecular function=proteasome endopeptidase activity; Cellular component=proteasome regulatory particle (sensu Eukarya); Biological process=proteolysis and peptidolysis
  misc_feature: Pfam annotation: Pfam_ID=AAA; Match level="Score=262.3, E-value=8.2e -76, Copies=1"; Pfam description=ATPase family associated with various
  misc_feature (365)..(365): Xaa can be any naturally occurring amino acid
  misc_feature (373)..(373): Xaa can be any naturally occurring amino acid
  misc_feature (393)..(393): Xaa can be any naturally occurring amino acid
MGQNQSGPGGGDKKEEKDKKKKYEPPIPTRVGKKKRRTKGPDTALKLPAVTPHTRCRLKLLKLERIKDYLLMEEEFIRNQERLKPQEEKNEEERSKVDDLRGTPMSVGTLEEIIDDNHAIVSTSVGSEHYVSILSFVDKDQLEPGCSVLLNHKVHAVVGVLGDDTDPMVTVMKLEKAPQETYADIGGLDTQIQEIKESVELPLTHPEYYEEMGIKPPKGVILYGPPGTGKTLLAKAVANQTSATFLRVVGSELIQKYLGDGPKLVRELFRVAEEHAPSIVFIDEIDAVGTKRYDSNSGGEREIQRTMLELLNQLDGFDSRGDVKVIMATNRIETLDPALIRPGRIDRKIEFPLPDEKTKKRIFNXHTSRMTLXAEDVNLQELIMAKDDLFGSXDLKLICTESGSKWRCQEKQRKGDE

SEQ ID NO: 24223 - protein, 282 aa, Diabrotica virgifera
  misc_feature: Coding regions on vcDNA: vcDNA=SeqID_3920; Strand=+; Position=152-997
  misc_feature: Homolog annotation: Hit_ID=NP_649990.1; Match level="QueryCoverage =97%, HitCoverage=87%, E-value=1e-102, Identity=65%"; Hit description= CG6284-PA [Drosophila melanogaster] gb|AAF54513.1| CG6284-PA [Drosophila melanogaster]
  misc_feature: Gene Ontology Annotation: Molecular function=molecular_function unknown; Cellular component=cellular_component unknown; Biological process=biological_process unknown
  misc_feature: Pfam annotation: Pfam_ID=SIR2; Match level="Score=45.3, E-value=9e -14, Copies=1"; Pfam description=Sir2 family
  misc_feature (230)..(230): Xaa can be any naturally occurring amino acid
MSCSYADGLSHYENKGVLGVPEQFDSEKKVDEKCEVLAQWIKNSKHIVLHTGAGISTSAGIPDFRGPNGVWTLEKEGKKPNINISFNEAIPTKTHMAIKHLLDKNIIHYVISQNIDGLHLKSGVSRTHMAELHGNMFIGQCNTCESQFVRPEATSTVGKKCLNEDCKRSSMLRGRTCRGKLHDTILDWEDSLPEYDLEMSDYHSSLADLNICLGTTLQIVPSGNLPLRCXKYGGKVAIVNLQPTKHDKKVDLIINSYVDDVISRIMKKLGLEIPDILPKSIQ

SEQ ID NO: 24224 - protein, 200 aa, Diabrotica virgifera
  misc_feature: Coding regions on vcDNA: vcDNA=SeqID_3921; Strand=+; Position=3-604
  misc_feature: Homolog annotation: Hit_ID=XP_319449.1; Match level="QueryCoverage =92%, HitCoverage=65%, E-value=3e-90, Identity=86%"; Hit description =ENSANGP00000014425 [Anopheles gambiae]
  misc_feature: Pfam annotation: Pfam_ID=Ldl_recept_a; Match level="Score=33.7, E -value=5.5e-07, Copies=1"; Pfam description=Low-density lipoprotein receptor doma
  misc_feature (95)..(95): Xaa can be any naturally occurring amino acid
EAPTAHPLLLVAVFVVMCAAIPHSIMAIDLSRLYGHVSSKRGDACHPYEPFKCPGDGNCISIQYLCDGAPDCPDGYDEDSRLCTAAKRPPVEETXSFLKSLLQSHGPNYLEKLFGSKARDALKPLGGVDKVAIALSESQTIEDFGAALHLMRSDLEHLRSVFIAVENGDLGMLKSLGIKDSELGDVKFFLEKLVNTGFLD

SEQ ID NO: 24225 - protein, 148 aa, Diabrotica virgifera
  misc_feature: Coding regions on vcDNA: vcDNA=SeqID_3922; Strand=+; Position=60-506
  misc_feature: Homolog annotation: Hit_ID=AAH46741.1; Match level="QueryCoverage =64%, HitCoverage=19%, E-value=3e-16, Identity=50%"; Hit description =Atp5b-prov protein [Xenopus laevis]
  misc_feature: Gene Ontology Annotation: Molecular function=transporter activity; Cellular component=proton-transporting ATP synthase, catalytic core (sensu Eukarya); Biological process=energy pathways
  misc_feature: Pfam annotation: Pfam_ID=ATP-synt_ab_N; Match level="Score=4.0, E -value=0.082, Copies=1"; Pfam description=ATP synthase alpha/beta family, beta-
MLGAVARATSSLLAGKSIEKVGSESLKIVSSYNVQKRDFAAKAAAGKAQGKVVAVIGAVVDVQFDEELPPILNALEVQNRQPRLFLEADLHLLENSDFYSAINILDNFFVMKCYSFLNISNFLRNKLNLFINNIFIIKYFYIINIKYF

SEQ ID NO: 24226 - protein, 231 aa, Diabrotica virgifera
  misc_feature: Coding regions on vcDNA: vcDNA=SeqID_3923; Strand=-; Position=226-921
  misc_feature: Homolog annotation: Hit_ID=NP_998609.1; Match level="QueryCoverage =96%, HitCoverage=87%, E-value=3e-76, Identity=56%"; Hit description =zgc:55637 [Danio rerio] gb|AAH45413.1| Zgc:55637 [Danio rerio]
  misc_feature: Gene Ontology Annotation: Molecular function=molecular_function unknown; Cellular component=membrane; Biological process =gametogenesis
  misc_feature: Pfam annotation: Pfam_ID=DER1; Match level="Score=284.9, E-value=1.3e- 82, Copies=1"; Pfam description=Der1-like family
MSDLGEWFRSVPIFTRYWFAGSILFTLLGRFGFINPYNLILLYEPLKSFQLWRLVTSVLYYPIQQAGFHYLINLYFLYNYSRRLEEGQYASKPADYLFLLIFNWTCCVVLGLVAELPILMDPMILSVLYIWCQLNKETIVSFWFGTRFKAIYLPWVLLAFNLVLSGGGIMELFGILVGHLYYFLMYKYPQEMGGPVLIQTPSFLKSLFPDQIGGVHGFGVAPRTTCHKRQS

SEQ ID NO: 24227 - protein, 516 aa, Diabrotica virgifera
  misc_feature: Coding regions on vcDNA: vcDNA=SeqID_3924; Strand=+; Position=86-1636
  misc_feature: Homolog annotation: Hit_ID=EAL29273.1; Match level="QueryCoverage =92%, HitCoverage=95%, E-value=0.0, Identity=92%"; Hit description =GA10801-PA [Drosophila pseudoobscura]
  misc_feature: Gene Ontology Annotation: Molecular function=transporter activity; Cellular component=proton-transporting ATP synthase, catalytic core (sensu Eukarya); Biological process=energy pathways
  misc_feature: Pfam annotation: Pfam_ID=ATP-synt_ab; Match level="Score=314.4, E -value=1.7e-91, Copies=1"; Pfam description=ATP synthase alpha/beta family, nucle
MLGAVARATSSLLAGKSIEKVGSESLKIVSSYNVQKRDFAAKAAAGKAQGKVVAVIGAVVDVQFDEELPPILNALEVQNRQPRLVLEVAQHLGENTVRTIAMDGTEGIVRGQQVNDTGYPIRIPVGEATLGRIMNVIGEPIDERGPIDTDKRASIHAEAPEFVDMSVEQEILVTGIKVVDLLAPYAKGGKIGLFGGAGVGKTVLIMELINNVAKAHGGYSVFAGVGERTREGNDLYHEMIESGVISLKDKTSKVALVYGQMNEPPGARARVALTGLTVAEYFRDQEGQDVLLFIDNIFRFTQAGSEVSALLGRIPSAVGYQPTLATDMGSMQERITTTKKGSITSVQAIYVPADDLTDPAPATTFAHLDATTVLSRAIAELGIYPAVDPLDSTSRIMDPNIIGAEHYKVARDVQKILQDYKSLQDIIAILGMDELSEDDKLTVSRARKIQRFLSQPFQVAEVFTGHAGKLVPLEETIKGFQKILAGELDHLPEVAFYMVGPIEEVVQKAEKLAEST

SEQ ID NO: 24228 - protein, 290 aa, Diabrotica virgifera
  misc_feature: Coding regions on vcDNA: vcDNA=SeqID_3925; Strand=+; Position=19-891
  misc_feature: Homolog annotation: Hit_ID=XP_308535.1; Match level="QueryCoverage =96%, HitCoverage=59%, E-value=1e-112, Identity=61%"; Hit description= ENSANGP00000015968 [Anopheles gambiae]
  misc_feature: Gene Ontology Annotation: Molecular function=alpha-L-fucosidase activity; Cellular component=cellular_component unknown; Biological process=fucose metabolism
  misc_feature: Pfam annotation: Pfam_ID=Alpha_L_fucos; Match level="Score=389.7, E -value=3.9e-114, Copies=1"; Pfam description=Alpha-L-fucosidase
MTNKKLLLTFLFALICASRAQYKADWDSLDSRPLPSWFDEAKIGIFLHWGVFSVPSFSSEWFWSYWSSGDSEVVNYLKNYYSPNWKYQNFAKDFTAEFYDPNEWAEIFANSGAKYIVLTSKHHEGYCLWPSKYSYSWNAQDVGPGRDILGELATAVRAKNLKFGLYHSYYEWFNQLYLADKANGYKTQDFVDRKTDPELRELVNTYKPSVIWADGDWDAPDTYWKSKEFLAWLYNESPVKDEVVVNDRWGSGIPCTHGGFFSCQDRYNPGTLQQHKWENAMTIDHKSWGI

SEQ ID NO: 24229 - protein, 267 aa, Diabrotica virgifera
  misc_feature: Coding regions on vcDNA: vcDNA=SeqID_3926; Strand=+; Position=64-866
  misc_feature: Homolog annotation: Hit_ID=XP_393157.1; Match level="QueryCoverage =99%, HitCoverage=49%, E-value=7e-62, Identity=49%"; Hit description =similar to ENSANGP00000016262 [Apis mellifera]
  misc_feature: Pfam annotation: Pfam_ID=LTV; Match level="Score=-35.5, E-value=2.9e -07, Copies=1"; Pfam description=Low temperature viability protein
  misc_feature (237)..(237): Xaa can be any naturally occurring amino acid
  misc_feature (243)..(243): Xaa can be any naturally occurring amino acid
MPKHKIDKQKAVTFQLVHRSQQDPLIADEDAPQRVLLPIKGKQRNTEDLFKNKQKAESIIDEGDDDEDFSDDMEESEGEDQEKVKELKVKFKLPTTVFPSEVEEEVGMLGKAAPVSGPQLHLDPDVVAAMDEDFDYSDPENQLEDNFIELANAVGSGHMNEDDDEYDDNMSGYNSEDLDEVNSLLGSDASFEKEETKSRFTNYSVTSSVMRRNDQLSLLDERFEKMFVGYDENEIGXALDCEXIEGDVSADDIITTLCKPIFQKSPN

SEQ ID NO: 24230 - protein, 455 aa, Diabrotica virgifera
  misc_feature: Coding regions on vcDNA: vcDNA=SeqID_3927; Strand=+; Position=3-1367
  misc_feature: Homolog annotation: Hit_ID=CAB81934.1; Match level="QueryCoverage =42%, HitCoverage=13%, E-value=7e-19, Identity=33%"; Hit description =adhesive serine protease [Anopheles gambiae]
  misc_feature: Pfam annotation: Pfam_ID=CBM_14; Match level="Score=68.3, E-value =2.2e-17, Copies=1"; Pfam description=Chitin binding Peritrophin-A domain
NTGEARYDSNRGQNSYGCRPRENCERPTQEYQYQNNYRCSGQNCVRQTSSYGQTNAGQYSNQHQTSSYGQNTAGQSSNQHQTSSYGQNTAGQYSNQQQTSSYGQNTAGQSSNQHQTSSYGQNTAGQYSNQNPAYTHSTTYGQTDNQEQISTSTEYVGCDLQTLKCFLPGEHGSPINGNTEGLVKKIYKVNQKCNPAVQNCGQYGETYSSSWQNNEYLGNGHGELNRHNCNPATHNCDQYSGQSSTVTQWSTAPQQQATQWSSAQQQRPNYNNICNVNDPSCRRNQPTPQQPASQKKTTNSRPVCPSGFVGLHKHPTECKKYLNCANGQTFVMDCGPGTVFNPKISVCDYPSNVDCTDGESSQVNTYVDSSHNAGRDTTERYTESYTEWHNQNGGDWQESSHNSGCDRPEYVIKPVDKSPEYDDVYNYNHYQRRPQVSTPRSAWITPYQTADSDDL

SEQ ID NO: 24231 - protein, 433 aa, Diabrotica virgifera
  misc_feature: Coding regions on vcDNA: vcDNA=SeqID_3928; Strand=+; Position=139-1440
  misc_feature: Homolog annotation: Hit_ID=XP_313188.1; Match level="QueryCoverage =96%, HitCoverage=97%, E-value=0.0, Identity=74%"; Hit description =ENSANGP00000013378 [Anopheles gambiae]
  misc_feature: Gene Ontology Annotation: Molecular function=ATPase activity; Cellular component=mitochondrial inner membrane; Biological process =aerobic respiration
  misc_feature: Pfam annotation: Pfam_ID=AAA; Match level="Score=75.0, E-value=2.1e -19, Copies=1"; Pfam description=ATPase family associated with various
NTTLVDKMPVTDFISTLSDNPYFGAGFGLFGVGAGAALLRKAFQSSLILFRRHYMITLEVPCRDKSYQWLLQWMTSKGARQTQHLSVETSFEQKDSGLIKTKYDFIPSIGTHFFRYGRTWIRVERTREQHTLDLHMGTPWETVQLTAFGRNKNMFFQILEEARHMALEKHEGKTLMYTAMGSEWRTLGHPRRKRPISSVILDKGISDKILTDCQEFIANPGWYINRGIPYRRGYLLYGPPGCGKSSYITALAGELGFSICILNLSERSLSDDRLNHLLSVAPQQSIILLEDIDAAFVSREDTALQKAAYEGLNRITFSGLLNCLDGVASTEARIVFMTTNYKERLDPALIRPGRVDMQEYIGWCSQDQIERMYLRFYDGEEAASQSKLFAEKVMKFNAKVSPAQVQGFFMIHKHSNFKDVINDCELLVELGKK

SEQ ID NO: 24232 - protein, 167 aa, Diabrotica virgifera
  misc_feature: Coding regions on vcDNA: vcDNA=SeqID_3929; Strand=-; Position=2-502
  misc_feature: Homolog annotation: Hit_ID=AAA59875.1; Match level="QueryCoverage =70%, HitCoverage=20%, E-value=6e-09, Identity=36%"; Hit description =mucin
ALSTAALTLAFCPKIFASTPACAPSCFPTPSLTPPLMPISLPKIFTLVSTFRLANASCPVKTFPVLSTTFSATLPVSFTTAPVPLTTAVPACPTMFPAAPTVCPAPLTTALPPWYTTLPAPSTTFPANPTTPFPMSVRKKQFEVAMRATRKTKINLQFIVVLFCSIF

SEQ ID NO: 24233 - protein, 297 aa, Diabrotica virgifera
  misc_feature: Coding regions on vcDNA: vcDNA=SeqID_3930; Strand=+; Position=105-994
  misc_feature: Homolog annotation: Hit_ID=NP_001062.1; Match level="QueryCoverage =89%, HitCoverage=83%, E-value=1e-93, Identity=65%"; Hit description =thymidylate synthetase [Homo sapiens] gb|AAP35457.1| thymidylate synthetase [Homo sapiens]
  misc_feature: Gene Ontology Annotation: Biological process=deoxyribonucleoside monophosphate biosynthesis
  misc_feature: Pfam annotation: Pfam_ID=Thymidylat_synt; Match level="Score=422.0, E- value=7e-124, Copies=1"; Pfam description=Thymidylate synthase
  misc_feature (144)..(144): Xaa can be any naturally occurring amino acid
  misc_feature (156)..(156): Xaa can be any naturally occurring amino acid
  misc_feature (169)..(169): Xaa can be any naturally occurring amino acid
  misc_feature (181)..(181): Xaa can be any naturally occurring amino acid
  misc_feature (214)..(214): Xaa can be any naturally occurring amino acid
  misc_feature (264)..(264): Xaa can be any naturally occurring amino acid
  misc_feature (288)..(288): Xaa can be any naturally occurring amino acid
MSSLMATQAEKVTIEITLDKANGDTKCNGVQSKVSEQNKKHEEYQYLDHIHHIITNGNKRVDRTGVGTYSIFGAQMRYNLRDSFPLLTTKRVFWRGVVEELLWFIKGSTNAFELSDKNVHIWDANSTREFLDSIGLKDREAGDXGPIYGFQWRHFXGADYKGMHESYKXKGLIQLAHVIKXTFKERPNDRRIIMCAWNPIDIPEMALPPCHCLXSFFCANDELSCQLYQRSADMGLGVPFYIASYALLTYMIAHITDLKLGDFXHTLRKYPEYLTHGKVPKKQFKREXPRPFPKLDN

SEQ ID NO: 24234 - protein, 330 aa, Diabrotica virgifera
  misc_feature: Coding regions on vcDNA: vcDNA=SeqID_3931; Strand=+; Position=111-1101
  misc_feature: Homolog annotation: Hit_ID=XP_308445.1; Match level="QueryCoverage =100%, HitCoverage=78%, E-value=1e-117, Identity=60%"; Hit description=ENSANGP00000017895 [Anopheles gambiae]
  misc_feature: Gene Ontology Annotation: Molecular function=molecular_function unknown; Cellular component=nucleoplasm; Biological process =establishment and/or maintenance of chromatin architecture
  misc_feature: Pfam annotation: Pfam_ID=DMAP1; Match level="Score=37.4, E-value=3.6e- 10, Copies=1"; Pfam description=DNA methyltransferase 1-associated pr
  misc_feature (315)..(315): Xaa can be any naturally occurring amino acid
  misc_feature (324)..(324): Xaa can be any naturally occurring amino acid
MADVRDIMELERPSTPEVTRETFLGNDKLKKRASTGPKVSKRPEGMHREVFALLYNDNKDAPPLFPSDTIGNNGYKQTKIKLGMRKPRKWKWMPFTNPGRSDNATFYHWRRPSDEPKEYPFAKFNKVIEVVKYTEQEYNTHLKCDNWTKEETDHLIDLAKRFDLRFIVMADRYDTEKYPKRSVEDLKQRYYKICGILSKLNGEKKIYTYDADHERRRKEQLKKLYERKPEQIEEEQFLLGELKKIEARKKERERKTQDLQKLISQADSQNDTPRRNDKKLPKKKIANPARPSRVDTNHILQAVESAGIKFSRLLXSGVSLRSQXMKLPAN

SEQ ID NO: 24235 - protein, 104 aa, Diabrotica virgifera
  misc_feature: Coding regions on vcDNA: vcDNA=SeqID_3932; Strand=+; Position=436-750
LCKIFKNIYYLLLRLNSCLTSCSFFVFLGRFTHFVIVLIHYLKKKVLYHVYCIYHMDRSSVSWPVELVVRRLQINFFLFHCFRKYSHTFVIICCMVYVCKYQND

SEQ ID NO: 24236 - protein, 290 aa, Diabrotica virgifera
  misc_feature: Coding regions on vcDNA: vcDNA=SeqID_3933; Strand=+; Position=1-873
  misc_feature: Homolog annotation: Hit_ID=NP_609118.1; Match level="QueryCoverage =100%, HitCoverage=56%, E-value=1e-101, Identity=65%"; Hit description=CG5261-PB, isoform B [Drosophila melanogaster] gb|AAF52514.1| CG5261-PB, isoform B [Drosophila
  misc_feature: Gene Ontology Annotation: Molecular function=dihydrolipoamide S -acetyltransferase activity; Cellular component=pyruvate dehydrogenase complex (sensu Eukarya); Biological process=acetyl-CoA biosynthesis
  misc_feature: Pfam annotation: Pfam_ID=2-oxoacid_dh; Match level="Score=431.7, E -value=8.6e-127, Copies=1"; Pfam description=2-oxoacid dehydrogenases acyltransfer
RVYVSPMAKRLAEQRNIRLQGKGTGLFGSITTSDLAALEAASAAHPMAAALPSAGASASPFVDIPVTGMRATIAKRLLQSKQSIPHYYLSVDINIDNLMAIRAKYNKKLEKQNVKLSVNDFIIKAVAQASLKVPEANSSWNESTIRQYRNVDVSVAVSTDKGLITPIIFEAERKGVVEISKAMKALAAKAREGKLQPQEFQGGTFSISNLGMMGVDQFCAVINPPQSCILAIGTSSSRLIEDPLSEKGFKSAQYMSVTLSCDHRTVDGAVGARWLQAFKENLEDPVAMII

SEQ ID NO: 24237 - protein, 417 aa, Diabrotica virgifera
  misc_feature: Coding regions on vcDNA: vcDNA=SeqID_3934; Strand=+; Position=133-1380
  misc_feature: Homolog annotation: Hit_ID=NP_609118.1; Match level="QueryCoverage =83%, HitCoverage=68%, E-value=4e-89, Identity=53%"; Hit description =CG5261-PB, isoform B [Drosophila melanogaster] gb|AAF52514.1| CG5261- PB, isoform B [Drosophila
  misc_feature: Gene Ontology Annotation: Molecular function=dihydrolipoamide S -acetyltransferase activity; Cellular component=mitochondrion; Biological process=acetyl-CoA biosynthesis
  misc_feature: Pfam annotation: Pfam_ID=Biotin_lipoyl; Match level="Score=64.5, E -value=2.9e-16, Copies=1"; Pfam description=Biotin-requiring enzyme
  misc_feature (296)..(296): Xaa can be any naturally occurring amino acid
  misc_feature (316)..(316): Xaa can be any naturally occurring amino acid
  misc_feature (327)..(327): Xaa can be any naturally occurring amino acid
MFRTIILRNDVAKEIFRKSLRSKTLRNVSIECCKRRHYHRALFGNEHSQVLQRWVKAEHNFVRYYAADLPSHTKVTLPALSPTMELGTIVSWEKKEGDKLNEGDLLAEIETDKATMGFETPEEGYLARIIIPAGTKDVPIGKLVCIIVENEADIAAFKDFKDDGAAAPAPPKAAAPSAPAPSPAAPVAAAPPAPAMVADVSSTGRVYVSPMAKRLAEQRNIRLQGKGTGLFGSITTSDLAALEAASAAHPMAAALPSAGASASPFVDIPVTGMRATIAKRLLQSKQSIPHYYLSVXINIDNLMAIRAKYNKKVKEXQNVKLRGNDFXSIQAGAPASLKGSRGHSSWKESTIRAEHKPKTSAEKYSPHQGLEPPPTIFQTKKKKGVGKNPQKHLKTSLAGQKKKKGKGFNPQKNFPKG

SEQ ID NO: 24238 - protein, 162 aa, Diabrotica virgifera
  misc_feature: Coding regions on vcDNA: vcDNA=SeqID_3935; Strand=+; Position=544-1029
  misc_feature: Homolog annotation: Hit_ID=XP_396554.1; Match level="QueryCoverage =100%, HitCoverage=56%, E-value=7e-75, Identity=78%"; Hit description= similar to ENSANGP00000021801 [Apis mellifera]
  misc_feature: Pfam annotation: Pfam_ID=zf-TRAF; Match level="Score=7.6, E-value =0.0086, Copies=1"; Pfam description=TRAF-type zinc finger
CSNGHLMCAGCFTHVLADARLRDETATCPSCRVEISKTTATRNLAVENAVSELPAECQFCNKQFPRNSLVRHEESECEERISGCKYSRIGCPWRGPLHERSEHEKECVHPNRSGADVMEALKVLDQQMNEERVLYDSIFDLLGYEKITFNDVQLKPYRTDEF

SEQ ID NO: 24239 - protein, 345 aa, Diabrotica virgifera
  misc_feature: Coding regions on vcDNA: vcDNA=SeqID_3936; Strand=+; Position=3-1040
  misc_feature: Homolog annotation: Hit_ID=XP_396554.1; Match level="QueryCoverage =80%, HitCoverage=96%, E-value=1e-127, Identity=75%"; Hit description= similar to ENSANGP00000021801 [Apis mellifera]
  misc_feature: Pfam annotation: Pfam_ID=Sina; Match level="Score=-59.6, E-value =0.0067, Copies=1"; Pfam description=Seven in absentia protein family
QPTSSSSETTSQIVEDVKQEEFLEPDIKKRKISSKLPDDKKYKLEERLGGILCCAVCLDLPRAAVYQCSNGHLMCAGCFTHVLADARLRDETATCPSCRVEISKTTATRNLAVENAVSELPAECQFCNKQFPRNSLVRHEESECEERISGCKYSRIGCPWRGPLHERSEHEKECVHPNRSGADVMEALKVLDQQMNEERVLYDSIFDLLGYEKITFNDVQLKPYRTDEFVHRLFYESSRFSAFNYQWVVKARINNNQKDPTQSSERDMSYQLILKSKSSKPISLSYIVLRGPVGDINVKARIHEFEFTEQNNETPFVKLPLPDTPECNRLLAATTINFRLIMFSK

SEQ ID NO: 24240 - protein, 364 aa, Diabrotica virgifera
  misc_feature: Coding regions on vcDNA: vcDNA=SeqID_3937; Strand=+; Position=107-1361
  misc_feature: Homolog annotation: Hit_ID=XP_396554.1; Match level="QueryCoverage =76%, HitCoverage=96%, E-value=1e-125, Identity=74%"; Hit description= similar to ENSANGP00000021801 [Apis mellifera]
  misc_feature: Pfam annotation: Pfam_ID=zf-TRAF; Match level="Score=7.6, E-value =0.0086, Copies=1"; Pfam description=TRAF-type zinc finger
  misc_feature (187)..(187): Xaa can be any naturally occurring amino acid
MIELAINEDINPIDMSETQPTSSSSETTSQIVEDVKQEEFLEPDIKKRKISSKLPDDKKYKLEERLGGILCCAVCLDLPRAAVYQCSNGHLMCAGCFTHVLADARLRDETATCPSCRVEISKTTATRNLAVENAVSELPAECQFCNKQFPRNSLVRHEESECEERISGCKYSRIGCPWRGPLHERSXHEKECVHPNRSGADVMEALKVLDQQMNEERVLYDSIFDLLGYEKITFNDVQLKPYRTDEFVHRLFYESSRFSAFNYQWWVVKARINNNQKDPTQSSERDMSYQLILKSKSSKPISLSYIVLRGPVGDINVKARIHEFEFTEQNNETPFVKLPLPDTPECNRLLAATTINFRLIMFSK

SEQ ID NO: 24241 - protein, 302 aa, Diabrotica virgifera
  misc_feature: Coding regions on vcDNA: vcDNA=SeqID_3938; Strand=+; Position=2-910
  misc_feature: Homolog annotation: Hit_ID=AAW43830.1; Match level="QueryCoverage =56%, HitCoverage=48%, E-value=1e-10, Identity=26%"; Hit description =isoprenoid biosynthesis-related protein, putative [Cryptococcus neoformans var. neoformans JEC21] gb|EAL20
  misc_feature: Gene Ontology Annotation: Molecular function=dimethylallyltransferase activity; Cellular component=cytosol; Biological process=ergosterol biosynthesis
KSKRSTVDTVFRTTMIKTIFQRDVTRSALKIMGRSNQKRRLATHTKRHPVFVRPTIDFTQEETILKNLIPQIREDILNESLVYQKNMPTVRKQFENLINDTVGDLKPKFLNCALIAIYAYKYFKQDHTEEELVKAGILGWCYKLQDLAMIIVDDILDESKIRYNKPPLYRVVGIKQAILDSIILESGANFLVLKYFSDHKHLVKIQKDLILNIATTTISQKQELSKYEIDELEVFENLIKSFPLLIHAVTSAVYLAGIDDPKIQSIVKKFCVDIAIFGKRYDDFTVFLDPKTIGDKGQHRYR

SEQ ID NO: 24242 - protein, 289 aa, Diabrotica virgifera
  misc_feature: Coding regions on vcDNA: vcDNA=SeqID_3939; Strand=+; Position=160-1024
  misc_feature: Homolog annotation: Hit_ID=XP_318734.1; Match level="QueryCoverage =91%, HitCoverage=73%, E-value=8e-89, Identity=52%"; Hit description =ENSANGP00000016582 [Anopheles gambiae]
  misc_feature: Gene Ontology Annotation: Molecular function=sphingosine-1-phosphate phosphatase activity; Cellular component=membrane fraction; Biological process=apoptosis
  misc_feature: Pfam annotation: Pfam_ID=PAP2; Match level="Score=58.0, E-value=2.6e -14, Copies=1"; Pfam description=PAP2 superfamily
  misc_feature (225)..(225): Xaa can be any naturally occurring amino acid
MEYLKKPELVAKVQKYFGVNTKHIQKDKEYTIENKFWYYLFVFGTALGDETFYSAFIPFWFWNIDGAVGRRVVLVWTIVMYIGQGIKDIIQWPRPGPPVVRLQNKWALEYGMPSTHAMVGVSIPFSVLLYTMGRYQYNIPLGMCIAVLWCTLISISRLYLGMHTVLDVIVGLALAVLIMFPIVPLVDLFDNYLLTSPTSPILLLVSSILLIFYYPNSGKWTPPRXGDTTMILSVCAGIQIGSGLTFPSGLITPPKVPPPKLIRWPPLHNVLKASPSSSSLANSSLVQLP

SEQ ID NO: 24243 - protein, 285 aa, Diabrotica virgifera
  misc_feature: Coding regions on vcDNA: vcDNA=SeqID_3940; Strand=+; Position=3-860
  misc_feature: Homolog annotation: Hit_ID=XP_313043.1; Match level="QueryCoverage =100%, HitCoverage=43%, E-value=1e-110, Identity=68%"; Hit description=ENSANGP00000011712 [Anopheles gambiae]
  misc_feature: Gene Ontology Annotation: Molecular function=electron transporter activity; Cellular component=cytosol; Biological process=pyruvate metabolism
  misc_feature: Pfam annotation: Pfam_ID=Malic_M; Match level="Score=340.6, E-value =2.2e-99, Copies=1"; Pfam description=Malic enzyme, NAD binding domain
DNKFLFLGAGEAAIGIADLTVKALENEGLSEQEARDKIWMVDIDGLLALERPEGGLDGHKKYYAKNHAPIKDFAAIVNEIKPSILIGASAAAGAFTPEILKNMAAFNERPIIFALSNPTSKAECTAEQAYVNTEGRAIFSSGSPFGKVHYGDKVFQPGQGNNAYIFPGVALGVILAGIHHINEQIFLIASETVAKNVSDEDLKRGSLYPPLSSIKECSMQIACEVLEYAYQERIASVYPKPKDMRKYIESHQYNYNYEPSLPQIWPWPNPPYIKTRPMEPTKLKA

SEQ ID NO: 24244 - protein, 502 aa, Diabrotica virgifera
  misc_feature: Coding regions on vcDNA: vcDNA=SeqID_3941; Strand=+; Position=22-1530
  misc_feature: Homolog annotation: Hit_ID=EAA11668.2; Match level="QueryCoverage =96%, HitCoverage=96%, E-value=1e-126, Identity=44%"; Hit description= ENSANGP00000004185 [Anopheles gambiae str. PEST] ref|XP_557099.1| ENSANGP00000004185 [Anopheles gambiae s
  misc_feature: Gene Ontology Annotation: Cellular component=endoplasmic reticulum; Biological process=aging
  misc_feature: Pfam annotation: Pfam_ID=Glyco_hydro_1; Match level="Score=585.5, E -value=4.2e-173, Copies=1"; Pfam description=Glycosyl hydrolase family 1
  misc_feature (447)..(447): Xaa can be any naturally occurring amino acid
MKLVGCFLVFLSVLALGAADGDDEFANYTITNRKFPKGFTFGVATAAYQIEGAWNLDGKGEQVWDTFFHEHPDRVDDGTNGDVATDSYHLYKEDVRCMEEVGVDYYRFSIAWSRILPDGTLDNVSQEGVNYYVNLFKELRAKGIKSFVTLYHWDIPTALEKQGGWRNPKVVDWFQDYAEFCFKTFGEYVDSWVTINEPKQICHAGYGVGGYAPGVVSPGIGEYVCARHVLLAHAKTWRLYDRSYRQQLKSRITIVIDSDWYEPETESEADETAAEHKRQFVYGMYANPIVYGNWPQIMIDNVADFSKKQGFKESRLPAFSEEEIELIKGTYDYLAVNHYTSLMVKARAEPTLIVSWDDDAGVDAYQKSTWETAAIGWFKKVPWGFGKLLRWIKKTYGDIEIVISENGVSDRSGTLQDEHRIKFIQAYMSHMLDAIHDGVNVTAYTLXYSIDNFEWTQGFNGKLGIYYVNQSDPSLPRIAKDSSKYYANVIKTKCLVDSCVDN

SEQ ID NO: 24245 - protein, 129 aa, Diabrotica virgifera
  misc_feature: Coding regions on vcDNA: vcDNA=SeqID_3942; Strand=+; Position=441-830
MFYRARNFEYVFNTLNCFILIFLPHCFVDSINLYIRSSNSRLYYLALLSLKILLASRLNLPCKDPSPDVKNHTFARQSHPRKMCTVSFSGRQILHRSSSANLISFNCLFRLQWPVSRPTMALTVFLPAY

SEQ ID NO: 24246 - protein, 383 aa, Diabrotica virgifera
  misc_feature: Coding regions on vcDNA: vcDNA=SeqID_3943; Strand=+; Position=102-1253
  misc_feature: Homolog annotation: Hit_ID=AAL13539.1; Match level="QueryCoverage =88%, HitCoverage=62%, E-value=2e-73, Identity=41%"; Hit description =GH07286p [Drosophila melanogaster]
  misc_feature (354)..(354): Xaa can be any naturally occurring amino acid
MFKLTNVFQKSCSRSNGLVPFIRFNFASSSSPQLKKTNTESEDVSEKAENRKRLVRAPQPHKSMVAAAFASLNSEEVSSAIKTPQTDGKLSKATNIEELLSVSEGTGVSRRHALKVVSILSEWSSTGKVTISEFENDPRFIKLCHILTKSNIAIKNIKTNSRSEDLSTVLSVTADDEAAKMVANITLPQMVKVMSTLSLKKRRSTLLLRSLSYNITRSTDQLNLKQCSDLLFSMATLNFLDDNLLSRVAGDITVELEKNIKRSSVIGSILTSIGLLKYKNPALLDILSEWILGNQSICRPQDVFSLLMTLAVVNYKPNNSENLFKVLLPQLTLSEAGKPQVWLDIVWSLTLLNXANSSHVSSVLDKSFLDQLEEPLSFSTFEY

SEQ ID NO: 24247 - protein, 263 aa, Diabrotica virgifera
  misc_feature: Coding regions on vcDNA: vcDNA=SeqID_3944; Strand=+; Position=132-923
  misc_feature: Homolog annotation: Hit_ID=EAL40344.1; Match level="QueryCoverage =76%, HitCoverage=100%, E-value=3e-34, Identity=33%"; Hit description= ENSANGP00000028831 [Anopheles gambiae str. PEST] ref|XP_558063.1| ENSANGP00000028831 [Anopheles gambiae s
MYNFVNDIKCSFAVLSALIITVFTTKVKAEACNFQNFIECAKPLSVLTDSGLTFFNNRQDLEQVCPNLRTAIKCIHSFTRRCMKKEDSQHFREVFRGTGSIVHELCRNGRYQEEYLRHAPCMTQISAENEKCFETYTTSMAKLKPNTYEVEVDAEMVDVTSELKKKRAIADEGIKNVCCAFQQYMECSTTAVRDKCGDDTAEFSRRFLNRMSASMLNVHCTEYGKRQCGLEAPIEAWPASSSSSYQSAVALVTSLLTAQLLLR

SEQ ID NO: 24248 - protein, 419 aa, Diabrotica virgifera
  misc_feature: Coding regions on vcDNA: vcDNA=SeqID_3945; Strand=+; Position=92-1351
  misc_feature: Homolog annotation: Hit_ID=EAL28478.1; Match level="QueryCoverage =89%, HitCoverage=92%, E-value=9e-80, Identity=41%"; Hit description =GA14973-PA [Drosophila pseudoobscura]
  misc_feature: Gene Ontology Annotation: Molecular function=serine protease inhibitor activity; Cellular component=cytoplasm; Biological process= regulation of proteolysis and peptidolysis
  misc_feature: Pfam annotation: Pfam_ID=Serpin; Match level="Score=312.9, E-value=5e- 91, Copies=1"; Pfam description=Serpin (serine protease inhibitor)
  misc_feature (309)..(309): Xaa can be any naturally occurring amino acid
MKITLVIALLVAALFKESLQQCFPPFTGNQPSQKAAPDLYSGQQDFSLALLNAVNKVIPNENLFFSPYSTYHALLMAYFLSGRQTESYLKKVLRLNQAQEKADIYAAYKVDKFVTQLLAKSAPYEFTSANKIYVENEVPVRECVLNDFPSELEMKDFKSSPEAARQQINHWVENVTHNMIKDLIPPGTIDSSTNLVLVNAAYFKGLWENKFPPEYTKQEVFYVSPTKQIMVDMMHVEGTFKHDVSESLGAHILEMPYKGDNISMYILLPPFSNTENSIEATLKKLTLANFKNIVENDSLVSKTVQLAFXKFSLETTLEMTPILDLLGLGDLFTEKADFSSLSPEKVYLGGGIHKARIDVHENGTQAAAATALFGFRIFSEENLIVKFACNHPFLYIIYNKNSKTIMFIGIFRSPPQEIY

SEQ ID NO: 24249 - protein, 296 aa, Diabrotica virgifera
  misc_feature: Coding regions on vcDNA: vcDNA=SeqID_3946; Strand=+; Position=100-987
  misc_feature: Homolog annotation: Hit_ID=XP_310009.1; Match level="QueryCoverage =100%, HitCoverage=59%, E-value=2e-78, Identity=46%"; Hit description= ENSANGP00000015076 [Anopheles gambiae]
  misc_feature: Gene Ontology Annotation: Molecular function=enzyme activator activity; Cellular component=spindle; Biological process=cyclin catabolism
  misc_feature: Pfam annotation: Pfam_ID=WD40; Match level="Score=29.3, E-value=1.2e -05, Copies=1"; Pfam description=WD domain, G-beta repeat
MSQFKFWNEVNGLLNMEGPVSGPVPRWQKKKEASSSNNSSNNSIKLRSLSCSALNSTKTPVKGSENDYQRNKTPSKTPKKNRTPTPNKGSKTPGGDRFIPSRSASNLDLAYLKLSQDEAKKSDSPTHKDLQKAMSENLYGTDISNQRILTYKNKPPSAPEGFQNPMKVIYTQTKTPASAKSSSRYIPQAPDRILDAPDIVDDFYLNLIDWGSNNVLAAALGSHVYLWNAGTGNIEQLLELEGNDYVCSLAWIQEGHCLAVGTTNGTVELWDCSGSKKLRIMEGHSARVGSLAWNSF

SEQ ID NO: 24250 - protein, 218 aa, Diabrotica virgifera
  misc_feature: Coding regions on vcDNA: vcDNA=SeqID_3947; Strand=+; Position=38-694
  misc_feature: Homolog annotation: Hit_ID=EAL27524.1; Match level="QueryCoverage =96%, HitCoverage=87%, E-value=2e-16, Identity=27%"; Hit description =GA22042-PA [Drosophila pseudoobscura]
  misc_feature: Pfam annotation: Pfam_ID=GILT; Match level="Score=52.5, E-value=1.2e -12, Copies=1"; Pfam description=Gamma interferon inducible lysosomal t
MDVSKLLLICTFLACAGLSTQTSPEVNLTIYYETYCGPSRQMIEDILIPAYAKLGDILKLNLVSYGGAMYMIHSNGSIEFKCSHGHYECFVNRIHACAINLSPPQAQLLKFIECDLRKSMFNTNDELLEFAKECADDSNLPYDDIEQCVNGSLGDEVLLSFADEQAKAIPNPYYSPDFRFFDIFESNQDIFTVEAFIQHTCSFIEGEKPTVCQKNIKL

SEQ ID NO: 24251 - protein, 404 aa, Diabrotica virgifera
  misc_feature: Coding regions on vcDNA: vcDNA=SeqID_3948; Strand=+; Position=37-1251
  misc_feature: Homolog annotation: Hit_ID=NP_649538.1; Match level="QueryCoverage =79%, HitCoverage=35%, E-value=3e-65, Identity=37%"; Hit description =CG2087-PA [Drosophila melanogaster] gb|AAF52028.2| CG2087-PA [Drosophila melanogaster]
  misc_feature: Gene Ontology Annotation: Molecular function=protein tyrosine kinase activity; Cellular component=extracellular space; Biological process= electron transport
  misc_feature: Pfam annotation: Pfam_ID=PQQ; Match level="Score=30.0, E-value=7.3e -06, Copies=2"; Pfam description=PQQ enzyme repeat
MFFEMKFLFIVINFLSFIIYSRSDIPSLPYCHGSEPGLVIVSTLDGKLSALNSIGSLMWTFDTGPGPLLLSNIHNLELTNNGEWIRIIPSLTGGLYKFDGSTVDPIPITTEELLKSSFKYSDDLVVAGSIDVRTYGIGFHSGTVYYECTSLKCSNSDDQRDEDDLLILERMTHTIRAVEPRNGQERWNFSVGLHDIKLSKISCIYSNTDKIDWNVSAILPDGVLKVSFNHNDVKNKWSHVFPSPIVRAWIWSGKNMSEIDLFVPEQTPSIYLGMHEKQLYIHESSLLQNAIVNRRSGTNVVAESRSIAKIPWKPIGASTTNTEEDSTALSVLNASEYVNGQGFYLHAIMEEQLLCNDSNKNKWLDIEPGEMTYLYYLITPWYWKQLILMTVPLVTAIFVLRKPL

SEQ ID NO: 24252 - protein, 142 aa, Diabrotica virgifera
  misc_feature: Coding regions on vcDNA: vcDNA=SeqID_3949; Strand=+; Position=337-765
MYRQGPVYRPGYSHAPCYQCLGYPNPNEYSGYPVPYGGSQPYLGEYQQAPFSGYQQPYGGYPLPYGGYVAPPYFPVSTEVNGTIPIQVNENLMDEGRVPRELEIEVNYEQPSDAQAEVKIKEDDESNLVVEEEKKEIVEESS

SEQ ID NO: 24253 - protein, 341 aa, Diabrotica virgifera
  misc_feature: Coding regions on vcDNA: vcDNA=SeqID_3950; Strand=+; Position=136-1158
  misc_feature: Homolog annotation: Hit_ID=CAE57866.1; Match level="QueryCoverage =80%, HitCoverage=69%, E-value=2e-09, Identity=23%"; Hit description =Hypothetical protein CBG00905 [Caenorhabditis briggsae]
CQVGSGIYFSTMRVLVLILCVAFLHLVAGACYDSKEECHSTNYETYVECVRRRQKRSTDCESRCDSGNCIDTCQECDCSSCSYNSCTSSCGSCCSSCCSNYVPCHTNHCCHKTCHAQCSTSSCRSNCRKNCFDIVKERSQTVVVEPGEETISKTNANINNVNKPNITTIIHLNNIINTTNLVDIPIILNNTNTQNITLFNEETGLSTTLQCCTVISPRECVSSPQPRCFHYRTKECGSFCTASIVHKEEQKLCSVNYPGAAPSCSKQIYYIPQPQPKCTYQSVWPYVSCGIQKKETCQGCYSHYVNGGTPNYLTCPPLCYVERALPPSKGKKEGGVGGGGG

SEQ ID NO: 24254 - protein, 248 aa, Diabrotica virgifera
  misc_feature: Coding regions on vcDNA: vcDNA=SeqID_3951; Strand=+; Position=1-747
  misc_feature: Homolog annotation: Hit_ID=XP_392460.1; Match level="QueryCoverage =100%, HitCoverage=18%, E-value=2e-19, Identity=30%"; Hit description= similar to BMKETTIN [Apis mellifera]
  misc_feature: Gene Ontology Annotation: Molecular function=cytoskeletal regulatory protein binding; Cellular component=microtubule associated complex; Biological process=mitotic chromosome condensation
LKRTKKEKKEQVKDEIETVELKPHKKQHVEEETIIKDVTEDKEEVVDVTTGKKVIKKVKKDKKFEEKDIKIEEEEKPQYLAKEVDVKPEDSTTETVEEVKQTDTRSWRKPKKPIQPEVEEQKPESGTTEQPKEVYEVTEEETVFEKSKEEVIPWNKQQITLKRTKKEKKEQVKDEIETVELKPHKKQHVEEETIIKDIIEDKDEDVKVTTDKKVIKKVKKDKTFEEKDVKIEEEEKPQYVAKEVDVKP

SEQ ID NO: 24255 - protein, 219 aa, Diabrotica virgifera
  misc_feature: Coding regions on vcDNA: vcDNA=SeqID_3952; Strand=+; Position=738-1397
  misc_feature: Homolog annotation: Hit_ID=NP_730963.1; Match level="QueryCoverage =96%, HitCoverage=50%, E-value=1e-63, Identity=53%"; Hit description =CG2922-PF, isoform F [Drosophila melanogaster] ref|NP_730962.1| CG2922-PE, isoform E [Drosophila
  misc_feature: Gene Ontology Annotation: Molecular function=translation initiation factor activity; Cellular component=cellular_component unknown; Biological process=amino acid metabolism
  misc_feature: Pfam annotation: Pfam_ID=W2; Match level="Score=97.5, E-value=3.3e -26, Copies=1"; Pfam description=eIF4-gamma/eIF5/eIF2-epsilon
LYQFLLHKKSNIESHLTSFIPDTKQSQLYFRNAFQDNGLEEILKLYNDQHQQLAKKELQVLLADNLSENKPLRDIINEIKEIALKDNIQEHEIACIIWTTVMDIPEWSKKEELVTEQAVRHLKYYTNLFGAFTESARSEINLLLKVQDYCYSNMTFMKAFQKIIMLFYKTDVISEQTILKWYKQDYNVKGKMMFVEQMKEFINWLQNAEEESDSEGDSE

SEQ ID NO: 24256 - protein, 180 aa, Diabrotica virgifera
  misc_feature: Coding regions on vcDNA: vcDNA=SeqID_3953; Strand=+; Position=111-653
  misc_feature: Homolog annotation: Hit_ID=NP_647799.1; Match level="QueryCoverage =76%, HitCoverage=16%, E-value=1e-40, Identity=57%"; Hit description =CG12009-PA [Drosophila melanogaster] gb|AAF47752.1| CG12009-PA [Drosophila melanogaster]
  misc_feature: Pfam annotation: Pfam_ID=CBM_14; Match level="Score=54.1, E-value =3.9e-13, Copies=1"; Pfam description=Chitin binding Peritrophin-A domain
MKTVLVLPVFFCLVNSAPKLRLTPQFIAPPSLLTLPSNATSIRTDISDSFHCEGRDYGYYADVENDCQLFHVCLPVTYSDGRNQTFRWSFICPEETVFNQEMFTCTRADEAIDCAESPRFYELNRNFGSEEIIGEVIDSVVPSTPEPHYLEEATALPDVPQGLGRNLSRRGGNKPDLKKQ

SEQ ID NO: 24257 - protein, 448 aa, Diabrotica virgifera
  misc_feature: Coding regions on vcDNA: vcDNA=SeqID_3954; Strand=+; Position=86-1432
  misc_feature: Homolog annotation: Hit_ID=NP_730963.1; Match level="QueryCoverage =95%, HitCoverage=100%, E-value=1e-141, Identity=57%"; Hit description=CG2922-PF, isoform F [Drosophila melanogaster] ref|NP _730962.1| CG2922-PE, isoform E [Drosophila
  misc_feature: Pfam annotation: Pfam_ID=W2; Match level="Score=32.4, E-value=1.3e -06, Copies=1"; Pfam description=eIF4-gamma/eIF5/eIF2-epsilon
MSQKVEKPVLSGQRIKTRKRDEKERYDPTGFRDAIISGLDKCSNDFEAISRYLDSAGNKLDYRRYGECLFDVLIAGGILVPGGTLSQEGDGPYRTEACIFNTPDEINMDIMKNWEQVFIKLMRRYKYLEKLFQDEIKKILLFVKYFLPSDRKKLSVMLYIWIANGSIPFTAVLVLNNSHLVKDHLALDFLIDIFKAWRQEKGVNSLHSAIKKSNIESHLTSFIPDTKQSQLYFRNAFQDNGLEEILKLYNDQHQQLAKKELQVLLADNLSENKPLRDIINEIKEIALKDNIQEHEIACIIWTTVMDIPEWSKKEELVTEQAVRHLKYYTNLFGAFTESARSEINLLLKVQDYCYSNMTFMKAFQKIIMLFYKTDVISEQTILKWYKQDYNVKGKMMFVEQMEKNSSIGYQNAKEEKVPEGEREKGKRGFLFGQKNKIASSPPITFKKN

SEQ ID NO: 24258 - protein, 326 aa, Diabrotica virgifera
  misc_feature: Coding regions on vcDNA: vcDNA=SeqID_3955; Strand=+; Position=93-1073
  misc_feature: Homolog annotation: Hit_ID=EAA13927.3; Match level="QueryCoverage =93%, HitCoverage=91%, E-value=1e-130, Identity=73%"; Hit description= ENSANGP00000011976 [Anopheles gambiae str. PEST] ref|XP_553905.1| ENSANGP00000011976 [Anopheles gambiae s
  misc_feature: Gene Ontology Annotation: Molecular function=dolichyl-diphospho -oligosaccharide-protein glycosyltransferase activity; Cellular component=integral to membrane; Biological process=protein modification
  misc_feature: Pfam annotation: Pfam_ID=OST3_OST6; Match level="Score=531.9, E-value= 5.8e-157, Copies=1"; Pfam description=OST3 / OST6 family
MKYLYLLLFLNLVAIVNVYGQQKRQPHTMAERVQQLTDMANKRPVLRFNANKFRDFVKASPRNYSVIIMFTAMAPQRQCQVCRHASEEFAIVANSYRYSQSYSNKLFFAVVDFDEGSDVFQMLRLNTAPVFIHFPPKGKPKNADTMDIQRIGFGAETIAKWIAERTDNQIRVFRPPNYSGTFALIILFAIVAAFLYLRRNNLEFLYNKTMWGLGALFFCFAMTSGQMWNHIRGPPFIHKTGNGQIAYIHGSSQGQFVFETYIVMFLNGAVVLGMILLTESARGKGDPKKRKIFAVSGLVLLSVFFSLLLSVFRTKTQGYPYSFLFK

SEQ ID NO: 24259 - protein, 371 aa, Diabrotica virgifera
  misc_feature: Coding regions on vcDNA: vcDNA=SeqID_3956; Strand=+; Position=1-1116
  misc_feature: Homolog annotation: Hit_ID=EAA09270.2; Match level="QueryCoverage =90%, HitCoverage=52%, E-value=1e-131, Identity=62%"; Hit description= ENSANGP00000003935 [Anopheles gambiae str. PEST] ref|XP_562256.1| ENSANGP00000003935 [Anopheles gambiae s
  misc_feature: Gene Ontology Annotation: Cellular component=nuclear lamina; Biological process=torso signaling pathway
  misc_feature: Pfam annotation: Pfam_ID=DOMON; Match level="Score=0.7, E-value =0.027, Copies=1"; Pfam description=DOMON domain
PTRPAADKSLMIGADVAVAYIDGFRGFATDYNITALTPCVKVLGQYKGVCKDEMVGGQDSNQMNTAARENGISIITYRRSLISPDPGDKEFPAEGSIYAVWGVGKLDEMKEPAFHDLYSKTDIKMEMTPKEPQNNCVSFTRSKPEPKEPWKKGQIFDKTIRIFKSYIGPSGAKRGYQAITGHSSTALAWYINGFLSPEIWLRRGLSYAFKVYGGNNPHSAEYYHPLIITDEPHGGFDRLTDEAQSKIRVLAGVEYSRRGRPRPTTSGVLCLSEHKEGKDRRLDDDFETFKKFNKSLMYHCETGDPGVLEFTPNTSWPDIVYYNSFTQANMGWKIRIVDSFNQRSSAQSWTMLSSNFYVLYLVTGVYVLFTM

SEQ ID NO: 24260 - protein, 448 aa, Diabrotica virgifera
  misc_feature: Coding regions on vcDNA: vcDNA=SeqID_3957; Strand=+; Position=74-1415
  misc_feature: Homolog annotation: Hit_ID=NP_523984.1; Match level="QueryCoverage =99%, HitCoverage=61%, E-value=1e-179, Identity=69%"; Hit description= CG4978-PA [Drosophila melanogaster] gb|AAF50357.1| CG4978-PA [Drosophila melanogaster]
  misc_feature: Gene Ontology Annotation: Molecular function=nucleotide binding; Cellular component=replication fork; Biological process=DNA replication
  misc_feature: Pfam annotation: Pfam_ID=MCM; Match level="Score=-24.9, E-value=4.2e -16, Copies=1"; Pfam description=MCM2/3/5 family
  misc_feature (406)..(407): Xaa can be any naturally occurring amino acid
  misc_feature (437)..(437): Xaa can be any naturally occurring amino acid
MARRDYDKDKEQLKTFLMEYCVQDVSGVKIFKYSNQLTKLAHREQVAMWIELDDVNDFDDDLARAIQANTRRYSTILGDIVFDLLPTFVQKDVIAKDALDVYIEHRLMMENRLRQPNEHREARNKFPSELMRRYEVYFQDLTTNKPVPIREIKADHVGQLVTARGIVTRCTEVKPMMCVATYTCDQCGAETYQPVNALSFMPADMCQSADCKTNRSGGRLYLQTRGSKFIKFQEVKIQEHSDQVPVGHIPRTLTVFCRGEVTRQALPGDHVAITGVFLPLLKQGFKQIMGGLLSDTYMEAHKIISLNKMNMENSDNLLTPEELATLTEDDFYTKLAMSLAPEIYGHLDVKKALLLLLVGGVDKRPDGMKIRGNINICLMGDPGVAKSQLLGYINRLAPRSQYTTGXXVHLGVGLTASVMKDPMTGEMMLEGGALVLXDQGVWCIDDLI

SEQ ID NO: 24261 - protein, 135 aa, Diabrotica virgifera
  misc_feature: Coding regions on vcDNA: vcDNA=SeqID_3958; Strand=+; Position=3-410
  misc_feature: Homolog annotation: Hit_ID=EAL33731.1; Match level="QueryCoverage =91%, HitCoverage=22%, E-value=1e-38, Identity=59%"; Hit description =GA14454-PA [Drosophila pseudoobscura]
  misc_feature: Gene Ontology Annotation: Molecular function=sterol carrier activity; Cellular component=peroxisome; Biological process=steroid biosynthesis
  misc_feature: Pfam annotation: Pfam_ID=SCP2; Match level="Score=101.6, E-value=2e -27, Copies=1"; Pfam description=SCP-2 sterol transfer family
FGPPNSDLVGGDNFEASKYLRILQQAMNEDEEGLVERHRGIYGLKVVKKSGETGYWVINTKVGKGQIVFNGKDKPDVTFIVKEEDVLELLSGKIPPQKAFFQGKVKIQGNMGVAMRLIELQKTAAAKIEVLRAKL

SEQ ID NO: 24262 - protein, 457 aa, Diabrotica virgifera
  misc_feature: Coding regions on vcDNA: vcDNA=SeqID_3959; Strand=+; Position=136-1505
  misc_feature: Homolog annotation: Hit_ID=XP_416458.1; Match level="QueryCoverage =97%, HitCoverage=60%, E-value=1e-100, Identity=45%"; Hit description= PREDICTED: similar to SAM50-like protein CGI-51 [Gallus gallus]
  misc_feature: Gene Ontology Annotation: Molecular function=molecular_function unknown; Cellular component=cellular_component unknown; Biological process=biological_process unknown
  misc_feature: Pfam annotation: Pfam_ID=Bac_surface_Ag; Match level="Score=111.3, E -value=2.5e-30, Copies=1"; Pfam description=Surface antigen
  misc_feature (374)..(374): Xaa can be any naturally occurring amino acid
  misc_feature (393)..(393): Xaa can be any naturally occurring amino acid
MGTVHAKNFQADENFTDSPNSNLKSKAMFREPPDKEQIKEIDLEGVKARVDKIHVDGLSRTKNDIIEDCIKELFKARDFQDVLLKAHKARVKLDELGCFKNISVYIDTSKGSKSTPDGLEVTFNVKEHKRITGGVSTHVGNNEGVLQIGMRAPNIFGRGERVQVEYSHGSKKSSNFNLAFIKPFRGTYRPTLTTSVFQSHSEWPASGYKQLERGLIFDLGFYSWSLLKHNLQWEGNIRDLSVLTRNASFDVRKESGLSLKSSLRHILSLDLRDDLIFPSSGSLLQLTSEVAGLGGDVGFLKNDIFVQGNYSIAEDIVFQACFSTGYMTSISNDLKISLSDMYFLGGPLSLRGFQNRGVGPHSDGDALGSKAYWXAGGLHLFTPLPFRPGRGGXGDLFRTHFFMNAGNIGNVEVLKDGNLVDLIQNNLRVSYGVGIALRLGNMARLEIILLSYITIKR

SEQ ID NO: 24263 - protein, 356 aa, Diabrotica virgifera
  misc_feature: Coding regions on vcDNA: vcDNA=SeqID_3960; Strand=+; Position=39-1109
  misc_feature: Homolog annotation: Hit_ID=XP_312614.1; Match level="QueryCoverage =99%, HitCoverage=97%, E-value=1e-124, Identity=67%"; Hit description= ENSANGP00000024411 [Anopheles gambiae]
  misc_feature: Gene Ontology Annotation: Molecular function=tropomyosin binding; Cellular component=troponin complex; Biological process=regulation of striated muscle contraction
  misc_feature: Pfam annotation: Pfam_ID=Troponin; Match level="Score=117.9, E-value =2.5e-32, Copies=1"; Pfam description=Troponin
  misc_feature (75)..(75): Xaa can be any naturally occurring amino acid
  misc_feature (89)..(89): Xaa can be any naturally occurring amino acid
ISLTMSDEEEVYSEEEEEEEVVVTTTTTTTKVEEGAIDPEFIKREDQKRSDYCEMLLCVHLLWNETMFQVRNRQXCLSRKLRLFINYIXDEERKMAERKKAEEERRVREIEEKKQRDIEEKRQRLEEAEKKRQAMMQALKDQNKNKGPNFTITKRDAASNLSAAQLERNKTKEQLEEEKKISLSIRIKPLVLDGLSVDKLRERATELWDCIVKLETEKYDLEERQKRQDYDLKELKERQKQQLRHKALKKGLDPEALTGKYPPKIQVASKYERRVDTRSYSDKKHLFEGGFENIVKDLNEKSWKEKFGQFDSRQKTRLPKWFGERPGKKSGDPETPEGEEEAVRARCRIYGIHEIV

SEQ ID NO: 24264 - protein, 381 aa, Diabrotica virgifera
  misc_feature: Coding regions on vcDNA: vcDNA=SeqID_3961; Strand=+; Position=78-1223
  misc_feature: Homolog annotation: Hit_ID=S02708; Match level="QueryCoverage=100%, HitCoverage=96%, E-value=1e-160, Identity=75%"; Hit description =troponin T - fruit fly (Drosophila melanogaster)
  misc_feature: Gene Ontology Annotation: Molecular function=tropomyosin binding; Cellular component=troponin complex; Biological process=regulation of striated muscle contraction
  misc_feature: Pfam annotation: Pfam_ID=Troponin; Match level="Score=117.9, E-value =2.5e-32, Copies=1"; Pfam description=Troponin
MSDEEEVYSEEEEEEEVVETTTTTTTKVEEGAGDPEFIKRQDQKRSDLDEQLREYITEWRKQRAKEEEDLKKLKEKQAKRKITRADEERKMAERKKAEEERRVREIEEKKQRDIEEKRQRLEEAEKKRQAMMQALKDQNKNKGPNFTITKRDAASNLSAAQLERNKTKEQLEEEKKISLSIRIKPLVLDGLSVDKLRERATELWDCIVKLETEKYDLEERQKRQDYDLKELKERQKQQLRHKALKKGLDPEALTGKYPPKIQVASKYERRVDTRSYSDKKHLFEGGFENIVKDLNEKSWKEKFGQFDSRQKTRLPKWFGERPGKKSGDPETPEGEEEGKQAADDDEDLKEPVIEPEPEEEEEEEEVEVDEEEEDDEEEEEE

SEQ ID NO: 24265 - protein, 112 aa, Diabrotica virgifera
  misc_feature: Coding regions on vcDNA: vcDNA=SeqID_3962; Strand=-; Position=686-1024
  misc_feature: Homolog annotation: Hit_ID=AAV91405.1; Match level="QueryCoverage =100%, HitCoverage=100%, E-value=7e-44, Identity=79%"; Hit description=ribosomal protein 7 [Lonomia obliqua]
  misc_feature: Gene Ontology Annotation: Molecular function=structural constituent of ribosome; Cellular component=cytosolic large ribosomal subunit (sensu Eukarya); Biological process=protein biosynthesis
  misc_feature: Pfam annotation: Pfam_ID=Ribosomal_60s; Match level="Score=128.2, E -value=1.9e-35, Copies=1"; Pfam description=60s Acidic ribosomal protein
MSTSAELACVYSALILADDDIAVTGEKIQTILKAANVEVEPYWPGLFAKALEGVNIKDLITNIGSGVGGGAPAGGASAAAPAAAAAAAPAKEDKKESEPEESDDDMGLGLFD

SEQ ID NO: 24266 - protein, 164 aa, Diabrotica virgifera
  misc_feature: Coding regions on vcDNA: vcDNA=SeqID_3963; Strand=+; Position=130-624
  misc_feature: Homolog annotation: Hit_ID=AAP33157.1; Match level="QueryCoverage =93%, HitCoverage=83%, E-value=2e-64, Identity=80%"; Hit description =beta-NAC-like protein [Reticulitermes flavipes]
  misc_feature: Gene Ontology Annotation: Molecular function=transcription factor activity; Cellular component=nucleus; Biological process=regulation of transcription, DNA-dependent
  misc_feature: Pfam annotation: Pfam_ID=NAC; Match level="Score=104.6, E-value=2.5e -28, Copies=1"; Pfam description=NAC domain
MNSEKLKKMQSQVRIGGKGTPRRKKKVVHSTQATDDKKLQSSLKKLSVNTIPGIEEVNMIKEDGTVIHFNNPKTQASLAANTFAITGHGENKQITDMLPGILSQLGPEGITQLKRLANTVANAGGVGKIVPEDEEDVPDLVENFDEASKGEVTKKEGEEKPKEN

SEQ ID NO: 24267 - protein, 381 aa, Diabrotica virgifera; identical to SEQ ID NO: 24264
  misc_feature: Coding regions on vcDNA: vcDNA=SeqID_3964; Strand=+; Position=885-2030
  misc_feature: Homolog annotation: Hit_ID=S02708; Match level="QueryCoverage=100%, HitCoverage=96%, E-value=1e-160, Identity=75%"; Hit description =troponin T - fruit fly (Drosophila melanogaster)
  misc_feature: Gene Ontology Annotation: Molecular function=tropomyosin binding; Cellular component=troponin complex; Biological process=regulation of striated muscle contraction
  misc_feature: Pfam annotation: Pfam_ID=Troponin; Match level="Score=117.9, E-value =2.5e-32, Copies=1"; Pfam description=Troponin

SEQ ID NO: 24268 - protein, 237 aa, Diabrotica virgifera
  misc_feature: Coding regions on vcDNA: vcDNA=SeqID_3965; Strand=+; Position=101-814
  misc_feature: Homolog annotation: Hit_ID=XP_395909.1; Match level="QueryCoverage =78%, HitCoverage=80%, E-value=3e-73, Identity=74%"; Hit description =similar to ENSANGP00000019116 [Apis mellifera]
  misc_feature: Gene Ontology Annotation: Molecular function=transcription factor activity; Cellular component=nucleus; Biological process=regulation of transcription, DNA-dependent
  misc_feature: Pfam annotation: Pfam_ID=HLH; Match level="Score=77.5, E-value=3.5e -20, Copies=1"; Pfam description=Helix-loop-helix DNA-binding domain
MYFLIVWRNYIIIKSTIYLENSKSKHQIAKMPHEHIKYTNSVSSVNNSDEEEDVESKTSPMSYKERRREAHTQAEQKRRDAIKKGYDTLQELVPTCQQPDVSGYKLSKATVLQKSIDYIQYLQMQKKKQEEERNALRKEVVALRIMQTNYEQIVKAQQSQPGHTETRISDEVKFSVFQAIMDELFATFSGVSVNNFSELSAGVFSWLEEYCKPLTLKDTVYQVLRLHHHTHTRGQQN

SEQ ID NO: 24269 - protein, 299 aa, Diabrotica virgifera
  misc_feature: Coding regions on vcDNA: vcDNA=SeqID_3966; Strand=+; Position=1-900
  misc_feature: Homolog annotation: Hit_ID=XP_393358.1; Match level="QueryCoverage =86%, HitCoverage=42%, E-value=3e-98, Identity=63%"; Hit description =similar to ENSANGP00000021627 [Apis mellifera]
  misc_feature: Gene Ontology Annotation: Molecular function=enzyme activator activity; Cellular component=integral to membrane; Biological process=proteolysis and peptidolysis
  misc_feature: Pfam annotation: Pfam_ID=Hemopexin; Match level="Score=223.7, E-value= 3.4e-64, Copies=4"; Pfam description=Hemopexin
DDIEGIRALYGQKTNKFPPRFDDGDQDSDYDNSHNVPKTKPSGGSDPSLCADPTFDTIFTSAEGYTYVFKGEKYWRLTDDSIAPGFPKLISDYWVGLPGNIDAAFTYKNGKTYFFKGSKYWRYKGKKPDGDYPKEISVGFTGIPDDVDSALVWSGNGKIYFYKGSKFWRFDPSQKPPVKSNYPKPISNWDGIPNNIDAAFQWTNGYTYFYKNNAYYRFNDRAFAVDVTTPAFPRSTAYWWFGCKDAPAGTIGSSESMRGTLIGEESSYPKFFDTSNDNDTDVHHDMSELPPQEYSGKRK

SEQ ID NO: 24270 - protein, 318 aa, Diabrotica virgifera
  misc_feature: Coding regions on vcDNA: vcDNA=SeqID_3967; Strand=+; Position=1-955
  misc_feature: Homolog annotation: Hit_ID=XP_313366.1; Match level="QueryCoverage =99%, HitCoverage=65%, E-value=6e-95, Identity=55%"; Hit description =ENSANGP00000011369 [Anopheles gambiae]
  misc_feature: Pfam annotation: Pfam_ID=Sterile; Match level="Score=-23.8, E-value =2.3e-06, Copies=1"; Pfam description=Male sterility protein
  misc_feature (284)..(284): Xaa can be any naturally occurring amino acid
EISERLNEIKKNSVFETLLKDKDVEQVFAKVKAIAGDVGEDKLGISDSDWQLLTEKINVIFHSAATLDFGDTLDTTVNINLLGTRRVTELAKACRNLAVFVHVSSAYVNSYKLHADEIIYPLPRDADELIATVKKLSKEELLKETPALLGDHPNTYTITKHMAEHEIQKCESLFPCTIVRPSMIIGCWKEPVPGWTISKNGPQGFLMGAAKGVIRRLPVATNLVYDYIPVDIVVNSLIVAGAHAGHTKTSKVEVYHATSSTREPFRWSSVENKITEYLHKYPLXKSAVWYPHLKFLPTITCYNVTAFFVHSIHVIVFI

SEQ ID NO: 24271 - protein, 265 aa, Diabrotica virgifera
  misc_feature: Coding regions on vcDNA: vcDNA=SeqID_3968; Strand=+; Position=52-849
LPPSTNMNCKLLTSFVLLFGCCHAALITGQNGLLDKVTDFFAIDNIASLDANARAKVLNNEIGADLSAGIGKQGIGAYGQVNGDVLGQKANVQADILNGREIDQRNHEVYRDNYGRQYTLKREYVGSKLVMVRQYLDDGQIYVEGKNDDNEIQYTQPDNNNYMWDERTGQYILVDPSYLQSVNGQYNPSIYYPSNGQEVMYPNSGDRMMYQPNTQVVYENQPGDSRIMYQPGGQVVYEKQPELVLREGGGLISRLRDRAHKLIRG

SEQ ID NO: 24272 - protein, 155 aa, Diabrotica virgifera
  misc_feature: Coding regions on vcDNA: vcDNA=SeqID_3969; Strand=+; Position=56-523
  misc_feature: Homolog annotation: Hit_ID=XP_320211.1; Match level="QueryCoverage =93%, HitCoverage=85%, E-value=4e-41, Identity=57%"; Hit description =ENSANGP00000020050 [Anopheles gambiae]
  misc_feature: Gene Ontology Annotation: Molecular function=protein translocase activity; Cellular component=mitochondrial outer membrane translocase complex; Biological process=mitochondrial translocation
  misc_feature: Pfam annotation: Pfam_ID=MAS20; Match level="Score=-13.2, E-value =6.3e-05, Copies=1"; Pfam description=MAS20 protein import receptor
MVSPQAMIGICAGVSATLFIGYCFYFDKQRHNDPEFKKKLRQRRRARRDAAASSGKRSSTVFPNIKDHEAVQRFFLQEIQLGEELLAAGDLENGVDHLGNAVTVCGQPNDLLQVLQQTLQPNVFHLLIERLPAVAPRLMKAQSGQSASLQEDDVE

SEQ ID NO: 24273 - protein, 100 aa, Diabrotica virgifera
  misc_feature: Coding regions on vcDNA: vcDNA=SeqID_3970; Strand=-; Position=422-724
TAKYNLHIYQFRLTLNHWHTICHTTPKIYFVVKLVLYKILRKPYSLIRKKSDITQKMHKSSYLVKLTPNILYFYQEKCHIDIYFQLLKMAVVSLFFGLVK

SEQ ID NO: 24274 - protein, 446 aa, Diabrotica virgifera
  misc_feature: Coding regions on vcDNA: vcDNA=SeqID_3971; Strand=+; Position=2-1339
  misc_feature: Homolog annotation: Hit_ID=XP_395212.1; Match level="QueryCoverage =100%, HitCoverage=68%, E-value=0.0, Identity=26%"; Hit description =similar to ENSANGP00000012507 [Apis mellifera]
  misc_feature: Gene Ontology Annotation: Molecular function=microtubule binding; Cellular component=plasma membrane; Biological process=neuromuscular synaptic transmission
  misc_feature: Pfam annotation: Pfam_ID=Spectrin; Match level="Score=309.7, E-value =4.4e-90, Copies=4"; Pfam description=Spectrin repeat
FSRRLGDEGHFAGDKITKRADNIDERRMANREKAQALLERLRDQLELQQFLRDCDELGEWIQEKHITAQDETYRSAKTVHSKWTRHQAFEAEIGANKERLHNLQKAAEELAKEKPEYASHIQPKIEDMVDQFDVLEQTTKEKGERLFDANREVLIHQTCDDIDSWMNDLEKQIESDDTGADLASVNILMQKQQMIETQMAVKARQVGELEKQTKHLETAAPEKDMEEIKVKKKKVEQRFAQLKEPLIERQRVLEKKKEALQFRRDVEDELLWIAEKMPQALSTEYGNSLFQVHMLEKKNQSLQTEVDNHEPRINTVCNNGQKLIDEGHEDSGEFSRLINELHKAWQELKDAIEKRRENLLRNERAQQYLFDANEAESWMSEQELYMMVEDRGKDETSARNCMKKHESLEAAVEAYADTIRSFGETVRALAAEGHPLAEQVAVKQSQ

SEQ ID NO: 24275 - protein, 227 aa, Diabrotica virgifera
  misc_feature: Coding regions on vcDNA: vcDNA=SeqID_3972; Strand=+; Position=3-686
HAMSRLILQSLLVTFLLFQTISAQPYLPQYWKRAADVGVNHGLEKRDASWWNEHVVEHPTYYVKRAADVGVNHGLDKRDASWWNEHVVEHPTYYVKRAADVGVNHGLDKRDASWWNEHVVEHPTYYVKRAADVGVNHGLDKRDASWWNEHVVEHPTYYVKRAADEGVNHGWIYDDERLDKRKAVNRDWINNEQILLKRDAKLAVSRSGGWREVKRSPSMTYIPLGAR

SEQ ID NO: 24276 - protein, 87 aa, Diabrotica virgifera
  misc_feature: Coding regions on vcDNA: vcDNA=SeqID_3973; Strand=-; Position=518-781
QIFFQNSLSTEANKIDLKINISKIKSMRTNARNDTLFTIHNMQIKDVENFTYFGSVKFVIEILKFQPRGKSPVLPWVISRNISNIIV

SEQ ID NO: 24277 - protein, 66 aa, Diabrotica virgifera
  misc_feature: Coding regions on vcDNA: vcDNA=SeqID_3974; Strand=+; Position=38-238
  misc_feature (54)..(54): Xaa can be any naturally occurring amino acid
SEHSNNLTSVTKNWNFNGFNNSRIKKTLPVSTFNHNLRGPYLKPNKNDGCCALXKFVFRLEQITVK

SEQ ID NO: 24278 - protein, 70 aa, Diabrotica virgifera
  misc_feature: Coding regions on vcDNA: vcDNA=SeqID_3975; Strand=-; Position=224-436
  misc_feature (13)..(20): Xaa can be any naturally occurring amino acid
  misc_feature (58)..(64): Xaa can be any naturally occurring amino acid
MVCSGSCNCKCFXXXXXXXXLFGKCKMLKCFDLHNLISNKISTNLHLIYCFLTLYFVXXXXXXXIKIKLI

SEQ ID NO: 24279 - protein, 98 aa, Diabrotica virgifera
  misc_feature: Coding regions on vcDNA: vcDNA=SeqID_3976; Strand=-; Position=0-293
  misc_feature (5)..(95): Xaa can be any naturally occurring amino acid
KKIVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXWTR

SEQ ID NO: 24280 - protein, 85 aa, Diabrotica virgifera
  misc_feature: Coding regions on vcDNA: vcDNA=SeqID_3977; Strand=+; Position=9-266
  misc_feature: Homolog annotation: Hit_ID=CAE47497.1; Match level="QueryCoverage =95%, HitCoverage=25%, E-value=6e-21, Identity=67%"; Hit description =cathepsin L-like proteinase [Diabrotica virgifera virgifera]
YSDNVIENKLRFAVFQDNLVEIEVHNAKYESGERAYYMAVKRGADWSSADFQARLGRQYGFMLIQSIIAKHVAVLMVHAVFEFVC

SEQ ID NO: 24281 - protein, 99 aa, Diabrotica virgifera
  misc_feature: Coding regions on vcDNA: vcDNA=SeqID_3978; Strand=+; Position=1-298
  misc_feature: Homolog annotation: Hit_ID=XP_393243.1; Match level="QueryCoverage =94%, HitCoverage=18%, E-value=8e-16, Identity=41%"; Hit description =similar to CG33094-PB [Apis mellifera]
  misc_feature (40)..(40): Xaa can be any naturally occurring amino acid
  misc_feature (56)..(56): Xaa can be any naturally occurring amino acid
  misc_feature (81)..(81): Xaa can be any naturally occurring amino acid
VRRHKLISLVGEWSDIDRNYAISLIACSKTWNNAIQNGLXYGTMGAAWDGSRIDVXRRCYRHSRLRYSLTNDLINMVKQWXTDSYHRSRMNLTDIKDMD

SEQ ID NO: 24282 - protein, 74 aa, Diabrotica virgifera
  misc_feature: Coding regions on vcDNA: vcDNA=SeqID_3979; Strand=+; Position=59-283
LHTDNYVLRDGHTSEAQHASTGIHNCVTGVNNVPISSNSGIIEHVLSAEVHSAAVALVGLVSNTADHGPWQFTC

SEQ ID NO: 24283 - protein, 92 aa, Diabrotica virgifera
  misc_feature: Coding regions on vcDNA: vcDNA=SeqID_3980; Strand=+; Position=68-343
KIKFDKMAGGTSDYRGPSINPDQQNITYSTITKQQPLTKFPIKNQGHNFTGSRRNKNRRVHHCTTNYSPSKKCTVLIQNVTRKNMHLPFKHT

SEQ ID NO: 24284 - protein, 74 aa, Diabrotica virgifera
  misc_feature: Coding regions on vcDNA: vcDNA=SeqID_3981; Strand=-; Position=174-398
  misc_feature (1)..(22): Xaa can be any naturally occurring amino acid
  misc_feature (25)..(38): Xaa can be any naturally occurring amino acid
  misc_feature (45)..(55): Xaa can be any naturally occurring amino acid
  misc_feature (57)..(66): Xaa can be any naturally occurring amino acid
XXXXXXXXXXXXXXXXXXXXXXLFXXXXXXXXXXXXXXKINLNIXXXXXXXXXXXVXXXXXXXXXXGAILGFLI

SEQ ID NO: 24285 - protein, 135 aa, Diabrotica virgifera
  misc_feature: Coding regions on vcDNA: vcDNA=SeqID_3982; Strand=+; Position=3-407
  misc_feature (114)..(120): Xaa can be any naturally occurring amino acid
ENQTEVKMLVILAWVAFGKLSYILKNKKFAQNLKSKVFNQCVLPVIDGEAALKNLFEFTKARFFTVDYCECVEKHTAVGQAKRRTRVNEKVSKFASYEGNYFHLLRLKISTHIXXXXXXXVIIVGQLYDGTEPVS

SEQ ID NO: 24286 - protein, 60 aa, Diabrotica virgifera
  misc_feature: Coding regions on vcDNA: vcDNA=SeqID_3983; Strand=-; Position=3-182
FPRALRVHPVGLFNLGFCNFLSRFVFWTLLLLFLIRRTIPTTTPVTIKKNFLDFKNGLEK

SEQ ID NO: 24287 - protein, 80 aa, Diabrotica virgifera
  misc_feature: Coding regions on vcDNA: vcDNA=SeqID_3984; Strand=-; Position=31-273
  misc_feature (20)..(37): Xaa can be any naturally occurring amino acid
GFSFSNLFRAPVKCRINRVXXXXXXXXXXXXXXXXXXSQSMKSLITRNRNVGVYRLVFVFRLAFRNSHRNQCKSKSQTSI

SEQ ID NO: 24288 - protein, 79 aa, Diabrotica virgifera
  misc_feature: Coding regions on vcDNA: vcDNA=SeqID_3985; Strand=+; Position=13-249
  misc_feature (41)..(41): Xaa can be any naturally occurring amino acid
  misc_feature (43)..(50): Xaa can be any naturally occurring amino acid
  misc_feature (66)..(66): Xaa can be any naturally occurring amino acid
MQASTVTRVILLNHPLTCGLILLIQTIFTSVITGLINYNYXFXXXXXXXXVGGILILFIYITRIAXILRFILMNNNNLI

SEQ ID NO: 24289 - protein, 54 aa, Diabrotica virgifera
  misc_feature: Coding regions on vcDNA: vcDNA=SeqID_3986; Strand=-; Position=1-162
QQIVIETGCLRDPQKLLRRHYGGHHTQPQETPEQRDLLTATPPSNAKMQRKQEQ

SEQ ID NO: 24290 - protein, 68 aa, Diabrotica virgifera
  misc_feature: Coding regions on vcDNA: vcDNA=SeqID_3987; Strand=+; Position=77-283
TVLVNYGGTDMVTTAIKSIFNSREFKHHANSLLIHIRVANYPHTSIGTDASHNNTRQHRAISCPFGQT

SEQ ID NO: 24291 - protein, 23 aa, Diabrotica virgifera
  misc_feature: Coding regions on vcDNA: vcDNA=SeqID_3988; Strand=+; Position=3-71
  misc_feature (8)..(17): Xaa can be any naturally occurring amino acid
LPINESYXXXXXXXXXXSNNLVS

SEQ ID NO: 24292 - protein, 37 aa, Diabrotica virgifera
  misc_feature: Coding regions on vcDNA: vcDNA=SeqID_3989; Strand=-; Position=50-163
ELILQVTQVSIIKFSRCTIMICSHNTMELPFSKMYVN

SEQ ID NO: 24293 - protein, 134 aa, Diabrotica virgifera
  misc_feature: Coding regions on vcDNA: vcDNA=SeqID_3990; Strand=+; Position=2-403
  misc_feature: Homolog annotation: Hit_ID=EAA01755.2; Match level="QueryCoverage =100%, HitCoverage=76%, E-value=9e-49, Identity=71%"; Hit description= ENSANGP00000020872 [Anopheles gambiae str. PEST] ref|XP_550952.1| ENSANGP00000020872 [Anopheles gambiae s
  misc_feature: Pfam annotation: Pfam_ID=Ribosomal_L17; Match level="Score=10.5, E -value=2e-07, Copies=1"; Pfam description=Ribosomal protein L17
KTVTALIKHERIELNYPRANESRMYAERLISDAIRYGDCHKTTMEMADYWLTEKQLIHKLFKVLVSRYENYNIGYTRLVRAPKLNGETRERAVLELRGNPYPSLWPENNSNRDLLHNVLLDEAKNAYTMVKYNE

SEQ ID NO: 24294 - protein, 45 aa, Diabrotica virgifera
  misc_feature: Coding regions on vcDNA: vcDNA=SeqID_3991; Strand=+; Position=63-200
IGLQINLVRFSALMKSHNNIFPAEATLKYVITQALASAIVLFSIH

SEQ ID NO: 24295 - protein, 47 aa, Diabrotica virgifera
  misc_feature: Coding regions on vcDNA: vcDNA=SeqID_3992; Strand=-; Position=39-182
IILTRYSIRSSPSEYRTAPCASRLACFGGISSCIIYNICRMCVTSLV

SEQ ID NO: 24296 - protein, 68 aa, Diabrotica virgifera
  misc_feature: Coding regions on vcDNA: vcDNA=SeqID_3993; Strand=+; Position=198-401
  misc_feature: Homolog annotation: Hit_ID=XP_311694.1; Match level="QueryCoverage =82%, HitCoverage=17%, E-value=3e-13, Identity=60%"; Hit description =ENSANGP00000015026 [Anopheles gambiae]
KNLAGIRYLFTGTVLKKWFDSGKLTRDDLFIVTKLPAPGIHPDRVEKYLTKSLADLQLDYLDLYPIHF

SEQ ID NO: 24297 - protein, 128 aa, Diabrotica virgifera
  misc_feature: Coding regions on vcDNA: vcDNA=SeqID_3994; Strand=+; Position=2-385
  misc_feature: Homolog annotation: Hit_ID=XP_319737.1; Match level="QueryCoverage =96%, HitCoverage=35%, E-value=9e-17, Identity=37%"; Hit description =ENSANGP00000019373 [Anopheles gambiae]
  misc_feature: Gene Ontology Annotation: Molecular function=molecular_function unknown
  misc_feature: Pfam annotation: Pfam_ID=DUF227; Match level="Score=54.3, E-value =3.5e-13, Copies=1"; Pfam description=Domain of unknown function (DUF227)
SKTLDENGKEETLHGVAKTLPQHEMMRQAFKVQVTYTNEMAFYDLIIPTLQAFQKELGIKNVIDCFPECYATRKNLNASDIIDDNAVIVLENLQIAGFQNIDRHIGFDLETTKLVLRDLASLHAVPLA

SEQ ID NO: 24298 - protein, 84 aa, Diabrotica virgifera
  misc_feature: Coding regions on vcDNA: vcDNA=SeqID_3995; Strand=-; Position=0-251
  misc_feature (13)..(22): Xaa can be any naturally occurring amino acid
  misc_feature (64)..(79): Xaa can be any naturally occurring amino acid
LEQHENISRQEVXXXXXXXXXXQGICKEEEVTSTAKEEYNQSDSHPSMVSPPFLFNSYIFLYFXXXXXXXXXXXXXXXXFITDA

SEQ ID NO: 24299 - protein, 31 aa, Diabrotica virgifera
  misc_feature: Coding regions on vcDNA: vcDNA=SeqID_3996; Strand=+; Position=1-96
RLAAIHIVATFLYVVFPLSPGFNLKDLMVEI

SEQ ID NO: 24300 - protein, 73 aa, Diabrotica virgifera
  misc_feature: Coding regions on vcDNA: vcDNA=SeqID_3997; Strand=+; Position=1-222
  misc_feature (1)..(22): Xaa can be any naturally occurring amino acid
XXXXXXXXXXXXXXXXXXXXXXNFARKYTRLMSSLTINSKGGGLLKVFNFNAHVSTFNTSPKGSINLITRAFF

SEQ ID NO: 24301 - protein, 56 aa, Diabrotica virgifera
  misc_feature: Coding regions on vcDNA: vcDNA=SeqID_3998; Strand=+; Position=63-230
  misc_feature (1)..(1): Xaa can be any naturally occurring amino acid
XNSSSECWGITQWIFEQINKIYPNDMAKMGVYTVGRIAPLTQLVESSRVTILRISK

SEQ ID NO: 24302 - protein, 63 aa, Diabrotica virgifera
  misc_feature: Coding regions on vcDNA: vcDNA=SeqID_3999; Strand=-; Position=85-276
VNPKTPGVYWPVKGGFHFHFKVGKFLERGIVGAFLVLTQFGKRGFFSKGFKLVNPRVFPFESF

SEQ ID NO: 24303 - protein, 111 aa, Diabrotica virgifera
  misc_feature: Coding regions on vcDNA: vcDNA=SeqID_4000; Strand=-; Position=55-390
  misc_feature (2)..(39): Xaa can be any naturally occurring amino acid
  misc_feature (45)..(55): Xaa can be any naturally occurring amino acid
  misc_feature (57)..(66): Xaa can be any naturally occurring amino acid
  misc_feature (68)..(68): Xaa can be any naturally occurring amino acid
  misc_feature (72)..(85): Xaa can be any naturally occurring amino acid
  misc_feature (91)..(106): Xaa can be any naturally occurring amino acid
PXXXXXXXXXXXXXXXXXXXXXXXXXXXXXXXXXXXXXXGITISXXXXXXXXXXXIXXXXXXXXXXAXFKFXXXXXXXXXXXXXXPDTPRXXXXXXXXXXXXXXXXLTNTN

SEQ ID NO: 24304 - protein, 99 aa, Diabrotica virgifera
  misc_feature: Coding regions on vcDNA: vcDNA=SeqID_4001; Strand=+; Position=3-300
  misc_feature: Homolog annotation: Hit_ID=AAO32817.1; Match level="QueryCoverage =84%, HitCoverage=27%, E-value=2e-21, Identity=64%"; Hit description =ADP/ATP translocase [Bombyx mori]
  misc_feature: Gene Ontology Annotation: Molecular function=adenine transporter activity; Cellular component=integral to plasma membrane; Biological process=transport
  misc_feature: Pfam annotation: Pfam_ID=Mito_carr; Match level="Score=-11.4, E-value= 0.05, Copies=1"; Pfam description=Mitochondrial carrier protein
  misc_feature (21)..(21): Xaa can be any naturally occurring amino acid
GRVGSWAIAQTVTTVAGIISXYPFDTVSWHMIDQSGRKKINFIYIGTDQCWATISMTDSIGVIFTGAFSIVLGGTGGAIVLGMYDEIRFLIELFVFHCY

SEQ ID NO: 24305 - protein, 68 aa, Diabrotica virgifera
  misc_feature: Coding regions on vcDNA: vcDNA=SeqID_4002; Strand=+; Position=32-238
MISMLFEKIPVMLETIIFKRDFPTIYFELCFYIAEGAIYVKIPKKGYIIALVFTEQKTLHYLIRLYAF

SEQ ID NO: 24306 - protein, 105 aa, Diabrotica virgifera
  misc_feature: Coding regions on vcDNA: vcDNA=SeqID_4003; Strand=+; Position=18-332
  misc_feature: Homolog annotation: Hit_ID=CAE47497.1; Match level="QueryCoverage =97%, HitCoverage=32%, E-value=4e-33, Identity=70%"; Hit description =cathepsin L-like proteinase [Diabrotica virgifera virgifera]
  misc_feature (7)..(13): Xaa can be any naturally occurring amino acid
  misc_feature (51)..(51): Xaa can be any naturally occurring amino acid
  misc_feature (62)..(62): Xaa can be any naturally occurring amino acid
VELAVNXXXXXXXAEFHAMLDRQMANTLRQSVIANHVADRNVDAVDEVDWXDSAVLGVIHHXHCGSCWAFSSTGSLEGQIAIHKTHRVPLSEQALVNCDTSGNAW

SEQ ID NO: 24307 - protein, 32 aa, Diabrotica virgifera
  misc_feature: Coding regions on vcDNA: vcDNA=SeqID_4004; Strand=-; Position=1-96
EFILFHLTSMRAYHNDSFNIRSRNDCICRVTS

SEQ ID NO: 24308 - protein, 84 aa, Diabrotica virgifera
  misc_feature: Coding regions on vcDNA: vcDNA=SeqID_4005; Strand=-; Position=163-417
  misc_feature (14)..(14): Xaa can be any naturally occurring amino acid
LNHMDRLYTPMEVXEAICSFPKRQKFTVQMVRTNDILDFKNWWSKYNKKTCYSVEISATSIQSSHSLFPALWSSTTITIQKKTC

SEQ ID NO: 24309 - protein, 69 aa, Diabrotica virgifera
  misc_feature: Coding regions on vcDNA: vcDNA=SeqID_4006; Strand=+; Position=24-233
  misc_feature (4)..(21): Xaa can be any naturally occurring amino acid
  misc_feature (28)..(37): Xaa can be any naturally occurring amino acid
  misc_feature (44)..(61): Xaa can be any naturally occurring amino acid
IVKXXXXXXXXXXXXXXXXXXLVHQGLXXXXXXXXXXKFKIARXXXXXXXXXXXXXXXXXXMLIVFKYI

SEQ ID NO: 24310 - protein, 55 aa, Diabrotica virgifera
  misc_feature: Coding regions on vcDNA: vcDNA=SeqID_4007; Strand=+; Position=54-221
  misc_feature (45)..(52): Xaa can be any naturally occurring amino acid
SNVKRFHQYRGLYEMNEYHMIINYIYKLRICILDLQNTYTDALNXXXXXXXXVYI

SEQ ID NO: 24311 - protein, 55 aa, Diabrotica virgifera
  misc_feature: Coding regions on vcDNA: vcDNA=SeqID_4008; Strand=-; Position=2-166
  misc_feature (19)..(36): Xaa can be any naturally occurring amino acid
  misc_feature (39)..(45): Xaa can be any naturally occurring amino acid
PPPSRPPYSFSLSHGPLSXXXXXXXXXXXXXXXXXXGDXXXXXXXKHNYRHLLNN

SEQ ID NO: 24312 - protein, 57 aa, Diabrotica virgifera
  misc_feature: Coding regions on vcDNA: vcDNA=SeqID_4009; Strand=+; Position=3-176
  misc_feature: Homolog annotation: Hit_ID=XP_391892.1; Match level="QueryCoverage =100%, HitCoverage=3%, E-value=4e-20, Identity=73%"; Hit description =similar to CG2049-PB [Apis mellifera]
  misc_feature: Gene Ontology Annotation: Molecular function=protein kinase activity; Biological process=signal transduction
  misc_feature: Pfam annotation: Pfam_ID=Pkinase_C; Match level="Score=69.3, E-value =1.1e-17, Copies=1"; Pfam description=Protein kinase C terminal domain
RIPPPFVPTVESMEDVSNFDEEFTSERPQLTPPKEPRQLSVQDQHLFREFTYMADWC

SEQ ID NO: 24313 - protein, 49 aa, Diabrotica virgifera
  misc_feature: Coding regions on vcDNA: vcDNA=SeqID_4010; Strand=+; Position=182-331
RLKEAFSKAASNAVLALKYFLYSLFYCRLYKTLVLKKYNNIHPKINKKK

SEQ ID NO: 24314 - protein, 118 aa, Diabrotica virgifera
  misc_feature: Coding regions on vcDNA: vcDNA=SeqID_4011; Strand=-; Position=4-360
  misc_feature (1)..(49): Xaa can be any naturally occurring amino acid
  misc_feature (61)..(72): Xaa can be any naturally occurring amino acid
  misc_feature (79)..(108): Xaa can be any naturally occurring amino acid
XXXXXXXXXXXXXXXXXXXXXXXXXXXXXXXXXXXXXXXXXXXXXXXXXYIFYNKNVNLLXXXXXXXXXXXXLSNNPCXXXXXXXXXXXXXXXXXXXXXXXXXXXXXXILILKNIILS

SEQ ID NO: 24315 - protein, 103 aa, Diabrotica virgifera
  misc_feature: Coding regions on vcDNA: vcDNA=SeqID_4012; Strand=+; Position=3-314
YTPAYAWAIVLRTGTIHYPVMAIHWLRLMSRPFMYHMTFRVKSHLKIVNLLSMIWTVLYITEYKMGQEVEFTITFIMVIQTLQKASVCASLHVSKGCRTISFD

SEQ ID NO: 24316 - protein, 94 aa, Diabrotica virgifera
  misc_feature: Coding regions on vcDNA: vcDNA=SeqID_4013; Strand=+; Position=2-286
IPYRESYYYLGRLLCLFLLQPLVNYKVSIHIIISHDEFSCTVGERSILQACRWDPAFFKTVKAISRRQLPLIKCRRFCKKEQGHYLSIAQQLHI

SEQ ID NO: 24317 - protein, 19 aa, Diabrotica virgifera
  misc_feature: Coding regions on vcDNA: vcDNA=SeqID_4014; Strand=-; Position=1-57
HNTSDLPLNQTFLHVHYRV

SEQ ID NO: 24318 - protein, 27 aa, Diabrotica virgifera
  misc_feature: Coding regions on vcDNA: vcDNA=SeqID_4015; Strand=-; Position=27-110
LKPWILKVLSIFIRFRFNHLLLDCTLS

SEQ ID NO: 24319 - protein, 90 aa, Diabrotica virgifera
  misc_feature: Coding regions on vcDNA: vcDNA=SeqID_4016; Strand=+; Position=11-283
  misc_feature (2)..(17): Xaa can be any naturally occurring amino acid
KXXXXXXXXXXXXXXXXAQKVQTLLSLQGNSKPLQKGHQIQFQGRSFKNFVMGKTRGYPTLTPLNKIPFSQTGLIPKRPEPLPFPKISQP

SEQ ID NO: 24320 - protein, 83 aa, Diabrotica virgifera
  misc_feature: Coding regions on vcDNA: vcDNA=SeqID_4017; Strand=+; Position=77-326
  misc_feature: Homolog annotation: Hit_ID=AAR10085.1; Match level="QueryCoverage =87%, HitCoverage=49%, E-value=4e-18, Identity=64%"; Hit description =similar to Drosophila melanogaster CG8332 [Drosophila yakuba] gb|AAR09890.1| similar to Drosophila melanog
  misc_feature: Gene Ontology Annotation: Biological process=positive regulation of growth rate
  misc_feature (36)..(36): Xaa can be any naturally occurring amino acid
  misc_feature (46)..(46): Xaa can be any naturally occurring amino acid
  misc_feature (60)..(60): Xaa can be any naturally occurring amino acid
LVTRRHFFNTAESAKELLKKNRTLKEFTSRGLDVDXRLDMPHEQLXELMHCRARRRFTVXLKRTPMALMKTLRAAKKHAPPLE

SEQ ID NO: 24321 - protein, 117 aa, Diabrotica virgifera
  misc_feature: Coding regions on vcDNA: vcDNA=SeqID_4018; Strand=-; Position=51-404
  misc_feature (75)..(75): Xaa can be any naturally occurring amino acid
SYTYSSTVASQDVTKEIMTHTESLRLGLINNEQQTYTDPQTHEVIPIVQAISEGKLAPDSKNSEKIVTGQIIKTXTVSTTTSTKTFNDRGITTDFITNEKKSFEKHIYALPSEVSYL

SEQ ID NO: 24322 - protein, 88 aa, Diabrotica virgifera
  misc_feature: Coding regions on vcDNA: vcDNA=SeqID_4019; Strand=-; Position=57-323
GLMNDRSSSRETLSLPYSSSTAYWSYLRHYFLYRISILDLILLLLENHAYSVTHFDDRSQENRIEVAKSNRNSQNRYSITPSESLQSE

SEQ ID NO: 24323 - protein, 105 aa, Diabrotica virgifera
  misc_feature: Coding regions on vcDNA: vcDNA=SeqID_4020; Strand=+; Position=110-425
  misc_feature: Homolog annotation: Hit_ID=NP_722593.1; Match level="QueryCoverage =93%, HitCoverage=24%, E-value=2e-25, Identity=56%"; Hit description =CG2674-PJ, isoform J [Drosophila melanogaster] ref|NP_524923.1| CG2674-PC, isoform C [Drosophila
  misc_feature: Gene Ontology Annotation: Molecular function=methionine adenosyltransferase activity; Cellular component=cytoplasm; Biological process=amino acid metabolism
  misc_feature: Pfam annotation: Pfam_ID=S-AdoMet_synt_N; Match level="Score=81.9, E -value=1.7e-21, Copies=1"; Pfam description=S-adenosylmethionine synthetase, N-te
  misc_feature (23)..(23): Xaa can be any naturally occurring amino acid
  misc_feature (54)..(68): Xaa can be any naturally occurring amino acid
  misc_feature (91)..(91): Xaa can be any naturally occurring amino acid
MDIHDCHSSYEMVDGGEFLFTSXSVSEGHPDTMCDQVSDAILDAHLEEDPDANXXXXXXXXXXXXXXXGDVTSGAVDNYHDVVTQSVDHIXYDDSSAGFDWSPLN

SEQ ID NO: 24324 - protein, 117 aa, Diabrotica virgifera
  misc_feature: Coding regions on vcDNA: vcDNA=SeqID_4021; Strand=-; Position=2-352
  misc_feature (72)..(102): Xaa can be any naturally occurring amino acid
LGGLFAGAFWLLPLLANGVSSARLLSGFSPGFSLSRFFNATPSDLFLRYSLGVFWRPLHVSVILPPCGPPLXXXXXXXXXXXXXXXXXXXXXXXXXXXXXXXRTCGWTRRSRTVTAG

SEQ ID NO: 24325 - protein, 52 aa, Diabrotica virgifera
  misc_feature: Coding regions on vcDNA: vcDNA=SeqID_4022; Strand=+; Position=151-306
  misc_feature (12)..(21): Xaa can be any naturally occurring amino acid
WSTGGLKFKVDXXXXXXXXXXLKTKYNKGGQKTLEPPLDPRLGTSFFQKKLI

SEQ ID NO: 24326 - protein, 29 aa, Diabrotica virgifera
  misc_feature: Coding regions on vcDNA: vcDNA=SeqID_4023; Strand=-; Position=23-112
  misc_feature (3)..(15): Xaa can be any naturally occurring amino acid
YNXXXXXXXXXXXXXLKVLIKGHGLISTK

SEQ ID NO: 24327 - protein, 137 aa, Diabrotica virgifera
  misc_feature: Coding regions on vcDNA: vcDNA=SeqID_4024; Strand=+; Position=3-416
TFHILYERIPADAVFQKLSQHPRCGKCNQELMISPYFEKENPRHQYEKDLKEAGFPEFYFQEHRNLTYTFPNEKSLKDLFISINATLPYVPESEVEEYKKDYLDIVRQRMKRAAEEKVIPNDLTAKYTLFVISAHKQ

SEQ ID NO: 24328 - protein, 56 aa, Diabrotica virgifera
  misc_feature: Coding regions on vcDNA: vcDNA=SeqID_4025; Strand=-; Position=40-210
  misc_feature (31)..(36): Xaa can be any naturally occurring amino acid
DYTSISVYECIEKAQNMSKQMSDLYMVSKEXXXXXXFLFEAYSIHIYVLSSNIIWK

SEQ ID NO: 24329 - protein, 78 aa, Diabrotica virgifera
  misc_feature: Coding regions on vcDNA: vcDNA=SeqID_4026; Strand=-; Position=1-234
  misc_feature (10)..(40): Xaa can be any naturally occurring amino acid
  misc_feature (42)..(78): Xaa can be any naturally occurring amino acid
IFLLNLQFLXXXXXXXXXXXXXXXXXXXXXXXXXXXXXXXVXXXXXXXXXXXXXXXXXXXXXXXXXXXXXXXXXXXXX

SEQ ID NO: 24330 - protein, 64 aa, Diabrotica virgifera
  misc_feature: Coding regions on vcDNA: vcDNA=SeqID_4027; Strand=+; Position=40-234
CPHIPTSQLQLKVPLLRDVYLTIQVNPILLKVSSLSLVTNVSISVIQCSAVISAYIYPLKSQYN

SEQ ID NO: 24331 - protein, 68 aa, Diabrotica virgifera
  misc_feature: Coding regions on vcDNA: vcDNA=SeqID_4028; Strand=-; Position=186-392
IIDAIIRCDLYIEAFSNLYRKSIANSDVRHTIERPHYFSWLHYLTYVICHWSCIEIRTLFNSYLYFIH

SEQ ID NO: 24332 - protein, 101 aa, Diabrotica virgifera
  misc_feature: Coding regions on vcDNA: vcDNA=SeqID_4029; Strand=+; Position=23-326
  misc_feature: Homolog annotation: Hit_ID=AAG17099.1; Match level="QueryCoverage =100%, HitCoverage=28%, E-value=5e-16, Identity=46%"; Hit description= cytochrome b [Cryptotermes domesticus]
  misc_feature (20)..(20): Xaa can be any naturally occurring amino acid
  misc_feature (25)..(25): Xaa can be any naturally occurring amino acid
  misc_feature (44)..(44): Xaa can be any naturally occurring amino acid
  misc_feature (63)..(63): Xaa can be any naturally occurring amino acid
GSLVNLNLMSAIPYLGNTLXPLNLXGYAIQNATLMLINTLQSYXPFTISALKSIHLFIVQQSXSIIPLGSKCNITDKIPLHPYDTFNAHLGLIPLLLIIST

SEQ ID NO: 24333 - protein, 43 aa, Diabrotica virgifera
  misc_feature: Coding regions on vcDNA: vcDNA=SeqID_4030; Strand=+; Position=124-252
EARSGNLSNHFHQIRDNLLQFTAIILQPRHRSPPSTRYVTTSP

SEQ ID NO: 24334 - protein, 89 aa, Diabrotica virgifera
  misc_feature: Coding regions on vcDNA: vcDNA=SeqID_4031; Strand=+; Position=3-271
  misc_feature: Homolog annotation: Hit_ID=NP_612043.1; Match level="QueryCoverage =80%, HitCoverage=29%, E-value=1e-12, Identity=45%"; Hit description =CG3200-PA [Drosophila melanogaster] gb|AAF47397.1| CG3200-PA [Drosophila melanogaster]
  misc_feature (67)..(67): Xaa can be any naturally occurring amino acid
RVDPRLYTKSHETMSSAKLENLEPQECLHIGDQKSLDYDGARNCGWHAVLVNDKEKYPDIDKEHVFXNLFDIHKHFIKTSGESLSSHTV

SEQ ID NO: 24335 - protein, 92 aa, Diabrotica virgifera
  misc_feature: Coding regions on vcDNA: vcDNA=SeqID_4032; Strand=-; Position=1-276
IVKRYRYVRSFYVRHFVYQRKKMQDVVRKMNIICCYADTGKRGKHILPNKTSTENRKIVKAHIESVPTMVLQYIHQSSKRRYLDKNLSTRKM

SEQ ID NO: 24336 - protein, 43 aa, Diabrotica virgifera
  misc_feature: Coding regions on vcDNA: vcDNA=SeqID_4033; Strand=-; Position=213-344
HCSGFKIIHFSAKRLMTLLLSYEVVSTHLCDTFLVKLPIGFLE

SEQ ID NO: 24337 - protein, 57 aa, Diabrotica virgifera
  misc_feature: Coding regions on vcDNA: vcDNA=SeqID_4034; Strand=+; Position=44-217
  misc_feature (2)..(8): Xaa can be any naturally occurring amino acid
RXXXXXXXGYVLNTLDSKSILSSLRRLKFWQLVSRVRDPFQYTISRFPCLLILRRLN

SEQ ID NO: 24338 - protein, 125 aa, Diabrotica virgifera
  misc_feature: Coding regions on vcDNA: vcDNA=SeqID_4035; Strand=+; Position=9-383
  misc_feature (36)..(43): Xaa can be any naturally occurring amino acid
  misc_feature (84)..(105): Xaa can be any naturally occurring amino acid
  misc_feature (119)..(125): Xaa can be any naturally occurring amino acid
TTRPIIAANINTMYIVPSILFALFASGVRQKWDGSXXXXXXXXSEVRIKKVSVWSIMSVYNLYKYYTDIIDHTETFFMVYYVCXXXXXXXXXXXXXXXXXXXXXXREKGRKRQESKNKXXXXXXX

SEQ ID NO: 24339 - protein, 49 aa, Diabrotica virgifera
  misc_feature: Coding regions on vcDNA: vcDNA=SeqID_4036; Strand=-; Position=2-148
EISHGFCGVIYGCSSLINLCINVSRPSLDLRIDCILELFCTRLFSRGRC

SEQ ID NO: 24340 - protein, 112 aa, Diabrotica virgifera
  misc_feature: Coding regions on vcDNA: vcDNA=SeqID_4037; Strand=+; Position=83-418
  misc_feature: Homolog annotation: Hit_ID=AAH74193.1; Match level="QueryCoverage =81%, HitCoverage=40%, E-value=9e-12, Identity=32%"; Hit description =MGC82090 protein [Xenopus laevis]
MKRTPLIISHIQRLFYNTSTHSIIRKNQNVNVSFLGTSSSQISLNYCWQCGAERKGSNIFCEKCNVIQVPNEKNNYFKVMGVQETFNVDQKLLKEKFRSFQSCIHPDKFSNS

SEQ ID NO: 24341 - protein, 53 aa, Diabrotica virgifera
  misc_feature: Coding regions on vcDNA: vcDNA=SeqID_4038; Strand=+; Position=161-319
  misc_feature (5)..(28): Xaa can be any naturally occurring amino acid
RLFQXXXXXXXXXXXXXXXXXXXXXXXXDKGGRSKGSKLTYPCMIRQRSILGA

SEQ ID NO: 24342 - protein, 107 aa, Diabrotica virgifera
  misc_feature: Coding regions on vcDNA: vcDNA=SeqID_4039; Strand=+; Position=12-335
  misc_feature (12)..(20): Xaa can be any naturally occurring amino acid
  misc_feature (24)..(31): Xaa can be any naturally occurring amino acid
  misc_feature (33)..(48): Xaa can be any naturally occurring amino acid
  misc_feature (69)..(97): Xaa can be any naturally occurring amino acid
  misc_feature (101)..(107): Xaa can be any naturally occurring amino acid
DNKVSFSRRKEXXXXXXXXXYCDXXXXXXXXEXXXXXXXXXXXXXXXXILITFEFNRANKLTFLVVNNXXXXXXXXXXXXXXXXXXXXXXXXXXXXXQDIXXXXXXX

SEQ ID NO: 24343 - protein, 59 aa, Diabrotica virgifera
  misc_feature: Coding regions on vcDNA: vcDNA=SeqID_4040; Strand=+; Position=3-182
PSLRVNSVANNPRKLYMWTAKYCCHILAILMWHHYAHCETVHHVMVNTAYCRLYSSVVR

SEQ ID NO: 24344 - protein, 119 aa, Diabrotica virgifera
  misc_feature: Coding regions on vcDNA: vcDNA=SeqID_4041; Strand=+; Position=78-434
  misc_feature: Homolog annotation: Hit_ID=XP_425653.1; Match level="QueryCoverage =86%, HitCoverage=33%, E-value=5e-25, Identity=52%"; Hit description =PREDICTED: similar to RAB38 [Gallus gallus]
  misc_feature: Gene Ontology Annotation: Molecular function=RAB small monomeric GTPase activity; Cellular component=cellular_component unknown; Biological process=small GTPase mediated signal transduction
  misc_feature: Pfam annotation: Pfam_ID=Ras; Match level="Score=-31.5, E-value=5.6e -07, Copies=1"; Pfam description=Ras family
MNGPRLGLSREEIIKISETIRENNLNKQELIFKIVIIGDYGVGKTSIIGRFTEGQFSTQYKITIGADFAVKTLEWDEDTRISLHLWDIAGNERFGSLLSVFYRHAVAAAIVSDLTRPET

SEQ ID NO: 24345 - protein, 55 aa, Diabrotica virgifera
  misc_feature: Coding regions on vcDNA: vcDNA=SeqID_4042; Strand=-; Position=0-164
  misc_feature (32)..(54): Xaa can be any naturally occurring amino acid
SYWLDHRNFTKAFATCHIHSYRGTMRYHVPQXXXXXXXXXXXXXXXXXXXXXXXT

SEQ ID NO: 24346 - protein, 52 aa, Diabrotica virgifera
  misc_feature: Coding regions on vcDNA: vcDNA=SeqID_4043; Strand=+; Position=101-259
  misc_feature (28)..(28): Xaa can be any naturally occurring amino acid
MGSRLGSFVNHMGSTITADGKKFTRTLXGGVQTINIILYETHEKVYSTTPRV

SEQ ID NO: 24347 - protein, 120 aa, Diabrotica virgifera
  misc_feature: Coding regions on vcDNA: vcDNA=SeqID_4044; Strand=+; Position=1-360
  misc_feature: Homolog annotation: Hit_ID=CAE47497.1; Match level="QueryCoverage =84%, HitCoverage=32%, E-value=9e-20, Identity=51%"; Hit description =cathepsin L-like proteinase [Diabrotica virgifera virgifera]
  misc_feature (87)..(87): Xaa can be any naturally occurring amino acid
  misc_feature (103)..(103): Xaa can be any naturally occurring amino acid
ESYYSSAHASGCSFSRSIRLPLFIPASALMVDTSAPLGAFSQSPISKASQTTSYHLIEDQLRFAVFQDTLRVIHEQPATHYGVDKAXYLAVTTFADWATADFXAIVGRHMVNIPIPSFIA

SEQ ID NO: 24348 - protein, 88 aa, Diabrotica virgifera
  misc_feature: Coding regions on vcDNA: vcDNA=SeqID_4045; Strand=-; Position=1-264
  misc_feature: Homolog annotation: Hit_ID=XP_314867.1; Match level="QueryCoverage =69%, HitCoverage=8%, E-value=2e-09, Identity=47%"; Hit description =ENSANGP00000005174 [Anopheles gambiae]
RCVVSQKKKVQCHGGAISGSGLIDYLINFFLFALDKLIKSKNLTRSSKIKIYKSIVTPVLTYGCETWTMTKSNEEKLRRFELKILRKI

SEQ ID NO: 24349 - protein, 31 aa, Diabrotica virgifera
  misc_feature: Coding regions on vcDNA: vcDNA=SeqID_4046; Strand=-; Position=11-106
TFPATRTVTCLPAPVSWADTLSVTSDRSSRL

SEQ ID NO: 24350 - protein, 41 aa, Diabrotica virgifera
  misc_feature: Coding regions on vcDNA: vcDNA=SeqID_4047; Strand=-; Position=38-163
HYFANTSCKIAYAQSDLAQNIPGTVGVLNTAPLSLHSNRTR

SEQ ID NO: 24351 - protein, 82 aa, Diabrotica virgifera
  misc_feature: Coding regions on vcDNA: vcDNA=SeqID_4048; Strand=+; Position=156-401
SVCWLTTWLLTVSKMAVNYLTSVPRLTGRDNYQDWSFAVENVFVLEGLSKCIQGTEQDTTLVAKAKAKLILTLDPSIYLHVK

SEQ ID NO: 24352 - protein, 88 aa, Diabrotica virgifera
  misc_feature: Coding regions on vcDNA: vcDNA=SeqID_4049; Strand=-; Position=6-272
STFRGKVISTHSKCSKKLHFCFIKSYSQNKVSRLFLGKQIGKITSQLVSQMNLIDFTSFLNRVCIIYMICKFHRFKVLIFEGAVVKRG

SEQ ID NO: 24353 - protein, 66 aa, Diabrotica virgifera
  misc_feature: Coding regions on vcDNA: vcDNA=SeqID_4050; Strand=-; Position=2-199
  misc_feature (53)..(60): Xaa can be any naturally occurring amino acid
INMPKPSTNNISTHTMDRYYLCNNPIYITIVLVKTTQSKCSSIDKLHPKTQQXXXXXXXXELHCQT

SEQ ID NO: 24354 - protein, 59 aa, Diabrotica virgifera
  misc_feature: Coding regions on vcDNA: vcDNA=SeqID_4051; Strand=-; Position=103-282
IYKRADRTYHRLVLKWKHIYLTHLHQHVTRFKYVTDVSLIMKQFKVKHYSKTRLHRFTL

SEQ ID NO: 24355 - protein, 39 aa, Diabrotica virgifera
  misc_feature: Coding regions on vcDNA: vcDNA=SeqID_4052; Strand=+; Position=1-117
KYNNWSKKLSGSKKYTREMYNRTLYNILNFKIVNIMYLF

SEQ ID NO: 24356 - protein, 137 aa, Diabrotica virgifera
  misc_feature: Coding regions on vcDNA: vcDNA=SeqID_4053; Strand=+; Position=2-412
  misc_feature: Homolog annotation: Hit_ID=XP_321157.1; Match level="QueryCoverage =95%, HitCoverage=20%, E-value=9e-12, Identity=34%"; Hit description =ENSANGP00000020227 [Anopheles gambiae]
EILKRQQNATVLTVFNLMAIIINNNLTYQTNRLTIKELVGEVTWIRSVVDKLGAFTHIENAEKGVREALITHNNLIRLDKRKMLRLIKNKVSQQVVNPKKLKGHALSDSTMTESVPFVMLQIYTNPVLQFLIDINII

SEQ ID NO: 24357 - protein, 138 aa, Diabrotica virgifera
  misc_feature: Coding regions on vcDNA: vcDNA=SeqID_4054; Strand=+; Position=1-414
  misc_feature: Homolog annotation: Hit_ID=EAL39993.1; Match level="QueryCoverage =99%, HitCoverage=74%, E-value=3e-19, Identity=55%"; Hit description =ENSANGP00000027037 [Anopheles gambiae str. PEST] ref|XP_556748.1| ENSANGP00000027037 [Anopheles gambiae st
  misc_feature: Gene Ontology Annotation: Molecular function=electron transporter activity; Cellular component=microsome; Biological process=sterol biosynthesis
  misc_feature: Pfam annotation: Pfam_ID=Cyt-b5; Match level="Score=51.1, E-value =3.2e-12, Copies=2"; Pfam description=Cytochrome b5-like Heme/Steroid bindin
GKQGSSVWIIIKDNVYDVTDFMEEHPGGAELIMEWAGQNATNDFDNFGHSLDAKRDLKKLKIGEVDVEEPKVKSTKITSTNDTKLYNVSEVAKHDGIQDTRTWIIIKNCVYDVTEYMEEHPGSADVIREWARKDATKA

SEQ ID NO: 24358 - protein, 89 aa, Diabrotica virgifera
  misc_feature: Coding regions on vcDNA: vcDNA=SeqID_4055; Strand=+; Position=3-272
QRGVSGRSLTLNSVLHKDMGCSAAKNLTVEPLDGSLANGHTEARTLPVSPKRQPNIPPLEAEDLQEELLENAAVNNVQQGDTSTENSVS

SEQ ID NO: 24359 - protein, 64 aa, Diabrotica virgifera
  misc_feature: Coding regions on vcDNA: vcDNA=SeqID_4056; Strand=+; Position=84-278
VCVSLLHLIWTNICNPFNILRNVLSVSVLLHRRCYQFFCYCTYIFLDFSLTLPVLTNFVLLVTF

SEQ ID NO: 24360 - protein, 96 aa, Diabrotica virgifera
  misc_feature: Coding regions on vcDNA: vcDNA=SeqID_4057; Strand=-; Position=2-289
  misc_feature (43)..(51): Xaa can be any naturally occurring amino acid
  misc_feature (62)..(67): Xaa can be any naturally occurring amino acid
  misc_feature (80)..(87): Xaa can be any naturally occurring amino acid
NVHSNRLTRSIHYLLKVYVARPVVAPSENFSYSTVLVYFHTCXXXXXXXXXFNQNTTIKPIXXXXXXIISLYSKLTSTLXXXXXXXXKTVVIAHAS

SEQ ID NO: 24361 - protein, 51 aa, Diabrotica virgifera
  misc_feature: Coding regions on vcDNA: vcDNA=SeqID_4058; Strand=-; Position=36-191
HHPCANSTTRDFGIHNKDTFGNHNIGFVLGTLGTYLQVIITLPSQHVNIFV

SEQ ID NO: 24362 - protein, 55 aa, Diabrotica virgifera
  misc_feature: Coding regions on vcDNA: vcDNA=SeqID_4059; Strand=-; Position=133-300
FCLKIFIRSLYLSYMACFLHTQGNPADRKFYDFSHGRKKISRKLSHKVIYLTFME

SEQ ID NO: 24363 - protein, 84 aa, Diabrotica virgifera
  misc_feature: Coding regions on vcDNA: vcDNA=SeqID_4060; Strand=+; Position=137-388
  misc_feature (1)..(7): Xaa can be any naturally occurring amino acid
XXXXXXXSKKSDIFILNHFFVSLIMIELHGEKCKFLRKFEKALHYLILLFSKTMLIKPVQLFEHGNNTKIKGIADKKQPLLNTI

SEQ ID NO: 24364 - protein, 42 aa, Diabrotica virgifera
  misc_feature: Coding regions on vcDNA: vcDNA=SeqID_4061; Strand=+; Position=85-213
YLSFNVSVDWLYIVPCSIMDQYLTVKVLSDSIFEDRYRYAFE

SEQ ID NO: 24365 - protein, 52 aa, Diabrotica virgifera
  misc_feature: Coding regions on vcDNA: vcDNA=SeqID_4062; Strand=-; Position=0-155
HTYLNIYIFVDFKQAYDSINSAYLYKILSEFEMSSKLFRLIGMKLTDTGRVG

SEQ ID NO: 24366 - protein, 37 aa, Diabrotica virgifera
  misc_feature: Coding regions on vcDNA: vcDNA=SeqID_4063; Strand=+; Position=62-172
PILELNQYFNPPDVFQCFIPAGESLSYFTIYFLLLGA

SEQ ID NO: 24367 - protein, 44 aa, Diabrotica virgifera
  misc_feature: Coding regions on vcDNA: vcDNA=SeqID_4064; Strand=+; Position=138-269
  misc_feature (17)..(23): Xaa can be any naturally occurring amino acid
MSKIYILVLINHPVYQXXXXXXXVNLRSRLVSNIFFLYVNKKYI

SEQ ID NO: 24368 - protein, 23 aa, Diabrotica virgifera
  misc_feature: Coding regions on vcDNA: vcDNA=SeqID_4065; Strand=-; Position=1-69
  misc_feature (8)..(20): Xaa can be any naturally occurring amino acid
SVVPFFVXXXXXXXXXXXXXIEA

SEQ ID NO: 24369 - protein, 136 aa, Diabrotica virgifera
  misc_feature: Coding regions on vcDNA: vcDNA=SeqID_4066; Strand=+; Position=2-412
  misc_feature: Homolog annotation: Hit_ID=CAA76931.1; Match level="QueryCoverage =88%, HitCoverage=49%, E-value=7e-28, Identity=48%"; Hit description =endoglucanase [Phaedon cochleariae]
  misc_feature: Pfam annotation: Pfam_ID=Glyco_hydro_45; Match level="Score=-17.3, E -value=7.5e-07, Copies=1"; Pfam description=Glycosyl hydrolase family 45
  misc_feature (79)..(79): Xaa can be any naturally occurring amino acid
  misc_feature (97)..(97): Xaa can be any naturally occurring amino acid
INIAIHVSTLVALAVATPLEQSLDINFIDKGISGQGTANRYWDCCIPSCSWQGNFYKPNGVPVASCEISGVFRVDANAXSGCEGSGSAYMCISQQAXALDNTLAYGFGAASFSNGIDVSLCCSCVLHSFTDQVSNN

SEQ ID NO: 24370 - protein, 73 aa, Diabrotica virgifera
  misc_feature: Coding regions on vcDNA: vcDNA=SeqID_4067; Strand=-; Position=0-218
VSAKNIIFVFGSTKIIITKKFSEIIVSSVETEREIIVFVGIYYELHRFVINILGVIIFADTHIKKNCIAGRVG

SEQ ID NO: 24371 - protein, 38 aa, Diabrotica virgifera
  misc_feature: Coding regions on vcDNA: vcDNA=SeqID_4068; Strand=-; Position=2-115
ILSRVRQKLDVTIMGNCAIDRASRKALLKILIRRLYRE

SEQ ID NO: 24372 - protein, 120 aa, Diabrotica virgifera
  misc_feature: Coding regions on vcDNA: vcDNA=SeqID_4069; Strand=-; Position=3-362
  misc_feature (12)..(22): Xaa can be any naturally occurring amino acid
  misc_feature (28)..(34): Xaa can be any naturally occurring amino acid
  misc_feature (76)..(89): Xaa can be any naturally occurring amino acid
  misc_feature (91)..(114): Xaa can be any naturally occurring amino acid
DLKIHVLPCDSXXXXXXXXXXXNVIIIXXXXXXXREAINQNLDGLTNRPNTLLNQYIGKLKLDVGSKEEPKITYHXXXXXXXXXXXXXXSXXXXXXXXXXXXXXXXXXXXXXXXLTLESC

SEQ ID NO: 24373 - protein, 45 aa, Diabrotica virgifera
  misc_feature: Coding regions on vcDNA: vcDNA=SeqID_4070; Strand=-; Position=2-136
  misc_feature (27)..(34): Xaa can be any naturally occurring amino acid
LLLNLFKCLINSGSKAQRISFDQNNYXXXXXXXXQNFEDSFLRLV

SEQ ID NO: 24374 - protein, 50 aa, Diabrotica virgifera
  misc_feature: Coding regions on vcDNA: vcDNA=SeqID_4071; Strand=-; Position=3-152
  misc_feature (17)..(25): Xaa can be any naturally occurring amino acid
SSIDVYLVNVLYSRKLXXXXXXXXXTRIHIHYAVNFAIKVLNNDHVFLNA

SEQ ID NO: 24375 - protein, 65 aa, Diabrotica virgifera
  misc_feature: Coding regions on vcDNA: vcDNA=SeqID_4072; Strand=-; Position=0-194
  misc_feature (11)..(17): Xaa can be any naturally occurring amino acid
RRHALKNLHDXXXXXXXTVSHCDCAEKHNAADHEKRRTVVNASAAKLFSYEGSQISFFFFGRLDG

SEQ ID NO: 24376 - protein, 76 aa, Diabrotica virgifera
  misc_feature: Coding regions on vcDNA: vcDNA=SeqID_4073; Strand=+; Position=61-291
CCVLILNRRFPSFEITTHIESFHLRCCDLPLTDNLITNSMVIIFEWKRSTYLTFISTSMYFVQLFCKAMRIDLIYI

SEQ ID NO: 24377 - protein, 50 aa, Diabrotica virgifera
  misc_feature: Coding regions on vcDNA: vcDNA=SeqID_4074; Strand=+; Position=158-310
GGINLLIEAVRYEIHSNDLIEDFNTPITRVLESLTVFYICFIFEHIFVNM

SEQ ID NO: 24378 - protein, 128 aa, Diabrotica virgifera
  misc_feature: Coding regions on vcDNA: vcDNA=SeqID_4075; Strand=+; Position=1-384
  misc_feature: Homolog annotation: Hit_ID=XP_396832.1; Match level="QueryCoverage =92%, HitCoverage=9%, E-value=4e-37, Identity=59%"; Hit description =similar to AT10293p [Apis mellifera]
INECEATEIEAYSEEVIELLERFKILLVRAKDKEEKLRELRTAACDAYNLLCTHEAGRILCPLCTKRNWAQLDNDLWRLEKWLQVAEGTQKTQKNPPSNIQYLEDVIQEHREFLLDLDSHMSIVTSLN

SEQ ID NO: 24379 - protein, 44 aa, Diabrotica virgifera
  misc_feature: Coding regions on vcDNA: vcDNA=SeqID_4076; Strand=-; Position=135-269
QQCKIPGRMIEDHFLGAHDLLVLFNLFFFRNYSPLFIFRTLFLS

SEQ ID NO: 24380 - protein, 36 aa, Diabrotica virgifera
  misc_feature: Coding regions on vcDNA: vcDNA=SeqID_4077; Strand=-; Position=66-176
KLEQKCDNEYSLIKKDNCIAYSRQLKKCKHINVNIN

SEQ ID NO: 24381 - protein, 54 aa, Diabrotica virgifera
  misc_feature: Coding regions on vcDNA: vcDNA=SeqID_4078; Strand=-; Position=18-182
  misc_feature (48)..(48): Xaa can be any naturally occurring amino acid
LEGPCNLSSRFYSLRLIIVIHEEFIPPLFLNMFICSSNHCDLFVFICXLDILHL

SEQ ID NO: 24382 - protein, 64 aa, Diabrotica virgifera
  misc_feature: Coding regions on vcDNA: vcDNA=SeqID_4079; Strand=+; Position=3-194
THNFSVNSSRYSHCGHNSKFIFSLIIVPVLKLHITGFFALFTTYFRQLFSTQISVVSTNRVPDL

SEQ ID NO: 24383 - protein, 54 aa, Diabrotica virgifera
  misc_feature: Coding regions on vcDNA: vcDNA=SeqID_4080; Strand=+; Position=12-176
RLLFSACPYLFYLLIVRYHCLTILYFYGIGSHFLHRVWLGGLLISFFWISFASR

SEQ ID NO: 24384 - protein, 98 aa, Diabrotica virgifera
  misc_feature: Coding regions on vcDNA: vcDNA=SeqID_4081; Strand=+; Position=29-322
  misc_feature: Homolog annotation: Hit_ID=CAE47497.1; Match level="QueryCoverage =98%, HitCoverage=30%, E-value=2e-12, Identity=41%"; Hit description =cathepsin L-like proteinase [Diabrotica virgifera virgifera]
  misc_feature (31)..(40): Xaa can be any naturally occurring amino acid
  misc_feature (56)..(65): Xaa can be any naturally occurring amino acid
SLSAILIVDKDDNLTASAQWATFNAPYRKFXXXXXXXXXXADFQYNHHRIDAHTAXXXXXXXXXXMAVDKLPDWASTQFEAILARQMANKPPQSFSAE

SEQ ID NO: 24385 - protein, 56 aa, Diabrotica virgifera
  misc_feature: Coding regions on vcDNA: vcDNA=SeqID_4082; Strand=-; Position=1-168
  misc_feature (21)..(28): Xaa can be any naturally occurring amino acid
  misc_feature (30)..(40): Xaa can be any naturally occurring amino acid
  misc_feature (45)..(54): Xaa can be any naturally occurring amino acid
KIEKRKTRNTPRRREGKEKAXXXXXXXXRXXXXXXXXXXXKEREXXXXXXXXXXRL

SEQ ID NO: 24386 - protein, 101 aa, Diabrotica virgifera
  misc_feature: Coding regions on vcDNA: vcDNA=SeqID_4083; Strand=+; Position=6-311
  misc_feature: Homolog annotation: Hit_ID=AAV90645.1; Match level="QueryCoverage =76%, HitCoverage=20%, E-value=5e-16, Identity=51%"; Hit description =putative salivary Gram negative bacteria-binding protein [Aedes albopictus]
  misc_feature (73)..(73): Xaa can be any naturally occurring amino acid
MILILFAFSAIVFNGVNSVSLSNSITSASGLDAPKNTSLCSGQLIFDDNFNWLDTSTWDPEQTLTGGGNNEIXWYTDTTRSSYTYNGQLQIIPTFVAHDYR

SEQ ID NO: 24387 - protein, 124 aa, Diabrotica virgifera
  misc_feature: Coding regions on vcDNA: vcDNA=SeqID_4084; Strand=+; Position=1-374
  misc_feature: Homolog annotation: Hit_ID=AAQ02892.1; Match level="QueryCoverage =97%, HitCoverage=28%, E-value=3e-27, Identity=50%"; Hit description =aspartate aminotransferase [Aedes aegypti]
  misc_feature: Gene Ontology Annotation: Cellular component=mitochondrion; Biological process=aspartate catabolism
  misc_feature (19)..(19): Xaa can be any naturally occurring amino acid
  misc_feature (23)..(23): Xaa can be any naturally occurring amino acid
  misc_feature (42)..(42): Xaa can be any naturally occurring amino acid
  misc_feature (53)..(53): Xaa can be any naturally occurring amino acid
  misc_feature (68)..(68): Xaa can be any naturally occurring amino acid
  misc_feature (85)..(85): Xaa can be any naturally occurring amino acid
  misc_feature (104)..(104): Xaa can be any naturally occurring amino acid
PYTLMKEYVPISGVTFICXNSLXLALGDFTSILEDGMFCTVXCIAGTGSLRIXCAYLFSFFPGLQFFXLPASSWGIHCPIMLHAXLYVKTYRYYDAITCGLDFXASIYDISIIPDISMDHLHAC

SEQ ID NO: 24388 - protein, 94 aa, Diabrotica virgifera
  misc_feature: Coding regions on vcDNA: vcDNA=SeqID_4085; Strand=-; Position=2-283
  misc_feature (62)..(89): Xaa can be any naturally occurring amino acid
PRKEDIKKGALNVKRGGYSKEHEFSTKANERKNPYNVHPFQNFHARVQKFTALRSTSILSLXXXXXXXXXXXXXXXXXXXXXXXXXXXXAWVRT

SEQ ID NO: 24389 - protein, 94 aa, Diabrotica virgifera
  misc_feature: Coding regions on vcDNA: vcDNA=SeqID_4086; Strand=+; Position=70-354
EIQDIKNDPFLRWCVNFLEQCISPTQRVTKDQSIDKTNDQFNLPTEKTAFIYVLLFCIHFTVNISLFNASVDSISLLNISLFCLHVIYSRYYLH

SEQ ID NO: 24390 - protein, 73 aa, Diabrotica virgifera
  misc_feature: Coding regions on vcDNA: vcDNA=SeqID_4087; Strand=-; Position=139-360
ILVERPMHQDKYAYRSEVSTEIALHLVQRTEGEVCPDTCHLTNNGMMLGTFLGMEEAFSNTPFEVIIKAIRVK

SEQ ID NO: 24391 - protein, 82 aa, Diabrotica virgifera
  misc_feature: Coding regions on vcDNA: vcDNA=SeqID_4088; Strand=+; Position=10-255
  misc_feature: Homolog annotation: Hit_ID=CAE47497.1; Match level="QueryCoverage =92%, HitCoverage=24%, E-value=2e-10, Identity=43%"; Hit description =cathepsin L-like proteinase [Diabrotica virgifera virgifera]
  misc_feature (5)..(6): Xaa can be any naturally occurring amino acid
  misc_feature (9)..(9): Xaa can be any naturally occurring amino acid
  misc_feature (53)..(53): Xaa can be any naturally occurring amino acid
  misc_feature (64)..(64): Xaa can be any naturally occurring amino acid
  misc_feature (70)..(70): Xaa can be any naturally occurring amino acid
TRPEXXLFXIAAGFIQVAHANLSAFGHCSSFMVSPNQSYYVLDEDLSLGFFEXNLRKIVSHSTXMTSVSXFYYLSVNHFADW

SEQ ID NO: 24392 - protein, 111 aa, Diabrotica virgifera
  misc_feature: Coding regions on vcDNA: vcDNA=SeqID_4089; Strand=+; Position=1-336
  misc_feature: Homolog annotation: Hit_ID=XP_319701.1; Match level="QueryCoverage =74%, HitCoverage=14%, E-value=1e-25, Identity=63%"; Hit description =ENSANGP00000021364 [Anopheles gambiae]
  misc_feature: Gene Ontology Annotation: Molecular function=molecular_function unknown; Cellular component=cellular_component unknown; Biological process=biological_process unknown
  misc_feature: Pfam annotation: Pfam_ID=BolA; Match level="Score=98.5, E-value=1.8e -26, Copies=1"; Pfam description=BolA-like protein
IAIEVSKVPYHKTEQYLTQFYLPVLVMTYTENYLKNKLLKELDASYVQVVDQSNGCGGKFACVIVSEKFKGKPLLARHRLVNSVLEEELKTIHAFSQKTLTPEQWQEQQQK

SEQ ID NO: 24393 - protein, 44 aa, Diabrotica virgifera
  misc_feature: Coding regions on vcDNA: vcDNA=SeqID_4090; Strand=-; Position=21-155
ISHIIELVKNSKNSHPCCKTAIIAKKPYKNKYSHFTLFNHLCYT

SEQ ID NO: 24394 - protein, 71 aa, Diabrotica virgifera
  misc_feature: Coding regions on vcDNA: vcDNA=SeqID_4091; Strand=+; Position=3-218
  misc_feature (36)..(36): Xaa can be any naturally occurring amino acid
GTPRVRQRVRPRVRGRVGGHVGVRHWFCGCVCLFPXCVLLFCVSCVQGLCTNRYLGSTSGLNRAYLLNSIM

SEQ ID NO: 24395 - protein, 107 aa, Diabrotica virgifera
  misc_feature: Coding regions on vcDNA: vcDNA=SeqID_4092; Strand=+; Position=3-326
  misc_feature: Homolog annotation: Hit_ID=CAE47497.1; Match level="QueryCoverage =93%, HitCoverage=31%, E-value=3e-21, Identity=56%"; Hit description =cathepsin L-like proteinase [Diabrotica virgifera virgifera]
  misc_feature (78)..(78): Xaa can be any naturally occurring amino acid
  misc_feature (81)..(81): Xaa can be any naturally occurring amino acid
  misc_feature (93)..(93): Xaa can be any naturally occurring amino acid
KRPERCDGLSAEAQYADNGSDDRCFIVENTSLSSTNGYVELVPTDDAIVCAVARVGRVVTAVYAERCELHRSGDFHNXTLXTKLNQRVRAVGXTFDAIIVKKSWGTS

SEQ ID NO: 24396 - protein, 61 aa, Diabrotica virgifera
  misc_feature: Coding regions on vcDNA: vcDNA=SeqID_4093; Strand=+; Position=243-425
  misc_feature (30)..(36): Xaa can be any naturally occurring amino acid
LKRIAILYAFNNSRKNCELPTFGPTELNNXXXXXXXLLNTIFLIEYKYLTDKFHINSCFVS

SEQ ID NO: 24397 - protein, 37 aa, Diabrotica virgifera
  misc_feature: Coding regions on vcDNA: vcDNA=SeqID_4094; Strand=+; Position=18-128
RYLGTHGMFIGLHAYTPFALGIDHEQVLHMRGVHFCP

SEQ ID NO: 24398 - protein, 80 aa, Diabrotica virgifera
  misc_feature: Coding regions on vcDNA: vcDNA=SeqID_4095; Strand=+; Position=54-296
  misc_feature (22)..(31): Xaa can be any naturally occurring amino acid
  misc_feature (70)..(78): Xaa can be any naturally occurring amino acid
AVFHNILMFYLFFTIISISTKXXXXXXXXXXIFSQVDIHRSRKRNESLQLAVYHNKNYSRSKKSSFVDCXXXXXXXXXTS

SEQ ID NO: 24399 - protein, 158 aa, Diabrotica virgifera
  misc_feature: Coding regions on vcDNA: vcDNA=SeqID_4096; Strand=+; Position=3-476
  misc_feature: Homolog annotation: Hit_ID=AAH70860.1; Match level="QueryCoverage =94%, HitCoverage=80%, E-value=2e-26, Identity=42%"; Hit description =MGC84616 protein [Xenopus laevis]
  misc_feature: Gene Ontology Annotation: Molecular function=molecular_function unknown; Cellular component=cellular_component unknown; Biological process=protein modification
  misc_feature: Pfam annotation: Pfam_ID=Glyco_tran_28_C; Match level="Score=54.2, E -value=3.6e-13, Copies=1"; Pfam description=Glycosyltransferase family 28 C-termi
  misc_feature (137)..(137): Xaa can be any naturally occurring amino acid
  misc_feature (143)..(143): Xaa can be any naturally occurring amino acid
GATQASGIFVTVGTTKFPKLINTITNEQVIRSFISLGYDYIQIQTGKDAIKPPVIDLPHTIKQEETSLIIEIQDKLVIKYDSYFEDFEPEIVKSDLVISHAGAGTCLEVLKKGKHLLVVVNEDLMDNHQIELAGQLXDSGYLXYCTCDTLNEMLKQNF

SEQ ID NO: 24400 - protein, 79 aa, Diabrotica virgifera
  misc_feature: Coding regions on vcDNA: vcDNA=SeqID_4097; Strand=+; Position=3-242
  misc_feature (30)..(40): Xaa can be any naturally occurring amino acid
  misc_feature (45)..(52): Xaa can be any naturally occurring amino acid
SETSGATQASEITYDSNVFLTQSSEWFYFXXXXXXXXXXXHLYNXXXXXXXXVYHGLLINTYILMICEFRLAKLLKVLL

SEQ ID NO: 24401 - protein, 58 aa, Diabrotica virgifera
  misc_feature: Coding regions on vcDNA: vcDNA=SeqID_4098; Strand=-; Position=1-174
  misc_feature (38)..(44): Xaa can be any naturally occurring amino acid
INICKTVCIHNCVITGVNFCIYLYFIVWQNSKPLFWHXXXXXXXQKYTVCPNFVTTVD

SEQ ID NO: 24402 - protein, 104 aa, Diabrotica virgifera
  misc_feature: Coding regions on vcDNA: vcDNA=SeqID_4099; Strand=+; Position=179-490
MQIAGSSGNSRFKKKPERAPPASDWQSDRDIRERERERDRERERERERAKSSSASDDSPPPKKMSLPPLPPAEKAVSVRKAMALKEPPLKKPESPKKLKLTPAP

SEQ ID NO: 24403 - protein, 77 aa, Diabrotica virgifera
  misc_feature: Coding regions on vcDNA: vcDNA=SeqID_4100; Strand=-; Position=84-317
  misc_feature (10)..(18): Xaa can be any naturally occurring amino acid
NRYKFLNSLXXXXXXXXXHHFPNVPHGGAVWNKYSQAARMVRNMELIIKLIFLIKLFVIFIKQSKVYTTAHKRKRKV

SEQ ID NO: 24404 - protein, 60 aa, Diabrotica virgifera
  misc_feature: Coding regions on vcDNA: vcDNA=SeqID_4101; Strand=-; Position=197-379
  misc_feature (26)..(32): Xaa can be any naturally occurring amino acid
NVYGVHKFHCSFFIRSSCHKNATCTXXXXXXXVFDILEKIDFHSVTSTVAIFFMCTLVLR

SEQ ID NO: 24405 - protein, 143 aa, Diabrotica virgifera
  misc_feature: Coding regions on vcDNA: vcDNA=SeqID_4102; Strand=+; Position=4-430
  misc_feature: Homolog annotation: Hit_ID=BAB85479.1; Match level="QueryCoverage =80%, HitCoverage=37%, E-value=6e-26, Identity=50%"; Hit description =luciferin-regenerating enzyme [Luciola cruciata]
  misc_feature: Pfam annotation: Pfam_ID=SMP-30; Match level="Score=-133.7, E-value =0.0038, Copies=1"; Pfam description=Senescence marker protein-30 (SMP-30)
  misc_feature (33)..(33): Xaa can be any naturally occurring amino acid
  misc_feature (65)..(65): Xaa can be any naturally occurring amino acid
SEPVEKLLSGFLLSEGPHWDDKKQCLYFVDILXKYINRYVPSTKEHTWAKLDDHNVSLIIPVKDXRKHFLVALDRSVCLVNWDGQSKQVTKIERLVEVEEGTEHVLNDGKCDYTGRLWIGTMGAAAKALQNLQDGQGAFSSNK

SEQ ID NO: 24406 - protein, 65 aa, Diabrotica virgifera
  misc_feature: Coding regions on vcDNA: vcDNA=SeqID_4103; Strand=-; Position=20-217
ILLNRQYRESCVLMMYIVMSTLLAIQNLISCIANDSRSISRDISHTVDEVNITVVEPKHSLQQSP

SEQ ID NO: 24407 - protein, 43 aa, Diabrotica virgifera
  misc_feature: Coding regions on vcDNA: vcDNA=SeqID_4104; Strand=+; Position=132-263
FRWIKKITFRHFNVREVALHDGVAKPMDQHKQRMQCHGTKGFR

SEQ ID NO: 24408 - protein, 119 aa, Diabrotica virgifera
  misc_feature: Coding regions on vcDNA: vcDNA=SeqID_4105; Strand=+; Position=59-418
  misc_feature (68)..(74): Xaa can be any naturally occurring amino acid
IFLKKLSLKMVFKVSLLCTLLVLVAYSSAYDYSNCPGNTNRQKNLIYSSLLPPGYSVKTRIPATGYYXXXXXXXLLIDQKGSASSPKIIEGGYLDTFAVVNITSTTAQPVSYYAIVFID

SEQ ID NO: 24409 - protein, 76 aa, Diabrotica virgifera
  misc_feature: Coding regions on vcDNA: vcDNA=SeqID_4106; Strand=+; Position=1-228
  misc_feature: Homolog annotation: Hit_ID=CAG03659.1; Match level="QueryCoverage =97%, HitCoverage=16%, E-value=2e-12, Identity=45%"; Hit description =unnamed protein product [Tetraodon nigroviridis]
  misc_feature: Gene Ontology Annotation: Molecular function=protein disulfide isomerase activity; Biological process=protein folding
  misc_feature (20)..(20): Xaa can be any naturally occurring amino acid
TRTVWVVEFLAPGGGNGRNXEQNFPKQPMPLKGMVKVGALMLNNPKKSGGHFGIKGFPTIKFLGQNNLNPENFNGG

SEQ ID NO: 24410 - protein, 44 aa, Diabrotica virgifera
  misc_feature: Coding regions on vcDNA: vcDNA=SeqID_4107; Strand=+; Position=66-200
YYISTTMLSLIKIEVFNKGIRLHVSQQYNMSMIISIEDVVSHAH

SEQ ID NO: 24411 - protein, 59 aa, Diabrotica virgifera
  misc_feature: Coding regions on vcDNA: vcDNA=SeqID_4108; Strand=+; Position=40-219
  misc_feature (20)..(20): Xaa can be any naturally occurring amino acid
  misc_feature (40)..(40): Xaa can be any naturally occurring amino acid
FLINVSLIIIPSPSNSTARXYFGSIIGLCIGCHLSTREYXAIHNCPIVSISFELVAHNC

SEQ ID NO: 24412 - protein, 133 aa, Diabrotica virgifera
  misc_feature: Coding regions on vcDNA: vcDNA=SeqID_4109; Strand=-; Position=1-399
  misc_feature (3)..(79): Xaa can be any naturally occurring amino acid
  misc_feature (86)..(95): Xaa can be any naturally occurring amino acid
  misc_feature (97)..(107): Xaa can be any naturally occurring amino acid
  misc_feature (112)..(133): Xaa can be any naturally occurring amino acid
YKXXXXXXXXXXXXXXXXXXXXXXXXXXXXXXXXXXXXXXXXXXXXXXXXXXXXXXXXXXXXXXXXXXXXXXXXXXXXXLKSKLYXXXXXXXXXXPXXXXXXXXXXXLNILXXXXXXXXXXXXXXXXXXXXXX

SEQ ID NO: 24413 - protein, 89 aa, Diabrotica virgifera
  misc_feature: Coding regions on vcDNA: vcDNA=SeqID_4110; Strand=-; Position=2-268
  misc_feature (26)..(26): Xaa can be any naturally occurring amino acid
  misc_feature (61)..(61): Xaa can be any naturally occurring amino acid
EKAKNTARQKKEAQKRKRTRKSGKGXRKRKANRGNSRTEENKDKTDKGQKRKPNHQTQKQXKNGAKDSRRNKREDDDNQDKDQSTKEGD

SEQ ID NO: 24414 - protein, 80 aa, Diabrotica virgifera
  misc_feature: Coding regions on vcDNA: vcDNA=SeqID_4111; Strand=+; Position=60-302
ATFFVQNVPKTQEKRVGAKDIDFCNLIRKIEKRIWTTFHVGNFLNLVLRCLTNVIMQSNLMVIFSQTNKVSPCLFGRFLF

SEQ ID NO: 24415 - protein, 116 aa, Diabrotica virgifera
  misc_feature: Coding regions on vcDNA: vcDNA=SeqID_4112; Strand=+; Position=1-348
  misc_feature: Homolog annotation: Hit_ID=CAA79494.1; Match level="QueryCoverage =83%, HitCoverage=10%, E-value=5e-28, Identity=59%"; Hit description =nitrate reductase [Arabidopsis thaliana] pir||S35228 nitrate reductase (NADH) (EC 1.7.1.1) 1 - Arabidopsis
  misc_feature: Pfam annotation: Pfam_ID=Oxidored_molyb; Match level="Score=-148.1, E- value=0.063, Copies=1"; Pfam description=Oxidoreductase molybdopterin binding
YGPYSREPPRVRNGAKLTPDHGFPVRLIVPGVIGGRMIKYLSKIMVTEVRSDSWYHYHDNRVLPSIVNNAYMDKREQWWTRPEYTINELNINSAMGSPAHGSDVTISESQALGTEI

SEQ ID NO: 24416 - protein, 35 aa, Diabrotica virgifera
  misc_feature: Coding regions on vcDNA: vcDNA=SeqID_4113; Strand=-; Position=2-106
  misc_feature (26)..(34): Xaa can be any naturally occurring amino acid
VNQLKVQAQNFGPMPFKCIHFFRILXXXXXXXXXS

SEQ ID NO: 24417 - protein, 46 aa, Diabrotica virgifera
  misc_feature: Coding regions on vcDNA: vcDNA=SeqID_4114; Strand=+; Position=202-342
  misc_feature (7)..(15): Xaa can be any naturally occurring amino acid
  misc_feature (35)..(43): Xaa can be any naturally occurring amino acid
LYLIIYXXXXXXXXXINISIYIYGLTLLNNFRDDXXXXXXXXXKFS

SEQ ID NO: 24418 - protein, 48 aa, Diabrotica virgifera
  misc_feature: Coding regions on vcDNA: vcDNA=SeqID_4115; Strand=-; Position=40-186
FNSDREHKNQTHDDLTKGRAIDIYLPSMDVTPSTTLAVSVPSYIKQCR

SEQ ID NO: 24419 - protein, 55 aa, Diabrotica virgifera
  misc_feature: Coding regions on vcDNA: vcDNA=SeqID_4116; Strand=+; Position=1-168
  misc_feature: Homolog annotation: Hit_ID=XP_319808.1; Match level="QueryCoverage =74%, HitCoverage=2%, E-value=3e-09, Identity=64%"; Hit description =ENSANGP00000016536 [Anopheles gambiae]
VGLRVAHASAQASAYRFWQHEFVHCAPEIDELFESVARSCMVKSTAQAQEGDIQE

SEQ ID NO: 24420 - protein, 76 aa, Diabrotica virgifera
  misc_feature: Coding regions on vcDNA: vcDNA=SeqID_4117; Strand=-; Position=9-239
  misc_feature (29)..(35): Xaa can be any naturally occurring amino acid
VVDSSRIKIYMIPKGAFAMGWLPPHLGGXXXXXXXLTAKVDKNFNSKQKMFFCIKYIFLIKLIVFDLFAIESVSFV

SEQ ID NO: 24421 - protein, 136 aa, Diabrotica virgifera
  misc_feature: Coding regions on vcDNA: vcDNA=SeqID_4118; Strand=+; Position=2-409
PHTMKKITLFFCAIILASVAALPNKVADDNFIDDVKKIVHTIEGLIDELFTTGPNFIGTFADKYHWYLTKVLNYTRTAITRALEALEPILNQIAAQSTDSVKKLISCIEEQENGIMALRVNFVASVGKCIKDDLVA

SEQ ID NO: 24422 - protein, 81 aa, Diabrotica virgifera
  misc_feature: Coding regions on vcDNA: vcDNA=SeqID_4119; Strand=+; Position=160-402
  misc_feature: Homolog annotation: Hit_ID=XP_320471.1; Match level="QueryCoverage =70%, HitCoverage=10%, E-value=7e-12, Identity=56%"; Hit description =ENSANGP00000008628 [Anopheles gambiae]
MKCYIVYASAVLFSYISAETVQSCDSLIYCQGELLDTVQSARIFSDSKTFVDLSQRQSPDETLGNFKKFMAKCNDNPTKDE

SEQ ID NO: 24423 - protein, 51 aa, Diabrotica virgifera
  misc_feature: Coding regions on vcDNA: vcDNA=SeqID_4120; Strand=+; Position=60-215
  misc_feature (6)..(16): Xaa can be any naturally occurring amino acid
  misc_feature (23)..(37): Xaa can be any naturally occurring amino acid
LLIVNXXXXXXXXXXXRVIYFLXXXXXXXXXXXXXXXISDFKTPNSLTFLL

SEQ ID NO: 24424 - protein, 58 aa, Diabrotica virgifera
  misc_feature: Coding regions on vcDNA: vcDNA=SeqID_4121; Strand=+; Position=2-178
LQIISIVSTLILLRYVLCRYHIDFRYDINTKSIFLSNIVKLYLIEINAQNPGTITGLR

SEQ ID NO: 24425 - protein, 105 aa, Diabrotica virgifera
  misc_feature: Coding regions on vcDNA: vcDNA=SeqID_4122; Strand=+; Position=2-319
TIALWEKEKRPEAFWSSSLSYVFMTLLKSYYESIKNGKILYYWNKNNNLINGPSAATLTNVENRLKAIINDIDKNLTVDPNVVAKYILSAQELIEFKMSNMKVKG

SEQ ID NO: 24426 - protein, 62 aa, Diabrotica virgifera
  misc_feature: Coding regions on vcDNA: vcDNA=SeqID_4123; Strand=-; Position=162-350
RDPTNHGMIRISTYGEHTLHAPLSGSVELLTLSTSNLYEIGGSCNLSTGTLQLLDKMRRREM

SEQ ID NO: 24427 - protein, 118 aa, Diabrotica virgifera
  misc_feature: Coding regions on vcDNA: vcDNA=SeqID_4124; Strand=+; Position=4-357
  misc_feature: Homolog annotation: Hit_ID=AAD38391.1; Match level="QueryCoverage =94%, HitCoverage=17%, E-value=6e-22, Identity=50%"; Hit description =5-aminolevulinic acid synthase [Aspergillus oryzae]
  misc_feature: Gene Ontology Annotation: Molecular function=electron transporter activity; Cellular component=extracellular space; Biological process= electron transport
  misc_feature (40)..(40): Xaa can be any naturally occurring amino acid
  misc_feature (73)..(73): Xaa can be any naturally occurring amino acid
MCSLAQNLPNSMILTDAKIHATKIQGIKGSGSKKMFFRHXDSTHLVGLLHIIDPSVSIIIAIENDYSMSGIIXKVYDICRLAIRYGAITIMDEVHAVCMYGRQGADVGNHLDIGENLN

SEQ ID NO: 24428 - protein, 48 aa, Diabrotica virgifera
  misc_feature: Coding regions on vcDNA: vcDNA=SeqID_4125; Strand=+; Position=220-366
IYLSRFDVIKCESDLKISKFSRMILYTSISIQLKVEYISITTIIYFYG

SEQ ID NO: 24429 - protein, 58 aa, Diabrotica virgifera
  misc_feature: Coding regions on vcDNA: vcDNA=SeqID_4126; Strand=-; Position=30-206
  misc_feature (19)..(26): Xaa can be any naturally occurring amino acid
  misc_feature (36)..(58): Xaa can be any naturally occurring amino acid
HAGDKHVTEILPKSYIKPXXXXXXXXNIIIIISSYXXXXXXXXXXXXXXXXXXXXXXX

SEQ ID NO: 24430 - protein, 76 aa, Diabrotica virgifera
  misc_feature: Coding regions on vcDNA: vcDNA=SeqID_4127; Strand=-; Position=66-296
CLSGHSTYNCHSYYPLAWMACFHHQLSDDCGSSARERGNSRCIHRASDQNSDWSNRSRVIHVQIFTNECDIPIIPR

SEQ ID NO: 24431 - protein, 109 aa, Diabrotica virgifera
  misc_feature: Coding regions on vcDNA: vcDNA=SeqID_4128; Strand=+; Position=57-383
  misc_feature: Homolog annotation: Hit_ID=CAE47497.1; Match level="QueryCoverage =100%, HitCoverage=34%, E-value=4e-34, Identity=69%"; Hit description= cathepsin L-like proteinase [Diabrotica virgifera virgifera]
  misc_feature (71)..(78): Xaa can be any naturally occurring amino acid
MNLFILDAALSGATSANLSAFDKWTNFKATDNTSCNVIDDTLRFAVFQHNLKVLDEHNAIYNSGEQTYYLXXXXXXXXSSAEFQAMLARHMANKPNHSFIAIHLADRNV

SEQ ID NO: 24432 - protein, 108 aa, Diabrotica virgifera
  misc_feature: Coding regions on vcDNA: vcDNA=SeqID_4129; Strand=-; Position=84-410
  misc_feature (1)..(44): Xaa can be any naturally occurring amino acid
  misc_feature (54)..(70): Xaa can be any naturally occurring amino acid
  misc_feature (76)..(86): Xaa can be any naturally occurring amino acid
  misc_feature (93)..(104): Xaa can be any naturally occurring amino acid
XXXXXXXXXXXXXXXXXXXXXXXXXXXXXXXXXXXXXXXXXXXXLFKNGLHFIXXXXXXXXXXXXXXXXXGLLNSXXXXXXXXXXXPWYPRYXXXXXXXXXXXXLSPY

SEQ ID NO: 24433 - protein, 44 aa, Diabrotica virgifera
  misc_feature: Coding regions on vcDNA: vcDNA=SeqID_4130; Strand=-; Position=0-131
  misc_feature (4)..(40): Xaa can be any naturally occurring amino acid
SSPXXXXXXXXXXXXXXXXXXXXXXXXXXXXXXXXXXXXXGRVG

SEQ ID NO: 24434 - protein, 69 aa, Diabrotica virgifera
  misc_feature: Coding regions on vcDNA: vcDNA=SeqID_4131; Strand=+; Position=7-217
  misc_feature: Homolog annotation: Hit_ID=AAP57194.1; Match level="QueryCoverage =94%, HitCoverage=30%, E-value=8e-11, Identity=58%"; Hit description =ferritin [Leptinotarsa decemlineata]
  misc_feature (29)..(29): Xaa can be any naturally occurring amino acid
  misc_feature (47)..(47): Xaa can be any naturally occurring amino acid
LIYNLSDLNVRNLVPSVTTWEPGVSALNXAHQLVASVTRKIRNDTKXVNKAVSFNYYQLVDYLAGYCLR

SEQ ID NO: 24435 - protein, 73 aa, Diabrotica virgifera
  misc_feature: Coding regions on vcDNA: vcDNA=SeqID_4132; Strand=+; Position=86-304
GYNVEDRFCAPAEVETTSQITRLGMTYHQHDSICSSIGSRVSNDQVVLASSHIKHLSVITHIDSITKNIADTE

SEQ ID NO: 24436 - protein, 50 aa, Diabrotica virgifera
  misc_feature: Coding regions on vcDNA: vcDNA=SeqID_4133; Strand=+; Position=45-197
LHDRRCEFVMKQYIQHLSPILWWSLSNRRVMIVTVGCNQYKYRFTSFLEI

SEQ ID NO: 24437 - protein, 27 aa, Diabrotica virgifera
  misc_feature: Coding regions on vcDNA: vcDNA=SeqID_4134; Strand=+; Position=1-81
FRAFCANDPLTSPSDTGFLLPNEHFHF

SEQ ID NO: 24438 - protein, 73 aa, Diabrotica virgifera
  misc_feature: Coding regions on vcDNA: vcDNA=SeqID_4135; Strand=+; Position=89-310
TQYLPLQLRQNHHLNEHSNERLVQHQILHTDTYTELSSTVPTHSFFTQQQDSSTIVPTYYSLISASDSSTTAP

SEQ ID NO: 24439 - protein, 145 aa, Diabrotica virgifera
  misc_feature: Coding regions on vcDNA: vcDNA=SeqID_4136; Strand=+; Position=2-436
TRVRSIDGTDVGLYRSTTQEMNKKIGYDVTYLGELSDTDSYEDPKFLLKGDSQSKPRIIDFVPLDYATKSMFPNNSNIPEYQTLEREKVYHVLNSAPKSTVNKADIKQVDDVDGKPRSTNPFVEPEPNKSPEGATKLEGTIGQER

SEQ ID NO: 24440 - protein, 25 aa, Diabrotica virgifera
  misc_feature: Coding regions on vcDNA: vcDNA=SeqID_4137; Strand=-; Position=1-75
LSYIVSDRHVHFICAGSVKTNIDAV

SEQ ID NO: 24441 - protein, 53 aa, Diabrotica virgifera
  misc_feature: Coding regions on vcDNA: vcDNA=SeqID_4138; Strand=+; Position=119-280
VEGISGETGVVTKNMASDAFSVIVLACNGVFFISKIFSMFHSSTQPCINKIKA

SEQ ID NO: 24442 - protein, 66 aa, Diabrotica virgifera
  misc_feature: Coding regions on vcDNA: vcDNA=SeqID_4139; Strand=+; Position=3-203
KPTAYSSSNVVDVQSLITMANIASGDSEINSKYKPVIAKSVPVSISDDLLEEPIYVLTTKAPVSIF

SEQ ID NO: 24443 - protein, 136 aa, Diabrotica virgifera
  misc_feature: Coding regions on vcDNA: vcDNA=SeqID_4140; Strand=-; Position=3-410
TQSYIHHNSSIECLLLTLLFLIFSCLIWLTLLAKSPTMISSFTLILSLLNTSSILFISSSRNELISFRLLFSFSLTRASLSVSVISVIMVISGSDSNCTKSSSFFLSSLDKSSSNHSVCFTMSTLDTSLAETPLRV

SEQ ID NO: 24444 - protein, 63 aa, Diabrotica virgifera
  misc_feature: Coding regions on vcDNA: vcDNA=SeqID_4141; Strand=-; Position=29-220
LWANKMPRYRSIQQHEVTFECGLSNVAATHFTVCYLLCTLFSHIGLSVEGSFIKIRFMCTHST

SEQ ID NO: 24445 - protein, 53 aa, Diabrotica virgifera
  misc_feature: Coding regions on vcDNA: vcDNA=SeqID_4142; Strand=+; Position=292-450
  misc_feature (9)..(14): Xaa can be any naturally occurring amino acid
MSFSNEGIXXXXXXNEIEKMGFKSISRFSNENILYSLFKLLENCKVYPHCYIA

SEQ ID NO: 24446 - protein, 60 aa, Diabrotica virgifera
  misc_feature: Coding regions on vcDNA: vcDNA=SeqID_4143; Strand=+; Position=2-184
KFSTLECSIYLSNMSLERQGCSIPPTSSVFQKDIEAHAWLETNHGAILPQGDAYRLYGPS

SEQ ID NO: 24447 - protein, 76 aa, Diabrotica virgifera
  misc_feature: Coding regions on vcDNA: vcDNA=SeqID_4144; Strand=-; Position=157-387
RESGNAHLDKFFGRPGYMYDRDRGLLVKRCKLGRRNTVRGITAHRVATDHVLNYTCQPLKACTKLVPLCQGLLPIC

SEQ ID NO: 24448 - protein, 92 aa, Diabrotica virgifera
  misc_feature: Coding regions on vcDNA: vcDNA=SeqID_4145; Strand=+; Position=40-318
  misc_feature: Homolog annotation: Hit_ID=XP_308324.1; Match level="QueryCoverage =93%, HitCoverage=63%, E-value=3e-09, Identity=36%"; Hit description =ENSANGP00000010970 [Anopheles gambiae]
  misc_feature (54)..(67): Xaa can be any naturally occurring amino acid
MEVEQLCLKEPQWILDRKDSGPLFWRRDSSETARVKFRYEVDIKEFQRGEHEFXXXXXXXXXXXXXXTSMSVMFCITVTVILPWLLFAQKGF

SEQ ID NO: 24449 - protein, 37 aa, Diabrotica virgifera
  misc_feature: Coding regions on vcDNA: vcDNA=SeqID_4146; Strand=+; Position=2-112
  misc_feature (4)..(10): Xaa can be any naturally occurring amino acid
CNSXXXXXXXLLALCLHIIVCSFLILFSLKGYLITTR

SEQ ID NO: 24450 - protein, 78 aa, Diabrotica virgifera
  misc_feature: Coding regions on vcDNA: vcDNA=SeqID_4147; Strand=-; Position=64-300
LLPMVNECRTYKHTRHHDIPDHDKQSTLNTPDLSHEATGTLLEVSKFPNHEQEGMHPSHSRVKNPSPLMQISMNLTHG

SEQ ID NO: 24451 - protein, 64 aa, Diabrotica virgifera
  misc_feature: Coding regions on vcDNA: vcDNA=SeqID_4148; Strand=+; Position=109-300
LLACHMKGNDMTVNDLFYDSNIVQNRGSEFIIKSDLMHIKSSESSRSAVGIVTLTCQHGDQGCY

SEQ ID NO: 24452 - protein, 93 aa, Diabrotica virgifera
  misc_feature: Coding regions on vcDNA: vcDNA=SeqID_4149; Strand=+; Position=133-411
LYLLNRSSDSNRQIFYCTVSYIGNDVDEEVSYMLILENGNRSCSHQLQIKIHVTTPLENSDLKNILYDPTSVVARIEIFNNEDEVLEFSDPDD

SEQ ID NO: 24453 - protein, 40 aa, Diabrotica virgifera
  misc_feature: Coding regions on vcDNA: vcDNA=SeqID_4150; Strand=-; Position=200-322
KFTKWNKYGDVPCFQGWFHFYIYIASENERVTIEPIPNVI

SEQ ID NO: 24454 - protein, 31 aa, Diabrotica virgifera
  misc_feature: Coding regions on vcDNA: vcDNA=SeqID_4151; Strand=+; Position=2-97
  misc_feature (8)..(14): Xaa can be any naturally occurring amino acid
TRCSMQPXXXXXXXPLSFIDLIGKFYASIVT

SEQ ID NO: 24455 - protein, 89 aa, Diabrotica virgifera
  misc_feature: Coding regions on vcDNA: vcDNA=SeqID_4152; Strand=+; Position=6-276
  misc_feature: Homolog annotation: Hit_ID=AAG17127.1; Match level="QueryCoverage =97%, HitCoverage=27%, E-value=8e-16, Identity=52%"; Hit description =cathepsin L-like cysteine proteinase CAL1 [Diabrotica virgifera virgifera]
  misc_feature (56)..(56): Xaa can be any naturally occurring amino acid
RVVLIAANNLNVTALSLNNHWEDFKVKHWLAYNNPLEDRVRISVFQTNLIGIIEHXAKTLSTSCPFTTEVMQFADMTSEQFIATLSEHA

SEQ ID NO: 24456 - protein, 139 aa, Diabrotica virgifera
  misc_feature: Coding regions on vcDNA: vcDNA=SeqID_4153; Strand=+; Position=3-419
  misc_feature: Homolog annotation: Hit_ID=XP_523752.1; Match level="QueryCoverage =100%, HitCoverage=29%, E-value=2e-27, Identity=41%"; Hit description= PREDICTED: similar to F4N2.10 [Pan troglodytes]
  misc_feature: Gene Ontology Annotation: Molecular function=molecular_function unknown; Cellular component=cell wall (sensu Fungi); Biological process=biological_process unknown
  misc_feature (124)..(124): Xaa can be any naturally occurring amino acid
TITAEPSPFTVTTEPSPFTVTAEPSPLTITKEPTPFTITAEPSPFTITTEPSPFTMTTETSPFTITTEQTPFTMTTEPSPFSISTEESPFTITTETSPFTVTTEQTPFAVTTEPSPFTITTETXPFTITTEKTPFTITT

SEQ ID NO: 24457 - protein, 60 aa, Diabrotica virgifera
  misc_feature: Coding regions on vcDNA: vcDNA=SeqID_4154; Strand=-; Position=1-180
  misc_feature (22)..(60): Xaa can be any naturally occurring amino acid
TQKDMPLLTSVTTVFPNSSHRXXXXXXXXXXXXXXXXXXXXXXXXXXXXXXXXXXXXXXX

SEQ ID NO: 24458 - protein, 138 aa, Diabrotica virgifera
  misc_feature: Coding regions on vcDNA: vcDNA=SeqID_4155; Strand=+; Position=15-426
  misc_feature: Homolog annotation: Hit_ID=CAE47497.1; Match level="QueryCoverage =98%, HitCoverage=42%, E-value=2e-28, Identity=53%"; Hit description =cathepsin L-like proteinase [Diabrotica virgifera virgifera]
  misc_feature (64)..(64): Xaa can be any naturally occurring amino acid
  misc_feature (79)..(79): Xaa can be any naturally occurring amino acid
  misc_feature (85)..(85): Xaa can be any naturally occurring amino acid
  misc_feature (108)..(108): Xaa can be any naturally occurring amino acid
IRLKLFTAAAALTVPITANLSSFEQWTIFKAIHIISYNVNVDIIRVTVFQFILNVVYEHIANHXVFNKPTILAVNTFAXDWSIAXFQSSLALQMVIKPLETFNGKHVXISIVNAANEVDRRSSADLGVKDLGICGSCW

SEQ ID NO: 24459 - protein, 68 aa, Diabrotica virgifera
  misc_feature: Coding regions on vcDNA: vcDNA=SeqID_4156; Strand=+; Position=53-256
DPHPIINNQKSFQGHPSFHFTGWLTPAHCPLRTLPGFMPLLLLPACLLGGRLFSLSLRGNPAVVQVIP

SEQ ID NO: 24460 - protein, 46 aa, Diabrotica virgifera
  misc_feature: Coding regions on vcDNA: vcDNA=SeqID_4157; Strand=-; Position=3-140
TLTHRRTLDPKLPTEEAFVGARKLTNDFVTSHREYHTSLYTTHFTV

SEQ ID NO: 24461 - protein, 148 aa, Diabrotica virgifera
  misc_feature: Coding regions on vcDNA: vcDNA=SeqID_4158; Strand=+; Position=9-452
  misc_feature (140)..(140): Xaa can be any naturally occurring amino acid
  misc_feature (145)..(145): Xaa can be any naturally occurring amino acid
HCIMEERDLVSNRRRSLHNYGEEKPVCRKFPDNDEQNFQYPPDYIHKVNTETEKWNAHLSNILVDQQRYKEKIRELKTVVYNENVLSHDQQEFLKSIDFNTYLRQTEIFCKKVHLAAELYSFNKSEKYQELQKTIEHVQXIIDSXLKT

SEQ ID NO: 24462 - protein, 54 aa, Diabrotica virgifera
  misc_feature: Coding regions on vcDNA: vcDNA=SeqID_4159; Strand=-; Position=1-162
  misc_feature (7)..(12): Xaa can be any naturally occurring amino acid
  misc_feature (15)..(44): Xaa can be any naturally occurring amino acid
LLTLSQXXXXXXHLXXXXXXXXXXXXXXXXXXXXXXXXXXXXXXRLFRRLCRPV

SEQ ID NO: 24463 - protein, 80 aa, Diabrotica virgifera
  misc_feature: Coding regions on vcDNA: vcDNA=SeqID_4160; Strand=+; Position=92-334
FDVTKPFRTNKNGRNTFKPPKMALEFLGGLNVFFQFLIQLKSYSYFKLYITYKNLDLIYFEVDKMGKILKNPIKNSFSNL

SEQ ID NO: 24464 - protein, 78 aa, Diabrotica virgifera
  misc_feature: Coding regions on vcDNA: vcDNA=SeqID_4161; Strand=+; Position=2-238
  misc_feature (2)..(28): Xaa can be any naturally occurring amino acid
RXXXXXXXXXXXXXXXXXXXXXXXXXXXKMEGYSEYIRVDGRLDSPFKGGGEGNSMGFDFGVPVREKPGVCQPYPLGW

SEQ ID NO: 24465 - protein, 51 aa, Diabrotica virgifera
  misc_feature: Coding regions on vcDNA: vcDNA=SeqID_4162; Strand=+; Position=36-191
VLHVISCRFYEDSELLIGGHRFYLVVTGNALSLTIINRLEAYPHYSTWCNI

SEQ ID NO: 24466 - protein, 58 aa, Diabrotica virgifera
  misc_feature: Coding regions on vcDNA: vcDNA=SeqID_4163; Strand=+; Position=77-253
MGRRFVRKISTSRISETKHFRTYVYKANCRYFFMRNCPLTCVALNWKHPVLMKNMASC

SEQ ID NO: 24467 - protein, 85 aa, Diabrotica virgifera
  misc_feature: Coding regions on vcDNA: vcDNA=SeqID_4164; Strand=+; Position=102-356
SNITLPSCHKSSTCSLLDNYCWIFALISTFHCTTVHIYHLITFSHIVAKSRLSHLSTDSNLTPAKPSENCNTFETTFGVTYHIIT

SEQ ID NO: 24468 - protein, 65 aa, Diabrotica virgifera
  misc_feature: Coding regions on vcDNA: vcDNA=SeqID_4165; Strand=+; Position=141-335
  misc_feature: Homolog annotation: Hit_ID=AAV34815.1; Match level="QueryCoverage =93%, HitCoverage=20%, E-value=5e-13, Identity=63%"; Hit description =ribosomal protein L6 [Bombyx mori]
  misc_feature: Pfam annotation: Pfam_ID=Ribosomal_L6e_N; Match level="Score=24.0, E -value=2.8e-05, Copies=1"; Pfam description=Ribosomal protein L6, N -terminal doma
MVEKKAVQKPAGDAPKKVHKPGKPRNYDLGNGVLRFSRSKMFHKKALYKFVGKKVEATKKPQKPK

SEQ ID NO: 24469 - protein, 85 aa, Diabrotica virgifera
  misc_feature: Coding regions on vcDNA: vcDNA=SeqID_4166; Strand=-; Position=1-255
  misc_feature (41)..(49): Xaa can be any naturally occurring amino acid
  misc_feature (52)..(65): Xaa can be any naturally occurring amino acid
TSLQGQVNMEPLRRPPTLTYDRYLSRCCSILFYFIVESLLXXXXXXXXXCIXXXXXXXXXXXXXXRSPSSLAISSALFIYFGTVI

SEQ ID NO: 24470 - protein, 104 aa, Diabrotica virgifera
  misc_feature: Coding regions on vcDNA: vcDNA=SeqID_4167; Strand=+; Position=1-315
  misc_feature: Homolog annotation: Hit_ID=XP_313345.1; Match level="QueryCoverage =88%, HitCoverage=70%, E-value=1e-29, Identity=60%"; Hit description =ENSANGP00000024515 [Anopheles gambiae]
  misc_feature: Pfam annotation: Pfam_ID=ATP_synt_H; Match level="Score=136.9, E -value=4.7e-38, Copies=1"; Pfam description=ATP synthase subunit H
THELFYTYTLQKLIYKLKMGASVIPFIVFTVLWGGVGAVLPIFVPKGPNRGIIQVILMITGVSCWLFWLCCYVAQMNPLIGPKLEQNIVLIMAKQWKYALPSSA

SEQ ID NO: 24471 - protein, 52 aa, Diabrotica virgifera
  misc_feature: Coding regions on vcDNA: vcDNA=SeqID_4168; Strand=-; Position=43-201
YITLLMMIPLIMAPSGRSLREALITYSAYTLHNRWNKMQKCFDALLVLCLCN

SEQ ID NO: 24472 - protein, 51 aa, Diabrotica virgifera
  misc_feature: Coding regions on vcDNA: vcDNA=SeqID_4169; Strand=+; Position=3-155
HATTLSRIKHNGMVSTTTHHSFDVVIVLATRERIFDFYQVKIYSLDREWQG

SEQ ID NO: 24473 - protein, 74 aa, Diabrotica virgifera
  misc_feature: Coding regions on vcDNA: vcDNA=SeqID_4170; Strand=-; Position=26-250
QEPVQIIIFIPYGTQPISVYIANNCFWTTVGNTNARYTLQGFIIAMYSGSKCRKGGHEPLTVYIVHILWDYFRI

SEQ ID NO: 24474 - protein, 85 aa, Diabrotica virgifera
  misc_feature: Coding regions on vcDNA: vcDNA=SeqID_4171; Strand=+; Position=52-306
  misc_feature: Homolog annotation: Hit_ID=NP_731021.1; Match level="QueryCoverage =92%, HitCoverage=16%, E-value=4e-11, Identity=49%"; Hit description =CG1213-PC, isoform C [Drosophila melanogaster] ref|NP_731020.1| CG1213-PB, isoform B [Drosophila
  misc_feature (64)..(64): Xaa can be any naturally occurring amino acid
MGAYLVAFCGNLLALTGDTTLTWSSPILTKLDSNDTDINPLGRKITLDEISWIGSLQYIGAMVXILPFAVLADVIGRKPVLLLLA

SEQ ID NO: 24475 - protein, 53 aa, Diabrotica virgifera
  misc_feature: Coding regions on vcDNA: vcDNA=SeqID_4172; Strand=-; Position=10-171
  misc_feature (42)..(51): Xaa can be any naturally occurring amino acid
TLFFTSIVCIKSLDVNLTDFSSMQMNENLQTYAFGGTIDEWXXXXXXXXXXFN

SEQ ID NO: 24476 - protein, 111 aa, Diabrotica virgifera
  misc_feature: Coding regions on vcDNA: vcDNA=SeqID_4173; Strand=+; Position=2-334
  misc_feature (3)..(15): Xaa can be any naturally occurring amino acid
  misc_feature (18)..(24): Xaa can be any naturally occurring amino acid
  misc_feature (27)..(37): Xaa can be any naturally occurring amino acid
  misc_feature (45)..(76): Xaa can be any naturally occurring amino acid
  misc_feature (83)..(96): Xaa can be any naturally occurring amino acid
VLXXXXXXXXXXXXXALXXXXXXXLGXXXXXXXXXXXHNKSYSLXXXXXXXXXXXXXXXXXXXXXXXXXXXXXXXXLAVNQFXXXXXXXXXXXXXXQIINRPELSFIETYE

SEQ ID NO: 24477 - protein, 81 aa, Diabrotica virgifera
  misc_feature: Coding regions on vcDNA: vcDNA=SeqID_4174; Strand=+; Position=51-294
  misc_feature: Homolog annotation: Hit_ID=EAL25466.1; Match level="QueryCoverage =97%, HitCoverage=47%, E-value=8e-19, Identity=60%"; Hit description =GA16582-PA [Drosophila pseudoobscura]
  misc_feature: Gene Ontology Annotation: Molecular function=structural constituent of ribosome; Cellular component=cytosolic large ribosomal subunit (sensu Eukarya)
  misc_feature: Pfam annotation: Pfam_ID=Ribosomal_L11_N; Match level="Score=10.7, E -value=0.0055, Copies=1"; Pfam description=Ribosomal protein L11, N -terminal dom
  misc_feature (54)..(54): Xaa can be any naturally occurring amino acid
FTLPPKFAPTDIKYVYMRCVGRQLGATSSLAPTIGPLRLLSSPSCDYPVSCTSXWEGLTFTVHLKIHNRQPTISVLPSASS

SEQ ID NO: 24478 - protein, 118 aa, Diabrotica virgifera
  misc_feature: Coding regions on vcDNA: vcDNA=SeqID_4175; Strand=+; Position=3-356
SLFSLTVTVFNLSSFYTSTFVLHPPFLFLLALLAVFFSESVKYQVLLPRSHLVYCLPLSLFLLPFVICPHCFFSSITRLSHTMIIIKFFILSDSFRFTTPGKRRTANAPSWTKTNAPL

SEQ ID NO: 24479 - protein, 54 aa, Diabrotica virgifera
  misc_feature: Coding regions on vcDNA: vcDNA=SeqID_4176; Strand=+; Position=3-167
WWEPLQNLRENNMQILVFKYRSVVCDLKLNYIYFRIQYFVECLFFQLLQKLSYN

SEQ ID NO: 24480 - protein, 64 aa, Diabrotica virgifera
  misc_feature: Coding regions on vcDNA: vcDNA=SeqID_4177; Strand=+; Position=3-197
VGHASTKSYLIHEHPYTVFDSPIRYLIWALHHLIKRDTSMIVSLYVFSAEFPTSTTFNSVCLTT

SEQ ID NO: 24481 - protein, 108 aa, Diabrotica virgifera
  misc_feature: Coding regions on vcDNA: vcDNA=SeqID_4178; Strand=+; Position=1-324
  misc_feature: Homolog annotation: Hit_ID=XP_320610.1; Match level="QueryCoverage =92%, HitCoverage=14%, E-value=6e-22, Identity=45%"; Hit description =ENSANGP00000015344 [Anopheles gambiae]
THASGLLFRILFMSGTQKFINGDPVWWNLKGISRVYEVLPLPTPLSWYAYALPEWQLKLTQVFVNVAEIILPFLFFVPIRCARHFAFLAQLFLQICVIVTGNFGFANI

SEQ ID NO: 24482 - protein, 114 aa, Diabrotica virgifera
  misc_feature: Coding regions on vcDNA: vcDNA=SeqID_4179; Strand=+; Position=65-406
  misc_feature: Homolog annotation: Hit_ID=EAA14894.3; Match level="QueryCoverage =92%, HitCoverage=41%, E-value=8e-35, Identity=63%"; Hit description =ENSANGP00000013879 [Anopheles gambiae str. PEST] ref|XP_552744.1| ENSANGP00000013879 [Anopheles gambiae st
  misc_feature: Pfam annotation: Pfam_ID=ATP12; Match level="Score=118.6, E-value =1.5e-32, Copies=1"; Pfam description=ATP12 chaperone protein
PTPNCFCLATPPKRFYKNTGILRSDGKFEITLDQRKLKTPKGNIFAVESEALALAVATEWNSQKDKIIRSKMHLTTLCNTTMDNPNNLTKYDIANYIVNYLDTDTVLFQANEDE

SEQ ID NO: 24483 - protein, 130 aa, Diabrotica virgifera
  misc_feature: Coding regions on vcDNA: vcDNA=SeqID_4180; Strand=-; Position=2-391
  misc_feature: Homolog annotation: Hit_ID=AAF78901.1; Match level="QueryCoverage =92%, HitCoverage=23%, E-value=2e-33, Identity=57%"; Hit description =putative adenosine deaminase [Lutzomyia longipalpis]
  misc_feature: Gene Ontology Annotation: Cellular component=integral to membrane; Biological process=spermatogenesis
NKVWKTFQAIFKSINGQPLTAFVPQLIELKNLGAKFFFHAGETNWYGETDLNLFDAILLNSTRIGHGYSILKHPLLAKYVKEQQIALEICPISNQVLKLVTDLRNHPGNLLIANGFPVVIASDDPSSDAW

SEQ ID NO: 24484 - protein, 110 aa, Diabrotica virgifera
  misc_feature: Coding regions on vcDNA: vcDNA=SeqID_4181; Strand=+; Position=103-432
EKKRPIWPQLGINTQNCDLWRYQIAEIHICGEITTKFGTPLPILGRGVIILTEMGGNGKNGEKLIGGNKIGRIATTDHPKTLFQCGINYRNLSNALQLGKTEKKGAPPGN

SEQ ID NO: 24485 - protein, 49 aa, Diabrotica virgifera
  misc_feature: Coding regions on vcDNA: vcDNA=SeqID_4182; Strand=-; Position=97-246
VFHLPFKLGKCLERPNVRGFLVLNPVGKRGYSGMGFSWNKPWVFPFRNY

SEQ ID NO: 24486 - protein, 62 aa, Diabrotica virgifera
  misc_feature: Coding regions on vcDNA: vcDNA=SeqID_4183; Strand=-; Position=1-186
EFDLHRDHQITFVMFQKLSLNPFYLNQDFNIIANNQINIFTDIKIKDKGCIQQTQSPSNRLV

SEQ ID NO: 24487 - protein, 50 aa, Diabrotica virgifera
  misc_feature: Coding regions on vcDNA: vcDNA=SeqID_4184; Strand=-; Position=32-184
EQSQHFPLDIIQMSLCKEFIPTSSKMKTQTKLEQRSTHQITQQTINYLYL

SEQ ID NO: 24488 - protein, 95 aa, Diabrotica virgifera
  misc_feature: Coding regions on vcDNA: vcDNA=SeqID_4185; Strand=+; Position=1-285
LVASWGRWGLAEPLVDTYIWWQLPANISVFVCGSALRWSTPVLPRLENLAACPLDHVTSTSEDGLIASCLQLAVVFRPVVCGILGELNWHGADTT

SEQ ID NO: 24489 - protein, 125 aa, Diabrotica virgifera
  misc_feature: Coding regions on vcDNA: vcDNA=SeqID_4186; Strand=+; Position=3-377
  misc_feature: Homolog annotation: Hit_ID=XP_310184.1; Match level="QueryCoverage =97%, HitCoverage=4%, E-value=7e-49, Identity=76%"; Hit description =ENSANGP00000005472 [Anopheles gambiae]
  misc_feature: Gene Ontology Annotation: Molecular function=ligand-dependent thyroid hormone receptor interactor activity; Cellular component=cellular _component unknown; Biological process=embryogenesis and morphogenesis
HASAQRDVTMERQRTPGLSPRRDDPHEFRVGRLKHERVKVPRGEQLLEWAMQVMKIHAARKSILEVEFAEEEGTGLGPTLEFYALVAAELQRRDLGMWICDDEAISLNEPVDLGEGMKPPGYYVR

SEQ ID NO: 24490 - protein, 129 aa, Diabrotica virgifera
  misc_feature: Coding regions on vcDNA: vcDNA=SeqID_4187; Strand=+; Position=1-387
TQKKYVENKNSIRRVSSSEDFQSQRASSVERVASSTAKKGSDKLLTYDDCEHEKRRSHERFARPLATKGKKHPTKRLKVKCIPRPKYKPELSFDTRDQHKKLQLTHGGFLAEHDSSRTGFLKLHIEEGN

SEQ ID NO: 24491 - protein, 91 aa, Diabrotica virgifera
  misc_feature: Coding regions on vcDNA: vcDNA=SeqID_4188; Strand=+; Position=43-318
YQQRFPISHEIGTVQLMHIFLIQLFIVISSAKYGSIIFPYNKYFMFFFNWRLPLFQSFFFFHSYSFILMFFMVIGTAFTIHPLTSHTLCKQ

SEQ ID NO: 24492 - protein, 70 aa, Diabrotica virgifera
  misc_feature: Coding regions on vcDNA: vcDNA=SeqID_4189; Strand=+; Position=103-315
  misc_feature (11)..(18): Xaa can be any naturally occurring amino acid
RFDFHFGNCSXXXXXXXXQLILDFQHYHYNQWWLNPIKNIIVKHAKKKPLQNIFMSITSYYSGHVPDFSS

SEQ ID NO: 24493 - protein, 76 aa, Diabrotica virgifera
  misc_feature: Coding regions on vcDNA: vcDNA=SeqID_4190; Strand=+; Position=3-233
  misc_feature (32)..(56): Xaa can be any naturally occurring amino acid
  misc_feature (58)..(69): Xaa can be any naturally occurring amino acid
LVQQGNAKSTILNSPHNDIHCSIIKTNCITLXXXXXXXXXXXXXXXXXXXXXXXXXGXXXXXXXXXXXXITVFMTC

SEQ ID NO: 24494 - protein, 128 aa, Diabrotica virgifera
  misc_feature: Coding regions on vcDNA: vcDNA=SeqID_4191; Strand=+; Position=3-386
  misc_feature (2)..(9): Xaa can be any naturally occurring amino acid
DXXXXXXXXRTIITQLDAEHQAEHVSRLGIIGALIGVGAALLSGHLMELSNGFSYLDSISILNSILGLGFVKLLTVIHPSNKEESELSQPVLEEITTALINLKTYSTSTTYSHIFLPKALTAISYGIP

SEQ ID NO: 24495 - protein, 130 aa, Diabrotica virgifera
  misc_feature: Coding regions on vcDNA: vcDNA=SeqID_4192; Strand=+; Position=17-406
  misc_feature: Homolog annotation: Hit_ID=NP_733310.1; Match level="QueryCoverage =93%, HitCoverage=93%, E-value=4e-17, Identity=36%"; Hit description =CG7829-PB, isoform B [Drosophila melanogaster] gb|AAN14189.1| CG7829- PB, isoform B [Drosophila
  misc_feature: Gene Ontology Annotation: Molecular function=complement factor D activity; Cellular component=integral to membrane; Biological process=proteolysis and peptidolysis
MRVTVLIACIVLIANQCESAVLGNNYRIVGGNDTTIEQHPWIVSIQFLRVHFCGGALVDEETVITAAHCFNDVSGRITILAGTADLTQEGTSIKVKSILIHENYNPDVGSLDHDIAILKLSEKITFSDKI

SEQ ID NO: 24496 - protein, 39 aa, Diabrotica virgifera
  misc_feature: Coding regions on vcDNA: vcDNA=SeqID_4193; Strand=+; Position=162-281
YGVFKRKFIFYVINTCGNHFIDIFCGLTDNVNILIPKCL

SEQ ID NO: 24497 - protein, 35 aa, Diabrotica virgifera
  misc_feature: Coding regions on vcDNA: vcDNA=SeqID_4194; Strand=-; Position=2-106
QTTEGTCHCAKVLPAMPREFSNKEIDLIRLDLDSC

SEQ ID NO: 24498 - protein, 25 aa, Diabrotica virgifera
  misc_feature: Coding regions on vcDNA: vcDNA=SeqID_4195; Strand=+; Position=3-77
FLKYISLFLHIIQHVCNIIFKINPL

SEQ ID NO: 24499 - protein, 38 aa, Diabrotica virgifera
  misc_feature: Coding regions on vcDNA: vcDNA=SeqID_4196; Strand=+; Position=123-236
  misc_feature (12)..(12): Xaa can be any naturally occurring amino acid
PVEGTIQLPYAXVVEPFHAWYDGYSNGTRIDYYHGTSW

SEQ ID NO: 24500 - protein, 48 aa, Diabrotica virgifera
  misc_feature: Coding regions on vcDNA: vcDNA=SeqID_4197; Strand=+; Position=1-147
ISCKQLLGFNISEFRQIKCPMRYIDQDLLWFRTVLDPSRQSFRSSTIG

SEQ ID NO: 24501 - protein, 64 aa, Diabrotica virgifera
  misc_feature: Coding regions on vcDNA: vcDNA=SeqID_4198; Strand=-; Position=16-210
  misc_feature: Homolog annotation: Hit_ID=CAE47502.1; Match level="QueryCoverage =93%, HitCoverage=18%, E-value=3e-22, Identity=81%"; Hit description =cathepsin B-like proteinase [Diabrotica virgifera virgifera]
  misc_feature: Gene Ontology Annotation: Molecular function=peroxidase activity; Cellular component=extracellular space; Biological process=protein targeting
SQKEILTNGPVEPAFDVYSDFMNYKGSVYKHVAGEYLGRHAVRILGWGQEGGVRYGLVSNSSKV

SEQ ID NO: 24502 - protein, 114 aa, Diabrotica virgifera
  misc_feature: Coding regions on vcDNA: vcDNA=SeqID_4199; Strand=+; Position=2-343
  misc_feature: Homolog annotation: Hit_ID=CAA76931.1; Match level="QueryCoverage =99%, HitCoverage=45%, E-value=2e-20, Identity=43%"; Hit description =endoglucanase [Phaedon cochleariae]
  misc_feature: Pfam annotation: Pfam_ID=Glyco_hydro_45; Match level="Score=-18.6, E -value=9.3e-07, Copies=1"; Pfam description=Glycosyl hydrolase family 45
  misc_feature (111)..(111): Xaa can be any naturally occurring amino acid
GNVEYKKPVKACQADGENANDPENESGCIGGQSYICTKQSGFAINSTLAYGYVAARFHGTTRNMCCSCVLFSFQPQELANKKMLVQVTNTGNAPETNTNLFDIAMPGSGVXYYT

SEQ ID NO: 24503 - protein, 66 aa, Diabrotica virgifera
  misc_feature: Coding regions on vcDNA: vcDNA=SeqID_4200; Strand=+; Position=197-394
MGLLLYTLGSLTLLAILWTVSSVARYVLKFACFGVLCMIFACAPIPLMLLNPRNSKNALIPSALLR

SEQ ID NO: 24504 - protein, 85 aa, Diabrotica virgifera
  misc_feature: Coding regions on vcDNA: vcDNA=SeqID_4201; Strand=+; Position=3-257
  misc_feature (2)..(14): Xaa can be any naturally occurring amino acid
  misc_feature (20)..(31): Xaa can be any naturally occurring amino acid
  misc_feature (36)..(54): Xaa can be any naturally occurring amino acid
  misc_feature (64)..(85): Xaa can be any naturally occurring amino acid
RXXXXXXXXXXXXXTLGNQXXXXXXXXXXXXEFKNXXXXXXXXXXXXXXXXXXXKCYSFLNISXXXXXXXXXXXXXXXXXXXXXX

SEQ ID NO: 24505 - protein, 63 aa, Diabrotica virgifera
  misc_feature: Coding regions on vcDNA: vcDNA=SeqID_4202; Strand=-; Position=160-351
  misc_feature (5)..(38): Xaa can be any naturally occurring amino acid
LLGGXXXXXXXXXXXXXXXXXXXXXXXXXXXXXXXXXXMSLNHTNCLISFHLTLSTHLKLKWK

SEQ ID NO: 24506 - protein, 76 aa, Diabrotica virgifera
  misc_feature: Coding regions on vcDNA: vcDNA=SeqID_4203; Strand=-; Position=156-386
GFDGSHFIMSQHPSLSLHRRPLHHHHDQHIFIHHPLHLRLVRPCNPDLQWHRLTPHLNHHSLNMHHTFKIRFFGVF

SEQ ID NO: 24507 - protein, 48 aa, Diabrotica virgifera
  misc_feature: Coding regions on vcDNA: vcDNA=SeqID_4204; Strand=+; Position=142-288
KLNTYKRYIGITIGIQRPDIHMSMYNMSVCHKYLDTYRRTVKLNRRRS

SEQ ID NO: 24508 - protein, 90 aa, Diabrotica virgifera
  misc_feature: Coding regions on vcDNA: vcDNA=SeqID_4205; Strand=+; Position=118-387
CLACRRARPPGFRPSRGLKTAGPPLCSRLRLPGAPPSRRPRRPGPLPSIRPRPSCPPSSRCPRPPGPPSSRRLRPLGPPPVRRLRPPGPP

SEQ ID NO: 24509 - protein, 52 aa, Diabrotica virgifera
  misc_feature: Coding regions on vcDNA: vcDNA=SeqID_4206; Strand=+; Position=151-309
  misc_feature (5)..(11): Xaa can be any naturally occurring amino acid
CTVTXXXXXXXFYALSYIYLLPIYLPLSIFIFLLSSMFRDELNNKPLLKFTF

SEQ ID NO: 24510 - protein, 91 aa, Diabrotica virgifera
  misc_feature: Coding regions on vcDNA: vcDNA=SeqID_4207; Strand=+; Position=1-276
  misc_feature: Homolog annotation: Hit_ID=BAB88642.1; Match level="QueryCoverage =96%, HitCoverage=29%, E-value=6e-16, Identity=48%"; Hit description =NADH dehydrogenase subunit 5 [Leptura aethiops]
  misc_feature (14)..(14): Xaa can be any naturally occurring amino acid
  misc_feature (26)..(33): Xaa can be any naturally occurring amino acid
  misc_feature (42)..(42): Xaa can be any naturally occurring amino acid
  misc_feature (64)..(70): Xaa can be any naturally occurring amino acid
  misc_feature (72)..(72): Xaa can be any naturally occurring amino acid
  misc_feature (90)..(90): Xaa can be any naturally occurring amino acid
LILFVVFSGRLFSXLVFSTPIFICLXXXXXXXXLIFIIVGVXLGYELAKFKISYNLLRLNNISXXXXXXXIXNIPFLSTLGINYYPIYFXG

SEQ ID NO: 24511 - protein, 49 aa, Diabrotica virgifera
  misc_feature: Coding regions on vcDNA: vcDNA=SeqID_4208; Strand=-; Position=1-147
  misc_feature (4)..(15): Xaa can be any naturally occurring amino acid
GQIXXXXXXXXXXXXHDTQGTKYEQFFLNYPCFLAIIKKISVNETFARF

SEQ ID NO: 24512 - protein, 135 aa, Diabrotica virgifera
  misc_feature: Coding regions on vcDNA: vcDNA=SeqID_4209; Strand=+; Position=3-407
  misc_feature: Homolog annotation: Hit_ID=AAQ16117.1; Match level="QueryCoverage =100%, HitCoverage=39%, E-value=1e-40, Identity=56%"; Hit description= cathepsin L-like cysteine proteinase A [Rhipicephalus haemaphysaloides haemaphysaloides]
  misc_feature: Gene Ontology Annotation: Molecular function=cysteine-type peptidase activity; Cellular component=extracellular space; Biological process= protein catabolism
  misc_feature: Pfam annotation: Pfam_ID=Peptidase_C1; Match level="Score=48.2, E -value=3.4e-14, Copies=1"; Pfam description=Papain family cysteine protease
GVDSDQSYPYEGVNGQCRFRREDVVATCTGFVDIGENDEKGLEIALATLGPVTAAIDAGKETFQFYSEGIYDDPACGNTPEQMNHAVLIVGYGQEADGRKYWLVKNSYGPNWGIGGYVKMAKENNNQCGIAIQAS

SEQ ID NO: 24513 - protein, 29 aa, Diabrotica virgifera
  misc_feature: Coding regions on vcDNA: vcDNA=SeqID_4210; Strand=-; Position=1-87
  misc_feature (6)..(29): Xaa can be any naturally occurring amino acid
LRIRPXXXXXXXXXXXXXXXXXXXXXXXX

SEQ ID NO: 24514 - protein, 60 aa, Diabrotica virgifera
  misc_feature: Coding regions on vcDNA: vcDNA=SeqID_4211; Strand=+; Position=123-302
  misc_feature (39)..(39): Xaa can be any naturally occurring amino acid
IQKAKRGGRPKGSNLTNPGRQRQSPPKGPPKSNPRAAVXKRRNGETPGVTHLNRLAADPP

SEQ ID NO: 24515 - protein, 97 aa, Diabrotica virgifera
  misc_feature: Coding regions on vcDNA: vcDNA=SeqID_4212; Strand=+; Position=91-381
  misc_feature (46)..(54): Xaa can be any naturally occurring amino acid
  misc_feature (94)..(94): Xaa can be any naturally occurring amino acid
RHENDGVGAHLSVLSDCLLHIAEDMHTVFCVPASIYLLLIITPYTXXXXXXXXXLVMDPNQTCKRARWARGKMADICHNKPGLLNQIAKGIALXQTE

SEQ ID NO: 24516 - protein, 106 aa, Diabrotica virgifera
  misc_feature: Coding regions on vcDNA: vcDNA=SeqID_4213; Strand=-; Position=2-319
LFIAHLSFWLCVLPISILVWLSFDDVSHLCSSPDLFVFDYVSQSYSQMDHSILLCVTLSLVAEANKTGRTHGSNTFLFRHVSNSLLKFLSIFHMLPPPKDRFFSSF

SEQ ID NO: 24517 - protein, 98 aa, Diabrotica virgifera
  misc_feature: Coding regions on vcDNA: vcDNA=SeqID_4214; Strand=-; Position=2-295
  misc_feature (5)..(17): Xaa can be any naturally occurring amino acid
  misc_feature (82)..(97): Xaa can be any naturally occurring amino acid
KKFRXXXXXXXXXXXXXRPVFFHPNPYSRVPLKKLWFWVPWKGQIPGAVQFIRWPGGIFFLLQKALFLKTGGKNFSGFPFLXXXXXXXXXXXXXXXXH

SEQ ID NO: 24518 - protein, 44 aa, Diabrotica virgifera
  misc_feature: Coding regions on vcDNA: vcDNA=SeqID_4215; Strand=+; Position=224-358
  misc_feature (40)..(40): Xaa can be any naturally occurring amino acid
LQYLLINYTFDGLLLRENGSSPQAQYNTHKFTLVAQQFIXTIDG

SEQ ID NO: 24519 - protein, 133 aa, Diabrotica virgifera
  misc_feature: Coding regions on vcDNA: vcDNA=SeqID_4216; Strand=+; Position=1-399
GLSLIEVMHKSIVYFYLVLKLSFFISLYVKSVHCIINICCRISIANDTNEKFVPVLLKTGPAGFDLAISQNNTIKLKRGEHIAFYCPKKNYLRITNTSVEHGRCLTGNSLSIKGNRFDFSYILCKNHVVGELQ

SEQ ID NO: 24520 - protein, 65 aa, Diabrotica virgifera
  misc_feature: Coding regions on vcDNA: vcDNA=SeqID_4217; Strand=+; Position=165-359
  misc_feature (11)..(21): Xaa can be any naturally occurring amino acid
  misc_feature (23)..(58): Xaa can be any naturally occurring amino acid
QYVISYFYILXXXXXXXXXXXYXXXXXXXXXXXXXXXXXXXXXXXXXXXXXXXXXXXXTCLVKTC

SEQ ID NO: 24521 - protein, 94 aa, Diabrotica virgifera
  misc_feature: Coding regions on vcDNA: vcDNA=SeqID_4218; Strand=+; Position=122-403
METDTLQTATPAEAEIPAEILAVIKAAVEQTLVSLMEKHLGKRKHCRSRSRSKSRNRSSSRSRGGRSRSKSKGRYDRSKSRGRRDRSRSRGRHD

SEQ ID NO: 24522 - protein, 105 aa, Diabrotica virgifera
  misc_feature: Coding regions on vcDNA: vcDNA=SeqID_4219; Strand=+; Position=2-318
  misc_feature: Homolog annotation: Hit_ID=AAM47598.1; Match level="QueryCoverage =97%, HitCoverage=86%, E-value=1e-17, Identity=45%"; Hit description =NBS/LRR resistance protein-like protein [Capsicum annuum]
  misc_feature (21)..(21): Xaa can be any naturally occurring amino acid
  misc_feature (41)..(41): Xaa can be any naturally occurring amino acid
  misc_feature (82)..(82): Xaa can be any naturally occurring amino acid
AKLQGSIPWCLMYADDIVLIXNRVRDLKQILEQWRQALEEXGLRLSKTKTEYLECSFIDGLTTYNMESLDGEMIVKSISTYXSVLQSNGEIYGDACSRIMAGWMK

SEQ ID NO: 24523 - protein, 74 aa, Diabrotica virgifera
  misc_feature: Coding regions on vcDNA: vcDNA=SeqID_4220; Strand=-; Position=4-228
  misc_feature (37)..(71): Xaa can be any naturally occurring amino acid
IQKTVSGLHFSCSKEAVLMNLARTSKAETRRDPPHSXXXXXXXXXXXXXXXXXXXXXXXXXXXXXXXXXXXKVK

SEQ ID NO: 24524 - protein, 36 aa, Diabrotica virgifera
  misc_feature: Coding regions on vcDNA: vcDNA=SeqID_4221; Strand=-; Position=167-277
  misc_feature (13)..(26): Xaa can be any naturally occurring amino acid
YLETNDISIQKSXXXXXXXXXXXXXXPLLNSQILTI

SEQ ID NO: 24525 - protein, 100 aa, Diabrotica virgifera
  misc_feature: Coding regions on vcDNA: vcDNA=SeqID_4222; Strand=+; Position=101-400
NPCRIFVKYKTHTITFKMIVGSLFLILLATVHFGNSYVCRPCEEKTVCEPLSCREGQKPVPKWSCNCCDTCLTVLKEGDNCSGNPFLGVPSQVVCDTGLI

SEQ ID NO: 24526 - protein, 75 aa, Diabrotica virgifera
  misc_feature: Coding regions on vcDNA: vcDNA=SeqID_4223; Strand=+; Position=2-228
  misc_feature: Homolog annotation: Hit_ID=XP_396307.1; Match level="QueryCoverage =98%, HitCoverage=3%, E-value=5e-18, Identity=59%"; Hit description =similar to CG31190-PB [Apis mellifera]
  misc_feature (26)..(26): Xaa can be any naturally occurring amino acid
  misc_feature (59)..(59): Xaa can be any naturally occurring amino acid
  misc_feature (65)..(65): Xaa can be any naturally occurring amino acid
AVKPGLAFEFHFFRWLKSLILICMGXRVEAYEQISVTPVHPGLGVTSSQLNEDSEHFSXRRRYHXSATVHGHLVN

SEQ ID NO: 24527 - protein, 45 aa, Diabrotica virgifera
  misc_feature: Coding regions on vcDNA: vcDNA=SeqID_4224; Strand=-; Position=12-149
  misc_feature (7)..(21): Xaa can be any naturally occurring amino acid
  misc_feature (32)..(42): Xaa can be any naturally occurring amino acid
NFNSKLXXXXXXXXXXXXXXXINVSIHNTLIXXXXXXXXXXXLYL

SEQ ID NO: 24528 - protein, 22 aa, Diabrotica virgifera
  misc_feature: Coding regions on vcDNA: vcDNA=SeqID_4225; Strand=-; Position=0-65
  misc_feature (2)..(21): Xaa can be any naturally occurring amino acid
MXXXXXXXXXXXXXXXXXXXXL

SEQ ID NO: 24529 - protein, 47 aa, Diabrotica virgifera
  misc_feature: Coding regions on vcDNA: vcDNA=SeqID_4226; Strand=+; Position=73-216
SALILHFYLHQIYLLYIGCQGLLCRKSFIQSIKFLRATKLGFLWVAK

SEQ ID NO: 24530 - protein, 40 aa, Diabrotica virgifera
  misc_feature: Coding regions on vcDNA: vcDNA=SeqID_4227; Strand=+; Position=3-125
PRVRVASQKNHSIYFFYCEIYSQFYTYSTRVKVKSLIVYS

SEQ ID NO: 24531 - protein, 19 aa, Diabrotica virgifera
  misc_feature: Coding regions on vcDNA: vcDNA=SeqID_4228; Strand=-; Position=8-67
IKIIAKLHCFKVHKFVYQI

SEQ ID NO: 24532 - protein, 63 aa, Diabrotica virgifera
  misc_feature: Coding regions on vcDNA: vcDNA=SeqID_4229; Strand=-; Position=121-312
  misc_feature (1)..(5): Xaa can be any naturally occurring amino acid
  misc_feature (7)..(21): Xaa can be any naturally occurring amino acid
  misc_feature (23)..(44): Xaa can be any naturally occurring amino acid
  misc_feature (48)..(54): Xaa can be any naturally occurring amino acid
XXXXXSXXXXXXXXXXXXXXXLXXXXXXXXXXXXXXXXXXXXXXHKEXXXXXXXLPLTRTFII

SEQ ID NO: 24533 - protein, 73 aa, Diabrotica virgifera
  misc_feature: Coding regions on vcDNA: vcDNA=SeqID_4230; Strand=-; Position=0-218
  misc_feature (24)..(29): Xaa can be any naturally occurring amino acid
KSVVEVHEKSKISPGCNRLKLQLXXXXXXLKYLIKGNVDAMKAMTSFRQYKVLLTHYIIRVISGNITTHSRRV

SEQ ID NO: 24534 - protein, 106 aa, Diabrotica virgifera
  misc_feature: Coding regions on vcDNA: vcDNA=SeqID_4231; Strand=+; Position=1-321
  misc_feature: Homolog annotation: Hit_ID=XP_421203.1; Match level="QueryCoverage =93%, HitCoverage=5%, E-value=5e-13, Identity=38%"; Hit description =PREDICTED: similar to GCN2 eIF2alpha kinase [Gallus gallus]
LTKLRNKDIIFPPDFSEKNTGKQELLIRWLLDHDISQRLMSQGLLSTLNIPPPVLQECEILEIFRHTFYNPHLKRCKYLITSCFKQSVSHVQHITYDKDPSAQNVV

SEQ ID NO: 24535 - protein, 64 aa, Diabrotica virgifera
  misc_feature: Coding regions on vcDNA: vcDNA=SeqID_4232; Strand=+; Position=128-322
YNYIIMKTLDSLKFRATTLDAARTIVLLMGRTQLIQSQLPDAQNAYAPNRIRPYSNTHPLTYIN

SEQ ID NO: 24536 - protein, 64 aa, Diabrotica virgifera
  misc_feature: Coding regions on vcDNA: vcDNA=SeqID_4233; Strand=+; Position=78-269
  misc_feature (9)..(15): Xaa can be any naturally occurring amino acid
  misc_feature (33)..(39): Xaa can be any naturally occurring amino acid
LTILVRQYXXXXXXXLILCTLCTRDYQLIIRNXXXXXXXELNILSFYCRIHNLTNFFVLQCQSF

SEQ ID NO: 24537 - protein, 132 aa, Diabrotica virgifera
  misc_feature: Coding regions on vcDNA: vcDNA=SeqID_4234; Strand=+; Position=3-398
  misc_feature: Homolog annotation: Hit_ID=XP_308803.1; Match level="QueryCoverage =87%, HitCoverage=57%, E-value=2e-29, Identity=56%"; Hit description =ENSANGP00000021844 [Anopheles gambiae]
LGNLKNYGIGRIIVRSKLERYPEKSYMKVLKVETLPNPENPSMDNTRKIKVWVEDTFRGKTFPEPVLIEGISYKTDYRLLPKDEEEAYCKTSEYKYQKILPKTMDFPPLLKEIIKRIAKSKGENVTEDNQTS

SEQ ID NO: 24538 - protein, 54 aa, Diabrotica virgifera
  misc_feature: Coding regions on vcDNA: vcDNA=SeqID_4235; Strand=-; Position=1-162
NFSAPSRVAIVRSGSSASRCCLKSTEFIPRDTVTYIVDRDALPPHAPLLVLLLA

SEQ ID NO: 24539 - protein, 64 aa, Diabrotica virgifera
  misc_feature: Coding regions on vcDNA: vcDNA=SeqID_4236; Strand=+; Position=53-247
  misc_feature (32)..(38): Xaa can be any naturally occurring amino acid
GAFKTMLKDTLSAGSFIANLKRLWRLLKTIYXXXXXXXPVYFYTGQQIFTCVMIGRYVFVTIKY

SEQ ID NO: 24540 - protein, 76 aa, Diabrotica virgifera
  misc_feature: Coding regions on vcDNA: vcDNA=SeqID_4237; Strand=+; Position=3-233
ERVGGHDGRSLEVQFSGFTLYSTHDSRFMSMKVFILFTFRSFGYDVRSAYRCSKLRRSTVNENFCSLKLKTYLDRP

SEQ ID NO: 24541 - protein, 81 aa, Diabrotica virgifera
  misc_feature: Coding regions on vcDNA: vcDNA=SeqID_4238; Strand=+; Position=78-323
NSCLPAICRIRTIVVHISPVAGTKKFSEREHKEAKIRSSVSANVDNVRTNHGERHFESPLFQKANQQRYLPTNKLAESSKG

SEQ ID NO: 24542 - protein, 105 aa, Diabrotica virgifera
  misc_feature: Coding regions on vcDNA: vcDNA=SeqID_4239; Strand=+; Position=92-406
  misc_feature: Homolog annotation: Hit_ID=CAB66612.1; Match level="QueryCoverage =72%, HitCoverage=17%, E-value=8e-19, Identity=60%"; Hit description =hypothetical protein [Homo sapiens] dbj|BAA91212.1| unnamed protein product [Homo sapiens]
  misc_feature (7)..(19): Xaa can be any naturally occurring amino acid
MEKKTLXXXXXXXXXXXXXHLLVSSGIPSLDTLLGGGIPVGTVVLIEEDFHGSYSKIVLKYFLAEGIVSNHSTLVASQDVNPSNIIKELPAVIDSDLEPERVLQS

SEQ ID NO: 24543 - protein, 44 aa, Diabrotica virgifera
  misc_feature: Coding regions on vcDNA: vcDNA=SeqID_4240; Strand=+; Position=52-186
RACFKNALNISILSGQSTLFFVINFSCRTIDIVLELAKWYIQLQ

SEQ ID NO: 24544 - protein, 88 aa, Diabrotica virgifera
  misc_feature: Coding regions on vcDNA: vcDNA=SeqID_4241; Strand=-; Position=1-264
  misc_feature (5)..(5): Xaa can be any naturally occurring amino acid
  misc_feature (10)..(27): Xaa can be any naturally occurring amino acid
  misc_feature (36)..(42): Xaa can be any naturally occurring amino acid
  misc_feature (55)..(70): Xaa can be any naturally occurring amino acid
  misc_feature (73)..(86): Xaa can be any naturally occurring amino acid
KMKYXMKKIXXXXXXXXXXXXXXXXXXKFHIYIIFXXXXXXXYKLKILVKLNYKXXXXXXXXXXXXXXXXLYXXXXXXXXXXXXXXIE

SEQ ID NO: 24545 - protein, 105 aa, Diabrotica virgifera
  misc_feature: Coding regions on vcDNA: vcDNA=SeqID_4242; Strand=+; Position=29-346
LIFIGTVYASETNSTNVDKCPNGALLPIVQVVSKEQLCIEPPCDVHAGSPAYITVNFTSPEYLPSMTPTYLVQALRLPIRYPVGKDACTSLNNTICPLVKDEFVS

SEQ ID NO: 24546 - protein, 80 aa, Diabrotica virgifera
  misc_feature: Coding regions on vcDNA: vcDNA=SeqID_4243; Strand=+; Position=2-244
SRNSTIWVSSYIHMHPSSSLCAYNSSRRQIQSYEHRWLKFMLISYGPPKHLSDTMLKDKLLYTAVCFSHRSRQPAYQFIH

SEQ ID NO: 24547 - protein, 134 aa, Diabrotica virgifera
  misc_feature: Coding regions on vcDNA: vcDNA=SeqID_4244; Strand=+; Position=2-403
  misc_feature: Homolog annotation: Hit_ID=CAE47500.1; Match level="QueryCoverage =100%, HitCoverage=41%, E-value=4e-69, Identity=91%"; Hit description= cathepsin L-like proteinase [Diabrotica virgifera virgifera]
  misc_feature: Gene Ontology Annotation: Molecular function=cathepsin K activity; Cellular component=lysosome; Biological process=proteolysis and peptidolysis
  misc_feature: Pfam annotation: Pfam_ID=Peptidase_C1; Match level="Score=86.0, E -value=9.8e-23, Copies=1"; Pfam description=Papain family cysteine protease
GCAGGYMDKALEYIEAAGGIMAENDYPYEGIDDKCRFDRSKVAAKISNFTYIKKNDEDDLKNAVVVKGPISVAIDASYNFQLYDSGILDDISCSSDFNYLNHGVLVVGYGTEKGHDYWIVKNSWGADWGMDGYI

SEQ ID NO: 24548 - protein, 31 aa, Diabrotica virgifera
  misc_feature: Coding regions on vcDNA: vcDNA=SeqID_4245; Strand=-; Position=8-103
RILPVVILVTIVSNETCLVKNMRQVLVRLNI

SEQ ID NO: 24549 - protein, 136 aa, Diabrotica virgifera
  misc_feature: Coding regions on vcDNA: vcDNA=SeqID_4246; Strand=+; Position=3-410
  misc_feature: Homolog annotation: Hit_ID=BAC42350.1; Match level="QueryCoverage =93%, HitCoverage=12%, E-value=6e-22, Identity=41%"; Hit description =unknown protein [Arabidopsis thaliana] ref|NP_172037.1| RNA helicase SDE3 (SDE3) [Arabidopsis thaliana]
  misc_feature: Gene Ontology Annotation: Molecular function=magnesium ion binding; Cellular component=intracellular; Biological process=germ-cell development
MVIKYIRALQALEFLDEEDKVKPSDIGIVTPYARQVYTLKALLKGNQIEGVDVGTTETFQGREKRIIIISTVRAQKDLLLYDKLYKLGFVKNEKRFNVALTRAMSKLIIIGCAQVLATDRKWLKYMDLCDTLSNFR

SEQ ID NO: 24550 - protein, 48 aa, Diabrotica virgifera
  misc_feature: Coding regions on vcDNA: vcDNA=SeqID_4247; Strand=+; Position=66-212
  misc_feature (6)..(14): Xaa can be any naturally occurring amino acid
VFRELXXXXXXXXXLKYHNLFCIYYIYINSKRHATRHMGRYLIAMLMG

SEQ ID NO: 24551 - protein, 41 aa, Diabrotica virgifera
  misc_feature: Coding regions on vcDNA: vcDNA=SeqID_4248; Strand=-; Position=161-286
RRSHSSAQKNCLKPISYDTIINRLVALNWKMIIISRQIEYA

SEQ ID NO: 24552 - protein, 60 aa, Diabrotica virgifera
  misc_feature: Coding regions on vcDNA: vcDNA=SeqID_4249; Strand=+; Position=233-415
  misc_feature (53)..(59): Xaa can be any naturally occurring amino acid
IHKYYLLLGWIILNTVNHNHKRVLIMLLFRSAYDVASLLKFPNIKIQVYGKQXXXXXXXG

SEQ ID NO: 24553 - protein, 38 aa, Diabrotica virgifera
  misc_feature: Coding regions on vcDNA: vcDNA=SeqID_4250; Strand=-; Position=3-116
YSYNQINWINIFLIKLLALISIKPYFNSPQYIKLVLLV

SEQ ID NO: 24554 - protein, 27 aa, Diabrotica virgifera
  misc_feature: Coding regions on vcDNA: vcDNA=SeqID_4251; Strand=-; Position=12-95
YMLTQHTINIITHITLTDQYSRLYDSL

SEQ ID NO: 24555 - protein, 88 aa, Diabrotica virgifera
  misc_feature: Coding regions on vcDNA: vcDNA=SeqID_4252; Strand=+; Position=165-428
  misc_feature (65)..(65): Xaa can be any naturally occurring amino acid
ILKFRNLKVENILLKINICKLSVAVTCYVSFLKSFKSSNRYLINLLVLILCFYVCIIISEFRSGXVIFFSSLGSYIAKIILQSHFSYT

SEQ ID NO: 24556 - protein, 64 aa, Diabrotica virgifera
  misc_feature: Coding regions on vcDNA: vcDNA=SeqID_4253; Strand=-; Position=93-287
TRRFFSTNDFVMNATVASIGDRGQPLSLLWNGTFNLHKNLEYSVALQNGSSVYALIIGSYSLSG

SEQ ID NO: 24557 - protein, 37 aa, Diabrotica virgifera
  misc_feature: Coding regions on vcDNA: vcDNA=SeqID_4254; Strand=+; Position=57-170
FQCIRHRDSKKEHSYRLNISCWYHSTSQAMTRMTCNG

SEQ ID NO: 24558 - protein, 67 aa, Diabrotica virgifera
  misc_feature: Coding regions on vcDNA: vcDNA=SeqID_4255; Strand=-; Position=76-279
KNSIEQKLLKISQFIHFLTFFGRIFFYPQNGVKTTPRAKAHIGTISLFFFDLLAMCMPNVMSIQAVL

SEQ ID NO: 24559 - protein, 70 aa, Diabrotica virgifera
  misc_feature: Coding regions on vcDNA: vcDNA=SeqID_4256; Strand=+; Position=176-385
SVLRNKTKVRKSESTFNFGILNCRPYRRRIPSRFKSAGSSKLTKVNSIISSSKSRSKISGVSDDLGRQYD

SEQ ID NO: 24560 - protein, 79 aa, Diabrotica virgifera
  misc_feature: Coding regions on vcDNA: vcDNA=SeqID_4257; Strand=+; Position=53-292
  misc_feature (7)..(14): Xaa can be any naturally occurring amino acid
  misc_feature (26)..(36): Xaa can be any naturally occurring amino acid
  misc_feature (49)..(58): Xaa can be any naturally occurring amino acid
LFINVMXXXXXXXXECIFCCLWCMEXXXXXXXXXXXSLLELVNYDFYCXXXXXXXXXXVMRCSSLIKSTFLRSNLSLIY

SEQ ID NO: 24561 - protein, 64 aa, Diabrotica virgifera
  misc_feature: Coding regions on vcDNA: vcDNA=SeqID_4258; Strand=-; Position=1-192
  misc_feature (43)..(62): Xaa can be any naturally occurring amino acid
KIKFKLKKLLIEIISLTLYVQQMVFKYIQGIAEYDNNFLYKNXXXXXXXXXXXXXXXXXXXXDC

SEQ ID NO: 24562 - protein, 62 aa, Diabrotica virgifera
  misc_feature: Coding regions on vcDNA: vcDNA=SeqID_4259; Strand=-; Position=38-226
  misc_feature (19)..(19): Xaa can be any naturally occurring amino acid
  misc_feature (22)..(22): Xaa can be any naturally occurring amino acid
  misc_feature (37)..(37): Xaa can be any naturally occurring amino acid
  misc_feature (53)..(59): Xaa can be any naturally occurring amino acid
GYLASEESQCCYTFFCLFXCIXSIIGIITLLKTNVIXVIYTGVECTSTGCTSXXXXXXXKIV

SEQ ID NO: 24563 - protein, 36 aa, Diabrotica virgifera
  misc_feature: Coding regions on vcDNA: vcDNA=SeqID_4260; Strand=-; Position=21-131
RRNHQLTKPQEIILDTHGTPTGALPPRNQICSHPIN

SEQ ID NO: 24564 - protein, 44 aa, Diabrotica virgifera
  misc_feature: Coding regions on vcDNA: vcDNA=SeqID_4261; Strand=-; Position=0-131
  misc_feature (6)..(15): Xaa can be any naturally occurring amino acid
NYLSLXXXXXXXXXXLSGILWLNFRFGFRIGQGVWISLSRMRRL

SEQ ID NO: 24565 - protein, 61 aa, Diabrotica virgifera
  misc_feature: Coding regions on vcDNA: vcDNA=SeqID_4262; Strand=+; Position=3-188
LMLLTIVSSIELSCLYYHNIIQCMYLEIDISTVYGPYVKLNDVRTDNSRSVTDSFKVTLLY

SEQ ID NO: 24566 - protein, 45 aa, Diabrotica virgifera
  misc_feature: Coding regions on vcDNA: vcDNA=SeqID_4263; Strand=+; Position=158-294
  misc_feature: Homolog annotation: Hit_ID=XP_396874.1; Match level="QueryCoverage =97%, HitCoverage=8%, E-value=7e-09, Identity=65%"; Hit description =similar to serine/threonine protein kinase Akt [Apis mellifera]
  misc_feature (21)..(21): Xaa can be any naturally occurring amino acid
DLCNKFSINGNSISTLTGKLXITLESFELIKVLGKGTFGKVILCI

SEQ ID NO: 24567 - protein, 91 aa, Diabrotica virgifera
  misc_feature: Coding regions on vcDNA: vcDNA=SeqID_4264; Strand=-; Position=90-365
  misc_feature (39)..(45): Xaa can be any naturally occurring amino acid
NSYCKIFSLRATAYVTKVSATAPGLIRIFNGLHIYNLFXXXXXXXIMYAISIYAYNIPTSMKFKLLQNCIHRKKYNVQLVPKKTDTTLSKI

SEQ ID NO: 24568 - protein, 63 aa, Diabrotica virgifera
  misc_feature: Coding regions on vcDNA: vcDNA=SeqID_4265; Strand=+; Position=66-257
  misc_feature (3)..(8): Xaa can be any naturally occurring amino acid
HDXXXXXXRYNLFIPKFTTQTLWFKILLINIMFYNINMFYFIYYKPRIAQIYLITIIFLSLRA

SEQ ID NO: 24569 - protein, 112 aa, Diabrotica virgifera
  misc_feature: Coding regions on vcDNA: vcDNA=SeqID_4266; Strand=+; Position=2-339
  misc_feature: Homolog annotation: Hit_ID=XP_397448.1; Match level="QueryCoverage =100%, HitCoverage=17%, E-value=9e-36, Identity=66%"; Hit description= similar to SR protein kinase 1 [Apis mellifera]
  misc_feature: Gene Ontology Annotation: Molecular function=ATP binding; Cellular component=cellular_component unknown; Biological process=protein amino acid phosphorylation
  misc_feature (30)..(30): Xaa can be any naturally occurring amino acid
  misc_feature (63)..(63): Xaa can be any naturally occurring amino acid
  misc_feature (79)..(79): Xaa can be any naturally occurring amino acid
  misc_feature (103)..(103): Xaa can be any naturally occurring amino acid
IGDHLLSIYQVMMELGWGHFSTVWLCWDDXEKRFVALKIVWSADHFTKAARDQIHSLSSVREXDPTYPKRITTVQLLNXFKISGINGVHVCKVCELQRHQLLXLSIKSNYRG

SEQ ID NO: 24570 - protein, 108 aa, Diabrotica virgifera
  misc_feature: Coding regions on vcDNA: vcDNA=SeqID_4267; Strand=+; Position=129-452
  misc_feature (71)..(79): Xaa can be any naturally occurring amino acid
TILERNYVKMVNEFDKLIEEIFKIKSELKNAIQASELRILLNIENLNEKIKNLEKENSQLKEKVEYLERGXXXXXXXXXGIENSENLEVSEFCNKLSQLLKITLSVND

SEQ ID NO: 24571 - protein, 76 aa, Diabrotica virgifera
  misc_feature: Coding regions on vcDNA: vcDNA=SeqID_4268; Strand=-; Position=0-227
  misc_feature (57)..(68): Xaa can be any naturally occurring amino acid
VSCINASFLLRYEGAANLAQYWTDSCHVATITFQTALTVLPMECTRSVMRLPTRPPXXXXXXXXXXXXTCVLEAWV

SEQ ID NO: 24572 - protein, 121 aa, Diabrotica virgifera
  misc_feature: Coding regions on vcDNA: vcDNA=SeqID_4269; Strand=+; Position=3-365
  misc_feature: Homolog annotation: Hit_ID=EAL26660.1; Match level="QueryCoverage =62%, HitCoverage=6%, E-value=9e-33, Identity=77%"; Hit description =GA15635-PA [Drosophila pseudoobscura]
  misc_feature: Gene Ontology Annotation: Molecular function=protein binding; Cellular component=Z disc; Biological process=cell adhesion
  misc_feature: Pfam annotation: Pfam_ID=LIM; Match level="Score=38.7, E-value=1.7e -08, Copies=1"; Pfam description=LIM domain
DLNLPDQLTFSSKPVDGNSISKIYINSGVTKDASDYRDTNNLASVPICWICNSEIVRGPFITALGKIWCPNHFICSTPSCRRPLQDIGFVEERGQLYCEYCFEQYLAPPCSKCGGKIKADC

SEQ ID NO: 24573 - protein, 104 aa, Diabrotica virgifera
  misc_feature: Coding regions on vcDNA: vcDNA=SeqID_4270; Strand=+; Position=8-322
IESYYCHFLGSPWGPGLPRCWCLAFVAVPSAFLLFVVVFCFLLSRGSVFLVLSGYIVARFKTALGLHVFTVTLAGCIAFLSSHVTRFYICPVCLEIGLLYLSAL

SEQ ID NO: 24574 - protein, 82 aa, Diabrotica virgifera
  misc_feature: Coding regions on vcDNA: vcDNA=SeqID_4271; Strand=+; Position=76-322
  misc_feature (52)..(52): Xaa can be any naturally occurring amino acid
EETKCAHYREVSLLNTADKLLSNIILSGLNPYTKNRLGEYQAGFHAQIHSIXSFTLRQFLDKGWEYNGPIHNLFIYFLYAYD

SEQ ID NO: 24575 - protein, 97 aa, Diabrotica virgifera
  misc_feature: Coding regions on vcDNA: vcDNA=SeqID_4272; Strand=+; Position=141-431
  misc_feature: Homolog annotation: Hit_ID=NP_523990.1; Match level="QueryCoverage =96%, HitCoverage=40%, E-value=1e-30, Identity=62%"; Hit description =CG4665-PA [Drosophila melanogaster] gb|AAF50315.1| CG4665-PA [Drosophila melanogaster]
  misc_feature: Gene Ontology Annotation: Molecular function=electron transporter activity; Biological process=dihydrobiopterin reduction
  misc_feature (95)..(95): Xaa can be any naturally occurring amino acid
MSYAGRVIVYGGRGALGAKCISHFKANNFWVGSIDLAENAEADVNILVKREDSLQDQETSILSSVNSSLNGSKLDGIFCVAGGWAGGNASKDLVXNS

SEQ ID NO: 24576 - protein, 130 aa, Diabrotica virgifera
  misc_feature: Coding regions on vcDNA: vcDNA=SeqID_4273; Strand=+; Position=2-391
  misc_feature (41)..(55): Xaa can be any naturally occurring amino acid
  misc_feature (120)..(128): Xaa can be any naturally occurring amino acid
THAPKDDQITNDLENSKLNKTNKVNSNHTNKLKTKLGPSDXXXXXXXXXXXXXXXDIANIEFLNEANSTYSVGSIVTVVTDSMSSNSNISTSISHNNSSEGEISEREDEISENSTNISNXXXXXXXXXNS

SEQ ID NO: 24577 - protein, 106 aa, Diabrotica virgifera
  misc_feature: Coding regions on vcDNA: vcDNA=SeqID_4274; Strand=-; Position=2-319
  misc_feature (98)..(104): Xaa can be any naturally occurring amino acid
QLSDHLLCVEESLSIWKVRYPNAGTTYQHNLRVPNVDAHTIPNIPHVLEFSNELYIPYVVKYSSQTIDPPIHYYAQHYWIASYLSTPAIPPWLLKASXXXXXXXRI

SEQ ID NO: 24578 - protein, 60 aa, Diabrotica virgifera
  misc_feature: Coding regions on vcDNA: vcDNA=SeqID_4275; Strand=+; Position=80-262
INYLLSRSCKSILHDNHTTPAVIKGGLRFKYVVIEFDFDLLLESSYVIFIYTLENEDSSV

SEQ ID NO: 24579 - protein, 66 aa, Diabrotica virgifera
  misc_feature: Coding regions on vcDNA: vcDNA=SeqID_4276; Strand=-; Position=1-198
SKLYRRPRQVNYYSDSFFCFAQSYSKRGPYNTSAGCRAVPWSKNYLNNFSHAFADVCVRRVCRPAS

SEQ ID NO: 24580 - protein, 57 aa, Diabrotica virgifera
  misc_feature: Coding regions on vcDNA: vcDNA=SeqID_4277; Strand=+; Position=258-428
VAGWGLVFLIFFAKTKATNFILSVTYLNLMLETCYKNRGRDFFKHFKKVICNGFSPK

SEQ ID NO: 24581 - protein, 55 aa, Diabrotica virgifera
  misc_feature: Coding regions on vcDNA: vcDNA=SeqID_4278; Strand=-; Position=0-164
  misc_feature (44)..(53): Xaa can be any naturally occurring amino acid
RPFYIALESDPMISFTMCTLPCVRLIPVPALFFVLFISFNLVNXXXXXXXXXXRV

SEQ ID NO: 24582 - protein, 94 aa, Diabrotica virgifera
  misc_feature: Coding regions on vcDNA: vcDNA=SeqID_4279; Strand=+; Position=151-432
IKLFKIMKLLGKIILILLIGFAYTQYFELFLGKQILEKLERKCEQAGLSEVFQSLQEMSRQVTTCLDVKQLNLNPDTIVEEFSRAERTYELLNF

SEQ ID NO: 24583 - protein, 36 aa, Diabrotica virgifera
  misc_feature: Coding regions on vcDNA: vcDNA=SeqID_4280; Strand=-; Position=60-170
DKNGIPQVNIIDLTCLRNIWFSMSSPVILISLITPY

SEQ ID NO: 24584 - protein, 67 aa, Diabrotica virgifera
  misc_feature: Coding regions on vcDNA: vcDNA=SeqID_4281; Strand=+; Position=230-430
  misc_feature (8)..(25): Xaa can be any naturally occurring amino acid
  misc_feature (29)..(42): Xaa can be any naturally occurring amino acid
  misc_feature (53)..(53): Xaa can be any naturally occurring amino acid
KLSKYGIXXXXXXXXXXXXXXXXXXVFSXXXXXXXXXXXXXXLVPVLLLIIGXGYHPERLDAGIYLL

SEQ ID NO: 24585 - protein, 31 aa, Diabrotica virgifera
  misc_feature: Coding regions on vcDNA: vcDNA=SeqID_4282; Strand=-; Position=1-93
  misc_feature (2)..(18): Xaa can be any naturally occurring amino acid
  misc_feature (27)..(31): Xaa can be any naturally occurring amino acid
PXXXXXXXXXXXXXXXXXFLFSSLFIXXXXX

SEQ ID NO: 24586 - protein, 126 aa, Diabrotica virgifera
  misc_feature: Coding regions on vcDNA: vcDNA=SeqID_4283; Strand=-; Position=1-378
  misc_feature (3)..(25): Xaa can be any naturally occurring amino acid
  misc_feature (52)..(61): Xaa can be any naturally occurring amino acid
  misc_feature (70)..(75): Xaa can be any naturally occurring amino acid
  misc_feature (82)..(96): Xaa can be any naturally occurring amino acid
  misc_feature (102)..(122): Xaa can be any naturally occurring amino acid
LSXXXXXXXXXXXXXXXXXXXXXXXLNFLKIWYYLKRITISFQKIHLNYSFXXXXXXXXXXLIWKFLIMXXXXXXPCSPGSXXXXXXXXXXXXXXXYYLISXXXXXXXXXXXXXXXXXXXXXRRLG

SEQ ID NO: 24587 - protein, 68 aa, Diabrotica virgifera
  misc_feature: Coding regions on vcDNA: vcDNA=SeqID_4284; Strand=+; Position=255-458
  misc_feature (27)..(27): Xaa can be any naturally occurring amino acid
  misc_feature (37)..(47): Xaa can be any naturally occurring amino acid
FVVINVTSLKCIHICFTNVHIKVKFNXCTETIGSNMXXXXXXXXXXXLVTIGTFVIFVSYNMYLHIVM

SEQ ID NO: 24588 - protein, 76 aa, Diabrotica virgifera
  misc_feature: Coding regions on vcDNA: vcDNA=SeqID_4285; Strand=+; Position=2-232
  misc_feature (5)..(14): Xaa can be any naturally occurring amino acid
THKSXXXXXXXXXXPNKLGDDTMLMTDEESYDEFGPLEQLLIQNNDKRTDECERDLDCSYMANSICDGTTKNCLQK

SEQ ID NO: 24589 - protein, 61 aa, Diabrotica virgifera
  misc_feature: Coding regions on vcDNA: vcDNA=SeqID_4286; Strand=-; Position=0-182
  misc_feature (19)..(53): Xaa can be any naturally occurring amino acid
LRTYYSFRYSFLILDTQVXXXXXXXXXXXXXXXXXXXXXXXXXXXXXXXXXXXRASVDSWV

SEQ ID NO: 24590 - protein, 57 aa, Diabrotica virgifera
  misc_feature: Coding regions on vcDNA: vcDNA=SeqID_4287; Strand=+; Position=77-250
  misc_feature (3)..(22): Xaa can be any naturally occurring amino acid
  misc_feature (26)..(26): Xaa can be any naturally occurring amino acid
  misc_feature (47)..(53): Xaa can be any naturally occurring amino acid
LLXXXXXXXXXXXXXXXXXXXXQGLXINKYVFIICEFNRSYYFNLYXXXXXXXYVFV

SEQ ID NO: 24591 - protein, 95 aa, Diabrotica virgifera
  misc_feature: Coding regions on vcDNA: vcDNA=SeqID_4288; Strand=-; Position=63-350
  misc_feature (12)..(18): Xaa can be any naturally occurring amino acid
  misc_feature (61)..(67): Xaa can be any naturally occurring amino acid
  misc_feature (74)..(82): Xaa can be any naturally occurring amino acid
PYWHKSTYIIKXXXXXXXNFSHKKVDKKKHEFTTTLQTNLRKITILQCQILTKKLEETPPXXXXXXXYLTIHCXXXXXXXXXLKYNLIYYHYIII

SEQ ID NO: 24592 - protein, 56 aa, Diabrotica virgifera
  misc_feature: Coding regions on vcDNA: vcDNA=SeqID_4289; Strand=-; Position=151-321
ATQKHKGENLLKMDIKSHGYGSRTTYMLSQGHIHKILYPSFGFYYISIHIRLLVYL

SEQ ID NO: 24593 - protein, 67 aa, Diabrotica virgifera
  misc_feature: Coding regions on vcDNA: vcDNA=SeqID_4290; Strand=+; Position=3-206
QASTHTFCERVGFSTLGLFVPSLLDIIVNWKNWGRYNWILVRDLFIITMFVFGFVFGAYYAVLHFIQ

SEQ ID NO: 24594 - protein, 77 aa, Diabrotica virgifera
  misc_feature: Coding regions on vcDNA: vcDNA=SeqID_4291; Strand=+; Position=42-306
  misc_feature: Homolog annotation: Hit_ID=CAE47497.1; Match level="QueryCoverage =100%, HitCoverage=27%, E-value=3e-26, Identity=70%"; Hit description= cathepsin L-like proteinase [Diabrotica virgifera virgifera]
SAAHIVTTSANRGAFDKWTSFKANHMKSYIVKNLKKIEEHNAKYESGEDSYYLAVNKFTDWSIAEFQAMLSRHMANK

SEQ ID NO: 24595 - protein, 86 aa, Diabrotica virgifera
  misc_feature: Coding regions on vcDNA: vcDNA=SeqID_4292; Strand=+; Position=1-261
  misc_feature (6)..(45): Xaa can be any naturally occurring amino acid
PTNLKXXXXXXXXXXXXXXXXXXXXXXXXXXXXXXXXXXXXXXXXPKGSNLPYACRPLQGPSIVPPNFIPWAFFLKLRIGKTPGFT

SEQ ID NO: 24596 - protein, 20 aa, Diabrotica virgifera
  misc_feature: Coding regions on vcDNA: vcDNA=SeqID_4293; Strand=-; Position=2-61
NYYKYYHIYWSSQYCLTDLA

SEQ ID NO: 24597 - protein, 104 aa, Diabrotica virgifera
  misc_feature: Coding regions on vcDNA: vcDNA=SeqID_4294; Strand=+; Position=3-317
  misc_feature (53)..(59): Xaa can be any naturally occurring amino acid
LLCTLMVLVAYSSAYDYSNCPGNTNRQKNLIYSSLLPSAYSAKTRIPATGYYXXXXXXXLLIDQKGSTSSPKIIEGGYLDTFAVVNITSTTAQPVSYYAIVFID

SEQ ID NO: 24598 - protein, 79 aa, Diabrotica virgifera
  misc_feature: Coding regions on vcDNA: vcDNA=SeqID_4295; Strand=-; Position=184-423
  misc_feature (60)..(67): Xaa can be any naturally occurring amino acid
FIAFDQPTPNPYEELAPLKKKESTLLVGKNIQIKNRKKLRTVKSKSTTFFSKKHPIYVHXXXXXXXXALFFNFFLQPAS

SEQ ID NO: 24599 - protein, 51 aa, Diabrotica virgifera
  misc_feature: Coding regions on vcDNA: vcDNA=SeqID_4296; Strand=+; Position=1-156
  misc_feature (11)..(20): Xaa can be any naturally occurring amino acid
YCEILIYFYNXXXXXXXXXXQGLLNNDYKFMSFDISRADKLRFLVYDREMR

SEQ ID NO: 24600 - protein, 52 aa, Diabrotica virgifera
  misc_feature: Coding regions on vcDNA: vcDNA=SeqID_4297; Strand=+; Position=3-158
PSVRKLSNNIDKQTVEYHTDEDDLAQETEWIRAKNRKERKMDTSLTPPKGTQ

SEQ ID NO: 24601 - protein, 69 aa, Diabrotica virgifera
  misc_feature: Coding regions on vcDNA: vcDNA=SeqID_4298; Strand=+; Position=204-413
  misc_feature (36)..(36): Xaa can be any naturally occurring amino acid
  misc_feature (52)..(57): Xaa can be any naturally occurring amino acid
CDILKTPTISALSYIELYTEMKHILLSLNTSDLFIXQLNKLYTDDSTIHIFXXXXXXLVILHSLSRDFF

SEQ ID NO: 24602 - protein, 118 aa, Diabrotica virgifera
  misc_feature: Coding regions on vcDNA: vcDNA=SeqID_4299; Strand=+; Position=27-380
QRFLHLRRMSVLLALSNRILPSIFLRVFISGVSSTLFILSVSGRLSVGSSSTFKEILLVLILIFQFNVSSENNMPLNILISNKLFNLILTTYNVRMLTIGLFLASVCPVSIAVDADTW

SEQ ID NO: 24603 - protein, 27 aa, Diabrotica virgifera
  misc_feature: Coding regions on vcDNA: vcDNA=SeqID_4300; Strand=+; Position=1-81
QLAPGVTSQVLFHVFEVKFRTVTSYLI

SEQ ID NO: 24604 - protein, 36 aa, Diabrotica virgifera
  misc_feature: Coding regions on vcDNA: vcDNA=SeqID_4301; Strand=-; Position=60-170
DLSKSRTVLSLYDKTKFFKPTGIGLFFTYCRKTHRP

SEQ ID NO: 24605 - protein, 26 aa, Diabrotica virgifera
  misc_feature: Coding regions on vcDNA: vcDNA=SeqID_4302; Strand=-; Position=1-78
MRAAARMNSNKQTGHGRVGRRIIRLT

SEQ ID NO: 24606 - protein, 55 aa, Diabrotica virgifera
  misc_feature: Coding regions on vcDNA: vcDNA=SeqID_4303; Strand=-; Position=2-166
  misc_feature (6)..(20): Xaa can be any naturally occurring amino acid
RPPRCXXXXXXXXXXXXXXXPTMPSNIFYNKNMHALAIMKTKIVKVQIETDNPTT

SEQ ID NO: 24607 - protein, 139 aa, Diabrotica virgifera
  misc_feature: Coding regions on vcDNA: vcDNA=SeqID_4304; Strand=+; Position=1-417
DPNVRHFEETLEDHVILRNYQDIDSLCQFLQVREAKRREMRNRRQHEQYNGPARRYQSNYDQRNRHAQSTNEDRPREYQNYNRQQNYDNRNHAKNRTYENHNRNRDAQNPPTRNTNEQRDGRNNQNFQRQNRREMNHVT

SEQ ID NO: 24608 - protein, 97 aa, Diabrotica virgifera
  misc_feature: Coding regions on vcDNA: vcDNA=SeqID_4305; Strand=-; Position=50-343
YSGLLIFKILTGRERKILRRFFGPNHNPNSNQHRMRAKAEVKQMYKTSDVVQESKSQRLIWAGHVYRLPKDVRGRPKTLLTSTNAMEASCTVRVVVL

SEQ ID NO: 24609 - protein, 60 aa, Diabrotica virgifera
  misc_feature: Coding regions on vcDNA: vcDNA=SeqID_4306; Strand=+; Position=53-235
HSPLFFSNSKGKFYLRTATQYCERSFPSYTRRGYFLSPVYQGLATSNYSGMNFEFTRAKS

SEQ ID NO: 24610 - protein, 63 aa, Diabrotica virgifera
  misc_feature: Coding regions on vcDNA: vcDNA=SeqID_4307; Strand=+; Position=3-194
  misc_feature (42)..(53): Xaa can be any naturally occurring amino acid
TRPVTLGVFRLSYRTLTAHIDSIYFSSRFPVIGKNSSVVHCXXXXXXXXXXXXLLFIPCVSII

SEQ ID NO: 24611 - protein, 53 aa, Diabrotica virgifera
  misc_feature: Coding regions on vcDNA: vcDNA=SeqID_4308; Strand=+; Position=2-163
GQTHESTVAWVMIDLSRFSTEYYNILIVKLCVIIVHYFSTFVIQSLYRVYYGL

SEQ ID NO: 24612 - protein, 139 aa, Diabrotica virgifera
  misc_feature: Coding regions on vcDNA: vcDNA=SeqID_4309; Strand=+; Position=2-418
  misc_feature: Homolog annotation: Hit_ID=BAB02145.1; Match level="QueryCoverage =89%, HitCoverage=38%, E-value=9e-12, Identity=30%"; Hit description =copia-like retroelement pol polyprotein-like [Arabidopsis thaliana]
GRPTRPPKRPVESDNDKNDENESIDETFDNRNENLNESMDDTENEHNELRKSQRDKNPPKKFDDYYVYNSSIFVNMCRTDIPHTFEEAMNSDESKYWEKAMDKEIDSLNKNKTWKLVENVENKKVLDVKWVYTKKSDDN

SEQ ID NO: 24613 - protein, 66 aa, Diabrotica virgifera
  misc_feature: Coding regions on vcDNA: vcDNA=SeqID_4310; Strand=+; Position=2-202
  misc_feature (7)..(15): Xaa can be any naturally occurring amino acid
  misc_feature (22)..(38): Xaa can be any naturally occurring amino acid
SVMMILXXXXXXXXXNIYVYSXXXXXXXXXXXXXXXXXVLSIMVAPGHWISFDGLGIFTVLMYHDH

SEQ ID NO: 24614 - protein, 132 aa, Diabrotica virgifera
  misc_feature: Coding regions on vcDNA: vcDNA=SeqID_4311; Strand=+; Position=29-424
  misc_feature: Homolog annotation: Hit_ID=XP_394468.1; Match level="QueryCoverage =53%, HitCoverage=30%, E-value=7e-20, Identity=62%"; Hit description =similar to Biphenyl hydrolase-like (serine hydrolase; breast epithelial
  misc_feature: Gene Ontology Annotation: Biological process=amino acid and derivative metabolism
  misc_feature (127)..(127): Xaa can be any naturally occurring amino acid
MCCNANIREALLLELLEDDIDLNVVGAAVEILAQSVDIDAMDMDTPDDFHNHVRLSKGRFQTQKIDVDGQTINYVKVGNGPKTVLCFPGALGTIWSDFKPQVENLDREKFTIVAWDPPGYGYSRPSXRKFGI

SEQ ID NO: 24615 - protein, 73 aa, Diabrotica virgifera
  misc_feature: Coding regions on vcDNA: vcDNA=SeqID_4312; Strand=-; Position=2-220
HLHLDSLTWLWKSYGVSMSIASLSIECDKHYTAAPIMYKSISFSSNFNKRDFIIFATQHMIHHITTTSVLSRA

SEQ ID NO: 24616 - protein, 96 aa, Diabrotica virgifera
  misc_feature: Coding regions on vcDNA: vcDNA=SeqID_4313; Strand=+; Position=78-368
  misc_feature (21)..(26): Xaa can be any naturally occurring amino acid
SFASESLWLTSLGYHPCRGLXXXXXXLLPYLVCDQFLFPQFLRLMLLVSVMLLVVIILRDNTKLLNSYYYSGIRNRFECIFCIGIDWCNTIHYGQY

SEQ ID NO: 24617 - protein, 23 aa, Diabrotica virgifera
  misc_feature: Coding regions on vcDNA: vcDNA=SeqID_4314; Strand=-; Position=0-68
  misc_feature (4)..(18): Xaa can be any naturally occurring amino acid
VPPXXXXXXXXXXXXXXXCVGRP

SEQ ID NO: 24618 - protein, 60 aa, Diabrotica virgifera
  misc_feature: Coding regions on vcDNA: vcDNA=SeqID_4315; Strand=+; Position=79-261
  misc_feature (6)..(20): Xaa can be any naturally occurring amino acid
  misc_feature (27)..(33): Xaa can be any naturally occurring amino acid
  misc_feature (42)..(49): Xaa can be any naturally occurring amino acid
LNLYCXXXXXXXXXXXXXXXYLEFQGXXXXXXXGITFEFNLXXXXXXXXYYDYFISFFCK

SEQ ID NO: 24619 - protein, 103 aa, Diabrotica virgifera
  misc_feature: Coding regions on vcDNA: vcDNA=SeqID_4316; Strand=-; Position=55-366
  misc_feature (3)..(11): Xaa can be any naturally occurring amino acid
SLXXXXXXXXXVYSDFHINLSHISLKLCIFLQARRPQIGGICCRLVESVYSCINLQVDLVMHCTPPLLFLQVRPMASLVLSGPGSLLSMLRRYHTGRRSLGER

SEQ ID NO: 24620 - protein, 78 aa, Diabrotica virgifera
  misc_feature: Coding regions on vcDNA: vcDNA=SeqID_4317; Strand=-; Position=0-233
  misc_feature (36)..(45): Xaa can be any naturally occurring amino acid
  misc_feature (48)..(70): Xaa can be any naturally occurring amino acid
QYKTKAIKFNKVENIKVFRYYILIHVTQDPNKITPXXXXXXXXXXIYXXXXXXXXXXXXXXXXXXXXXXXDASADAWV

SEQ ID NO: 24621 - protein, 90 aa, Diabrotica virgifera
  misc_feature: Coding regions on vcDNA: vcDNA=SeqID_4318; Strand=+; Position=66-338
  misc_feature: Homolog annotation: Hit_ID=XP_307418.1; Match level="QueryCoverage =100%, HitCoverage=84%, E-value=2e-33, Identity=65%"; Hit description= ENSANGP00000001833 [Anopheles gambiae] gb|EAA03027.1| ENSANGP00000001833 [Anopheles gambiae
MAFGDYPAEYNPKVHGPYDPARFYGKPDTPFGQVKVGEIGSWLARRHKSPATLAGAFSTAYWPWQHMYVQPKKSGNTAFIHVAVGSTIFF

SEQ ID NO: 24622 - protein, 71 aa, Diabrotica virgifera
  misc_feature: Coding regions on vcDNA: vcDNA=SeqID_4319; Strand=+; Position=165-377
  misc_feature (16)..(23): Xaa can be any naturally occurring amino acid
TNIYNVCFKIVQDLWXXXXXXXXRFVHKLVIKLIFISNWQQNFIVHYPKCMFYSFVLNKSCTLMLLNKEYG

SEQ ID NO: 24623 - protein, 76 aa, Diabrotica virgifera
  misc_feature: Coding regions on vcDNA: vcDNA=SeqID_4320; Strand=+; Position=1-231
IEIRNKASVESSVNSGAHSSFHASVLLKVTRGFPIFMVHAQVYVRFRFNSSTVSRMFKSIAIDLLTSLWVSLCNIH

SEQ ID NO: 24624 - protein, 83 aa, Diabrotica virgifera
  misc_feature: Coding regions on vcDNA: vcDNA=SeqID_4321; Strand=-; Position=150-401
  misc_feature (56)..(62): Xaa can be any naturally occurring amino acid
LENQLRHQYICHNMSRLPYTIDKTDIQSLNMVNNYTFFNSTSPYTNAMKNIKIIVXXXXXXXPIGRRTLHKKIELKNFLQKVL

SEQ ID NO: 24625 - protein, 26 aa, Diabrotica virgifera
  misc_feature: Coding regions on vcDNA: vcDNA=SeqID_4322; Strand=+; Position=31-111
LAKRMRKEETYDLNSLCMVSREVTYA

SEQ ID NO: 24626 - protein, 120 aa, Diabrotica virgifera
  misc_feature: Coding regions on vcDNA: vcDNA=SeqID_4323; Strand=+; Position=2-361
  misc_feature (10)..(16): Xaa can be any naturally occurring amino acid
  misc_feature (94)..(94): Xaa can be any naturally occurring amino acid
TNIIIKLQEXXXXXXXVSLVWIKGHCGIKENEEVDEDAKKGSRTGELLSYKCPHSEIACHVKPIILAEWREMYSNSPKGKFYKNIVTKPPGQSXFSRLSGSKRFFSVLCRLRFNHVLTPQ

SEQ ID NO: 24627 - protein, 23 aa, Diabrotica virgifera
  misc_feature: Coding regions on vcDNA: vcDNA=SeqID_4324; Strand=-; Position=2-70
SKKSLPTLDNSLGSSRRLQKFKL

SEQ ID NO: 24628 - protein, 51 aa, Diabrotica virgifera
  misc_feature: Coding regions on vcDNA: vcDNA=SeqID_4325; Strand=+; Position=3-158
FVLSIHSRSLTYLKGLMLEKMEFKEKKIFCNFVFFTFYFKISPNLLEIRKK

SEQ ID NO: 24629 - protein, 34 aa, Diabrotica virgifera
  misc_feature: Coding regions on vcDNA: vcDNA=SeqID_4326; Strand=+; Position=48-152
GQRHMLCISLAIEMLVVFNDIEVLTTYMEFIYQP

SEQ ID NO: 24630 - protein, 52 aa, Diabrotica virgifera
  misc_feature: Coding regions on vcDNA: vcDNA=SeqID_4327; Strand=+; Position=64-222
TFSIAMHCHNIKYRLIMFFASVSCNECCFLFNSNFNFDQKQKLASFKLDMII

SEQ ID NO: 24631 - protein, 74 aa, Diabrotica virgifera
  misc_feature: Coding regions on vcDNA: vcDNA=SeqID_4328; Strand=-; Position=2-223
  misc_feature (68)..(74): Xaa can be any naturally occurring amino acid
TTYPPKVTKACAQAILLTARAETIPPQTCKTPIPAPDNLSFPRRLTTTCKSLLDLIKLHQDEKKAKYXXXXXXX

SEQ ID NO: 24632 - protein, 113 aa, Diabrotica virgifera
  misc_feature: Coding regions on vcDNA: vcDNA=SeqID_4329; Strand=+; Position=93-431
  misc_feature: Homolog annotation: Hit_ID=XP_395455.1; Match level="QueryCoverage =100%, HitCoverage=29%, E-value=1e-34, Identity=62%"; Hit description= similar to eukaryotic translation initiation factor 4A, isoform 1 [Apis mellifera]
  misc_feature: Gene Ontology Annotation: Molecular function=translation initiation factor activity; Cellular component=eukaryotic translation initiation factor 4 complex; Biological process=regulation of translational initiation
SYDSPLGMEPEGIIESNCEYVVDTFNYMKLSDEVVTRIYAYGFEQPSATHERVIIPSVAGHDVTAQAQSSAGITGTFTITILHLMDTSLRECHALILAPTYELAQQIQKVVVA

SEQ ID NO: 24633 - protein, 147 aa, Diabrotica virgifera
  misc_feature: Coding regions on vcDNA: vcDNA=SeqID_4330; Strand=+; Position=3-443
  misc_feature: Homolog annotation: Hit_ID=CAE69070.1; Match level="QueryCoverage =94%, HitCoverage=13%, E-value=8e-35, Identity=48%"; Hit description =Hypothetical protein CBG15088 [Caenorhabditis briggsae]
RGPIHASTDVLENFRDIGHRTSGLDPAWYYTIPGYSFDCMLLYTKCELELLSDVDMILFIEKGIRGGISQCCSRYSEANNKYMTNYDPNKPDKYIFYVNVNNLYGWAMSQPLPISNFKWVDTNIDVTGISDDSLFGYICEVDIEYPQ

SEQ ID NO: 24634 - protein, 97 aa, Diabrotica virgifera
  misc_feature: Coding regions on vcDNA: vcDNA=SeqID_4331; Strand=-; Position=2-292
  misc_feature (52)..(95): Xaa can be any naturally occurring amino acid
LQNPGFSHYELFKQTPIKSNYEAPNERYLVSITRKLTSNPLSHLPLLIFFYXXXXXXXXXXXXXXXXXXXXXXXXXXXXXXXXXXXXXXXXXXXXEL

SEQ ID NO: 24635 - protein, 81 aa, Diabrotica virgifera
  misc_feature: Coding regions on vcDNA: vcDNA=SeqID_4332; Strand=-; Position=131-375
  misc_feature (21)..(21): Xaa can be any naturally occurring amino acid
MMYGPCRDNVTNEWRLRYNKXKVSLFGKENLVRYIKANRLRWAEHVIRNNDNRLINNVFWEIPDGRRSVGRSTKRWKDTVK

SEQ ID NO: 24636 - protein, 69 aa, Diabrotica virgifera
  misc_feature: Coding regions on vcDNA: vcDNA=SeqID_4333; Strand=+; Position=1-210
DHASMKIPSSLRLISLVCIVPSLRGYTLFLEWINTYFVVGRMILAEDEVVESPHAWSYGKSTSSNNDYY

SEQ ID NO: 24637 - protein, 44 aa, Diabrotica virgifera
  misc_feature: Coding regions on vcDNA: vcDNA=SeqID_4334; Strand=-; Position=0-131
SLLMFIRIALRVTCMNFPNFQDKMINKCDIQDEQFPQVTADSWV

SEQ ID NO: 24638 - protein, 30 aa, Diabrotica virgifera
  misc_feature: Coding regions on vcDNA: vcDNA=SeqID_4335; Strand=-; Position=0-89
FYVILENYGTYPYFFNASKVFFNAISLYAL

SEQ ID NO: 24639 - protein, 127 aa, Diabrotica virgifera
  misc_feature: Coding regions on vcDNA: vcDNA=SeqID_4336; Strand=+; Position=2-382
  misc_feature: Homolog annotation: Hit_ID=XP_309670.1; Match level="QueryCoverage =88%, HitCoverage=23%, E-value=2e-30, Identity=50%"; Hit description =ENSANGP00000024638 [Anopheles gambiae] ref|XP_309669.1| ENSANGP00000023240 [Anopheles gambiae]
  misc_feature: Gene Ontology Annotation: Molecular function=sugar porter activity; Cellular component=nucleus; Biological process=acrosome formation
ASTHTSANAWVTYFFYLKDNQHKDVSNIGWVPILSLVVFIITYCLGFGPLPWAVMGELFPGNVKSVASTATASFCWILGFLLTNYFGAVAGVIGKSGSFGFFTICCLLSAIFTFKFLPETAGKSLTK

SEQ ID NO: 24640 - protein, 99 aa, Diabrotica virgifera
  misc_feature: Coding regions on vcDNA: vcDNA=SeqID_4337; Strand=+; Position=105-401
  misc_feature: Homolog annotation: Hit_ID=AAD32906.1; Match level="QueryCoverage =76%, HitCoverage=9%, E-value=1e-12, Identity=46%"; Hit description =putative retroelement pol polyprotein [Arabidopsis thaliana] pir||G84552 probable retroelement pol polyprot
  misc_feature (12)..(12): Xaa can be any naturally occurring amino acid
  misc_feature (33)..(33): Xaa can be any naturally occurring amino acid
  misc_feature (54)..(54): Xaa can be any naturally occurring amino acid
HKKVTPYELWYXKKVNNISTLKSFGSRVSVHVXKEKRLKWDAKNMFGFFIGYSXDVKGYKIFVPDKNKVEIHRDVIFLPEKTIEIQNGETDMNKNIQMI

SEQ ID NO: 24641 - protein, 53 aa, Diabrotica virgifera
  misc_feature: Coding regions on vcDNA: vcDNA=SeqID_4338; Strand=-; Position=108-269
HRVLLDVLLVICKRTLVNSISNYVVSQRCALLRPLPQKCSYLDTNTSSVDVKG

SEQ ID NO: 24642 - protein, 40 aa, Diabrotica virgifera
  misc_feature: Coding regions on vcDNA: vcDNA=SeqID_4339; Strand=-; Position=0-119
PSLLHKVQNLNHSPSQHKLFSHTTNSLSLTKTIHYFYYNT

SEQ ID NO: 24643 - protein, 59 aa, Diabrotica virgifera
  misc_feature: Coding regions on vcDNA: vcDNA=SeqID_4340; Strand=+; Position=3-182
GKVTTSEINEKKLKFSGRPSYGFVTYLPLIAFSHPFYTSPQFIFMCPFFHILGLGKPLG

SEQ ID NO: 24644 - protein, 88 aa, Diabrotica virgifera
  misc_feature: Coding regions on vcDNA: vcDNA=SeqID_4341; Strand=+; Position=98-361
  misc_feature: Homolog annotation: Hit_ID=XP_318321.1; Match level="QueryCoverage =80%, HitCoverage=7%, E-value=2e-10, Identity=46%"; Hit description =ENSANGP00000014035 [Anopheles gambiae]
TKKHRKSTELKVQATSSIPVYFQNIRGLRTKLNLLYENISYSQYNIILLNETRLTSDINNSELQMFDHNIHRKDRSLSTSIFSRGGGV

SEQ ID NO: 24645 - protein, 52 aa, Diabrotica virgifera
  misc_feature: Coding regions on vcDNA: vcDNA=SeqID_4342; Strand=+; Position=99-257
PLSLSALLCRFLMSVGVSVHPAEMDQRFIQLTQSNAFLWSTKHIVIGTYIGN

SEQ ID NO: 24646 - protein, 85 aa, Diabrotica virgifera
  misc_feature: Coding regions on vcDNA: vcDNA=SeqID_4343; Strand=+; Position=60-317
  misc_feature (4)..(12): Xaa can be any naturally occurring amino acid
  misc_feature (27)..(74): Xaa can be any naturally occurring amino acid
HYTXXXXXXXXXYQIFLGIIVKIHSHXXXXXXXXXXXXXXXXXXXXXXXXXXXXXXXXXXXXXXXXXXXXXXXXDDNSTINKLYI

SEQ ID NO: 24647 - protein, 61 aa, Diabrotica virgifera
  misc_feature: Coding regions on vcDNA: vcDNA=SeqID_4344; Strand=-; Position=44-229
VQFISQISFINCTGISNCGFMLYAGKNYHGSNCNHMKYYIRHSRSHTIYTRIISNVSTQFW

SEQ ID NO: 24648 - protein, 35 aa, Diabrotica virgifera
  misc_feature: Coding regions on vcDNA: vcDNA=SeqID_4345; Strand=+; Position=2-109
  misc_feature (2)..(11): Xaa can be any naturally occurring amino acid
  misc_feature (17)..(24): Xaa can be any naturally occurring amino acid
TXXXXXXXXXXKKLFFXXXXXXXXTPQLDSYEFPI

SEQ ID NO: 24649 - protein, 59 aa, Diabrotica virgifera
  misc_feature: Coding regions on vcDNA: vcDNA=SeqID_4346; Strand=+; Position=3-182
ADTRVNLCPKNVHIATQLPVIKFLRNSSHILIACKLIKRFRDGQTIVNFSNFYNSEQQK

SEQ ID NO: 24650 - protein, 63 aa, Diabrotica virgifera
  misc_feature: Coding regions on vcDNA: vcDNA=SeqID_4347; Strand=+; Position=45-233
VQCLFFCNVMFGTFSSVTQFKFLGAFFYFASWGKTLVFPIYPPLKKFPFSKVEFKPKGPPFFT

SEQ ID NO: 24651 - protein, 65 aa, Diabrotica virgifera
  misc_feature: Coding regions on vcDNA: vcDNA=SeqID_4348; Strand=+; Position=26-223
  misc_feature (47)..(54): Xaa can be any naturally occurring amino acid
LHFILRCSEQAAYVVVCTQYNVKPNKNRRFRFDSIRISYHPLIFVFXXXXXXXXVILISTTYTSE

SEQ ID NO: 24652 - protein, 123 aa, Diabrotica virgifera
  misc_feature: Coding regions on vcDNA: vcDNA=SeqID_4349; Strand=-; Position=1-369
  misc_feature: Homolog annotation: Hit_ID=AAC24982.2; Match level="QueryCoverage =90%, HitCoverage=10%, E-value=5e-12, Identity=35%"; Hit description =reverse transcriptase [synthetic construct]
ILEKKLRENIEATLDDSQCGFRPGRGTTDLIFTVRQLSEEAIEHNSKLFLCFVDFEKAFDRAPRNKIWEILNRRYVKPKLIQAKKSIYKCTRNNVRTNNCSSLEFYTRTGVKQGGVLGAWWTR

SEQ ID NO: 24653 - protein, 83 aa, Diabrotica virgifera
  misc_feature: Coding regions on vcDNA: vcDNA=SeqID_4350; Strand=+; Position=129-380
  misc_feature (12)..(27): Xaa can be any naturally occurring amino acid
  misc_feature (75)..(81): Xaa can be any naturally occurring amino acid
PTYFCCGWHVHXXXXXXXXXXXXXXXXCDFYVALLRVFKYTFYTEFYCFLYYMVYSQLQENFLLVKFNKKLSYFXXXXXXXSI

SEQ ID NO: 24654 - protein, 63 aa, Diabrotica virgifera
  misc_feature: Coding regions on vcDNA: vcDNA=SeqID_4351; Strand=+; Position=97-288
FSDRYLRIVRAYFAFIQEGFNFLSLCVRDYSVWSIALLLSMLDHLMAYNFYCSFNTLHCILCQ

SEQ ID NO: 24655 - protein, 131 aa, Diabrotica virgifera
  misc_feature: Coding regions on vcDNA: vcDNA=SeqID_4352; Strand=+; Position=30-421
  misc_feature: Homolog annotation: Hit_ID=AAQ22984.1; Match level="QueryCoverage =96%, HitCoverage=38%, E-value=3e-19, Identity=39%"; Hit description =cathepsin L-like cysteine proteinase precursor [Acanthoscelides obtectus]
  misc_feature: Gene Ontology Annotation: Molecular function=cathepsin S activity; Cellular component=lysosome; Biological process=proteolysis and peptidolysis
  misc_feature (61)..(61): Xaa can be any naturally occurring amino acid
  misc_feature (124)..(124): Xaa can be any naturally occurring amino acid
CKIKLLILVITKLTFNCRKNIHIWNNFKETYKKPYTTKNEKFDRFKIFQDNLRKIKEHNAXYKKGQETYKMGLNQFADLTRDEFVKMLGLSKRTRPTRPQNVTFMSFSREVLADVPESVDWRDXGCSTSVK

SEQ ID NO: 24656 - protein, 138 aa, Diabrotica virgifera
  misc_feature: Coding regions on vcDNA: vcDNA=SeqID_4353; Strand=+; Position=2-415
  misc_feature: Homolog annotation: Hit_ID=CAE47500.1; Match level="QueryCoverage =100%, HitCoverage=42%, E-value=2e-75, Identity=98%"; Hit description= cathepsin L-like proteinase [Diabrotica virgifera virgifera]
  misc_feature: Gene Ontology Annotation: Molecular function=cathepsin S activity; Cellular component=extracellular space; Biological process =proteolysis and peptidolysis
  misc_feature: Pfam annotation: Pfam_ID=Peptidase_C1; Match level="Score=106.2, E -value=8.3e-29, Copies=1"; Pfam description=Papain family cysteine protease
TEVKDKGSCGSCWIFSTTGTVEGAYFLKTGKLVSLSEQNLVDCAKEDCYGCSGGYMDKALEYIETAGGIMSENDYPYEGIDDKCRFDSSKVAAKISNFTYIKKNDEDDLKNAVIAKGPISVAIDASFNFQLYDSGILD

SEQ ID NO: 24657 - protein, 41 aa, Diabrotica virgifera
  misc_feature: Coding regions on vcDNA: vcDNA=SeqID_4354; Strand=+; Position=81-206
  misc_feature (11)..(18): Xaa can be any naturally occurring amino acid
LMELVTNGKGXXXXXXXXLKISKPTKIQKPSMEGKIKPTLK

SEQ ID NO: 24658 - protein, 37 aa, Diabrotica virgifera
  misc_feature: Coding regions on vcDNA: vcDNA=SeqID_4355; Strand=+; Position=14-127
  misc_feature (21)..(27): Xaa can be any naturally occurring amino acid
VGCLEGILNFIYLMRRRNNFXXXXXXXPEYITLWIAA

SEQ ID NO: 24659 - protein, 117 aa, Diabrotica virgifera
  misc_feature: Coding regions on vcDNA: vcDNA=SeqID_4356; Strand=+; Position=1-351
FIHVCDKTILEEEKAQNTQKQVSYNLVYPAFVSHNFLEKGICLVPVKILLHSIVDNKILDVFVNTTEPSVTQPEINKSSLFCTYASSNFCWLGNSKNLRTLHPLTTESISLTAAVSG

SEQ ID NO: 24660 - protein, 25 aa, Diabrotica virgifera
  misc_feature: Coding regions on vcDNA: vcDNA=SeqID_4357; Strand=-; Position=0-74
  misc_feature (16)..(23): Xaa can be any naturally occurring amino acid
HWTILVLSRTCTTLDXXXXXXXXVV

SEQ ID NO: 24661 - protein, 50 aa, Diabrotica virgifera
  misc_feature: Coding regions on vcDNA: vcDNA=SeqID_4358; Strand=+; Position=3-155
  misc_feature (26)..(34): Xaa can be any naturally occurring amino acid
LIHFKSTQSSIGRVLKHLLYSYLITXXXXXXXXXLQRINSSTPAGTRINH

SEQ ID NO: 24662 - protein, 45 aa, Diabrotica virgifera
  misc_feature: Coding regions on vcDNA: vcDNA=SeqID_4359; Strand=+; Position=73-210
YCGIILKFYGDPVQYLYHAYQGLTVKCDLPSIFDICLCKSGRFLM

SEQ ID NO: 24663 - protein, 136 aa, Diabrotica virgifera
  misc_feature: Coding regions on vcDNA: vcDNA=SeqID_4360; Strand=+; Position=20-427
  misc_feature: Homolog annotation: Hit_ID=XP_487284.1; Match level="QueryCoverage =83%, HitCoverage=22%, E-value=2e-09, Identity=29%"; Hit description =similar to Zinc finger protein Kr18 (HKr18) [Mus musculus]
  misc_feature: Pfam annotation: Pfam_ID=zf-C2H2; Match level="Score=57.3, E-value =4.4e-14, Copies=3"; Pfam description=Zinc finger, C2H2 type
MEKHRSVSAIMLIPRCNTCNKDFTTQDEYETHKRLHDFLERQKQHEQKMLIQQQDGPQSKMAPNKPKFPCKYCNAAFSRSDTLGGHIRQYHKEHVQTEFRCNQCDRVFEKQNSLTIHLKTQDRQRSFPNPASQSKP

SEQ ID NO: 24664 - protein, 47 aa, Diabrotica virgifera
  misc_feature: Coding regions on vcDNA: vcDNA=SeqID_4361; Strand=+; Position=53-193
VCLGVLLQFLFMSEKWSVSHTWWQRGFPPNFNVNFGRPAVIFFIVIV

SEQ ID NO: 24665 - protein, 115 aa, Diabrotica virgifera
  misc_feature: Coding regions on vcDNA: vcDNA=SeqID_4362; Strand=-; Position=22-369
HFRLSTFWISSAFGILVEFKSTSGMSMFKSHRPCSILPFNLSAYRSLNDDWHWIHTIMMKNVTARCLIVILILGSKLDSKNLREKFHLSLMNKNCKTTRTYTSPRVTGRVRRSVC

SEQ ID NO: 24666 - protein, 37 aa, Diabrotica virgifera
  misc_feature: Coding regions on vcDNA: vcDNA=SeqID_4363; Strand=-; Position=29-142
RSDNTVLCNCLTVHHPTPKHCEDLNCPYTSYESTNER

SEQ ID NO: 24667 - protein, 135 aa, Diabrotica virgifera
  misc_feature: Coding regions on vcDNA: vcDNA=SeqID_4364; Strand=-; Position=0-404
  misc_feature (1)..(134): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXL

SEQ ID NO: 24668 - protein, 139 aa, Diabrotica virgifera
  misc_feature: Coding regions on vcDNA: vcDNA=SeqID_4365; Strand=+; Position=2-418
  misc_feature: Homolog annotation: Hit_ID=CAE47501.1; Match level="QueryCoverage =95%, HitCoverage=40%, E-value=8e-69, Identity=93%"; Hit description =cathepsin L-like proteinase [Diabrotica virgifera virgifera]
  misc_feature: Gene Ontology Annotation: Cellular component=extracellular space
AGRYKTLQGVVEKEEWVQFKVKNNKSYRSYVEEQTRFRIFQENLRKIENHNEKYNNGESTFKFGVTKFADLTEKEFLDLLVLSKNARPNRTHATHLLAPLRDLPSALDWRDKGAVTEVKDQGMCGSCWTFSTTGSVERA

SEQ ID NO: 24669 - protein, 96 aa, Diabrotica virgifera
  misc_feature: Coding regions on vcDNA: vcDNA=SeqID_4366; Strand=+; Position=47-337
  misc_feature: Homolog annotation: Hit_ID=XP_308768.1; Match level="QueryCoverage =94%, HitCoverage=32%, E-value=3e-21, Identity=57%"; Hit description =ENSANGP00000015059 [Anopheles gambiae]
  misc_feature: Gene Ontology Annotation: Molecular function=general RNA polymerase II transcription factor activity; Cellular component=transcription factor TFIIF complex
MSSTSVNKMSKDTHIDRDLDLSNANRGVWLVKVPKYVSELWEKASGYMEVGKLKITKPVGHAAQLSLTLSSTIRNLNEPVQECMRHDQRIDVSTVT

SEQ ID NO: 24670 - protein, 43 aa, Diabrotica virgifera
  misc_feature: Coding regions on vcDNA: vcDNA=SeqID_4367; Strand=-; Position=21-152
  misc_feature (8)..(16): Xaa can be any naturally occurring amino acid
LSIFIGIXXXXXXXXXYNSLNININFNAETFPLEAISSILKSC

SEQ ID NO: 24671 - protein, 119 aa, Diabrotica virgifera
  misc_feature: Coding regions on vcDNA: vcDNA=SeqID_4368; Strand=+; Position=26-382
  misc_feature: Homolog annotation: Hit_ID=XP_395536.1; Match level="QueryCoverage =98%, HitCoverage=38%, E-value=4e-37, Identity=60%"; Hit description =similar to CG1227-PA [Apis mellifera]
  misc_feature: Gene Ontology Annotation: Molecular function=protein kinase activity; Cellular component=cellular_component unknown; Biological process =signal transduction
  misc_feature (20)..(27): Xaa can be any naturally occurring amino acid
YCAPAKVQVCGAQDAQKLQXXXXXXXXMTYRAPELFHVESYCVIDQRVDIWSLGCVLYAMLYFKSPYDIVYEKGDSVNLAVISGTISFPQDAHFSEDVHDLIRFILKVNRSERPFIDDV

SEQ ID NO: 24672 - protein, 52 aa, Diabrotica virgifera
  misc_feature: Coding regions on vcDNA: vcDNA=SeqID_4369; Strand=+; Position=249-407
ISINTTNVLISLSLKMIHVKIHSKQGIKDMPYCLSLFSLLWFLWTNGLVLRY

SEQ ID NO: 24673 - protein, 141 aa, Diabrotica virgifera
  misc_feature: Coding regions on vcDNA: vcDNA=SeqID_4370; Strand=+; Position=3-425
  misc_feature: Homolog annotation: Hit_ID=AAH54300.1; Match level="QueryCoverage =94%, HitCoverage=39%, E-value=7e-57, Identity=76%"; Hit description =Osgep-prov protein [Xenopus laevis] sp|Q7SYR1|GCP_XENLA Probable O -sialoglycoprotein endopeptidase
  misc_feature: Gene Ontology Annotation: Molecular function=molecular_function unknown; Cellular component=cellular_component unknown; Biological process=proteolysis and peptidolysis
  misc_feature: Pfam annotation: Pfam_ID=Peptidase_M22; Match level="Score=86.0, E -value=1e-22, Copies=1"; Pfam description=Glycoprotease family
  misc_feature (139)..(139): Xaa can be any naturally occurring amino acid
RGPTQASRFNRSTNKLGIGIIKDGKVLSNCRRTYITPPGEGFLPKETAQHHRENVLVVLNEALQESQLKPEDIDVICYTKGPGMGAPLATVAVVARTVAQLWNKPLLGVNHCIGHIEMGRLITGASNPTVLYVSGGNTXII

SEQ ID NO: 24674 - protein, 72 aa, Diabrotica virgifera
  misc_feature: Coding regions on vcDNA: vcDNA=SeqID_4371; Strand=+; Position=2-220
  misc_feature (3)..(9): Xaa can be any naturally occurring amino acid
  misc_feature (23)..(35): Xaa can be any naturally occurring amino acid
  misc_feature (49)..(58): Xaa can be any naturally occurring amino acid
ATXXXXXXXARVSNEILVDVKVXXXXXXXXXXXXXYGIFIKDTFLFCTXXXXXXXXXXYMLTNFELKSANVI

SEQ ID NO: 24675 - protein, 135 aa, Diabrotica virgifera
  misc_feature: Coding regions on vcDNA: vcDNA=SeqID_4372; Strand=-; Position=2-406
  misc_feature: Homolog annotation: Hit_ID=XP_318233.1; Match level="QueryCoverage =98%, HitCoverage=47%, E-value=2e-24, Identity=38%"; Hit description =ENSANGP00000001561 [Anopheles gambiae]
ESSLKTSVFPTLWKHSYICPIFKSGNKQDITNYRSVCKQSSIPKLFDRLLHDQLKFYCKERLIHNQHGFSQNKSTVTNLVLFEQKILNALENKSQMDTIYTDFSKAFDRVDHNMLLGKLNAFGFSHQSLQWFNSF

SEQ ID NO: 24676 - protein, 123 aa, Diabrotica virgifera
  misc_feature: Coding regions on vcDNA: vcDNA=SeqID_4373; Strand=+; Position=27-398
CLNISAMSKKIVILALVCYFVAHVQCEPDVNCPDPANPGLLLFSQQVSTIFRDHISEHIPSSGTLNTGISCLVLTSDNNTSIEVVAGGVGFKYVKIEVFSLNWLQRSNYGIEIYVLQPDVKLP

SEQ ID NO: 24677 - protein, 89 aa, Diabrotica virgifera
  misc_feature: Coding regions on vcDNA: vcDNA=SeqID_4374; Strand=+; Position=33-299
  misc_feature (64)..(72): Xaa can be any naturally occurring amino acid
  misc_feature (79)..(88): Xaa can be any naturally occurring amino acid
ADNLTTREVLDKYWALRLRDCDVRYEIVRERHSFTSLQSWYYNVNLGLFKFTTDENISIRELYXXXXXXXXXQGVGSMXXXXXXXXXXF

SEQ ID NO: 24678 - protein, 64 aa, Diabrotica virgifera
  misc_feature: Coding regions on vcDNA: vcDNA=SeqID_4375; Strand=+; Position=85-279
RFFRAATQAVHLLGGNITTSHHFCDDSSVHVTPRLFTHSFGVQPNVVTNQTLLLKAPVRNHTFT

SEQ ID NO: 24679 - protein, 38 aa, Diabrotica virgifera
  misc_feature: Coding regions on vcDNA: vcDNA=SeqID_4376; Strand=-; Position=1-114
SCDPKNCINNVVSNILGDPIISPFLDGTKIVTCGYSEG

SEQ ID NO: 24680 - protein, 47 aa, Diabrotica virgifera
  misc_feature: Coding regions on vcDNA: vcDNA=SeqID_4377; Strand=+; Position=13-156
IVSIVCNSLFTLCAMWIRDYEMIMHNISFRDVSQSYGIKVLTFDLIV

SEQ ID NO: 24681 - protein, 35 aa, Diabrotica virgifera
  misc_feature: Coding regions on vcDNA: vcDNA=SeqID_4378; Strand=+; Position=3-110
  misc_feature (9)..(16): Xaa can be any naturally occurring amino acid
GLMAFACNXXXXXXXXWFLIPTVLAAIMFYFQRFV

SEQ ID NO: 24682 - protein, 104 aa, Diabrotica virgifera
  misc_feature: Coding regions on vcDNA: vcDNA=SeqID_4379; Strand=+; Position=2-316
  misc_feature: Homolog annotation: Hit_ID=XP_396770.1; Match level="QueryCoverage =96%, HitCoverage=2%, E-value=8e-13, Identity=39%"; Hit description =similar to CG11122-PA [Apis mellifera]
  misc_feature (66)..(73): Xaa can be any naturally occurring amino acid
RSCTKCTKHCKTLGELHTHILECVRDWTWMLARKKCKYIYGAKSTRIRGCLVLRVHHHKSKTDSTXXXXXXXXRPNQRTSDADTIQRMLANLPANRSTRNLVSH

SEQ ID NO: 24683 - protein, 75 aa, Diabrotica virgifera
  misc_feature: Coding regions on vcDNA: vcDNA=SeqID_4380; Strand=+; Position=86-313
  misc_feature (45)..(51): Xaa can be any naturally occurring amino acid
YIYRNAKIPILGQRIFFLYRVLIGSYLFWIIPTQFVLLSLTGFSXXXXXXXLQFSIRVIFEISNCRLLTALEISS

SEQ ID NO: 24684 - protein, 17 aa, Diabrotica virgifera
  misc_feature: Coding regions on vcDNA: vcDNA=SeqID_4381; Strand=-; Position=0-50
  misc_feature (5)..(12): Xaa can be any naturally occurring amino acid
PQIAXXXXXXXXDQVEG

SEQ ID NO: 24685 - protein, 37 aa, Diabrotica virgifera
  misc_feature: Coding regions on vcDNA: vcDNA=SeqID_4382; Strand=+; Position=119-232
YCQGSLTSHYFDYYSELNNGQNIVSYNVSDECELLFL

SEQ ID NO: 24686 - protein, 46 aa, Diabrotica virgifera
  misc_feature: Coding regions on vcDNA: vcDNA=SeqID_4383; Strand=-; Position=69-209
  misc_feature (6)..(14): Xaa can be any naturally occurring amino acid
RSAYLXXXXXXXXXNNTPLQKNYLTTVFHNKNLNPTALLNSKLVSR

SEQ ID NO: 24687 - protein, 118 aa, Diabrotica virgifera
  misc_feature: Coding regions on vcDNA: vcDNA=SeqID_4384; Strand=+; Position=38-391
  misc_feature: Homolog annotation: Hit_ID=XP_311545.1; Match level="QueryCoverage =96%, HitCoverage=51%, E-value=1e-23, Identity=48%"; Hit description =ENSANGP00000010247 [Anopheles gambiae]
  misc_feature: Gene Ontology Annotation: Molecular function=glutathione peroxidase activity; Cellular component=cellular_component unknown; Biological process=glutathione conjugation reaction
  misc_feature: Pfam annotation: Pfam_ID=GST_N; Match level="Score=78.6, E-value=1.6e- 20, Copies=1"; Pfam description=Glutathione S-transferase, N-terminal
MAHTYKLIYFDGPGKAEAIRMILSYGEIPFEDKRIQIGDWPKLKPTTPLGQLPLLEVDGKAIPQSTAICRYLASIVKLDGKDAKESLALDVAVETLFDVQKLSSEVSYEQDAAKKKEK

SEQ ID NO: 24688 - protein, 101 aa, Diabrotica virgifera
  misc_feature: Coding regions on vcDNA: vcDNA=SeqID_4385; Strand=+; Position=80-382
  misc_feature: Homolog annotation: Hit_ID=XP_397306.1; Match level="QueryCoverage =62%, HitCoverage=8%, E-value=2e-18, Identity=69%"; Hit description =similar to ENSANGP00000020121 [Apis mellifera]
  misc_feature: Gene Ontology Annotation: Molecular function=UDP-galactose transporter activity; Cellular component=Golgi membrane; Biological process=galactose transport
MMGSTRLRKNSSLVNNIRDKQPDIKIQKMTDTNSYLKYVSLLILTLQNAVFGLSMRYARTREGDMFLSSTAVLLMEVVKLITCLMIVYIDAGGLLKMFRLI

SEQ ID NO: 24689 - protein, 67 aa, Diabrotica virgifera
  misc_feature: Coding regions on vcDNA: vcDNA=SeqID_4386; Strand=+; Position=3-206
AGQSTPLNSLSLRVRSLFMLKLDFKTDEDFSATRSDFPTTNLEFMHRAVHGMVHCQYIMRIFLAKTA

SEQ ID NO: 24690 - protein, 61 aa, Diabrotica virgifera
  misc_feature: Coding regions on vcDNA: vcDNA=SeqID_4387; Strand=+; Position=148-333
  misc_feature (8)..(17): Xaa can be any naturally occurring amino acid
NHRQRILXXXXXXXXXXSRKCPKGLIPVLTETIPDMLVTSLNLPFIPVINKLLYELKIYRT

SEQ ID NO: 24691 - protein, 51 aa, Diabrotica virgifera
  misc_feature: Coding regions on vcDNA: vcDNA=SeqID_4388; Strand=+; Position=219-371
  misc_feature: Homolog annotation: Hit_ID=XP_396542.1; Match level="QueryCoverage =98%, HitCoverage=6%, E-value=2e-09, Identity=61%"; Hit description =similar to ENSANGP00000016041 [Apis mellifera]
MADSDDEYDRKRRDKFRGERAEASYRGAERVARPRDEWAERDSWSRPRPRE

SEQ ID NO: 24692 - protein, 106 aa, Diabrotica virgifera
  misc_feature: Coding regions on vcDNA: vcDNA=SeqID_4389; Strand=-; Position=55-375
  misc_feature (11)..(11): Xaa can be any naturally occurring amino acid
  misc_feature (41)..(48): Xaa can be any naturally occurring amino acid
  misc_feature (96)..(102): Xaa can be any naturally occurring amino acid
GKDTMNKEDEXDSTICNHIPFIRLGRMPTTRKLIPCTQNMXXXXXXXXAYVSFWFRADVLSPYVRFCPSRRFQWGYMITSEDAWRDRNVRMGMTSXXXXXXXGECN

SEQ ID NO: 24693 - protein, 73 aa, Diabrotica virgifera
  misc_feature: Coding regions on vcDNA: vcDNA=SeqID_4390; Strand=+; Position=212-430
  misc_feature (12)..(17): Xaa can be any naturally occurring amino acid
ASCLIYALKLYXXXXXXEDNGPEQFGLRNLFHKSPNQIISIFIIDLNANPTKTNVNNKKISNMRYIRPSTQNL

SEQ ID NO: 24694 - protein, 27 aa, Diabrotica virgifera
  misc_feature: Coding regions on vcDNA: vcDNA=SeqID_4391; Strand=-; Position=1-81
  misc_feature (7)..(14): Xaa can be any naturally occurring amino acid
  misc_feature (16)..(23): Xaa can be any naturally occurring amino acid
PKKLDSXXXXXXXXFXXXXXXXXFPIK

SEQ ID NO: 24695 - protein, 39 aa, Diabrotica virgifera
  misc_feature: Coding regions on vcDNA: vcDNA=SeqID_4392; Strand=-; Position=0-116
  misc_feature (30)..(36): Xaa can be any naturally occurring amino acid
VLCTNGLLGRTTNLTDLHSLARSAGPNGEXXXXXXXVVA

SEQ ID NO: 24696 - protein, 62 aa, Diabrotica virgifera
  misc_feature: Coding regions on vcDNA: vcDNA=SeqID_4393; Strand=+; Position=1-189
  misc_feature (4)..(10): Xaa can be any naturally occurring amino acid
  misc_feature (12)..(20): Xaa can be any naturally occurring amino acid
  misc_feature (23)..(31): Xaa can be any naturally occurring amino acid
YNTXXXXXXXSXXXXXXXXXVIXXXXXXXXXMKFHNCYFTILNILKIYNICFNYFINSNLLK

SEQ ID NO: 24697 - protein, 30 aa, Diabrotica virgifera
  misc_feature: Coding regions on vcDNA: vcDNA=SeqID_4394; Strand=-; Position=3-92
MYAYIMHAPSSADALGLTFARTCGRTFNTT

SEQ ID NO: 24698 - protein, 55 aa, Diabrotica virgifera
  misc_feature: Coding regions on vcDNA: vcDNA=SeqID_4395; Strand=-; Position=159-326
  misc_feature (5)..(32): Xaa can be any naturally occurring amino acid
  misc_feature (37)..(50): Xaa can be any naturally occurring amino acid
KKSCXXXXXXXXXXXXXXXXXXXXXXXXXXXXNFKFXXXXXXXXXXXXXXLKITY

SEQ ID NO: 24699 - protein, 24 aa, Diabrotica virgifera
  misc_feature: Coding regions on vcDNA: vcDNA=SeqID_4396; Strand=-; Position=1-72
  misc_feature (4)..(24): Xaa can be any naturally occurring amino acid
NNSXXXXXXXXXXXXXXXXXXXXX

SEQ ID NO: 24700 - protein, 44 aa, Diabrotica virgifera
  misc_feature: Coding regions on vcDNA: vcDNA=SeqID_4397; Strand=+; Position=17-152
  misc_feature: Homolog annotation: Hit_ID=XP_312540.1; Match level="QueryCoverage =93%, HitCoverage=9%, E-value=2e-10, Identity=73%"; Hit description =ENSANGP00000014900 [Anopheles gambiae]
  misc_feature (24)..(24): Xaa can be any naturally occurring amino acid
KTFCMSQKVEEPVLSGQRIKERGXDEQERCDPTGFRDAIVAGLE

SEQ ID NO: 24701 - protein, 46 aa, Diabrotica virgifera
  misc_feature: Coding regions on vcDNA: vcDNA=SeqID_4398; Strand=-; Position=1-138
HVDKTELEVPATQSSINSGRGFPRNAVSDDNDVNLNLLGPPKLEFE

SEQ ID NO: 24702 - protein, 30 aa, Diabrotica virgifera
  misc_feature: Coding regions on vcDNA: vcDNA=SeqID_4399; Strand=+; Position=1-90
  misc_feature (4)..(12): Xaa can be any naturally occurring amino acid
LLQXXXXXXXXXFFRCGPPAFSSTVGYSDW

SEQ ID NO: 24703 - protein, 63 aa, Diabrotica virgifera
  misc_feature: Coding regions on vcDNA: vcDNA=SeqID_4400; Strand=-; Position=78-269
GLAFPHTIISCSPYALLKITEFQRPMTLYITYLYFRANGPRPLKVHKIMHAFVPILHYRPLTF

SEQ ID NO: 24704 - protein, 60 aa, Diabrotica virgifera
  misc_feature: Coding regions on vcDNA: vcDNA=SeqID_4401; Strand=-; Position=2-181
LSDSSAYIYDHYLEISQNKLSMTLNVLHIPSTLLNHDQHGPTLGKFQVQTNFHPEEELKT

SEQ ID NO: 24705 - protein, 83 aa, Diabrotica virgifera
  misc_feature: Coding regions on vcDNA: vcDNA=SeqID_4402; Strand=-; Position=1-249
DKLLNNEMYDSFPIFLHIQNTLKGNKSTFHEYGVLITTLVHNAQLDKELLYNIYFSISNNVLLYMTSLEYHNRIPTQLKVPLS

SEQ ID NO: 24706 - protein, 76 aa, Diabrotica virgifera
  misc_feature: Coding regions on vcDNA: vcDNA=SeqID_4403; Strand=+; Position=31-261
VTNHKSVYGQDYLTEGVVSRRCPYAIGRHNRGDALILSEDVAVWEIYEHYDRSCIPDRFDTGVHNEYYFCLIIGLS

SEQ ID NO: 24707 - protein, 115 aa, Diabrotica virgifera
  misc_feature: Coding regions on vcDNA: vcDNA=SeqID_4404; Strand=+; Position=3-347
  misc_feature: Homolog annotation: Hit_ID=CAE47497.1; Match level="QueryCoverage =100%, HitCoverage=36%, E-value=1e-39, Identity=73%"; Hit description= cathepsin L-like proteinase [Diabrotica virgifera virgifera]
  misc_feature (20)..(20): Xaa can be any naturally occurring amino acid
  misc_feature (103)..(103): Xaa can be any naturally occurring amino acid
LFIPAAALIVASSANLGAFXKWTSFKATHSISYNVIVDILRFAVFHENLKCIEEYNAKYYSGEGTYYLAVIIFADWTSAEFEAMLDRQLANKLVKTFIGKHVXDLNVHAAHDYDW

SEQ ID NO: 24708 - protein, 67 aa, Diabrotica virgifera
  misc_feature: Coding regions on vcDNA: vcDNA=SeqID_4405; Strand=-; Position=2-202
  misc_feature (62)..(63): Xaa can be any naturally occurring amino acid
MVVASRVPIEEHVHNIDCVDANSNYTMHHECQTKSIFIVYCYTYPTSNFGCNLHLISCAKSXXNTTH

SEQ ID NO: 24709 - protein, 34 aa, Diabrotica virgifera
  misc_feature: Coding regions on vcDNA: vcDNA=SeqID_4406; Strand=+; Position=183-284
GKGVHDTGYIVFAYTAKFKTFIESLRKLGDVYVN

SEQ ID NO: 24710 - protein, 79 aa, Diabrotica virgifera
  misc_feature: Coding regions on vcDNA: vcDNA=SeqID_4407; Strand=-; Position=3-239
  misc_feature (1)..(6): Xaa can be any naturally occurring amino acid
  misc_feature (11)..(28): Xaa can be any naturally occurring amino acid
  misc_feature (57)..(79): Xaa can be any naturally occurring amino acid
XXXXXXPYLLXXXXXXXXXXXXXXXXXXLLLQKIDVFSKRITFTYKNIISNINFTIXXXXXXXXXXXXXXXXXXXXXXX

SEQ ID NO: 24711 - protein, 103 aa, Diabrotica virgifera
  misc_feature: Coding regions on vcDNA: vcDNA=SeqID_4408; Strand=-; Position=2-310
RLFTLETCSGYGYEPLRASKWPSPGLTRFAEKIRTPLQMRCYSRSKPYLRDGGFRRTRTLIQKRKLFPDLWPTSPGRFRLPRRTILRGPEFLTVPLPGTRFNT

SEQ ID NO: 24712 - protein, 79 aa, Diabrotica virgifera
  misc_feature: Coding regions on vcDNA: vcDNA=SeqID_4409; Strand=+; Position=2-241
  misc_feature: Homolog annotation: Hit_ID=CAE47497.1; Match level="QueryCoverage =100%, HitCoverage=25%, E-value=1e-27, Identity=74%"; Hit description= cathepsin L-like proteinase [Diabrotica virgifera virgifera]
GPFSTAVDADTWQLCGGGPCSSTACRSNLSHGVHAVGYTTDACIVKNSWGNSWGEQCYIRVARGEHLSGTNLMNSYPQL

SEQ ID NO: 24713 - protein, 110 aa, Diabrotica virgifera
  misc_feature: Coding regions on vcDNA: vcDNA=SeqID_4410; Strand=+; Position=1-332
  misc_feature: Homolog annotation: Hit_ID=XP_311984.1; Match level="QueryCoverage =97%, HitCoverage=95%, E-value=4e-21, Identity=50%"; Hit description =ENSANGP00000011144 [Anopheles gambiae]
  misc_feature: Pfam annotation: Pfam_ID=Ribosomal_L36e; Match level="Score=72.8, E -value=9.1e-19, Copies=1"; Pfam description=Ribosomal protein L36e
  misc_feature (49)..(49): Xaa can be any naturally occurring amino acid
  misc_feature (60)..(60): Xaa can be any naturally occurring amino acid
  misc_feature (101)..(101): Xaa can be any naturally occurring amino acid
FNSKATMAPRFEIAVGLNLGHNITSISDISNLNKVRHARLNGIQTIHIXFVRYIIREVVXRAPYEHESHGYSIKVSQDNRALQFLKPRLGTHIRSMDEAIXLSNSLTHMR

SEQ ID NO: 24714 - protein, 40 aa, Diabrotica virgifera
  misc_feature: Coding regions on vcDNA: vcDNA=SeqID_4411; Strand=-; Position=34-156
  misc_feature (3)..(14): Xaa can be any naturally occurring amino acid
  misc_feature (28)..(34): Xaa can be any naturally occurring amino acid
LKXXXXXXXXXXXXYFLDNKNSNYLALXXXXXXXFLIKYQ

SEQ ID NO: 24715 - protein, 53 aa, Diabrotica virgifera
  misc_feature: Coding regions on vcDNA: vcDNA=SeqID_4412; Strand=+; Position=1-162
  misc_feature (39)..(47): Xaa can be any naturally occurring amino acid
SFILDRVKDFILLKVTRIVMRESILLLHQINLRFVPCVXXXXXXXXXINYFRN

SEQ ID NO: 24716 - protein, 57 aa, Diabrotica virgifera
  misc_feature: Coding regions on vcDNA: vcDNA=SeqID_4413; Strand=+; Position=2-172
  misc_feature (1)..(7): Xaa can be any naturally occurring amino acid
XXXXXXXVRAMILRFGLDHSHSARFHHQYPADQSRGCETQDFVHRWRGLYLQDPVIT

SEQ ID NO: 24717 - protein, 47 aa, Diabrotica virgifera
  misc_feature: Coding regions on vcDNA: vcDNA=SeqID_4414; Strand=-; Position=227-370
ELVDFRGTLLRIPSLVLEKTITTRTVKCPVTFKLSEIWCKKTMTIVF

SEQ ID NO: 24718 - protein, 68 aa, Diabrotica virgifera
  misc_feature: Coding regions on vcDNA: vcDNA=SeqID_4415; Strand=-; Position=2-205
  misc_feature (5)..(16): Xaa can be any naturally occurring amino acid
  misc_feature (26)..(60): Xaa can be any naturally occurring amino acid
LKFEXXXXXXXXXXXXLHTVQTINLXXXXXXXXXXXXXXXXXXXXXXXXXXXXXXXXXXXTTSVQWRA

SEQ ID NO: 24719 - protein, 54 aa, Diabrotica virgifera
  misc_feature: Coding regions on vcDNA: vcDNA=SeqID_4416; Strand=+; Position=3-167
  misc_feature (1)..(5): Xaa can be any naturally occurring amino acid
XXXXXFALSDVLVPICILHNYCCDRRHFYDKVGYFLSLVNQGVDIMNHIVIDFH

SEQ ID NO: 24720 - protein, 44 aa, Diabrotica virgifera
  misc_feature: Coding regions on vcDNA: vcDNA=SeqID_4417; Strand=-; Position=119-253
KKLQTNIHTLLIVITNQRHLGKSDPLSLILNLQLSSPSYSQFTP

SEQ ID NO: 24721 - protein, 35 aa, Diabrotica virgifera
  misc_feature: Coding regions on vcDNA: vcDNA=SeqID_4418; Strand=+; Position=181-288
VVTNYLDISNELIGVMPVVLIVRHAKFMLFYENEL

SEQ ID NO: 24722 - protein, 68 aa, Diabrotica virgifera
  misc_feature: Coding regions on vcDNA: vcDNA=SeqID_4419; Strand=-; Position=3-206
SLMCVEAVGVSNRLRAQTRFVLTNACHMQPSVALKLAQSSIPAKLTFLTTMRLTARLPNLNMTLLSVK

SEQ ID NO: 24723 - protein, 62 aa, Diabrotica virgifera
  misc_feature: Coding regions on vcDNA: vcDNA=SeqID_4420; Strand=-; Position=192-380
  misc_feature (16)..(28): Xaa can be any naturally occurring amino acid
  misc_feature (41)..(50): Xaa can be any naturally occurring amino acid
  misc_feature (54)..(62): Xaa can be any naturally occurring amino acid
QVKKVLPNSLVKPMYXXXXXXXXXXXXXSLLNISDINQYVXXXXXXXXXXPMYXXXXXXXXX

SEQ ID NO: 24724 - protein, 52 aa, Diabrotica virgifera
  misc_feature: Coding regions on vcDNA: vcDNA=SeqID_4421; Strand=+; Position=149-304
HLMLSLLFQIWIYPMLLTFLRFRSWMREVLVAPEYGVYPLYLCRFPSALMGD

SEQ ID NO: 24725 - protein, 44 aa, Diabrotica virgifera
  misc_feature: Coding regions on vcDNA: vcDNA=SeqID_4422; Strand=+; Position=70-201
QLHWGVLPQVTFDITKWYTATLRVLSRSNCGKITVCDYIAFKPL

SEQ ID NO: 24726 - protein, 45 aa, Diabrotica virgifera
  misc_feature: Coding regions on vcDNA: vcDNA=SeqID_4423; Strand=+; Position=16-153
VVLLLFAISMGSCYTTILNGIGYIMSSSKITFSGCKHIVGASTST

SEQ ID NO: 24727 - protein, 51 aa, Diabrotica virgifera
  misc_feature: Coding regions on vcDNA: vcDNA=SeqID_4424; Strand=+; Position=34-186
PKGRSQTHRGRVKAFPREDPSLPVHLTGLQMLRELEGTHMWREAEIPASLI

SEQ ID NO: 24728 - protein, 40 aa, Diabrotica virgifera
  misc_feature: Coding regions on vcDNA: vcDNA=SeqID_4425; Strand=+; Position=3-122
  misc_feature (3)..(10): Xaa can be any naturally occurring amino acid
TTXXXXXXXXDTAYLGYYCTSRSQGPCGTVMAFAAHVSLM

SEQ ID NO: 24729 - protein, 68 aa, Diabrotica virgifera
  misc_feature: Coding regions on vcDNA: vcDNA=SeqID_4426; Strand=+; Position=2-208
RLDKYFNLVIRSTYAGQVYVLNLRPTSLYTFCLNKDFGHASGTSFITCGRTAGHLAFRLPTGQVTEPL

SEQ ID NO: 24730 - protein, 78 aa, Diabrotica virgifera
  misc_feature: Coding regions on vcDNA: vcDNA=SeqID_4427; Strand=-; Position=161-397
LVELAPISFSLYRPSYLNRSPAFLSSCLQFLYYPVSFFFSSSSSFPYLISLFVYLKANIQCIEASPNTHLRYSVSLPI

SEQ ID NO: 24731 - protein, 54 aa, Diabrotica virgifera
  misc_feature: Coding regions on vcDNA: vcDNA=SeqID_4428; Strand=+; Position=236-397
NILIGTIQLFYFICRLEETIYDAEDIDDIIFTPTCFFGMSFLFCYKYCIINITV

SEQ ID NO: 24732 - protein, 35 aa, Diabrotica virgifera
  misc_feature: Coding regions on vcDNA: vcDNA=SeqID_4429; Strand=-; Position=33-140
  misc_feature (6)..(15): Xaa can be any naturally occurring amino acid
VNRHYXXXXXXXXXXKLQYYRHYNTNQTVTSQLSN

SEQ ID NO: 24733 - protein, 29 aa, Diabrotica virgifera
  misc_feature: Coding regions on vcDNA: vcDNA=SeqID_4430; Strand=-; Position=2-88
SPHPTEDHTRANHAPNNTNPVNTREARTN

SEQ ID NO: 24734 - protein, 66 aa, Diabrotica virgifera
  misc_feature: Coding regions on vcDNA: vcDNA=SeqID_4431; Strand=-; Position=208-408
  misc_feature (1)..(6): Xaa can be any naturally occurring amino acid
XXXXXXVLNRPSCYTNSIVSTKFKALSLMCSSKICEKYEYYYLKVTNNRLSSLKIVNPNRYVTSKF

SEQ ID NO: 24735 - protein, 66 aa, Diabrotica virgifera
  misc_feature: Coding regions on vcDNA: vcDNA=SeqID_4432; Strand=-; Position=2-199
  misc_feature (1)..(7): Xaa can be any naturally occurring amino acid
  misc_feature (11)..(63): Xaa can be any naturally occurring amino acid
XXXXXXXLTFXXXXXXXXXXXXXXXXXXXXXXXXXXXXXXXXXXXXXXXXXXXXXXXXXXXXXFTI

SEQ ID NO: 24736 - protein, 56 aa, Diabrotica virgifera
  misc_feature: Coding regions on vcDNA: vcDNA=SeqID_4433; Strand=-; Position=2-169
  misc_feature (21)..(50): Xaa can be any naturally occurring amino acid
MLYYYLNQSDFIRYLTRLAFXXXXXXXXXXXXXXXXXXXXXXXXXXXXXXFRRVDR

SEQ ID NO: 24737 - protein, 79 aa, Diabrotica virgifera
  misc_feature: Coding regions on vcDNA: vcDNA=SeqID_4434; Strand=+; Position=16-255
VIHTGNMKCTSVNILAILLVFSSAVIRCDIDTLSKIYPLSTIELDFLQHLHKSIEYILDFWNEPSTLRGLVDVRVSPSD

SEQ ID NO: 24738 - protein, 87 aa, Diabrotica virgifera
  misc_feature: Coding regions on vcDNA: vcDNA=SeqID_4435; Strand=+; Position=102-365
  misc_feature: Homolog annotation: Hit_ID=CAE47500.1; Match level="QueryCoverage =96%, HitCoverage=25%, E-value=3e-15, Identity=51%"; Hit description =cathepsin L-like proteinase [Diabrotica virgifera virgifera]
  misc_feature (30)..(30): Xaa can be any naturally occurring amino acid
  misc_feature (38)..(38): Xaa can be any naturally occurring amino acid
  misc_feature (56)..(56): Xaa can be any naturally occurring amino acid
MMKVVIFNSRAIAAFHALRDNDYWVQFKVXYGTCHRNXVQEQNRFTLFQDILTKVXHLFDIDWDGQSTCTLGVTKFSDLTEKDFTAL

SEQ ID NO: 24739 - protein, 70 aa, Diabrotica virgifera
  misc_feature: Coding regions on vcDNA: vcDNA=SeqID_4436; Strand=+; Position=28-240
  misc_feature (37)..(37): Xaa can be any naturally occurring amino acid
CRDTGQHIARLKWSFAGHNARQTDSRWNTTIQQWRPXAGKRARGRSQMRWGDDIKKIGGTHWKQNALNRS

SEQ ID NO: 24740 - protein, 60 aa, Diabrotica virgifera
  misc_feature: Coding regions on vcDNA: vcDNA=SeqID_4437; Strand=+; Position=251-430
  misc_feature (42)..(48): Xaa can be any naturally occurring amino acid
  misc_feature (50)..(50): Xaa can be any naturally occurring amino acid
TLIFGATRRTGSGVRFEQVDFHQHFFQSLCNILLCIYSIFCXXXXXXXHXNQTNLIIVCE

SEQ ID NO: 24741 - protein, 140 aa, Diabrotica virgifera
  misc_feature: Coding regions on vcDNA: vcDNA=SeqID_4438; Strand=+; Position=3-422
  misc_feature: Homolog annotation: Hit_ID=NP_572638.1; Match level="QueryCoverage =100%, HitCoverage=22%, E-value=1e-10, Identity=26%"; Hit description= CG2124-PA [Drosophila melanogaster] gb|AAF46606.1| CG2124-PA [Drosophila melanogaster]
  misc_feature (38)..(50): Xaa can be any naturally occurring amino acid
  misc_feature (104)..(113): Xaa can be any naturally occurring amino acid
NFHDVWSCLDDICCWKIIEWDMEKSFTVANAWYKLRLXXXXXXXXXXXXXTAKRADDLTKEQLLSIYFYLNVYRKRAVDFEYEFALEKLVNDMDIDEMGVVAMXXXXXXXXXXLVNIQEALAKKVIENSSTAHDITLTAI

SEQ ID NO: 24742 - protein, 45 aa, Diabrotica virgifera
  misc_feature: Coding regions on vcDNA: vcDNA=SeqID_4439; Strand=+; Position=29-166
DHVMKSSLHDLNKKNFSLHYQIFLYRKFLFISPNFICHGYCCIFN

SEQ ID NO: 24743 - protein, 39 aa, Diabrotica virgifera
  misc_feature: Coding regions on vcDNA: vcDNA=SeqID_4440; Strand=+; Position=3-122
KNIKTFVYLNMIFKEKQYTYYLIFMFFANSLYNFFHIKG

SEQ ID NO: 24744 - protein, 54 aa, Diabrotica virgifera
  misc_feature: Coding regions on vcDNA: vcDNA=SeqID_4441; Strand=+; Position=1-162
  misc_feature (1)..(5): Xaa can be any naturally occurring amino acid
XXXXXDENKRGGPPQGSPLLWRGGVFNRPPLFSPPVVCLAPFFTGLTRVTPGFS

SEQ ID NO: 24745 - protein, 76 aa, Diabrotica virgifera
  misc_feature: Coding regions on vcDNA: vcDNA=SeqID_4442; Strand=-; Position=150-380
  misc_feature (26)..(39): Xaa can be any naturally occurring amino acid
KFRMFLRYKLCLYLKEYTPTNVGCIXXXXXXXXXXXXXXPKYHHNKITTIGLSTNSQIFFNHCRYLLMKIIPWVVL

SEQ ID NO: 24746 - protein, 43 aa, Diabrotica virgifera
  misc_feature: Coding regions on vcDNA: vcDNA=SeqID_4443; Strand=+; Position=162-293
  misc_feature (13)..(22): Xaa can be any naturally occurring amino acid
FLNILQQYNYLRXXXXXXXXXXMYNLKNDTFISCNFNLVIRNN

SEQ ID NO: 24747 - protein, 124 aa, Diabrotica virgifera
  misc_feature: Coding regions on vcDNA: vcDNA=SeqID_4444; Strand=+; Position=2-373
  misc_feature: Homolog annotation: Hit_ID=EAL40127.1; Match level="QueryCoverage =96%, HitCoverage=34%, E-value=6e-38, Identity=66%"; Hit description =ENSANGP00000027029 [Anopheles gambiae str. PEST] ref|XP_557301.1| ENSANGP00000027029 [Anopheles gambiae st
  misc_feature: Pfam annotation: Pfam_ID=HEAT; Match level="Score=26.3, E-value=9.6e -05, Copies=2"; Pfam description=HEAT repeat
PRVREHQETHRAAAADTLAYLTEVDSNLQQVAAISNQLVSALVDLLKCPSVAARGAAFRAFASLGANDEDIRKRIIDTKCLMDRVVDGLGDDNKEIRLAAVRCLHSLSRSVQQLRTTFQDHSVW

SEQ ID NO: 24748 - protein, 42 aa, Diabrotica virgifera
  misc_feature: Coding regions on vcDNA: vcDNA=SeqID_4445; Strand=-; Position=22-150
  misc_feature (10)..(21): Xaa can be any naturally occurring amino acid
LIILDTQGTXXXXXXXXXXXXYHNTNYLSLIKIINYFDYNIQ

SEQ ID NO: 24749 - protein, 21 aa, Diabrotica virgifera
  misc_feature: Coding regions on vcDNA: vcDNA=SeqID_4446; Strand=-; Position=1-63
LVFTQLCKSLPKLFFVLLPIG

SEQ ID NO: 24750 - protein, 23 aa, Diabrotica virgifera
  misc_feature: Coding regions on vcDNA: vcDNA=SeqID_4447; Strand=-; Position=0-68
  misc_feature (22)..(22): Xaa can be any naturally occurring amino acid
NQRHRGDTQQLSAGPRPDLLRXL

SEQ ID NO: 24751 - protein, 35 aa, Diabrotica virgifera
  misc_feature: Coding regions on vcDNA: vcDNA=SeqID_4448; Strand=-; Position=2-106
  misc_feature (18)..(35): Xaa can be any naturally occurring amino acid
SITLTKLTISHISNDKCXXXXXXXXXXXXXXXXXX

SEQ ID NO: 24752 - protein, 137 aa, Diabrotica virgifera
  misc_feature: Coding regions on vcDNA: vcDNA=SeqID_4449; Strand=+; Position=2-412
  misc_feature (94)..(107): Xaa can be any naturally occurring amino acid
  misc_feature (127)..(127): Xaa can be any naturally occurring amino acid
DDYKKRTREQSECNIRTHEQCDSTSDMNIPPREQNDNGNHSNTRTHEVSDNETDSNKRTHEQSSSSDAFNNRTHEQSGSGSGSNKRSLQQSPSXXXXXXXXXXXXXXGSGYNKRSHEQSDHGSGSNXFIHEESDNDD

SEQ ID NO: 24753 - protein, 45 aa, Diabrotica virgifera
  misc_feature: Coding regions on vcDNA: vcDNA=SeqID_4450; Strand=+; Position=87-224
RIQRKLAKFLVETEISQQNFKYDAYIFYSPFLINLYQEKTTINLK

SEQ ID NO: 24754 - protein, 129 aa, Diabrotica virgifera
  misc_feature: Coding regions on vcDNA: vcDNA=SeqID_4451; Strand=+; Position=1-387
  misc_feature: Homolog annotation: Hit_ID=A32713; Match level="QueryCoverage=96%, HitCoverage=14%, E-value=2e-25, Identity=44%"; Hit description =reverse transcriptase homolog - fruit fly (Drosophila melanogaster)
SSTGSVLGPVLYLLYTCDIPVLENNTVATFADDTAIQAVGTTSEEATNKVQIAVNQIYKWTQKWRIRLNEAKSVHVNFTNKKIQYIPVIINNIQVPYADTAKYLGITLDAKLRWKVHVKKRKGRTKYKI

SEQ ID NO: 24755 - protein, 63 aa, Diabrotica virgifera
  misc_feature: Coding regions on vcDNA: vcDNA=SeqID_4452; Strand=-; Position=0-188
QQREVLEQPSCQAWDGYKIDGFRTCHGHGTIQISIATRHGGLLIDVMTTETWHRRLVDAAIKL

SEQ ID NO: 24756 - protein, 56 aa, Diabrotica virgifera
  misc_feature: Coding regions on vcDNA: vcDNA=SeqID_4453; Strand=+; Position=1-171
  misc_feature: Homolog annotation: Hit_ID=AAL13583.1; Match level="QueryCoverage =75%, HitCoverage=7%, E-value=9e-09, Identity=69%"; Hit description =GH12682p [Drosophila melanogaster]
LLTKTKFMPEPEGWRRSHRPSIRDISIINEEEEKEPQEVSSDSGQIKTIAVIKEVV

SEQ ID NO: 24757 - protein, 88 aa, Diabrotica virgifera
  misc_feature: Coding regions on vcDNA: vcDNA=SeqID_4454; Strand=-; Position=2-265
NPIVSFAVFVITSLKYFHVSSTDSPVCCDTVRLIASFSLNLFLIHSCFRASTLYLFLLLIFWFLSLANFIFSLALISMWSDPTSAPLK

SEQ ID NO: 24758 - protein, 66 aa, Diabrotica virgifera
  misc_feature: Coding regions on vcDNA: vcDNA=SeqID_4455; Strand=-; Position=35-235
  misc_feature (30)..(40): Xaa can be any naturally occurring amino acid
YKCRNNHFKTLEIYTFTFEYIEFFFENFYXXXXXXXXXXXKKFRILGYAANEKRTLSSFRNPSFRS

SEQ ID NO: 24759 - protein, 41 aa, Diabrotica virgifera
  misc_feature: Coding regions on vcDNA: vcDNA=SeqID_4456; Strand=-; Position=3-125
  misc_feature (23)..(33): Xaa can be any naturally occurring amino acid
EAPLADSSLGIYPHFKFNPYVAXXXXXXXXXXXIRIYFGGL

SEQ ID NO: 24760 - protein, 51 aa, Diabrotica virgifera
  misc_feature: Coding regions on vcDNA: vcDNA=SeqID_4457; Strand=-; Position=13-168
  misc_feature (15)..(20): Xaa can be any naturally occurring amino acid
ATHDTSSSQGSRKSXXXXXXADRVCFSVINCYYCHRMSADSQHGHMRPLMC

SEQ ID NO: 24761 - protein, 63 aa, Diabrotica virgifera
  misc_feature: Coding regions on vcDNA: vcDNA=SeqID_4458; Strand=+; Position=32-223
  misc_feature (45)..(45): Xaa can be any naturally occurring amino acid
NWPITRVKRPCGPGKTSMREQMKMREFNDLQFTSHLSSAEKIQRXNGPYILIQMSNTNTNKNE

SEQ ID NO: 24762 - protein, 140 aa, Diabrotica virgifera
  misc_feature: Coding regions on vcDNA: vcDNA=SeqID_4459; Strand=-; Position=1-420
  misc_feature (1)..(36): Xaa can be any naturally occurring amino acid
  misc_feature (43)..(53): Xaa can be any naturally occurring amino acid
  misc_feature (59)..(91): Xaa can be any naturally occurring amino acid
  misc_feature (98)..(110): Xaa can be any naturally occurring amino acid
  misc_feature (118)..(124): Xaa can be any naturally occurring amino acid
  misc_feature (127)..(137): Xaa can be any naturally occurring amino acid
XXXXXXXXXXXXXXXXXXXXXXXXXXXXXXXXXXXXLLSKSMXXXXXXXXXXXDYLSLXXXXXXXXXXXXXXXXXXXXXXXXXXXXXXXXXSLLPRFXXXXXXXXXXXXXLTLLFTYXXXXXXXTFXXXXXXXXXXXGRL

SEQ ID NO: 24763 - protein, 66 aa, Diabrotica virgifera
  misc_feature: Coding regions on vcDNA: vcDNA=SeqID_4460; Strand=-; Position=1-198
  misc_feature (50)..(55): Xaa can be any naturally occurring amino acid
SQSLSAILLNPDTSKFTARAERLRTEITPLDHRTMSLTIIAPTDRKYSVXXXXXXLASLSTFVGRC

SEQ ID NO: 24764 - protein, 51 aa, Diabrotica virgifera
  misc_feature: Coding regions on vcDNA: vcDNA=SeqID_4461; Strand=-; Position=29-184
  misc_feature (10)..(16): Xaa can be any naturally occurring amino acid
FLKLYRLYCXXXXXXXYEHKYKFSLKSIKTVTFSSNHVSQLSVIKIMIILP

SEQ ID NO: 24765 - protein, 52 aa, Diabrotica virgifera
  misc_feature: Coding regions on vcDNA: vcDNA=SeqID_4462; Strand=-; Position=1-156
YQTRSIKSHFSDLVHKYYLINYFLALDVVSGKYIVYFLFLMLFLTLFNAQYA

SEQ ID NO: 24766 - protein, 44 aa, Diabrotica virgifera
  misc_feature: Coding regions on vcDNA: vcDNA=SeqID_4463; Strand=-; Position=27-161
MLIISLKLAYLAKMSVAARDLSMRVGYTYTSGRRRVDDKMYSKL

SEQ ID NO: 24767 - protein, 83 aa, Diabrotica virgifera
  misc_feature: Coding regions on vcDNA: vcDNA=SeqID_4464; Strand=+; Position=2-253
SESAIGGKDTKLLIIIGGLVAAVGVAAFAYNIMKKRKATAAESRVPTQMNGNGDRNDPEEGREMKPLMKSPQPNSSVEYKDEK

SEQ ID NO: 24768 - protein, 66 aa, Diabrotica virgifera
  misc_feature: Coding regions on vcDNA: vcDNA=SeqID_4465; Strand=+; Position=137-337
  misc_feature (5)..(15): Xaa can be any naturally occurring amino acid
CWSLXXXXXXXXXXXRGIYSSLLLRSVNVLQMGSTIFIFGACFSKVFTGEFRGDPHQFPLEKNPFC

SEQ ID NO: 24769 - protein, 137 aa, Diabrotica virgifera
  misc_feature: Coding regions on vcDNA: vcDNA=SeqID_4466; Strand=-; Position=1-411
  misc_feature (4)..(98): Xaa can be any naturally occurring amino acid
  misc_feature (100)..(119): Xaa can be any naturally occurring amino acid
  misc_feature (124)..(135): Xaa can be any naturally occurring amino acid
LLYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTXXXXXXXXXXXXXXXXXXXXFFKFXXXXXXXXXXXXPE

SEQ ID NO: 24770 - protein, 118 aa, Diabrotica virgifera
  misc_feature: Coding regions on vcDNA: vcDNA=SeqID_4467; Strand=+; Position=1-357
  misc_feature: Homolog annotation: Hit_ID=XP_321324.1; Match level="QueryCoverage =100%, HitCoverage=15%, E-value=3e-58, Identity=92%"; Hit description= ENSANGP00000012825 [Anopheles gambiae]
  misc_feature: Gene Ontology Annotation: Molecular function=GTPase activator activity; Cellular component=membrane; Biological process=vesicle -mediated transport
  misc_feature: Pfam annotation: Pfam_ID=Gelsolin; Match level="Score=34.1, E-value =4.2e-07, Copies=1"; Pfam description=Gelsolin repeat
  misc_feature (58)..(58): Xaa can be any naturally occurring amino acid
LYPQFMYHLRRSQFLQVFTNSPDETSFYRHMLMREDLTQSLIMIQPNLYSYSFNGPSXPVLLDTSSIQPDRILLMDTFFQILIFHGETIAQWRSLKYQDMPEYENFRQLLQAPVDDAQ

SEQ ID NO: 24771 - protein, 81 aa, Diabrotica virgifera
  misc_feature: Coding regions on vcDNA: vcDNA=SeqID_4468; Strand=+; Position=41-286
  misc_feature (10)..(44): Xaa can be any naturally occurring amino acid
  misc_feature (47)..(58): Xaa can be any naturally occurring amino acid
IRGNHFFLLXXXXXXXXXXXXXXXXXXXXXXXXXXXXXXXXXXXICXXXXXXXXXXXXNQINKLFLVYNLYLHNLTFYRKP

SEQ ID NO: 24772 - protein, 56 aa, Diabrotica virgifera
  misc_feature: Coding regions on vcDNA: vcDNA=SeqID_4469; Strand=-; Position=200-370
  misc_feature (10)..(16): Xaa can be any naturally occurring amino acid
  misc_feature (21)..(28): Xaa can be any naturally occurring amino acid
IILKIIWSYXXXXXXXVNVLXXXXXXXXLKDSVVFNKALILVTNKLINVFASQAQS

SEQ ID NO: 24773 - protein, 106 aa, Diabrotica virgifera
  misc_feature: Coding regions on vcDNA: vcDNA=SeqID_4470; Strand=+; Position=2-319
PVYNMFAFIFLCLLLQTLTFPPTLGRDADQNEYPLIVAVESCNFPVCYPQCAGVVLSKSWILTLGSCAYVATNFDHYRINAGVVNVTSEGAQLRDIEKALLHPEFN

SEQ ID NO: 24774 - protein, 100 aa, Diabrotica virgifera
  misc_feature: Coding regions on vcDNA: vcDNA=SeqID_4471; Strand=+; Position=1-303
NYSSAWGTREVTVAAKAHDATQDATPSASPAPAPISSQPLSFFGNSKDNAGSLEFSFGRLFKLVCCTYDSSGEETEVLTIIQTSIQTMHEFLAQMDNHKL

SEQ ID NO: 24775 - protein, 53 aa, Diabrotica virgifera
  misc_feature: Coding regions on vcDNA: vcDNA=SeqID_4472; Strand=-; Position=2-160
FTDEFMIPVTQVAKMKLITPRIKIPSGMTTGLSLLHAVGHCQKRFLDFKLCID

SEQ ID NO: 24776 - protein, 61 aa, Diabrotica virgifera
  misc_feature: Coding regions on vcDNA: vcDNA=SeqID_4473; Strand=+; Position=255-437
  misc_feature: Homolog annotation: Hit_ID=XP_484011.1; Match level="QueryCoverage =91%, HitCoverage=7%, E-value=5e-16, Identity=67%"; Hit description =PREDICTED: similar to Ddx5 protein [Mus musculus]
  misc_feature: Gene Ontology Annotation: Molecular function=RNA helicase activity; Cellular component=nucleus; Biological process=cell growth
  misc_feature (32)..(37): Xaa can be any naturally occurring amino acid
YVLSYLDVEGIKYVVNYDYPHSSEDYIHRIGXXXXXXSAGTSYAFFTPSNYKQARDLISVL

SEQ ID NO: 24777 - protein, 44 aa, Diabrotica virgifera
  misc_feature: Coding regions on vcDNA: vcDNA=SeqID_4474; Strand=-; Position=162-296
  misc_feature (29)..(40): Xaa can be any naturally occurring amino acid
TIIVVASIIIDLNYPFKLRCDPYSMILLXXXXXXXXXXXXDPNI

SEQ ID NO: 24778 - protein, 138 aa, Diabrotica virgifera
  misc_feature: Coding regions on vcDNA: vcDNA=SeqID_4475; Strand=+; Position=27-440
  misc_feature: Homolog annotation: Hit_ID=PC1123; Match level="QueryCoverage=78%, HitCoverage=16%, E-value=3e-16, Identity=39%"; Hit description =hypothetical protein - bloodfluke planorb (fragment)
RGPTQASTHASAHASETWLSEDIPDNWREYRVIPILKTNRNPDSAESYRGISLSSCITKTLERMIKLRLESWLEKNNKLSQTQFGFRKNHSTVEAVSHLVTDINLAFTKNSSVIALLLDVEAAYDNVNLNILYNRMIQ

SEQ ID NO: 24779 - protein, 57 aa, Diabrotica virgifera
  misc_feature: Coding regions on vcDNA: vcDNA=SeqID_4476; Strand=+; Position=17-187
  misc_feature (2)..(8): Xaa can be any naturally occurring amino acid
SXXXXXXXLLPPLLLHVPIYVPSHNRLILRPPTVILAPCVFTTTVSLIIYAIFTNSM

SEQ ID NO: 24780 - protein, 50 aa, Diabrotica virgifera
  misc_feature: Coding regions on vcDNA: vcDNA=SeqID_4477; Strand=-; Position=114-266
TNTFRVCFSSTLAYAAILTQIIGVGRYALDRFALLPEIGRFALYTLIPES

SEQ ID NO: 24781 - protein, 70 aa, Diabrotica virgifera
  misc_feature: Coding regions on vcDNA: vcDNA=SeqID_4478; Strand=+; Position=1-213
THKSASSEGCLPYVIAFISIRQQCICTDYNICAMILQEVRLTYKLSKLTLHPTSQISPHDDSNRCMLVHE

SEQ ID NO: 24782 - protein, 45 aa, Diabrotica virgifera
  misc_feature: Coding regions on vcDNA: vcDNA=SeqID_4479; Strand=-; Position=3-140
YLTRWFQCQFRHLLRSSYFMTVLYRRNDVTHWHVHWCRMLINAIT

SEQ ID NO: 24783 - protein, 65 aa, Diabrotica virgifera
  misc_feature: Coding regions on vcDNA: vcDNA=SeqID_4480; Strand=+; Position=146-340
QTTPILSLKNSRLRHGKHGRHGKRFPFPCGYFSSSSQENEQNSQSEKEEQNPLCDKEGTPGRRRR

SEQ ID NO: 24784 - protein, 86 aa, Diabrotica virgifera
  misc_feature: Coding regions on vcDNA: vcDNA=SeqID_4481; Strand=+; Position=39-299
  misc_feature (63)..(68): Xaa can be any naturally occurring amino acid
SYDNYSVLVINTPYLLKWSSRLKNNYEYNKWSCLLYRWESRVKFLVLFHNQYNFLTTNIVIQXXXXXXRLQVGFAFVSTVIDRVIH

SEQ ID NO: 24785 - protein, 119 aa, Diabrotica virgifera
  misc_feature: Coding regions on vcDNA: vcDNA=SeqID_4482; Strand=+; Position=1-360
  misc_feature: Homolog annotation: Hit_ID=EAL31447.1; Match level="QueryCoverage =99%, HitCoverage=8%, E-value=5e-10, Identity=33%"; Hit description =GA15974-PA [Drosophila pseudoobscura]
VYSSYHGYGGIVNWILVRPTLQITAKLSYCMYLIHGLVITHATLITRDRLFFSDWVEFNNWCAYFIVSFLLAFVWSLAFESPLIIIEKLIFGGATPRKSKPKNKSENAENTQDVQNAAV

SEQ ID NO: 24786 - protein, 91 aa, Diabrotica virgifera
  misc_feature: Coding regions on vcDNA: vcDNA=SeqID_4483; Strand=-; Position=95-370
EYHLWHSLTSHSFDVAQISYILCFDRRRYLWLFIQFFKFFVGSYSPLTFYLHTPIYYSLIFLFLLSERSVSEFFSTHVSHAYVTVGLITVL

SEQ ID NO: 24787 - protein, 90 aa, Diabrotica virgifera
  misc_feature: Coding regions on vcDNA: vcDNA=SeqID_4484; Strand=+; Position=1-273
  misc_feature (6)..(30): Xaa can be any naturally occurring amino acid
RPTTSXXXXXXXXXXXXXXXXXXXXXXXXXHKDVPGYLSSSVAKLVCNELSSGNHVAILPHWSVVHILWSSSSPSALSIARLTGFIRIAL

SEQ ID NO: 24788 - protein, 89 aa, Diabrotica virgifera
  misc_feature: Coding regions on vcDNA: vcDNA=SeqID_4485; Strand=+; Position=30-296
  misc_feature (14)..(21): Xaa can be any naturally occurring amino acid
NRSLFIFIQYYLYXXXXXXXXKNSNWLDLVMMILSVVQYCKQSKLIQVEYWNSVPFFAPVYLIHLVVGILFSRASPLSNLVGRSYMTVL

SEQ ID NO: 24789 - protein, 66 aa, Diabrotica virgifera
  misc_feature: Coding regions on vcDNA: vcDNA=SeqID_4486; Strand=+; Position=111-311
  misc_feature (58)..(64): Xaa can be any naturally occurring amino acid
NNTLRRESAIISNTSEIVLIFQFYLNNYKKHRFFCNKKRKYFVSVSTVLMHHLMLVQXXXXXXXNN

SEQ ID NO: 24790 - protein, 78 aa, Diabrotica virgifera
  misc_feature: Coding regions on vcDNA: vcDNA=SeqID_4487; Strand=+; Position=11-247
  misc_feature (37)..(50): Xaa can be any naturally occurring amino acid
MVIHLEIVIETFWPYSTMSTRKLLSTVILGGICTPLXXXXXXXXXXXXXXRINAVFEGCRRKLSTGTETQRVFRLSVT

SEQ ID NO: 24791 - protein, 53 aa, Diabrotica virgifera
  misc_feature: Coding regions on vcDNA: vcDNA=SeqID_4488; Strand=-; Position=195-356
CANFSRLLVCHCCCVFYAVTEVIVTSAMKCIILLNSVATFSRYLLFWYIFDII

SEQ ID NO: 24792 - protein, 75 aa, Diabrotica virgifera
  misc_feature: Coding regions on vcDNA: vcDNA=SeqID_4489; Strand=+; Position=119-346
TIATLTIQNIYQNAMTSVRLAEQKANFVYREECDKETLFLQSSSQHNSFTKFLKPHLNEFGINLMFVPTRRRTVM

SEQ ID NO: 24793 - protein, 126 aa, Diabrotica virgifera
  misc_feature: Coding regions on vcDNA: vcDNA=SeqID_4490; Strand=+; Position=1-378
  misc_feature: Homolog annotation: Hit_ID=XP_320480.1; Match level="QueryCoverage =100%, HitCoverage=21%, E-value=3e-46, Identity=69%"; Hit description= ENSANGP00000015819 [Anopheles gambiae]
NHPYGYSNMKYVASLISGVGIFCVGTGLSVYHGISGLLHPTPLEDFFWAYFILCGSLVSEGATWLVAFNSIRKGAREVNMTVKEYIFRGQDPSVNVVLLEDFAAVIGVIVAAGCMGVSSVTNSPVP

SEQ ID NO: 24794 - protein, 50 aa, Diabrotica virgifera
  misc_feature: Coding regions on vcDNA: vcDNA=SeqID_4491; Strand=+; Position=18-167
IYHNNSNNNNFKETTSHTGKSFIILTTTYFSSDNINICSSRLTMVFQIFL

SEQ ID NO: 24795 - protein, 120 aa, Diabrotica virgifera
  misc_feature: Coding regions on vcDNA: vcDNA=SeqID_4492; Strand=-; Position=2-361
  misc_feature (4)..(58): Xaa can be any naturally occurring amino acid
  misc_feature (62)..(78): Xaa can be any naturally occurring amino acid
  misc_feature (84)..(95): Xaa can be any naturally occurring amino acid
  misc_feature (101)..(113): Xaa can be any naturally occurring amino acid
FLIXXXXXXXXXXXXXXXXXXXXXXXXXXXXXXXXXXXXXXXXXXXXXXXXXXXXXXXHSIXXXXXXXXXXXXXXXXXASFNLXXXXXXXXXXXXLFPRVXXXXXXXXXXXXXLPLLITF

SEQ ID NO: 24796 - protein, 96 aa, Diabrotica virgifera
  misc_feature: Coding regions on vcDNA: vcDNA=SeqID_4493; Strand=+; Position=3-293
  misc_feature: Pfam annotation: Pfam_ID=TAP_C; Match level="Score=27.5, E-value=4.1e- 05, Copies=1"; Pfam description=TAP C-terminal domain
SFKQPRSVIRTIEFPKSESDHQKAINAFKRITTLDTQWAKRCLEDRQYNMKMALLLFVDLYKQNKIPPDGFVKTGTNNTYEGVGNDQYNQNKKMRV

SEQ ID NO: 24797 - protein, 59 aa, Diabrotica virgifera
  misc_feature: Coding regions on vcDNA: vcDNA=SeqID_4494; Strand=-; Position=1-177
  misc_feature (29)..(58): Xaa can be any naturally occurring amino acid
KITHIQNKLNSKLTTTPYIDNFPNKILYXXXXXXXXXXXXXXXXXXXXXXXXXXXXXXT

SEQ ID NO: 24798 - protein, 50 aa, Diabrotica virgifera
  misc_feature: Coding regions on vcDNA: vcDNA=SeqID_4495; Strand=+; Position=23-175
KRLSTHSKVYRIRGAPSNIYSVMVCLGLLHRGCTTVFIMNSRSRSQLSYL

SEQ ID NO: 24799 - protein, 90 aa, Diabrotica virgifera
  misc_feature: Coding regions on vcDNA: vcDNA=SeqID_4496; Strand=-; Position=0-269
  misc_feature (7)..(7): Xaa can be any naturally occurring amino acid
  misc_feature (11)..(44): Xaa can be any naturally occurring amino acid
  misc_feature (50)..(86): Xaa can be any naturally occurring amino acid
WIYLKTXTISXXXXXXXXXXXXXXXXXXXXXXXXXXXXXXXXXXLFPRFXXXXXXXXXXXXXXXXXXXXXXXXXXXXXXXXXXXXXNSDA

SEQ ID NO: 24800 - protein, 98 aa, Diabrotica virgifera
  misc_feature: Coding regions on vcDNA: vcDNA=SeqID_4497; Strand=-; Position=127-423
  misc_feature (15)..(22): Xaa can be any naturally occurring amino acid
  misc_feature (51)..(57): Xaa can be any naturally occurring amino acid
  misc_feature (66)..(72): Xaa can be any naturally occurring amino acid
IKKLCLNIQLHYSNXXXXXXXXSNYGYSSSFYYNYDNYFIITFTKKSHSSXXXXXXXKSKIQPSDXXXXXXXTRYVKNMNSSQLLSAFIIHNILIRRM

SEQ ID NO: 24801 - protein, 42 aa, Diabrotica virgifera
  misc_feature: Coding regions on vcDNA: vcDNA=SeqID_4498; Strand=-; Position=107-235
VLNSYIKPRYHHEIYNLPVLLPSSVLKVNNINVYCTKLSSKL

SEQ ID NO: 24802 - protein, 130 aa, Diabrotica virgifera
  misc_feature: Coding regions on vcDNA: vcDNA=SeqID_4499; Strand=+; Position=1-390
  misc_feature: Homolog annotation: Hit_ID=XP_320129.1; Match level="QueryCoverage =70%, HitCoverage=20%, E-value=3e-15, Identity=38%"; Hit description =ENSANGP00000008931 [Anopheles gambiae] gb|EAA00711.1| ENSANGP00000008931 [Anopheles gambiae
ARVCTSRLVARWDSLTELDIRDNPWTCDCENQWLIDELMPIYIKIDENSAKQVMCAAPIEMEKTSFHQLLVRQSQMRCLDSYGHRPEKDGLLLVGVLTDKNVEETNKPPDALPESDESEQESDDDYVEMN

SEQ ID NO: 24803 - protein, 53 aa, Diabrotica virgifera
  misc_feature: Coding regions on vcDNA: vcDNA=SeqID_4500; Strand=-; Position=2-160
VILDHCLIQHFLCKYLLFLCNLKVVASFLFRKSVTTRKKPAVFHYFVNNGFHV

SEQ ID NO: 24804 - protein, 73 aa, Diabrotica virgifera
  misc_feature: Coding regions on vcDNA: vcDNA=SeqID_4501; Strand=+; Position=12-233
  misc_feature (4)..(43): Xaa can be any naturally occurring amino acid
PDVXXXXXXXXXXXXXXXXXXXXXXXXXXXXXXXXXXXXXXXXPQEDQALLFLVIKFKFLQNCPLSSFNGPPF

SEQ ID NO: 24805 - protein, 66 aa, Diabrotica virgifera
  misc_feature: Coding regions on vcDNA: vcDNA=SeqID_4502; Strand=+; Position=120-317
VHHFLISLVIGINISSRHYLEIVGIMTYEVELHHRLAFNAQSCEAHDRSISDIWNFRNNICYDCNW

SEQ ID NO: 24806 - protein, 71 aa, Diabrotica virgifera
  misc_feature: Coding regions on vcDNA: vcDNA=SeqID_4503; Strand=-; Position=2-214
  misc_feature (12)..(28): Xaa can be any naturally occurring amino acid
  misc_feature (33)..(40): Xaa can be any naturally occurring amino acid
  misc_feature (47)..(54): Xaa can be any naturally occurring amino acid
EPYKLLLLKSYXXXXXXXXXXXXXXXXXSKPLXXXXXXXXLTINAFXXXXXXXXPVKILLIIQKSDVCADA

SEQ ID NO: 24807 - protein, 52 aa, Diabrotica virgifera
  misc_feature: Coding regions on vcDNA: vcDNA=SeqID_4504; Strand=+; Position=130-288
RVTNNFLKSESSSHASAIVVVQMLDDGASVIHHSVLSSLCVKCNPIIGRGCR

SEQ ID NO: 24808 - protein, 47 aa, Diabrotica virgifera
  misc_feature: Coding regions on vcDNA: vcDNA=SeqID_4505; Strand=-; Position=122-265
  misc_feature (13)..(13): Xaa can be any naturally occurring amino acid
NQIILIVFLYFSXCSRSRQYIYNVETLKAVKNNCVHRRNSCSELRSY

SEQ ID NO: 24809 - protein, 22 aa, Diabrotica virgifera
  misc_feature: Coding regions on vcDNA: vcDNA=SeqID_4506; Strand=-; Position=1-66
FFSPYTITIHYLNKIRRFFGRV

SEQ ID NO: 24810 - protein, 58 aa, Diabrotica virgifera
  misc_feature: Coding regions on vcDNA: vcDNA=SeqID_4507; Strand=-; Position=2-178
  misc_feature (1)..(7): Xaa can be any naturally occurring amino acid
  misc_feature (13)..(22): Xaa can be any naturally occurring amino acid
  misc_feature (35)..(46): Xaa can be any naturally occurring amino acid
XXXXXXXGLPFLXXXXXXXXXXPLKFSPFSSFKFXXXXXXXXXXXXLVPQVPKINFPL

SEQ ID NO: 24811 - protein, 64 aa, Diabrotica virgifera
  misc_feature: Coding regions on vcDNA: vcDNA=SeqID_4508; Strand=-; Position=1-192
  misc_feature (2)..(13): Xaa can be any naturally occurring amino acid
  misc_feature (19)..(27): Xaa can be any naturally occurring amino acid
  misc_feature (39)..(61): Xaa can be any naturally occurring amino acid
IXXXXXXXXXXXXLETQVXXXXXXXXXLNFFLPLLFTYXXXXXXXXXXXXXXXXXXXXXXXTCP

SEQ ID NO: 24812 - protein, 118 aa, Diabrotica virgifera
  misc_feature: Coding regions on vcDNA: vcDNA=SeqID_4509; Strand=+; Position=64-417
  misc_feature: Homolog annotation: Hit_ID=XP_313976.1; Match level="QueryCoverage =99%, HitCoverage=48%, E-value=2e-47, Identity=76%"; Hit description =ENSANGP00000010006 [Anopheles gambiae]
  misc_feature: Gene Ontology Annotation: Cellular component=nucleus; Biological process=intracellular protein transport
  misc_feature: Pfam annotation: Pfam_ID=SNF7; Match level="Score=19.9, E-value=6e -07, Copies=1"; Pfam description=SNF7
YKMNRLFGKGKPKEPGPSITDVISGVDQRAEGVEKKINALENDLRKFRDQMSKMREGPAKNAVKQKALKILKQKKMYEGQLENLRGQSFNMEQANFAHQALKDTQVTVVAMRDGMKEM

SEQ ID NO: 24813 - protein, 142 aa, Diabrotica virgifera
  misc_feature: Coding regions on vcDNA: vcDNA=SeqID_4510; Strand=+; Position=1-426
  misc_feature: Homolog annotation: Hit_ID=EAL25002.1; Match level="QueryCoverage =99%, HitCoverage=27%, E-value=1e-36, Identity=46%"; Hit description =GA18094-PA [Drosophila pseudoobscura]
  misc_feature: Gene Ontology Annotation: Molecular function=UDP-glycosyltransferase activity; Cellular component=membrane fraction; Biological process =metabolism
NLLPHPNVKLFITHGGFLSTIETLYHGIPTVAVPVVHDQQTNAKQAEKNGYSIVVDYNTLTEQQLSAAIEEILSNPKYRQNAKTRSKIFHDRPVKPMDEAVFWVEYIARHNGAKHLRVAYVDLAWYQYYLLDVFGLIFGTIF

SEQ ID NO: 24814 - protein, 90 aa, Diabrotica virgifera
  misc_feature: Coding regions on vcDNA: vcDNA=SeqID_4511; Strand=-; Position=148-420
  misc_feature (1)..(12): Xaa can be any naturally occurring amino acid
  misc_feature (21)..(55): Xaa can be any naturally occurring amino acid
  misc_feature (61)..(70): Xaa can be any naturally occurring amino acid
  misc_feature (83)..(90): Xaa can be any naturally occurring amino acid
XXXXXXXXXXXXYKLIPKTIXXXXXXXXXXXXXXXXXXXXXXXXXXXXXXXXXXXLHKTYXXXXXXXXXXNKIALLNAKIITXXXXXXXX

SEQ ID NO: 24815 - protein, 35 aa, Diabrotica virgifera
  misc_feature: Coding regions on vcDNA: vcDNA=SeqID_4512; Strand=+; Position=183-290
SSHNIGDPVGNSRFFGSLNPMEVVWKPKYAAFNFH

SEQ ID NO: 24816 - protein, 37 aa, Diabrotica virgifera
  misc_feature: Coding regions on vcDNA: vcDNA=SeqID_4513; Strand=+; Position=37-150
VSQKIGIVRISEPTIPVLHVPIYDYGYVYKFLNLIIL

SEQ ID NO: 24817 - protein, 96 aa, Diabrotica virgifera
  misc_feature: Coding regions on vcDNA: vcDNA=SeqID_4514; Strand=-; Position=52-342
KTAGDHAAKLKWSFAGHNARLKDKRWNHELQQWRPWLGRSRGRPQMRWADDIKKFGGHNWKQVAQNRQHWIELREAMSKVGLLKAEEEEECVLFTL

SEQ ID NO: 24818 - protein, 87 aa, Diabrotica virgifera
  misc_feature: Coding regions on vcDNA: vcDNA=SeqID_4515; Strand=+; Position=176-436
  misc_feature (56)..(62): Xaa can be any naturally occurring amino acid
  misc_feature (71)..(71): Xaa can be any naturally occurring amino acid
LLSTNQLLKIKYLLTMANPFSTMYHSLDSILSILRKPENLAIHGVKELLQIYEHAXXXXXXXETSGDSRRXPFIVLEGLDGSRKSTV

SEQ ID NO: 24819 - protein, 39 aa, Diabrotica virgifera
  misc_feature: Coding regions on vcDNA: vcDNA=SeqID_4516; Strand=-; Position=53-172
STLNLMNLSYPLMLTLKIVTNECLCLARGLASSLNILGY

SEQ ID NO: 24820 - protein, 77 aa, Diabrotica virgifera
  misc_feature: Coding regions on vcDNA: vcDNA=SeqID_4517; Strand=+; Position=89-322
  misc_feature (45)..(65): Xaa can be any naturally occurring amino acid
IKGRSTIDAIHVLTQTIEKSYEHDIELHILFIDFQQAFNSIYRQXXXXXXXXXXXXXXXXXXXXXRCPKGIQANVNI

SEQ ID NO: 24821 - protein, 51 aa, Diabrotica virgifera
  misc_feature: Coding regions on vcDNA: vcDNA=SeqID_4518; Strand=-; Position=2-154
ILYCILFTTYPCMPTILCLEYVSFDLSILSHHYPMIIKLRMCPVQLTSIMI

SEQ ID NO: 24822 - protein, 96 aa, Diabrotica virgifera
  misc_feature: Coding regions on vcDNA: vcDNA=SeqID_4519; Strand=+; Position=51-341
  misc_feature (6)..(12): Xaa can be any naturally occurring amino acid
  misc_feature (23)..(34): Xaa can be any naturally occurring amino acid
  misc_feature (78)..(89): Xaa can be any naturally occurring amino acid
LITIVXXXXXXXVRDFTSCTLYXXXXXXXXXXXXLSNLTELNNENFYCTAQTLHHLFVTICYSLLNISNLLRDNFDLXXXXXXXXXXXXLTNIQYL

SEQ ID NO: 24823 - protein, 89 aa, Diabrotica virgifera
  misc_feature: Coding regions on vcDNA: vcDNA=SeqID_4520; Strand=+; Position=2-271
  misc_feature: Homolog annotation: Hit_ID=XP_395941.1; Match level="QueryCoverage =87%, HitCoverage=45%, E-value=4e-12, Identity=37%"; Hit description =similar to ENSANGP00000012978 [Apis mellifera]
  misc_feature (64)..(64): Xaa can be any naturally occurring amino acid
RTNSIPYNARSLGVCLLGSFKDTNPPNVQLKALEDFLSCAAADHKIIADYHLIGHRQADKTECXGDRVHAVIEKWPHFEANPQDAPKKL

SEQ ID NO: 24824 - protein, 28 aa, Diabrotica virgifera
  misc_feature: Coding regions on vcDNA: vcDNA=SeqID_4521; Strand=+; Position=71-154
FTHILYSITSFIFTALSTFYYYLMSLLL

SEQ ID NO: 24825 - protein, 55 aa, Diabrotica virgifera
  misc_feature: Coding regions on vcDNA: vcDNA=SeqID_4522; Strand=+; Position=2-169
RTRGLFSKNKRCFFSTDRNTLLFLLVILTVVMYWMTDVKIESDLVSRDAICRRLD

SEQ ID NO: 24826 - protein, 40 aa, Diabrotica virgifera
  misc_feature: Coding regions on vcDNA: vcDNA=SeqID_4523; Strand=+; Position=98-220
VYITCVKGRPHLPGSQFNYPYMQYVHSQNNRSRFLSMTYY

SEQ ID NO: 24827 - protein, 41 aa, Diabrotica virgifera
  misc_feature: Coding regions on vcDNA: vcDNA=SeqID_4524; Strand=+; Position=2-127
  misc_feature (27)..(32): Xaa can be any naturally occurring amino acid
MIILAIQSNGVQQDGGGVVNQLNKLSXXXXXXFDEYNNLLT

SEQ ID NO: 24828 - protein, 110 aa, Diabrotica virgifera
  misc_feature: Coding regions on vcDNA: vcDNA=SeqID_4525; Strand=-; Position=3-332
  misc_feature (60)..(106): Xaa can be any naturally occurring amino acid
SISVISLKHLGFSLRVSFHFSHVFFKYFSYTIYGIYLALLNSKLLILYFLIDYPCYTGSXXXXXXXXXXXXXXXXXXXXXXXXXXXXXXXXXXXXXXXXXXXXXXXSGCC

SEQ ID NO: 24829 - protein, 19 aa, Diabrotica virgifera
  misc_feature: Coding regions on vcDNA: vcDNA=SeqID_4526; Strand=+; Position=3-62
SRIILISDYFLVLVAIPFS

SEQ ID NO: 24830 - protein, 73 aa, Diabrotica virgifera
  misc_feature: Coding regions on vcDNA: vcDNA=SeqID_4527; Strand=+; Position=180-398
YDCSNGHPFLMTCPAGQLSCNLRSTCDWAAHVNCSYLVTTPDPYTATTYYIIYMIIPVNLLFILVSLVSKIMI

SEQ ID NO: 24831 - protein, 94 aa, Diabrotica virgifera
  misc_feature: Coding regions on vcDNA: vcDNA=SeqID_4528; Strand=+; Position=124-408
  misc_feature (22)..(22): Xaa can be any naturally occurring amino acid
  misc_feature (84)..(89): Xaa can be any naturally occurring amino acid
SNYGCLVFLFSFLQLTPMFLLXKSSVINFFEQICYVRSFSSIIIDDTYILSYLVIGYFYSLDFLADFRQKSIFKDNKLAMDVFXXXXXXRVRYF

SEQ ID NO: 24832 - protein, 76 aa, Diabrotica virgifera
  misc_feature: Coding regions on vcDNA: vcDNA=SeqID_4529; Strand=+; Position=2-229
  misc_feature (4)..(11): Xaa can be any naturally occurring amino acid
  misc_feature (39)..(39): Xaa can be any naturally occurring amino acid
  misc_feature (41)..(48): Xaa can be any naturally occurring amino acid
  misc_feature (64)..(64): Xaa can be any naturally occurring amino acid
IICXXXXXXXXHPLTCGLILLIQTIFTSVITGLINYNYXFXXXXXXXXVGGILILFIYITRIAXILRFILMNNLIK

SEQ ID NO: 24833 - protein, 118 aa, Diabrotica virgifera
  misc_feature: Coding regions on vcDNA: vcDNA=SeqID_4530; Strand=+; Position=41-394
  misc_feature: Homolog annotation: Hit_ID=NP_649476.1; Match level="QueryCoverage =97%, HitCoverage=15%, E-value=1e-24, Identity=50%"; Hit description =CG1078-PA [Drosophila melanogaster] gb|AAF52120.1| CG1078-PA [Drosophila melanogaster]
  misc_feature: Gene Ontology Annotation: Biological process=mRNA polyadenylation
  misc_feature: Pfam annotation: Pfam_ID=Fip1; Match level="Score=72.0, E-value=1.6e -18, Copies=1"; Pfam description=Fip1 motif
  misc_feature (53)..(53): Xaa can be any naturally occurring amino acid
  misc_feature (62)..(62): Xaa can be any naturally occurring amino acid
GGLLSAVGDKNKHIKQQQQPGKFTVVEFDQAGSINGVLASEFNLDSLEDKPWXKPGADNTEXFNYRFNEDTWRAYCERQNRITVNESRTGLVPMTMMSGLPRGPMPIMNDNSIDTGNF

SEQ ID NO: 24834 - protein, 44 aa, Diabrotica virgifera
  misc_feature: Coding regions on vcDNA: vcDNA=SeqID_4531; Strand=-; Position=1-132
RVVLPYPPILVSLNSIHRVRSLRLVASRSSWVVTMIADHIRSRG

SEQ ID NO: 24835 - protein, 49 aa, Diabrotica virgifera
  misc_feature: Coding regions on vcDNA: vcDNA=SeqID_4532; Strand=+; Position=28-177
LTCCSSRSFTRSFYSIIYQLHRIITGIEVIYMLLHYVIGLLLTLCLTWH

SEQ ID NO: 24836 - protein, 46 aa, Diabrotica virgifera
  misc_feature: Coding regions on vcDNA: vcDNA=SeqID_4533; Strand=-; Position=3-140
RLARPNQSVVTPCSLSGPPQMVQKLLTLVTRSWSSRSNRASTLLYI

SEQ ID NO: 24837 - protein, 74 aa, Diabrotica virgifera
  misc_feature: Coding regions on vcDNA: vcDNA=SeqID_4534; Strand=+; Position=175-396
  misc_feature: Homolog annotation: Hit_ID=XP_392888.1; Match level="QueryCoverage =86%, HitCoverage=16%, E-value=4e-10, Identity=53%"; Hit description =similar to ENSANGP00000020336 [Apis mellifera]
  misc_feature (68)..(73): Xaa can be any naturally occurring amino acid
MSTMDSTVSSSSPPLDLNSTQNTEIVESALEHDPIFLQTKLCQTVAGLFVWAALFLTCSQIYHHLRWXXXXXXQ

SEQ ID NO: 24838 - protein, 61 aa, Diabrotica virgifera
  misc_feature: Coding regions on vcDNA: vcDNA=SeqID_4535; Strand=-; Position=192-377
YKNNTLATHNRLTRSFYHPQLHACAPKQTNLRPSTTQKVLIYFNNMKQQIPPTICPSISCY

SEQ ID NO: 24839 - protein, 99 aa, Diabrotica virgifera
  misc_feature: Coding regions on vcDNA: vcDNA=SeqID_4536; Strand=+; Position=3-299
  misc_feature (46)..(82): Xaa can be any naturally occurring amino acid
SLGSLPTPLVVFLQYDFLGHYDDYVGEFTVLRAYFYLYISAHMSNXXXXXXXXXXXXXXXXXXXXXXXXXXXXXXXXXXXXXSILREVSLIGLPIWLYL

SEQ ID NO: 24840 - protein, 47 aa, Diabrotica virgifera
  misc_feature: Coding regions on vcDNA: vcDNA=SeqID_4537; Strand=-; Position=8-151
  misc_feature (24)..(37): Xaa can be any naturally occurring amino acid
LHLRCVLKTQLCLIRINPSVQPPXXXXXXXXXXXXXXAASYAWVARK

SEQ ID NO: 24841 - protein, 119 aa, Diabrotica virgifera
  misc_feature: Coding regions on vcDNA: vcDNA=SeqID_4538; Strand=+; Position=18-374
LIQYESYFVEVPVDPSERYTWIFEKIVKIFHEPGESINNIKEYLDTWLLNTIYITQLRDEAIARRDQHSSRNTSNVCCTICRRRYFTQSQHPLLTCTSYILLNLYTTGKTMGWFKGVTP

SEQ ID NO: 24842 - protein, 33 aa, Diabrotica virgifera
  misc_feature: Coding regions on vcDNA: vcDNA=SeqID_4539; Strand=-; Position=2-100
  misc_feature (1)..(24): Xaa can be any naturally occurring amino acid
XXXXXXXXXXXXXXXXXXXXXXXXNIATHFRVL

SEQ ID NO: 24843 - protein, 100 aa, Diabrotica virgifera
  misc_feature: Coding regions on vcDNA: vcDNA=SeqID_4540; Strand=+; Position=74-376
  misc_feature (3)..(9): Xaa can be any naturally occurring amino acid
  misc_feature (73)..(78): Xaa can be any naturally occurring amino acid
  misc_feature (81)..(93): Xaa can be any naturally occurring amino acid
RSXXXXXXXAYIPGDLMEKSGLISSVNNFCNEKAILKFINSNVLIKKLKGMTRIIQQDNNIERIPRQMIFVTXXXXXXPQXXXXXXXXXXXXXLDAPVET

SEQ ID NO: 24844 - protein, 60 aa, Diabrotica virgifera
  misc_feature: Coding regions on vcDNA: vcDNA=SeqID_4541; Strand=-; Position=169-351
GGEMGGALLIVTQNVERGDVHRGQKGVTPGVSQGRQFKKRALKIVMGAALGGSKMVVQGI

SEQ ID NO: 24845 - protein, 113 aa, Diabrotica virgifera
  misc_feature: Coding regions on vcDNA: vcDNA=SeqID_4542; Strand=+; Position=37-378
  misc_feature: Homolog annotation: Hit_ID=XP_313347.1; Match level="QueryCoverage =76%, HitCoverage=33%, E-value=2e-20, Identity=51%"; Hit description =ENSANGP00000011331 [Anopheles gambiae] gb|EAA08952.1| ENSANGP00000011331 [Anopheles gambiae
  misc_feature: Pfam annotation: Pfam_ID=Arv1; Match level="Score=-68.9, E-value =0.0039, Copies=1"; Pfam description=Arv1-like family
  misc_feature (39)..(45): Xaa can be any naturally occurring amino acid
MDVMNKRYFCINCGNEVKSLYREYSKTVLKLTECDNCKXXXXXXXEYDTVIVVIDLLLLRIMAYRHILLNSEFKNFWKLPIGLILLETYMTWILTKEFPLERHKDISNITSFE

SEQ ID NO: 24846 - protein, 58 aa, Diabrotica virgifera
  misc_feature: Coding regions on vcDNA: vcDNA=SeqID_4543; Strand=-; Position=0-173
  misc_feature (3)..(13): Xaa can be any naturally occurring amino acid
  misc_feature (50)..(56): Xaa can be any naturally occurring amino acid
ICXXXXXXXXXXXFCFVLCRSLRPFIFAFHFEFFSLLYFLDGKLVMFFEXXXXXXXLG

SEQ ID NO: 24847 - protein, 130 aa, Diabrotica virgifera
  misc_feature: Coding regions on vcDNA: vcDNA=SeqID_4544; Strand=+; Position=1-390
  misc_feature: Homolog annotation: Hit_ID=NP_648918.1; Match level="QueryCoverage =95%, HitCoverage=23%, E-value=8e-24, Identity=46%"; Hit description =CG9701-PA [Drosophila melanogaster] gb|AAF49418.2| CG9701-PA [Drosophila melanogaster]
  misc_feature: Gene Ontology Annotation: Cellular component=endoplasmic reticulum
FRRTQSRLPEFTDAEKAALKGNADYFALNTYTGNLVKSIPDPPRFNIPSRYQDVGVLTYTDPKWESSSLDWLKVAPWGIVDLLNFIKNNYNDPDIMVTENGLCDKGGLDDPRRVNYHKLYLSYIHDAMIN

SEQ ID NO: 24848 - protein, 137 aa, Diabrotica virgifera
  misc_feature: Coding regions on vcDNA: vcDNA=SeqID_4545; Strand=+; Position=5-415
  misc_feature: Homolog annotation: Hit_ID=XP_320245.1; Match level="QueryCoverage =100%, HitCoverage=24%, E-value=9e-39, Identity=52%"; Hit description= ENSANGP00000016471 [Anopheles gambiae]
  misc_feature: Gene Ontology Annotation: Molecular function=cytochrome P450 activity; Cellular component=microsome; Biological process=electron transport
MNYETLMKMKYLDMVISESLRKWPSFPLSDRWCNKTYTLEPEAPNEKPIIIQKDLLIIIPIKAIHRDPKYFPDPERFDPERFSDENKDKIDPYTYLPFGLGPRNCIGSRFALMEIKSWFAHVLHNFEIVPTADTQIP

SEQ ID NO: 24849 - protein, 121 aa, Diabrotica virgifera
  misc_feature: Coding regions on vcDNA: vcDNA=SeqID_4546; Strand=+; Position=3-365
  misc_feature (6)..(26): Xaa can be any naturally occurring amino acid
PSDTRXXXXXXXXXXXXXXXXXXXXXGRRASRVTTSFILHGGSSILSTRGGCPDRSMLIYSLRKGQTPPIFYPNLHSRNSLFHLRAWKNPGFTHFNSLCSTTPFCKMGSSRECPTQSPFRK

SEQ ID NO: 24850 - protein, 97 aa, Diabrotica virgifera
  misc_feature: Coding regions on vcDNA: vcDNA=SeqID_4547; Strand=+; Position=91-381
  misc_feature: Homolog annotation: Hit_ID=XP_469689.1; Match level="QueryCoverage =100%, HitCoverage=70%, E-value=4e-46, Identity=97%"; Hit description= putative histone H2A protein [Oryza sativa (japonica cultivar-group)] gb|AAP12995.1| putative
  misc_feature: Gene Ontology Annotation: Molecular function=chromatin binding; Cellular component=nucleus; Biological process=establishment and/or maintenance of chromatin architecture
  misc_feature: Pfam annotation: Pfam_ID=Histone; Match level="Score=52.8, E-value=1e- 12, Copies=1"; Pfam description=Core histone H2A/H2B/H3/H4
MAGKGGKGLLAAKTTAAKTAEKDKGKKAPISRSSRAGLQFPVGRIHRQLKQRTQANGRVGATAAVYSAAILEYLTAEVLELAGNASKDLKVKRITPR

SEQ ID NO: 24851 - protein, 68 aa, Diabrotica virgifera
  misc_feature: Coding regions on vcDNA: vcDNA=SeqID_4548; Strand=+; Position=162-365
VCEFFMTNVESMDYTHSHHSTIASLSSTAQLSLVPYTHHIPSLKKPIPNYYGISIATPRYIATQLFTV

SEQ ID NO: 24852 - protein, 106 aa, Diabrotica virgifera
  misc_feature: Coding regions on vcDNA: vcDNA=SeqID_4549; Strand=+; Position=1-318
  misc_feature: Homolog annotation: Hit_ID=XP_480536.1; Match level="QueryCoverage =77%, HitCoverage=25%, E-value=7e-26, Identity=68%"; Hit description =unknown protein [Oryza sativa (japonica cultivar-group)] dbj|BAD03699.1| unknown protein [Oryza
  misc_feature (58)..(58): Xaa can be any naturally occurring amino acid
DAEYGYKGAKLSSEDGKYGGNSGRNYSKILSGQDMLESLSTATSLDLLSDAGEVVLSXELKRCPTFSNLKTLSLGEWCMAADFDALIFLLQHSPNIKRLFLQLKLN

SEQ ID NO: 24853 - protein, 83 aa, Diabrotica virgifera
  misc_feature: Coding regions on vcDNA: vcDNA=SeqID_4550; Strand=-; Position=0-248
  misc_feature (8)..(14): Xaa can be any naturally occurring amino acid
  misc_feature (35)..(35): Xaa can be any naturally occurring amino acid
IGMLEFPXXXXXXXYSHGDRDGLWQHRRYQSSVGXRVRRSSCFFVIPIRVFLISTPTWHIPQFHNPCQDLHRLRRKGQGPRVV

SEQ ID NO: 24854 - protein, 143 aa, Diabrotica virgifera
  misc_feature: Coding regions on vcDNA: vcDNA=SeqID_4551; Strand=+; Position=1-429
  misc_feature: Homolog annotation: Hit_ID=AAU44123.1; Match level="QueryCoverage =96%, HitCoverage=20%, E-value=4e-45, Identity=65%"; Hit description =putative polyprotein [Oryza sativa (japonica cultivar-group)] gb|AAT85159.1| unknown protein [Oryza sativa
  misc_feature: Pfam annotation: Pfam_ID=rve; Match level="Score=17.8, E-value =0.00036, Copies=1"; Pfam description=Integrase core domain
  misc_feature (107)..(115): Xaa can be any naturally occurring amino acid
GSTRFCKEILPVHGVPKTIVSDRDVKFLSYFWKTLCAKLKIKLLFSTAYHPQTDGQTEVTNHTLSTLLHVLIKKNIKEWEECLPITEFAYNRARHSTTGKSPFEVIXXXXXXXXXEILPLPLQERISIEASACVNHLKKFYED

SEQ ID NO: 24855 - protein, 131 aa, Diabrotica virgifera
  misc_feature: Coding regions on vcDNA: vcDNA=SeqID_4552; Strand=-; Position=2-394
  misc_feature (19)..(24): Xaa can be any naturally occurring amino acid
HWEMICTRKVRSIATYIQXXXXXXPRQENQMYASKIDMKKVMTRNMELGEELKSTCDGYEEEIAVRVEKSEDQKKKLGIFMGDPEPEEDIHPKDNIIIDDTDSNPDSDDDYEDEAGVDIMESSTDQYFWPT

SEQ ID NO: 24856 - protein, 90 aa, Diabrotica virgifera
  misc_feature: Coding regions on vcDNA: vcDNA=SeqID_4553; Strand=+; Position=70-339
  misc_feature: Homolog annotation: Hit_ID=AAQ62074.1; Match level="QueryCoverage =100%, HitCoverage=23%, E-value=4e-46, Identity=96%"; Hit description= ribosomal protein L3 [Triticum aestivum] gb|AAQ21397.1| ribosomal protein L3 [Triticum aestivum]
  misc_feature: Gene Ontology Annotation: Molecular function=structural constituent of ribosome; Cellular component=cytosolic ribosome (sensu Eukarya); Biological process=protein biosynthesis
MSHRKFEHPRHGSLGFLARKRCSRHRGKVKAFPKDDQQKPCHLTAFLGYKAGMTHIVREVEKPGSKLHKKETCEAVTIIETPPLVIVGPV

SEQ ID NO: 24857 - protein, 50 aa, Diabrotica virgifera
  misc_feature: Coding regions on vcDNA: vcDNA=SeqID_4554; Strand=-; Position=1-150
TLGEKELRETWLGGKGQTGLIWMVHKEQQNRGVGQGVRARVSRTCVWLRG

SEQ ID NO: 24858 - protein, 119 aa, Diabrotica virgifera
  misc_feature: Coding regions on vcDNA: vcDNA=SeqID_4555; Strand=+; Position=3-359
  misc_feature: Pfam annotation: Pfam_ID=Di19; Match level="Score=17.3, E-value=2.1e -07, Copies=1"; Pfam description=Drought induced 19 protein (Di19)
LECPFCGEEFDGVGLCLHIEDEHAAETKAGVCPICTDRVGMDLVGHMTSEHPSFFKGRWRNQRVSSGSPSSMYSALKKDAAHIQYRYGGSSRATSLNTVPDPLLSSFVGSFIDDDAHSP

SEQ ID NO: 24859 - protein, 83 aa, Diabrotica virgifera
  misc_feature: Coding regions on vcDNA: vcDNA=SeqID_4556; Strand=+; Position=1-252
  misc_feature: Homolog annotation: Hit_ID=CAA44311.1; Match level="QueryCoverage =100%, HitCoverage=54%, E-value=4e-36, Identity=92%"; Hit description= cytoplasmatic ribosomal protein S13 [Zea mays] pir||S30146 ribosomal protein S13, cytosolic - maize sp|Q0
  misc_feature: Gene Ontology Annotation: Molecular function=structural constituent of ribosome; Cellular component=cytosolic ribosome (sensu Eukarya); Biological process=protein biosynthesis
  misc_feature: Pfam annotation: Pfam_ID=Ribosomal_S15; Match level="Score=74.9, E -value=2.2e-19, Copies=1"; Pfam description=Ribosomal protein S15
SRILRILKAHGLAPEIPEELYFLIKKAVAIRKHLEMNRKDKDSKFRLILVESMIHRLARYYKRTMKLPPTCKYESTTASTLVA

SEQ ID NO: 24860 - protein, 115 aa, Diabrotica virgifera
  misc_feature: Coding regions on vcDNA: vcDNA=SeqID_4557; Strand=+; Position=2-346
GSSRTYRSVHSVLRTKECVCVCVYVCIKCSESSSKHFAPCLSMQSVGGTQAQGKGREGTKSIREKGTGRDQIIVIARCSHCCALPPLLQLALLLLFSLYRTRQFPLRHLAVQIDR

SEQ ID NO: 24861 - protein, 75 aa, Diabrotica virgifera
  misc_feature: Coding regions on vcDNA: vcDNA=SeqID_4558; Strand=+; Position=1-228
  misc_feature: Homolog annotation: Hit_ID=XP_468456.1; Match level="QueryCoverage =92%, HitCoverage=10%, E-value=1e-19, Identity=73%"; Hit description =putative NAC2 [Oryza sativa (japonica cultivar-group)] dbj|BAD22894.1| putative NAC2 [Oryza
NESKWPLQKNGVFNLLLSFTVESNVSTKSITFDDEPAATRVSTVPTVLRGGLYLFFVSAMILMLSFKVGSCIYSR

SEQ ID NO: 24862 - protein, 76 aa, Diabrotica virgifera
  misc_feature: Coding regions on vcDNA: vcDNA=SeqID_4559; Strand=+; Position=78-308
  misc_feature: Homolog annotation: Hit_ID=NP_912963.1; Match level="QueryCoverage =98%, HitCoverage=99%, E-value=2e-31, Identity=70%"; Hit description =unnamed protein product [Oryza sativa (japonica cultivar-group)] dbj|BAA90391.1| hypothetical
  misc_feature: Pfam annotation: Pfam_ID=DSS1_SEM1; Match level="Score=115.2, E-value= 1.6e-31, Copies=1"; Pfam description=DSS1/SEM1 family
MAAAAPADAKAEAAKMDLLEDDDEFEEFEIDQEWDDKEDGNEAVQQWEDDWDDDDVNDDFSLQLRKELEGGNTQKS

SEQ ID NO: 24863 - protein, 86 aa, Diabrotica virgifera
  misc_feature: Coding regions on vcDNA: vcDNA=SeqID_4560; Strand=+; Position=3-260
RVMQEWWGDLGYRVPTCRWQAKEGQCAPIVQTQGKTSVHLIQHAFIRSRASSRGYTFKAYKRNDSRSVPSRGSIRSRDIVEVGGTR

SEQ ID NO: 24864 - protein, 25 aa, Diabrotica virgifera
  misc_feature: Coding regions on vcDNA: vcDNA=SeqID_4561; Strand=-; Position=2-76
  misc_feature (9)..(23): Xaa can be any naturally occurring amino acid
VFSLLVYNXXXXXXXXXXXXXXXYR

SEQ ID NO: 24865 - protein, 84 aa, Diabrotica virgifera
  misc_feature: Coding regions on vcDNA: vcDNA=SeqID_4562; Strand=+; Position=3-257
SRVIRIMPAHVFMDCRLLHFDIAHTPLVKGPNLSTLGLGLSTSKAVTVPFNGGSNIYWSSESRRAHRIVRLLGNQISLRMSLEP

SEQ ID NO: 24866 - protein, 76 aa, Diabrotica virgifera
  misc_feature: Coding regions on vcDNA: vcDNA=SeqID_4563; Strand=+; Position=2-232
  misc_feature: Homolog annotation: Hit_ID=AAT93993.1; Match level="QueryCoverage =100%, HitCoverage=9%, E-value=2e-27, Identity=82%"; Hit description =putative minichromosome maintenance family protein [Oryza sativa (japonica cultivar-group)] gb|AAT73631.1|
  misc_feature (25)..(25): Xaa can be any naturally occurring amino acid
GDLIIWYVEQQNAQGAYSSTEEVKXEVKCIKAIIERLIQRECHLVVIDEGTAAAEGATARASEHRILAVNPNYVID

SEQ ID NO: 24867 - protein, 119 aa, Diabrotica virgifera
  misc_feature: Coding regions on vcDNA: vcDNA=SeqID_4564; Strand=+; Position=2-361
GSTGLQIEEGSMPHLRRLLIDFQSSEDDTDHFVLGIQHFSCLVQVRATIYCEPTSTTVVSAAETHIRDQVSQNPNNPLLEFNRKRRGRLVRRLRPLSNVKEQPSAVIKIRSLDDWTMMI

SEQ ID NO: 24868 - protein, 79 aa, Diabrotica virgifera
  misc_feature: Coding regions on vcDNA: vcDNA=SeqID_4565; Strand=-; Position=18-257
RVLARLPPLHPDCKFSIDCRDICQLFPLPRNGFLGFEHDDIIIFLNVPTHCQIGQILLYPEIILCPMYKNVVIGDFHCR

SEQ ID NO: 24869 - protein, 104 aa, Diabrotica virgifera
  misc_feature: Coding regions on vcDNA: vcDNA=SeqID_4566; Strand=+; Position=57-368
GALPKDLPRPGRGLGTRHGGAGGRHLGRRAHGGTVPHGDYRRGSCSIRPPYEHGSGDPYGPEARQAASFKRRGRARPFGDLCPTRGAGQSIGSATRRFHCGRTP

SEQ ID NO: 24870 - protein, 66 aa, Diabrotica virgifera
  misc_feature: Coding regions on vcDNA: vcDNA=SeqID_4567; Strand=+; Position=2-202
IGLIVACSSGSQSRGQILARATAVQGEIPFFCVFIPCFNSAPRPSLDASSIFAMEGLDQNTNAMDS

SEQ ID NO: 24871 - protein, 76 aa, Diabrotica virgifera
  misc_feature: Coding regions on vcDNA: vcDNA=SeqID_4568; Strand=+; Position=1-231
  misc_feature (23)..(23): Xaa can be any naturally occurring amino acid
SRQGNTDGCCRWFVSPTRVSSMXSIVSHFSIHSHLFNVASKPCWQLKWHIDRRDSFERSKSEARPVPLPFPSPFPI

SEQ ID NO: 24872 - protein, 74 aa, Diabrotica virgifera
  misc_feature: Coding regions on vcDNA: vcDNA=SeqID_4569; Strand=+; Position=64-286
  misc_feature: Homolog annotation: Hit_ID=NP_919530.1; Match level="QueryCoverage =97%, HitCoverage=8%, E-value=5e-15, Identity=48%"; Hit description =putative transposase [Oryza sativa (japonica cultivar-group)] gb|AAP51817.1| putative
  misc_feature (15)..(15): Xaa can be any naturally occurring amino acid
  misc_feature (55)..(55): Xaa can be any naturally occurring amino acid
EVIEFCIDFIPDLRXGKGTLGGEQIICMDGHSLTEAHYTVLQNSALVAPYMDEHXNLLRSKHPERSDDWIAREQ

SEQ ID NO: 24873 - protein, 78 aa, Diabrotica virgifera
  misc_feature: Coding regions on vcDNA: vcDNA=SeqID_4570; Strand=+; Position=3-239
  misc_feature (24)..(24): Xaa can be any naturally occurring amino acid
  misc_feature (30)..(41): Xaa can be any naturally occurring amino acid
INLREILQKIFFVRNGPNSLKWCXPGPKIXXXXXXXXXXXXNNHKKISISWGLQGAKGIQCVPFEMRGFIGFPEERKI

SEQ ID NO: 24874 - protein, 93 aa, Diabrotica virgifera
  misc_feature: Coding regions on vcDNA: vcDNA=SeqID_4571; Strand=+; Position=3-284
  misc_feature (5)..(34): Xaa can be any naturally occurring amino acid
PTHPXXXXXXXXXXXXXXXXXXXXXXXXXXXXXXYKFQHLFGNTIKFGSFPRVSTLIIPLGEFFAFSKLPSIFYLSAFLFLLFIWVSPGFLPI

SEQ ID NO: 24875 - protein, 93 aa, Diabrotica virgifera
  misc_feature: Coding regions on vcDNA: vcDNA=SeqID_4572; Strand=+; Position=64-342
  misc_feature: Homolog annotation: Hit_ID=NP_915993.1; Match level="QueryCoverage =100%, HitCoverage=62%, E-value=4e-50, Identity=96%"; Hit description= ubiquitin conjugating enzyme [Oryza sativa (japonica cultivar-group)] ref|NP_915996.1|
  misc_feature: Gene Ontology Annotation: Molecular function=ubiquitin conjugating enzyme activity; Cellular component=proteasome complex (sensu Eukarya); Biological process=sporulation (sensu Saccharomyces)
  misc_feature: Pfam annotation: Pfam_ID=UQ_con; Match level="Score=99.5, E-value =8.6e-27, Copies=1"; Pfam description=Ubiquitin-conjugating enzyme
MASKRILKELKDLQKDPPRSCSAGPSGEDMFHWQATIMGPPDSPYAGGVFLVNIHFPPDYPFKPPKVSFKTKVFHPNINSNGGICLDILKEQW

SEQ ID NO: 24876 - protein, 54 aa, Diabrotica virgifera
  misc_feature: Coding regions on vcDNA: vcDNA=SeqID_4573; Strand=+; Position=36-200
FLNHTYRSQCLRSASMKQPTMYSYMASQRYLYQIVFNTPLSLPTLTFHSSPSPR

SEQ ID NO: 24877 - protein, 121 aa, Diabrotica virgifera
  misc_feature: Coding regions on vcDNA: vcDNA=SeqID_4574; Strand=-; Position=1-363
YQKIGINTLIAKHFTIYNNYTILQYTIKIDKIYNFIVSTCKIRYFNYTLAATATSTATAAAATATTTATPATATTASATATPRNGRRCRGYSLNYQKDDAEEYHNCRHNPHLEIDFKINKI

SEQ ID NO: 24878 - protein, 88 aa, Diabrotica virgifera
  misc_feature: Coding regions on vcDNA: vcDNA=SeqID_4575; Strand=-; Position=108-374
  misc_feature (27)..(31): Xaa can be any naturally occurring amino acid
IVMYYRAHKPEEEKPQPKEEEVIVFTXXXXXGFSPLGSKFFWDALHLFNLHPQDIGPNSVSNICNFQVSVRCTFKRIPVWSCLETNFI

SEQ ID NO: 24879 - protein, 61 aa, Diabrotica virgifera
  misc_feature: Coding regions on vcDNA: vcDNA=SeqID_4576; Strand=+; Position=1-186
DMPTNYCFDGHSGSLRDVVSIATKDYMCIISLWILCTAYMKEYQFQIRNFITFPVYKNFNI

SEQ ID NO: 24880 - protein, 44 aa, Diabrotica virgifera
  misc_feature: Coding regions on vcDNA: vcDNA=SeqID_4577; Strand=+; Position=1-135
SSYHLPFISFYGFHAPTPLSVHIDFLVLSTMHYPFKKYYLIKYS

SEQ ID NO: 24881 - protein, 132 aa, Diabrotica virgifera
  misc_feature: Coding regions on vcDNA: vcDNA=SeqID_4578; Strand=+; Position=1-396
PTQPLTYSNLAKLTKSFKVSYLPYVQNPIKALKHLDVTVTEVPLDKFGKNFEIPETDILIVNLNDAKDSESRTDMLKRHDAAISKIYEDLANTNDNVLGMYTAHHTSWVVSEEVIKSRQARSLMVAENAEAA

SEQ ID NO: 24882 - protein, 135 aa, Diabrotica virgifera
  misc_feature: Coding regions on vcDNA: vcDNA=SeqID_4579; Strand=+; Position=3-407
  misc_feature: Homolog annotation: Hit_ID=XP_313621.1; Match level="QueryCoverage =88%, HitCoverage=28%, E-value=1e-17, Identity=38%"; Hit description =ENSANGP00000024261 [Anopheles gambiae]
  misc_feature (121)..(130): Xaa can be any naturally occurring amino acid
DGTIFTKLNQVVAYADDIDIISWTLNDLEKTYTYFKEAAQTMGLEVNVSKTKYMITTREKVQTKGNISLSGQIFERVDRFKYLGSTITEGNKNSDEVTARISLGNKCFYSLQNIIKSKSVXXXXXXXXXXTVMRT

SEQ ID NO: 24883 - protein, 55 aa, Diabrotica virgifera
  misc_feature: Coding regions on vcDNA: vcDNA=SeqID_4580; Strand=+; Position=78-245
SRFNRQQKIIVSRLYHYYQYIGLPCEFHSIYCTCILKPCAFGVSIGSRVYRDKVH

SEQ ID NO: 24884 - protein, 74 aa, Diabrotica virgifera
  misc_feature: Coding regions on vcDNA: vcDNA=SeqID_4581; Strand=+; Position=82-306
  misc_feature (13)..(19): Xaa can be any naturally occurring amino acid
LAYAYAIRKFFTXXXXXXXTTCMVLVPENLIEAKTSKLHLTTVRYTSFMSILSCQYRAVFIMVEKFILLDVKIM

SEQ ID NO: 24885 - protein, 100 aa, Diabrotica virgifera
  misc_feature: Coding regions on vcDNA: vcDNA=SeqID_4582; Strand=-; Position=56-358
LIPYKELLNSPPAYPYPRPFSKYGRNRRSSATPQPSRAKAMGRKMHQALIKACAKGTLSSNKNSVSFLTLIIVPKNKTLLLETLAGSEKNQAKAFSYIIK

SEQ ID NO: 24886 - protein, 101 aa, Diabrotica virgifera
  misc_feature: Coding regions on vcDNA: vcDNA=SeqID_4583; Strand=-; Position=0-302
STGKIVLNLLKELRSEEMCPDFNNTLITISLECLYGTQKSVKSALKLTITTLIFKNFPQTLRYPSQKKVHGPSRKSVLDPPLHANTFFTCKIDFTYLHSSS

SEQ ID NO: 24887 - protein, 38 aa, Diabrotica virgifera
  misc_feature: Coding regions on vcDNA: vcDNA=SeqID_4584; Strand=-; Position=84-200
NFKLFGDLNSEIINQLILNYYPWYPRYQKLIFSFFKIN

SEQ ID NO: 24888 - protein, 122 aa, Diabrotica virgifera
  misc_feature: Coding regions on vcDNA: vcDNA=SeqID_4585; Strand=+; Position=35-400
  misc_feature: Homolog annotation: Hit_ID=XP_308197.1; Match level="QueryCoverage =73%, HitCoverage=24%, E-value=1e-30, Identity=65%"; Hit description =ENSANGP00000021555 [Anopheles gambiae]
  misc_feature: Gene Ontology Annotation: Molecular function=GTPase activator activity; Cellular component=membrane; Biological process=G-protein coupled receptor protein signaling pathway
  misc_feature (109)..(109): Xaa can be any naturally occurring amino acid
MFKKQKKPSKLNSVQSDKRIDPVPRPPVSPVSPVTRSTLQFYCQLAHGSPTAFVSGFSNIKELYERIGECFNLPASDILFCTLNTYKIDMTKLLGGQIGLEDFIFAHCXGRPKEVELTKSES

SEQ ID NO: 24889 - protein, 120 aa, Diabrotica virgifera
  misc_feature: Coding regions on vcDNA: vcDNA=SeqID_4586; Strand=+; Position=1-360
TTPRTESYYIFTVILIGILIRIKFREKKKTQHEPTAPTAHQQDDIYNISGRVQNQEQWPTHDAHLSIDHISVLNQMNKPVYDDAPPSYEEVMKTSIQVVGETSTPPYSPPQPASQVVIVV

SEQ ID NO: 24890 - protein, 95 aa, Diabrotica virgifera
  misc_feature: Coding regions on vcDNA: vcDNA=SeqID_4587; Strand=+; Position=58-345
AALAVAHSLNSIKLVETVQLLMAQIQYNLAIWNLLNNLINAKWTTTSVHTMLMVHHFDTIAKNCDIHPTSTQVVLRDYYQQIKLIYYCNKHSIFV

SEQ ID NO: 24891 - protein, 140 aa, Diabrotica virgifera
  misc_feature: Coding regions on vcDNA: vcDNA=SeqID_4588; Strand=-; Position=2-421
  misc_feature (36)..(93): Xaa can be any naturally occurring amino acid
  misc_feature (110)..(116): Xaa can be any naturally occurring amino acid
FPGQKFLKGRPLNLNLGALLEGFEVAFKGKLGLNLXXXXXXXXXXXXXXXXXXXXXXXXXXXXXXXXXXXXXXXXXXXXXXXXXXXXXXXXXXCKCKHKFLQFFLHPVNXXXXXXXVKLWLISHKKIRNYKYQNVCVEAC

SEQ ID NO: 24892 - protein, 43 aa, Diabrotica virgifera
  misc_feature: Coding regions on vcDNA: vcDNA=SeqID_4589; Strand=+; Position=1-129
THASTELHIKLQIIQKRPYIYVVQQLISLHAAIFELDGHFGAF

SEQ ID NO: 24893 - protein, 90 aa, Diabrotica virgifera
  misc_feature: Coding regions on vcDNA: vcDNA=SeqID_4590; Strand=+; Position=15-284
  misc_feature (29)..(35): Xaa can be any naturally occurring amino acid
  misc_feature (76)..(83): Xaa can be any naturally occurring amino acid
YTTDDNGNETTVDDITTTSLEPEPSAETXXXXXXXTATERSVDFVCVNARKFAHPVDCNKYYLCVDTVFSTVKYLXXXXXXXXYDADNEI

SEQ ID NO: 24894 - protein, 50 aa, Diabrotica virgifera
  misc_feature: Coding regions on vcDNA: vcDNA=SeqID_4591; Strand=-; Position=2-151
  misc_feature (29)..(35): Xaa can be any naturally occurring amino acid
  misc_feature (37)..(44): Xaa can be any naturally occurring amino acid
LRKNSGYVETHKISYTKSSGRYSRRTKHXXXXXXXCXXXXXXXXWQMRGW

SEQ ID NO: 24895 - protein, 62 aa, Diabrotica virgifera
  misc_feature: Coding regions on vcDNA: vcDNA=SeqID_4592; Strand=-; Position=145-333
  misc_feature (8)..(16): Xaa can be any naturally occurring amino acid
  misc_feature (30)..(40): Xaa can be any naturally occurring amino acid
  misc_feature (46)..(52): Xaa can be any naturally occurring amino acid
KIYGNNPXXXXXXXXXNSEIKINVLPWDLXXXXXXXXXXXNVIIIXXXXXXXREGINQNLDE

SEQ ID NO: 24896 - protein, 45 aa, Diabrotica virgifera
  misc_feature: Coding regions on vcDNA: vcDNA=SeqID_4593; Strand=+; Position=1-138
  misc_feature (5)..(11): Xaa can be any naturally occurring amino acid
  misc_feature (37)..(41): Xaa can be any naturally occurring amino acid
MIKLXXXXXXXGEKIIIMVKILIKFQIMAGTVLGGSXXXXXLSYR

SEQ ID NO: 24897 - protein, 120 aa, Diabrotica virgifera
  misc_feature: Coding regions on vcDNA: vcDNA=SeqID_4594; Strand=+; Position=73-432
  misc_feature: Homolog annotation: Hit_ID=AAO15527.1; Match level="QueryCoverage =90%, HitCoverage=27%, E-value=4e-23, Identity=50%"; Hit description =galactokinase [Canis familiaris] gb|AAP31026.1| galactokinase [Canis familiaris] ref|NP_001003104.1| galac
MATNFVTVEQLVVEANYIFKEQFGEEADIAVYAPGRVNLIGEHTDYNDGFVMPMALPLVTVMVGKKVEGSVVTVYTTSTFCDQETSFDMPSPCAPIRAITPVGPRWVMYIKRVIVNYIGD

SEQ ID NO: 24898 - protein, 41 aa, Diabrotica virgifera
  misc_feature: Coding regions on vcDNA: vcDNA=SeqID_4595; Strand=-; Position=3-125
  misc_feature (32)..(39): Xaa can be any naturally occurring amino acid
ATHLVIDVMGRLRLMTVSSLRTTVSTTLSSTXXXXXXXXCC

SEQ ID NO: 24899 - protein, 55 aa, Diabrotica virgifera
  misc_feature: Coding regions on vcDNA: vcDNA=SeqID_4596; Strand=+; Position=2-169
GSTQASSIRQHNIDIFDFSLTDEEMAVIDEFNCNVRVCHAEELKDNPEYPFTLQE

SEQ ID NO: 24900 - protein, 140 aa, Diabrotica virgifera
  misc_feature: Coding regions on vcDNA: vcDNA=SeqID_4597; Strand=+; Position=2-421
  misc_feature: Homolog annotation: Hit_ID=XP_319133.1; Match level="QueryCoverage =95%, HitCoverage=25%, E-value=2e-26, Identity=44%"; Hit description =ENSANGP00000011850 [Anopheles gambiae]
  misc_feature: Gene Ontology Annotation: Molecular function=molecular_function unknown; Cellular component=nucleoplasm; Biological process =chromosome segregation
  misc_feature: Pfam annotation: Pfam_ID=RIO1; Match level="Score=56.2, E-value=9.5e -14, Copies=1"; Pfam description=RIO1 family
  misc_feature (48)..(56): Xaa can be any naturally occurring amino acid
HHSKVSRNNHRFMNRKGKHASRSTVNISAEREMIHLMQMQKAGIPCPXXXXXXXXXLVMEFIGENQIPAPTLKDIMADVHCTNAYEQVIEYMRILYTKADLVHADLTEDNILWHHDKCYFIDVSEALEPSHEQAFFYLYK

SEQ ID NO: 24901 - protein, 24 aa, Diabrotica virgifera
  misc_feature: Coding regions on vcDNA: vcDNA=SeqID_4598; Strand=-; Position=41-115
NACRPLGCQSIPNSVAPTIELGIL

SEQ ID NO: 24902 - protein, 48 aa, Diabrotica virgifera
  misc_feature: Coding regions on vcDNA: vcDNA=SeqID_4599; Strand=-; Position=98-244
MYLKPELEIWTNICKSIPQSHQQVYDISLYHFQLIIVGYIPIGNGRLQ

SEQ ID NO: 24903 - protein, 54 aa, Diabrotica virgifera
  misc_feature: Coding regions on vcDNA: vcDNA=SeqID_4600; Strand=-; Position=1-162
  misc_feature (32)..(47): Xaa can be any naturally occurring amino acid
NNLNVIFSTETEIIFRNHNIQLKRWIPKGLKXXXXXXXXXXXXXXXXAWVDGCV

SEQ ID NO: 24904 - protein, 64 aa, Diabrotica virgifera
  misc_feature: Coding regions on vcDNA: vcDNA=SeqID_4601; Strand=-; Position=0-191
  misc_feature (1)..(60): Xaa can be any naturally occurring amino acid
XXXXXXXXXXXXXXXXXXXXXXXXXXXXXXXXXXXXXXXXXXXXXXXXXXXXXXXXXXXXGRVG

SEQ ID NO: 24905 - protein, 81 aa, Diabrotica virgifera
  misc_feature: Coding regions on vcDNA: vcDNA=SeqID_4602; Strand=+; Position=30-275
TYVPIVFTNFCSWFFSQRHDSDLSHIFPALYMSLNSSAIIFICSIANSFNSSAGISSSPSAFPSFICLMAAVTSSGRISGP

SEQ ID NO: 24906 - protein, 101 aa, Diabrotica virgifera
  misc_feature: Coding regions on vcDNA: vcDNA=SeqID_4603; Strand=+; Position=3-305
RPNESLAICSFRVICYDCIRICTYGSGSRYLLRLPRFEPTASTLSDPCPHQSWPSLPIVRAIFPASSHVHVIDTSPAIALQMDSCACCAVIAVYASFIDRL

SEQ ID NO: 24907 - protein, 134 aa, Diabrotica virgifera
  misc_feature: Coding regions on vcDNA: vcDNA=SeqID_4604; Strand=+; Position=1-402
  misc_feature: Homolog annotation: Hit_ID=AAP94193.1; Match level="QueryCoverage =99%, HitCoverage=27%, E-value=8e-43, Identity=61%"; Hit description =cytochrome P450 monooxygenase [Tribolium castaneum]
  misc_feature: Gene Ontology Annotation: Molecular function=cytochrome P450 activity; Cellular component=extracellular space
  misc_feature (86)..(91): Xaa can be any naturally occurring amino acid
MKFAERCIKESLRLYPSAVSISRLSGEEIKTKTGYTIPKGCTVAVLIYDLHRNPEIWENPLKFDPDRFLPENMSGRHPYAYIPFSXXXXXXIGQKYAMLELKTAVCGLINNFKLEPVTRPADMRFKADIVLRPA

SEQ ID NO: 24908 - protein, 41 aa, Diabrotica virgifera
  misc_feature: Coding regions on vcDNA: vcDNA=SeqID_4605; Strand=+; Position=2-124
  misc_feature (1)..(20): Xaa can be any naturally occurring amino acid
  misc_feature (35)..(41): Xaa can be any naturally occurring amino acid
XXXXXXXXXXXXXXXXXXXXERLSFFNYTKFFRPXXXXXXX

SEQ ID NO: 24909 - protein, 94 aa, Diabrotica virgifera
  misc_feature: Coding regions on vcDNA: vcDNA=SeqID_4606; Strand=+; Position=3-287
  misc_feature (81)..(91): Xaa can be any naturally occurring amino acid
GRPRVRTHFRPRSPVMLQKMDGVTDIVVFIQYSNTIIYHDNYRHDVKLHANPGIEFRIYTYLTIKLNVHSKLVSITGCGDXXXXXXXXXXXAWN

SEQ ID NO: 24910 - protein, 81 aa, Diabrotica virgifera
  misc_feature: Coding regions on vcDNA: vcDNA=SeqID_4607; Strand=+; Position=52-294
  misc_feature (12)..(19): Xaa can be any naturally occurring amino acid
  misc_feature (47)..(47): Xaa can be any naturally occurring amino acid
  misc_feature (49)..(56): Xaa can be any naturally occurring amino acid
  misc_feature (72)..(72): Xaa can be any naturally occurring amino acid
IISLISLISDIXXXXXXXXHPLTCGLILLIQTIFTSVITGLINYNYXFXXXXXXXXVGGILILFIYITRIAXILRFILMNN

SEQ ID NO: 24911 - protein, 128 aa, Diabrotica virgifera
  misc_feature: Coding regions on vcDNA: vcDNA=SeqID_4608; Strand=+; Position=1-384
  misc_feature: Homolog annotation: Hit_ID=AAR09691.1; Match level="QueryCoverage =96%, HitCoverage=75%, E-value=5e-44, Identity=62%"; Hit description =similar to Drosophila melanogaster asf1 [Drosophila yakuba]
  misc_feature: Gene Ontology Annotation: Molecular function=histone binding; Cellular component=chromatin assembly complex; Biological process =DNA damage response, signal transduction resulting in induction of apoptosis
  misc_feature: Pfam annotation: Pfam_ID=Anti-silence; Match level="Score=148.3, E -value=1.7e-41, Copies=1"; Pfam description=Anti-silencing protein, ASF1-like
QTLDSVFVGPIPEGKHMFVFQADPPNVSRIPENDALGVTVVLLTCSYRSQEFIRVGYFINNEYTDPELKENLPSPPQFDKVTRNILASEPRVTRFKINWEETNPTENNTNSDQSGASAPTTSEAGPSA

SEQ ID NO: 24912 - protein, 78 aa, Diabrotica virgifera
  misc_feature: Coding regions on vcDNA: vcDNA=SeqID_4609; Strand=-; Position=0-233
  misc_feature (17)..(25): Xaa can be any naturally occurring amino acid
PELRFHPGGGCHPFSVXXXXXXXXXSDIDRRPNFKQKMLHKVFSKTQYCSRYWQLKIRNFLTIFNSFFANISKNMHFV

SEQ ID NO: 24913 - protein, 61 aa, Diabrotica virgifera
  misc_feature: Coding regions on vcDNA: vcDNA=SeqID_4610; Strand=+; Position=112-294
  misc_feature (12)..(22): Xaa can be any naturally occurring amino acid
  misc_feature (25)..(32): Xaa can be any naturally occurring amino acid
VLKYWYQGFREXXXXXXXXXXXGVXXXXXXXXYMEIYRLRNFCAKICDSLLNIPKGLRRKL

SEQ ID NO: 24914 - protein, 53 aa, Diabrotica virgifera
  misc_feature: Coding regions on vcDNA: vcDNA=SeqID_4611; Strand=-; Position=0-158
  misc_feature (26)..(33): Xaa can be any naturally occurring amino acid
  misc_feature (41)..(47): Xaa can be any naturally occurring amino acid
NELIAGSLDGGVCIILAEAVHMLHGXXXXXXXXGTKEFLNXXXXXXXFWVILR

SEQ ID NO: 24915 - protein, 141 aa, Diabrotica virgifera
  misc_feature: Coding regions on vcDNA: vcDNA=SeqID_4612; Strand=+; Position=3-425
NSEESLAFLGLIGEQNIEERAKLLDENPANVAEALNVAEEDKENVGKQLKALYTSSSFTDDRDALITFTSDAVFVRSIIRQAESISRHVPVYLYDLTYLPEDSTAQGVAHGVDMRYLFGGDSHGLVFNENLRKSLLKFWTK

SEQ ID NO: 24916 - protein, 65 aa, Diabrotica virgifera
  misc_feature: Coding regions on vcDNA: vcDNA=SeqID_4613; Strand=+; Position=3-200
WLHFHHPMHIIITTVHIPARSDTKFTRIHYRGKLSMYAFHKRVSFTHHSLVFRDPSLMIVVLHHL

SEQ ID NO: 24917 - protein, 22 aa, Diabrotica virgifera
  misc_feature: Coding regions on vcDNA: vcDNA=SeqID_4614; Strand=+; Position=111-179
LLVGCLISGRAIGAKSAYFYIR

SEQ ID NO: 24918 - protein, 95 aa, Diabrotica virgifera
  misc_feature: Coding regions on vcDNA: vcDNA=SeqID_4615; Strand=-; Position=69-356
  misc_feature (61)..(68): Xaa can be any naturally occurring amino acid
QSHYSIHTKRQYGCQSDNVILTHYKQLRLLNSSIFCLMAPYSCKIYQKFQLRSTNCYNQLXXXXXXXXKIESYRLYRYENLFSEHMRFQCNKLDP

SEQ ID NO: 24919 - protein, 70 aa, Diabrotica virgifera
  misc_feature: Coding regions on vcDNA: vcDNA=SeqID_4616; Strand=-; Position=74-286
  misc_feature (17)..(28): Xaa can be any naturally occurring amino acid
  misc_feature (30)..(36): Xaa can be any naturally occurring amino acid
  misc_feature (50)..(58): Xaa can be any naturally occurring amino acid
NKKSNDYDTLPHSKYSXXXXXXXXXXXXIXXXXXXXITKQMKKMVPNSDXXXXXXXXXHNATHNKIFIIY

SEQ ID NO: 24920 - protein, 53 aa, Diabrotica virgifera
  misc_feature: Coding regions on vcDNA: vcDNA=SeqID_4617; Strand=+; Position=1-162
  misc_feature (3)..(16): Xaa can be any naturally occurring amino acid
  misc_feature (28)..(49): Xaa can be any naturally occurring amino acid
RVXXXXXXXXXXXXXXQFRLILLIDLFXXXXXXXXXXXXXXXXXXXXXXRISL

SEQ ID NO: 24921 - protein, 18 aa, Diabrotica virgifera
  misc_feature: Coding regions on vcDNA: vcDNA=SeqID_4618; Strand=-; Position=33-89
ISPLIFNHPLFKSALLIA

SEQ ID NO: 24922 - protein, 34 aa, Diabrotica virgifera
  misc_feature: Coding regions on vcDNA: vcDNA=SeqID_4619; Strand=+; Position=3-104
GGKNNSKKKNVCVLCTHVRSYTSTTYYVIFKTIP

SEQ ID NO: 24923 - protein, 59 aa, Diabrotica virgifera
  misc_feature: Coding regions on vcDNA: vcDNA=SeqID_4620; Strand=+; Position=3-179
HESDHAPVTLLVTWIAPNLLYQHRVVIYCYNSYTDIVNMYDKGWCCTTSRSVKGNVKTP

SEQ ID NO: 24924 - protein, 64 aa, Diabrotica virgifera
  misc_feature: Coding regions on vcDNA: vcDNA=SeqID_4621; Strand=-; Position=111-305
  misc_feature (24)..(30): Xaa can be any naturally occurring amino acid
  misc_feature (47)..(55): Xaa can be any naturally occurring amino acid
DLLRSNRKPIFSLNYKISHLSALXXXXXXXWFSTRRAKKNERECINXXXXXXXXXLLMEFEGVG

SEQ ID NO: 24925 - protein, 70 aa, Diabrotica virgifera
  misc_feature: Coding regions on vcDNA: vcDNA=SeqID_4622; Strand=-; Position=185-397
  misc_feature (3)..(10): Xaa can be any naturally occurring amino acid
KPXXXXXXXXNNLCTQCKNISVITVFINVSVYSNSRPTRHIGTLSYYSPGSFTCRTFLFMSSPPRLSENV

SEQ ID NO: 24926 - protein, 37 aa, Diabrotica virgifera
  misc_feature: Coding regions on vcDNA: vcDNA=SeqID_4623; Strand=+; Position=58-168
RIMVFYVQVVVHGLLEAEPRDLQIKTAMFRKTSGGIP

SEQ ID NO: 24927 - protein, 74 aa, Diabrotica virgifera
  misc_feature: Coding regions on vcDNA: vcDNA=SeqID_4624; Strand=+; Position=2-226
  misc_feature: Homolog annotation: Hit_ID=XP_394187.1; Match level="QueryCoverage =82%, HitCoverage=42%, E-value=3e-15, Identity=62%"; Hit description =similar to CG7911-PA [Apis mellifera]
  misc_feature (64)..(65): Xaa can be any naturally occurring amino acid
KDSVKIPIATLKAGGPNNQVLLDLSFPDPPVTFSLIQGNGPVHIVGHHLIGSPMEEFDRMERVXXEGWAGGQEE

SEQ ID NO: 24928 - protein, 97 aa, Diabrotica virgifera
  misc_feature: Coding regions on vcDNA: vcDNA=SeqID_4625; Strand=-; Position=44-337
  misc_feature (42)..(42): Xaa can be any naturally occurring amino acid
  misc_feature (56)..(62): Xaa can be any naturally occurring amino acid
NVVTQATVFSLSLPSSTASLLGSLFKTSPRFPRTTPAPLNQXPPLRQRFFSPIRSXXXXXXXGNVSFGTVPRFFVFQESKVSRHLILSGRKNATSNG

SEQ ID NO: 24929 - protein, 52 aa, Diabrotica virgifera
  misc_feature: Coding regions on vcDNA: vcDNA=SeqID_4626; Strand=-; Position=0-155
  misc_feature (4)..(30): Xaa can be any naturally occurring amino acid
  misc_feature (36)..(45): Xaa can be any naturally occurring amino acid
TKTXXXXXXXXXXXXXXXXXXXXXXXXXXXPSTLPXXXXXXXXXXNNITIFA

SEQ ID NO: 24930 - protein, 34 aa, Diabrotica virgifera
  misc_feature: Coding regions on vcDNA: vcDNA=SeqID_4627; Strand=+; Position=22-126
  misc_feature (11)..(17): Xaa can be any naturally occurring amino acid
FITNFTYKLKXXXXXXXSENPTEFYQSNNKFFHN

SEQ ID NO: 24931 - protein, 65 aa, Diabrotica virgifera
  misc_feature: Coding regions on vcDNA: vcDNA=SeqID_4628; Strand=+; Position=56-253
NLINTAKYQGGLFSLAHTVYILIFYTEKSQEQICNANASRGGYFFFTKSLLSQFLLITSTEKRIK

SEQ ID NO: 24932 - protein, 26 aa, Diabrotica virgifera
  misc_feature: Coding regions on vcDNA: vcDNA=SeqID_4629; Strand=+; Position=2-79
SLVRFDIHDTKPKHKLYKIKFSYYCK

SEQ ID NO: 24933 - protein, 42 aa, Diabrotica virgifera
  misc_feature: Coding regions on vcDNA: vcDNA=SeqID_4630; Strand=-; Position=1-126
  misc_feature (26)..(40): Xaa can be any naturally occurring amino acid
VIVRDTQGTKIKFLSGKNQLFSHISXXXXXXXXXXXXXXXVL

SEQ ID NO: 24934 - protein, 54 aa, Diabrotica virgifera
  misc_feature: Coding regions on vcDNA: vcDNA=SeqID_4631; Strand=+; Position=1-165
  misc_feature: Homolog annotation: Hit_ID=NP_726243.1; Match level="QueryCoverage =100%, HitCoverage=9%, E-value=8e-16, Identity=79%"; Hit description =CG3612-PA [Drosophila melanogaster] gb|AAF46903.1| CG3612-PA [Drosophila melanogaster]
  misc_feature: Gene Ontology Annotation: Molecular function=hydrogen-transporting ATP synthase activity, rotational mechanism; Cellular component =extracellular space; Biological process=morphogenesis
  misc_feature: Pfam annotation: Pfam_ID=ATP-synt_ab_C; Match level="Score=-1.9, E -value=0.04, Copies=1"; Pfam description=ATP synthase alpha/beta chain, C termi
VAGSMKLELDHYREVTAFAQFSSDLDAATHQLLSICVRLTDLLRQGQYIPMAIE

SEQ ID NO: 24935 - protein, 112 aa, Diabrotica virgifera
  misc_feature: Coding regions on vcDNA: vcDNA=SeqID_4632; Strand=+; Position=3-339
  misc_feature: Homolog annotation: Hit_ID=EAA13916.3; Match level="QueryCoverage =100%, HitCoverage=18%, E-value=2e-27, Identity=51%"; Hit description= ENSANGP00000022343 [Anopheles gambiae str. PEST] ref|XP_553864.1| ENSANGP00000022343 [Anopheles gambiae s
  misc_feature: Gene Ontology Annotation: Biological process=G-protein coupled receptor protein signaling pathway
  misc_feature (82)..(82): Xaa can be any naturally occurring amino acid
GFLGLLHLEVFTQRLTQEYDAEPIITAPSVTYKIKLKPTKQNIKDGSDVIFMNNPANFRDHVRIEEGGGGRIIGTMVTPGQXLGPVISLCMERRGIQRSANNIDNERVILQY

SEQ ID NO: 24936 - protein, 59 aa, Diabrotica virgifera
  misc_feature: Coding regions on vcDNA: vcDNA=SeqID_4633; Strand=+; Position=3-182
  misc_feature (3)..(9): Xaa can be any naturally occurring amino acid
  misc_feature (11)..(17): Xaa can be any naturally occurring amino acid
  misc_feature (32)..(40): Xaa can be any naturally occurring amino acid
  misc_feature (49)..(57): Xaa can be any naturally occurring amino acid
PGXXXXXXXGXXXXXXXLIKCKKKFTLTFKGXXXXXXXXXTHRGLEHYXXXXXXXXXLT

SEQ ID NO: 24937 - protein, 29 aa, Diabrotica virgifera
  misc_feature: Coding regions on vcDNA: vcDNA=SeqID_4634; Strand=-; Position=77-166
GQFFRNGPPEVCLLNYLLGIISFKLKVQT

SEQ ID NO: 24938 - protein, 44 aa, Diabrotica virgifera
  misc_feature: Coding regions on vcDNA: vcDNA=SeqID_4635; Strand=-; Position=276-410
MALLTYVKIIMGQDFDVWEANCQTIVFVLYYLNHIAMFLKFFYR

SEQ ID NO: 24939 - protein, 47 aa, Diabrotica virgifera
  misc_feature: Coding regions on vcDNA: vcDNA=SeqID_4636; Strand=+; Position=98-238
  misc_feature (35)..(46): Xaa can be any naturally occurring amino acid
PLQIFYQHIHLNLLKFSHDDHITPKQIVSLLKISXXXXXXXXXXXXP

SEQ ID NO: 24940 - protein, 67 aa, Diabrotica virgifera
  misc_feature: Coding regions on vcDNA: vcDNA=SeqID_4637; Strand=-; Position=200-403
  misc_feature (1)..(40): Xaa can be any naturally occurring amino acid
  misc_feature (48)..(65): Xaa can be any naturally occurring amino acid
XXXXXXXXXXXXXXXXXXXXXXXXXXXXXXXXXXXXXXXXLKGINISXXXXXXXXXXXXXXXXXXVF

SEQ ID NO: 24941 - protein, 56 aa, Diabrotica virgifera
  misc_feature: Coding regions on vcDNA: vcDNA=SeqID_4638; Strand=-; Position=18-188
DIHQRQFTTLGTQNIHPKFKKTIQSSVRFLKKWCNLELFYQGCQADYIQLYNMFIT

SEQ ID NO: 24942 - protein, 56 aa, Diabrotica virgifera
  misc_feature: Coding regions on vcDNA: vcDNA=SeqID_4639; Strand=+; Position=278-445
CEIHIFLHNSTKIDSILYMMIASSILYHADLFMKTITLSRKITNKKVSRNISVQLK

SEQ ID NO: 24943 - protein, 37 aa, Diabrotica virgifera
  misc_feature: Coding regions on vcDNA: vcDNA=SeqID_4640; Strand=-; Position=214-327
  misc_feature (13)..(31): Xaa can be any naturally occurring amino acid
FHSRCSLFRLVYXXXXXXXXXXXXXXXXXXXIVYYEF

SEQ ID NO: 24944 - protein, 34 aa, Diabrotica virgifera
  misc_feature: Coding regions on vcDNA: vcDNA=SeqID_4641; Strand=+; Position=3-107
  misc_feature (1)..(6): Xaa can be any naturally occurring amino acid
XXXXXXVRDNPRENLVIANDDLRPSTFIKTQIFT

SEQ ID NO: 24945 - protein, 77 aa, Diabrotica virgifera
  misc_feature: Coding regions on vcDNA: vcDNA=SeqID_4642; Strand=-; Position=93-326
SLLCVLKLPFLYIRSQTKFYLILHQFYCFNLILLVSTDFRGFPKLWKWEIADFDFTPLKVQCTGCHKLVCFAVYTEN

SEQ ID NO: 24946 - protein, 55 aa, Diabrotica virgifera
  misc_feature: Coding regions on vcDNA: vcDNA=SeqID_4643; Strand=+; Position=204-368
  misc_feature (42)..(42): Xaa can be any naturally occurring amino acid
MMSRPRMHIIQVSTYQLVILISFKNHNELTYEEIHNESEISXMDPIRGLQSLAMG

SEQ ID NO: 24947 - protein, 56 aa, Diabrotica virgifera
  misc_feature: Coding regions on vcDNA: vcDNA=SeqID_4644; Strand=+; Position=258-428
  misc_feature (6)..(13): Xaa can be any naturally occurring amino acid
HNCLLXXXXXXXXLYCCPQNIKVFCIYLKNNKLFILMVVLLFLRFFTQLFTLVLVR

SEQ ID NO: 24948 - protein, 108 aa, Diabrotica virgifera
  misc_feature: Coding regions on vcDNA: vcDNA=SeqID_4645; Strand=+; Position=84-407
  misc_feature (4)..(13): Xaa can be any naturally occurring amino acid
  misc_feature (24)..(36): Xaa can be any naturally occurring amino acid
TNLXXXXXXXXXXDTFRDELINKXXXXXXXXXXXXXQNLHNLRHVKIYVQILLIIVISHFIDQNIFKLVKFNREDTFRSPNMYIEYKSSSLTDELGNIFFTCLMIPCQ

SEQ ID NO: 24949 - protein, 41 aa, Diabrotica virgifera
  misc_feature: Coding regions on vcDNA: vcDNA=SeqID_4646; Strand=+; Position=3-125
RVRIIFIQPLNLVLSTTLVISPFKTTSLLALPSVLSPLLSG

SEQ ID NO: 24950 - protein, 99 aa, Diabrotica virgifera
  misc_feature: Coding regions on vcDNA: vcDNA=SeqID_4647; Strand=+; Position=86-382
  misc_feature: Homolog annotation: Hit_ID=XP_316955.1; Match level="QueryCoverage =87%, HitCoverage=21%, E-value=1e-16, Identity=47%"; Hit description =ENSANGP00000019191 [Anopheles gambiae] gb|EAA12277.1| ENSANGP00000019191 [Anopheles gambiae
  misc_feature: Gene Ontology Annotation: Biological process=establishment and/or maintenance of cell polarity
MSAYILCGTSSGGLPILSRKKGNSEPLPFSITGSLNGIHMFGKPFGIEVLETLTDDYAVSWKEFEDSIIIIGAASGCSIDILNRLLEDVFNTTSYDNLE

SEQ ID NO: 24951 - protein, 73 aa, Diabrotica virgifera
  misc_feature: Coding regions on vcDNA: vcDNA=SeqID_4648; Strand=+; Position=116-337
  misc_feature: Homolog annotation: Hit_ID=XP_310423.1; Match level="QueryCoverage =91%, HitCoverage=66%, E-value=3e-14, Identity=52%"; Hit description =ENSANGP00000017964 [Anopheles gambiae]
  misc_feature (42)..(42): Xaa can be any naturally occurring amino acid
MNAVPTKSLLGLFKTGWNEIPEIMGSSPFGLTGIGLTAYSLXLYYQNDGDNRKYNDQYTVYRHDDPRVAKLKP

SEQ ID NO: 24952 - protein, 58 aa, Diabrotica virgifera
  misc_feature: Coding regions on vcDNA: vcDNA=SeqID_4649; Strand=+; Position=145-321
TSGFQSLRLVFGFTCYYYYYKPRVRKRICVSTRRFIYSIRLVPVPLTVRYLYVIYSIR

SEQ ID NO: 24953 - protein, 85 aa, Diabrotica virgifera
  misc_feature: Coding regions on vcDNA: vcDNA=SeqID_4650; Strand=+; Position=29-286
  misc_feature (6)..(15): Xaa can be any naturally occurring amino acid
ANDGIXXXXXXXXXXAMPPNKSTSAQIHFAGIYTLTVHGIMCDGIAILTDGDKLPKSGGVDLPRTSLGKTSLRKMSIAEHSSLEI

SEQ ID NO: 24954 - protein, 52 aa, Diabrotica virgifera
  misc_feature: Coding regions on vcDNA: vcDNA=SeqID_4651; Strand=-; Position=20-178
  misc_feature (2)..(9): Xaa can be any naturally occurring amino acid
  misc_feature (46)..(52): Xaa can be any naturally occurring amino acid
NXXXXXXXXVINNKTTSPNISLFIYFICINTSTNKEFNPRNIGSQXXXXXXX

SEQ ID NO: 24955 - protein, 83 aa, Diabrotica virgifera
  misc_feature: Coding regions on vcDNA: vcDNA=SeqID_4652; Strand=+; Position=144-392
  misc_feature: Homolog annotation: Hit_ID=NP_649241.1; Match level="QueryCoverage =100%, HitCoverage=51%, E-value=8e-27, Identity=69%"; Hit description= CG5104-PB [Drosophila melanogaster] gb|AAN12138.1| CG5104-PB [Drosophila melanogaster]
  misc_feature: Pfam annotation: Pfam_ID=SFT2; Match level="Score=-31.8, E-value =0.01, Copies=1"; Pfam description=SFT2-like protein
MDKLKRVLTGNESPDEESGIMSQLDDATTLSWSTRLKGFLACFIIGILLSFLGSFALFLNRGLPVFAVFYTLGNVTSLLSTCF

SEQ ID NO: 24956 - protein, 70 aa, Diabrotica virgifera
  misc_feature: Coding regions on vcDNA: vcDNA=SeqID_4653; Strand=-; Position=2-211
RTIANSPRYLWAIMTGKNLTSILDEGMIRTFTIPSQAAMHFDVAVQSCPHESKYIKERAHCVASLLLIVT

SEQ ID NO: 24957 - protein, 142 aa, Diabrotica virgifera
  misc_feature: Coding regions on vcDNA: vcDNA=SeqID_4654; Strand=+; Position=2-427
QIHDANQKQIVGAEVKKVYTNGQFQDHLGDAVEFFSDTSFGRPIIQHAKLQSQFSDVYFYHFSYQGTIPGVRPYYEGAYKVAHGDELQYEWAIGNNTNLNTFPPGDVLTSQRYRILLSNFAKNLNPTSESTDILGINYWATL

SEQ ID NO: 24958 - protein, 82 aa, Diabrotica virgifera
  misc_feature: Coding regions on vcDNA: vcDNA=SeqID_4655; Strand=-; Position=8-256
  misc_feature (6)..(24): Xaa can be any naturally occurring amino acid
  misc_feature (47)..(59): Xaa can be any naturally occurring amino acid
  misc_feature (62)..(72): Xaa can be any naturally occurring amino acid
  misc_feature (76)..(82): Xaa can be any naturally occurring amino acid
KRINIXXXXXXXXXXXXXXXXXXXAFLMSEISNSLILINTPWNHRVXXXXXXXXXXXXXSQXXXXXXXXXXXLLLXXXXXXX

SEQ ID NO: 24959 - protein, 73 aa, Diabrotica virgifera
  misc_feature: Coding regions on vcDNA: vcDNA=SeqID_4656; Strand=-; Position=2-223
LVITFKSRFQTMNISSSQCCLFQNRIFADKHFCKVLKNNVMAQSLKKAYRFKYSSDGARNTVEYHELFCKTNF

SEQ ID NO: 24960 - protein, 52 aa, Diabrotica virgifera
  misc_feature: Coding regions on vcDNA: vcDNA=SeqID_4657; Strand=+; Position=32-190
  misc_feature (16)..(25): Xaa can be any naturally occurring amino acid
  misc_feature (30)..(36): Xaa can be any naturally occurring amino acid
LIAIDVQVSIFILLVXXXXXXXXXXKILVXXXXXXXVTMKNFHILQYVTTYF

SEQ ID NO: 24961 - protein, 97 aa, Diabrotica virgifera
  misc_feature: Coding regions on vcDNA: vcDNA=SeqID_4658; Strand=+; Position=2-295
TFILLPVIIEIMLPKKHNFVKFQKAAPALALLFLSYTILYFSLYFRHGVWLYPVYKVLTWPQRLLFSAAQLCGALGYQKLGIVLQNSKRSQNKQKVK

SEQ ID NO: 24962 - protein, 61 aa, Diabrotica virgifera
  misc_feature: Coding regions on vcDNA: vcDNA=SeqID_4659; Strand=-; Position=1-183
  misc_feature (4)..(32): Xaa can be any naturally occurring amino acid
  misc_feature (35)..(56): Xaa can be any naturally occurring amino acid
ILNXXXXXXXXXXXXXXXXXXXXXXXXXXXXXLVXXXXXXXXXXXXXXXXXXXXXXDVFKK

SEQ ID NO: 24963 - protein, 37 aa, Diabrotica virgifera
  misc_feature: Coding regions on vcDNA: vcDNA=SeqID_4660; Strand=-; Position=1-111
GLFASLKKFSAFYLKIKFLIIKLRPFFFIPPFIPAFN

SEQ ID NO: 24964 - protein, 50 aa, Diabrotica virgifera
  misc_feature: Coding regions on vcDNA: vcDNA=SeqID_4661; Strand=-; Position=60-212
  misc_feature (6)..(18): Xaa can be any naturally occurring amino acid
  misc_feature (21)..(27): Xaa can be any naturally occurring amino acid
  misc_feature (41)..(47): Xaa can be any naturally occurring amino acid
NVKIFXXXXXXXXXXXXXFIXXXXXXXLDTHHIKILNHRCXXXXXXXAGS

SEQ ID NO: 24965 - protein, 60 aa, Diabrotica virgifera
  misc_feature: Coding regions on vcDNA: vcDNA=SeqID_4662; Strand=+; Position=26-208
  misc_feature: Homolog annotation: Hit_ID=1PPJ; Match level="QueryCoverage=96%, HitCoverage=93%, E-value=2e-13, Identity=56%"; Hit description=Chain W, Bovine Cytochrome Bc1 Complex With Stigmatellin And Antimycin pdb|1PPJ|J Chain J, Bovine Cytochrome
  misc_feature: Pfam annotation: Pfam_ID=UCR_UQCRX_QCR9; Match level="Score=97.3, E -value=3.9e-26, Copies=1"; Pfam description=Ubiquinol-cytochrome C reductase, UQCR
MGLSSTIYNSIFKRTSTMALAVVVSAFFFERTFDLATDTFFERYNEGKLWKHIKDKYEQE

SEQ ID NO: 24966 - protein, 148 aa, Diabrotica virgifera
  misc_feature: Coding regions on vcDNA: vcDNA=SeqID_4663; Strand=+; Position=2-445
  misc_feature: Homolog annotation: Hit_ID=S01168; Match level="QueryCoverage=99%, HitCoverage=59%, E-value=1e-30, Identity=41%"; Hit description=beta -glycosidase complex precursor - human emb|CAA30801.1| unnamed protein product [Homo
  misc_feature: Gene Ontology Annotation: Cellular component=endoplasmic reticulum; Biological process=aging
PRVRNYSRVAYRLFGDDVKFWITINEPLTICYYGYGTGAVPPFIQSEGILEYQCLRNLLKAHARAYHVYAEEFRNKQQGKLSMSFNTNAFLPGSDNPKDIQATERVQQFNLGVYAHPIFVGDWPEIVKTRVAIRSKLEGRNESRLPAF

SEQ ID NO: 24967 - protein, 141 aa, Diabrotica virgifera
  misc_feature: Coding regions on vcDNA: vcDNA=SeqID_4664; Strand=+; Position=2-424
  misc_feature: Homolog annotation: Hit_ID=XP_392380.1; Match level="QueryCoverage =82%, HitCoverage=34%, E-value=3e-22, Identity=46%"; Hit description =similar to CG1646-PA [Apis mellifera]
TKVEQKEAINTEGKQDTEKETLDKQKADPDTENISEDELPVVQAVKVPEAEEVSDEELPGPKRAELPADTEVVSEDELPTVKNDSKKESNKRKLATDYDPGSPTSENEAPSKKPSLDSSAEKDKEEKPKPKKLPELDKYWK

SEQ ID NO: 24968 - protein, 49 aa, Diabrotica virgifera
  misc_feature: Coding regions on vcDNA: vcDNA=SeqID_4665; Strand=-; Position=108-257
PANMKSTLFSLKLVTNDENQIRLDVQNNKNQITTLFNKELYIIHVAFKK

SEQ ID NO: 24969 - protein, 28 aa, Diabrotica virgifera
  misc_feature: Coding regions on vcDNA: vcDNA=SeqID_4666; Strand=-; Position=1-84
IGGTFGGVLNFLYGYVRFIPFGRPPLFF

SEQ ID NO: 24970 - protein, 17 aa, Diabrotica virgifera
  misc_feature: Coding regions on vcDNA: vcDNA=SeqID_4667; Strand=-; Position=1-51
  misc_feature (2)..(9): Xaa can be any naturally occurring amino acid
YXXXXXXXXVVIFPMRL

SEQ ID NO: 24971 - protein, 37 aa, Diabrotica virgifera
  misc_feature: Coding regions on vcDNA: vcDNA=SeqID_4668; Strand=-; Position=1-111
  misc_feature (3)..(37): Xaa can be any naturally occurring amino acid
FYXXXXXXXXXXXXXXXXXXXXXXXXXXXXXXXXXXX

SEQ ID NO: 24972 - protein, 21 aa, Diabrotica virgifera
  misc_feature: Coding regions on vcDNA: vcDNA=SeqID_4669; Strand=+; Position=2-67
ATIFCVPPKEEPMLLYMFVLI

SEQ ID NO: 24973 - protein, 90 aa, Diabrotica virgifera
  misc_feature: Coding regions on vcDNA: vcDNA=SeqID_4670; Strand=+; Position=14-286
  misc_feature (58)..(70): Xaa can be any naturally occurring amino acid
IICSTVLSKEFVTFVSNRTFQCCLYFFPQGPRYHMCKVCNAHGRHPLGAPKPWVKNCXXXXXXXXXXXXXVEKLNRIEYKHIRDFISIII

SEQ ID NO: 24974 - protein, 47 aa, Diabrotica virgifera
  misc_feature: Coding regions on vcDNA: vcDNA=SeqID_4671; Strand=-; Position=2-142
  misc_feature (39)..(44): Xaa can be any naturally occurring amino acid
SSLLSDGTISNMSTTSMNNVDNLCNPGRMTETGVYCCEXXXXXXQIN

SEQ ID NO: 24975 - protein, 39 aa, Diabrotica virgifera
  misc_feature: Coding regions on vcDNA: vcDNA=SeqID_4672; Strand=+; Position=32-148
  misc_feature (21)..(38): Xaa can be any naturally occurring amino acid
TYHLLMTILRNNKGQFTVYFXXXXXXXXXXXXXXXXXXP

SEQ ID NO: 24976 - protein, 71 aa, Diabrotica virgifera
  misc_feature: Coding regions on vcDNA: vcDNA=SeqID_4673; Strand=+; Position=2-217
KKVPVIIGFNSEEWLYLALMNNEEVLKAYDANPSSLVSGLMTMTPENRTIAGNLLKDLYTNNGSFVDDLGG

SEQ ID NO: 24977 - protein, 72 aa, Diabrotica virgifera
  misc_feature: Coding regions on vcDNA: vcDNA=SeqID_4674; Strand=-; Position=2-217
PKLLRGSISADRIGAKPANEWAWMCKAHKLRHDERFPKTDVIEPPVSKLKVPDKLEVIQRRIHAKISLDPLG

SEQ ID NO: 24978 - protein, 102 aa, Diabrotica virgifera
  misc_feature: Coding regions on vcDNA: vcDNA=SeqID_4675; Strand=+; Position=3-308
  misc_feature: Homolog annotation: Hit_ID=EAL25196.1; Match level="QueryCoverage =100%, HitCoverage=52%, E-value=4e-34, Identity=66%"; Hit description= GA10115-PA [Drosophila pseudoobscura]
  misc_feature: Gene Ontology Annotation: Cellular component=TRAPP; Biological process=intracellular protein transport
  misc_feature: Pfam annotation: Pfam_ID=TRAPP_Bet3; Match level="Score=44.6, E-value= 2.9e-10, Copies=1"; Pfam description=Transport protein particle (TRAPP) com
  misc_feature (13)..(13): Xaa can be any naturally occurring amino acid
IGVKLIDLYFVRXRGGKREIRLLNILLYVKSTLWKALFGKESHTLEHSNDDQNTYYLMEKEPLVNLYISVPRDKSSLNCAVMIAGIVEAVLIGTGFPAKVTA

SEQ ID NO: 24979 - protein, 37 aa, Diabrotica virgifera
  misc_feature: Coding regions on vcDNA: vcDNA=SeqID_4676; Strand=+; Position=133-246
MAKRATVKPGLHNVIMVCSGGVGKSALKLQFMYDEFG

SEQ ID NO: 24980 - protein, 68 aa, Diabrotica virgifera
  misc_feature: Coding regions on vcDNA: vcDNA=SeqID_4677; Strand=+; Position=1-207
  misc_feature (7)..(30): Xaa can be any naturally occurring amino acid
  misc_feature (47)..(58): Xaa can be any naturally occurring amino acid
  misc_feature (61)..(67): Xaa can be any naturally occurring amino acid
PTRPNLXXXXXXXXXXXXXXXXXXXXXXXXSFLHITNFLRTQLNLVXXXXXXXXXXXXSNXXXXXXXP

SEQ ID NO: 24981 - protein, 111 aa, Diabrotica virgifera
  misc_feature: Coding regions on vcDNA: vcDNA=SeqID_4678; Strand=+; Position=75-406
  misc_feature: Homolog annotation: Hit_ID=CAG04374.1; Match level="QueryCoverage =100%, HitCoverage=70%, E-value=7e-54, Identity=85%"; Hit description= unnamed protein product [Tetraodon nigroviridis]
  misc_feature: Gene Ontology Annotation: Molecular function=ubiquitin-like conjugating enzyme activity; Cellular component=nucleoplasm; Biological process=growth
  misc_feature: Pfam annotation: Pfam_ID=UQ_con; Match level="Score=71.7, E-value=2e -18, Copies=1"; Pfam description=Ubiquitin-conjugating enzyme
  misc_feature (101)..(101): Xaa can be any naturally occurring amino acid
MSGIAGARLTEERKAWRKDHPFGFVARPSKNQDGTLNLMNWECSIPGKKGTPWEEGHYKLRMLFKEDLPTSPTKCKFEPPLFHPNVYPSGTVCLSLLDEDXDWRPAITIKQ

SEQ ID NO: 24982 - protein, 78 aa, Diabrotica virgifera
  misc_feature: Coding regions on vcDNA: vcDNA=SeqID_4679; Strand=+; Position=92-328
SISCSKTRYTDDFLDYLFLTKRQLKICNMCRRIFGTGFFHVCDYRFFCHIGENTPRDFHIWPIYFKCRLLLYQYILLD

SEQ ID NO: 24983 - protein, 65 aa, Diabrotica virgifera
  misc_feature: Coding regions on vcDNA: vcDNA=SeqID_4680; Strand=-; Position=96-293
  misc_feature (39)..(47): Xaa can be any naturally occurring amino acid
APHGLFLRSQRKSFNIVIMVSLRRNVQTRVYIQPNTDVXXXXXXXXXDLNSHLKISKSNTNVMRK

SEQ ID NO: 24984 - protein, 64 aa, Diabrotica virgifera
  misc_feature: Coding regions on vcDNA: vcDNA=SeqID_4681; Strand=+; Position=216-407
  misc_feature (4)..(10): Xaa can be any naturally occurring amino acid
  misc_feature (43)..(50): Xaa can be any naturally occurring amino acid
FFNXXXXXXXLRRVLRAMVAGNKYQKLQKPNHTYKVEKILREXXXXXXXXLASRKIITNIFYVR

SEQ ID NO: 24985 - protein, 59 aa, Diabrotica virgifera
  misc_feature: Coding regions on vcDNA: vcDNA=SeqID_4682; Strand=-; Position=1-177
  misc_feature (1)..(36): Xaa can be any naturally occurring amino acid
  misc_feature (46)..(54): Xaa can be any naturally occurring amino acid
XXXXXXXXXXXXXXXXXXXXXXXXXXXXXXXXXXXXTAPIQFNHCXXXXXXXXXKDMFY

SEQ ID NO: 24986 - protein, 113 aa, Diabrotica virgifera
  misc_feature: Coding regions on vcDNA: vcDNA=SeqID_4683; Strand=+; Position=3-341
  misc_feature: Homolog annotation: Hit_ID=NP_861421.1; Match level="QueryCoverage =100%, HitCoverage=52%, E-value=2e-31, Identity=44%"; Hit description= zinc finger protein 233 [Homo sapiens]
  misc_feature: Gene Ontology Annotation: Molecular function=transcription factor activity; Cellular component=nucleus; Biological process=regulation of transcription, DNA-dependent
  misc_feature: Pfam annotation: Pfam_ID=zf-C2H2; Match level="Score=102.6, E-value =9.9e-28, Copies=4"; Pfam description=Zinc finger, C2H2 type
HTEEKPYQCQICFRSFSLNGYLKAHLRNHTGEQPHQCEICSKSFSNVSVLNTHKRIHTGEKPFQCEICFKSFSQSSAKNKHMMSHTGKKPYQCEICLKSFSRTHDLKDLKTGH

SEQ ID NO: 24987 - protein, 47 aa, Diabrotica virgifera
  misc_feature: Coding regions on vcDNA: vcDNA=SeqID_4684; Strand=+; Position=181-324
  misc_feature (17)..(24): Xaa can be any naturally occurring amino acid
KRILSGTTYFSSYYWFXXXXXXXXYFISYNLLYDIIEDFFIEYLHHI

SEQ ID NO: 24988 - protein, 70 aa, Diabrotica virgifera
  misc_feature: Coding regions on vcDNA: vcDNA=SeqID_4685; Strand=+; Position=177-386
YDNQDTEMELSLILGIVYIILPHFTSAASNFSTEQINSIEDTTQTPLKAYLTNGEIILLPKTEFPPKNEI

SEQ ID NO: 24989 - protein, 38 aa, Diabrotica virgifera
  misc_feature: Coding regions on vcDNA: vcDNA=SeqID_4686; Strand=-; Position=1-114
  misc_feature (2)..(38): Xaa can be any naturally occurring amino acid
LXXXXXXXXXXXXXXXXXXXXXXXXXXXXXXXXXXXXX

SEQ ID NO: 24990 - protein, 49 aa, Diabrotica virgifera
  misc_feature: Coding regions on vcDNA: vcDNA=SeqID_4687; Strand=-; Position=99-248
RMTSHDKKDIIRDLVYSKNLNTVRSFIIQNHDLESLNIVILETHGTKND

SEQ ID NO: 24991 - protein, 147 aa, Diabrotica virgifera
  misc_feature: Coding regions on vcDNA: vcDNA=SeqID_4688; Strand=+; Position=1-441
  misc_feature: Homolog annotation: Hit_ID=NP_503526.1; Match level="QueryCoverage =91%, HitCoverage=33%, E-value=2e-23, Identity=38%"; Hit description =predicted CDS, reverse transcriptase family member (5C378) [Caenorhabditis elegans]
PARPTTHPQTCEIQRRLTLAWAAYGALRDIFRSSIPIGLKRQVFEQCVLPVMTYGAETLTLTKATASKMRVAQRRMERSMLGVTLRDKIRNEDLRQTTGIADVVERITRLKWNWAGHVARLKDSRWARRLMEWRPREDKRSRGRPPT

SEQ ID NO: 24992 - protein, 107 aa, Diabrotica virgifera
  misc_feature: Coding regions on vcDNA: vcDNA=SeqID_4689; Strand=+; Position=1-321
  misc_feature: Homolog annotation: Hit_ID=P50533; Match level="QueryCoverage=88%, HitCoverage=7%, E-value=2e-15, Identity=45%"; Hit description =Structural maintenance of chromosome 2 (Chromosome-associated protein E) (Chromosome
  misc_feature: Gene Ontology Annotation: Molecular function=ATP-binding cassette (ABC) transporter activity; Cellular component=membrane; Biological process=transport
HPPVRPRVRLDSRTTSYDSKLQILRRVVNTKAQIRCEQQENQYNELRKRDEILMHDTTKILETIQEMDTQKKNSLRLPYDQLSNDFGSIFSTLLPGANARLVLPPGK

SEQ ID NO: 24993 - protein, 30 aa, Diabrotica virgifera
  misc_feature: Coding regions on vcDNA: vcDNA=SeqID_4690; Strand=-; Position=0-89
  misc_feature (4)..(18): Xaa can be any naturally occurring amino acid
LFLXXXXXXXXXXXXXXXMFILKNVYTITT

SEQ ID NO: 24994 - protein, 76 aa, Diabrotica virgifera
  misc_feature: Coding regions on vcDNA: vcDNA=SeqID_4691; Strand=-; Position=7-237
WIFSKFSWVTSFSFSWGFHSRAVLVILELFFTHLTFICPVVASQNSKHSSTTDHFSDVYLLSACRSTFAHKLITLT

SEQ ID NO: 24995 - protein, 102 aa, Diabrotica virgifera
  misc_feature: Coding regions on vcDNA: vcDNA=SeqID_4692; Strand=+; Position=2-307
  misc_feature: Homolog annotation: Hit_ID=EAL31477.1; Match level="QueryCoverage =98%, HitCoverage=56%, E-value=2e-21, Identity=53%"; Hit description =GA14506-PA [Drosophila pseudoobscura]
  misc_feature: Gene Ontology Annotation: Molecular function=glutathione transferase activity; Cellular component=microsome; Biological process =glutathione metabolism
  misc_feature: Pfam annotation: Pfam_ID=MAPEG; Match level="Score=22.9, E-value=5e -07, Copies=1"; Pfam description=MAPEG family
  misc_feature (10)..(15): Xaa can be any naturally occurring amino acid
  misc_feature (74)..(74): Xaa can be any naturally occurring amino acid
KAFANPEDAXXXXXXPKVSEHVERVRRAHLNDIEKIPLFFVTGLIYTLTNPAVYLAKTFFLAYTLARISHTVVXAVVPIPQPAGGLCWMVGYGITGYMAVVS

SEQ ID NO: 24996 - protein, 85 aa, Diabrotica virgifera
  misc_feature: Coding regions on vcDNA: vcDNA=SeqID_4693; Strand=-; Position=63-320
  misc_feature (42)..(59): Xaa can be any naturally occurring amino acid
TNAAIGDSPSALETFLCAKKNLIENKTRFYNSKNLKLKKKNXXXXXXXXXXXXXXXXXXNTASSSSLTAWSPLISRAVAGLMSSI

SEQ ID NO: 24997 - protein, 141 aa, Diabrotica virgifera
  misc_feature: Coding regions on vcDNA: vcDNA=SeqID_4694; Strand=+; Position=2-424
  misc_feature: Homolog annotation: Hit_ID=XP_309435.1; Match level="QueryCoverage =97%, HitCoverage=27%, E-value=7e-28, Identity=48%"; Hit description =ENSANGP00000011164 [Anopheles gambiae]
  misc_feature: Gene Ontology Annotation: Molecular function=polyamine oxidase activity; Biological process=spermine catabolism
  misc_feature (110)..(110): Xaa can be any naturally occurring amino acid
DVFGFYVIDSQPNTLLGWVVGKMAAEVEYMSDDDVIALCMFLLRKFLGKLYNICDADEILRSKWSSNSHFCGSYVFKSIDQEKHIATAEDLARPVTSNKDNKPVLFFAGXATSPDHFSTVHGAIETGFREGDRLAQLLKKT

SEQ ID NO: 24998 - protein, 92 aa, Diabrotica virgifera
  misc_feature: Coding regions on vcDNA: vcDNA=SeqID_4695; Strand=+; Position=62-337
  misc_feature: Homolog annotation: Hit_ID=CAA67590.1; Match level="QueryCoverage =100%, HitCoverage=62%, E-value=4e-26, Identity=59%"; Hit description= ribosomal protein L27a [Tenebrio molitor] sp|Q27021|RL2A_TENMO 60S ribosomal protein L27a
  misc_feature: Gene Ontology Annotation: Molecular function=structural constituent of ribosome; Cellular component=nucleus; Biological process=protein biosynthesis
  misc_feature (38)..(38): Xaa can be any naturally occurring amino acid
  misc_feature (42)..(42): Xaa can be any naturally occurring amino acid
  misc_feature (51)..(51): Xaa can be any naturally occurring amino acid
LRGHVYHCQRRFGKHRKHPTGPGNAGGMHHRKITVDVXHPGXLGELGITNXHVRKNSNRCPAINLYKLWTLLVEQPRLAYLEYPSGNDPFID

SEQ ID NO: 24999 - protein, 48 aa, Diabrotica virgifera
  misc_feature: Coding regions on vcDNA: vcDNA=SeqID_4696; Strand=-; Position=122-268
KTNNSSLQKSSVKYLLPTKNLNCLAGLNWKLVNLYALGDNPCDTRYAK

SEQ ID NO: 25000 - protein, 49 aa, Diabrotica virgifera
  misc_feature: Coding regions on vcDNA: vcDNA=SeqID_4697; Strand=-; Position=1-147
KSNLVQFFLPPTYQFPGGRNCELNLTRLKNYGGFPFGNYGQFFPKAWVA

SEQ ID NO: 25001 - protein, 50 aa, Diabrotica virgifera
  misc_feature: Coding regions on vcDNA: vcDNA=SeqID_4698; Strand=-; Position=2-151
  misc_feature (10)..(17): Xaa can be any naturally occurring amino acid
  misc_feature (29)..(38): Xaa can be any naturally occurring amino acid
PPPKYILNKXXXXXXXXHLVIFKTSIYIXXXXXXXXXXLNLYNNSFTILL

SEQ ID NO: 25002 - protein, 88 aa, Diabrotica virgifera
  misc_feature: Coding regions on vcDNA: vcDNA=SeqID_4699; Strand=+; Position=165-428
  misc_feature (13)..(13): Xaa can be any naturally occurring amino acid
  misc_feature (16)..(22): Xaa can be any naturally occurring amino acid
  misc_feature (31)..(48): Xaa can be any naturally occurring amino acid
  misc_feature (52)..(65): Xaa can be any naturally occurring amino acid
  misc_feature (76)..(76): Xaa can be any naturally occurring amino acid
MQRSYSLILLRFXVCXXXXXXXGKLYKYGIXXXXXXXXXXXXXXXXXXVFSXXXXXXXXXXXXXXLVPVLLLIIGXGYQPERLEAGIY

SEQ ID NO: 25003 - protein, 41 aa, Diabrotica virgifera
  misc_feature: Coding regions on vcDNA: vcDNA=SeqID_4700; Strand=+; Position=53-175
FTLNDFLVLAAVFAVADAFQVDYLRWVSLYGTLPDNGLPPG

SEQ ID NO: 25004 - protein, 61 aa, Diabrotica virgifera
  misc_feature: Coding regions on vcDNA: vcDNA=SeqID_4701; Strand=-; Position=173-358
  misc_feature (2)..(8): Xaa can be any naturally occurring amino acid
  misc_feature (15)..(22): Xaa can be any naturally occurring amino acid
LXXXXXXXKYIIFHXXXXXXXXFSILYHSLRCMNHTNTGKFSYLLDSYDYRNFNQQFKNIV

SEQ ID NO: 25005 - protein, 34 aa, Diabrotica virgifera
  misc_feature: Coding regions on vcDNA: vcDNA=SeqID_4702; Strand=-; Position=1-102
  misc_feature (4)..(23): Xaa can be any naturally occurring amino acid
QMLXXXXXXXXXXXXXXXXXXXXDAMADAWGPPE

SEQ ID NO: 25006 - protein, 37 aa, Diabrotica virgifera
  misc_feature: Coding regions on vcDNA: vcDNA=SeqID_4703; Strand=-; Position=1-111
  misc_feature (1)..(16): Xaa can be any naturally occurring amino acid
  misc_feature (22)..(34): Xaa can be any naturally occurring amino acid
XXXXXXXXXXXXXXXXLVTPRXXXXXXXXXXXXXLSH

SEQ ID NO: 25007 - protein, 122 aa, Diabrotica virgifera
  misc_feature: Coding regions on vcDNA: vcDNA=SeqID_4704; Strand=+; Position=1-366
  misc_feature (103)..(112): Xaa can be any naturally occurring amino acid
SGAVRQLKDLQLIEKQDELRTQAKRAVNEKLSKEKELLKTKRDFKEDKTVPEPVGERDPSTECAIQHCNESCRDNSKLIGKLQKENSELSRKNQNCLEEINDXXXXXXXXXXDFSMFHTKIS

SEQ ID NO: 25008 - protein, 75 aa, Diabrotica virgifera
  misc_feature: Coding regions on vcDNA: vcDNA=SeqID_4705; Strand=+; Position=2-229
  misc_feature (5)..(22): Xaa can be any naturally occurring amino acid
  misc_feature (35)..(48): Xaa can be any naturally occurring amino acid
PPTRXXXXXXXXXXXXXXXXXXKTLFFLQEDTTLXXXXXXXXXXXXXXVYLPNGFNLSCVIMKFNNLSKGYPNSN

SEQ ID NO: 25009 - protein, 31 aa, Diabrotica virgifera
  misc_feature: Coding regions on vcDNA: vcDNA=SeqID_4706; Strand=-; Position=206-301
KYKQLVNPSTMICNLNKIQNILIHTSYRMCH

SEQ ID NO: 25010 - protein, 73 aa, Diabrotica virgifera
  misc_feature: Coding regions on vcDNA: vcDNA=SeqID_4707; Strand=-; Position=3-221
  misc_feature (10)..(56): Xaa can be any naturally occurring amino acid
GLVRFDSFGXXXXXXXXXXXXXXXXXXXXXXXXXXXXXXXXXXXXXXXXXXXXXXXVYSDFHINLSHISLKLC

SEQ ID NO: 25011 - protein, 57 aa, Diabrotica virgifera
  misc_feature: Coding regions on vcDNA: vcDNA=SeqID_4708; Strand=+; Position=3-173
NKVKIITLVFYLRITFSSITIIIGEIYRISRKINNNLTRFSEGIYFNKINFMYRNFQ

SEQ ID NO: 25012 - protein, 84 aa, Diabrotica virgifera
  misc_feature: Coding regions on vcDNA: vcDNA=SeqID_4709; Strand=-; Position=2-253
  misc_feature (17)..(27): Xaa can be any naturally occurring amino acid
  misc_feature (32)..(49): Xaa can be any naturally occurring amino acid
  misc_feature (52)..(65): Xaa can be any naturally occurring amino acid
  misc_feature (72)..(81): Xaa can be any naturally occurring amino acid
RNGPYKNFVIFTTAIKXXXXXXXXXXXIKLFXXXXXXXXXXXXXXXXXXLFXXXXXXXXXXXXXXKINLNIXXXXXXXXXXDAL

SEQ ID NO: 25013 - protein, 50 aa, Diabrotica virgifera
  misc_feature: Coding regions on vcDNA: vcDNA=SeqID_4710; Strand=-; Position=22-174
ITPPCLKTEHSCLHVKAPIHVEIGIDTCIATSCDTCIMRFISVSRQWCRR

SEQ ID NO: 25014 - protein, 53 aa, Diabrotica virgifera
  misc_feature: Coding regions on vcDNA: vcDNA=SeqID_4711; Strand=-; Position=2-160
  misc_feature (26)..(32): Xaa can be any naturally occurring amino acid
  misc_feature (36)..(45): Xaa can be any naturally occurring amino acid
NISHNKDFFKKHNLLTLSNYIASSRXXXXXXXFNIXXXXXXXXXXTVQMTTFR

SEQ ID NO: 25015 - protein, 69 aa, Diabrotica virgifera
  misc_feature: Coding regions on vcDNA: vcDNA=SeqID_4712; Strand=+; Position=47-253
  misc_feature (9)..(21): Xaa can be any naturally occurring amino acid
NIFNKTISXXXXXXXXXXXXXKHKRNRPISDQERHSPKSPVHSPSIGATRPGSMAPPIRYPGREATGTP

SEQ ID NO: 25016 - protein, 34 aa, Diabrotica virgifera
  misc_feature: Coding regions on vcDNA: vcDNA=SeqID_4713; Strand=+; Position=64-168
FSLMIFNYYCALLCYFYPLRVYFMSLRVSWISRF

SEQ ID NO: 25017 - protein, 124 aa, Diabrotica virgifera
  misc_feature: Coding regions on vcDNA: vcDNA=SeqID_4714; Strand=-; Position=0-371
  misc_feature (31)..(107): Xaa can be any naturally occurring amino acid
YFSTVQITGAIKIIQWAGGTLIYVQKDMFLXXXXXXXXXXXXXXXXXXXXXXXXXXXXXXXXXXXXXXXXXXXXXXXXXXXXXXXXXXXXXXXXXXXXXXXXXXXXXTNKILSIRSSLKIVRVV

SEQ ID NO: 25018 - protein, 65 aa, Diabrotica virgifera
  misc_feature: Coding regions on vcDNA: vcDNA=SeqID_4715; Strand=-; Position=2-196
  misc_feature (14)..(22): Xaa can be any naturally occurring amino acid
  misc_feature (26)..(32): Xaa can be any naturally occurring amino acid
FKSKGNVFEQFIDXXXXXXXXXCLCXXXXXXXIPPSLPLSSYHACSLHLTWHWFPSCQPSLPHAW

SEQ ID NO: 25019 - protein, 73 aa, Diabrotica virgifera
  misc_feature: Coding regions on vcDNA: vcDNA=SeqID_4716; Strand=+; Position=57-278
VVLRRLIIDIVIFLSCQELTFRRQDESEHSLNQVNYREQIKLFNKYDLEFSNLLFDSKTFNGVPKTAQNERIN

SEQ ID NO: 25020 - protein, 64 aa, Diabrotica virgifera
  misc_feature: Coding regions on vcDNA: vcDNA=SeqID_4717; Strand=-; Position=56-250
IHFSKKLTHCLKNWSPPMPRISQTCPIQVISLTCCSPIPQQYRCNNIVARQATCHCTPGAPIKL

SEQ ID NO: 25021 - protein, 50 aa, Diabrotica virgifera
  misc_feature: Coding regions on vcDNA: vcDNA=SeqID_4718; Strand=-; Position=99-251
REAFSQNLAGIFCRPNTVLTQFIGNFKFDVGSKEETHCRVIFNSMLNLLL

SEQ ID NO: 25022 - protein, 130 aa, Diabrotica virgifera
  misc_feature: Coding regions on vcDNA: vcDNA=SeqID_4719; Strand=+; Position=3-392
  misc_feature: Homolog annotation: Hit_ID=CAG31896.1; Match level="QueryCoverage =95%, HitCoverage=37%, E-value=6e-21, Identity=42%"; Hit description =hypothetical protein [Gallus gallus]
  misc_feature: Gene Ontology Annotation: Molecular function=ATP binding; Cellular component=cellular_component unknown; Biological process=protein amino acid phosphorylation
EKSDIYSLGILTCELANGSEPFSGMSKTLMLTEKVRGCVPPLLDKTTIPRGENLDCGDTEISSSILNRRFSHNLHQFVSLCFMWDVTDRPSATQLINHPIFKTVKRALPLPELLKPALPLSDRVGFDTDE

SEQ ID NO: 25023 - protein, 97 aa, Diabrotica virgifera
  misc_feature: Coding regions on vcDNA: vcDNA=SeqID_4720; Strand=-; Position=0-290
  misc_feature (1)..(16): Xaa can be any naturally occurring amino acid
  misc_feature (19)..(52): Xaa can be any naturally occurring amino acid
  misc_feature (58)..(75): Xaa can be any naturally occurring amino acid
  misc_feature (80)..(89): Xaa can be any naturally occurring amino acid
XXXXXXXXXXXXXXXXYPXXXXXXXXXXXXXXXXXXXXXXXXXXXXXXXXXXGLPFLXXXXXXXXXXXXXXXXXXFFKFXXXXXXXXXXLSLKPQVP

SEQ ID NO: 25024 - protein, 95 aa, Diabrotica virgifera
  misc_feature: Coding regions on vcDNA: vcDNA=SeqID_4721; Strand=+; Position=3-287
  misc_feature (20)..(27): Xaa can be any naturally occurring amino acid
  misc_feature (33)..(45): Xaa can be any naturally occurring amino acid
MGVRAQKSHRNGETPTTCKXXXXXXXXSQQRPXXXXXXXXXXXXXKGTKPTQPSSEDQRPPKGTPKLTSRGSVSQGPAGKPPGGTKSNPLEQNPP

SEQ ID NO: 25025 - protein, 57 aa, Diabrotica virgifera
  misc_feature: Coding regions on vcDNA: vcDNA=SeqID_4722; Strand=+; Position=183-356
SIFICSHPHQFCLPFFLSQKYDFKIIYVPLPSKNNIKRFYYISIVVNMTTYVYRWFF

SEQ ID NO: 25026 - protein, 56 aa, Diabrotica virgifera
  misc_feature: Coding regions on vcDNA: vcDNA=SeqID_4723; Strand=-; Position=96-266
  misc_feature (29)..(35): Xaa can be any naturally occurring amino acid
KHQDINLINNLEKSISITILKHINHNNTXXXXXXXVNKILNPTPKNIPIDHAPTTN

SEQ ID NO: 25027 - protein, 81 aa, Diabrotica virgifera
  misc_feature: Coding regions on vcDNA: vcDNA=SeqID_4724; Strand=-; Position=2-244
  misc_feature (6)..(37): Xaa can be any naturally occurring amino acid
  misc_feature (43)..(60): Xaa can be any naturally occurring amino acid
  misc_feature (65)..(77): Xaa can be any naturally occurring amino acid
HPLKYXXXXXXXXXXXXXXXXXXXXXXXXXXXXXXXXGLPFIXXXXXXXXXXXXXXXXXXSFKFXXXXXXXXXXXXXVHKV

SEQ ID NO: 25028 - protein, 84 aa, Diabrotica virgifera
  misc_feature: Coding regions on vcDNA: vcDNA=SeqID_4725; Strand=+; Position=27-279
  misc_feature: Homolog annotation: Hit_ID=XP_313007.1; Match level="QueryCoverage =92%, HitCoverage=24%, E-value=2e-11, Identity=49%"; Hit description =ENSANGP00000020386 [Anopheles gambiae] gb|EAA08668.1| ENSANGP00000020386 [Anopheles gambiae
  misc_feature (52)..(52): Xaa can be any naturally occurring amino acid
LRELKKLLGNGGGGKHVTYEVVPHASHSSAHVSTHETAYAGGSGHGGRYGGXSGGGANAGGGPGGWGRSLNAKPLPYRGHQQAK

SEQ ID NO: 25029 - protein, 57 aa, Diabrotica virgifera
  misc_feature: Coding regions on vcDNA: vcDNA=SeqID_4726; Strand=+; Position=1-171
  misc_feature (4)..(30): Xaa can be any naturally occurring amino acid
  misc_feature (32)..(41): Xaa can be any naturally occurring amino acid
IKIXXXXXXXXXXXXXXXXXXXXXXXXXXXLXXXXXXXXXXPFIKNKSFCIKYKVPP

SEQ ID NO: 25030 - protein, 25 aa, Diabrotica virgifera
  misc_feature: Coding regions on vcDNA: vcDNA=SeqID_4727; Strand=-; Position=2-76
  misc_feature (20)..(25): Xaa can be any naturally occurring amino acid
GAFWNGFGLNSDPYLLTCTXXXXXX

SEQ ID NO: 25031 - protein, 44 aa, Diabrotica virgifera
  misc_feature: Coding regions on vcDNA: vcDNA=SeqID_4728; Strand=-; Position=0-131
  misc_feature (4)..(40): Xaa can be any naturally occurring amino acid
NKFXXXXXXXXXXXXXXXXXXXXXXXXXXXXXXXXXXXXXGRVG

SEQ ID NO: 25032 - protein, 114 aa, Diabrotica virgifera
  misc_feature: Coding regions on vcDNA: vcDNA=SeqID_4729; Strand=-; Position=1-342
  misc_feature (2)..(68): Xaa can be any naturally occurring amino acid
  misc_feature (74)..(89): Xaa can be any naturally occurring amino acid
  misc_feature (103)..(113): Xaa can be any naturally occurring amino acid
LXXXXXXXXXXXXXXXXXXXXXXXXXXXXXXXXXXXXXXXXXXXXXXXXXXXXXXXXXXXXXXXXXXXLVPQVXXXXXXXXXXXXXXXXLIYFPLIKFFLTFXXXXXXXXXXXP

SEQ ID NO: 25033 - protein, 54 aa, Diabrotica virgifera
  misc_feature: Coding regions on vcDNA: vcDNA=SeqID_4730; Strand=-; Position=155-319
  misc_feature (43)..(52): Xaa can be any naturally occurring amino acid
FFSRCTLHYNYAVFPQVTYSCIPKNLIPKILTHVIILKKVNFXXXXXXXXXXVG

SEQ ID NO: 25034 - protein, 128 aa, Diabrotica virgifera
  misc_feature: Coding regions on vcDNA: vcDNA=SeqID_4731; Strand=+; Position=2-385
  misc_feature: Homolog annotation: Hit_ID=AAV88529.1; Match level="QueryCoverage =100%, HitCoverage=33%, E-value=2e-63, Identity=94%"; Hit description= cadherin-like protein [Diabrotica virgifera virgifera]
  misc_feature (25)..(31): Xaa can be any naturally occurring amino acid
FEFKIKVEDNRDDYGNGPFESEADXXXXXXXKDNTVDFQFYNDIEDVQDRETPMLKIISDIVGYDAYRQNIDTVTNSGLVRTRARLYFIDSKSSRRLQLTKSPADSGFELVNSETILNIVTNVNTFQN

SEQ ID NO: 25035 - protein, 102 aa, Diabrotica virgifera
  misc_feature: Coding regions on vcDNA: vcDNA=SeqID_4732; Strand=+; Position=77-382
MKTKLISFLKMMNLTDQTQSLTSEVKGIKEEQREYRNDLRELRKEINEFKQSNQQLQKENDEMKQELKIVKMKVEKFEKERKANNVIVQGLPMDTNNPNVVN

SEQ ID NO: 25036 - protein, 65 aa, Diabrotica virgifera
  misc_feature: Coding regions on vcDNA: vcDNA=SeqID_4733; Strand=+; Position=2-199
  misc_feature (22)..(29): Xaa can be any naturally occurring amino acid
VYGKHGNSERSHSSVLTVLLRXXXXXXXXRFCSKNTICTYYAKLIKSKQPTSLPKNMRDIFYFHL

SEQ ID NO: 25037 - protein, 51 aa, Diabrotica virgifera
  misc_feature: Coding regions on vcDNA: vcDNA=SeqID_4734; Strand=-; Position=247-402
FKYMRYPMFLKRCNLLKINVRNLTSKLHDRIRLVKKLQTSGQYQSSYIRAG

SEQ ID NO: 25038 - protein, 125 aa, Diabrotica virgifera
  misc_feature: Coding regions on vcDNA: vcDNA=SeqID_4735; Strand=+; Position=3-377
  misc_feature (16)..(24): Xaa can be any naturally occurring amino acid
DKGMEIVKCAQRAISXXXXXXXXXSHNPFVVIRNVSWTGSIGVASTHIELNTNKWYGLADWDISAKQINDDEDFEAVFDYTTYWPSFRIVGNYEATVKELFLTQHYKGTYNITMIKPKWTGRISA

SEQ ID NO: 25039 - protein, 63 aa, Diabrotica virgifera
  misc_feature: Coding regions on vcDNA: vcDNA=SeqID_4736; Strand=-; Position=67-258
  misc_feature (25)..(30): Xaa can be any naturally occurring amino acid
SVVFCESVREVRRNDCLHDCLHNLXXXXXXQTLLIAYVISLDVHPYHDRIPWWMATLTETSTG

SEQ ID NO: 25040 - protein, 123 aa, Diabrotica virgifera
  misc_feature: Coding regions on vcDNA: vcDNA=SeqID_4737; Strand=+; Position=1-369
  misc_feature: Homolog annotation: Hit_ID=AAC24041.1; Match level="QueryCoverage =100%, HitCoverage=34%, E-value=4e-64, Identity=92%"; Hit description= casein kinase II alpha subunit [Spodoptera frugiperda] sp|O76484|KC2A_ SPOFR Casein kinase II, alpha chain
  misc_feature: Gene Ontology Annotation: Molecular function=protein kinase CK2 activity; Cellular component=protein kinase CK2 complex; Biological process=signal transduction
MWSLGCMLASMIFRKEPFFHGHDNYDQLVRIAKVLGTEELFEYLDKYHIELDPRFNDILGRHSRKRWERFVHSENQHLVSPEALDFLDKLLRYDHLERLTARDAMDHSYFYPVVKEQCRMLST

SEQ ID NO: 25041 - protein, 106 aa, Diabrotica virgifera
  misc_feature: Coding regions on vcDNA: vcDNA=SeqID_4738; Strand=+; Position=2-322
  misc_feature: Homolog annotation: Hit_ID=AAH85423.1; Match level="QueryCoverage =91%, HitCoverage=30%, E-value=4e-15, Identity=43%"; Hit description =Zgc:101719 [Danio rerio] ref|NP_001007425.1| zgc:101719 [Danio rerio]
PRVRRLNEFNISVFALHPGMIATDIITRHLSPVVYRGVAPLSKFLFKTPEEGAQTTIYVATEPGIEHLTGGFFSECHYQEHYKTARDPELARQLWDETIKLLNYND

SEQ ID NO: 25042 - protein, 47 aa, Diabrotica virgifera
  misc_feature: Coding regions on vcDNA: vcDNA=SeqID_4739; Strand=+; Position=67-210
HFYCRINILHTVFVLKCHTILDTSKFLDRTVHLIISNILISDTVLHQ

SEQ ID NO: 25043 - protein, 122 aa, Diabrotica virgifera
  misc_feature: Coding regions on vcDNA: vcDNA=SeqID_4740; Strand=-; Position=0-365
  misc_feature (1)..(48): Xaa can be any naturally occurring amino acid
  misc_feature (54)..(73): Xaa can be any naturally occurring amino acid
  misc_feature (76)..(87): Xaa can be any naturally occurring amino acid
  misc_feature (93)..(105): Xaa can be any naturally occurring amino acid
  misc_feature (108)..(120): Xaa can be any naturally occurring amino acid
XXXXXXXXXXXXXXXXXXXXXXXXXXXXXXXXXXXXXXXXXXXXXXXXGLPFIXXXXXXXXXXXXXXXXXXXXKFXXXXXXXXXXXXLDPQVXXXXXXXXXXXXXSPXXXXXXXXXXXXXFS

SEQ ID NO: 25044 - protein, 36 aa, Diabrotica virgifera
  misc_feature: Coding regions on vcDNA: vcDNA=SeqID_4741; Strand=-; Position=41-151
FYQIIYSYNKYFMILINFELFKKWVDLVSLDQMYYY

SEQ ID NO: 25045 - protein, 57 aa, Diabrotica virgifera
  misc_feature: Coding regions on vcDNA: vcDNA=SeqID_4742; Strand=+; Position=2-175
HVCNFGIVEIKFDINFLNQFLFKQLPDVSFLTDRTLLTNRKRIQGGLRRKRSMYNVT

SEQ ID NO: 25046 - protein, 85 aa, Diabrotica virgifera
  misc_feature: Coding regions on vcDNA: vcDNA=SeqID_4743; Strand=+; Position=2-259
ASDHASDFASEQTFGNCSVKTLVTISFVWQGFRALKALQSASPGSLLGSTLRSYDLNSLLSYTLWGRLCGNSVALGYLSRSLFNS

SEQ ID NO: 25047 - protein, 106 aa, Diabrotica virgifera
  misc_feature: Coding regions on vcDNA: vcDNA=SeqID_4744; Strand=+; Position=53-373
  misc_feature: Homolog annotation: Hit_ID=XP_392408.1; Match level="QueryCoverage =100%, HitCoverage=5%, E-value=4e-44, Identity=78%"; Hit description =similar to ENSANGP00000017306 [Apis mellifera]
  misc_feature: Gene Ontology Annotation: Molecular function=transcription factor activity; Cellular component=nucleus; Biological process=regulation of transcription, DNA-dependent
FFDLLKLYFPTIYDVKYLMKSCKNLKGGLQEVAEQLELERIGPQHQAGSDSLLTGMAFFKMKEMFFEDTIDDSKFSGHLYGLGTSFAVNGTANNYSNDNGDTTNSS

SEQ ID NO: 25048 - protein, 26 aa, Diabrotica virgifera
  misc_feature: Coding regions on vcDNA: vcDNA=SeqID_4745; Strand=-; Position=32-112
SYIVRKLVLSEHKIHVFLKCMMKFNY

SEQ ID NO: 25049 - protein, 44 aa, Diabrotica virgifera
  misc_feature: Coding regions on vcDNA: vcDNA=SeqID_4746; Strand=-; Position=3-134
  misc_feature (26)..(32): Xaa can be any naturally occurring amino acid
NGPFGVKYRNQLMLATNLVHTGLNSXXXXXXXSNRSTSIVATPL

SEQ ID NO: 25050 - protein, 59 aa, Diabrotica virgifera
  misc_feature: Coding regions on vcDNA: vcDNA=SeqID_4747; Strand=-; Position=2-178
RNYPTDCSTYTHSLIYHPSSFHPDCRIPLQDIYIQTMKVYNLMFQFLMLNISLINVGLL

SEQ ID NO: 25051 - protein, 104 aa, Diabrotica virgifera
  misc_feature: Coding regions on vcDNA: vcDNA=SeqID_4748; Strand=-; Position=1-312
  misc_feature (1)..(69): Xaa can be any naturally occurring amino acid
  misc_feature (79)..(99): Xaa can be any naturally occurring amino acid
XXXXXXXXXXXXXXXXXXXXXXXXXXXXXXXXXXXXXXXXXXXXXXXXXXXXXXXXXXXXXXXXXXXXXSPFLFLILLXXXXXXXXXXXXXXXXXXXXXFLLFF

SEQ ID NO: 25052 - protein, 85 aa, Diabrotica virgifera
  misc_feature: Coding regions on vcDNA: vcDNA=SeqID_4749; Strand=+; Position=1-258
EPDTEIQYSSPNQYIITATDDNQLISEPKPIETNEVSDTEPETPVFDNSRIALYFSNNQRLKKETQEASVGELKEESKESETVQI

SEQ ID NO: 25053 - protein, 58 aa, Diabrotica virgifera
  misc_feature: Coding regions on vcDNA: vcDNA=SeqID_4750; Strand=+; Position=131-307
FETLVHVCCVCWIITYDVDSDCCRLQMACGDEIYNGYSGFLIIFLSRALIHLVVDLIP

SEQ ID NO: 25054 - protein, 70 aa, Diabrotica virgifera
  misc_feature: Coding regions on vcDNA: vcDNA=SeqID_4751; Strand=-; Position=73-285
  misc_feature (51)..(57): Xaa can be any naturally occurring amino acid
CYTIYKLYTNIAVALFIISFVVSYCNIDNIQQVNLYFNLNIWIIKTVNFLXXXXXXXLLNNHLTVISLLN

SEQ ID NO: 25055 - protein, 35 aa, Diabrotica virgifera
  misc_feature: Coding regions on vcDNA: vcDNA=SeqID_4752; Strand=+; Position=29-136
ITKSSTFAIRKKNSVSNTDDLVIQTVEQCRTSKKK

SEQ ID NO: 25056 - protein, 35 aa, Diabrotica virgifera
  misc_feature: Coding regions on vcDNA: vcDNA=SeqID_4753; Strand=+; Position=146-253
TYHRIVKCFTYWTNTKFHPKLAHQMVSRPTHSSMA

SEQ ID NO: 25057 - protein, 76 aa, Diabrotica virgifera
  misc_feature: Coding regions on vcDNA: vcDNA=SeqID_4754; Strand=+; Position=82-309
  misc_feature: Homolog annotation: Hit_ID=XP_321964.1; Match level="QueryCoverage =85%, HitCoverage=7%, E-value=2e-25, Identity=78%"; Hit description =ENSANGP00000013874 [Anopheles gambiae]
  misc_feature: Gene Ontology Annotation: Molecular function=RNA binding; Cellular component=nucleoplasm; Biological process=mRNA-nucleus export
NWGKNWTRAQRDQKNLFLIIIQRFSMILTEHLVRCDTDGKDYGTHWYKWTIGRLQQIFLAHHDQVQKYSSTLETLL

SEQ ID NO: 25058 - protein, 40 aa, Diabrotica virgifera
  misc_feature: Coding regions on vcDNA: vcDNA=SeqID_4755; Strand=+; Position=44-166
SYRKLFPDVEQFMGYLPQTYLHRWLRRPPMNLISDFFNSS

SEQ ID NO: 25059 - protein, 79 aa, Diabrotica virgifera
  misc_feature: Coding regions on vcDNA: vcDNA=SeqID_4756; Strand=-; Position=0-236
  misc_feature (1)..(52): Xaa can be any naturally occurring amino acid
XXXXXXXXXXXXXXXXXXXXXXXXXXXXXXXXXXXXXXXXXXXXXXXXXXXXECTLQPYLFTIVHRYKNIGRVVGSAWV

SEQ ID NO: 25060 - protein, 81 aa, Diabrotica virgifera
  misc_feature: Coding regions on vcDNA: vcDNA=SeqID_4757; Strand=+; Position=3-245
ALKEKGGPSKGFILLLPSTRSPNSFSLAPLFKSRGCDFPALSRENPLVSQLSSPTRLPPFHDCPFPQSAHFFSPFRNFSPP

SEQ ID NO: 25061 - protein, 24 aa, Diabrotica virgifera
  misc_feature: Coding regions on vcDNA: vcDNA=SeqID_4758; Strand=-; Position=1-72
  misc_feature (14)..(21): Xaa can be any naturally occurring amino acid
FYLFQKECFLLNGXXXXXXXXLLN

SEQ ID NO: 25062 - protein, 74 aa, Diabrotica virgifera
  misc_feature: Coding regions on vcDNA: vcDNA=SeqID_4759; Strand=+; Position=76-297
  misc_feature (15)..(21): Xaa can be any naturally occurring amino acid
REGIVHNRYGRITPXXXXXXXTIIMRLHIGFNVLIGNYKCQGRTLILITPFRLILFNEFPGLYAYMYTVLRHLA

SEQ ID NO: 25063 - protein, 56 aa, Diabrotica virgifera
  misc_feature: Coding regions on vcDNA: vcDNA=SeqID_4760; Strand=+; Position=96-266
PSSKFAYKNRDQRQSRFGPFRLIYALLGNRVASILARVGFCIFHKVDGHIINCCAR

SEQ ID NO: 25064 - protein, 118 aa, Diabrotica virgifera
  misc_feature: Coding regions on vcDNA: vcDNA=SeqID_4761; Strand=-; Position=1-354
  misc_feature (8)..(110): Xaa can be any naturally occurring amino acid
IYILLKNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAYAFVEPG

SEQ ID NO: 25065 - protein, 56 aa, Diabrotica virgifera
  misc_feature: Coding regions on vcDNA: vcDNA=SeqID_4762; Strand=+; Position=29-196
YLLAYSNTAVEIRDTFKNKCTTGVMAYLLGASDSFISTISVRRCYVIHMCLIAVDS

SEQ ID NO: 25066 - protein, 66 aa, Diabrotica virgifera
  misc_feature: Coding regions on vcDNA: vcDNA=SeqID_4763; Strand=+; Position=1-198
SVYIRIELFVPYVKFNEPEHVYEVQYLECENVDIWKDVLPTQVLPQFTFSWPAKSDSYHTFQKVDP

SEQ ID NO: 25067 - protein, 127 aa, Diabrotica virgifera
  misc_feature: Coding regions on vcDNA: vcDNA=SeqID_4764; Strand=+; Position=3-383
  misc_feature (120)..(126): Xaa can be any naturally occurring amino acid
AKDIHYTQYIDIEVAFLEYAYTNDRDAFKLEATELMKRACDGIRLWNYKRDFENSKLKYELFLELVSVFLKEVPSRSDCYKDVQACLIIELVDLSKEYPQKCINISDYPEFMSVIETMLXXXXXXXV

SEQ ID NO: 25068 - protein, 53 aa, Diabrotica virgifera
  misc_feature: Coding regions on vcDNA: vcDNA=SeqID_4765; Strand=+; Position=80-241
KLSYCVTTFYYEFLHYLSPLFPPYFFLTRTLICIIYIFYYQTDFIYIHDISII

SEQ ID NO: 25069 - protein, 56 aa, Diabrotica virgifera
  misc_feature: Coding regions on vcDNA: vcDNA=SeqID_4766; Strand=+; Position=2-172
  misc_feature: Homolog annotation: Hit_ID=AAG17127.1; Match level="QueryCoverage =87%, HitCoverage=15%, E-value=3e-11, Identity=71%"; Hit description =cathepsin L-like cysteine proteinase CAL1 [Diabrotica virgifera virgifera]
  misc_feature (15)..(15): Xaa can be any naturally occurring amino acid
GRVGEPLSYQVLLDXSVSYGIGDCHEGGLMNLAFGFVYDHRIVSEASYPYNTIYRH

SEQ ID NO: 25070 - protein, 45 aa, Diabrotica virgifera
  misc_feature: Coding regions on vcDNA: vcDNA=SeqID_4767; Strand=-; Position=16-153
TFRYSNNYVLLNRKYLLKVGTQIKGTTLFAESLKELTEMLDRASL

SEQ ID NO: 25071 - protein, 27 aa, Diabrotica virgifera
  misc_feature: Coding regions on vcDNA: vcDNA=SeqID_4768; Strand=-; Position=1-81
  misc_feature (6)..(27): Xaa can be any naturally occurring amino acid
LKIIEXXXXXXXXXXXXXXXXXXXXXX

SEQ ID NO: 25072 - protein, 82 aa, Diabrotica virgifera
  misc_feature: Coding regions on vcDNA: vcDNA=SeqID_4769; Strand=+; Position=3-251
  misc_feature (19)..(38): Xaa can be any naturally occurring amino acid
TQASTYASVKIPNTASAHXXXXXXXXXXXXXXXXXXXXGPKADGTTTRELGFCQSALRRDYYGPPTHPSITCRITYILDKLG

SEQ ID NO: 25073 - protein, 62 aa, Diabrotica virgifera
  misc_feature: Coding regions on vcDNA: vcDNA=SeqID_4770; Strand=+; Position=25-214
  misc_feature: Homolog annotation: Hit_ID=XP_321144.1; Match level="QueryCoverage =95%, HitCoverage=11%, E-value=8e-14, Identity=66%"; Hit description =ENSANGP00000020140 [Anopheles gambiae]
  misc_feature: Gene Ontology Annotation: Molecular function=protein disulfide isomerase activity; Biological process=protein folding
  misc_feature (16)..(16): Xaa can be any naturally occurring amino acid
  misc_feature (31)..(31): Xaa can be any naturally occurring amino acid
LFSKEAIYEFLRNLSXVKALTAPVKGQQLLXIFKIVPWDGIDGVLPYEEDIDLSDVDLDEIA

SEQ ID NO: 25074 - protein, 15 aa, Diabrotica virgifera
  misc_feature: Coding regions on vcDNA: vcDNA=SeqID_4771; Strand=+; Position=6-50
DVLKFMFSNKCYSPL

SEQ ID NO: 25075 - protein, 105 aa, Diabrotica virgifera
  misc_feature: Coding regions on vcDNA: vcDNA=SeqID_4772; Strand=+; Position=1-318
RNFTGHPSHPVQLPPPHFANMPNNLTPNNHQLPQMQMGNNGIDDTLRSPEETLQIGKDGGAPPNRGPPRPNNNQSYYQNNGYNRPRQQNQNRNASGPRPTATRHA

SEQ ID NO: 25076 - protein, 58 aa, Diabrotica virgifera
  misc_feature: Coding regions on vcDNA: vcDNA=SeqID_4773; Strand=+; Position=180-353
RFKGYDFHTDLFILMHIAKLHASTSSQTLIDPNTFDDQVKKYCHVYKFPKDHNTNNGF

SEQ ID NO: 25077 - protein, 40 aa, Diabrotica virgifera
  misc_feature: Coding regions on vcDNA: vcDNA=SeqID_4774; Strand=+; Position=31-153
  misc_feature (15)..(23): Xaa can be any naturally occurring amino acid
LMISNVRGDIIFKFXXXXXXXXXLMDHGLVITYLIFTNFE

SEQ ID NO: 25078 - protein, 70 aa, Diabrotica virgifera
  misc_feature: Coding regions on vcDNA: vcDNA=SeqID_4775; Strand=-; Position=127-339
HVNFPKNAKMHGSNSKSNRYKLDLEGQIIKQVMEFIYLGITLSSYGKLETEVEDQVNRPNRAADGLDIEK

SEQ ID NO: 25079 - protein, 131 aa, Diabrotica virgifera
  misc_feature: Coding regions on vcDNA: vcDNA=SeqID_4776; Strand=-; Position=1-393
  misc_feature (1)..(31): Xaa can be any naturally occurring amino acid
  misc_feature (33)..(58): Xaa can be any naturally occurring amino acid
  misc_feature (61)..(67): Xaa can be any naturally occurring amino acid
  misc_feature (73)..(92): Xaa can be any naturally occurring amino acid
  misc_feature (95)..(106): Xaa can be any naturally occurring amino acid
  misc_feature (112)..(127): Xaa can be any naturally occurring amino acid
XXXXXXXXXXXXXXXXXXXXXXXXXXXXXXXHXXXXXXXXXXXXXXXXXXXXXXXXXXLKXXXXXXXDYLFLXXXXXXXXXXXXXXXXXXXXNLXXXXXXXXXXXXLFPRFXXXXXXXXXXXXXXXXNYLS

SEQ ID NO: 25080 - protein, 72 aa, Diabrotica virgifera
  misc_feature: Coding regions on vcDNA: vcDNA=SeqID_4777; Strand=-; Position=2-217
  misc_feature (4)..(4): Xaa can be any naturally occurring amino acid
  misc_feature (7)..(7): Xaa can be any naturally occurring amino acid
  misc_feature (16)..(16): Xaa can be any naturally occurring amino acid
  misc_feature (24)..(36): Xaa can be any naturally occurring amino acid
  misc_feature (44)..(44): Xaa can be any naturally occurring amino acid
  misc_feature (48)..(48): Xaa can be any naturally occurring amino acid
  misc_feature (65)..(65): Xaa can be any naturally occurring amino acid
  misc_feature (68)..(68): Xaa can be any naturally occurring amino acid
NIFXYIXVIVIYHIRXHSDINSEXXXXXXXXXXXXXILCMYNSXTVTXVIHFRHLIRQDSLFYYXYCXLSCD

SEQ ID NO: 25081 - protein, 73 aa, Diabrotica virgifera
  misc_feature: Coding regions on vcDNA: vcDNA=SeqID_4778; Strand=+; Position=48-269
PILLPPIYQFNSSHFSFIFDFPCFDYPFDLRISVCIFFLSLSPLDCRYLLYMHIFIDNRTLVRRLKGPYEQKE

SEQ ID NO: 25082 - protein, 83 aa, Diabrotica virgifera
  misc_feature: Coding regions on vcDNA: vcDNA=SeqID_4779; Strand=+; Position=2-250
  misc_feature (12)..(36): Xaa can be any naturally occurring amino acid
  misc_feature (63)..(69): Xaa can be any naturally occurring amino acid
  misc_feature (75)..(82): Xaa can be any naturally occurring amino acid
TPPRTRPHTRTXXXXXXXXXXXXXXXXXXXXXXXXXSNVREIFTFIKRKINFWYLWNRNNQLXXXXXXXPNLNEXXXXXXXXK

SEQ ID NO: 25083 - protein, 32 aa, Diabrotica virgifera
  misc_feature: Coding regions on vcDNA: vcDNA=SeqID_4780; Strand=-; Position=0-95
  misc_feature (3)..(30): Xaa can be any naturally occurring amino acid
QGXXXXXXXXXXXXXXXXXXXXXXXXXXXXFS

SEQ ID NO: 25084 - protein, 26 aa, Diabrotica virgifera
  misc_feature: Coding regions on vcDNA: vcDNA=SeqID_4781; Strand=-; Position=2-79
YQIPCLVEVPLHVCSRPIKSFDGALI

SEQ ID NO: 25085 - protein, 85 aa, Diabrotica virgifera
  misc_feature: Coding regions on vcDNA: vcDNA=SeqID_4782; Strand=-; Position=3-257
  misc_feature (4)..(12): Xaa can be any naturally occurring amino acid
FWGXXXXXXXXXNQIGFYYKFMVKLHFGTIGRHFGNNGVSRVDSALGNCPIQLKCILSRYIFLKDRCLTRQLRNFWFLLRSLKSM

SEQ ID NO: 25086 - protein, 70 aa, Diabrotica virgifera
  misc_feature: Coding regions on vcDNA: vcDNA=SeqID_4783; Strand=+; Position=2-214
  misc_feature (4)..(4): Xaa can be any naturally occurring amino acid
TRPXPRGVPIIFDRQYLYHTISALYHLDSEFTQNCQKCGSPVLLRLKVNPLLIFYLLQLRCIFLLAFKCT

SEQ ID NO: 25087 - protein, 34 aa, Diabrotica virgifera
  misc_feature: Coding regions on vcDNA: vcDNA=SeqID_4784; Strand=+; Position=1-102
  misc_feature (9)..(9): Xaa can be any naturally occurring amino acid
HSKSEHGTXSHQYDVLVMPNLYGDILSEMCASPV

SEQ ID NO: 25088 - protein, 17 aa, Diabrotica virgifera
  misc_feature: Coding regions on vcDNA: vcDNA=SeqID_4785; Strand=-; Position=2-52
  misc_feature (1)..(6): Xaa can be any naturally occurring amino acid
XXXXXXLKISILNGYFH

SEQ ID NO: 25089 - protein, 31 aa, Diabrotica virgifera
  misc_feature: Coding regions on vcDNA: vcDNA=SeqID_4786; Strand=-; Position=3-98
  misc_feature (7)..(27): Xaa can be any naturally occurring amino acid
FKFLLNXXXXXXXXXXXXXXXXXXXXXDNRN

SEQ ID NO: 25090 - protein, 98 aa, Diabrotica virgifera
  misc_feature: Coding regions on vcDNA: vcDNA=SeqID_4787; Strand=-; Position=2-295
  misc_feature (3)..(50): Xaa can be any naturally occurring amino acid
  misc_feature (61)..(78): Xaa can be any naturally occurring amino acid
  misc_feature (83)..(93): Xaa can be any naturally occurring amino acid
FNXXXXXXXXXXXXXXXXXXXXXXXXXXXXXXXXXXXXXXXXXXXXXXXXVYLKTDYISLXXXXXXXXXXXXXXXXXXLLNFXXXXXXXXXXXLVTQV

SEQ ID NO: 25091 - protein, 24 aa, Diabrotica virgifera
  misc_feature: Coding regions on vcDNA: vcDNA=SeqID_4788; Strand=+; Position=1-72
  misc_feature (6)..(24): Xaa can be any naturally occurring amino acid
NLFITXXXXXXXXXXXXXXXXXXX

SEQ ID NO: 25092 - protein, 74 aa, Diabrotica virgifera
  misc_feature: Coding regions on vcDNA: vcDNA=SeqID_4789; Strand=+; Position=1-222
  misc_feature (29)..(29): Xaa can be any naturally occurring amino acid
  misc_feature (50)..(50): Xaa can be any naturally occurring amino acid
PLSLLLCQNINTEWLYHTLINKELTVCPXEGDIDNTYNFVKILCSSKLPXGITDVNKQKKSFTTDEIVEYYKNA

SEQ ID NO: 25093 - protein, 83 aa, Diabrotica virgifera
  misc_feature: Coding regions on vcDNA: vcDNA=SeqID_4790; Strand=+; Position=70-318
  misc_feature: Homolog annotation: Hit_ID=EAA09343.2; Match level="QueryCoverage =96%, HitCoverage=42%, E-value=1e-26, Identity=68%"; Hit description =ENSANGP00000015739 [Anopheles gambiae str. PEST] ref|XP_558625.1| ENSANGP00000015739 [Anopheles gambiae st
  misc_feature: Gene Ontology Annotation: Molecular function=molecular_function unknown; Cellular component=cellular_component unknown; Biological process=biological_process unknown
MTETTSIYHEKQIRELCALHALNNLFQAKGTFSKAELDLICTSLSPNHWINPHKSMLGLGNYDINVIMKALQDRGYEVIWFDK

SEQ ID NO: 25094 - protein, 77 aa, Diabrotica virgifera
  misc_feature: Coding regions on vcDNA: vcDNA=SeqID_4791; Strand=-; Position=0-230
QHEGTAAVRTCGIRPPCSSSAACIRCKSRATKDWEVLRCLNRHKRVPTRSQVRTVKCQVPGLQEQTWTAPRGVPSPT

SEQ ID NO: 25095 - protein, 148 aa, Diabrotica virgifera
  misc_feature: Coding regions on vcDNA: vcDNA=SeqID_4792; Strand=-; Position=3-446
  misc_feature (13)..(141): Xaa can be any naturally occurring amino acid
  misc_feature (145)..(145): Xaa can be any naturally occurring amino acid
YFYLNIHFFNTIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTPGXAPE

SEQ ID NO: 25096 - protein, 78 aa, Diabrotica virgifera
  misc_feature: Coding regions on vcDNA: vcDNA=SeqID_4793; Strand=+; Position=1-237
  misc_feature (6)..(6): Xaa can be any naturally occurring amino acid
NSVATXLRFSNSLQNENTAKPYSSPIRECCKHAYRFRNLLVSHREAHMLLSLIQPKQTPACSPGLQRTKWHRCPSGNC

SEQ ID NO: 25097 - protein, 23 aa, Diabrotica virgifera
  misc_feature: Coding regions on vcDNA: vcDNA=SeqID_4794; Strand=+; Position=1-69
  misc_feature (5)..(10): Xaa can be any naturally occurring amino acid
  misc_feature (12)..(17): Xaa can be any naturally occurring amino acid
NYNLXXXXXXPXXXXXXLIYLRD

SEQ ID NO: 25098 - protein, 105 aa, Diabrotica virgifera
  misc_feature: Coding regions on vcDNA: vcDNA=SeqID_4795; Strand=-; Position=2-316
  misc_feature (19)..(25): Xaa can be any naturally occurring amino acid
  misc_feature (46)..(72): Xaa can be any naturally occurring amino acid
  misc_feature (100)..(105): Xaa can be any naturally occurring amino acid
FVGGFPPLPPPPGFLPFWXXXXXXXVFFPLRLVVLCFRSFFFSPLXXXXXXXXXXXXXXXXXXXXXXXXXXXQILCIYFKCQLHYKKNYERLLNVFVAGXXXXXX

SEQ ID NO: 25099 - protein, 103 aa, Diabrotica virgifera
  misc_feature: Coding regions on vcDNA: vcDNA=SeqID_4796; Strand=+; Position=2-313
SGTYRFHQTCYCHINTSISDYHAGNTYLSKYLIFNARCVDSGTYLCLALTQFGKDDQKVTINVPCKKSDSELYSLLFLIPFGLLLIPLVVWLCYYRTKKHLLS

SEQ ID NO: 25100 - protein, 130 aa, Diabrotica virgifera
  misc_feature: Coding regions on vcDNA: vcDNA=SeqID_4797; Strand=+; Position=3-392
  misc_feature: Homolog annotation: Hit_ID=XP_315658.1; Match level="QueryCoverage =100%, HitCoverage=61%, E-value=2e-44, Identity=62%"; Hit description= ENSANGP00000021663 [Anopheles gambiae] gb|EAA11754.1| ENSANGP00000021663 [Anopheles gambiae
  misc_feature: Gene Ontology Annotation: Molecular function=ATP-binding cassette (ABC) transporter activity; Cellular component=integral to membrane; Biological process=transport
  misc_feature: Pfam annotation: Pfam_ID=ABC_tran; Match level="Score=41.5, E-value =2.5e-09, Copies=1"; Pfam description=ABC transporter
QLLERFYDPSYGKVEISNKNIRYVDLKSLRSQLGIVSQEPNLFDKTIAENIAYGANYKQVEMDAIIDAAKSANIHEFILNLPKGYETKVGSKGTQLSGGQKQRIAIARALLRNPKILLLDEATSALDNES

SEQ ID NO: 25101 - protein, 51 aa, Diabrotica virgifera
  misc_feature: Coding regions on vcDNA: vcDNA=SeqID_4798; Strand=+; Position=39-191
LSWYFNLHVSVLCPVLQNVTSALENYILLTIYRALGEIVIIISFPGWRATL

SEQ ID NO: 25102 - protein, 118 aa, Diabrotica virgifera
  misc_feature: Coding regions on vcDNA: vcDNA=SeqID_4799; Strand=+; Position=1-357
  misc_feature (3)..(83): Xaa can be any naturally occurring amino acid
  misc_feature (94)..(112): Xaa can be any naturally occurring amino acid
PSXXXXXXXXXXXXXXXXXXXXXXXXXXXXXXXXXXXXXXXXXXXXXXXXXXXXXXXXXXXXXXXXXXXXXXXXXXXXXXXXXLLVVKNCILSXXXXXXXXXXXXXXXXXXXKHLFLY

SEQ ID NO: 25103 - protein, 25 aa, Diabrotica virgifera
  misc_feature: Coding regions on vcDNA: vcDNA=SeqID_4800; Strand=-; Position=0-74
  misc_feature (3)..(24): Xaa can be any naturally occurring amino acid
LFXXXXXXXXXXXXXXXXXXXXXXG

SEQ ID NO: 25104 - protein, 88 aa, Diabrotica virgifera
  misc_feature: Coding regions on vcDNA: vcDNA=SeqID_4801; Strand=+; Position=1-264
  misc_feature (17)..(36): Xaa can be any naturally occurring amino acid
  misc_feature (44)..(50): Xaa can be any naturally occurring amino acid
PNFINFRLIEYFLVKVXXXXXXXXXXXXXXXXXXXXQHRFMVCXXXXXXXEGIIIYLLLSNLRELHLSHFYCRLHLSTTFFVRQLLFV

SEQ ID NO: 25105 - protein, 39 aa, Diabrotica virgifera
  misc_feature: Coding regions on vcDNA: vcDNA=SeqID_4802; Strand=-; Position=2-118
  misc_feature (2)..(8): Xaa can be any naturally occurring amino acid
  misc_feature (23)..(35): Xaa can be any naturally occurring amino acid
TXXXXXXXYYENMYLNETLISFXXXXXXXXXXXXXLRTR

SEQ ID NO: 25106 - protein, 51 aa, Diabrotica virgifera
  misc_feature: Coding regions on vcDNA: vcDNA=SeqID_4803; Strand=-; Position=30-185
  misc_feature (24)..(31): Xaa can be any naturally occurring amino acid
FFFSKFFCILNFFCNLVSYSSVPXXXXXXXXFVVMLTNYAETLVLTTLPKN

SEQ ID NO: 25107 - protein, 31 aa, Diabrotica virgifera
  misc_feature: Coding regions on vcDNA: vcDNA=SeqID_4804; Strand=-; Position=37-132
QNNIPKPYILPININSSTYNHCHHPHNLILH

SEQ ID NO: 25108 - protein, 48 aa, Diabrotica virgifera
  misc_feature: Coding regions on vcDNA: vcDNA=SeqID_4805; Strand=+; Position=65-211
YTIVKHKMGCVCKLYSKAKVLCQLYFKSCYPLKFLNYKVKNTYLQASC

SEQ ID NO: 25109 - protein, 29 aa, Diabrotica virgifera
  misc_feature: Coding regions on vcDNA: vcDNA=SeqID_4806; Strand=-; Position=4-93
  misc_feature (24)..(24): Xaa can be any naturally occurring amino acid
SLKHIPNSTTHLNQNLFSYFYFKXIFYSF

SEQ ID NO: 25110 - protein, 111 aa, Diabrotica virgifera
  misc_feature: Coding regions on vcDNA: vcDNA=SeqID_4807; Strand=+; Position=3-335
  misc_feature (59)..(66): Xaa can be any naturally occurring amino acid
  misc_feature (77)..(89): Xaa can be any naturally occurring amino acid
  misc_feature (97)..(105): Xaa can be any naturally occurring amino acid
NYNATIKELFLSQHYSGTIKITMKQPVWTGRISAQKTPTDLKPNTTVDSFTVDWHVADXXXXXXXXGLLGDTYALAXXXXXXXXXXXXXIGNTVGDXXXXXXXXXWYPTGK

SEQ ID NO: 25111 - protein, 102 aa, Diabrotica virgifera
  misc_feature: Coding regions on vcDNA: vcDNA=SeqID_4808; Strand=+; Position=35-340
  misc_feature: Homolog annotation: Hit_ID=AAV90675.1; Match level="QueryCoverage =93%, HitCoverage=37%, E-value=2e-11, Identity=34%"; Hit description =salivary antigen-5 related protein AG5-1 [Aedes albopictus]
  misc_feature: Pfam annotation: Pfam_ID=SCP; Match level="Score=17.8, E-value=0.006, Copies=1"; Pfam description=SCP-like extracellular protein
  misc_feature (82)..(82): Xaa can be any naturally occurring amino acid
  misc_feature (91)..(91): Xaa can be any naturally occurring amino acid
PHTRFKQMSLTDSDRRLVLDAHNYLRNKVATGQEPIGPQPQASNMKALSYSKELEYIAQCHTNSCKWGHDACRRTPEWGWVXQNLFLRSYXGGSITTRDMLN

SEQ ID NO: 25112 - protein, 63 aa, Diabrotica virgifera
  misc_feature: Coding regions on vcDNA: vcDNA=SeqID_4809; Strand=-; Position=22-213
FFPSSVCQVDEVTLSLKTTFKMTTKYYEVAACSVLKIQIFGEYEYTRYVQYDDLNERDILNRR

SEQ ID NO: 25113 - protein, 58 aa, Diabrotica virgifera
  misc_feature: Coding regions on vcDNA: vcDNA=SeqID_4810; Strand=-; Position=1-174
  misc_feature (45)..(54): Xaa can be any naturally occurring amino acid
MISTVSRQSNISNTTRHPNVKYSESVIANSTPVHSQKHNSNRIDXXXXXXXXXXCLRV

SEQ ID NO: 25114 - protein, 114 aa, Diabrotica virgifera
  misc_feature: Coding regions on vcDNA: vcDNA=SeqID_4811; Strand=-; Position=0-341
  misc_feature (8)..(71): Xaa can be any naturally occurring amino acid
  misc_feature (78)..(99): Xaa can be any naturally occurring amino acid
  misc_feature (102)..(110): Xaa can be any naturally occurring amino acid
NTNIILIXXXXXXXXXXXXXXXXXXXXXXXXXXXXXXXXXXXXXXXXXXXXXXXXXXXXXXXXXXXXXXXXPIFLGMXXXXXXXXXXXXXXXXXXXXXXMSXXXXXXXXXLADA

SEQ ID NO: 25115 - protein, 50 aa, Diabrotica virgifera
  misc_feature: Coding regions on vcDNA: vcDNA=SeqID_4812; Strand=-; Position=1-150
  misc_feature (25)..(32): Xaa can be any naturally occurring amino acid
STAALQGNPWAGEMWCVVQKDMFLXXXXXXXXGIRVLNVCIWSKSHSFAD

SEQ ID NO: 25116 - protein, 77 aa, Diabrotica virgifera
  misc_feature: Coding regions on vcDNA: vcDNA=SeqID_4813; Strand=+; Position=3-234
  misc_feature: Homolog annotation: Hit_ID=XP_395536.1; Match level="QueryCoverage =100%, HitCoverage=25%, E-value=3e-20, Identity=59%"; Hit description= similar to CG1227-PA [Apis mellifera]
  misc_feature (57)..(57): Xaa can be any naturally occurring amino acid
LKTANTCLTEHMDPILMDLGSCAPPKVQVCGAQDAQKLQDLAAETCSITYTTPELFXVESYCVIDQTLYILSLGCVL

SEQ ID NO: 25117 - protein, 40 aa, Diabrotica virgifera
  misc_feature: Coding regions on vcDNA: vcDNA=SeqID_4814; Strand=+; Position=114-233
RIKLSISTHNVCTLCAHKTLYFYYTISTTSTYFKHVYLSL

SEQ ID NO: 25118 - protein, 57 aa, Diabrotica virgifera
  misc_feature: Coding regions on vcDNA: vcDNA=SeqID_4815; Strand=-; Position=91-264
TKITGYFHLDYKNKVREKREREKKCARRQKKQLSEKKLWKIYSFSRILMVMSDSTSK

SEQ ID NO: 25119 - protein, 61 aa, Diabrotica virgifera
  misc_feature: Coding regions on vcDNA: vcDNA=SeqID_4816; Strand=-; Position=52-237
SKILKIILQSYYRGFLPMNLKSEVRIEFMIRFNPRIVMTDEKSSLTSNIFRRRNSSESILR

SEQ ID NO: 25120 - protein, 111 aa, Diabrotica virgifera
  misc_feature: Coding regions on vcDNA: vcDNA=SeqID_4817; Strand=-; Position=0-332
  misc_feature (20)..(31): Xaa can be any naturally occurring amino acid
  misc_feature (34)..(108): Xaa can be any naturally occurring amino acid
LLNLNSLSVYCSKKFIKGKXXXXXXXXXXXXEMXXXXXXXXXXXXXXXXXXXXXXXXXXXXXXXXXXXXXXXXXXXXXXXXXXXXXXXXXXXXXXXXXXXXXXXXXXXYRT

SEQ ID NO: 25121 - protein, 38 aa, Diabrotica virgifera
  misc_feature: Coding regions on vcDNA: vcDNA=SeqID_4818; Strand=+; Position=3-116
FIANTVLDPNVHAVDHVDWRERAVLGVHHRGHSGSRWA

SEQ ID NO: 25122 - protein, 47 aa, Diabrotica virgifera
  misc_feature: Coding regions on vcDNA: vcDNA=SeqID_4819; Strand=-; Position=2-142
KPPSQPSLTQSQSTNSCSLRETALIPIDDELTFEGSHDTESPAISDA

SEQ ID NO: 25123 - protein, 55 aa, Diabrotica virgifera
  misc_feature: Coding regions on vcDNA: vcDNA=SeqID_4820; Strand=+; Position=48-215
YEVYLSRYAAKVLTYTAAVHNPSEKLRMCNVVDQFPINSQPTTTKNSYMIYEGAR

SEQ ID NO: 25124 - protein, 22 aa, Diabrotica virgifera
  misc_feature: Coding regions on vcDNA: vcDNA=SeqID_4821; Strand=-; Position=1-66
KITKTEKIFLVIVGFRTRGDPG

SEQ ID NO: 25125 - protein, 85 aa, Diabrotica virgifera
  misc_feature: Coding regions on vcDNA: vcDNA=SeqID_4822; Strand=+; Position=1-255
  misc_feature: Homolog annotation: Hit_ID=CAE47499.1; Match level="QueryCoverage =85%, HitCoverage=23%, E-value=6e-09, Identity=46%"; Hit description =cathepsin L-like proteinase [Diabrotica virgifera virgifera]
  misc_feature (10)..(10): Xaa can be any naturally occurring amino acid
SGNYCFVCFXAIFVFAGCSSFSCCVGALLVAVGLVGPVAVCVRAVVCWRLWLGGLLVVRGCPGGAGFVRAVFAVVFWFVSWFCFL

SEQ ID NO: 25126 - protein, 101 aa, Diabrotica virgifera
  misc_feature: Coding regions on vcDNA: vcDNA=SeqID_4823; Strand=+; Position=2-304
RRPQTRPELFLSPHYAGTSEMTRTQAVWTGRVSAQESPTDVKPSTTVDSFTVDWHVADVAGPISGVGLLGDTYALAIHEGIECALNHGRIANTVGEFLKMR

SEQ ID NO: 25127 - protein, 52 aa, Diabrotica virgifera
  misc_feature: Coding regions on vcDNA: vcDNA=SeqID_4824; Strand=-; Position=2-157
SLIHSVQKLNSSRIKLKSSLTTLTNCPSTTIFPYILLENCLLTLNPRIVGRV

SEQ ID NO: 25128 - protein, 98 aa, Diabrotica virgifera
  misc_feature: Coding regions on vcDNA: vcDNA=SeqID_4825; Strand=-; Position=2-295
  misc_feature (2)..(25): Xaa can be any naturally occurring amino acid
  misc_feature (31)..(88): Xaa can be any naturally occurring amino acid
VXXXXXXXXXXXXXXXXXXXXXXXXCIFKLXXXXXXXXXXXXXXXXXXXXXXXXXXXXXXXXXXXXXXXXXXXXXXXXXXXXXXXXXXGRLGGPGDLG

SEQ ID NO: 25129 - protein, 58 aa, Diabrotica virgifera
  misc_feature: Coding regions on vcDNA: vcDNA=SeqID_4826; Strand=+; Position=3-179
  misc_feature (33)..(39): Xaa can be any naturally occurring amino acid
GVTHTSAHASGITLCCFISHYSENLIIYLFVVXXXXXXXHYQTVGFVVCDFRIIKISC

SEQ ID NO: 25130 - protein, 35 aa, Diabrotica virgifera
  misc_feature: Coding regions on vcDNA: vcDNA=SeqID_4827; Strand=-; Position=56-163
IQQKLINFHTCNTLLSNLCKNHKRVTTLQESHTHM

SEQ ID NO: 25131 - protein, 139 aa, Diabrotica virgifera
  misc_feature: Coding regions on vcDNA: vcDNA=SeqID_4828; Strand=+; Position=40-456
  misc_feature: Homolog annotation: Hit_ID=AAV65755.1; Match level="QueryCoverage =94%, HitCoverage=35%, E-value=1e-45, Identity=65%"; Hit description =ribosomal SOP2 [Bombyx mori]
  misc_feature: Gene Ontology Annotation: Molecular function=actin binding; Cellular component=Arp2/3 protein complex; Biological process=actin cytoskeleton organization and biogenesis
  misc_feature: Pfam annotation: Pfam_ID=WD40; Match level="Score=43.8, E-value=4.9e -10, Copies=2"; Pfam description=WD domain, G-beta repeat
  misc_feature (8)..(8): Xaa can be any naturally occurring amino acid
  misc_feature (63)..(77): Xaa can be any naturally occurring amino acid
PGSPTTSXWVSKHIKKPIRSTVTCLDWHPNNVLLAAGSSDFKVRVFSAYIKDIEKTPEPTAWXXXXXXXXXXXXXXXSNVGGGWVHSLSFSPDGNKICWVSHDSSINVADASKGNAVHKLRTEFLPFLSCTWIGNKSVV

SEQ ID NO: 25132 - protein, 36 aa, Diabrotica virgifera
  misc_feature: Coding regions on vcDNA: vcDNA=SeqID_4829; Strand=-; Position=50-160
SNLTFNHILFLSSSLKIFHLNNLKIFTYKSTATKST

SEQ ID NO: 25133 - protein, 29 aa, Diabrotica virgifera
  misc_feature: Coding regions on vcDNA: vcDNA=SeqID_4830; Strand=-; Position=0-86
  misc_feature (17)..(25): Xaa can be any naturally occurring amino acid
SLIHTPQKLNSSRPTPXXXXXXXXXRMRG

SEQ ID NO: 25134 - protein, 52 aa, Diabrotica virgifera
  misc_feature: Coding regions on vcDNA: vcDNA=SeqID_4831; Strand=+; Position=2-158
  misc_feature: Homolog annotation: Hit_ID=BAB88642.1; Match level="QueryCoverage =90%, HitCoverage=15%, E-value=8e-11, Identity=59%"; Hit description =NADH dehydrogenase subunit 5 [Leptura aethiops]
  misc_feature (28)..(28): Xaa can be any naturally occurring amino acid
SVNTSAGNISHKLNNCRDIRDIRGLITXLPLTCIYLNTCNLSLCGFPFRSGF

SEQ ID NO: 25135 - protein, 29 aa, Diabrotica virgifera
  misc_feature: Coding regions on vcDNA: vcDNA=SeqID_4832; Strand=+; Position=1-87
VRKFVLWNKYSKSVFCPELSRVLRYIYVF

SEQ ID NO: 25136 - protein, 68 aa, Diabrotica virgifera
  misc_feature: Coding regions on vcDNA: vcDNA=SeqID_4833; Strand=-; Position=0-203
  misc_feature (12)..(18): Xaa can be any naturally occurring amino acid
NLFDNIFYCMYXXXXXXXGITRNVVMVLPTKNTRKIIASAPLSQEASGSWLKPYRTTAHASADAWGAP

SEQ ID NO: 25137 - protein, 59 aa, Diabrotica virgifera
  misc_feature: Coding regions on vcDNA: vcDNA=SeqID_4834; Strand=-; Position=0-176
  misc_feature (21)..(27): Xaa can be any naturally occurring amino acid
SYYYKNLLIIFSNSVGCSRVXXXXXXXHLENKILYKSNKDSFVFIQPFGRVGGPGNVGP

SEQ ID NO: 25138 - protein, 61 aa, Diabrotica virgifera
  misc_feature: Coding regions on vcDNA: vcDNA=SeqID_4835; Strand=-; Position=67-252
KVLTRQLRHQIQKDLPVSIRPAAKQHLLTKALTKTRLSSCKKCQHWIPEQWKDTVKIVPPA

SEQ ID NO: 25139 - protein, 74 aa, Diabrotica virgifera
  misc_feature: Coding regions on vcDNA: vcDNA=SeqID_4836; Strand=+; Position=1-222
PRVRMRRVSCYEACIDSQIIRMHSEYIFGRFLQKFIYSSSYDSVVRTNSCVSSVPPSAGTFSRRGFSPGKEEPS

SEQ ID NO: 25140 - protein, 77 aa, Diabrotica virgifera
  misc_feature: Coding regions on vcDNA: vcDNA=SeqID_4837; Strand=+; Position=3-234
  misc_feature: Homolog annotation: Hit_ID=AAT46318.1; Match level="QueryCoverage =94%, HitCoverage=32%, E-value=8e-16, Identity=60%"; Hit description =cytochrome oxidase subunit 3 [Mantispidae sp. EH-2004b] gb|AAT46317.1| cytochrome oxidase subunit 3 [Manti
  misc_feature: Pfam annotation: Pfam_ID=COX3; Match level="Score=-200.6, E-value =0.0022, Copies=1"; Pfam description=Cytochrome c oxidase subunit III
  misc_feature (23)..(23): Xaa can be any naturally occurring amino acid
  misc_feature (35)..(35): Xaa can be any naturally occurring amino acid
  misc_feature (50)..(50): Xaa can be any naturally occurring amino acid
  misc_feature (59)..(59): Xaa can be any naturally occurring amino acid
RKRDREGTYQGLQTLVVTKGVRXRIILFTTSEVLXFLEHFFEDFFTDHYXPTVELGIRXPPRGRQAFNPLEIPLLNT

SEQ ID NO: 25141 - protein, 52 aa, Diabrotica virgifera
  misc_feature: Coding regions on vcDNA: vcDNA=SeqID_4838; Strand=+; Position=1-159
VAVRHSRLPPRVRYKCWTERLDERSTVFEYVTTHLSFTSTRLDFCTRLDHPM

SEQ ID NO: 25142 - protein, 41 aa, Diabrotica virgifera
  misc_feature: Coding regions on vcDNA: vcDNA=SeqID_4839; Strand=+; Position=40-162
NNTLFFSHSADRFYPLIVNYYCERSSYFLQKNHLFLVPSVA

SEQ ID NO: 25143 - protein, 39 aa, Diabrotica virgifera
  misc_feature: Coding regions on vcDNA: vcDNA=SeqID_4840; Strand=-; Position=1-117
  misc_feature (17)..(35): Xaa can be any naturally occurring amino acid
KKLLQHIPFVCVIIITXXXXXXXXXXXXXXXXXXXRMRE

SEQ ID NO: 25144 - protein, 22 aa, Diabrotica virgifera
  misc_feature: Coding regions on vcDNA: vcDNA=SeqID_4841; Strand=-; Position=2-67
APLFLILVSFLSLIFTLSVYSL

SEQ ID NO: 25145 - protein, 23 aa, Diabrotica virgifera
  misc_feature: Coding regions on vcDNA: vcDNA=SeqID_4842; Strand=+; Position=1-69
THPKIVDTGISLIAGPSAQVDKS

SEQ ID NO: 25146 - protein, 124 aa, Diabrotica virgifera
  misc_feature: Coding regions on vcDNA: vcDNA=SeqID_4843; Strand=+; Position=2-373
  misc_feature: Homolog annotation: Hit_ID=CAC20599.1; Match level="QueryCoverage =89%, HitCoverage=73%, E-value=7e-12, Identity=34%"; Hit description =hypothetical protein [Ixodes ricinus]
THPEGYSGLGHYGVLPAATSYSSSVVHHTPVVAKTYVAPVVAKAYVAPVVSYSAPLVTSYGLGHGYGGLSHGYGGLSHGYGHGLGYGHGLGHGYGLGHGYSLGHSYAGLGHGYSLGGSGPGWYL

SEQ ID NO: 25147 - protein, 21 aa, Diabrotica virgifera
  misc_feature: Coding regions on vcDNA: vcDNA=SeqID_4844; Strand=-; Position=1-63
YGNLYYFQCPCQHITKLGNSG

SEQ ID NO: 25148 - protein, 62 aa, Diabrotica virgifera
  misc_feature: Coding regions on vcDNA: vcDNA=SeqID_4845; Strand=-; Position=174-362
SHDRECARVRSIVLVTSTLTPNTFNHIFSRTAILVFCYYDIVGNQFFEPTNSLSFVIVLNKN

SEQ ID NO: 25149 - protein, 25 aa, Diabrotica virgifera
  misc_feature: Coding regions on vcDNA: vcDNA=SeqID_4846; Strand=+; Position=62-136
ILGLTICTLQNTSSCIFISDRVHSS

SEQ ID NO: 25150 - protein, 34 aa, Diabrotica virgifera
  misc_feature: Coding regions on vcDNA: vcDNA=SeqID_4847; Strand=-; Position=8-112
  misc_feature (13)..(25): Xaa can be any naturally occurring amino acid
KQSNKTIKLLNIXXXXXXXXXXXXXPNPNHHFKN

SEQ ID NO: 25151 - protein, 118 aa, Diabrotica virgifera
  misc_feature: Coding regions on vcDNA: vcDNA=SeqID_4848; Strand=-; Position=3-356
  misc_feature (2)..(13): Xaa can be any naturally occurring amino acid
  misc_feature (15)..(38): Xaa can be any naturally occurring amino acid
  misc_feature (46)..(64): Xaa can be any naturally occurring amino acid
  misc_feature (68)..(80): Xaa can be any naturally occurring amino acid
  misc_feature (96)..(106): Xaa can be any naturally occurring amino acid
  misc_feature (109)..(118): Xaa can be any naturally occurring amino acid
QXXXXXXXXXXXXNXXXXXXXXXXXXXXXXXXXXXXXXTNINKHTXXXXXXXXXXXXXXXXXXXHNPXXXXXXXXXXXXXTNKYNQQKKNNQNINXXXXXXXXXXXPNXXXXXXXXXX

SEQ ID NO: 25152 - protein, 28 aa, Diabrotica virgifera
  misc_feature: Coding regions on vcDNA: vcDNA=SeqID_4849; Strand=-; Position=1-84
  misc_feature (1)..(25): Xaa can be any naturally occurring amino acid
XXXXXXXXXXXXXXXXXXXXXXXXXGCV

SEQ ID NO: 25153 - protein, 31 aa, Diabrotica virgifera
  misc_feature: Coding regions on vcDNA: vcDNA=SeqID_4850; Strand=-; Position=1-93
  misc_feature (19)..(27): Xaa can be any naturally occurring amino acid
PVSIAVEADTWQFLLLKTXXXXXXXXXADAW

SEQ ID NO: 25154 - protein, 39 aa, Diabrotica virgifera
  misc_feature: Coding regions on vcDNA: vcDNA=SeqID_4851; Strand=+; Position=222-338
RYIKSHEATFDLPFTGSTVTLDGKNLDYYEMSITSTFGT

SEQ ID NO: 25155 - protein, 56 aa, Diabrotica virgifera
  misc_feature: Coding regions on vcDNA: vcDNA=SeqID_4852; Strand=+; Position=15-185
  misc_feature: Homolog annotation: Hit_ID=XP_397030.1; Match level="QueryCoverage =96%, HitCoverage=13%, E-value=2e-16, Identity=75%"; Hit description =similar to Bys protein [Apis mellifera]
  misc_feature: Gene Ontology Annotation: Cellular component=cytoplasm; Biological process=cell adhesion
TFVQRYKADISSEQKEALLELLKKQNHHTLTPEIRGELQHAKCRDLEDVMPTMEFD

SEQ ID NO: 25156 - protein, 61 aa, Diabrotica virgifera
  misc_feature: Coding regions on vcDNA: vcDNA=SeqID_4853; Strand=-; Position=0-182
  misc_feature (39)..(47): Xaa can be any naturally occurring amino acid
KTKIYVVYTPHGILSYTTAVKGIALKLTIDSSSNKCFLXXXXXXXXXPFSLFVTPSFRMRG

SEQ ID NO: 25157 - protein, 35 aa, Diabrotica virgifera
  misc_feature: Coding regions on vcDNA: vcDNA=SeqID_4854; Strand=+; Position=19-123
LHSILISLCAHFFANQLCIAVNSFTCPWHILGQEL

SEQ ID NO: 25158 - protein, 112 aa, Diabrotica virgifera
  misc_feature: Coding regions on vcDNA: vcDNA=SeqID_4855; Strand=+; Position=1-336
PRDPQTRPMKLMLFFFVALTVVASQAEEFNVFEKYVEFVPQCNSTLSNQAFKDFMTKKNANLGLEELGNFLFCMNTKFLTQNENGDVNVQQFNKIVGTLVPQNDLEHLTTVC

SEQ ID NO: 25159 - protein, 68 aa, Diabrotica virgifera
  misc_feature: Coding regions on vcDNA: vcDNA=SeqID_4856; Strand=-; Position=213-419
LYLDHIRYHDRCNLDIQIQRSSMQRSQHVSNDIVSNFSLMYKTAIRFERPGYITVESMYAITTVTRMT

SEQ ID NO: 25160 - protein, 81 aa, Diabrotica virgifera
  misc_feature: Coding regions on vcDNA: vcDNA=SeqID_4857; Strand=+; Position=180-422
  misc_feature (9)..(15): Xaa can be any naturally occurring amino acid
TGADSKTVXXXXXXXPKMSTEVKTISARAITILRMEETQPRLTRSSSLDKIKKFNTFICSQQYYVLPALLNWLKSSQTNLQ

SEQ ID NO: 25161 - protein, 58 aa, Diabrotica virgifera
  misc_feature: Coding regions on vcDNA: vcDNA=SeqID_4858; Strand=+; Position=71-247
  misc_feature (7)..(14): Xaa can be any naturally occurring amino acid
  misc_feature (23)..(23): Xaa can be any naturally occurring amino acid
AFLHFIXXXXXXXXHLSNGLSRXRKVAQTFFLQKNGRFAPHQSNAPFVGELFAKNPCL

SEQ ID NO: 25162 - protein, 92 aa, Diabrotica virgifera
  misc_feature: Coding regions on vcDNA: vcDNA=SeqID_4859; Strand=+; Position=142-417
  misc_feature: Homolog annotation: Hit_ID=AAL67865.1; Match level="QueryCoverage =97%, HitCoverage=40%, E-value=3e-13, Identity=45%"; Hit description =ATP synthase F0 subunit 6 [Crioceris duodecimpunctata] ref|NP _569064.1| ATP synthase F0 subunit 6
  misc_feature (15)..(15): Xaa can be any naturally occurring amino acid
  misc_feature (30)..(30): Xaa can be any naturally occurring amino acid
  misc_feature (35)..(41): Xaa can be any naturally occurring amino acid
  misc_feature (48)..(57): Xaa can be any naturally occurring amino acid
  misc_feature (71)..(80): Xaa can be any naturally occurring amino acid
NYFDPTSNFNLPINXLRTVLGLLIIPSRFXLIPSXXXXXXXKIIITLXXXXXXXXXXYKSQGRTLIFISLXXXXXXXXXXGLFPYIFTRTRH

SEQ ID NO: 25163 - protein, 94 aa, Diabrotica virgifera
  misc_feature: Coding regions on vcDNA: vcDNA=SeqID_4860; Strand=-; Position=2-283
  misc_feature (32)..(74): Xaa can be any naturally occurring amino acid
ELFKRRPLELNLGAILEGFEIALKGKLGLNPXXXXXXXXXXXXXXXXXXXXXXXXXXXXXXXXXXXXXXXXXXXDIKVLLYQLSYITSSRNNML

SEQ ID NO: 25164 - protein, 50 aa, Diabrotica virgifera
  misc_feature: Coding regions on vcDNA: vcDNA=SeqID_4861; Strand=-; Position=1-150
VLRNWFIHVSCGAQQDFPWVLRQRHVSRKRFLLVLPKWFRTRGQTLVRTL

SEQ ID NO: 25165 - protein, 37 aa, Diabrotica virgifera
  misc_feature: Coding regions on vcDNA: vcDNA=SeqID_4862; Strand=-; Position=2-112
HPSYIYVPMVLNFITKLRMESNMGHTSFKSKHVRTRG

SEQ ID NO: 25166 - protein, 118 aa, Diabrotica virgifera
  misc_feature: Coding regions on vcDNA: vcDNA=SeqID_4863; Strand=+; Position=60-416
  misc_feature: Homolog annotation: Hit_ID=NP_649645.1; Match level="QueryCoverage =97%, HitCoverage=96%, E-value=4e-54, Identity=88%"; Hit description =CG1249-PA [Drosophila melanogaster] gb|AAF54135.1| CG1249-PA [Drosophila melanogaster]
  misc_feature: Gene Ontology Annotation: Molecular function=pre-mRNA splicing factor activity; Cellular component=small nuclear ribonucleoprotein complex; Biological process=mRNA splicing
  misc_feature: Pfam annotation: Pfam_ID=LSM; Match level="Score=67.3, E-value=4.2e -17, Copies=1"; Pfam description=LSM domain
MALTKPKSEMSSEELQAREEEEFNTGPLSVLTQSVKNNTQVLINCRNNKKLLGRVKAFDRHCNMVLENVKEMWTELPRAGKGRKKAKPVNKDRFISKMFLRGDAVILIVRNPLATVNA

SEQ ID NO: 25167 - protein, 119 aa, Diabrotica virgifera
  misc_feature: Coding regions on vcDNA: vcDNA=SeqID_4864; Strand=+; Position=2-361
  misc_feature: Homolog annotation: Hit_ID=EAL27432.1; Match level="QueryCoverage =98%, HitCoverage=13%, E-value=3e-34, Identity=61%"; Hit description =GA11255-PA [Drosophila pseudoobscura]
GNILRVWVLDKITDFLFFLSKVLLTLGVGAASYVFFASGLLPTKVIDNSDLHYGIVPVAVIMICTYFISSLFFNVYSMAVDTLFLCFLEDCERNDGSPEKPYYMSKSLMKIFGKKNKID

SEQ ID NO: 25168 - protein, 77 aa, Diabrotica virgifera
  misc_feature: Coding regions on vcDNA: vcDNA=SeqID_4865; Strand=-; Position=2-232
  misc_feature (7)..(23): Xaa can be any naturally occurring amino acid
  misc_feature (30)..(39): Xaa can be any naturally occurring amino acid
  misc_feature (46)..(75): Xaa can be any naturally occurring amino acid
MYFKTNXXXXXXXXXXXXXXXXXANLIALXXXXXXXXXXPSNTPCXXXXXXXXXXXXXXXXXXXXXXXXXXXXXXLL

SEQ ID NO: 25169 - protein, 48 aa, Diabrotica virgifera
  misc_feature: Coding regions on vcDNA: vcDNA=SeqID_4866; Strand=+; Position=62-208
KMKTVLLCIILCILDSFSEINIVCCIAHNMPIYTKNLFVSNPNSKRKC

SEQ ID NO: 25170 - protein, 112 aa, Diabrotica virgifera
  misc_feature: Coding regions on vcDNA: vcDNA=SeqID_4867; Strand=+; Position=51-386
LICYIYFVLNAMFKRNSAKVELESIAAFLSKCLQTKIYINKTNIDHFLEVISICLGEHCTVWKKSNVDARKLLENVINFTHSIEVAETSRIKMISILADFDDSPYLTKAIGY

SEQ ID NO: 25171 - protein, 53 aa, Diabrotica virgifera
  misc_feature: Coding regions on vcDNA: vcDNA=SeqID_4868; Strand=+; Position=251-409
MMRIKRTTLILGLLIIIWSSIFYLTYYYHPVHIYSEIPSKLSQHIVILEQGIS

SEQ ID NO: 25172 - protein, 89 aa, Diabrotica virgifera
  misc_feature: Coding regions on vcDNA: vcDNA=SeqID_4869; Strand=+; Position=77-346
  misc_feature: Homolog annotation: Hit_ID=NP_648022.1; Match level="QueryCoverage =95%, HitCoverage=93%, E-value=1e-22, Identity=63%"; Hit description =CG6610-PA [Drosophila melanogaster] gb|AAF50703.1| CG6610-PA [Drosophila melanogaster]
  misc_feature: Pfam annotation: Pfam_ID=LSM; Match level="Score=11.9, E-value =0.0061, Copies=1"; Pfam description=LSM domain
  misc_feature (61)..(61): Xaa can be any naturally occurring amino acid
MSTMPMTSSSLLPLELVYNCIGSELQIIMINEMEIDGTLSRFDDFVKKLLDDVTEYENTPXGRRITTLDEILLNGINKSLHVPEGDMPE

SEQ ID NO: 25173 - protein, 55 aa, Diabrotica virgifera
  misc_feature: Coding regions on vcDNA: vcDNA=SeqID_4870; Strand=-; Position=77-244
ASCILTRTFFIIGCHFIIFVNNLISHIYRSNYFQIKNPFKNISLHQQYTDKLNIS

SEQ ID NO: 25174 - protein, 35 aa, Diabrotica virgifera
  misc_feature: Coding regions on vcDNA: vcDNA=SeqID_4871; Strand=-; Position=1-105
RSSSCLLMIIYLQSKISDITCLHLKISKFAKLVAL

SEQ ID NO: 25175 - protein, 108 aa, Diabrotica virgifera
  misc_feature: Coding regions on vcDNA: vcDNA=SeqID_4872; Strand=+; Position=2-324
  misc_feature: Homolog annotation: Hit_ID=I41220; Match level="QueryCoverage=95%, HitCoverage=34%, E-value=8e-16, Identity=45%"; Hit description =glyceraldehyde-3-phosphate dehydrogenase (phosphorylating)  (EC 1.2.1.12) - Escherichia
  misc_feature: Gene Ontology Annotation: Biological process=glycolysis
  misc_feature: Pfam annotation: Pfam_ID=Gp_dh_C; Match level="Score=-39.3, E-value =1.7e-05, Copies=1"; Pfam description=Glyceraldehyde 3-phosphate dehydrogen
  misc_feature (43)..(43): Xaa can be any naturally occurring amino acid
  misc_feature (60)..(60): Xaa can be any naturally occurring amino acid
  misc_feature (73)..(73): Xaa can be any naturally occurring amino acid
GENITASTNVTANVVGKVNPFLFGKLTGKAIHVHVPIVTFVDXTVHLGNPAIYEEVYSQXLMNPHKVTHKGIXGYDADYLVTSDFDGKAHTAVLDAKSGTKLNDQSNK

SEQ ID NO: 25176 - protein, 65 aa, Diabrotica virgifera
  misc_feature: Coding regions on vcDNA: vcDNA=SeqID_4873; Strand=+; Position=1-195
DPRVRFFFIFFLYSTFNNLLQTILYFDIYFCYIRAFPTSGGNLILLPLTCTYTSFSSLFLHIYLL

SEQ ID NO: 25177 - protein, 90 aa, Diabrotica virgifera
  misc_feature: Coding regions on vcDNA: vcDNA=SeqID_4874; Strand=+; Position=3-272
GQPRFGKNSLLISLENNDDCKNYILYVISYINQECVRKKFMLKTETPFEFTSIPGNLKVFSGLNDVKELVNLDLLIIWVDRKYSLSAKDI

SEQ ID NO: 25178 - protein, 120 aa, Diabrotica virgifera
  misc_feature: Coding regions on vcDNA: vcDNA=SeqID_4875; Strand=+; Position=3-365
  misc_feature (4)..(39): Xaa can be any naturally occurring amino acid
  misc_feature (41)..(102): Xaa can be any naturally occurring amino acid
THAXXXXXXXXXXXXXXXXXXXXXXXXXXXXXXXXXXXXWXXXXXXXXXXXXXXXXXXXXXXXXXXXXXXXXXXXXXXXXXXXXXXXXXXXXXXXXXXXXXXHLVLSSITLSFYKFFITI

SEQ ID NO: 25179 - protein, 26 aa, Diabrotica virgifera
  misc_feature: Coding regions on vcDNA: vcDNA=SeqID_4876; Strand=+; Position=3-83
GPARVRIYKLRFYSSYCSSFKCWITS

SEQ ID NO: 25180 - protein, 88 aa, Diabrotica virgifera
  misc_feature: Coding regions on vcDNA: vcDNA=SeqID_4877; Strand=+; Position=3-266
  misc_feature (5)..(24): Xaa can be any naturally occurring amino acid
  misc_feature (35)..(54): Xaa can be any naturally occurring amino acid
  misc_feature (58)..(85): Xaa can be any naturally occurring amino acid
SDLKXXXXXXXXXXXXXXXXXXXXKCYAFLNISKXXXXXXXXXXXXXXXXXXXXISNXXXXXXXXXXXXXXXXXXXXXXXXXXXXELK

SEQ ID NO: 25181 - protein, 58 aa, Diabrotica virgifera
  misc_feature: Coding regions on vcDNA: vcDNA=SeqID_4878; Strand=+; Position=2-178
ENGGDIEQKRFSFKIKMAANAIARFGRDFKFALLLTPLKIGKLKFGAAPNARLGLLFV

SEQ ID NO: 25182 - protein, 30 aa, Diabrotica virgifera
  misc_feature: Coding regions on vcDNA: vcDNA=SeqID_4879; Strand=+; Position=3-95
  misc_feature (4)..(22): Xaa can be any naturally occurring amino acid
KFIXXXXXXXXXXXXXXXXXXXLLNELISL

SEQ ID NO: 25183 - protein, 61 aa, Diabrotica virgifera
  misc_feature: Coding regions on vcDNA: vcDNA=SeqID_4880; Strand=-; Position=188-373
KIYKNLYGVDLSSSLVLLTLMFQVVTVLRVQSIVTSLGVQYIDFSMKRNNIVYLKQSSILI

SEQ ID NO: 25184 - protein, 48 aa, Diabrotica virgifera
  misc_feature: Coding regions on vcDNA: vcDNA=SeqID_4881; Strand=+; Position=43-189
TLIAFLQIFSKIRFAPVVEIKLGTGLTLYKMHTYVSVYDNYLYFNVVT

SEQ ID NO: 25185 - protein, 101 aa, Diabrotica virgifera
  misc_feature: Coding regions on vcDNA: vcDNA=SeqID_4882; Strand=+; Position=32-334
  misc_feature: Homolog annotation: Hit_ID=AAK92163.1; Match level="QueryCoverage =91%, HitCoverage=68%, E-value=6e-11, Identity=39%"; Hit description =ribosomal protein L27 [Spodoptera frugiperda]
MGFLVKSGKVFMDRGGRNTGRKSFIFKTYDFSLCTLLYQGSLITGYEMNTLKFHRPMGLGFLLVRSIFQPFIMVWNVNHLKPTTYSVDLASDLVIVPIVLI

SEQ ID NO: 25186 - protein, 79 aa, Diabrotica virgifera
  misc_feature: Coding regions on vcDNA: vcDNA=SeqID_4883; Strand=-; Position=171-410
  misc_feature (5)..(23): Xaa can be any naturally occurring amino acid
FNFSXXXXXXXXXXXXXXXXXXXCNFLPWVLAPLKEGARVHCTLGTYGSGSPGTNAPPSQKRTALNGSTPRVFSYLDVH

SEQ ID NO: 25187 - protein, 75 aa, Diabrotica virgifera
  misc_feature: Coding regions on vcDNA: vcDNA=SeqID_4884; Strand=+; Position=1-228
  misc_feature (9)..(20): Xaa can be any naturally occurring amino acid
  misc_feature (23)..(35): Xaa can be any naturally occurring amino acid
  misc_feature (39)..(51): Xaa can be any naturally occurring amino acid
THASDNNNXXXXXXXXXXXXLIXXXXXXXXXXXXXRLAXXXXXXXXXXXXXSLYLYYFRIETSYSIQIFIVTYIF

SEQ ID NO: 25188 - protein, 29 aa, Diabrotica virgifera
  misc_feature: Coding regions on vcDNA: vcDNA=SeqID_4885; Strand=-; Position=1-87
  misc_feature (12)..(17): Xaa can be any naturally occurring amino acid
KKPRGMAERAQXXXXXXEINVGRVGGCVG

SEQ ID NO: 25189 - protein, 33 aa, Diabrotica virgifera
  misc_feature: Coding regions on vcDNA: vcDNA=SeqID_4886; Strand=+; Position=1-99
  misc_feature (15)..(21): Xaa can be any naturally occurring amino acid
FFELIFLLFYLPKCXXXXXXXKICSSFLDISCF

SEQ ID NO: 25190 - protein, 59 aa, Diabrotica virgifera
  misc_feature: Coding regions on vcDNA: vcDNA=SeqID_4887; Strand=+; Position=193-372
YQNTVMIYLLSYRELLSSVFYSNFTTKIYYYLSLSTKLTVTLIPDIILKKYHILPIFWY

SEQ ID NO: 25191 - protein, 103 aa, Diabrotica virgifera
  misc_feature: Coding regions on vcDNA: vcDNA=SeqID_4888; Strand=+; Position=22-333
QTKMARPLKPKHGVVEVLKTFNVKTVIYMIAESWEQVTTISLIMLEKNYGSMYVTCQKIQFNQWRTVTWKMTRQTRSSPKNFWICSKILTVALKSMKVTLICG

SEQ ID NO: 25192 - protein, 35 aa, Diabrotica virgifera
  misc_feature: Coding regions on vcDNA: vcDNA=SeqID_4889; Strand=-; Position=3-107
RLDRGFVIDSRIRPPDNGSLASYIGKLRNEVGLKQ

SEQ ID NO: 25193 - protein, 75 aa, Diabrotica virgifera
  misc_feature: Coding regions on vcDNA: vcDNA=SeqID_4890; Strand=+; Position=5-232
  misc_feature (2)..(15): Xaa can be any naturally occurring amino acid
KXXXXXXXXXXXXXXPKRFSAFRITESLFINPSNLNPTVRFQGGGSFQGNDCYTLWVNHHKPLANFPPFQLGRLF

SEQ ID NO: 25194 - protein, 111 aa, Diabrotica virgifera
  misc_feature: Coding regions on vcDNA: vcDNA=SeqID_4891; Strand=+; Position=2-337
  misc_feature (4)..(20): Xaa can be any naturally occurring amino acid
HASXXXXXXXXXXXXXXXXXVQEMKSIFIITFFACIGLAVAVAIPMNIKGPAPDLDDPNCVVCFSAGNFIQGFKNSGDSKEEAKQQRNFICNLFNTDELMQICMSTYEDDV

SEQ ID NO: 25195 - protein, 60 aa, Diabrotica virgifera
  misc_feature: Coding regions on vcDNA: vcDNA=SeqID_4892; Strand=+; Position=64-246
  misc_feature: Homolog annotation: Hit_ID=NP_788568.1; Match level="QueryCoverage =90%, HitCoverage=93%, E-value=1e-11, Identity=57%"; Hit description =CG33169-PA, isoform A [Drosophila melanogaster] gb|AAN12206.1| CG33169-PA, isoform A [Drosophila
MRNKAGKVKETSKEKKQRKKDFQETQKQVKTIVLPGLIVIAIFIIIYVYMKTRPKNGYID

SEQ ID NO: 25196 - protein, 52 aa, Diabrotica virgifera
  misc_feature: Coding regions on vcDNA: vcDNA=SeqID_4893; Strand=+; Position=46-204
HCARSVRYTHIHQIRFVCYSILHDHELPLLIWGFSQMCFEYALLLHHSRTFS

SEQ ID NO: 25197 - protein, 67 aa, Diabrotica virgifera
  misc_feature: Coding regions on vcDNA: vcDNA=SeqID_4894; Strand=-; Position=2-202
MHKVVIRVRQGCILSPVVFNMYCEHIFQQALEELQEGVVNRVRLNNIMYADDAVGFAVGLDDLQRIS

SEQ ID NO: 25198 - protein, 90 aa, Diabrotica virgifera
  misc_feature: Coding regions on vcDNA: vcDNA=SeqID_4895; Strand=+; Position=20-292
NDGKRRLKIRNHHCTVYYESWDKLRVVKKNKQLTISDELADYNLPTLKRTKLDAQKSEGPVELFPSDSEEDYDDECGKRKRGKRGGKKIK

SEQ ID NO: 25199 - protein, 86 aa, Diabrotica virgifera
  misc_feature: Coding regions on vcDNA: vcDNA=SeqID_4896; Strand=+; Position=113-370
  misc_feature (13)..(23): Xaa can be any naturally occurring amino acid
  misc_feature (71)..(85): Xaa can be any naturally occurring amino acid
KHGLHIFSKIREXXXXXXXXXXXKRPYIILLILNFRLVKLFKDRQSESEIFKSVNSVQKRSTAPKGVLSYXXXXXXXXXXXXXXXH

SEQ ID NO: 25200 - protein, 45 aa, Diabrotica virgifera
  misc_feature: Coding regions on vcDNA: vcDNA=SeqID_4897; Strand=+; Position=2-136
LQANCSTSPYLPNFHLFGLWLSNIRKKHWNCNFVASEGGATGETF

SEQ ID NO: 25201 - protein, 25 aa, Diabrotica virgifera
  misc_feature: Coding regions on vcDNA: vcDNA=SeqID_4898; Strand=+; Position=1-78
TSISDLVCSTFKFLHHVTLNRCEPS

SEQ ID NO: 25202 - protein, 54 aa, Diabrotica virgifera
  misc_feature: Coding regions on vcDNA: vcDNA=SeqID_4899; Strand=+; Position=3-167
KTRTKDLSSTFPYASIDMSHVLFLQLSYGTSGQNFLGGNDIKTKIRYTYLFSSC

SEQ ID NO: 25203 - protein, 17 aa, Diabrotica virgifera
  misc_feature: Coding regions on vcDNA: vcDNA=SeqID_4900; Strand=-; Position=14-67
YDMCLNRFEPGCFYINI

SEQ ID NO: 25204 - protein, 59 aa, Diabrotica virgifera
  misc_feature: Coding regions on vcDNA: vcDNA=SeqID_4901; Strand=+; Position=123-302
  misc_feature (23)..(35): Xaa can be any naturally occurring amino acid
VHFLYCKLTSLLISSTLNSSLYXXXXXXXXXXXXXDIVFIEATTKLNVFHFPKIYSRLI

SEQ ID NO: 25205 - protein, 43 aa, Diabrotica virgifera
  misc_feature: Coding regions on vcDNA: vcDNA=SeqID_4902; Strand=+; Position=35-166
LTSVILFINSWRASELSANTTVSSAYRMLLNYLYGNSIHITLM

SEQ ID NO: 25206 - protein, 73 aa, Diabrotica virgifera
  misc_feature: Coding regions on vcDNA: vcDNA=SeqID_4903; Strand=+; Position=1-222
  misc_feature (3)..(15): Xaa can be any naturally occurring amino acid
  misc_feature (22)..(30): Xaa can be any naturally occurring amino acid
  misc_feature (50)..(57): Xaa can be any naturally occurring amino acid
  misc_feature (59)..(70): Xaa can be any naturally occurring amino acid
TLXXXXXXXXXXXXXLTIRINXXXXXXXXXIYFYILRLLRVTTFLSKYKXXXXXXXXMXXXXXXXXXXXXPNI

SEQ ID NO: 25207 - protein, 17 aa, Diabrotica virgifera
  misc_feature: Coding regions on vcDNA: vcDNA=SeqID_4904; Strand=-; Position=31-84
DSKSVIKQLNLFINHPK

SEQ ID NO: 25208 - protein, 58 aa, Diabrotica virgifera
  misc_feature: Coding regions on vcDNA: vcDNA=SeqID_4905; Strand=-; Position=2-175
  misc_feature (30)..(39): Xaa can be any naturally occurring amino acid
PHVTNCGLSIKLLVKKLINNCIKLPRVFCXXXXXXXXXXKSKCHRKLRYRQIGADPTD

SEQ ID NO: 25209 - protein, 82 aa, Diabrotica virgifera
  misc_feature: Coding regions on vcDNA: vcDNA=SeqID_4906; Strand=-; Position=48-296
  misc_feature (68)..(75): Xaa can be any naturally occurring amino acid
PYLYKYNCNTVFRYIFNIQCVHKATHQFIISQINSIIRNSRNRSICIFKLRILGIYAILVTASRVLNXXXXXXXXRQNEESM

SEQ ID NO: 25210 - protein, 121 aa, Diabrotica virgifera
  misc_feature: Coding regions on vcDNA: vcDNA=SeqID_4907; Strand=+; Position=1-363
SHSPLLICSWITWIISYCTTLMGFNNDNGFEYSKDEEPTAFLQVKHRQAAPGLSPAVEVPLFKINQVYHFLIFTKSNHRATISILTYPYNYHITCTSAIKRLVEFTDCPHLCNPGLHPFVK

SEQ ID NO: 25211 - protein, 63 aa, Diabrotica virgifera
  misc_feature: Coding regions on vcDNA: vcDNA=SeqID_4908; Strand=+; Position=3-191
TRTESTHAFDEHNQCLHLFYLEFKVYVKHPNFFHVPTSLYGGVNTYKPPFYGDTTTFTFISFL

SEQ ID NO: 25212 - protein, 138 aa, Diabrotica virgifera
  misc_feature: Coding regions on vcDNA: vcDNA=SeqID_4909; Strand=+; Position=1-414
  misc_feature: Homolog annotation: Hit_ID=XP_394740.1; Match level="QueryCoverage =94%, HitCoverage=26%, E-value=9e-17, Identity=35%"; Hit description =similar to ENSANGP00000011318 [Apis mellifera]
  misc_feature: Gene Ontology Annotation: Molecular function=snoRNA binding; Cellular component=nucleolus organizer complex; Biological process=rRNA processing
  misc_feature (16)..(21): Xaa can be any naturally occurring amino acid
TRPQILAESGQIAEMXXXXXXVRNKHKQNSHMWIEVAKIYYMLDKFKEARNLKDAALKSITIKKMQLDIIVQFALMEFNYGEPHYGSHIFEAILSSDPKKVTIWTMYVDQLVKKGKIDEARQVLDRSVSQHLPVKSLK

SEQ ID NO: 25213 - protein, 55 aa, Diabrotica virgifera
  misc_feature: Coding regions on vcDNA: vcDNA=SeqID_4910; Strand=+; Position=1-168
HASVSYIMLAFGYSSSSSLLVIILYCPAASSSMVPNIFLGIFLSQQNKATISIKN

SEQ ID NO: 25214 - protein, 59 aa, Diabrotica virgifera
  misc_feature: Coding regions on vcDNA: vcDNA=SeqID_4911; Strand=+; Position=2-178
  misc_feature (16)..(41): Xaa can be any naturally occurring amino acid
CRRELMFYIIHFIYYXXXXXXXXXXXXXXXXXXXXXXXXXXEGASRARSENLPSTMSQG

SEQ ID NO: 25215 - protein, 140 aa, Diabrotica virgifera
  misc_feature: Coding regions on vcDNA: vcDNA=SeqID_4912; Strand=+; Position=23-442
  misc_feature: Homolog annotation: Hit_ID=XP_318831.1; Match level="QueryCoverage =99%, HitCoverage=50%, E-value=2e-09, Identity=30%"; Hit description =ENSANGP00000010180 [Anopheles gambiae]
  misc_feature: Pfam annotation: Pfam_ID=GILT; Match level="Score=-11.1, E-value =0.00013, Copies=1"; Pfam description=Gamma interferon inducible lysosomal t
  misc_feature (63)..(88): Xaa can be any naturally occurring amino acid
CPDSVRFIGRQLYPKWDQIKDYIDELEFVPFGKAIYVHHDADIVKQTPERYSFSCQHGRRECXXXXXXXXXXXXXXXXXXXXXXXXXXMKSIDPSSFDTVEECARRFGLDIPKLKSCSDSIEGDKLLATKGDRTFQLDPN

SEQ ID NO: 25216 - protein, 70 aa, Diabrotica virgifera
  misc_feature: Coding regions on vcDNA: vcDNA=SeqID_4913; Strand=-; Position=61-273
  misc_feature (27)..(39): Xaa can be any naturally occurring amino acid
ISTLTNLLYYKTDILQNMEQFNQIDSXXXXXXXXXXXXXPKIITISQTLSSVLERTNPQYLAYWTWSHIL

SEQ ID NO: 25217 - protein, 58 aa, Diabrotica virgifera
  misc_feature: Coding regions on vcDNA: vcDNA=SeqID_4914; Strand=-; Position=30-206
  misc_feature (44)..(50): Xaa can be any naturally occurring amino acid
TFVHLCQVHFCINIYLISCNIERFHSSTVYLRYKFIDVMLFDPXXXXXXXSHPKIQNF

SEQ ID NO: 25218 - protein, 69 aa, Diabrotica virgifera
  misc_feature: Coding regions on vcDNA: vcDNA=SeqID_4915; Strand=-; Position=32-241
  misc_feature (39)..(45): Xaa can be any naturally occurring amino acid
NERFSNHCDKLISDMLVNLDINWKLLYNVLTCSYPIFIXXXXXXXLYSQFIIEITRIILFTKFCYVQFR

SEQ ID NO: 25219 - protein, 86 aa, Diabrotica virgifera
  misc_feature: Coding regions on vcDNA: vcDNA=SeqID_4916; Strand=+; Position=80-337
  misc_feature (28)..(38): Xaa can be any naturally occurring amino acid
  misc_feature (41)..(62): Xaa can be any naturally occurring amino acid
  misc_feature (65)..(86): Xaa can be any naturally occurring amino acid
NVMNLFSNRSPSHVNINMYIINTYEKLXXXXXXXXXXXLLXXXXXXXXXXXXXXXXXXXXXXIDXXXXXXXXXXXXXXXXXXXXXX

SEQ ID NO: 25220 - protein, 57 aa, Diabrotica virgifera
  misc_feature: Coding regions on vcDNA: vcDNA=SeqID_4917; Strand=-; Position=6-179
  misc_feature (10)..(16): Xaa can be any naturally occurring amino acid
  misc_feature (28)..(48): Xaa can be any naturally occurring amino acid
KMILNSFGKXXXXXXXYNDFILNTSSHXXXXXXXXXXXXXXXXXXXXXYINININIF

SEQ ID NO: 25221 - protein, 81 aa, Diabrotica virgifera
  misc_feature: Coding regions on vcDNA: vcDNA=SeqID_4918; Strand=+; Position=44-286
  misc_feature (2)..(14): Xaa can be any naturally occurring amino acid
RXXXXXXXXXXXXXIIFIYGKFDFFIDFLVIYLLRLVPFSNEDDMSTNNVSEYAYQQRVLMEVGNMCVTGLLKSCPFVLNL

SEQ ID NO: 25222 - protein, 138 aa, Diabrotica virgifera
  misc_feature: Coding regions on vcDNA: vcDNA=SeqID_4919; Strand=+; Position=1-414
  misc_feature: Homolog annotation: Hit_ID=EAL41175.1; Match level="QueryCoverage =92%, HitCoverage=43%, E-value=2e-23, Identity=44%"; Hit description =ENSANGP00000025801 [Anopheles gambiae str. PEST] ref|XP_565822.1| ENSANGP00000025801 [Anopheles gambiae st
  misc_feature: Gene Ontology Annotation: Molecular function=DNA helicase activity; Cellular component=nucleus; Biological process=aging
  misc_feature: Pfam annotation: Pfam_ID=3_5_exonuc; Match level="Score=-34.9, E -value=0.026, Copies=1"; Pfam description=3'-5' exonuclease
FRVPPRVSIHVSKIRNLPSSLSQLLIHPNVRLTGNCIKRYVRKLARDFAGFDGDNMVDNCVDLGLFANRVLSIRDTWSLERLVEHFLDLQLSIDMNVRHSRWHIIPLSKEQQLYAATDSYASLLLYNVLKSRENELKA

SEQ ID NO: 25223 - protein, 67 aa, Diabrotica virgifera
  misc_feature: Coding regions on vcDNA: vcDNA=SeqID_4920; Strand=-; Position=79-282
  misc_feature (14)..(40): Xaa can be any naturally occurring amino acid
PLFLLNLRPFFYYXXXXXXXXXXXXXXXXXXXXXXXXXXXYKYIKDSQILIPNIKIKYIIRVLASTQ

SEQ ID NO: 25224 - protein, 101 aa, Diabrotica virgifera
  misc_feature: Coding regions on vcDNA: vcDNA=SeqID_4921; Strand=-; Position=51-356
  misc_feature (39)..(51): Xaa can be any naturally occurring amino acid
  misc_feature (54)..(96): Xaa can be any naturally occurring amino acid
PRFFPGGQFLKRGPGVKTTGALRGRFIPRPAVIKDGPPXXXXXXXXXXXXXCTXXXXXXXXXXXXXXXXXXXXXXXXXXXXXXXXXXXXXXXXXXXLFKLF

SEQ ID NO: 25225 - protein, 47 aa, Diabrotica virgifera
  misc_feature: Coding regions on vcDNA: vcDNA=SeqID_4922; Strand=+; Position=35-175
QQLLVQTDDQNLFYKVPVYKFMEDVRLSNPKEIDLQDHWIIQISLVV

SEQ ID NO: 25226 - protein, 71 aa, Diabrotica virgifera
  misc_feature: Coding regions on vcDNA: vcDNA=SeqID_4923; Strand=-; Position=328-543
  misc_feature (3)..(26): Xaa can be any naturally occurring amino acid
  misc_feature (32)..(32): Xaa can be any naturally occurring amino acid
  misc_feature (35)..(36): Xaa can be any naturally occurring amino acid
  misc_feature (40)..(40): Xaa can be any naturally occurring amino acid
  misc_feature (45)..(45): Xaa can be any naturally occurring amino acid
  misc_feature (48)..(49): Xaa can be any naturally occurring amino acid
  misc_feature (54)..(55): Xaa can be any naturally occurring amino acid
  misc_feature (70)..(71): Xaa can be any naturally occurring amino acid
VFXXXXXXXXXXXXXXXXXXXXXXXXKDQFFXFHXXTPSXSRLSXIKXXLIDYXXTLSKRSQNTPAAPFXX

SEQ ID NO: 25227 - protein, 123 aa, Diabrotica virgifera
  misc_feature: Coding regions on vcDNA: vcDNA=SeqID_4924; Strand=+; Position=2-370
  misc_feature: Homolog annotation: Hit_ID=XP_392115.1; Match level="QueryCoverage =100%, HitCoverage=50%, E-value=9e-55, Identity=86%"; Hit description= similar to p27BBP/eIF6 [Apis mellifera]
  misc_feature: Gene Ontology Annotation: Molecular function=molecular_function unknown; Cellular component=nucleus; Biological process=ribosomal large subunit biogenesis
  misc_feature: Pfam annotation: Pfam_ID=eIF-6; Match level="Score=140.0, E-value =5.5e-39, Copies=1"; Pfam description=eIF-6 family
GNKNGLLVPSSTFDTELQHIRNALPDTVKVHRVEERLSALGNVIACNDYVALVHPDLDRETEELIADTLKVEVFRQTIASNVLVGSYCVLSNQGGLLHPNTTIVDQEELSSLLQVPLVAGTVN

SEQ ID NO: 25228 - protein, 39 aa, Diabrotica virgifera
  misc_feature: Coding regions on vcDNA: vcDNA=SeqID_4925; Strand=+; Position=16-135
RVNRFVIYYVAGRWISIRNWDYITNYLNILFWYRYYISR

SEQ ID NO: 25229 - protein, 120 aa, Diabrotica virgifera
  misc_feature: Coding regions on vcDNA: vcDNA=SeqID_4926; Strand=-; Position=37-399
  misc_feature (19)..(28): Xaa can be any naturally occurring amino acid
FTKITKISLQYRLLKIIYXXXXXXXXXXINKEYYDLYLFIMSLQRLQRLFTLTELQKFLYNINYLKSFTRNRTINYNKELKRIVCYYLHQSMRARSGYYLQILSYCMDFNEILKIVLLIS

SEQ ID NO: 25230 - protein, 95 aa, Diabrotica virgifera
  misc_feature: Coding regions on vcDNA: vcDNA=SeqID_4927; Strand=-; Position=2-286
  misc_feature (6)..(64): Xaa can be any naturally occurring amino acid
YGVKPXXXXXXXXXXXXXXXXXXXXXXXXXXXXXXXXXXXXXXXXXXXXXXXXXXXXXXXXXXXTCFKIIVLYNILEAYVQKMFLKFVVFQNKNI

SEQ ID NO: 25231 - protein, 62 aa, Diabrotica virgifera
  misc_feature: Coding regions on vcDNA: vcDNA=SeqID_4928; Strand=-; Position=109-297
AGPDPSTDYRIFKVSNEPRTSFDPFHSFYSPAPECLDTFSSIHSVLFFLFQARSRIVENIGS

SEQ ID NO: 25232 - protein, 134 aa, Diabrotica virgifera
  misc_feature: Coding regions on vcDNA: vcDNA=SeqID_4929; Strand=+; Position=3-404
  misc_feature: Homolog annotation: Hit_ID=CAA76931.1; Match level="QueryCoverage =95%, HitCoverage=52%, E-value=2e-27, Identity=44%"; Hit description =endoglucanase [Phaedon cochleariae]
  misc_feature: Pfam annotation: Pfam_ID=Glyco_hydro_45; Match level="Score=22.2, E -value=1.1e-09, Copies=1"; Pfam description=Glycosyl hydrolase family 45
  misc_feature (9)..(9): Xaa can be any naturally occurring amino acid
  misc_feature (35)..(35): Xaa can be any naturally occurring amino acid
  misc_feature (107)..(116): Xaa can be any naturally occurring amino acid
ITPSCSWRXNLHTPSGLPLASCNISGVNRVDDNAXSGCEGDGTAYMCNSHHPWALPITLAYGFGAASFNNGIDVSLSCTCYLHTFSDHISNTTIIVQITNTGSDLTXXXXXXXXXXCGVGIFTQGCHDHWHAPW

SEQ ID NO: 25233 - protein, 114 aa, Diabrotica virgifera
  misc_feature: Coding regions on vcDNA: vcDNA=SeqID_4930; Strand=+; Position=33-377
  misc_feature: Homolog annotation: Hit_ID=XP_541454.1; Match level="QueryCoverage =95%, HitCoverage=5%, E-value=1e-10, Identity=33%"; Hit description =PREDICTED: similar to zinc finger protein 615 [Canis familiaris]
  misc_feature: Pfam annotation: Pfam_ID=zf-C2H2; Match level="Score=58.1, E-value =2.5e-14, Copies=3"; Pfam description=Zinc finger, C2H2 type
SSSQSFEKKWLEDHKMFHKMYKQFEPKGCKVCSREFTTTKQLLVHIQESHSDNSLIPFKKYKCTTCNLTLPYKKNLDQHMEHMHSSEEKKSFLCTDCGHSFASISRLTDHMKIH

SEQ ID NO: 25234 - protein, 39 aa, Diabrotica virgifera
  misc_feature: Coding regions on vcDNA: vcDNA=SeqID_4931; Strand=+; Position=2-121
GRVGKNLQSRHAEVVIFILDVILHYIFIHVIFSIPCETE

SEQ ID NO: 25235 - protein, 39 aa, Diabrotica virgifera
  misc_feature: Coding regions on vcDNA: vcDNA=SeqID_4932; Strand=-; Position=73-192
  misc_feature (27)..(33): Xaa can be any naturally occurring amino acid
TFHIQFIPINIDHYLYRNLLCYRYCWXXXXXXXVKTWLS

SEQ ID NO: 25236 - protein, 60 aa, Diabrotica virgifera
  misc_feature: Coding regions on vcDNA: vcDNA=SeqID_4933; Strand=+; Position=123-302
VTAIAYDLHILIIECHRTYLGQNVSQREKGFVARQCTPLKLKFLKLPQHPLVRNTPCSGL

SEQ ID NO: 25237 - protein, 110 aa, Diabrotica virgifera
  misc_feature: Coding regions on vcDNA: vcDNA=SeqID_4934; Strand=+; Position=18-347
  misc_feature (8)..(18): Xaa can be any naturally occurring amino acid
  misc_feature (46)..(103): Xaa can be any naturally occurring amino acid
RKINKTTXXXXXXXXXXXKGSNLNYPLMQLQTPPKLPPNLNPLASXXXXXXXXXXXXXXXXXXXXXXXXXXXXXXXXXXXXXXXXXXXXXXXXXXXXXXXXXXPAVLWFT

SEQ ID NO: 25238 - protein, 46 aa, Diabrotica virgifera
  misc_feature: Coding regions on vcDNA: vcDNA=SeqID_4935; Strand=+; Position=56-193
LVRPCKIANFTGTSWPLCFYHNWSWRCWCYRISWQIYYYIGVLRPC

SEQ ID NO: 25239 - protein, 135 aa, Diabrotica virgifera
  misc_feature: Coding regions on vcDNA: vcDNA=SeqID_4936; Strand=+; Position=60-466
  misc_feature: Homolog annotation: Hit_ID=XP_322020.1; Match level="QueryCoverage =95%, HitCoverage=85%, E-value=3e-38, Identity=58%"; Hit description =ENSANGP00000012155 [Anopheles gambiae] gb|EAA01536.2| ENSANGP00000012155 [Anopheles gambiae
  misc_feature (88)..(88): Xaa can be any naturally occurring amino acid
  misc_feature (101)..(101): Xaa can be any naturally occurring amino acid
RAIVSLSTTSIRYGKRNFRKFPIYNKRGTRIFKQQQMQNPDPEVPVHKRGVREVGYEERDKFITIPERIPELIVPDLRNCQLKPYVSXRPQEVFQSEFTSXDLLNVVYAPKIVKDFNEGKLADDGQPLEPSREEK

SEQ ID NO: 25240 - protein, 88 aa, Diabrotica virgifera
  misc_feature: Coding regions on vcDNA: vcDNA=SeqID_4937; Strand=-; Position=1-264
  misc_feature (45)..(84): Xaa can be any naturally occurring amino acid
VTPRKKTKHPQHTKNRLNPPKSAPPSIFLIHLHYNLSNFILFTLXXXXXXXXXXXXXXXXXXXXXXXXXXXXXXXXXXXXXXXXSDAW

SEQ ID NO: 25241 - protein, 59 aa, Diabrotica virgifera
  misc_feature: Coding regions on vcDNA: vcDNA=SeqID_4938; Strand=+; Position=2-181
  misc_feature: Homolog annotation: Hit_ID=NP_729843.1; Match level="QueryCoverage =86%, HitCoverage=10%, E-value=2e-10, Identity=62%"; Hit description =CG10960-PC, isoform C [Drosophila melanogaster] ref|NP_729842.1| CG10960-PA, isoform A [Drosophila
HASAILVTKFFNDLNLALGIGGTFWLFACFCIAALVFVIFFVPETKGKSFQEIQIFLDR

SEQ ID NO: 25242 - protein, 100 aa, Diabrotica virgifera
  misc_feature: Coding regions on vcDNA: vcDNA=SeqID_4939; Strand=+; Position=3-305
  misc_feature: Homolog annotation: Hit_ID=XP_397128.1; Match level="QueryCoverage =75%, HitCoverage=16%, E-value=1e-15, Identity=58%"; Hit description =similar to ENSANGP00000006836 [Apis mellifera]
  misc_feature (43)..(48): Xaa can be any naturally occurring amino acid
VRKKSFSSDIKYVDIPIPAGCEEVFVRFSNSECAKEFCNKEYXXXXXXLEGDEEQMYWEKIQNDRSIKFSKNVKKQRGRDKLLKKAEKERAKHIKFDEGE

SEQ ID NO: 25243 - protein, 110 aa, Diabrotica virgifera
  misc_feature: Coding regions on vcDNA: vcDNA=SeqID_4940; Strand=+; Position=1-334
  misc_feature: Homolog annotation: Hit_ID=CAA10770.1; Match level="QueryCoverage =90%, HitCoverage=29%, E-value=6e-14, Identity=30%"; Hit description =reverse transcriptase-like [Bos taurus]
  misc_feature (55)..(55): Xaa can be any naturally occurring amino acid
PRVSERVGARSAFNNMAKLFKSHNLNLKIKIRLLRCYIFLILYYGVESWTLTEAXRKNLEVFEMWLYRRILRISWTDKITNETVLRRIGKEREVMYTIKRRTLEYLGHTE

SEQ ID NO: 25244 - protein, 69 aa, Diabrotica virgifera
  misc_feature: Coding regions on vcDNA: vcDNA=SeqID_4941; Strand=+; Position=131-340
NANTCFLWFFSKLLLFCNKCDNFWNFQLIVYCRKFNYAAFMSVQLFSKMNTFKVIIGKPRKKSNFSFIS

SEQ ID NO: 25245 - protein, 43 aa, Diabrotica virgifera
  misc_feature: Coding regions on vcDNA: vcDNA=SeqID_4942; Strand=+; Position=85-213
  misc_feature (20)..(26): Xaa can be any naturally occurring amino acid
  misc_feature (36)..(43): Xaa can be any naturally occurring amino acid
VADYIFIHINSDSLFAHNIXXXXXXXLFISLNKLEXXXXXXXX

SEQ ID NO: 25246 - protein, 85 aa, Diabrotica virgifera
  misc_feature: Coding regions on vcDNA: vcDNA=SeqID_4943; Strand=-; Position=0-254
  misc_feature (12)..(21): Xaa can be any naturally occurring amino acid
  misc_feature (23)..(81): Xaa can be any naturally occurring amino acid
RVQIVNVYIYSXXXXXXXXXXHXXXXXXXXXXXXXXXXXXXXXXXXXXXXXXXXXXXXXXXXXXXXXXXXXXXXXXXXXXXDAYV

SEQ ID NO: 25247 - protein, 53 aa, Diabrotica virgifera
  misc_feature: Coding regions on vcDNA: vcDNA=SeqID_4944; Strand=+; Position=199-360
  misc_feature (15)..(33): Xaa can be any naturally occurring amino acid
  misc_feature (41)..(49): Xaa can be any naturally occurring amino acid
VSITIKTFHSLKGVXXXXXXXXXXXXXXXXXXXQFKLLQFXXXXXXXXXKLYA

SEQ ID NO: 25248 - protein, 95 aa, Diabrotica virgifera
  misc_feature: Coding regions on vcDNA: vcDNA=SeqID_4945; Strand=+; Position=3-287
  misc_feature (82)..(87): Xaa can be any naturally occurring amino acid
SGQKQKLDIHLSTHYSHLIRNETRFDVGSTEYIIGEFLAFADLYNCPGILISSFEVTALLHGYFGNPADPVAHRDMFLPFVXXXXXXSDGRGSFI

SEQ ID NO: 25249 - protein, 60 aa, Diabrotica virgifera
  misc_feature: Coding regions on vcDNA: vcDNA=SeqID_4946; Strand=-; Position=95-277
  misc_feature (14)..(14): Xaa can be any naturally occurring amino acid
MLFSLISVLCYCLXLSTCLLVVYYCNFHYICFEINIVNLSFLFLFYIPTRICLFILRKHY

SEQ ID NO: 25250 - protein, 57 aa, Diabrotica virgifera
  misc_feature: Coding regions on vcDNA: vcDNA=SeqID_4947; Strand=+; Position=72-244
  misc_feature (10)..(10): Xaa can be any naturally occurring amino acid
  misc_feature (36)..(54): Xaa can be any naturally occurring amino acid
GKIKIRKGPXKIGFLGLNQPFNGSSKLINKRTNLPXXXXXXXXXXXXXXXXXXXLIL

SEQ ID NO: 25251 - protein, 52 aa, Diabrotica virgifera
  misc_feature: Coding regions on vcDNA: vcDNA=SeqID_4948; Strand=-; Position=204-362
  misc_feature (15)..(24): Xaa can be any naturally occurring amino acid
HIQYYIQNMYKIMTXXXXXXXXXXWFSFNKANIYGMSQRVGTIEKISLLCEE

SEQ ID NO: 25252 - protein, 60 aa, Diabrotica virgifera
  misc_feature: Coding regions on vcDNA: vcDNA=SeqID_4949; Strand=+; Position=164-343
  misc_feature (43)..(49): Xaa can be any naturally occurring amino acid
FLPKKNDFTCDYMQYLNKCKRYMCSFFKYLLNLVSPTKMTFSXXXXXXXTTVSVGQSLLS

SEQ ID NO: 25253 - protein, 138 aa, Diabrotica virgifera
  misc_feature: Coding regions on vcDNA: vcDNA=SeqID_4950; Strand=-; Position=1-414
  misc_feature (1)..(93): Xaa can be any naturally occurring amino acid
  misc_feature (102)..(128): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFYLNGYHFXXXXXXXXXXXXXXXXXXXXXXXXXXXGRVCGRVAGP

SEQ ID NO: 25254 - protein, 116 aa, Diabrotica virgifera
  misc_feature: Coding regions on vcDNA: vcDNA=SeqID_4951; Strand=+; Position=22-369
MDKALKTLYTNSSFVEDPLGYIKYNSDEVFGRSTARQAEAASRFVPVYMYQFSWYDKSSPLPGVKHAADLYYMWNVSFGTTTHNDALRKPILKWWTNFIKYQNPTPVKDEDLQNVI

SEQ ID NO: 25255 - protein, 97 aa, Diabrotica virgifera
  misc_feature: Coding regions on vcDNA: vcDNA=SeqID_4952; Strand=+; Position=33-323
  misc_feature (10)..(10): Xaa can be any naturally occurring amino acid
  misc_feature (13)..(19): Xaa can be any naturally occurring amino acid
  misc_feature (28)..(45): Xaa can be any naturally occurring amino acid
  misc_feature (49)..(62): Xaa can be any naturally occurring amino acid
  misc_feature (73)..(73): Xaa can be any naturally occurring amino acid
  misc_feature (83)..(92): Xaa can be any naturally occurring amino acid
SYSLILLRFXVCXXXXXXXGKLYKYGIXXXXXXXXXXXXXXXXXXVFSXXXXXXXXXXXXXXLVPVLLVIIGXGYQPERLEAXXXXXXXXXXISLPI

SEQ ID NO: 25256 - protein, 66 aa, Diabrotica virgifera
  misc_feature: Coding regions on vcDNA: vcDNA=SeqID_4953; Strand=-; Position=2-199
  misc_feature (11)..(25): Xaa can be any naturally occurring amino acid
  misc_feature (30)..(56): Xaa can be any naturally occurring amino acid
NSKIITSIIIXXXXXXXXXXXXXXXLIKIXXXXXXXXXXXXXXXXXXXXXXXXXXXQINTDAFRTR

SEQ ID NO: 25257 - protein, 70 aa, Diabrotica virgifera
  misc_feature: Coding regions on vcDNA: vcDNA=SeqID_4954; Strand=-; Position=2-211
EPNYERLQLLCRRFYKFLIMYLFFYAIFTKIFNICLFFMCMINFKFFEIEISIRYPFDPPLVHRSTSYFF

SEQ ID NO: 25258 - protein, 48 aa, Diabrotica virgifera
  misc_feature: Coding regions on vcDNA: vcDNA=SeqID_4955; Strand=-; Position=151-297
QLKNLLNISILSTAAYIQRYRNHKSFKALYKLLFSYLIYCTLITIKLH

SEQ ID NO: 25259 - protein, 42 aa, Diabrotica virgifera
  misc_feature: Coding regions on vcDNA: vcDNA=SeqID_4956; Strand=+; Position=64-189
PIPIVNYENEGVNADGSYNWRLQTGNGIIAQEQRQIKNIANE

SEQ ID NO: 25260 - protein, 40 aa, Diabrotica virgifera
  misc_feature: Coding regions on vcDNA: vcDNA=SeqID_4957; Strand=-; Position=1-120
  misc_feature (34)..(39): Xaa can be any naturally occurring amino acid
FFSYVLNINLFPTFDVENCKSVFFVPLDFFMDFXXXXXXS

SEQ ID NO: 25261 - protein, 50 aa, Diabrotica virgifera
  misc_feature: Coding regions on vcDNA: vcDNA=SeqID_4958; Strand=-; Position=0-149
INSIQRQYNGIKKLNQAIKNYLVMEHITLTQKRRLLKWSSFPIDSIARTA

SEQ ID NO: 25262 - protein, 98 aa, Diabrotica virgifera
  misc_feature: Coding regions on vcDNA: vcDNA=SeqID_4959; Strand=-; Position=0-293
  misc_feature (32)..(39): Xaa can be any naturally occurring amino acid
ILYTLNMDRIFFNQPINLAVTKNINDSPTLAXXXXXXXXILSVGRRDFLNLTRGLASPKQMKKMLPNSCIIPKLSYYSYTLILPIIPAFLSVTCGRAG

SEQ ID NO: 25263 - protein, 47 aa, Diabrotica virgifera
  misc_feature: Coding regions on vcDNA: vcDNA=SeqID_4960; Strand=+; Position=33-176
  misc_feature (29)..(39): Xaa can be any naturally occurring amino acid
QKKTHVGDYISSVKFITFILVVNRWRYNXXXXXXXXXXXYEYNRYNL

SEQ ID NO: 25264 - protein, 70 aa, Diabrotica virgifera
  misc_feature: Coding regions on vcDNA: vcDNA=SeqID_4961; Strand=+; Position=121-333
  misc_feature (48)..(55): Xaa can be any naturally occurring amino acid
SPEQSQFFLAYFPGVNVSRFTYVFTIEIIISTYFVQNIKTLKFVFIAXXXXXXXXLLITIDLLLISYFYF

SEQ ID NO: 25265 - protein, 89 aa, Diabrotica virgifera
  misc_feature: Coding regions on vcDNA: vcDNA=SeqID_4962; Strand=+; Position=1-267
  misc_feature (19)..(25): Xaa can be any naturally occurring amino acid
  misc_feature (50)..(62): Xaa can be any naturally occurring amino acid
  misc_feature (64)..(89): Xaa can be any naturally occurring amino acid
SRAHDRINRRPLFLMSNLXXXXXXXQLITNVRENFIFRTEKFNFWTLCIXXXXXXXXXXXXXNXXXXXXXXXXXXXXXXXXXXXXXXXX

SEQ ID NO: 25266 - protein, 81 aa, Diabrotica virgifera
  misc_feature: Coding regions on vcDNA: vcDNA=SeqID_4963; Strand=+; Position=1-243
  misc_feature (8)..(17): Xaa can be any naturally occurring amino acid
  misc_feature (20)..(39): Xaa can be any naturally occurring amino acid
  misc_feature (50)..(80): Xaa can be any naturally occurring amino acid
TLCITEYXXXXXXXXXXNFXXXXXXXXXXXXXXXXXXXXEESVTRFKISXXXXXXXXXXXXXXXXXXXXXXXXXXXXXXXA

SEQ ID NO: 25267 - protein, 73 aa, Diabrotica virgifera
  misc_feature: Coding regions on vcDNA: vcDNA=SeqID_4964; Strand=+; Position=2-223
THASTCYKGQICDRCELDNCASILKLTDETFDPPFCIFRITNVILDLIYQSYFIAYILTSTQVLYVLFNIIVF

SEQ ID NO: 25268 - protein, 77 aa, Diabrotica virgifera
  misc_feature: Coding regions on vcDNA: vcDNA=SeqID_4965; Strand=-; Position=2-232
  misc_feature (59)..(69): Xaa can be any naturally occurring amino acid
FLWNILYLWPSFHQKWIGLDLRFPILSKNCGLQFKTIIEAKKMCQKSFVYLKLMFSEPXXXXXXXXXXXLFLSDFPF

SEQ ID NO: 25269 - protein, 52 aa, Diabrotica virgifera
  misc_feature: Coding regions on vcDNA: vcDNA=SeqID_4966; Strand=-; Position=1-156
  misc_feature (3)..(37): Xaa can be any naturally occurring amino acid
  misc_feature (40)..(52): Xaa can be any naturally occurring amino acid
VIXXXXXXXXXXXXXXXXXXXXXXXXXXXXXXXXXXXDYXXXXXXXXXXXXX

SEQ ID NO: 25270 - protein, 125 aa, Diabrotica virgifera
  misc_feature: Coding regions on vcDNA: vcDNA=SeqID_4967; Strand=+; Position=2-379
  misc_feature: Homolog annotation: Hit_ID=NP_610854.1; Match level="QueryCoverage =91%, HitCoverage=17%, E-value=5e-16, Identity=36%"; Hit description =CG4679-PA [Drosophila melanogaster] gb|AAF58398.1| CG4679-PA [Drosophila melanogaster]
ENQNTNKVNKLSLTGNLLGRILLLILRNDDFEKACIIMDKLDKDHQTIAGVPDIEALECFVDSCIERKAPSRAIACIQYCADSGFQEAGIFAAKLNEKLTLDESHLNSLSRIVGDVKLAKVSDQS

SEQ ID NO: 25271 - protein, 82 aa, Diabrotica virgifera
  misc_feature: Coding regions on vcDNA: vcDNA=SeqID_4968; Strand=+; Position=2-250
PSVRKAFYMTSGQIFNRLNPHHFCDDQTYLSPTDNLMLLYLVYEGLLAVTTIIHNGHHGCFTLICVQSHPRMTQICPCVAKC

SEQ ID NO: 25272 - protein, 45 aa, Diabrotica virgifera
  misc_feature: Coding regions on vcDNA: vcDNA=SeqID_4969; Strand=+; Position=2-139
LKFRFEFFSSSNEDFNRMKVQYYCETKIGLQKEFGNILYIGLQGS

SEQ ID NO: 25273 - protein, 69 aa, Diabrotica virgifera
  misc_feature: Coding regions on vcDNA: vcDNA=SeqID_4970; Strand=-; Position=33-242
  misc_feature (20)..(45): Xaa can be any naturally occurring amino acid
  misc_feature (49)..(56): Xaa can be any naturally occurring amino acid
AVEGSQRGEDLLHPNHADCXXXXXXXXXXXXXXXXXXXXXXXXXXIAYXXXXXXXXSLSLFYVLNVVHA

SEQ ID NO: 25274 - protein, 70 aa, Diabrotica virgifera
  misc_feature: Coding regions on vcDNA: vcDNA=SeqID_4971; Strand=-; Position=2-211
  misc_feature (59)..(66): Xaa can be any naturally occurring amino acid
IDFFLAYVMTVVLVIQPFIPAFNKQSNDYVTVARSIFRVHSNESVGRRDLIFGAKRHDXXXXXXXXLPNP

SEQ ID NO: 25275 - protein, 44 aa, Diabrotica virgifera
  misc_feature: Coding regions on vcDNA: vcDNA=SeqID_4972; Strand=-; Position=1-132
  misc_feature (2)..(44): Xaa can be any naturally occurring amino acid
YXXXXXXXXXXXXXXXXXXXXXXXXXXXXXXXXXXXXXXXXXXX

SEQ ID NO: 25276 - protein, 59 aa, Diabrotica virgifera
  misc_feature: Coding regions on vcDNA: vcDNA=SeqID_4973; Strand=+; Position=2-181
VKNYRDSLNGSVQVDLILYLRLLHIICRCPIRFFNIKVFVLVSSNVRNFLSLYYSFHIY

SEQ ID NO: 25277 - protein, 132 aa, Diabrotica virgifera
  misc_feature: Coding regions on vcDNA: vcDNA=SeqID_4974; Strand=+; Position=3-398
  misc_feature (107)..(116): Xaa can be any naturally occurring amino acid
LSSAFYPNKNREQAFEFGRKLNSSFASSKSSDLLKLLQEAPLSDIVTQQALSPTACIPTMEEEFNDKAFVSGPMHRAILNGEFNFVPVLIGINSEEYLLFVDADSDXXXXXXXXXXDNPEQMVSASFNVAEE

SEQ ID NO: 25278 - protein, 39 aa, Diabrotica virgifera
  misc_feature: Coding regions on vcDNA: vcDNA=SeqID_4975; Strand=-; Position=1-117
IRSRQFVCHLTLHASWSHKITSDCAAVAPSFYLDAWLGP

SEQ ID NO: 25279 - protein, 135 aa, Diabrotica virgifera
  misc_feature: Coding regions on vcDNA: vcDNA=SeqID_4976; Strand=+; Position=2-406
  misc_feature: Homolog annotation: Hit_ID=NP_702139.1; Match level="QueryCoverage =97%, HitCoverage=10%, E-value=5e-10, Identity=27%"; Hit description =hypothetical protein PF14_0250 [Plasmodium falciparum 3D7] gb|AAN36863.1| hypothetical protein
SEKEHDADKEENLTKQNNKNAGENENGESKKNSVDVVESLSNNYDNIKSIDTEDNDNDFSGFDLNTEKEKKNSGSNNSDQIITNDINITNDNKNVEEKDNGECHISEEECINHNNVNDNNYSFSTDQNIERDSEN

SEQ ID NO: 25280 - protein, 94 aa, Diabrotica virgifera
  misc_feature: Coding regions on vcDNA: vcDNA=SeqID_4977; Strand=+; Position=144-425
  misc_feature (33)..(59): Xaa can be any naturally occurring amino acid
  misc_feature (66)..(93): Xaa can be any naturally occurring amino acid
NKAGMFVKTKQTCLFCCYFVLNRVDLSNYCILXXXXXXXXXXXXXXXXXXXXXXXXXXXDVNLREXXXXXXXXXXXXXXXXXXXXXXXXXXXXT

SEQ ID NO: 25281 - protein, 52 aa, Diabrotica virgifera
  misc_feature: Coding regions on vcDNA: vcDNA=SeqID_4978; Strand=-; Position=157-315
IRLYRCSVLVVKARGAQFKRRYVLSNLCQNYGSLSPCIPFLVNWGDQVDFVG

SEQ ID NO: 25282 - protein, 128 aa, Diabrotica virgifera
  misc_feature: Coding regions on vcDNA: vcDNA=SeqID_4979; Strand=+; Position=37-421
  misc_feature: Homolog annotation: Hit_ID=A45117; Match level="QueryCoverage=89%, HitCoverage=29%, E-value=3e-15, Identity=41%"; Hit description =aspartic proteinase (EC 3.4.23.-), lysosomal - yellow fever mosquito gb|AAA29350.1|
  misc_feature: Gene Ontology Annotation: Cellular component=extracellular space
  misc_feature (30)..(30): Xaa can be any naturally occurring amino acid
  misc_feature (33)..(33): Xaa can be any naturally occurring amino acid
  misc_feature (88)..(88): Xaa can be any naturally occurring amino acid
LTQTANGNQGELLIGGSDPSNYRGDFTNTXYRXQGWQTKLQSVTVCKHSLSKNGCRSVIDTGTSHIYGPYDEVEANKTQLVPSKTTIXGIHTNDCDADLTKLPKVTFTDGRKNFDISPSAYVIRDSSN

SEQ ID NO: 25283 - protein, 123 aa, Diabrotica virgifera
  misc_feature: Coding regions on vcDNA: vcDNA=SeqID_4980; Strand=+; Position=1-372
  misc_feature: Homolog annotation: Hit_ID=XP_314442.1; Match level="QueryCoverage =99%, HitCoverage=60%, E-value=5e-29, Identity=48%"; Hit description =ENSANGP00000016060 [Anopheles gambiae]
  misc_feature (25)..(30): Xaa can be any naturally occurring amino acid
PAQGVVSYTALSINVMNPSLVFRIXXXXXXTNILLGQTLLGSGLYLYNRPHLKALPTKEKILYSSFGAVTFSLGSVLVWAIFRSVVPQNVALGTVCGIGSGIALIKIARSYVEHVDSLVAEKA

SEQ ID NO: 25284 - protein, 36 aa, Diabrotica virgifera
  misc_feature: Coding regions on vcDNA: vcDNA=SeqID_4981; Strand=-; Position=77-187
KTLVEKIFRDSVIKLVWVNSLDKLVLEYTSSLVNVG

SEQ ID NO: 25285 - protein, 113 aa, Diabrotica virgifera
  misc_feature: Coding regions on vcDNA: vcDNA=SeqID_4982; Strand=+; Position=1-339
  misc_feature: Homolog annotation: Hit_ID=CAH04315.1; Match level="QueryCoverage =100%, HitCoverage=42%, E-value=2e-21, Identity=53%"; Hit description= S3Ae ribosomal protein [Biphyllus lunatus]
  misc_feature: Gene Ontology Annotation: Molecular function=structural constituent of ribosome; Cellular component=cytosolic small ribosomal subunit (sensu Eukarya); Biological process=protein biosynthesis
  misc_feature: Pfam annotation: Pfam_ID=Ribosomal_S3Ae; Match level="Score=-71.9, E -value=0.064, Copies=1"; Pfam description=Ribosomal S3Ae family
  misc_feature (44)..(44): Xaa can be any naturally occurring amino acid
  misc_feature (48)..(48): Xaa can be any naturally occurring amino acid
  misc_feature (83)..(83): Xaa can be any naturally occurring amino acid
RSLGEVVHGIVVVTNFHSMGLSTNIVRSMVNIWQPLINSSSHVXTDYXLLLWVFSICHFNRAQLSQLITCYAQHTQFISIHMXIVYIITRNFQGSNFIYVVTKLLPDNISKAI

SEQ ID NO: 25286 - protein, 94 aa, Diabrotica virgifera
  misc_feature: Coding regions on vcDNA: vcDNA=SeqID_4983; Strand=+; Position=93-375
  misc_feature: Homolog annotation: Hit_ID=CAH04315.1; Match level="QueryCoverage =92%, HitCoverage=31%, E-value=5e-11, Identity=41%"; Hit description =S3Ae ribosomal protein [Biphyllus lunatus]
  misc_feature (44)..(44): Xaa can be any naturally occurring amino acid
QLEDLRFSFGLKSTTGLCIYISAFSILNHQHQTILSQGKTCYAXHTQFKALPLKIIYIITINLHRSNIKDLVTNLLRDTISNDIDKACQSIYPL

SEQ ID NO: 25287 - protein, 78 aa, Diabrotica virgifera
  misc_feature: Coding regions on vcDNA: vcDNA=SeqID_4984; Strand=+; Position=70-306
  misc_feature (36)..(43): Xaa can be any naturally occurring amino acid
GVFTQTFWCLGHVQYWNCTLMMELVFRKCSVTLFGXXXXXXXXKEHTIVCDLWYTASYRNLFSSWIFLNKHFVSYNSY

SEQ ID NO: 25288 - protein, 59 aa, Diabrotica virgifera
  misc_feature: Coding regions on vcDNA: vcDNA=SeqID_4985; Strand=+; Position=2-181
HNDIPLWTFIKLGIRFFSTNFSYIINLLNLGRKNIIYFLKLYTHRSLCYNFFDYNNNLA

SEQ ID NO: 25289 - protein, 46 aa, Diabrotica virgifera
  misc_feature: Coding regions on vcDNA: vcDNA=SeqID_4986; Strand=-; Position=40-180
LLIKKYSVLHKVQYINSPLHQNKLFSHKTMHLSVTKTFDYLSEKLA

SEQ ID NO: 25290 - protein, 66 aa, Diabrotica virgifera
  misc_feature: Coding regions on vcDNA: vcDNA=SeqID_4987; Strand=-; Position=145-345
TLNTDYIRYYLFRRAVLTWPSAACPISNIHYSYPILNSIFLSPRISHEPSCYGIIHVRVSNLVHEL

SEQ ID NO: 25291 - protein, 81 aa, Diabrotica virgifera
  misc_feature: Coding regions on vcDNA: vcDNA=SeqID_4988; Strand=-; Position=1-243
  misc_feature (5)..(11): Xaa can be any naturally occurring amino acid
  misc_feature (17)..(30): Xaa can be any naturally occurring amino acid
FLILXXXXXXXFSFLFXXXXXXXXXXXXXXYIYILTLCCHTCNKTVIFVIYYLSSWLFFPELFPTFFFGSFIIFFTIFRCS

SEQ ID NO: 25292 - protein, 229 aa, Diabrotica virgifera
  misc_feature: Coding regions on vcDNA: vcDNA=SeqID_4989; Strand=+; Position=127-816
  misc_feature (100)..(107): Xaa can be any naturally occurring amino acid
MPIQFSNTMENNPINISTLISKIISNVKKKHENGTKEFPELMNPDPLISEVAGVAIIQLIKDGILPVDSVLTDFISTMKSIQCHSTLINTLGELLYLQIXXXXXXXXLHSPQHPFIILENENPHLSSHILNKICQLQELDGSIVNKIFEPFYLYCLCCPSKHEHDLLRYRLWTLLLNSNCVDSNFFVNILGWLQVQRIEDLPLISDQLIEALNNPNISKFIEIELIIGW

SEQ ID NO: 25293 - protein, 37 aa, Diabrotica virgifera
  misc_feature: Coding regions on vcDNA: vcDNA=SeqID_4990; Strand=+; Position=1-114
GLPRPTQKLRRSHCRFEFRLRFLNTSRPRINSHCNLV

SEQ ID NO: 25294 - protein, 106 aa, Diabrotica virgifera
  misc_feature: Coding regions on vcDNA: vcDNA=SeqID_4991; Strand=+; Position=49-369
LYIVRKSQNLVSVIKDHTFCSYSTLLKYCLQQEIEEYCGQRISLLLTFLLIFLLTLNFPVRLPSILTLLSVFTKVIFTGLIIFYGITSTLKAWYKHLLVTPSCKLV

SEQ ID NO: 25295 - protein, 48 aa, Diabrotica virgifera
  misc_feature: Coding regions on vcDNA: vcDNA=SeqID_4992; Strand=-; Position=1-144
GYLWPCFLPGAWVTGLDDLPASTWYIPVATKASTNTIKYVILMLLLLL

SEQ ID NO: 25296 - protein, 116 aa, Diabrotica virgifera
  misc_feature: Coding regions on vcDNA: vcDNA=SeqID_4993; Strand=+; Position=54-404
MDMDNSTEQEISKILEDMGRKFESIQPETKDSLGFFGKIMESVKGYLSKDKKDMFGAADYGGFQKKGFIEPDIDDFTHAEDPPKKRMRLDPDLGPLNENIVTTTTLNTRALNTKEK

SEQ ID NO: 25297 - protein, 62 aa, Diabrotica virgifera
  misc_feature: Coding regions on vcDNA: vcDNA=SeqID_4994; Strand=-; Position=204-392
WFKIFHENCLICHENLINWEYVMRIYHSVNSNKISRIQKYNRYLLITDNCWYLVYNLVSINS

SEQ ID NO: 25298 - protein, 52 aa, Diabrotica virgifera
  misc_feature: Coding regions on vcDNA: vcDNA=SeqID_4995; Strand=+; Position=64-222
  misc_feature (13)..(19): Xaa can be any naturally occurring amino acid
SFLYSFLVHILHXXXXXXXSSWSCSAELAIITVSSAYLMLLIDLPLIIIPSL

SEQ ID NO: 25299 - protein, 41 aa, Diabrotica virgifera
  misc_feature: Coding regions on vcDNA: vcDNA=SeqID_4996; Strand=-; Position=87-212
FVCFRLLYLNVSVVPYTFISAFSNSRVSFFEVYSIVSIFFL

SEQ ID NO: 25300 - protein, 63 aa, Diabrotica virgifera
  misc_feature: Coding regions on vcDNA: vcDNA=SeqID_4997; Strand=-; Position=1-189
  misc_feature (47)..(54): Xaa can be any naturally occurring amino acid
NKSVKLRGYPSVKVRKSYTFLGISKIKSNIPIVFVNCHLLEKELCTXXXXXXXXIENSNDLCA

SEQ ID NO: 25301 - protein, 105 aa, Diabrotica virgifera
  misc_feature: Coding regions on vcDNA: vcDNA=SeqID_4998; Strand=-; Position=3-317
KKVSTSNIYHPHPPGNLSSPHDTINLGFIISFGFNISCHPLILNNTHIPVSTEVKYLALHIDQRLTWNEHIQMKRRQLDLKFRQMLVQEAALKNSPNPPKPDLSQ

SEQ ID NO: 25302 - protein, 92 aa, Diabrotica virgifera
  misc_feature: Coding regions on vcDNA: vcDNA=SeqID_4999; Strand=+; Position=108-386
VDMKIMDSDVQNCVLLNTFHTRKKKLRIIFHQGNLVWDNEKPPSDKTTVPIENVISVQQNYRKTHPSETRELNPNAFTNHYAEREKRPRMGL

SEQ ID NO: 25303 - protein, 112 aa, Diabrotica virgifera
  misc_feature: Coding regions on vcDNA: vcDNA=SeqID_5000; Strand=+; Position=55-390
  misc_feature (63)..(82): Xaa can be any naturally occurring amino acid
KLEKCLSWQYLYTKWDDIQKLSVIQSLTSLMQKDRKGTLTRIIPKIQQELPINTSSEFHLATXXXXXXXXXXXXXXXXXXXXFQSIDSKDLVVATAWSENLIQVNKCVSQND

SEQ ID NO: 25304 - protein, 136 aa, Diabrotica virgifera
  misc_feature: Coding regions on vcDNA: vcDNA=SeqID_5001; Strand=+; Position=1-408
  misc_feature (116)..(130): Xaa can be any naturally occurring amino acid
GYEKEDYVPKCDNCKTRLPSSQSDGTENQVKDDAIRKKVSRISLNEDNSPQTWCTKWHNFCRNCGTQLQHTPSKEEVQFEKVVVGAHGDINSNESGLFMYIDLHGHASKKGIFMYXXXXXXXXXXXXXXXLPKLMS

SEQ ID NO: 25305 - protein, 42 aa, Diabrotica virgifera
  misc_feature: Coding regions on vcDNA: vcDNA=SeqID_5002; Strand=+; Position=73-201
SLLISHGSLHLAVRSYNSVDNGHKLYILRTTLNLIIPEHCPA

SEQ ID NO: 25306 - protein, 69 aa, Diabrotica virgifera
  misc_feature: Coding regions on vcDNA: vcDNA=SeqID_5003; Strand=+; Position=185-391
GTLVGDSYCGVFYGIYRTLIRKMYSLTFRRIVCIKLFELGFLVVAGVSLRDVLNRNSFFKVYVLNRSLG

SEQ ID NO: 25307 - protein, 52 aa, Diabrotica virgifera
  misc_feature: Coding regions on vcDNA: vcDNA=SeqID_5004; Strand=-; Position=1-156
QISNIFFFGNPGRKTLDTGAYFNLKSSLQESCDRLNPKKFYPKTNRSWDVFV

SEQ ID NO: 25308 - protein, 101 aa, Diabrotica virgifera
  misc_feature: Coding regions on vcDNA: vcDNA=SeqID_5005; Strand=+; Position=52-357
PTHLIPLDPEDLLNKVDNFIKFTQPDLSATETLAVKAFFYLLIGILGSSSVQLTSLLVTASTELNAGAGLGSSASFTVCLSAALLQLIKSKIPEESFSIEG

SEQ ID NO: 25309 - protein, 93 aa, Diabrotica virgifera
  misc_feature: Coding regions on vcDNA: vcDNA=SeqID_5006; Strand=-; Position=3-281
  misc_feature (3)..(21): Xaa can be any naturally occurring amino acid
  misc_feature (23)..(29): Xaa can be any naturally occurring amino acid
  misc_feature (35)..(69): Xaa can be any naturally occurring amino acid
  misc_feature (74)..(86): Xaa can be any naturally occurring amino acid
  misc_feature (90)..(93): Xaa can be any naturally occurring amino acid
LIXXXXXXXXXXXXXXXXXXXKXXXXXXXGLPFLXXXXXXXXXXXXXXXXXXXXXXXXXXXXXXXXXXXVPQVXXXXXXXXXXXXXLTIXXXX

SEQ ID NO: 25310 - protein, 105 aa, Diabrotica virgifera
  misc_feature: Coding regions on vcDNA: vcDNA=SeqID_5007; Strand=+; Position=40-354
  misc_feature: Homolog annotation: Hit_ID=AAR09709.1; Match level="QueryCoverage =100%, HitCoverage=58%, E-value=3e-28, Identity=56%"; Hit description= similar to Drosophila melanogaster ATPsyn-d [Drosophila yakuba]
  misc_feature: Pfam annotation: Pfam_ID=Mt_ATP-synt_D; Match level="Score=40.5, E -value=4.8e-09, Copies=1"; Pfam description=ATP synthase D chain, mitochondrial (
  misc_feature (92)..(99): Xaa can be any naturally occurring amino acid
MAARRITKSAVNWAALSEKVPEHQRAQFLAFKTKSDSYLRRVLANPEQAPAIDWAYYKSKVPVAGMVDDFQKQYGALSIAFPADTVKPQLDXXXXXXXXDIEKFK

SEQ ID NO: 25311 - protein, 136 aa, Diabrotica virgifera
  misc_feature: Coding regions on vcDNA: vcDNA=SeqID_5008; Strand=+; Position=1-408
  misc_feature: Homolog annotation: Hit_ID=S43231; Match level="QueryCoverage=100%, HitCoverage=24%, E-value=3e-47, Identity=66%"; Hit description =malate dehydrogenase (oxaloacetate-decarboxylating) (NADP)  (EC 1.1.1.40), cytosolic -
  misc_feature: Gene Ontology Annotation: Molecular function=electron transporter activity; Cellular component=cytosol; Biological process=malate metabolism
  misc_feature: Pfam annotation: Pfam_ID=malic; Match level="Score=26.7, E-value=2e -10, Copies=1"; Pfam description=Malic enzyme, N-terminal domain
  misc_feature (84)..(94): Xaa can be any naturally occurring amino acid
  misc_feature (133)..(133): Xaa can be any naturally occurring amino acid
ITIDVGTNNETHLKDPLYIGLRQKRVTGQEYDELLDEFMEAVVRRWGQNTLIQFEDFGNSNAFRLLEKYRNEYCTFNDDIQGTXXXXXXXXXXXLRITKTRRSDHVIVFQGAGEANLGIAQLCTMAMVKEGTXESD

SEQ ID NO: 25312 - protein, 84 aa, Diabrotica virgifera
  misc_feature: Coding regions on vcDNA: vcDNA=SeqID_5009; Strand=+; Position=155-406
NYGKDYDNLLQKQQENSQECIDLSDIDSLDGVTPINESKSPRVSKDMNCVDLDRQVILPTTKPFNELLEDKLADDQPYLPPAKR

SEQ ID NO: 25313 - protein, 98 aa, Diabrotica virgifera
  misc_feature: Coding regions on vcDNA: vcDNA=SeqID_5010; Strand=+; Position=107-400
  misc_feature: Homolog annotation: Hit_ID=AAH86701.1; Match level="QueryCoverage =78%, HitCoverage=18%, E-value=2e-21, Identity=63%"; Hit description =Zgc:101545 [Danio rerio] ref|NP_001008638.1| zgc:101545 [Danio rerio] sp|P02993|EF1A_ARTSA Elongation fact
  misc_feature: Gene Ontology Annotation: Molecular function=translation factor activity, nucleic acid binding
  misc_feature (42)..(42): Xaa can be any naturally occurring amino acid
  misc_feature (55)..(55): Xaa can be any naturally occurring amino acid
  misc_feature (70)..(70): Xaa can be any naturally occurring amino acid
CSFYSTFNFEHLHLRYFETRNLGSVQIHINILVITGHLIYKXCGGSDTRTIVAVXKEAQDMGTGSFRYAXVLDNLKADRERGIIIDTALWRFATAKYY

SEQ ID NO: 25314 - protein, 59 aa, Diabrotica virgifera
  misc_feature: Coding regions on vcDNA: vcDNA=SeqID_5011; Strand=-; Position=145-324
  misc_feature (27)..(33): Xaa can be any naturally occurring amino acid
LNYMLITKVNLSPKKLDIFKTEEHFLXXXXXXXISIYTKNLNHDSCFKFANTKYIILNL

SEQ ID NO: 25315 - protein, 54 aa, Diabrotica virgifera
  misc_feature: Coding regions on vcDNA: vcDNA=SeqID_5012; Strand=-; Position=70-234
HRKKHKIMIQTRRNIVPQNIIHEDYIGKFTYLEVEIYADGSEDGEIRNRSGFRV

SEQ ID NO: 25316 - protein, 59 aa, Diabrotica virgifera
  misc_feature: Coding regions on vcDNA: vcDNA=SeqID_5013; Strand=+; Position=7-183
QFELGSSQCTSKTPYSCTSHRINRHKNTILSILTHVTYCSYHRLATDVTIGEKPVFNRK

SEQ ID NO: 25317 - protein, 121 aa, Diabrotica virgifera
  misc_feature: Coding regions on vcDNA: vcDNA=SeqID_5014; Strand=+; Position=2-364
YKLNDHSMEFMEDFLAEWKHGHGFLWYNFLTFRNRSNLIGMDMKISSTASFADENNHLDDLKDTHSDASLKVTSALLKVITEMVNITPVMLYDTGSNKCRGMIDDLENGRAELPGNSLFIS

SEQ ID NO: 25318 - protein, 28 aa, Diabrotica virgifera
  misc_feature: Coding regions on vcDNA: vcDNA=SeqID_5015; Strand=+; Position=2-85
  misc_feature (12)..(18): Xaa can be any naturally occurring amino acid
RSRQKRRLQQLXXXXXXXSSRIIEQEIQ

SEQ ID NO: 25319 - protein, 61 aa, Diabrotica virgifera
  misc_feature: Coding regions on vcDNA: vcDNA=SeqID_5016; Strand=+; Position=18-200
MAGNENKVRMMMREEGEAPAAAPAPAGSRSASESSSNKAIRSGSNVFSMFSQSQVAEFREA

SEQ ID NO: 25320 - protein, 59 aa, Diabrotica virgifera
  misc_feature: Coding regions on vcDNA: vcDNA=SeqID_5017; Strand=+; Position=123-299
  misc_feature (44)..(56): Xaa can be any naturally occurring amino acid
AHPYRYLTLGLLHIFKDDLKCNDLFKFNLYITITIKYFHISIYXXXXXXXXXXXXXRNF

SEQ ID NO: 25321 - protein, 73 aa, Diabrotica virgifera
  misc_feature: Coding regions on vcDNA: vcDNA=SeqID_5018; Strand=-; Position=0-218
  misc_feature (1)..(8): Xaa can be any naturally occurring amino acid
  misc_feature (12)..(45): Xaa can be any naturally occurring amino acid
  misc_feature (51)..(68): Xaa can be any naturally occurring amino acid
XXXXXXXXGSSXXXXXXXXXXXXXXXXXXXXXXXXXXXXXXXXXXGLPFLXXXXXXXXXXXXXXXXXXLFKFG

SEQ ID NO: 25322 - protein, 51 aa, Diabrotica virgifera
  misc_feature: Coding regions on vcDNA: vcDNA=SeqID_5019; Strand=-; Position=51-206
  misc_feature (9)..(15): Xaa can be any naturally occurring amino acid
FWFVLGFSXXXXXXXGFLFTFILRKFYYVTYSGSIENSPGLILVPLKIPRG

SEQ ID NO: 25323 - protein, 25 aa, Diabrotica virgifera
  misc_feature: Coding regions on vcDNA: vcDNA=SeqID_5020; Strand=-; Position=1-75
  misc_feature (2)..(12): Xaa can be any naturally occurring amino acid
SXXXXXXXXXXXLLTKIILLLISRF

SEQ ID NO: 25324 - protein, 76 aa, Diabrotica virgifera
  misc_feature: Coding regions on vcDNA: vcDNA=SeqID_5021; Strand=-; Position=1-228
  misc_feature (6)..(13): Xaa can be any naturally occurring amino acid
  misc_feature (20)..(28): Xaa can be any naturally occurring amino acid
  misc_feature (54)..(59): Xaa can be any naturally occurring amino acid
  misc_feature (65)..(73): Xaa can be any naturally occurring amino acid
FIPINXXXXXXXXSYKFVYXXXXXXXXXSMIHMLQKMNNTSLQINYSLSILINXXXXXXALTNTXXXXXXXXXINL

SEQ ID NO: 25325 - protein, 48 aa, Diabrotica virgifera
  misc_feature: Coding regions on vcDNA: vcDNA=SeqID_5022; Strand=-; Position=197-343
ICLSTFEEITTPVRIQKLNVSVYLTLEAISKLSTLSRQDHNKNDVSKY

SEQ ID NO: 25326 - protein, 113 aa, Diabrotica virgifera
  misc_feature: Coding regions on vcDNA: vcDNA=SeqID_5023; Strand=+; Position=17-358
  misc_feature (9)..(37): Xaa can be any naturally occurring amino acid
  misc_feature (49)..(57): Xaa can be any naturally occurring amino acid
  misc_feature (60)..(78): Xaa can be any naturally occurring amino acid
  misc_feature (80)..(89): Xaa can be any naturally occurring amino acid
  misc_feature (96)..(107): Xaa can be any naturally occurring amino acid
YNIFYVKVXXXXXXXXXXXXXXXXXXXXXXXXXXXXXCCITDYYLLTIXXXXXXXXXLQXXXXXXXXXXXXXXXXXXXHXXXXXXXXXXHKLTLLXXXXXXXXXXXXININYF

SEQ ID NO: 25327 - protein, 64 aa, Diabrotica virgifera
  misc_feature: Coding regions on vcDNA: vcDNA=SeqID_5024; Strand=+; Position=2-196
  misc_feature: Homolog annotation: Hit_ID=NP_001008751.1; Match level="QueryCoverage= 79%, HitCoverage=11%, E-value=4e-12, Identity=64%"; Hit description =keratin complex 1, acidic, gene 14 [Rattus norvegicus] tpg|DAA04481.1| TPA: type I keratin KA14
  misc_feature: Gene Ontology Annotation: Molecular function=molecular_function unknown
NRAPTGDGRSAFIRSKPIGGGHGGGIGGGIGGGGIGGGIGGGIGGGSGGGISSSYGPPGKSGPY

SEQ ID NO: 25328 - protein, 73 aa, Diabrotica virgifera
  misc_feature: Coding regions on vcDNA: vcDNA=SeqID_5025; Strand=-; Position=1-219
IMRHHPQLSQQLRPLHRGHLQHLLLNHRYQLRHIRECHPVRQWRIHNPHINPNSLKMHHILLMIAIMGSSTLS

SEQ ID NO: 25329 - protein, 51 aa, Diabrotica virgifera
  misc_feature: Coding regions on vcDNA: vcDNA=SeqID_5026; Strand=+; Position=174-329
TLQISLVNLSHALTTSNLAQDITALSTVTTVARCSIASIDRIASCVLARIE

SEQ ID NO: 25330 - protein, 87 aa, Diabrotica virgifera
  misc_feature: Coding regions on vcDNA: vcDNA=SeqID_5027; Strand=+; Position=95-355
  misc_feature: Homolog annotation: Hit_ID=A24701; Match level="QueryCoverage=96%, HitCoverage=18%, E-value=3e-14, Identity=45%"; Hit description =tubulin beta-3 chain - chicken gb|AAA49118.1| c-beta-3 beta-tubulin sp|P09206|TBB3_CHICK TUBULIN
  misc_feature: Gene Ontology Annotation: Molecular function=structural constituent of cytoskeleton; Cellular component=tubulin; Biological process =microtubule-based process
DIVQDLVDICAGQCGTKFGDIIWEVNSDEHSIDYNGDYDGDSDLHIVYYNVDYSEASVGHYILLDIVVDMIPSIMSALLSDLFRQVI

SEQ ID NO: 25331 - protein, 42 aa, Diabrotica virgifera
  misc_feature: Coding regions on vcDNA: vcDNA=SeqID_5028; Strand=-; Position=234-362
ELIPKNVSECSLTSTLVSTSCYSRNMSYFIKNSICLNTCNMS

SEQ ID NO: 25332 - protein, 83 aa, Diabrotica virgifera
  misc_feature: Coding regions on vcDNA: vcDNA=SeqID_5029; Strand=-; Position=0-248
VLMGQILLLAQSTVLKLKLMLHLSVRNLELSESRLRMLQSLVTSTGLMVSNITAFSTGGISIHTTTNNWWNVPTGSTATPRVL

SEQ ID NO: 25333 - protein, 58 aa, Diabrotica virgifera
  misc_feature: Coding regions on vcDNA: vcDNA=SeqID_5030; Strand=+; Position=98-271
AGSYDRGCQRRERVTDEYQHFSRMDAVLVHSHPGWEYVLSSDMCIYQYARWKTSYYHR

SEQ ID NO: 25334 - protein, 60 aa, Diabrotica virgifera
  misc_feature: Coding regions on vcDNA: vcDNA=SeqID_5031; Strand=-; Position=28-210
  misc_feature (16)..(22): Xaa can be any naturally occurring amino acid
SSAQPVSTNCRPTNYXXXXXXXQKVNRSSLKVKYSLTIVTDYHLIKFFATFTKKYLPRIN

SEQ ID NO: 25335 - protein, 28 aa, Diabrotica virgifera
  misc_feature: Coding regions on vcDNA: vcDNA=SeqID_5032; Strand=-; Position=0-83
RETVLKNLAEKTQAKVITGDHWTLASTR

SEQ ID NO: 25336 - protein, 74 aa, Diabrotica virgifera
  misc_feature: Coding regions on vcDNA: vcDNA=SeqID_5033; Strand=-; Position=1-222
  misc_feature (1)..(72): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXDE

SEQ ID NO: 25337 - protein, 62 aa, Diabrotica virgifera
  misc_feature: Coding regions on vcDNA: vcDNA=SeqID_5034; Strand=-; Position=159-347
NLENIIFLTPLRIYYGALRDEVLPKKDKRPLIPKLPIRWILKKRCDRSKGKNIRYYSNTECF

SEQ ID NO: 25338 - protein, 60 aa, Diabrotica virgifera
  misc_feature: Coding regions on vcDNA: vcDNA=SeqID_5035; Strand=+; Position=2-181
  misc_feature (4)..(10): Xaa can be any naturally occurring amino acid
  misc_feature (12)..(19): Xaa can be any naturally occurring amino acid
  misc_feature (30)..(39): Xaa can be any naturally occurring amino acid
PKRXXXXXXXRXXXXXXXXYGDIISIVRLXXXXXXXXXXLGFVSIFDTCLVITCLLVSNL

SEQ ID NO: 25339 - protein, 46 aa, Diabrotica virgifera
  misc_feature: Coding regions on vcDNA: vcDNA=SeqID_5036; Strand=+; Position=2-142
  misc_feature: Homolog annotation: Hit_ID=1DEJ; Match level="QueryCoverage=97%, HitCoverage=12%, E-value=5e-16, Identity=82%"; Hit description=Chain A, Crystal Structure Of A DictyosteliumTETRAHYMENA CHIMERA Actin (Mutant 646:
  misc_feature: Gene Ontology Annotation: Molecular function=structural constituent of cytoskeleton; Cellular component=cytoskeleton; Biological process= actin cytoskeleton organization and biogenesis
  misc_feature (33)..(33): Xaa can be any naturally occurring amino acid
IAPPERNYSVWIGGSILATLSTFEQMWITKHEXDDSGPGIVHRMCL

SEQ ID NO: 25340 - protein, 54 aa, Diabrotica virgifera
  misc_feature: Coding regions on vcDNA: vcDNA=SeqID_5037; Strand=+; Position=1-162
YLYSHGKAPFESTILHADEINMLVATFITFKATNLALDSQIASIYSCLNNEYGG

SEQ ID NO: 25341 - protein, 27 aa, Diabrotica virgifera
  misc_feature: Coding regions on vcDNA: vcDNA=SeqID_5038; Strand=-; Position=0-80
IESNHYRNCAISLDSGRCQTVDAWSTR

SEQ ID NO: 25342 - protein, 43 aa, Diabrotica virgifera
  misc_feature: Coding regions on vcDNA: vcDNA=SeqID_5039; Strand=-; Position=19-150
SSFVEVLDVFLRNNKFQNYKELYPTWSKMTHIIKDNRCVTYRG

SEQ ID NO: 25343 - protein, 97 aa, Diabrotica virgifera
  misc_feature: Coding regions on vcDNA: vcDNA=SeqID_5040; Strand=+; Position=86-376
  misc_feature (86)..(86): Xaa can be any naturally occurring amino acid
RNKKRRSKIPDAIQKITMLNWNWAGHTGRLENNRWMKRILEWRTRASKKSRGRPQTRWTDDIKLMAGHEWQHFISVPNSDSMSSIXHQHLHRVKRTD

SEQ ID NO: 25344 - protein, 33 aa, Diabrotica virgifera
  misc_feature: Coding regions on vcDNA: vcDNA=SeqID_5041; Strand=-; Position=2-100
PVASQQFYKAMLNSWLLTIADRLWRTRWTTLVW

SEQ ID NO: 25345 - protein, 18 aa, Diabrotica virgifera
  misc_feature: Coding regions on vcDNA: vcDNA=SeqID_5042; Strand=+; Position=1-54
SFENMANLFNVIVAQASG

SEQ ID NO: 25346 - protein, 51 aa, Diabrotica virgifera
  misc_feature: Coding regions on vcDNA: vcDNA=SeqID_5043; Strand=-; Position=1-153
  misc_feature (13)..(32): Xaa can be any naturally occurring amino acid
  misc_feature (35)..(45): Xaa can be any naturally occurring amino acid
NLVIFKTDYHFIXXXXXXXXXXXXXXXXXXXXKLXXXXXXXXXXXSLIPRV

SEQ ID NO: 25347 - protein, 81 aa, Diabrotica virgifera
  misc_feature: Coding regions on vcDNA: vcDNA=SeqID_5044; Strand=-; Position=1-246
  misc_feature (3)..(38): Xaa can be any naturally occurring amino acid
  misc_feature (40)..(60): Xaa can be any naturally occurring amino acid
  misc_feature (63)..(78): Xaa can be any naturally occurring amino acid
YYXXXXXXXXXXXXXXXXXXXXXXXXXXXXXXXXXXXXLXXXXXXXXXXXXXXXXXXXXXLIXXXXXXXXXXXXXXXXYCY

SEQ ID NO: 25348 - protein, 103 aa, Diabrotica virgifera
  misc_feature: Coding regions on vcDNA: vcDNA=SeqID_5045; Strand=-; Position=0-308
  misc_feature (1)..(100): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFGR

SEQ ID NO: 25349 - protein, 98 aa, Diabrotica virgifera
  misc_feature: Coding regions on vcDNA: vcDNA=SeqID_5046; Strand=+; Position=8-301
  misc_feature (2)..(27): Xaa can be any naturally occurring amino acid
  misc_feature (29)..(59): Xaa can be any naturally occurring amino acid
  misc_feature (67)..(81): Xaa can be any naturally occurring amino acid
  misc_feature (93)..(98): Xaa can be any naturally occurring amino acid
FXXXXXXXXXXXXXXXXXXXXXXXXXXYXXXXXXXXXXXXXXXXXXXXXXXXXXXXXXXDNFKDELXXXXXXXXXXXXXXXDRNFHILTYVIXXXXXX

SEQ ID NO: 25350 - protein, 55 aa, Diabrotica virgifera
  misc_feature: Coding regions on vcDNA: vcDNA=SeqID_5047; Strand=+; Position=3-167
  misc_feature: Homolog annotation: Hit_ID=XP_395344.1; Match level="QueryCoverage =96%, HitCoverage=5%, E-value=2e-11, Identity=58%"; Hit description =similar to ENSANGP00000015157 [Apis mellifera]
KNSKNSLAHIVDDWIQSYKLNLKAGLISLMEFFIKASGCKGRITQQMQGSMGHAG

SEQ ID NO: 25351 - protein, 29 aa, Diabrotica virgifera
  misc_feature: Coding regions on vcDNA: vcDNA=SeqID_5048; Strand=-; Position=1-87
  misc_feature (5)..(11): Xaa can be any naturally occurring amino acid
HFSLXXXXXXXFKLVFNPKCLTIPPNLVY

SEQ ID NO: 25352 - protein, 64 aa, Diabrotica virgifera
  misc_feature: Coding regions on vcDNA: vcDNA=SeqID_5049; Strand=+; Position=164-358
  misc_feature (27)..(38): Xaa can be any naturally occurring amino acid
SQNLIKVTSTHKHVLPIQLEMGHDVIXXXXXXXXXXXXLVKAVVYIFTLNILFYCSVICNYKLF

SEQ ID NO: 25353 - protein, 65 aa, Diabrotica virgifera
  misc_feature: Coding regions on vcDNA: vcDNA=SeqID_5050; Strand=+; Position=98-292
AHLHEKGNFVIALSGNVLRNCVTWPLVILVTPYLGWHWGHYLLNLVTVLFCAVFFLVVTDTPEAH

SEQ ID NO: 25354 - protein, 135 aa, Diabrotica virgifera
  misc_feature: Coding regions on vcDNA: vcDNA=SeqID_5051; Strand=+; Position=7-411
  misc_feature: Homolog annotation: Hit_ID=NP_648724.1; Match level="QueryCoverage =91%, HitCoverage=15%, E-value=4e-20, Identity=42%"; Hit description =CG13472-PA [Drosophila melanogaster] gb|AAF49703.1| CG13472-PA [Drosophila melanogaster]
MATILGNEWHISSKGNEILTGNVSTGDKQQIYNFALNTDLKEICSPIVNSFPIDATSNVVLQIHKIRNISAPKANEDSQAAPRMLKITLTDGENYIQALELTTISTINYKTTPPGTKLLVQGAKLTSGFLLLNPQ

SEQ ID NO: 25355 - protein, 100 aa, Diabrotica virgifera
  misc_feature: Coding regions on vcDNA: vcDNA=SeqID_5052; Strand=+; Position=2-304
  misc_feature (13)..(18): Xaa can be any naturally occurring amino acid
PQSESVDSSRYHXXXXXXGGCTEEDLLKPHSQVTTDFPSKLHALMITIPKRDKSNVTDIDQYIAQLKYNHRSNTDHNLEDVIYAQNSSIIGRTMVLIKVR

SEQ ID NO: 25356 - protein, 80 aa, Diabrotica virgifera
  misc_feature: Coding regions on vcDNA: vcDNA=SeqID_5053; Strand=+; Position=132-374
VVQGQQETVEISETQDDTGPAGLIGPPTIAGDLTGISLTLEWDMKGVHKRLEVQYTDIATGKRYGTFFYRRIAYGTSIST

SEQ ID NO: 25357 - protein, 62 aa, Diabrotica virgifera
  misc_feature: Coding regions on vcDNA: vcDNA=SeqID_5054; Strand=+; Position=91-276
  misc_feature (29)..(59): Xaa can be any naturally occurring amino acid
INLMRSSPLMKSHNNIFPGECTLKNFITXXXXXXXXXXXXXXXXXXXXXXXXXXXXXXXLIL

SEQ ID NO: 25358 - protein, 108 aa, Diabrotica virgifera
  misc_feature: Coding regions on vcDNA: vcDNA=SeqID_5055; Strand=+; Position=1-327
SGIAPSKVYNYGPIPKGCVRVKMWIDKSISFSDPLHILRQLSQQNSCLRTKSWTVLDVKNNPKTGSIFLLQLRQEHLTVLRSFNMAPCIQKKKTLFKVLQPGEELNYF

SEQ ID NO: 25359 - protein, 38 aa, Diabrotica virgifera
  misc_feature: Coding regions on vcDNA: vcDNA=SeqID_5056; Strand=-; Position=76-192
  misc_feature (24)..(36): Xaa can be any naturally occurring amino acid
MVYSKNCNLVDVLNSKVINVYLLXXXXXXXXXXXXXFQ

SEQ ID NO: 25360 - protein, 55 aa, Diabrotica virgifera
  misc_feature: Coding regions on vcDNA: vcDNA=SeqID_5057; Strand=+; Position=3-170
  misc_feature (11)..(18): Xaa can be any naturally occurring amino acid
  misc_feature (25)..(39): Xaa can be any naturally occurring amino acid
GQTHTSTLSSXXXXXXXXSKDKFYXXXXXXXXXXXXXXXKVTDLVFVTCVSGMIT

SEQ ID NO: 25361 - protein, 124 aa, Diabrotica virgifera
  misc_feature: Coding regions on vcDNA: vcDNA=SeqID_5058; Strand=+; Position=1-375
  misc_feature: Pfam annotation: Pfam_ID=I-set; Match level="Score=21.6, E-value=1.3e- 05, Copies=1"; Pfam description=Immunoglobulin I-set domain
  misc_feature (52)..(52): Xaa can be any naturally occurring amino acid
ARVHLNVLSIFLILQSSYGDDYTKEYPNDTEDVQGPPEVTLTTPKRVLVHLXQNLNINCSATGAQPMEIGWKAWKRDMPSSVYTNKGYIKFNNIQSEHAGIYWCMATNPAGTGGAIAEVIIENN

SEQ ID NO: 25362 - protein, 89 aa, Diabrotica virgifera
  misc_feature: Coding regions on vcDNA: vcDNA=SeqID_5059; Strand=+; Position=130-399
  misc_feature (36)..(60): Xaa can be any naturally occurring amino acid
ILMCITDIQLMALRRQLLVRMRFPVQTELQLLHVAXXXXXXXXXXXXXXXXXXXXXXXXXYLITSTHHRQFTLMTLQEIIRCGILSEHR

SEQ ID NO: 25363 - protein, 61 aa, Diabrotica virgifera
  misc_feature: Coding regions on vcDNA: vcDNA=SeqID_5060; Strand=+; Position=7-189
LASSLSYIIILCSASNKVGRSRMTSVHVSVVNYCSRGSISDLSWLQIMFDFNCSRLTCDYI

SEQ ID NO: 25364 - protein, 44 aa, Diabrotica virgifera
  misc_feature: Coding regions on vcDNA: vcDNA=SeqID_5061; Strand=-; Position=71-205
  misc_feature (26)..(42): Xaa can be any naturally occurring amino acid
YFKLLNICIIATYKRPKTINFSVIVXXXXXXXXXXXXXXXXXNF

SEQ ID NO: 25365 - protein, 63 aa, Diabrotica virgifera
  misc_feature: Coding regions on vcDNA: vcDNA=SeqID_5062; Strand=+; Position=88-279
NFSTLFLHFLLSMAAVLQFVIPMSRSFLHASSHFLLGLPLLPLNYILYVHGFKTNVKVHPSET

SEQ ID NO: 25366 - protein, 77 aa, Diabrotica virgifera
  misc_feature: Coding regions on vcDNA: vcDNA=SeqID_5063; Strand=+; Position=22-255
VRHFFYMSSIDSSMKRTVDVAFCRIFTDNFAVSSDTITDSCDDPKAHYGCESPCIATCNDRQIAKCASHCINGWFCN

SEQ ID NO: 25367 - protein, 68 aa, Diabrotica virgifera
  misc_feature: Coding regions on vcDNA: vcDNA=SeqID_5064; Strand=+; Position=37-243
DCAPELFLPLKMAQLMALLAILAVCIAVITAVCATYCDNCSDEACKENVKVMYGVTSEKPAESVWQTV

SEQ ID NO: 25368 - protein, 57 aa, Diabrotica virgifera
  misc_feature: Coding regions on vcDNA: vcDNA=SeqID_5065; Strand=-; Position=1-171
GVYVHGVTYISCHHYDDHSHRICYARGVLMCFADAISSAACSTDRLKGSLRPGLSLC

SEQ ID NO: 25369 - protein, 117 aa, Diabrotica virgifera
  misc_feature: Coding regions on vcDNA: vcDNA=SeqID_5066; Strand=+; Position=3-353
  misc_feature: Homolog annotation: Hit_ID=CAA84406.1; Match level="QueryCoverage =97%, HitCoverage=45%, E-value=5e-56, Identity=87%"; Hit description =cytosolic ascorbate peroxidase [Zea mays] pir||S49914 L-ascorbate peroxidase (EC 1.11.1.11), cytosolic iso
  misc_feature: Gene Ontology Annotation: Molecular function=cytochrome c peroxidase activity; Cellular component=mitochondrial intermembrane space; Biological process=response to oxidative stress
  misc_feature: Pfam annotation: Pfam_ID=peroxidase; Match level="Score=-10.5, E -value=6e-08, Copies=1"; Pfam description=Peroxidase
TRVHQLAGVVAVEVTGGPEIPFHPGREDKPQPPPEGRLPDATNGSDHLRQVFGNQMGLSDQDIVALSGGHTLGRCHTKRSGFEGAWTTNPLVFDNSYFKELLSGDTEGLLQLPSDKA

SEQ ID NO: 25370 - protein, 51 aa, Diabrotica virgifera
  misc_feature: Coding regions on vcDNA: vcDNA=SeqID_5067; Strand=+; Position=1-156
  misc_feature (33)..(39): Xaa can be any naturally occurring amino acid
ILLFCSTKYQNKIICLNCVFVLNNFQNRKRNIXXXXXXXEMTQERGFRTKL

SEQ ID NO: 25371 - protein, 61 aa, Diabrotica virgifera
  misc_feature: Coding regions on vcDNA: vcDNA=SeqID_5068; Strand=+; Position=95-280
  misc_feature (29)..(39): Xaa can be any naturally occurring amino acid
KIVHTAADLQIRHQYNLLQHFFAINRQQXXXXXXXXXXXLNELKLILKKADVTNSFDLQMT

SEQ ID NO: 25372 - protein, 98 aa, Diabrotica virgifera
  misc_feature: Coding regions on vcDNA: vcDNA=SeqID_5069; Strand=-; Position=10-306
  misc_feature: Homolog annotation: Hit_ID=AAH27517.1; Match level="QueryCoverage =89%, HitCoverage=33%, E-value=2e-25, Identity=64%"; Hit description =Hadh2 protein [Mus musculus] gb|AAK15008.1| 17beta-hydroxysteroid dehydrogenase type 10/short chain L-3-hy
  misc_feature: Gene Ontology Annotation: Molecular function=7-alpha-hydroxysteroid dehydrogenase activity; Cellular component=plasma membrane; Biological process=lipid metabolism
  misc_feature (17)..(17): Xaa can be any naturally occurring amino acid
LQVNTIGTFKIFGMSVXPLGQIDPDQYGCRRVIVNTASVAAYDGQMGQVAYSASKGAIAGMSMPLARDLASQGIRVVTIAPGLFKTPLSGNASNKADA

SEQ ID NO: 25373 - protein, 183 aa, Diabrotica virgifera
  misc_feature: Coding regions on vcDNA: vcDNA=SeqID_5070; Strand=+; Position=104-652
  misc_feature: Pfam annotation: Pfam_ID=Ank; Match level="Score=36.2, E-value=1e-07, Copies=3"; Pfam description=Ankyrin repeat
MYSKINNGDKSNIFTRTNSICPPPEEVLLDRVLTNETDQLETIVNEKLLKYLYPDHSKPILLIACTAKEVEARTVKLLIDLGADVRYQDENQWEALHYAAERADYFVLKVIIDKLKERKFHLNEVLAQGSNALHILIRHGNKNSKDFVKCAKLLIDEGINVNLADNKMITPILWAAKKDLDII

SEQ ID NO: 25374 - protein, 104 aa, Diabrotica virgifera
  misc_feature: Coding regions on vcDNA: vcDNA=SeqID_5071; Strand=+; Position=1-312
  misc_feature: Homolog annotation: Hit_ID=AAU95200.1; Match level="QueryCoverage =94%, HitCoverage=22%, E-value=1e-13, Identity=47%"; Hit description =enolase [Oncometopia nigricans]
  misc_feature: Gene Ontology Annotation: Molecular function=phosphopyruvate hydratase activity
  misc_feature (20)..(20): Xaa can be any naturally occurring amino acid
  misc_feature (28)..(28): Xaa can be any naturally occurring amino acid
  misc_feature (49)..(49): Xaa can be any naturally occurring amino acid
  misc_feature (59)..(59): Xaa can be any naturally occurring amino acid
  misc_feature (80)..(80): Xaa can be any naturally occurring amino acid
RVRSTVLSGVSAFVLPVPAXLVVCGGSXAGLSLAVLAFLLRPSVAAFFXVAVDMRCEVXYHLMNVNMDQFGFGATGGSYXRGFASKILINNVGLELIQGAISNA

SEQ ID NO: 25375 - protein, 116 aa, Diabrotica virgifera
  misc_feature: Coding regions on vcDNA: vcDNA=SeqID_5072; Strand=+; Position=50-397
  misc_feature: Homolog annotation: Hit_ID=NP_610774.3; Match level="QueryCoverage =81%, HitCoverage=70%, E-value=4e-24, Identity=55%"; Hit description =CG8505-PA [Drosophila melanogaster] gb|AAF58518.2| CG8505-PA [Drosophila melanogaster]
  misc_feature: Pfam annotation: Pfam_ID=Chitin_bind_4; Match level="Score=57.8, E -value=3e-14, Copies=1"; Pfam description=Insect cuticle protein
  misc_feature (78)..(78): Xaa can be any naturally occurring amino acid
  misc_feature (83)..(83): Xaa can be any naturally occurring amino acid
MDWLRISLLCICIFNIYGAPHGEKEVRIISQTNEIAPDGGYSWSFQADNGIKAEETGTLMKTNDPENPQVITAQGNYXYTDNXGNKISLTYVADDDGGFQPQRAHLPTSPPIPPNI

SEQ ID NO: 25376 - protein, 56 aa, Diabrotica virgifera
  misc_feature: Coding regions on vcDNA: vcDNA=SeqID_5073; Strand=+; Position=165-332
HLNFTVSNHSPSDIEIEVAYTDSDQRANDQYKVILPNETVKLDHDTNTGVTTVNIL

SEQ ID NO: 25377 - protein, 56 aa, Diabrotica virgifera
  misc_feature: Coding regions on vcDNA: vcDNA=SeqID_5074; Strand=-; Position=1-168
  misc_feature (15)..(22): Xaa can be any naturally occurring amino acid
  misc_feature (48)..(48): Xaa can be any naturally occurring amino acid
RTLLPYHNDIVKFCXXXXXXXXQENVFFTAPTPSHNQFLNEIHRFPFXKLATRTRG

SEQ ID NO: 25378 - protein, 141 aa, Diabrotica virgifera
  misc_feature: Coding regions on vcDNA: vcDNA=SeqID_5075; Strand=+; Position=2-424
  misc_feature: Homolog annotation: Hit_ID=EAL32401.1; Match level="QueryCoverage =100%, HitCoverage=21%, E-value=7e-41, Identity=53%"; Hit description= GA15301-PA [Drosophila pseudoobscura]
  misc_feature (4)..(10): Xaa can be any naturally occurring amino acid
NCQXXXXXXXTCDGAPGTHRRYSYIQYKGGRTLGQRGSCARRTVDSWWRWFVHCSYCLCYCDEPGLNSDRYFSLRPSIADVNNNWVVTGMRFVKRNRMIHIQIQQGVLLPYGYINQDSVHWKPVDDFSIQSWGAVEGEDYH

SEQ ID NO: 25379 - protein, 49 aa, Diabrotica virgifera
  misc_feature: Coding regions on vcDNA: vcDNA=SeqID_5076; Strand=+; Position=1-147
DRRVQGRMGRACVVICSNDNFSHSLFTKIRNERNCHLNILQHMLFPRVR

SEQ ID NO: 25380 - protein, 144 aa, Diabrotica virgifera
  misc_feature: Coding regions on vcDNA: vcDNA=SeqID_5077; Strand=+; Position=8-439
  misc_feature (102)..(107): Xaa can be any naturally occurring amino acid
GRRRVHLQILYNWDNTLSMLREELFSAVTNLYEYNPDSIHKIVIERSLVTKAMNCHLRPQKKREKSTKKCPVCVSNNCLKRYELKLFNMTQRTETFEEMSLXXXXXXTYPEIVMQSLHNILKLQNANQEFIKDGWTQINMNNTM

SEQ ID NO: 25381 - protein, 39 aa, Diabrotica virgifera
  misc_feature: Coding regions on vcDNA: vcDNA=SeqID_5078; Strand=+; Position=1-120
VHAVAAVMNTVSVFAAGWHWGRPPPFVRLLTRKWAGPLV

SEQ ID NO: 25382 - protein, 49 aa, Diabrotica virgifera
  misc_feature: Coding regions on vcDNA: vcDNA=SeqID_5079; Strand=+; Position=35-184
  misc_feature (27)..(27): Xaa can be any naturally occurring amino acid
NTNFTMQVAPVINDKSLEDQAQELKVXLKSLGAEISEEKFPKGIKHDLH

SEQ ID NO: 25383 - protein, 47 aa, Diabrotica virgifera
  misc_feature: Coding regions on vcDNA: vcDNA=SeqID_5080; Strand=-; Position=1-141
SCSKKGNLEFALPFRGVPFLVLVATPFGIRLCLTDLGEAHRQNYFEP

SEQ ID NO: 25384 - protein, 93 aa, Diabrotica virgifera
  misc_feature: Coding regions on vcDNA: vcDNA=SeqID_5081; Strand=+; Position=1-279
  misc_feature: Homolog annotation: Hit_ID=XP_308641.1; Match level="QueryCoverage =100%, HitCoverage=53%, E-value=8e-26, Identity=63%"; Hit description= ENSANGP00000011253 [Anopheles gambiae]
  misc_feature: Gene Ontology Annotation: Molecular function=ATP binding; Cellular component=nucleus; Biological process=negative regulation of cell proliferation
  misc_feature: Pfam annotation: Pfam_ID=NDK; Match level="Score=12.3, E-value=7.2e -10, Copies=1"; Pfam description=Nucleoside diphosphate kinase
  misc_feature (37)..(44): Xaa can be any naturally occurring amino acid
  misc_feature (47)..(56): Xaa can be any naturally occurring amino acid
ICTLLAIFYYFFRAMAANQERTFIMIKPDGVQRGLVXXXXXXXXQKXXXXXXXXXXWPSEELLKKHYADLAGKPFFAGLVKYMSSGPVVPMVW

SEQ ID NO: 25385 - protein, 40 aa, Diabrotica virgifera
  misc_feature: Coding regions on vcDNA: vcDNA=SeqID_5082; Strand=-; Position=23-145
FFVTVVTLNRWHFFNFIEHSLICRYLFKILSWWHFNFTFT

SEQ ID NO: 25386 - protein, 65 aa, Diabrotica virgifera
  misc_feature: Coding regions on vcDNA: vcDNA=SeqID_5083; Strand=-; Position=1-198
  misc_feature (1)..(63): Xaa can be any naturally occurring amino acid
XXXXXXXXXXXXXXXXXXXXXXXXXXXXXXXXXXXXXXXXXXXXXXXXXXXXXXXXXXXXXXXLF

SEQ ID NO: 25387 - protein, 59 aa, Diabrotica virgifera
  misc_feature: Coding regions on vcDNA: vcDNA=SeqID_5084; Strand=+; Position=35-211
LLLCHRLCVQVWDIKCSIDLPLYPKILMMNTDVQLMDLRRQFLVMMRFTVQSELQLLHV

SEQ ID NO: 25388 - protein, 53 aa, Diabrotica virgifera
  misc_feature: Coding regions on vcDNA: vcDNA=SeqID_5085; Strand=+; Position=1-159
RGHPRVRTSADVIDGFIIYHKGTLLKVKGLALRHTYLLLYSKEFYLVPCLSWI

SEQ ID NO: 25389 - protein, 95 aa, Diabrotica virgifera
  misc_feature: Coding regions on vcDNA: vcDNA=SeqID_5086; Strand=+; Position=72-357
  misc_feature: Homolog annotation: Hit_ID=AAQ55293.1; Match level="QueryCoverage =97%, HitCoverage=24%, E-value=7e-28, Identity=59%"; Hit description =nuclear receptor RXR-l [Locusta migratoria]
  misc_feature (68)..(68): Xaa can be any naturally occurring amino acid
MEMDSTERGLSLDQNLSMGALGPQSPLEIKPDASTLNQFSPQGPNSPGSFSLGHANLLSPSAGSQKSXSPYPPNHPLTGSKHPCSICGDKATGKH

SEQ ID NO: 25390 - protein, 77 aa, Diabrotica virgifera
  misc_feature: Coding regions on vcDNA: vcDNA=SeqID_5087; Strand=-; Position=7-240
  misc_feature (64)..(68): Xaa can be any naturally occurring amino acid
IVRSATYVTADMYFVAISDDLNRVRIAASAHLWLYVAITAWSLLKHFKWLHKLACEIERSAVCXXXXXSKIHGTVER

SEQ ID NO: 25391 - protein, 89 aa, Diabrotica virgifera
  misc_feature: Coding regions on vcDNA: vcDNA=SeqID_5088; Strand=+; Position=2-268
HANKISSSCAKLPTKSSVPVINPQGKKPPIWGKSLNFQNVALNIVNDCFHPNDNNHPNVSNFENYLKDMIKIYGTTCKLGAGNSGQQSV

SEQ ID NO: 25392 - protein, 48 aa, Diabrotica virgifera
  misc_feature: Coding regions on vcDNA: vcDNA=SeqID_5089; Strand=-; Position=117-263
KLSFLYNDTMVPTFNPHSLTFLFKRGQQNVIMSKIYEKYLKKINHSKK

SEQ ID NO: 25393 - protein, 51 aa, Diabrotica virgifera
  misc_feature: Coding regions on vcDNA: vcDNA=SeqID_5090; Strand=+; Position=1-156
  misc_feature (5)..(20): Xaa can be any naturally occurring amino acid
  misc_feature (28)..(42): Xaa can be any naturally occurring amino acid
TRLRXXXXXXXXXXXXXXXXLVNERLLXXXXXXXXXXXXXXXSGASGTRNY

SEQ ID NO: 25394 - protein, 74 aa, Diabrotica virgifera
  misc_feature: Coding regions on vcDNA: vcDNA=SeqID_5091; Strand=+; Position=1-225
KHFGSYFGFWCGNTKCFQIACLLIVIHDYADEMPGIINAFIVPSIFCVTALDSQYSCYHDSFTASDPAAARSVD

SEQ ID NO: 25395 - protein, 131 aa, Diabrotica virgifera
  misc_feature: Coding regions on vcDNA: vcDNA=SeqID_5092; Strand=+; Position=3-398
  misc_feature: Homolog annotation: Hit_ID=XP_392101.1; Match level="QueryCoverage =93%, HitCoverage=8%, E-value=1e-20, Identity=48%"; Hit description =similar to CG10840-PB [Apis mellifera]
  misc_feature (71)..(82): Xaa can be any naturally occurring amino acid
STPASDHTSAEGKLLTAKQKADRARAQALIDSLKAQGVQLPDVGEKKPTRLGTRIRPNKQKKEQTPVPKPXXXXXXXXXXXXPKEEVVVPPVETKEPEPEDDVKDAWDASSEEDEESQETDVKPQESRKTI

SEQ ID NO: 25396 - protein, 37 aa, Diabrotica virgifera
  misc_feature: Coding regions on vcDNA: vcDNA=SeqID_5093; Strand=-; Position=2-112
HELCISTQKSQKLQDTSLSSTVRTFSDTSNRRHSYAC

SEQ ID NO: 25397 - protein, 99 aa, Diabrotica virgifera
  misc_feature: Coding regions on vcDNA: vcDNA=SeqID_5094; Strand=+; Position=58-357
  misc_feature (78)..(86): Xaa can be any naturally occurring amino acid
NLTLETAIEICRNSEITKRQFESVRNNESLEVNAVKNKQSELKFLCKNCKRKHVAAQCPASGKNFFVYGGANHFSNAXXXXXXXXXRYKRQSVKKSSRN

SEQ ID NO: 25398 - protein, 102 aa, Diabrotica virgifera
  misc_feature: Coding regions on vcDNA: vcDNA=SeqID_5095; Strand=+; Position=76-381
  misc_feature (3)..(11): Xaa can be any naturally occurring amino acid
  misc_feature (97)..(97): Xaa can be any naturally occurring amino acid
INXXXXXXXXXVKRQVPEKSCKVETDNNEVNLLDTFKVEDKEEPKTEIIYMYDTFDYLDKEILIKAEIEKDDLSFSPFEEKQSQKELQEYNCCTGTXQQYIG

SEQ ID NO: 25399 - protein, 131 aa, Diabrotica virgifera
  misc_feature: Coding regions on vcDNA: vcDNA=SeqID_5096; Strand=+; Position=2-394
  misc_feature: Homolog annotation: Hit_ID=NP_492704.1; Match level="QueryCoverage =100%, HitCoverage=25%, E-value=1e-33, Identity=48%"; Hit description= nonstructural protein like family member (1K893) [Caenorhabditis elegans] emb|CAA22056.1|
  misc_feature (72)..(72): Xaa can be any naturally occurring amino acid
HYRNLKQALSNGLILTKIHKVLKFNQSAWLRPYIELNTNLRAASKSSFEKNLYKMMNNAVFGKTMENIRRHXTVKICKNWNGRYGAKNLIASIRFHSRTIFSENLVAIELTKSVVCFNKPLYIGAAILDIS

SEQ ID NO: 25400 - protein, 54 aa, Diabrotica virgifera
  misc_feature: Coding regions on vcDNA: vcDNA=SeqID_5097; Strand=-; Position=190-354
  misc_feature (12)..(18): Xaa can be any naturally occurring amino acid
EITCPDAPLRTXXXXXXXFSRKKYIALCYLHCIVTVAFSSFMILYYSELTLNKL

SEQ ID NO: 25401 - protein, 67 aa, Diabrotica virgifera
  misc_feature: Coding regions on vcDNA: vcDNA=SeqID_5098; Strand=+; Position=126-326
  misc_feature: Homolog annotation: Hit_ID=CAA90716.1; Match level="QueryCoverage =94%, HitCoverage=18%, E-value=3e-16, Identity=66%"; Hit description =hnRNP protein [Chironomus tentans]
  misc_feature: Gene Ontology Annotation: Cellular component=nuclear speck
  misc_feature (56)..(56): Xaa can be any naturally occurring amino acid
DVSTDHQNGSRDAPSDIATAKTPGRDDDRQLFVGGMSWETTDMELREHFAQYGDIXSINVNTDPNTG

SEQ ID NO: 25402 - protein, 69 aa, Diabrotica virgifera
  misc_feature: Coding regions on vcDNA: vcDNA=SeqID_5099; Strand=+; Position=139-348
  misc_feature (6)..(12): Xaa can be any naturally occurring amino acid
KNCVVXXXXXXXEGKLKVCKTIFDPTLIEKSCRYFYFISKEKFLLYCFIGVLHHLLIYRRKMIDVIQCD

SEQ ID NO: 25403 - protein, 98 aa, Diabrotica virgifera
  misc_feature: Coding regions on vcDNA: vcDNA=SeqID_5100; Strand=-; Position=1-294
  misc_feature (17)..(24): Xaa can be any naturally occurring amino acid
  misc_feature (30)..(45): Xaa can be any naturally occurring amino acid
  misc_feature (47)..(57): Xaa can be any naturally occurring amino acid
  misc_feature (68)..(81): Xaa can be any naturally occurring amino acid
  misc_feature (86)..(95): Xaa can be any naturally occurring amino acid
LSISFEVQPFVFEYGCXXXXXXXXINHGEXXXXXXXXXXXXXXXXVXXXXXXXXXXXLQEELQLLSFXXXXXXXXXXXXXXNPQGXXXXXXXXXXHHR

SEQ ID NO: 25404 - protein, 21 aa, Diabrotica virgifera
  misc_feature: Coding regions on vcDNA: vcDNA=SeqID_5101; Strand=-; Position=2-64
GTLLGSWFSELNGISQVSITS

SEQ ID NO: 25405 - protein, 96 aa, Diabrotica virgifera
  misc_feature: Coding regions on vcDNA: vcDNA=SeqID_5102; Strand=+; Position=2-289
  misc_feature (1)..(6): Xaa can be any naturally occurring amino acid
  misc_feature (10)..(27): Xaa can be any naturally occurring amino acid
  misc_feature (30)..(48): Xaa can be any naturally occurring amino acid
  misc_feature (59)..(67): Xaa can be any naturally occurring amino acid
  misc_feature (82)..(96): Xaa can be any naturally occurring amino acid
XXXXXXTLGXXXXXXXXXXXXXXXXXXLQXXXXXXXXXXXXXXXXXXXHPFLTIPNFLXXXXXXXXXSIFTIKYFYIINIKXXXXXXXXXXXXXXX

SEQ ID NO: 25406 - protein, 105 aa, Diabrotica virgifera
  misc_feature: Coding regions on vcDNA: vcDNA=SeqID_5103; Strand=-; Position=1-315
  misc_feature (1)..(105): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 25407 - protein, 41 aa, Diabrotica virgifera
  misc_feature: Coding regions on vcDNA: vcDNA=SeqID_5104; Strand=-; Position=1-123
  misc_feature (22)..(33): Xaa can be any naturally occurring amino acid
PLDRSPVSGTRKTMTLKSRTNXXXXXXXXXXXXILKCRGRV

SEQ ID NO: 25408 - protein, 26 aa, Diabrotica virgifera
  misc_feature: Coding regions on vcDNA: vcDNA=SeqID_5105; Strand=+; Position=1-78
  misc_feature (1)..(15): Xaa can be any naturally occurring amino acid
  misc_feature (18)..(25): Xaa can be any naturally occurring amino acid
XXXXXXXXXXXXXXXLLXXXXXXXXC

SEQ ID NO: 25409 - protein, 87 aa, Diabrotica virgifera
  misc_feature: Coding regions on vcDNA: vcDNA=SeqID_5106; Strand=-; Position=0-260
  misc_feature (1)..(40): Xaa can be any naturally occurring amino acid
  misc_feature (44)..(83): Xaa can be any naturally occurring amino acid
XXXXXXXXXXXXXXXXXXXXXXXXXXXXXXXXXXXXXXXXTQGXXXXXXXXXXXXXXXXXXXXXXXXXXXXXXXXXXXXXXXXRRVG

SEQ ID NO: 25410 - protein, 27 aa, Diabrotica virgifera
  misc_feature: Coding regions on vcDNA: vcDNA=SeqID_5107; Strand=+; Position=3-86
  misc_feature (4)..(16): Xaa can be any naturally occurring amino acid
RPKXXXXXXXXXXXXXNLGKEMLGYIS

SEQ ID NO: 25411 - protein, 55 aa, Diabrotica virgifera
  misc_feature: Coding regions on vcDNA: vcDNA=SeqID_5108; Strand=+; Position=178-345
SSAITILGTGRLCSIHKNLLKDAENHWGIPPKPPFKTTARFFTPRTNNFFVFVCW

SEQ ID NO: 25412 - protein, 49 aa, Diabrotica virgifera
  misc_feature: Coding regions on vcDNA: vcDNA=SeqID_5109; Strand=+; Position=267-413
LRSKKLSISSFLTLTESIKTLKQRFKWLFSKCYSFFYNFCILRTIFKVK

SEQ ID NO: 25413 - protein, 28 aa, Diabrotica virgifera
  misc_feature: Coding regions on vcDNA: vcDNA=SeqID_5110; Strand=-; Position=188-274
MDKLSKKTEINIPLMSYTKMYLMNKMNS

SEQ ID NO: 25414 - protein, 78 aa, Diabrotica virgifera
  misc_feature: Coding regions on vcDNA: vcDNA=SeqID_5111; Strand=+; Position=19-255
SAGLLSANNSRKHLFLICFCFCIVDISSCVSYVASCAVSCSLFSSCSSKKSLLFIHCISPCYFVFALAVCAVVDNSVC

SEQ ID NO: 25415 - protein, 152 aa, Diabrotica virgifera
  misc_feature: Coding regions on vcDNA: vcDNA=SeqID_5112; Strand=+; Position=2-457
  misc_feature (9)..(17): Xaa can be any naturally occurring amino acid
  misc_feature (91)..(98): Xaa can be any naturally occurring amino acid
ANKVNLLAXXXXXXXXXLGGSGIFGSNGTAYQSYISGTTASKILIATVVDTVINASATRHFTNKFFKGGLGSFDFDDDKPEILKYQSNRLXXXXXXXXKTLDLSQHNIKEKICHRSFCCQFNTNVTTNSSTDVYKLVAYSGSVDIFGTQKKT

SEQ ID NO: 25416 - protein, 30 aa, Diabrotica virgifera
  misc_feature: Coding regions on vcDNA: vcDNA=SeqID_5113; Strand=-; Position=0-89
  misc_feature (6)..(24): Xaa can be any naturally occurring amino acid
RITFPXXXXXXXXXXXXXXXXXXXFPTRWP

SEQ ID NO: 25417 - protein, 21 aa, Diabrotica virgifera
  misc_feature: Coding regions on vcDNA: vcDNA=SeqID_5114; Strand=-; Position=0-62
TQLSNCTPKVFNGFVTAGRVG

SEQ ID NO: 25418 - protein, 108 aa, Diabrotica virgifera
  misc_feature: Coding regions on vcDNA: vcDNA=SeqID_5115; Strand=+; Position=68-391
  misc_feature: Homolog annotation: Hit_ID=XP_313445.1; Match level="QueryCoverage =75%, HitCoverage=26%, E-value=2e-21, Identity=52%"; Hit description =ENSANGP00000020288 [Anopheles gambiae]
MKFTVSSWFICLFLVYFRCGFARFMLPPVPDVIYPPVPDIVAKMNETLLEEEHMDPELSPGLFQGDMALTNEFYNYWRVGLKFEIFPDKLWRNGNCSYTISPLYEPSE

SEQ ID NO: 25419 - protein, 114 aa, Diabrotica virgifera
  misc_feature: Coding regions on vcDNA: vcDNA=SeqID_5116; Strand=+; Position=2-344
  misc_feature: Homolog annotation: Hit_ID=AAL62468.1; Match level="QueryCoverage =100%, HitCoverage=27%, E-value=4e-28, Identity=56%"; Hit description= ribosomal protein L3 [Spodoptera frugiperda]
  misc_feature: Gene Ontology Annotation: Molecular function=structural constituent of ribosome; Cellular component=ribosome; Biological process=protein biosynthesis
  misc_feature (47)..(47): Xaa can be any naturally occurring amino acid
RKFSAPLHGFMGSYPNERSQTLRGTVKAYPIDDTSKPVHVTDIIRFXSGTTHVIQEGHRPDSKIINNDLEEADINLETPPIVIVGDVGYINNLHGHMALSIICAEHPSEYCRTR

SEQ ID NO: 25420 - protein, 51 aa, Diabrotica virgifera
  misc_feature: Coding regions on vcDNA: vcDNA=SeqID_5117; Strand=+; Position=3-155
RVQSLLTLECKSKTPPRVSPNSISGAFFLKLLMGKNLGIPQVTPFKKIPLF

SEQ ID NO: 25421 - protein, 60 aa, Diabrotica virgifera
  misc_feature: Coding regions on vcDNA: vcDNA=SeqID_5118; Strand=-; Position=0-179
  misc_feature (1)..(55): Xaa can be any naturally occurring amino acid
XXXXXXXXXXXXXXXXXXXXXXXXXXXXXXXXXXXXXXXXXXXXXXXXXXXXXXXPRVGG

SEQ ID NO: 25422 - protein, 50 aa, Diabrotica virgifera
  misc_feature: Coding regions on vcDNA: vcDNA=SeqID_5119; Strand=+; Position=38-190
NDPSRLRSLNPGQEIHWKRCIMAMRDMGPLSRVRSCRNWRSSLDRRELGS

SEQ ID NO: 25423 - protein, 28 aa, Diabrotica virgifera
  misc_feature: Coding regions on vcDNA: vcDNA=SeqID_5120; Strand=+; Position=2-85
RVRQNTDHLALYRTLFNFNCFSRAFSKS

SEQ ID NO: 25424 - protein, 93 aa, Diabrotica virgifera
  misc_feature: Coding regions on vcDNA: vcDNA=SeqID_5121; Strand=+; Position=1-282
  misc_feature (5)..(11): Xaa can be any naturally occurring amino acid
  misc_feature (16)..(22): Xaa can be any naturally occurring amino acid
  misc_feature (28)..(33): Xaa can be any naturally occurring amino acid
SQASXXXXXXXPASDXXXXXXXSAKSIXXXXXXYRECNTGSNFAHCNPGIFSKRWFYTEYNRHFIKTINRLRANHALTPYYMHRIGLSDTPNW

SEQ ID NO: 25425 - protein, 74 aa, Diabrotica virgifera
  misc_feature: Coding regions on vcDNA: vcDNA=SeqID_5122; Strand=-; Position=7-231
  misc_feature (61)..(69): Xaa can be any naturally occurring amino acid
CPVAISCATSRIVSLCCYANWTISCANCSATTPCCSWTSTVTGCLLAVSSVTSLLINSCLXXXXXXXXXRPIAT

SEQ ID NO: 25426 - protein, 42 aa, Diabrotica virgifera
  misc_feature: Coding regions on vcDNA: vcDNA=SeqID_5123; Strand=+; Position=167-295
LHITLTSQNYFWVPNFQIHFRLDIVEVTNRITVIGIIACDST

SEQ ID NO: 25427 - protein, 141 aa, Diabrotica virgifera
  misc_feature: Coding regions on vcDNA: vcDNA=SeqID_5124; Strand=-; Position=2-424
SRGKTYTRKFNKDMYLRNQWICGCSEKNAFFCFPCALFGADKEEKLWRETGVRDLVHLSEKIKKHENTQTHMNNEMRFALFGKLNIQAQLDSAYWINIQKHNEEVTKNRYVLSKIIDCIKFCGAFELALRGHDESETSDNP

SEQ ID NO: 25428 - protein, 58 aa, Diabrotica virgifera
  misc_feature: Coding regions on vcDNA: vcDNA=SeqID_5125; Strand=-; Position=51-227
LLPNPYFTSTYKLVWSCQQLFLKSNIYTKSFFNVYTRIFGSLGSFYFKMHFAYIISPF

SEQ ID NO: 25429 - protein, 33 aa, Diabrotica virgifera
  misc_feature: Coding regions on vcDNA: vcDNA=SeqID_5126; Strand=+; Position=2-103
LCTSRLSYIGISSFTIGIRSQIGQKRSSAVRRM

SEQ ID NO: 25430 - protein, 123 aa, Diabrotica virgifera
  misc_feature: Coding regions on vcDNA: vcDNA=SeqID_5127; Strand=+; Position=57-425
  misc_feature: Homolog annotation: Hit_ID=XP_396167.1; Match level="QueryCoverage =100%, HitCoverage=33%, E-value=8e-48, Identity=79%"; Hit description= similar to CG3263-PC [Apis mellifera]
  misc_feature: Gene Ontology Annotation: Molecular function=cAMP-dependent protein kinase, intrinsic regulator activity; Cellular component=cAMP -dependent protein kinase complex; Biological process=olfactory learning
  misc_feature: Pfam annotation: Pfam_ID=RIIa; Match level="Score=64.0, E-value=4.2e -16, Copies=1"; Pfam description=Regulatory subunit of type II PKA R -su
MTTNFDEEQALRECEAYVQAHNIQQVLKDCIVQLCINRPSNPIAFLREHFQKLEREQALDAKQQAMSPEDTEDLSPLPAHAQQPARRRGGISAEPVSEEDATSYVKKVVPKDYKTMAALSKAI

SEQ ID NO: 25431 - protein, 72 aa, Diabrotica virgifera
  misc_feature: Coding regions on vcDNA: vcDNA=SeqID_5128; Strand=+; Position=2-216
  misc_feature: Homolog annotation: Hit_ID=AAR01306.1; Match level="QueryCoverage =97%, HitCoverage=9%, E-value=5e-19, Identity=72%"; Hit description =elongation factor-2 [Nicoletia meinerti]
  misc_feature: Gene Ontology Annotation: Molecular function=ATP binding; Biological process=protein biosynthesis
  misc_feature (13)..(13): Xaa can be any naturally occurring amino acid
  misc_feature (26)..(26): Xaa can be any naturally occurring amino acid
  misc_feature (31)..(31): Xaa can be any naturally occurring amino acid
  misc_feature (36)..(36): Xaa can be any naturally occurring amino acid
  misc_feature (53)..(53): Xaa can be any naturally occurring amino acid
TADGLAEDHDEGXVNPREDFKVRARXLQRDXDYDIXTEARKIRCFGRMSTGPXILVDCTKGVQQLNEIIYSV

SEQ ID NO: 25432 - protein, 41 aa, Diabrotica virgifera
  misc_feature: Coding regions on vcDNA: vcDNA=SeqID_5129; Strand=-; Position=1-123
RRKNLSFPWLYAIWSKKTVKSCTEDLSPSIKLSMAALTKEA

SEQ ID NO: 25433 - protein, 101 aa, Diabrotica virgifera
  misc_feature: Coding regions on vcDNA: vcDNA=SeqID_5130; Strand=+; Position=75-377
  misc_feature (56)..(60): Xaa can be any naturally occurring amino acid
IHNIRLSLRYITLLSTVAVLSGQVSQSLVAHCLKATDTSIRQYTNSSTLMRDLSKXXXXXMQYKNQYLYTWDSFQKSGFRLSTINLVLHDHTLSHSPCLHT

SEQ ID NO: 25434 - protein, 44 aa, Diabrotica virgifera
  misc_feature: Coding regions on vcDNA: vcDNA=SeqID_5131; Strand=+; Position=87-221
CHNRILTYLVVMKCHSSSNMSPFFRSMVVLFSRSICKNPVLLSY

SEQ ID NO: 25435 - protein, 108 aa, Diabrotica virgifera
  misc_feature: Coding regions on vcDNA: vcDNA=SeqID_5132; Strand=+; Position=3-324
  misc_feature: Homolog annotation: Hit_ID=NP_995904.1; Match level="QueryCoverage =75%, HitCoverage=30%, E-value=4e-25, Identity=70%"; Hit description =CG9193-PB, isoform B [Drosophila melanogaster] ref|NP_476905.1| CG9193-PA, isoform A [Drosophila
  misc_feature: Gene Ontology Annotation: Molecular function=DNA binding; Cellular component=delta-DNA polymerase cofactor complex; Biological process =DNA replication
  misc_feature: Pfam annotation: Pfam_ID=PCNA_N; Match level="Score=85.8, E-value =1.1e-22, Copies=1"; Pfam description=Proliferating cell nuclear antigen, N-
  misc_feature (89)..(89): Xaa can be any naturally occurring amino acid
RTSQSPLSSCCVFFNEFNCLVSTNKSKMCEARLVQSATFKKVIDAIKDLLNEASFDCPESGIQLQAMENSQVSLVSITLKSEGVDKYRXCERDLTMGMNLGSMSKIFK

SEQ ID NO: 25436 - protein, 41 aa, Diabrotica virgifera
  misc_feature: Coding regions on vcDNA: vcDNA=SeqID_5133; Strand=-; Position=2-124
PGVKDWRLEMRYALALVMKDHYISCINNTSKSQKVSLDCIV

SEQ ID NO: 25437 - protein, 61 aa, Diabrotica virgifera
  misc_feature: Coding regions on vcDNA: vcDNA=SeqID_5134; Strand=+; Position=20-205
MCSQTFIIFISFKCQLISLCVFKYECRRVSTTYLSFNRCPVWGVTMRAYELYDVQSLWLCI

SEQ ID NO: 25438 - protein, 93 aa, Diabrotica virgifera
  misc_feature: Coding regions on vcDNA: vcDNA=SeqID_5135; Strand=+; Position=1-279
  misc_feature (21)..(53): Xaa can be any naturally occurring amino acid
  misc_feature (62)..(80): Xaa can be any naturally occurring amino acid
WWSWGVGGGCVVWGGRGGGWXXXXXXXXXXXXXXXXXXXXXXXXXXXXXXXXXWAWGAGVGXXXXXXXXXXXXXXXXXXXAGGRWGGGGGGVG

SEQ ID NO: 25439 - protein, 75 aa, Diabrotica virgifera
  misc_feature: Coding regions on vcDNA: vcDNA=SeqID_5136; Strand=+; Position=80-305
  misc_feature: Homolog annotation: Hit_ID=XP_343837.1; Match level="QueryCoverage =100%, HitCoverage=19%, E-value=1e-17, Identity=61%"; Hit description= similar to Elongation factor 1-alpha 1 (EF-1-alpha-1) (Elongation factor 1 A-1) (eEF1A-1)
  misc_feature: Gene Ontology Annotation: Molecular function=translation factor activity, nucleic acid binding; Biological process=protein biosynthesis
  misc_feature (58)..(58): Xaa can be any naturally occurring amino acid
MGTQHSHRNIVVIGHVYSGRSTTTGHLVYQCGGHGSHHIYCCGCSSYCMGRGSIRYAXVLDKLKADRECGITIDI

SEQ ID NO: 25440 - protein, 35 aa, Diabrotica virgifera
  misc_feature: Coding regions on vcDNA: vcDNA=SeqID_5137; Strand=+; Position=154-258
AYADGSEIYTGRKGVAVVQVPPSNAKCVAHGRPWW

SEQ ID NO: 25441 - protein, 119 aa, Diabrotica virgifera
  misc_feature: Coding regions on vcDNA: vcDNA=SeqID_5138; Strand=+; Position=110-466
  misc_feature: Homolog annotation: Hit_ID=NP_723092.1; Match level="QueryCoverage =99%, HitCoverage=43%, E-value=6e-45, Identity=69%"; Hit description =CG6957-PB, isoform B [Drosophila melanogaster] ref|NP_608938.1| CG6957-PA, isoform A [Drosophila
  misc_feature: Gene Ontology Annotation: Molecular function=glucosamine-6-phosphate deaminase activity; Biological process=fertilization (sensu Animalia)
  misc_feature: Pfam annotation: Pfam_ID=Glucosamine_iso; Match level="Score=29.3, E -value=1.2e-10, Copies=1"; Pfam description=Glucosamine-6-phosphate isomerases/6-
  misc_feature (90)..(96): Xaa can be any naturally occurring amino acid
MRLIILDKAEEVAEWAATYIMKRIQDFKPSAEKYFVLGLPTGSTPLGMYKKLIEFQKQGKISFKYVKTFNMDEYVNLPKEHTESYHYYMXXXXXXXIDIQPNNVHLLDGNAADLNGECQ

SEQ ID NO: 25442 - protein, 51 aa, Diabrotica virgifera
  misc_feature: Coding regions on vcDNA: vcDNA=SeqID_5139; Strand=+; Position=140-292
LNIRSHTLGTAEHVAQWASTSFSTRIRDFTPSDGGYFVHGLPTGSTPLGML

SEQ ID NO: 25443 - protein, 140 aa, Diabrotica virgifera
  misc_feature: Coding regions on vcDNA: vcDNA=SeqID_5140; Strand=+; Position=25-444
  misc_feature: Homolog annotation: Hit_ID=XP_392422.1; Match level="QueryCoverage =98%, HitCoverage=91%, E-value=2e-43, Identity=59%"; Hit description =similar to ENSANGP00000023168 [Apis mellifera]
  misc_feature: Gene Ontology Annotation: Molecular function=DNA binding; Cellular component=polytene chromosome; Biological process=negative regulation of transcription
  misc_feature: Pfam annotation: Pfam_ID=MBD; Match level="Score=8.6, E-value=0.013, Copies=1"; Pfam description=Methyl-CpG binding domain
MANITIEKTKYECAPVSKRCQRDDVLRKTGLTVGKVDLYYGRGVRNDGSLVPPIRQTASIFKQPVTVYKLQESKVKNDYKNGNQEKPKQLIWEKRLEGLRACDMDGFEFEAMELPKGLKPVGPNVTEDTIIQSVATALHV

SEQ ID NO: 25444 - protein, 142 aa, Diabrotica virgifera
  misc_feature: Coding regions on vcDNA: vcDNA=SeqID_5141; Strand=+; Position=2-427
  misc_feature: Homolog annotation: Hit_ID=CAF94600.1; Match level="QueryCoverage =96%, HitCoverage=48%, E-value=1e-18, Identity=33%"; Hit description =unnamed protein product [Tetraodon nigroviridis]
  misc_feature: Gene Ontology Annotation: Molecular function=ATP binding; Cellular component=nucleus; Biological process=photoreceptor fate commitment (sensu Drosophila)
  misc_feature: Pfam annotation: Pfam_ID=zf-C2H2; Match level="Score=22.8, E-value =0.001, Copies=1"; Pfam description=Zinc finger, C2H2 type
  misc_feature (17)..(28): Xaa can be any naturally occurring amino acid
  misc_feature (45)..(58): Xaa can be any naturally occurring amino acid
  misc_feature (102)..(116): Xaa can be any naturally occurring amino acid
PRVRFSQKGTLKTHLRXXXXXXXXXXXXCLKQFREAYTLKAHLVXXXXXXXXXXXXXXKEFSTVGDLKAHLRTHTGIKPYKCEICEKQFSRTSDLKRHLKIXXXXXXXXXXXXXXXFSQNSILKSHLRVHTGEKPYSTSVKL

SEQ ID NO: 25445 - protein, 111 aa, Diabrotica virgifera
  misc_feature: Coding regions on vcDNA: vcDNA=SeqID_5142; Strand=-; Position=70-405
  misc_feature (11)..(11): Xaa can be any naturally occurring amino acid
VTFFKIHDFIXAIGGGFLVHDVGIQRYLDRFVDVTLVCRVQKFYTASTNTQTVYVQLFLPTAVFSHISPKYCFTLFRRLLWEQLRPIVVHVVNYCFSNIAHCAAVKRLPTH

SEQ ID NO: 25446 - protein, 98 aa, Diabrotica virgifera
  misc_feature: Coding regions on vcDNA: vcDNA=SeqID_5143; Strand=+; Position=94-390
  misc_feature (7)..(14): Xaa can be any naturally occurring amino acid
CRCRLQXXXXXXXXHMQEDLVSYILMDFRHGTSGYIMVSRVNPISTGGIMCCAVTRLKMSLYLGYITHGKSRMCISKLPYIEISMQHIYFRIHLQWNL

SEQ ID NO: 25447 - protein, 81 aa, Diabrotica virgifera
  misc_feature: Coding regions on vcDNA: vcDNA=SeqID_5144; Strand=+; Position=90-332
QYICSSLLIFQDRYVCICNRANKSLKEYISGFRKCIMYYNSCVFGFVIPCSKIMKYVRITFLQFVPVLCKYIRNLHVNSSG

SEQ ID NO: 25448 - protein, 56 aa, Diabrotica virgifera
  misc_feature: Coding regions on vcDNA: vcDNA=SeqID_5145; Strand=-; Position=66-236
  misc_feature (23)..(29): Xaa can be any naturally occurring amino acid
  misc_feature (39)..(48): Xaa can be any naturally occurring amino acid
LKNFLNYINYNKKANLKAKLISXXXXXXXPCYTRCNTWXXXXXXXXXXSHYLLTLL

SEQ ID NO: 25449 - protein, 81 aa, Diabrotica virgifera
  misc_feature: Coding regions on vcDNA: vcDNA=SeqID_5146; Strand=+; Position=194-439
  misc_feature (76)..(76): Xaa can be any naturally occurring amino acid
QGSAMALWHYLTGRHCSTCKQLIVLVLLLLQKAILSQNALILVIKTFFNEIFILKCLCFIIAKCSVIWNRLWTVGXILQYL

SEQ ID NO: 25450 - protein, 143 aa, Diabrotica virgifera
  misc_feature: Coding regions on vcDNA: vcDNA=SeqID_5147; Strand=+; Position=1-429
  misc_feature: Homolog annotation: Hit_ID=NP_648179.3; Match level="QueryCoverage =90%, HitCoverage=14%, E-value=9e-41, Identity=59%"; Hit description =CG13676-PA [Drosophila melanogaster] gb|AAF50480.2| CG13676-PA [Drosophila melanogaster]
  misc_feature: Pfam annotation: Pfam_ID=CBM_14; Match level="Score=48.7, E-value =1.7e-11, Copies=1"; Pfam description=Chitin binding Peritrophin-A domain
PNLPKELNGYNLSDYPFYERVPENITFKCDGLHDGFYASVIHKCQVYHHCLFGIRYDFLCANYTAFDQTLFNCNFVSNVDCQNSKKFWNRNDELYKTKSTTPPPIVYSFYTQSPRVYPPPGSIRRVPQRRGPVIPDVASSPEA

SEQ ID NO: 25451 - protein, 70 aa, Diabrotica virgifera
  misc_feature: Coding regions on vcDNA: vcDNA=SeqID_5148; Strand=-; Position=222-434
LLQYLLKKTCTTLFYSYNIIPTVFFLNVILLILESFYLSFKCTYLCIIDFSTYMTNTYIETIHIIFDNFV

SEQ ID NO: 25452 - protein, 87 aa, Diabrotica virgifera
  misc_feature: Coding regions on vcDNA: vcDNA=SeqID_5149; Strand=-; Position=70-333
  misc_feature (38)..(45): Xaa can be any naturally occurring amino acid
KGIIDNILLIFIISCKLFLEKRIWKRSILRTVFMYLYXXXXXXXXLLQLSKNKNILITALVYLAIGITIVLTNVSPESEIIQYMPIS

SEQ ID NO: 25453 - protein, 58 aa, Diabrotica virgifera
  misc_feature: Coding regions on vcDNA: vcDNA=SeqID_5150; Strand=-; Position=273-449
  misc_feature (30)..(38): Xaa can be any naturally occurring amino acid
QSYYLIKLKIFSDSNRMLFLHKFSIILNTXXXXXXXXXAIKHNTFTLANQIFTVNTYL

SEQ ID NO: 25454 - protein, 152 aa, Diabrotica virgifera
  misc_feature: Coding regions on vcDNA: vcDNA=SeqID_5151; Strand=+; Position=3-458
  misc_feature: Homolog annotation: Hit_ID=AAV90724.1; Match level="QueryCoverage =96%, HitCoverage=67%, E-value=1e-63, Identity=80%"; Hit description =60S ribosomal protein L10a [Aedes albopictus]
  misc_feature: Gene Ontology Annotation: Cellular component=cytosolic ribosome (sensu Eukarya); Biological process=protein biosynthesis
  misc_feature: Pfam annotation: Pfam_ID=Ribosomal_L1; Match level="Score=28.2, E -value=2.5e-12, Copies=1"; Pfam description=Ribosomal protein L1p/L10e family
  misc_feature (40)..(51): Xaa can be any naturally occurring amino acid
NNLFYRLKHIPRPKMQVCILGDQQHCDEANANNVPFMDVXXXXXXXXXXXXVKKLAKKYDAFLASEALIKQIPRLLGPGLNKAGKFPGLLSHQESMTQKIDEVKATIKFQMKKVLCLSVAVGHVGMNQDELVQNVHLSINFLVSLLKKHWQN

SEQ ID NO: 25455 - protein, 36 aa, Diabrotica virgifera
  misc_feature: Coding regions on vcDNA: vcDNA=SeqID_5152; Strand=+; Position=84-194
YFILATVHYTGLLDSHSLSRQLLMGMKPFLCDISVY

SEQ ID NO: 25456 - protein, 103 aa, Diabrotica virgifera
  misc_feature: Coding regions on vcDNA: vcDNA=SeqID_5153; Strand=+; Position=44-352
  misc_feature: Homolog annotation: Hit_ID=XP_394723.1; Match level="QueryCoverage =96%, HitCoverage=13%, E-value=4e-13, Identity=41%"; Hit description =similar to ENSANGP00000015773 [Apis mellifera]
  misc_feature: Gene Ontology Annotation: Molecular function=RNA helicase activity; Cellular component=bud neck; Biological process=cell cycle
  misc_feature: Pfam annotation: Pfam_ID=Helicase_C; Match level="Score=15.2, E-value= 0.0012, Copies=1"; Pfam description=Helicase conserved C-terminal domain
  misc_feature (42)..(49): Xaa can be any naturally occurring amino acid
  misc_feature (69)..(69): Xaa can be any naturally occurring amino acid
  misc_feature (82)..(82): Xaa can be any naturally occurring amino acid
VNECGTSNIICDNIRKIVVGVPRFIRMIDWTALSRNGENSKXXXXXXXXEFSTGKSSTLVATDVAARGXDVVGLRYVVNYDXRQSSDYYSHSFGTTGPSDSAG

SEQ ID NO: 25457 - protein, 45 aa, Diabrotica virgifera
  misc_feature: Coding regions on vcDNA: vcDNA=SeqID_5154; Strand=-; Position=0-134
SSSGFAISMRHADIGTSYRDTRTHDCYGLTFIHNEGTFTAHLTDS

SEQ ID NO: 25458 - protein, 53 aa, Diabrotica virgifera
  misc_feature: Coding regions on vcDNA: vcDNA=SeqID_5155; Strand=-; Position=29-190
HARRTHADREVHQLAACRLKIRIFETRRMDRNMMLGGPGCKMLEYVSIRSLTR

SEQ ID NO: 25459 - protein, 107 aa, Diabrotica virgifera
  misc_feature: Coding regions on vcDNA: vcDNA=SeqID_5156; Strand=+; Position=2-325
PRVRGLYTLNHLSFNDLEPWNERYKFGSSITTIMRLKCLRFALINLLNIVQHYIFSFIFTTCLHKFELEFESANDLSSSISSHAEFNNNAQILIGQLREHVSTGYVI

SEQ ID NO: 25460 - protein, 93 aa, Diabrotica virgifera
  misc_feature: Coding regions on vcDNA: vcDNA=SeqID_5157; Strand=+; Position=58-339
PLLKAKMRKFIVQCLLVALVAVGVADTWTTIDKRDCESNCMRNCNKANYQSSECISHGGHFPRFADCHCWHKTYDYDKYDKMSKYNNLLGYYE

SEQ ID NO: 25461 - protein, 114 aa, Diabrotica virgifera
  misc_feature: Coding regions on vcDNA: vcDNA=SeqID_5158; Strand=+; Position=86-427
RKMSKPKGSVSSVSKAGQLSVSGISRTSRIGARAPAPPPKVGLEKPPKGLEWTLPPFSVCPRPKTGIDWDELKKRMIRRQAPEGEDIKGIRLILKELQGKNIPVQDFVNLISAY

SEQ ID NO: 25462 - protein, 60 aa, Diabrotica virgifera
  misc_feature: Coding regions on vcDNA: vcDNA=SeqID_5159; Strand=+; Position=2-181
PGVIHASKMTSYYSIVLCTIASTSSSKSCLGSLIRLSLRPSDTIGRSLSIDYCPVAESAF

SEQ ID NO: 25463 - protein, 55 aa, Diabrotica virgifera
  misc_feature: Coding regions on vcDNA: vcDNA=SeqID_5160; Strand=+; Position=143-307
DDTLADNVILLGVTTIYFSVLLNGLCIDCHFIFHGNVCQTAASEHFISQQLHISC

SEQ ID NO: 25464 - protein, 55 aa, Diabrotica virgifera
  misc_feature: Coding regions on vcDNA: vcDNA=SeqID_5161; Strand=+; Position=2-169
PRVREKIPECDQAILTPSFCIAGPFIMFRTFLMPAIRVLTSYSSSADLTMASMLK

SEQ ID NO: 25465 - protein, 46 aa, Diabrotica virgifera
  misc_feature: Coding regions on vcDNA: vcDNA=SeqID_5162; Strand=-; Position=46-186
  misc_feature (20)..(27): Xaa can be any naturally occurring amino acid
IINTVACHYLRQRSKLTLVXXXXXXXXFMLNQTYHIIIKWIYNKTN

SEQ ID NO: 25466 - protein, 82 aa, Diabrotica virgifera
  misc_feature: Coding regions on vcDNA: vcDNA=SeqID_5163; Strand=+; Position=1-249
  misc_feature (3)..(9): Xaa can be any naturally occurring amino acid
QDXXXXXXXDTCSDIRSSSMYITIRTEELLTIIERSPALTSFRSVYTSSSIDRNELSYKYDCKISEYCERIVILSLCTRPSC

SEQ ID NO: 25467 - protein, 66 aa, Diabrotica virgifera
  misc_feature: Coding regions on vcDNA: vcDNA=SeqID_5164; Strand=+; Position=85-282
  misc_feature (3)..(10): Xaa can be any naturally occurring amino acid
  misc_feature (15)..(23): Xaa can be any naturally occurring amino acid
  misc_feature (32)..(41): Xaa can be any naturally occurring amino acid
  misc_feature (52)..(63): Xaa can be any naturally occurring amino acid
LLXXXXXXXXFITDXXXXXXXXXHGLLLNNYXXXXXXXXXXNGLQIFTVKYXXXXXXXXXXXXRFY

SEQ ID NO: 25468 - protein, 147 aa, Diabrotica virgifera
  misc_feature: Coding regions on vcDNA: vcDNA=SeqID_5165; Strand=+; Position=1-441
  misc_feature: Homolog annotation: Hit_ID=XP_312776.1; Match level="QueryCoverage =95%, HitCoverage=36%, E-value=6e-70, Identity=91%"; Hit description =ENSANGP00000020417 [Anopheles gambiae]
  misc_feature: Gene Ontology Annotation: Molecular function=translation initiation factor activity; Cellular component=eukaryotic translation initiation factor 4 complex; Biological process=histogenesis and organogenesis
  misc_feature: Pfam annotation: Pfam_ID=DEAD; Match level="Score=6.1, E-value=6.1e -06, Copies=1"; Pfam description=DEAD/DEAH box helicase
STNPSENLGEDIRKLDYGKKVVIGKPGKVYDMIRRRALRTRSVKMLVLDEADEMLNKGFKEQIYDVYRFLPPSTQVVLISATLPHEILEITSKFMTDPIRILVKRDELTLEGIKQFFVAVEREEWKFDTLCDLYDTLTITQAVIFCN

SEQ ID NO: 25469 - protein, 70 aa, Diabrotica virgifera
  misc_feature: Coding regions on vcDNA: vcDNA=SeqID_5166; Strand=-; Position=130-342
EEQETRLECHLGDSLVNADLLRVRYGWIWGGMVLKYRKRRNCPKYQVVLSFVYHSYTKIVSSTEASKLCQ

SEQ ID NO: 25470 - protein, 23 aa, Diabrotica virgifera
  misc_feature: Coding regions on vcDNA: vcDNA=SeqID_5167; Strand=-; Position=3-71
  misc_feature (12)..(23): Xaa can be any naturally occurring amino acid
YSLTKVFIYLVXXXXXXXXXXXX

SEQ ID NO: 25471 - protein, 46 aa, Diabrotica virgifera
  misc_feature: Coding regions on vcDNA: vcDNA=SeqID_5168; Strand=-; Position=240-380
KAQERNRSTSRPIIKPKKNLPLQNTSREGLHSSKSCQSYVGMVTWL

SEQ ID NO: 25472 - protein, 67 aa, Diabrotica virgifera
  misc_feature: Coding regions on vcDNA: vcDNA=SeqID_5169; Strand=+; Position=241-441
  misc_feature (25)..(25): Xaa can be any naturally occurring amino acid
  misc_feature (32)..(39): Xaa can be any naturally occurring amino acid
  misc_feature (45)..(51): Xaa can be any naturally occurring amino acid
NSAFFILLGRAPGHAAIAAYCYKYXKKKYRMXXXXXXXXGNLKAXXXXXXXPFKMHSPNGTIFNKQN

SEQ ID NO: 25473 - protein, 139 aa, Diabrotica virgifera
  misc_feature: Coding regions on vcDNA: vcDNA=SeqID_5170; Strand=+; Position=57-473
  misc_feature: Homolog annotation: Hit_ID=XP_312889.1; Match level="QueryCoverage =97%, HitCoverage=44%, E-value=6e-25, Identity=41%"; Hit description =ENSANGP00000014748 [Anopheles gambiae]
  misc_feature: Gene Ontology Annotation: Molecular function=soluble NSF attachment protein activity; Biological process=synaptic vesicle priming
  misc_feature: Pfam annotation: Pfam_ID=NSF; Match level="Score=35.0, E-value=2.2e -07, Copies=4"; Pfam description=Aromatic-di-Alanine (AdAR) repeat
MSHIEFKALQLQEEAQRKVKSAGFLQSLFLRSTSKSEESIEYYKRAGNLFKMVKKWKQAGSAFMDAANLCYKAKNFTEAALEYIEAANCFKNCDTEMAIKAYKEAVKLYRNNGKYSAVAKNYEAMSELLQEDYNNQGAE

SEQ ID NO: 25474 - protein, 56 aa, Diabrotica virgifera
  misc_feature: Coding regions on vcDNA: vcDNA=SeqID_5171; Strand=+; Position=1-168
PRSTYAIRKRVRGRLGGRIGTVLVTGFKSLRGNFCDYDKVSSLSGDNDGDIRPHAC

SEQ ID NO: 25475 - protein, 110 aa, Diabrotica virgifera
  misc_feature: Coding regions on vcDNA: vcDNA=SeqID_5172; Strand=+; Position=114-443
  misc_feature (2)..(18): Xaa can be any naturally occurring amino acid
  misc_feature (83)..(83): Xaa can be any naturally occurring amino acid
  misc_feature (107)..(107): Xaa can be any naturally occurring amino acid
GXXXXXXXXXXXXXXXXXVGLLNPQRSPFIRERSPLNSERNSLEQYGSNSGNNIEILDFKPPQDNSGNGIAPSKGNNFGPIPXGCVRVKMWIGKGISFSDSTRIVRXLSQ

SEQ ID NO: 25476 - protein, 79 aa, Diabrotica virgifera
  misc_feature: Coding regions on vcDNA: vcDNA=SeqID_5173; Strand=+; Position=198-434
MSINGKEKPGSKQPLLGNDKQTSFKLRPRINTTSLPYIRTVAKDGDCNIYPSNVQKRRFLRDIFTTLIDMKWRYTFTVF

SEQ ID NO: 25477 - protein, 23 aa, Diabrotica virgifera
  misc_feature: Coding regions on vcDNA: vcDNA=SeqID_5174; Strand=+; Position=3-71
ATAVTTCLQSYLCIVWSGNLAYA

SEQ ID NO: 25478 - protein, 136 aa, Diabrotica virgifera
  misc_feature: Coding regions on vcDNA: vcDNA=SeqID_5175; Strand=+; Position=24-431
  misc_feature: Homolog annotation: Hit_ID=NP_524174.1; Match level="QueryCoverage =97%, HitCoverage=72%, E-value=1e-23, Identity=42%"; Hit description =CG7445-PA [Drosophila melanogaster] gb|AAF49084.1| CG7445-PA [Drosophila melanogaster]
  misc_feature: Gene Ontology Annotation: Cellular component=striated muscle thick filament
AEEAPAEGEAPAEGAAEEERPEAEEEYLDPDKLILFKHWIRPKFLPYKYLYIYRQNYYDDVMDYLDKRTRGIDREIPKAQTWAERVLRTFSNRTTQNNTYTRRIRNDLEMVEKTRTSGQFYYYHGKNSFNRQFSKL

SEQ ID NO: 25479 - protein, 114 aa, Diabrotica virgifera
  misc_feature: Coding regions on vcDNA: vcDNA=SeqID_5176; Strand=+; Position=106-447
  misc_feature: Homolog annotation: Hit_ID=NP_830279.1; Match level="QueryCoverage =97%, HitCoverage=74%, E-value=1e-17, Identity=43%"; Hit description =surface protein [Bacillus cereus ATCC 14579] gb|AAP07480.1| surface protein [Bacillus cereus ATCC
  misc_feature: Gene Ontology Annotation: Biological process=regulation of protein activity, epigenetic
LRKTTHYQNPIPQDKSNDIDNGADKGGPDTKGSDNGKDGPDNDSKKGGPDNGTDKGGPDSKGNGGKDSGEKGNGGNGSGEKGNGGKGSGEKGNGGKGNGNSSEGNGNGDDNDCD

SEQ ID NO: 25480 - protein, 113 aa, Diabrotica virgifera
  misc_feature: Coding regions on vcDNA: vcDNA=SeqID_5177; Strand=+; Position=75-413
  misc_feature: Homolog annotation: Hit_ID=XP_312117.1; Match level="QueryCoverage =75%, HitCoverage=8%, E-value=2e-19, Identity=54%"; Hit description =ENSANGP00000016771 [Anopheles gambiae]
  misc_feature: Gene Ontology Annotation: Molecular function=kainate selective glutamate receptor activity; Cellular component=integral to plasma membrane; Biological process=glutamate signaling pathway
  misc_feature (18)..(27): Xaa can be any naturally occurring amino acid
TVEIRVHHVPKSGGNFRXXXXXXXXXXATHFVLDCSIEILEEVLKQAQQVGLMTNKHNFIITNLDLHTIELMPYQYSETNITGMRFVDPDDEGLAEKAKKIYKQNLQVFTGYK

SEQ ID NO: 25481 - protein, 138 aa, Diabrotica virgifera
  misc_feature: Coding regions on vcDNA: vcDNA=SeqID_5178; Strand=+; Position=48-461
  misc_feature (10)..(16): Xaa can be any naturally occurring amino acid
VLKTTKKMDXXXXXXXQDESQIEEQMQPACLGICDCNLRCCECYNTGLAMIEFERKDKRRKGMKKADEVDNFKIQLDKSPYVVSRDYYIKTCEVPSYKDAKRTLGNLATFVYNYCEPGLKPYIPSEPQMPYGDLWISP

SEQ ID NO: 25482 - protein, 157 aa, Diabrotica virgifera
  misc_feature: Coding regions on vcDNA: vcDNA=SeqID_5179; Strand=+; Position=1-471
  misc_feature: Homolog annotation: Hit_ID=XP_392573.1; Match level="QueryCoverage =87%, HitCoverage=6%, E-value=3e-21, Identity=38%"; Hit description =similar to ENSANGP00000003488 [Apis mellifera]
  misc_feature: Gene Ontology Annotation: Molecular function=RNA polymerase II transcription factor activity; Cellular component=nucleus; Biological process=transcription from Pol II promoter
  misc_feature: Pfam annotation: Pfam_ID=WW; Match level="Score=33.3, E-value=7e-07, Copies=1"; Pfam description=WW domain
FRGHPRVRTGWPVPPGAPWPIPPALFSGGALAAIDEAAVMSKIDPEIIAKASEWTEHKGPDGRFYYYNAKKGESVWEKPQPLKDLETAKLAAAQGISTKPAGETAGETGKTLSTPNGALTKEEQDKGNEEKIKKLQEEIKRKKEEDEKAKELKLLIN

SEQ ID NO: 25483 - protein, 46 aa, Diabrotica virgifera
  misc_feature: Coding regions on vcDNA: vcDNA=SeqID_5180; Strand=+; Position=3-139
  misc_feature: Homolog annotation: Hit_ID=XP_317070.1; Match level="QueryCoverage =97%, HitCoverage=10%, E-value=6e-13, Identity=84%"; Hit description =ENSANGP00000006644 [Anopheles gambiae]
  misc_feature (9)..(9): Xaa can be any naturally occurring amino acid
  misc_feature (29)..(29): Xaa can be any naturally occurring amino acid
GTYRMDILXQKSTGQWYEMQDLHVTDILXQMITLTEAYIQIYELRT

SEQ ID NO: 25484 - protein, 101 aa, Diabrotica virgifera
  misc_feature: Coding regions on vcDNA: vcDNA=SeqID_5181; Strand=+; Position=2-307
  misc_feature (5)..(16): Xaa can be any naturally occurring amino acid
  misc_feature (28)..(96): Xaa can be any naturally occurring amino acid
FKKYXXXXXXXXXXXXPLHLQLNIFTLXXXXXXXXXXXXXXXXXXXXXXXXXXXXXXXXXXXXXXXXXXXXXXXXXXXXXXXXXXXXXXXXXXXXXKKMYI

SEQ ID NO: 25485 - protein, 104 aa, Diabrotica virgifera
  misc_feature: Coding regions on vcDNA: vcDNA=SeqID_5182; Strand=-; Position=2-313
  misc_feature (91)..(100): Xaa can be any naturally occurring amino acid
SCYYSSLITISIVGKLLKGNNVSPNKKFSQKRTHGLSMLKGTYFMQHINVFVRMVITAIFTVIKLTAFENVCNLRTNVFNFLCDKNLENVXXXXXXXXXXCVCG

SEQ ID NO: 25486 - protein, 56 aa, Diabrotica virgifera
  misc_feature: Coding regions on vcDNA: vcDNA=SeqID_5183; Strand=-; Position=161-331
AMYNTVKPVLTATCTNDQFKNSPKQLYVDSLIYDLVLTATFIIRTRLNNLTFLKPS

SEQ ID NO: 25487 - protein, 60 aa, Diabrotica virgifera
  misc_feature: Coding regions on vcDNA: vcDNA=SeqID_5184; Strand=+; Position=120-302
  misc_feature (3)..(9): Xaa can be any naturally occurring amino acid
IRXXXXXXXEQQDGDENYQKKIRVKEFSNRFSRNYLYPIVKQIDELSKFKQIHPTTIIRC

SEQ ID NO: 25488 - protein, 73 aa, Diabrotica virgifera
  misc_feature: Coding regions on vcDNA: vcDNA=SeqID_5185; Strand=+; Position=199-417
MRICFRNVISTWSSGTGGARVIGAATYAILAQVHLEMRTILQILLVVPVAMGLAFAHALEIQNLVNSDELKNP

SEQ ID NO: 25489 - protein, 55 aa, Diabrotica virgifera
  misc_feature: Coding regions on vcDNA: vcDNA=SeqID_5186; Strand=-; Position=2-166
RYVSLFKEVSVLAHFVATLPNTGRDENEINKRLLKESRVLGSLNTLTRVRTRGWP

SEQ ID NO: 25490 - protein, 76 aa, Diabrotica virgifera
  misc_feature: Coding regions on vcDNA: vcDNA=SeqID_5187; Strand=-; Position=17-247
CEKFSDSVSLRIFVKIVPFQQIERIFLDKICLSNFLRKTEVSLFRKKENVLIMGAASQHLLELTNGNSPNFFVRFS

SEQ ID NO: 25491 - protein, 78 aa, Diabrotica virgifera
  misc_feature: Coding regions on vcDNA: vcDNA=SeqID_5188; Strand=+; Position=192-425
ARKMKFWLILVCYTWIFAECHTTKNRTALFEQIKKGIEEIKTFNKASATFETAIKEYNIPNIFTSSPDNFDKEEVCST

SEQ ID NO: 25492 - protein, 124 aa, Diabrotica virgifera
  misc_feature: Coding regions on vcDNA: vcDNA=SeqID_5189; Strand=+; Position=1-372
  misc_feature: Homolog annotation: Hit_ID=NP_788055.2; Match level="QueryCoverage =79%, HitCoverage=10%, E-value=1e-26, Identity=57%"; Hit description =CG33090-PB [Drosophila melanogaster] gb|AAO41192.2| CG33090-PB [Drosophila melanogaster]
  misc_feature (95)..(95): Xaa can be any naturally occurring amino acid
  misc_feature (107)..(107): Xaa can be any naturally occurring amino acid
VRIRIRGRVGLEDSIYNWQKDVLKDRNTYGHFAYLQGQEYTMYNSYDVHFYASHALHKNWPMLQKCLQYDLRDFISVEINEPVKVLYNGKLMERXYPSTVPHDARSXGEEPLTLINAYPIHDVS

SEQ ID NO: 25493 - protein, 48 aa, Diabrotica virgifera
  misc_feature: Coding regions on vcDNA: vcDNA=SeqID_5190; Strand=+; Position=1-144
HTRTAVELKSNFQTSNNLGFGNSSNFKQRKNNNKSKFGGLMASLAIGG

SEQ ID NO: 25494 - protein, 44 aa, Diabrotica virgifera
  misc_feature: Coding regions on vcDNA: vcDNA=SeqID_5191; Strand=-; Position=4-138
  misc_feature (13)..(19): Xaa can be any naturally occurring amino acid
  misc_feature (32)..(41): Xaa can be any naturally occurring amino acid
FFSNYFLLIQWSXXXXXXXLKNLVLFKTDYHXXXXXXXXXXIYH

SEQ ID NO: 25495 - protein, 141 aa, Diabrotica virgifera
  misc_feature: Coding regions on vcDNA: vcDNA=SeqID_5192; Strand=+; Position=2-427
  misc_feature: Homolog annotation: Hit_ID=XP_394433.1; Match level="QueryCoverage =91%, HitCoverage=9%, E-value=3e-39, Identity=63%"; Hit description =similar to ENSANGP00000005866 [Apis mellifera]
  misc_feature (21)..(27): Xaa can be any naturally occurring amino acid
PRVRNDWNNETPQFGYEIQDXXXXXXXATIEKPANIPFVLAFPSVLYQTRVGGYQAEISLPLGMVVNAVFKNQHWLYVQTPHAREGYVSYAACLPLGIIPPPEDDKLARCWEKSTDVFSKASGNLTDIEKLSSKSDCEGGG

SEQ ID NO: 25496 - protein, 77 aa, Diabrotica virgifera
  misc_feature: Coding regions on vcDNA: vcDNA=SeqID_5193; Strand=+; Position=1-231
  misc_feature (21)..(31): Xaa can be any naturally occurring amino acid
GRIKRNGPLSQLWANHKIFKXXXXXXXXXXXACGDCGSYGQCCGSPCSPPMYPHAVRCTSCPPSGILSTKPRPMKPL

SEQ ID NO: 25497 - protein, 36 aa, Diabrotica virgifera
  misc_feature: Coding regions on vcDNA: vcDNA=SeqID_5194; Strand=-; Position=2-109
FPRGISLESILVSTSFPWLLVLCFLLIPSFLADAWS

SEQ ID NO: 25498 - protein, 110 aa, Diabrotica virgifera
  misc_feature: Coding regions on vcDNA: vcDNA=SeqID_5195; Strand=+; Position=83-412
YMKNLSFFRYAILVPSLNAIPVDVIQRNIPVEVRYDQILPGIVSREQVRMHGRTNLDATVQLSSYELPHVVKHLPIPLESDLVPELVSDDKVQVASEVGNNAVNSLLQPA

SEQ ID NO: 25499 - protein, 62 aa, Diabrotica virgifera
  misc_feature: Coding regions on vcDNA: vcDNA=SeqID_5196; Strand=+; Position=63-251
  misc_feature: Pfam annotation: Pfam_ID=HRM; Match level="Score=2.0, E-value=0.024, Copies=1"; Pfam description=Hormone receptor domain
HYLSKKCYRTHHFNVTKDGMCPRSYDGRLRWHPTNAGELAVRSCSWDILESTQQGLATWQCL

SEQ ID NO: 25500 - protein, 132 aa, Diabrotica virgifera
  misc_feature: Coding regions on vcDNA: vcDNA=SeqID_5197; Strand=+; Position=1-399
  misc_feature (27)..(27): Xaa can be any naturally occurring amino acid
  misc_feature (42)..(42): Xaa can be any naturally occurring amino acid
HTRPASTSSSICSADDRSTKVAKVRAXKSSRIIVLQPTASSXKNPRKSPRQHASTLAILSDLVQQRKRRSKHRQPVEDINNPLATSMMTRNIIGSGARRSCTRTSSSSSISISSPSTRKRLPSKSSKPIHSC

SEQ ID NO: 25501 - protein, 71 aa, Diabrotica virgifera
  misc_feature: Coding regions on vcDNA: vcDNA=SeqID_5198; Strand=+; Position=3-218
  misc_feature (13)..(25): Xaa can be any naturally occurring amino acid
HASAKMKLLRRIXXXXXXXXXXXXXSLEENVTYICTVLRRQRPSVVIYGGVSPSHKPLSLAVPLFHRPIRH

SEQ ID NO: 25502 - protein, 44 aa, Diabrotica virgifera
  misc_feature: Coding regions on vcDNA: vcDNA=SeqID_5199; Strand=-; Position=72-206
VRLLCKYQHVQWWLLPCILSHSLLRHPQKSLNRSYTKYRRPNLM

SEQ ID NO: 25503 - protein, 62 aa, Diabrotica virgifera
  misc_feature: Coding regions on vcDNA: vcDNA=SeqID_5200; Strand=+; Position=28-216
CCRLLMYVISVKYHIYIRFGRRYLLLLKFNDFCLCRYRLNECKHRNSQNCNCWYLHMNRTYT

SEQ ID NO: 25504 - protein, 142 aa, Diabrotica virgifera
  misc_feature: Coding regions on vcDNA: vcDNA=SeqID_5201; Strand=-; Position=2-427
  misc_feature: Homolog annotation: Hit_ID=AAC60281.1; Match level="QueryCoverage =54%, HitCoverage=7%, E-value=5e-13, Identity=42%"; Hit description =unknown [Gallus gallus]
  misc_feature (80)..(86): Xaa can be any naturally occurring amino acid
FNGTDIANLFANQFFSIYTNQSLHPHVTQDSPFVNVSNYHHEISKIYGKLFELNTNKGPGPDGIPPTFLKAFSFILSRPXXXXXXXSLLTGEFPDYWKNSYVTPIYKSGRKSDIGNYRPICILRAIRPNNSDLHPKNQQNWV

SEQ ID NO: 25505 - protein, 122 aa, Diabrotica virgifera
  misc_feature: Coding regions on vcDNA: vcDNA=SeqID_5202; Strand=+; Position=78-443
  misc_feature: Homolog annotation: Hit_ID=EAL29934.1; Match level="QueryCoverage =94%, HitCoverage=10%, E-value=9e-31, Identity=57%"; Hit description =GA20548-PA [Drosophila pseudoobscura]
  misc_feature: Gene Ontology Annotation: Molecular function=GTP binding; Cellular component=nucleolus; Biological process=rRNA processing
  misc_feature (98)..(107): Xaa can be any naturally occurring amino acid
MEEDTSTKKKAHRDRHSGRKLEKKKAKKVTQNGEVGAKERNPKAFAFNSAVRAERRFRRKEDIDTKKQHVPLVDRTPIEPPPIVVAVVGPPKVGKSTXXXXXXXXXXKLPLTNINGPVTIVT

SEQ ID NO: 25506 - protein, 147 aa, Diabrotica virgifera
  misc_feature: Coding regions on vcDNA: vcDNA=SeqID_5203; Strand=+; Position=2-442
  misc_feature: Homolog annotation: Hit_ID=XP_531823.1; Match level="QueryCoverage =99%, HitCoverage=7%, E-value=9e-23, Identity=32%"; Hit description =PREDICTED: similar to KIAA0077 [Canis familiaris]
  misc_feature (89)..(89): Xaa can be any naturally occurring amino acid
PRVRVDPFSFSKQSVINRDVKPGVQEDSKWLIHSDRNIPKNVEQWEERMYIHDQYTGYYCWPKTLELYDTPSTQKTAAKRLDDLTEIEXDVYTFFNNKENIEKLIKFLSLDEKKGRDHFNAYRFLAFKNLFTIFEDSLLPNFVPHLQ

SEQ ID NO: 25507 - protein, 43 aa, Diabrotica virgifera
  misc_feature: Coding regions on vcDNA: vcDNA=SeqID_5204; Strand=+; Position=126-257
CYLRPSTRKITGSVQWSACYSPFAKLNWPVILVRNLFVFGQFC

SEQ ID NO: 25508 - protein, 32 aa, Diabrotica virgifera
  misc_feature: Coding regions on vcDNA: vcDNA=SeqID_5205; Strand=+; Position=164-259
IRCDDDVAALVVDIGSGMCTAGFAGEDAPSSC

SEQ ID NO: 25509 - protein, 45 aa, Diabrotica virgifera
  misc_feature: Coding regions on vcDNA: vcDNA=SeqID_5206; Strand=-; Position=142-279
ATCANDQFRILTMQYDLEYVIYAVGSTATSLIRAGLNDLTLIMHT

SEQ ID NO: 25510 - protein, 137 aa, Diabrotica virgifera
  misc_feature: Coding regions on vcDNA: vcDNA=SeqID_5207; Strand=+; Position=22-436
  misc_feature: Homolog annotation: Hit_ID=AAA29354.1; Match level="QueryCoverage =94%, HitCoverage=14%, E-value=1e-10, Identity=33%"; Hit description =reverse transcriptase-like protein
  misc_feature (113)..(113): Xaa can be any naturally occurring amino acid
VRTRYIQELDPNKSGFWKVSKILRNERKPIPALHGANGIVYTEKEKAEVMKDTLELGSTKNFHQEEDLDFTIEVENNARRLRRRKGRIALEHTSPEEIKELLKMANAKKAPGXDNITNKALKNLPTKIIVYITNIVY

SEQ ID NO: 25511 - protein, 81 aa, Diabrotica virgifera
  misc_feature: Coding regions on vcDNA: vcDNA=SeqID_5208; Strand=+; Position=32-274
YAVVTTTYEAYDYETTFSVSDTSRLDDFVLAPRTTILALSQIGCHMEYGKRYVVTNHGNSDLYVEVVHLNIQGWCSNNGLW

SEQ ID NO: 25512 - protein, 121 aa, Diabrotica virgifera
  misc_feature: Coding regions on vcDNA: vcDNA=SeqID_5209; Strand=+; Position=97-459
  misc_feature (102)..(102): Xaa can be any naturally occurring amino acid
YKCNTQETQRMSINSQFASRSLRQHLNLNPNTPRKNEDYAAKGEDTMHGCNVRDEVLAKYWEDGKYYNATVISVTPRTFAVRVTGYGNIKEILKLIVYKYRXTMRDQAVIKISNMNIIDNT

SEQ ID NO: 25513 - protein, 87 aa, Diabrotica virgifera
  misc_feature: Coding regions on vcDNA: vcDNA=SeqID_5210; Strand=-; Position=34-297
MFSPARVSNPGLPACESDILQPELRRPLLNSKMLTDKLTIILYILRSRSAVLNLWYMYHWWYISLFEVVRKVKTAKISTTIGTIIVN

SEQ ID NO: 25514 - protein, 69 aa, Diabrotica virgifera
  misc_feature: Coding regions on vcDNA: vcDNA=SeqID_5211; Strand=+; Position=2-208
RDPQIPVDLGDRFSYICAIGGADLGCFGIPNTSYTCLYHQCHFDQSLRSGVLTVKIDWTRDIVSANVSL

SEQ ID NO: 25515 - protein, 85 aa, Diabrotica virgifera
  misc_feature: Coding regions on vcDNA: vcDNA=SeqID_5212; Strand=-; Position=2-256
SSEQRIPVSSSLTFGFWFQTIHRLGHRAKFNQLPVFIPVVKGLNRRIVSNLAFSFPNLAWLLFGVGLYCCSRLTNSQLIPEGWWA

SEQ ID NO: 25516 - protein, 112 aa, Diabrotica virgifera
  misc_feature: Coding regions on vcDNA: vcDNA=SeqID_5213; Strand=+; Position=1-336
VRIRNRSHIFVITVLITHTGIHQTDAFVLLVYYCGDRHYPHSSPDYQSIDLQNGVVVGGPHTHGSDNGNDGHDNETTIGGPDDGTDKRGLYINVNGCMYTGQTRNACNSISH

SEQ ID NO: 25517 - protein, 132 aa, Diabrotica virgifera
  misc_feature: Coding regions on vcDNA: vcDNA=SeqID_5214; Strand=-; Position=1-396
  misc_feature: Homolog annotation: Hit_ID=XP_309688.1; Match level="QueryCoverage =78%, HitCoverage=55%, E-value=1e-15, Identity=42%"; Hit description =ENSANGP00000023551 [Anopheles gambiae]
  misc_feature (7)..(7): Xaa can be any naturally occurring amino acid
  misc_feature (11)..(11): Xaa can be any naturally occurring amino acid
  misc_feature (20)..(28): Xaa can be any naturally occurring amino acid
LPEQMSXDNVXQWISEEFSXXXXXXXXXHICTAPYHPASNGQAERAVQSFKKALLSSKFDSDETEQRLLSWLLSYRTAPHISTGKAPCELMFGRVLRTRLSVIKDSVLIPKQNINSKTVKQFLPDDHLHADA

SEQ ID NO: 25518 - protein, 68 aa, Diabrotica virgifera
  misc_feature: Coding regions on vcDNA: vcDNA=SeqID_5215; Strand=+; Position=1-207
  misc_feature (5)..(13): Xaa can be any naturally occurring amino acid
HASAXXXXXXXXXFMLWKFRNGIYAFTTHRHVMSFITSRADLTLGGVVVSHLSSSLPSYGNVLETELI

SEQ ID NO: 25519 - protein, 58 aa, Diabrotica virgifera
  misc_feature: Coding regions on vcDNA: vcDNA=SeqID_5216; Strand=-; Position=120-296
HCSYNITVIRLVFRLYLQLLCSSAFRVTSCAFILTSSFVVSSGGSGCRVVWYSNAFYG

SEQ ID NO: 25520 - protein, 98 aa, Diabrotica virgifera
  misc_feature: Coding regions on vcDNA: vcDNA=SeqID_5217; Strand=-; Position=1-294
  misc_feature (9)..(27): Xaa can be any naturally occurring amino acid
  misc_feature (30)..(98): Xaa can be any naturally occurring amino acid
ILILSSILXXXXXXXXXXXXXXXXXXXNSXXXXXXXXXXXXXXXXXXXXXXXXXXXXXXXXXXXXXXXXXXXXXXXXXXXXXXXXXXXXXXXXXXXXX

SEQ ID NO: 25521 - protein, 148 aa, Diabrotica virgifera
  misc_feature: Coding regions on vcDNA: vcDNA=SeqID_5218; Strand=+; Position=2-445
  misc_feature: Homolog annotation: Hit_ID=XP_313055.1; Match level="QueryCoverage =98%, HitCoverage=86%, E-value=2e-48, Identity=48%"; Hit description =ENSANGP00000011681 [Anopheles gambiae]
  misc_feature: Gene Ontology Annotation: Molecular function=structural molecule activity; Cellular component=collagen type IV; Biological process =negative regulation of cell proliferation
  misc_feature: Pfam annotation: Pfam_ID=Collagen; Match level="Score=56.7, E-value =6.6e-14, Copies=1"; Pfam description=Collagen triple helix repeat (20 copie
STDPSAGIIEGPPGPPGPPGAKGDSGVMGPPGISGLNGEPGLQGPPGLPGSTGDKGDKGDYGDIGPPGLMGPPGLPGPPGYPGQKGEKGEKGDSKYKKLRRRQGDGTGEFSTGELIMGPPGPPGPPGVPGLQGPPGIKGDRGADGLKG

SEQ ID NO: 25522 - protein, 68 aa, Diabrotica virgifera
  misc_feature: Coding regions on vcDNA: vcDNA=SeqID_5219; Strand=-; Position=209-415
  misc_feature (56)..(62): Xaa can be any naturally occurring amino acid
SYSTGIFGSSRKLFASQNLESVLKTKAILPNTKFLHNIFFSVSTFSLLIADGYYLXXXXXXXELVLKY

SEQ ID NO: 25523 - protein, 62 aa, Diabrotica virgifera
  misc_feature: Coding regions on vcDNA: vcDNA=SeqID_5220; Strand=-; Position=0-185
  misc_feature (4)..(59): Xaa can be any naturally occurring amino acid
  misc_feature (61)..(61): Xaa can be any naturally occurring amino acid
IITXXXXXXXXXXXXXXXXXXXXXXXXXXXXXXXXXXXXXXXXXXXXXXXXXXXXXXXXHXL

SEQ ID NO: 25524 - protein, 66 aa, Diabrotica virgifera
  misc_feature: Coding regions on vcDNA: vcDNA=SeqID_5221; Strand=-; Position=2-199
  misc_feature (22)..(22): Xaa can be any naturally occurring amino acid
  misc_feature (37)..(43): Xaa can be any naturally occurring amino acid
  misc_feature (47)..(60): Xaa can be any naturally occurring amino acid
IIIRRGDYTNLDGIINRSNTVXNTFIVKLKLDVGSKXXXXXXXLLHXXXXXXXXXXXXXXIIKRKL

SEQ ID NO: 25525 - protein, 75 aa, Diabrotica virgifera
  misc_feature: Coding regions on vcDNA: vcDNA=SeqID_5222; Strand=-; Position=166-393
TMFWLTEDILYYNQGKMDIFYLFLTVKYWYVELTPWLHLDIFIFLVENMVNRIYHHALQHSRRSQGVNAGAIKYI

SEQ ID NO: 25526 - protein, 119 aa, Diabrotica virgifera
  misc_feature: Coding regions on vcDNA: vcDNA=SeqID_5223; Strand=+; Position=94-450
  misc_feature: Homolog annotation: Hit_ID=XP_394756.1; Match level="QueryCoverage =100%, HitCoverage=33%, E-value=8e-11, Identity=37%"; Hit description= similar to ENSANGP00000021019 [Apis mellifera]
  misc_feature (81)..(81): Xaa can be any naturally occurring amino acid
MAHRFPGPVPYHHLGRPPPQRYQQQPPNQGIRQYAQQIFPQRPGYNPRPANIPSNGGTMIHRPAGAPYSPFRRGIIPPQQXFTMPADNRTHMQHRSNEYIHTTCKKNDKLAVNILPHKV

SEQ ID NO: 25527 - protein, 128 aa, Diabrotica virgifera
  misc_feature: Coding regions on vcDNA: vcDNA=SeqID_5224; Strand=+; Position=53-436
  misc_feature: Homolog annotation: Hit_ID=XP_308451.1; Match level="QueryCoverage =95%, HitCoverage=85%, E-value=7e-25, Identity=42%"; Hit description =ENSANGP00000017907 [Anopheles gambiae] gb|EAA04262.1| ENSANGP00000017907 [Anopheles gambiae
MSGIMSSRIPMIRRVIPIVARRFVSTSQKKNVTAEAVDAAKSKAKVADQNWISYGYEYTSKTDDRNAMHSIMFVSITLCIVMGTLFFAYMPDYNLRDWAQREAFLELRRREEQGLPPIDANFVDPSKI

SEQ ID NO: 25528 - protein, 104 aa, Diabrotica virgifera
  misc_feature: Coding regions on vcDNA: vcDNA=SeqID_5225; Strand=+; Position=2-316
  misc_feature: Homolog annotation: Hit_ID=XP_395483.1; Match level="QueryCoverage =69%, HitCoverage=23%, E-value=5e-31, Identity=79%"; Hit description =similar to ENSANGP00000010382 [Apis mellifera]
  misc_feature: Pfam annotation: Pfam_ID=EI24; Match level="Score=-167.3, E-value =0.073, Copies=1"; Pfam description=Etoposide-induced protein 2.4 (EI24)
  misc_feature (73)..(98): Xaa can be any naturally occurring amino acid
LYSLYAFEYKWFNMGWELHKRLSFIETHWPYFMGFGLPMAIVTQLSDSWVISGCVFSVLFPFFIISGNEASPXXXXXXXXXXXXXXXXXXXXXXXXXXIGSSKR

SEQ ID NO: 25529 - protein, 93 aa, Diabrotica virgifera
  misc_feature: Coding regions on vcDNA: vcDNA=SeqID_5226; Strand=-; Position=3-281
LYIIIINNLVKRLVEMKCIIPKFKNIFYLGTVVNSKYETTEIRSRVEKDIATFNNMHEKYFHPLRYNISPTKNAAVKMLLFPVLLYGAEAWTI

SEQ ID NO: 25530 - protein, 50 aa, Diabrotica virgifera
  misc_feature: Coding regions on vcDNA: vcDNA=SeqID_5227; Strand=+; Position=20-172
QGHLCQIAIMKFVVSYLTNVEDFKNITVIVYIHIKMLTITVMFLYECIFI

SEQ ID NO: 25531 - protein, 55 aa, Diabrotica virgifera
  misc_feature: Coding regions on vcDNA: vcDNA=SeqID_5228; Strand=-; Position=19-186
  misc_feature (13)..(27): Xaa can be any naturally occurring amino acid
  misc_feature (30)..(52): Xaa can be any naturally occurring amino acid
TRRKNFDNYLLNXXXXXXXXXXXXXXXLLXXXXXXXXXXXXXXXXXXXXXXXKNT

SEQ ID NO: 25532 - protein, 99 aa, Diabrotica virgifera
  misc_feature: Coding regions on vcDNA: vcDNA=SeqID_5229; Strand=-; Position=133-432
  misc_feature (62)..(73): Xaa can be any naturally occurring amino acid
  misc_feature (84)..(89): Xaa can be any naturally occurring amino acid
HLVVDGKSYRLTFPTSAIIILFRANFAKRILLKSKRSYPFIRILPMSVFLKLFLLKTLENVXXXXXXXXXXXXGYSIISRKFVXXXXXXHFGQLCIAGS

SEQ ID NO: 25533 - protein, 145 aa, Diabrotica virgifera
  misc_feature: Coding regions on vcDNA: vcDNA=SeqID_5230; Strand=+; Position=3-437
  misc_feature: Homolog annotation: Hit_ID=XP_315098.1; Match level="QueryCoverage =84%, HitCoverage=3%, E-value=3e-11, Identity=30%"; Hit description =ENSANGP00000010787 [Anopheles gambiae]
  misc_feature: Pfam annotation: Pfam_ID=Laminin_II; Match level="Score=29.5, E-value= 1e-05, Copies=1"; Pfam description=Laminin Domain II
  misc_feature (50)..(50): Xaa can be any naturally occurring amino acid
  misc_feature (107)..(107): Xaa can be any naturally occurring amino acid
QTADDAAESVGEVKESVSTSYNNLPNETAQAQLLPIEVDDMQRNLVQTEXHINTVNEKLRAVFESIEELAALQSDTKRSSDMIKSNLNKLTQQIDLARDIANRIKLXVKFFTNTTLVLRNPKSLEALSTSSKFSGYFKTNERQGL

SEQ ID NO: 25534 - protein, 139 aa, Diabrotica virgifera
  misc_feature: Coding regions on vcDNA: vcDNA=SeqID_5231; Strand=+; Position=3-422
  misc_feature: Homolog annotation: Hit_ID=XP_318845.1; Match level="QueryCoverage =70%, HitCoverage=54%, E-value=1e-16, Identity=46%"; Hit description =ENSANGP00000014460 [Anopheles gambiae]
SGNRKRSCLAHYHHQIHYCSLFLHHSPLTSICNIPVPVPVKAPVPIDRPHPVHVPKPYTVPVEKPLPCSVNPMVPYPVIVPYSVHHPVPHPVPVRNPVSNTVHKPMPYTVNVPVIVNMIVSVIVHGHDDHGIGSRFDSG

SEQ ID NO: 25535 - protein, 99 aa, Diabrotica virgifera
  misc_feature: Coding regions on vcDNA: vcDNA=SeqID_5232; Strand=+; Position=152-448
  misc_feature: Homolog annotation: Hit_ID=XP_397400.1; Match level="QueryCoverage =89%, HitCoverage=20%, E-value=8e-21, Identity=52%"; Hit description =similar to CG17161-PA [Apis mellifera]
  misc_feature: Gene Ontology Annotation: Molecular function=protein tyrosine kinase activity; Cellular component=nucleus; Biological process=G2/M transition of mitotic cell cycle
MAEDHDADCKTVFVEDWLCSSNILGEGAYGEVKLLEHKNTKEKIACKMIDHNKYKDASANINREVSIHKLLDHENIIKYYGRRQEPNKEYIFLEFAAGG

SEQ ID NO: 25536 - protein, 40 aa, Diabrotica virgifera
  misc_feature: Coding regions on vcDNA: vcDNA=SeqID_5233; Strand=-; Position=1-120
DPRTHSETHPQTPTAKHSGKERTHTQPTEKLVKTTRNKPD

SEQ ID NO: 25537 - protein, 111 aa, Diabrotica virgifera
  misc_feature: Coding regions on vcDNA: vcDNA=SeqID_5234; Strand=-; Position=1-332
  misc_feature: Homolog annotation: Hit_ID=AAC46945.1; Match level="QueryCoverage =79%, HitCoverage=25%, E-value=4e-13, Identity=45%"; Hit description =mariner transposase pir||S35520 transposase - lacewing
  misc_feature (49)..(49): Xaa can be any naturally occurring amino acid
MPDVLIEVSTSETIEKIHDMVLANRRLKVRDIMEAIGISHDSVVSILNXHLGMRKLSASWVPRLLTIDHKRNRVTISQGWLALFRRKMDELKKKTTAFGHEKSAFPLRQCK

SEQ ID NO: 25538 - protein, 18 aa, Diabrotica virgifera
  misc_feature: Coding regions on vcDNA: vcDNA=SeqID_5235; Strand=+; Position=28-81
VLTYFRVIVSFSDHVFTY

SEQ ID NO: 25539 - protein, 31 aa, Diabrotica virgifera
  misc_feature: Coding regions on vcDNA: vcDNA=SeqID_5236; Strand=+; Position=5-97
SNLLKSLQEFSDSTNFCINNYIPNPLTDIMP

SEQ ID NO: 25540 - protein, 65 aa, Diabrotica virgifera
  misc_feature: Coding regions on vcDNA: vcDNA=SeqID_5237; Strand=+; Position=1-195
  misc_feature (18)..(26): Xaa can be any naturally occurring amino acid
  misc_feature (29)..(36): Xaa can be any naturally occurring amino acid
  misc_feature (43)..(50): Xaa can be any naturally occurring amino acid
  misc_feature (56)..(62): Xaa can be any naturally occurring amino acid
FVNISSDNFYLLIANSYXXXXXXXXXRKXXXXXXXXHGLLLNXXXXXXXXFKRANXXXXXXXPRY

SEQ ID NO: 25541 - protein, 76 aa, Diabrotica virgifera
  misc_feature: Coding regions on vcDNA: vcDNA=SeqID_5238; Strand=+; Position=96-323
GVYSLVISHVPFIVNHIQHTHTVLDHVCHDRSARQWPRTLYRHQLLREHLPLCSCRPWMWKWMSFWLTLTLLGRWN

SEQ ID NO: 25542 - protein, 128 aa, Diabrotica virgifera
  misc_feature: Coding regions on vcDNA: vcDNA=SeqID_5239; Strand=+; Position=66-449
  misc_feature: Homolog annotation: Hit_ID=NP_730661.1; Match level="QueryCoverage =89%, HitCoverage=57%, E-value=2e-15, Identity=40%"; Hit description =CG32441-PB, isoform B [Drosophila melanogaster] gb|AAN12181.1| CG32441-PB, isoform B [Drosophila
  misc_feature (121)..(121): Xaa can be any naturally occurring amino acid
MIAFTRLVFVALIIATTSASTLEHDGSVTIRLQHSLTFQNPPVWTERGNITIVSLRLGQATVDQKPLLPEEKKLLRDLSAKNSYYQIKAIVTANDGSQKSFISTLKACMLAESELDDRLSXSIDYMGR

SEQ ID NO: 25543 - protein, 54 aa, Diabrotica virgifera
  misc_feature: Coding regions on vcDNA: vcDNA=SeqID_5240; Strand=-; Position=157-321
KCIMKKPYKRPEQDFEKYIESHNYTIGDKMKRVRNLKKFIKYEKHFERFEVLVI

SEQ ID NO: 25544 - protein, 25 aa, Diabrotica virgifera
  misc_feature: Coding regions on vcDNA: vcDNA=SeqID_5241; Strand=-; Position=26-103
MFVKGRNALGRGLISTLRCDIARPH

SEQ ID NO: 25545 - protein, 26 aa, Diabrotica virgifera
  misc_feature: Coding regions on vcDNA: vcDNA=SeqID_5242; Strand=-; Position=1-78
NLEYLNYAFVIYKINKFTNEPYAWRT

SEQ ID NO: 25546 - protein, 34 aa, Diabrotica virgifera
  misc_feature: Coding regions on vcDNA: vcDNA=SeqID_5243; Strand=-; Position=1-102
RRTLQQCLIKIEINCKLFIYLLNINKPGRAGGRV

SEQ ID NO: 25547 - protein, 79 aa, Diabrotica virgifera
  misc_feature: Coding regions on vcDNA: vcDNA=SeqID_5244; Strand=+; Position=1-240
PTRTLDHLSLVYLNVSAYYPSTGRHVALGVTGNVRLLCSHRSQIYIRSSPYYPLTVDFTLISPNARTRTLQIEDSRIGQ

SEQ ID NO: 25548 - protein, 29 aa, Diabrotica virgifera
  misc_feature: Coding regions on vcDNA: vcDNA=SeqID_5245; Strand=+; Position=185-274
MVSFLMCTLWFNYIYCIKMLIVYINIVID

SEQ ID NO: 25549 - protein, 43 aa, Diabrotica virgifera
  misc_feature: Coding regions on vcDNA: vcDNA=SeqID_5246; Strand=+; Position=2-130
  misc_feature (2)..(8): Xaa can be any naturally occurring amino acid
  misc_feature (23)..(36): Xaa can be any naturally occurring amino acid
IXXXXXXXLRKNFIKGKLIRMVXXXXXXXXXXXXXXTLGTRDY

SEQ ID NO: 25550 - protein, 122 aa, Diabrotica virgifera
  misc_feature: Coding regions on vcDNA: vcDNA=SeqID_5247; Strand=+; Position=2-367
RDILESNQDFRPFKHTSSSETECEVRPILKQNSREEPVRQRLSFCSEHTNIRDEPRPRTSRRSHTICTDFNVGDFNLDTRERDEMLNKPRPFSVRDLVKSFETDCSTGAIPKRSSLKRNSDR

SEQ ID NO: 25551 - protein, 116 aa, Diabrotica virgifera
  misc_feature: Coding regions on vcDNA: vcDNA=SeqID_5248; Strand=+; Position=51-398
  misc_feature: Homolog annotation: Hit_ID=EAL33354.1; Match level="QueryCoverage =95%, HitCoverage=15%, E-value=6e-19, Identity=41%"; Hit description =GA21070-PA [Drosophila pseudoobscura]
MSTSDVDVSQQVPNGTTTEKISEGMTSLKSMAQQVIDQAGLQNNQVILEPSKLQNQGKSDAHIPPLLGVAPLGAIPLQKEHQTQFQLMEAAYYHMPHPSDSERIRTYLPRSPCTTP

SEQ ID NO: 25552 - protein, 71 aa, Diabrotica virgifera
  misc_feature: Coding regions on vcDNA: vcDNA=SeqID_5249; Strand=+; Position=222-434
  misc_feature (15)..(21): Xaa can be any naturally occurring amino acid
FPVTNIGNIIKVIYXXXXXXXYRIEQNRIENARANFNKMRKVLCTRDLKLELSVSLARCYVFSTLFYVMEA

SEQ ID NO: 25553 - protein, 134 aa, Diabrotica virgifera
  misc_feature: Coding regions on vcDNA: vcDNA=SeqID_5250; Strand=+; Position=18-419
  misc_feature: Homolog annotation: Hit_ID=AAT47774.1; Match level="QueryCoverage =58%, HitCoverage=10%, E-value=9e-17, Identity=53%"; Hit description =AT19737p [Drosophila melanogaster]
MLILKHPVGRTRYKLGISGLTTLYHVKCYNDKTNEWYKPTDMNIYRSALSACVIDGLPNVHDYIHKHRDKLMEEKRQKMIALENHRNLVNDQNNNNNHDTIAAAVNANMQQLNILQQLNGHLNPALTPAHVPDP

SEQ ID NO: 25554 - protein, 73 aa, Diabrotica virgifera
  misc_feature: Coding regions on vcDNA: vcDNA=SeqID_5251; Strand=+; Position=1-219
  misc_feature (24)..(24): Xaa can be any naturally occurring amino acid
SQGIVIALAIVFECVARTLGPRCXPISFTAQFLLMFCESVDPESDWYYNDVFIRSHIHGKRSMSAYYIFRFHR

SEQ ID NO: 25555 - protein, 107 aa, Diabrotica virgifera
  misc_feature: Coding regions on vcDNA: vcDNA=SeqID_5252; Strand=+; Position=207-527
LFVRTGFSMTFFFKRYDVVYIDRNSRMKRLRRQIGQICLQVMGLPLIGAGVFTFVFFEAIYEFILAEALKFRPESRPYKAWSNNDPPFSMDIFRFNWANPEQIYTIS

SEQ ID NO: 25556 - protein, 52 aa, Diabrotica virgifera
  misc_feature: Coding regions on vcDNA: vcDNA=SeqID_5253; Strand=-; Position=97-255
  misc_feature (43)..(49): Xaa can be any naturally occurring amino acid
DLNSTLLCVLILCMKSIYKRFLIVVLLEENGILINRVDTGTHXXXXXXXIGE

SEQ ID NO: 25557 - protein, 65 aa, Diabrotica virgifera
  misc_feature: Coding regions on vcDNA: vcDNA=SeqID_5254; Strand=-; Position=174-371
YHLMMCGSQYTTTSIHILSILFYFLPFVLHHSKWFLFLPAVPQALCVFKSKTVYTCKNTLTSVKR

SEQ ID NO: 25558 - protein, 41 aa, Diabrotica virgifera
  misc_feature: Coding regions on vcDNA: vcDNA=SeqID_5255; Strand=+; Position=184-309
ARINVILCMWTVFKLLSLWRVQVQVSNLTCSDYTCTIARIG

SEQ ID NO: 25559 - protein, 155 aa, Diabrotica virgifera
  misc_feature: Coding regions on vcDNA: vcDNA=SeqID_5256; Strand=+; Position=126-592
  misc_feature: Homolog annotation: Hit_ID=XP_315339.1; Match level="QueryCoverage =99%, HitCoverage=71%, E-value=6e-67, Identity=77%"; Hit description =ENSANGP00000024002 [Anopheles gambiae]
  misc_feature: Gene Ontology Annotation: Molecular function=ubiquitin-protein ligase activity; Cellular component=proteasome complex (sensu Eukarya); Biological process=ubiquitin-dependent protein catabolism
  misc_feature: Pfam annotation: Pfam_ID=UQ_con; Match level="Score=102.1, E-value =1.4e-27, Copies=1"; Pfam description=Ubiquitin-conjugating enzyme
  misc_feature (62)..(62): Xaa can be any naturally occurring amino acid
  misc_feature (86)..(86): Xaa can be any naturally occurring amino acid
  misc_feature (93)..(93): Xaa can be any naturally occurring amino acid
  misc_feature (123)..(123): Xaa can be any naturally occurring amino acid
  misc_feature (130)..(130): Xaa can be any naturally occurring amino acid
MSGMSPSERRLQKELMSLIKEPPPGVSVDTDITEKNLLHWVINMDGAAGTLYEGEHFQLQFXFSNKYPFDSPEVTFVRTNIPIQPXVKIMGHXCLSILTDDWSPALSVQSVCLSIVSMLSNCXEKQRPPXDNSFYIKTCSKNPKKTKWWYHDDSV

SEQ ID NO: 25560 - protein, 57 aa, Diabrotica virgifera
  misc_feature: Coding regions on vcDNA: vcDNA=SeqID_5257; Strand=-; Position=187-360
  misc_feature (20)..(43): Xaa can be any naturally occurring amino acid
IIEVLETVKEYFFIPIWRFXXXXXXXXXXXXXXXXXXXXXXXXFSLIISMEQKIYLS

SEQ ID NO: 25561 - protein, 60 aa, Diabrotica virgifera
  misc_feature: Coding regions on vcDNA: vcDNA=SeqID_5258; Strand=-; Position=342-524
KQLFVNYKKHQNAKIRQNNSKNFNKLTATKVNKPKRQKLYLEYVKTSPIVFLCTYLFSMH

SEQ ID NO: 25562 - protein, 31 aa, Diabrotica virgifera
  misc_feature: Coding regions on vcDNA: vcDNA=SeqID_5259; Strand=+; Position=2-94
FVQFLAYAVHFIDVYVSSRSFCLQTIPCQSS

SEQ ID NO: 25563 - protein, 62 aa, Diabrotica virgifera
  misc_feature: Coding regions on vcDNA: vcDNA=SeqID_5260; Strand=-; Position=3-191
HFQHDQLRAISDPASNGLNHPHGESQAASRKVWSSWKPWQEALLKTAGIISHGRMCVRRSGG

SEQ ID NO: 25564 - protein, 132 aa, Diabrotica virgifera
  misc_feature: Coding regions on vcDNA: vcDNA=SeqID_5261; Strand=+; Position=2-397
INIPNERNVFLDLIFTNVCDLQVAKASDPIFKNSYHHISYTYNISLCEHRGKSLEYTEFYHDFVNADYEGLNNYLSMIPWEDHLNLSNVDDALTEFYNILNMSLSLFVPVKRFKTSSYPKWFDANLRYLVVQ

SEQ ID NO: 25565 - protein, 62 aa, Diabrotica virgifera
  misc_feature: Coding regions on vcDNA: vcDNA=SeqID_5262; Strand=-; Position=1-186
  misc_feature (46)..(46): Xaa can be any naturally occurring amino acid
MMRDSKSNSNRITDGDRPDTPQPEQQSTKDGGNEAKQPKRAKDINXTKNEQTRIVTHVSADA

SEQ ID NO: 25566 - protein, 68 aa, Diabrotica virgifera
  misc_feature: Coding regions on vcDNA: vcDNA=SeqID_5263; Strand=-; Position=2-205
  misc_feature (45)..(65): Xaa can be any naturally occurring amino acid
HKLKCINSQLKLRQIKTVFLTSHPLLTNLQLHPVFDPLSFYIYPXXXXXXXXXXXXXXXXXXXXXYAW

SEQ ID NO: 25567 - protein, 72 aa, Diabrotica virgifera
  misc_feature: Coding regions on vcDNA: vcDNA=SeqID_5264; Strand=+; Position=3-221
  misc_feature (3)..(16): Xaa can be any naturally occurring amino acid
DAXXXXXXXXXXXXXXIRLVYKMSLKDGPPRKLRKLEDIKPNVQQPITQSTIAVPSGSSTRLCPYLDTINRQ

SEQ ID NO: 25568 - protein, 88 aa, Diabrotica virgifera
  misc_feature: Coding regions on vcDNA: vcDNA=SeqID_5265; Strand=-; Position=102-368
ILVGANSGSFSQDGNLTVSGIGPNNLLGFSIPVFLAGALIGFSGGPFCILTGRLVNYIFLHLFFCSLWHGSRINFCTHTCALFDSSSF

SEQ ID NO: 25569 - protein, 19 aa, Diabrotica virgifera
  misc_feature: Coding regions on vcDNA: vcDNA=SeqID_5266; Strand=+; Position=1-57
THASTTPPVSAFHISVLNR

SEQ ID NO: 25570 - protein, 54 aa, Diabrotica virgifera
  misc_feature: Coding regions on vcDNA: vcDNA=SeqID_5267; Strand=-; Position=72-236
CHKASISVKSYYLTTNVTRLWLKIIDTTFFSVFVIRFKSLSMYFLRHSSLTSLV

SEQ ID NO: 25571 - protein, 47 aa, Diabrotica virgifera
  misc_feature: Coding regions on vcDNA: vcDNA=SeqID_5268; Strand=-; Position=78-221
VIVVYNPSTAKNCYTSGCDFIDVPLELLQSLLQKTVCIFLSLLNWRR

SEQ ID NO: 25572 - protein, 72 aa, Diabrotica virgifera
  misc_feature: Coding regions on vcDNA: vcDNA=SeqID_5269; Strand=+; Position=206-424
  misc_feature (8)..(44): Xaa can be any naturally occurring amino acid
SFTLQTQXXXXXXXXXXXXXXXXXXXXXXXXXXXXXXXXXXXXXKGSNLTYPSRQVKTPPKGPPNLISRAFV

SEQ ID NO: 25573 - protein, 54 aa, Diabrotica virgifera
  misc_feature: Coding regions on vcDNA: vcDNA=SeqID_5270; Strand=-; Position=1-162
  misc_feature (23)..(51): Xaa can be any naturally occurring amino acid
GDRCGRTLNSRARKPKSYRARAXXXXXXXXXXXXXXXXXXXXXXXXXXXXXTLG

SEQ ID NO: 25574 - protein, 103 aa, Diabrotica virgifera
  misc_feature: Coding regions on vcDNA: vcDNA=SeqID_5271; Strand=+; Position=3-314
GRVGSKLVLFMRYNCVKIRFLVNYVLAPVIYKSSLLSYSIMAVTGSSKIDLLINRLDVAETRSKRLNSEVRSIRKEIADLRRTLSGPNNPGVFPKNGNGGNTN

SEQ ID NO: 25575 - protein, 79 aa, Diabrotica virgifera
  misc_feature: Coding regions on vcDNA: vcDNA=SeqID_5272; Strand=-; Position=60-299
  misc_feature (58)..(64): Xaa can be any naturally occurring amino acid
CVRRCCQISNITNDYYSSIHLFMCSPEIYLTKIHLYILSFLFLATLHLICLDGVQYCXXXXXXXFTKNMCISANIHTSY

SEQ ID NO: 25576 - protein, 68 aa, Diabrotica virgifera
  misc_feature: Coding regions on vcDNA: vcDNA=SeqID_5273; Strand=-; Position=119-325
  misc_feature (20)..(26): Xaa can be any naturally occurring amino acid
VCHNAQLDDIIILIFMPKIXXXXXXXDLAWKFIPKIAHSLKNEFIPTMTCSLYTTLSQKTIFDMFSKE

SEQ ID NO: 25577 - protein, 66 aa, Diabrotica virgifera
  misc_feature: Coding regions on vcDNA: vcDNA=SeqID_5274; Strand=-; Position=127-327
  misc_feature (36)..(43): Xaa can be any naturally occurring amino acid
KDLRIQRNKLFYIFLSNITNLVTTPTRLYIPSSKSXXXXXXXXLLIVYFLEQGRKRKYANIFAKPN

SEQ ID NO: 25578 - protein, 23 aa, Diabrotica virgifera
  misc_feature: Coding regions on vcDNA: vcDNA=SeqID_5275; Strand=-; Position=1-69
KDEQTQQQSRNTNHKPKANIEVA

SEQ ID NO: 25579 - protein, 53 aa, Diabrotica virgifera
  misc_feature: Coding regions on vcDNA: vcDNA=SeqID_5276; Strand=-; Position=228-389
WPIVRLASYLIFSTGFSLNMLKIHCIGFFRPRYISLPTGTSQNRETRSDLCDM

SEQ ID NO: 25580 - protein, 50 aa, Diabrotica virgifera
  misc_feature: Coding regions on vcDNA: vcDNA=SeqID_5277; Strand=+; Position=204-356
  misc_feature (6)..(12): Xaa can be any naturally occurring amino acid
LLIRKXXXXXXXSVQKCLLSPTHFSLESFTFPHACYFSARGFYFSARVLI

SEQ ID NO: 25581 - protein, 51 aa, Diabrotica virgifera
  misc_feature: Coding regions on vcDNA: vcDNA=SeqID_5278; Strand=-; Position=78-230
PPRPAPARPPPPTPPPRPGPPRQAHPSAPPADHAGPPPGAPPGRRGPPKHN

SEQ ID NO: 25582 - protein, 109 aa, Diabrotica virgifera
  misc_feature: Coding regions on vcDNA: vcDNA=SeqID_5279; Strand=-; Position=2-328
  misc_feature (21)..(30): Xaa can be any naturally occurring amino acid
  misc_feature (101)..(101): Xaa can be any naturally occurring amino acid
YLFFTWMLIPFCIPVCYYFLXXXXXXXXXXYYFLDTFFYYFFFITSDVLPLFYLLGYYFALLLLLLLLFITVLYYFFLITCVFTSFVITLCLFLFFYYFRXLLFGRVCG

SEQ ID NO: 25583 - protein, 57 aa, Diabrotica virgifera
  misc_feature: Coding regions on vcDNA: vcDNA=SeqID_5280; Strand=+; Position=29-202
LHMFPIAIYNIYSAYRFDFVSYVIILGQFAGISSSTEGDISYCLFIVVVVVKEFYFY

SEQ ID NO: 25584 - protein, 151 aa, Diabrotica virgifera
  misc_feature: Coding regions on vcDNA: vcDNA=SeqID_5281; Strand=+; Position=1-453
  misc_feature: Homolog annotation: Hit_ID=AAV90724.1; Match level="QueryCoverage =98%, HitCoverage=68%, E-value=3e-63, Identity=81%"; Hit description =60S ribosomal protein L10a [Aedes albopictus]
  misc_feature: Gene Ontology Annotation: Cellular component=cytosolic ribosome (sensu Eukarya); Biological process=protein biosynthesis
  misc_feature: Pfam annotation: Pfam_ID=Ribosomal_L1; Match level="Score=36.5, E -value=6.5e-13, Copies=1"; Pfam description=Ribosomal protein L1p/L10e family
  misc_feature (45)..(53): Xaa can be any naturally occurring amino acid
  misc_feature (140)..(140): Xaa can be any naturally occurring amino acid
PRVRQFSGTVKLKHIPRPKMQVCILGDQQHCDEANANNVPFMDVXXXXXXXXXTKLVKKLAKKYDAFLASEALIKQIPRLLGPGLNKAGKFPGLLSHQESMTQKIDEVKATIKFQMKKVLCLSVAVGHVGMNQDELVQNXHLSINFLVSLL

SEQ ID NO: 25585 - protein, 31 aa, Diabrotica virgifera
  misc_feature: Coding regions on vcDNA: vcDNA=SeqID_5282; Strand=-; Position=1-93
QNSPLEQDTAWAETDIGHCKWSMTQTRMQIN

SEQ ID NO: 25586 - protein, 55 aa, Diabrotica virgifera
  misc_feature: Coding regions on vcDNA: vcDNA=SeqID_5283; Strand=+; Position=1-165
TRGCGSRAWCYIPGSVPFIRSLISSSCIWFISRQSGWVKKRVRLTVVGIGHVNSG

SEQ ID NO: 25587 - protein, 44 aa, Diabrotica virgifera
  misc_feature: Coding regions on vcDNA: vcDNA=SeqID_5284; Strand=-; Position=0-131
ARRTSEPHDPAKHAQSPRPTRPAATAGKESNKETTKQNKQRQEA

SEQ ID NO: 25588 - protein, 53 aa, Diabrotica virgifera
  misc_feature: Coding regions on vcDNA: vcDNA=SeqID_5285; Strand=+; Position=223-384
MSCAHNCYVLKLLSETDCTLDWFSTNFSIVNLIQLHRLGWSYLHNIFHMSIST

SEQ ID NO: 25589 - protein, 46 aa, Diabrotica virgifera
  misc_feature: Coding regions on vcDNA: vcDNA=SeqID_5286; Strand=-; Position=143-283
DLLRSIERIGRLLTLLVKLQVGPFLHLFYMVYIFLLEIKCYTTIIH

SEQ ID NO: 25590 - protein, 56 aa, Diabrotica virgifera
  misc_feature: Coding regions on vcDNA: vcDNA=SeqID_5287; Strand=+; Position=14-184
  misc_feature (26)..(33): Xaa can be any naturally occurring amino acid
NIFSSNDWIKFYQTSFCRFFKKQILXXXXXXXXVLVYELESVKQLNCYITNYYLLN

SEQ ID NO: 25591 - protein, 150 aa, Diabrotica virgifera
  misc_feature: Coding regions on vcDNA: vcDNA=SeqID_5288; Strand=+; Position=1-450
  misc_feature: Homolog annotation: Hit_ID=NP_500284.2; Match level="QueryCoverage =64%, HitCoverage=2%, E-value=7e-14, Identity=43%"; Hit description =ubiquitin-associated domain and HECT domain containing protein (4D798) [Caenorhabditis elegans]
RGHPRIRTSQVFFLRVLRVIVQIRNSIKENLKSAETATYELPALSEQLNSLTSFWETLSQCLSELEHAPDHHAVLVLQPAVEAFFLVHSPQQGPIKSEEKDTAKETEMEEHSGESTESQGSVPSTSDAAAQATVTPAEEEQQPSRPASEI

SEQ ID NO: 25592 - protein, 62 aa, Diabrotica virgifera
  misc_feature: Coding regions on vcDNA: vcDNA=SeqID_5289; Strand=-; Position=115-303
  misc_feature (48)..(56): Xaa can be any naturally occurring amino acid
YTYSVHYKEYSKKFQGKIFKNKPTVANFYRLLTKMDFALDIGIGSCEXXXXXXXXXRMSFSK

SEQ ID NO: 25593 - protein, 17 aa, Diabrotica virgifera
  misc_feature: Coding regions on vcDNA: vcDNA=SeqID_5290; Strand=-; Position=0-50
  misc_feature (5)..(16): Xaa can be any naturally occurring amino acid
TNRQXXXXXXXXXXXXT

SEQ ID NO: 25594 - protein, 55 aa, Diabrotica virgifera
  misc_feature: Coding regions on vcDNA: vcDNA=SeqID_5291; Strand=+; Position=63-230
  misc_feature (24)..(35): Xaa can be any naturally occurring amino acid
QLCLLNIKLSCMWLLNLSFFNYKXXXXXXXXXXXXDIYLFITYDIDNSGSFPTSF

SEQ ID NO: 25595 - protein, 108 aa, Diabrotica virgifera
  misc_feature: Coding regions on vcDNA: vcDNA=SeqID_5292; Strand=-; Position=58-384
  misc_feature (48)..(60): Xaa can be any naturally occurring amino acid
DKSTLNHTNVMTDNVGPDGWGVCNVFGTTKKLYIMVGRPIWLYNRDIXXXXXXXXXXXXXELVLSDSLVRMCLELTPTRMVGEFSHVGWHGRNVCRPFNFKVKNTAAL

SEQ ID NO: 25596 - protein, 141 aa, Diabrotica virgifera
  misc_feature: Coding regions on vcDNA: vcDNA=SeqID_5293; Strand=+; Position=3-425
QNSIQHYFSKPNSGDVGPQQNAGDSQKKLYEEIERQRYQQEQLRQFYQQNPDIKHSAVDDARNSQQPSFNQEYQKPTITNSVSKEIYVTTTSTTTTPAPSTPPTTTKDPKILEAQLPDEVPEDLRQQLLSSGILNHADISV

SEQ ID NO: 25597 - protein, 84 aa, Diabrotica virgifera
  misc_feature: Coding regions on vcDNA: vcDNA=SeqID_5294; Strand=+; Position=171-422
  misc_feature: Homolog annotation: Hit_ID=XP_310330.1; Match level="QueryCoverage =75%, HitCoverage=9%, E-value=1e-09, Identity=55%"; Hit description =ENSANGP00000015865 [Anopheles gambiae]
MSQLPSIWFLLLGTLLGTTTGQSNLLDGVIKLLQDGDNQIQKEPPDMPEYEMLKEYDFIIVGAGTAGCTLANRLSENPDWNVLL

SEQ ID NO: 25598 - protein, 152 aa, Diabrotica virgifera
  misc_feature: Coding regions on vcDNA: vcDNA=SeqID_5295; Strand=+; Position=2-457
  misc_feature: Homolog annotation: Hit_ID=NP_702533.1; Match level="QueryCoverage =99%, HitCoverage=14%, E-value=3e-45, Identity=60%"; Hit description =hypothetical protein PF14_0644 [Plasmodium falciparum 3D7] gb|AAN37257.1| hypothetical protein
  misc_feature: Gene Ontology Annotation: Molecular function=RNA helicase activity; Cellular component=cytoplasm; Biological process=regulation of protein activity, epigenetic
SRVITRRQSNSNNNGNGHGNGNGNGRSNGNGNGNGNGNGNGNGNGKPGASYLPPSNGNGNGNGNGYKNGNGNGNGNGRPSGTYGPPSNTYGLPVNGNGNGNGNGNGNGNGHSNGNGNGNGNGNGNGKLNGLYGPPSATYGPPSNTYGQPANG

SEQ ID NO: 25599 - protein, 68 aa, Diabrotica virgifera
  misc_feature: Coding regions on vcDNA: vcDNA=SeqID_5296; Strand=+; Position=3-209
  misc_feature (5)..(5): Xaa can be any naturally occurring amino acid
SRIKXSYSLLINFLTITLYYFLNIIFWLIPKTRGMRSIYNSASVISTFQPTRTTLSYDSCPSMSRCEV

SEQ ID NO: 25600 - protein, 51 aa, Diabrotica virgifera
  misc_feature: Coding regions on vcDNA: vcDNA=SeqID_5297; Strand=+; Position=3-158
  misc_feature (2)..(9): Xaa can be any naturally occurring amino acid
TXXXXXXXXFRICIELFYWWFDSYDCWKLIDLYPICLEFLGGVVLGVVANY

SEQ ID NO: 25601 - protein, 98 aa, Diabrotica virgifera
  misc_feature: Coding regions on vcDNA: vcDNA=SeqID_5298; Strand=+; Position=26-322
  misc_feature (19)..(26): Xaa can be any naturally occurring amino acid
IESYYILTAASDLDVETLXXXXXXXXCGLFPFKQHNSKILHAYGGLSILHYLQCIFRLLHLYINQVSSFMALINNNYEQLKNMIKRATTFYKIIEYCL

SEQ ID NO: 25602 - protein, 148 aa, Diabrotica virgifera
  misc_feature: Coding regions on vcDNA: vcDNA=SeqID_5299; Strand=+; Position=3-447
  misc_feature: Homolog annotation: Hit_ID=XP_393600.1; Match level="QueryCoverage =80%, HitCoverage=14%, E-value=9e-23, Identity=44%"; Hit description =similar to CG7927-PA [Apis mellifera]
  misc_feature: Gene Ontology Annotation: Cellular component=nucleus
  misc_feature (25)..(25): Xaa can be any naturally occurring amino acid
  misc_feature (40)..(40): Xaa can be any naturally occurring amino acid
  misc_feature (96)..(96): Xaa can be any naturally occurring amino acid
  misc_feature (120)..(120): Xaa can be any naturally occurring amino acid
  misc_feature (128)..(138): Xaa can be any naturally occurring amino acid
VYPTRPNCYAKGARQYQWLIEFGAXWDRAKPLMWLPNFAXSLGVAHLYLEQSAKADLLLREALPKFPGVLLPLLYKCSVQTDTRVSSQQIFVTAEXAIMQPTALTQIILLYANRSYHIWXDSDLLPWXXXXXXXXXXXVHKIDAVLKD

SEQ ID NO: 25603 - protein, 64 aa, Diabrotica virgifera
  misc_feature: Coding regions on vcDNA: vcDNA=SeqID_5300; Strand=+; Position=3-197
SRIKNNDSLQVDVLRLYSTLIFTMPKCSDSPEYGVVGSSVLETLIRQNMSEHILDLIEALACLI

SEQ ID NO: 25604 - protein, 29 aa, Diabrotica virgifera
  misc_feature: Coding regions on vcDNA: vcDNA=SeqID_5301; Strand=-; Position=1-87
QDGRKPTKDRPKGPIHSIGGSSLHTYEVQ

SEQ ID NO: 25605 - protein, 34 aa, Diabrotica virgifera
  misc_feature: Coding regions on vcDNA: vcDNA=SeqID_5302; Strand=-; Position=2-106
  misc_feature (29)..(34): Xaa can be any naturally occurring amino acid
RDSENGELTKKLEGVRKKLADDSLRLVNXXXXXX

SEQ ID NO: 25606 - protein, 64 aa, Diabrotica virgifera
  misc_feature: Coding regions on vcDNA: vcDNA=SeqID_5303; Strand=-; Position=254-448
KKKKERIIHSFGHNVLTTPLSFIVISIALNIFGEYANYDNYIEHNGYRDRAVLETWQEALILPH

SEQ ID NO: 25607 - protein, 46 aa, Diabrotica virgifera
  misc_feature: Coding regions on vcDNA: vcDNA=SeqID_5304; Strand=+; Position=18-155
SCQQVACTSIPNKHLLAYIPGRVRAKSRLNTSVHKFRYENAIPKFI

SEQ ID NO: 25608 - protein, 114 aa, Diabrotica virgifera
  misc_feature: Coding regions on vcDNA: vcDNA=SeqID_5305; Strand=+; Position=51-392
LSVRKNPIFLWGFCYKSTYEISKSSLLSLKAEILRKHQELSKAKVENDVKIQTLNKSPLEIRNKGVEAWDRNDQSDVDQDLLKQSRSVLEHKAALYEKLSSGDVSENDKERNKL

SEQ ID NO: 25609 - protein, 81 aa, Diabrotica virgifera
  misc_feature: Coding regions on vcDNA: vcDNA=SeqID_5306; Strand=+; Position=165-407
MRDSPDSATKRSRSRSTNSSASRKSRSRSASSGSRSRSRSRSSEIDGFRLHIGDIGDEIRRSDLEKVFSVYGPLKEVWMTN

SEQ ID NO: 25610 - protein, 58 aa, Diabrotica virgifera
  misc_feature: Coding regions on vcDNA: vcDNA=SeqID_5307; Strand=-; Position=1-174
  misc_feature (36)..(57): Xaa can be any naturally occurring amino acid
PFFNPQLLYLTSHIQEIPFKSQHVHALLSSMHSKSXXXXXXXXXXXXXXXXXXXXXXY

SEQ ID NO: 25611 - protein, 150 aa, Diabrotica virgifera
  misc_feature: Coding regions on vcDNA: vcDNA=SeqID_5308; Strand=+; Position=1-450
  misc_feature: Homolog annotation: Hit_ID=XP_534972.1; Match level="QueryCoverage =97%, HitCoverage=12%, E-value=1e-14, Identity=34%"; Hit description =PREDICTED: similar to chromosome 10 open reading frame 117 [Canis familiaris]
  misc_feature: Pfam annotation: Pfam_ID=NOC3p; Match level="Score=-6.4, E-value =0.00069, Copies=1"; Pfam description=Nucleolar complex-associated protein
  misc_feature (86)..(86): Xaa can be any naturally occurring amino acid
  misc_feature (91)..(96): Xaa can be any naturally occurring amino acid
SRVITRGQKCARYKQVKNLLPIKTKRGIIPMQTLEPIQDEQDEEASDVNNEEEVIEETEPEGNNFSLESTGFDTGEPISAAQLLAXRNEVXXXXXXHIGTLSSGLLENPEEKVLNLRTLLSLMDEEAAQLYITVKKLITVSLLEVFKDIL

SEQ ID NO: 25612 - protein, 142 aa, Diabrotica virgifera
  misc_feature: Coding regions on vcDNA: vcDNA=SeqID_5309; Strand=+; Position=1-426
  misc_feature (10)..(29): Xaa can be any naturally occurring amino acid
  misc_feature (86)..(105): Xaa can be any naturally occurring amino acid
RGSTHASMLXXXXXXXXXXXXXXXXXXXXNLYCPQNHLAIRTLFCKKQLQNLPRRLDTVVIKTQNISRVGLKTLRDSFKPNTGELXXXXXXXXXXXXXXXXXXXXDKHILASRQSQAVQSGSTAKPLAQQARNKWVQNIVNG

SEQ ID NO: 25613 - protein, 60 aa, Diabrotica virgifera
  misc_feature: Coding regions on vcDNA: vcDNA=SeqID_5310; Strand=-; Position=159-341
  misc_feature (28)..(34): Xaa can be any naturally occurring amino acid
SQKVFKITPRQIFLSIVISFFAIPLSTXXXXXXXFLKLQRNSDTTCCLFIPYVDSTRPSH

SEQ ID NO: 25614 - protein, 127 aa, Diabrotica virgifera
  misc_feature: Coding regions on vcDNA: vcDNA=SeqID_5311; Strand=+; Position=46-426
  misc_feature: Homolog annotation: Hit_ID=EAA03501.3; Match level="QueryCoverage =90%, HitCoverage=54%, E-value=2e-28, Identity=48%"; Hit description =ENSANGP00000018087 [Anopheles gambiae str. PEST] ref|XP_565707.1| ENSANGP00000018087 [Anopheles gambiae st
  misc_feature: Gene Ontology Annotation: Molecular function=electron transporter activity; Cellular component=cellular_component unknown; Biological process=glucose metabolism
  misc_feature: Pfam annotation: Pfam_ID=Aldo_ket_red; Match level="Score=-94.2, E -value=0.00062, Copies=1"; Pfam description=Aldo/keto reductase family
  misc_feature (53)..(53): Xaa can be any naturally occurring amino acid
  misc_feature (63)..(63): Xaa can be any naturally occurring amino acid
  misc_feature (73)..(73): Xaa can be any naturally occurring amino acid
  misc_feature (87)..(87): Xaa can be any naturally occurring amino acid
  misc_feature (105)..(105): Xaa can be any naturally occurring amino acid
MSLPNITPNNGAHCPSFGHGTWLAAPGELKETVKTAIELGYRLYDCSWLYWNXKEISEGLVAXIQDKTVKRQXLFVVTKLWNIFHEXEKVVPSCKESLKNFGLDXVDLYLSHWPCATKNIDFNIQLP

SEQ ID NO: 25615 - protein, 45 aa, Diabrotica virgifera
  misc_feature: Coding regions on vcDNA: vcDNA=SeqID_5312; Strand=+; Position=154-291
MVDQGGNISNEVTMRVDIRLPQQLTGLAVLNAISIRWRSVTNIRF

SEQ ID NO: 25616 - protein, 79 aa, Diabrotica virgifera
  misc_feature: Coding regions on vcDNA: vcDNA=SeqID_5313; Strand=+; Position=3-242
VVLNLTTHTAESFCHSILANVAGKHCVKSHAWEHMYYSTSCVVTQAAVYILAYLCDTSQHSIHPVPNLRYASHASKVHC

SEQ ID NO: 25617 - protein, 46 aa, Diabrotica virgifera
  misc_feature: Coding regions on vcDNA: vcDNA=SeqID_5314; Strand=-; Position=2-139
  misc_feature (38)..(44): Xaa can be any naturally occurring amino acid
DLYTNHLGSSVESSPDRQQPKFLKYHEHQINSIRYRKXXXXXXXGL

SEQ ID NO: 25618 - protein, 71 aa, Diabrotica virgifera
  misc_feature: Coding regions on vcDNA: vcDNA=SeqID_5315; Strand=-; Position=161-376
  misc_feature (18)..(25): Xaa can be any naturally occurring amino acid
TKVCLKKQIVVFDNLVLXXXXXXXXLLLCKIFIPSYNFLFQQFFLEAWLSYRRLGTGCIEWCGVSQRYDKI

SEQ ID NO: 25619 - protein, 48 aa, Diabrotica virgifera
  misc_feature: Coding regions on vcDNA: vcDNA=SeqID_5316; Strand=-; Position=284-430
FIVVRTETNMFITVVIFIWSFKATGTYYLLNVSVRILIKNFIGRYLPI

SEQ ID NO: 25620 - protein, 92 aa, Diabrotica virgifera
  misc_feature: Coding regions on vcDNA: vcDNA=SeqID_5317; Strand=+; Position=119-394
LALIFPRSFSFCDEVLVCTKLAANVHCSTGMLSDCVFIIQHYFYAFLQATLCKIHPLVAYISLRSKLSIFFRCSGVSRCDCSFRICTSRANL

SEQ ID NO: 25621 - protein, 91 aa, Diabrotica virgifera
  misc_feature: Coding regions on vcDNA: vcDNA=SeqID_5318; Strand=+; Position=63-338
MYKLLVLAMVLYTVSAGVILDHKPAVIVHHGATSHQNSNSLSVHPVPVVAHKVAVAHVAHAPVIAHAPIAVAHAPVAVAHAPVLHHAVLHH

SEQ ID NO: 25622 - protein, 61 aa, Diabrotica virgifera
  misc_feature: Coding regions on vcDNA: vcDNA=SeqID_5319; Strand=+; Position=237-419
VKCMKPLASPTSDTAIKKGKSIYWRYGYCKVLSPIFSSSKSRYIASDAKLLEILPYVTSSF

SEQ ID NO: 25623 - protein, 40 aa, Diabrotica virgifera
  misc_feature: Coding regions on vcDNA: vcDNA=SeqID_5320; Strand=-; Position=1-120
  misc_feature (28)..(34): Xaa can be any naturally occurring amino acid
SDHEEDDERAAEDATAQRHRKHTLQPTXXXXXXXRIVTKN

SEQ ID NO: 25624 - protein, 37 aa, Diabrotica virgifera
  misc_feature: Coding regions on vcDNA: vcDNA=SeqID_5321; Strand=-; Position=1-111
  misc_feature (31)..(32): Xaa can be any naturally occurring amino acid
INCWSIKVNYSRPRLVNYQSVTYLRTFTRKXXFNTTH

SEQ ID NO: 25625 - protein, 69 aa, Diabrotica virgifera
  misc_feature: Coding regions on vcDNA: vcDNA=SeqID_5322; Strand=+; Position=39-248
  misc_feature (48)..(53): Xaa can be any naturally occurring amino acid
VTFVICLLLGDQLTMPSTLNTTDLRLLTWTIINSNLSCLLTVTSLHHXXXXXXTGDSSLRMSMRFVLTT

SEQ ID NO: 25626 - protein, 49 aa, Diabrotica virgifera
  misc_feature: Coding regions on vcDNA: vcDNA=SeqID_5323; Strand=-; Position=66-215
PPFIRLSLCTATGDDILKLVVIQLLLAMCIPIRNYCHSLYSNSFITILR

SEQ ID NO: 25627 - protein, 66 aa, Diabrotica virgifera
  misc_feature: Coding regions on vcDNA: vcDNA=SeqID_5324; Strand=-; Position=24-224
GLYSQSCLDHYTLPSFNSFPFHTRTGKHVTRLSFTNVKAAFPNPNRLTLTLMIPTIVHYTTHDSLK

SEQ ID NO: 25628 - protein, 95 aa, Diabrotica virgifera
  misc_feature: Coding regions on vcDNA: vcDNA=SeqID_5325; Strand=+; Position=44-328
  misc_feature: Homolog annotation: Hit_ID=NP_727952.2; Match level="QueryCoverage =98%, HitCoverage=9%, E-value=6e-21, Identity=52%"; Hit description =CG3632-PC, isoform C [Drosophila melanogaster] ref|NP_727950.2| CG3632-PA, isoform A [Drosophila
  misc_feature: Gene Ontology Annotation: Molecular function=protein tyrosine phosphatase activity; Cellular component=membrane; Biological process=protein amino acid dephosphorylation
  misc_feature: Pfam annotation: Pfam_ID=Myotub-related; Match level="Score=40.0, E -value=2.2e-09, Copies=1"; Pfam description=Myotubularin-related
  misc_feature (87)..(93): Xaa can be any naturally occurring amino acid
MRLENQRQYTFDRRLFENEMCRLGFQGHSWRISKVNENYKFCPTYPPYLLVPSCINDDMLESVAKFRSSRRIPAVVWRHFRNGAVIXXXXXXXVG

SEQ ID NO: 25629 - protein, 84 aa, Diabrotica virgifera
  misc_feature: Coding regions on vcDNA: vcDNA=SeqID_5326; Strand=-; Position=99-353
IGLVCLKISANVIKEFLLFLRYEEGSIMSGKLIFVVYTIANFLFIVRFAHVTSNIHCMSNNVHLQTVECQKCTLILIHHGLYKS

SEQ ID NO: 25630 - protein, 54 aa, Diabrotica virgifera
  misc_feature: Coding regions on vcDNA: vcDNA=SeqID_5327; Strand=-; Position=15-179
IYESDYLDISNECNDTGLIRPTPVYLICIRPVCFREQNGTEYIREYNSMYCNLT

SEQ ID NO: 25631 - protein, 107 aa, Diabrotica virgifera
  misc_feature: Coding regions on vcDNA: vcDNA=SeqID_5328; Strand=+; Position=3-326
  misc_feature: Gene Ontology Annotation: Molecular function=molecular_function unknown; Biological process=cellular morphogenesis
AGGGTGFGGGSGIGGGIGGGIGGGIGGGIGGGIGGGIGEDDGQYRPELYERPQQQLIQLPSHQRASYPAPLAVSPTPSSNALEEKDYFDEPGKAHSFGSGYIFEFGG

SEQ ID NO: 25632 - protein, 123 aa, Diabrotica virgifera
  misc_feature: Coding regions on vcDNA: vcDNA=SeqID_5329; Strand=+; Position=2-373
  misc_feature: Homolog annotation: Hit_ID=EAL27514.1; Match level="QueryCoverage =82%, HitCoverage=16%, E-value=3e-09, Identity=34%"; Hit description =GA15982-PA [Drosophila pseudoobscura]
VVKATPKIKPCDDPNESINGVGTVLFTPADVYKQCWSLEEIAILTTRMILEDLLPDVTVFNIDSNAFVDDIVSYFRLLIEVVKTATTGRKKRVTLLALTDLLGGYLQYAVLPLARYAFYAGFN

SEQ ID NO: 25633 - protein, 137 aa, Diabrotica virgifera
  misc_feature: Coding regions on vcDNA: vcDNA=SeqID_5330; Strand=-; Position=2-413
  misc_feature: Homolog annotation: Hit_ID=EAL40773.1; Match level="QueryCoverage =99%, HitCoverage=37%, E-value=7e-14, Identity=28%"; Hit description =ENSANGP00000028815 [Anopheles gambiae str. PEST] ref|XP_558777.1| ENSANGP00000028815 [Anopheles gambiae st
  misc_feature (117)..(117): Xaa can be any naturally occurring amino acid
GNNIIDVRSLRGIDGDTDHYLVTAKVKCRISSHKYKKTMNPQWNMDEMQNTEKHKKYIEQLEQTLNSETVYNDIERLWETTAEIITKTADKIFGRSRQKRAKTWYDDECRKQLEKKXTVRKTWIQLQTDKSKKEYDR

SEQ ID NO: 25634 - protein, 17 aa, Diabrotica virgifera
  misc_feature: Coding regions on vcDNA: vcDNA=SeqID_5331; Strand=-; Position=1-51
TCTSYLIAEFNTTHLRV

SEQ ID NO: 25635 - protein, 33 aa, Diabrotica virgifera
  misc_feature: Coding regions on vcDNA: vcDNA=SeqID_5332; Strand=-; Position=37-138
NVQYWIYFPKSVMQFNELIWRIPERQFNVTSAP

SEQ ID NO: 25636 - protein, 59 aa, Diabrotica virgifera
  misc_feature: Coding regions on vcDNA: vcDNA=SeqID_5333; Strand=+; Position=71-250
LRPHNAQHTLKDCTSRHKLRGDYMVRVIRWMALMVHRQLRWVTCHFGPTRTGSKVTRTE

SEQ ID NO: 25637 - protein, 83 aa, Diabrotica virgifera
  misc_feature: Coding regions on vcDNA: vcDNA=SeqID_5334; Strand=+; Position=20-268
RVSLWFNISISFPMFSWQVRFVVQLHWRLNNDAYQYKMLQMATSPQFTRYLLRYSDEIITGNIPSIDHVINFVLEIRIELAPR

SEQ ID NO: 25638 - protein, 48 aa, Diabrotica virgifera
  misc_feature: Coding regions on vcDNA: vcDNA=SeqID_5335; Strand=-; Position=133-279
KMIILISNQNINSMKHNVSGASVKKLCRLAINTWGGNPKLNNLQAFMP

SEQ ID NO: 25639 - protein, 45 aa, Diabrotica virgifera
  misc_feature: Coding regions on vcDNA: vcDNA=SeqID_5336; Strand=-; Position=61-198
LNIRDPKVRTQLVMQSLKIKQNSSQRQGKTPMMYNQNRCPHHISE

SEQ ID NO: 25640 - protein, 97 aa, Diabrotica virgifera
  misc_feature: Coding regions on vcDNA: vcDNA=SeqID_5337; Strand=-; Position=77-370
ACKVSDTCLKIMSTSPLYAVSWVLRWSMKSFMMLTNIMPVSFTMLMIWSGAGEVTSNDFIGNYDQIVSLLTRARLLLHYGQMGVAHGKPLVWIQQPG

SEQ ID NO: 25641 - protein, 109 aa, Diabrotica virgifera
  misc_feature: Coding regions on vcDNA: vcDNA=SeqID_5338; Strand=+; Position=32-361
  misc_feature: Homolog annotation: Hit_ID=XP_394383.1; Match level="QueryCoverage =100%, HitCoverage=20%, E-value=3e-20, Identity=52%"; Hit description= similar to ENSANGP00000013953 [Apis mellifera]
  misc_feature: Gene Ontology Annotation: Biological process=histogenesis and organogenesis
MSLAEELLADLEDNDADDVEEEMEEIPEEEVKEEKPDLEDLLMEQESVHINSVREICKLRDSETLQHLMEQIQGFGTKIRKSVDIVRPVETDPEYQLIVEANNVAHDIE

SEQ ID NO: 25642 - protein, 78 aa, Diabrotica virgifera
  misc_feature: Coding regions on vcDNA: vcDNA=SeqID_5339; Strand=-; Position=164-400
IIHNEHSGCDVTNCHFQFAQTSLIKLFDGGTRSLFFSTNLKDLLCSFWFKILFIVCSLYLLFTTTCLMIFISIVKLFF

SEQ ID NO: 25643 - protein, 85 aa, Diabrotica virgifera
  misc_feature: Coding regions on vcDNA: vcDNA=SeqID_5340; Strand=+; Position=146-400
EVFLFYYYNIHQTSLMLLQKDRLDESFNSFIEEDKRYRLLLMMTSMLLTIMVVLVYCFDVVLPITTEDPIQMLYIENDKPSTFKT

SEQ ID NO: 25644 - protein, 92 aa, Diabrotica virgifera
  misc_feature: Coding regions on vcDNA: vcDNA=SeqID_5341; Strand=+; Position=114-390
  misc_feature: Homolog annotation: Hit_ID=XP_393034.1; Match level="QueryCoverage =98%, HitCoverage=33%, E-value=2e-24, Identity=61%"; Hit description =similar to 60S ribosomal protein L7a (Surfeit locus protein 3) (PLA -X polypeptide) [Apis
  misc_feature: Gene Ontology Annotation: Molecular function=structural constituent of ribosome; Cellular component=cytosolic ribosome (sensu Eukarya); Biological process=protein biosynthesis
  misc_feature (56)..(56): Xaa can be any naturally occurring amino acid
  misc_feature (60)..(60): Xaa can be any naturally occurring amino acid
TVAATPLALKIIEDQIDIIPLFEKRPINFGIEQDIQSPRDLTRFVEWPKYIRIHRXLAVXTMRLKVPPPIKQFSQSIDTSPVTQIFRVLVKY

SEQ ID NO: 25645 - protein, 61 aa, Diabrotica virgifera
  misc_feature: Coding regions on vcDNA: vcDNA=SeqID_5342; Strand=-; Position=73-258
TKICASLMHHDIPITDVRVSSVLRYCTDSTYRRSNELRQSRLLRNRERAIPQVISIRHQYH

SEQ ID NO: 25646 - protein, 129 aa, Diabrotica virgifera
  misc_feature: Coding regions on vcDNA: vcDNA=SeqID_5343; Strand=+; Position=41-427
  misc_feature: Homolog annotation: Hit_ID=AAK27411.1; Match level="QueryCoverage =100%, HitCoverage=29%, E-value=2e-70, Identity=96%"; Hit description= beta-tubulin [Monosiga brevicollis]
  misc_feature: Gene Ontology Annotation: Molecular function=structural constituent of cytoskeleton; Cellular component=tubulin; Biological process =microtubule-based process
  misc_feature: Pfam annotation: Pfam_ID=Tubulin; Match level="Score=50.0, E-value =6.9e-12, Copies=1"; Pfam description=Tubulin/FtsZ family, GTPase domain
DEHGIDPTGTYHGDSDLQLERINVYYNEATGGKYVPRAVLVDLEPGTMDSVRSGPFGQIFRPDNFVFGQSGAGNNWAKGHYTEGAELVDSVLDVVRKEAEGCDCMQGFQLTHSLGSGTGSGLGTLIISK

SEQ ID NO: 25647 - protein, 47 aa, Diabrotica virgifera
  misc_feature: Coding regions on vcDNA: vcDNA=SeqID_5344; Strand=-; Position=1-144
CLRKFRLTIIHHSVSLRKTSLFYMTGAEIFTPDDTLSDRMSFRDEEL

SEQ ID NO: 25648 - protein, 56 aa, Diabrotica virgifera
  misc_feature: Coding regions on vcDNA: vcDNA=SeqID_5345; Strand=-; Position=115-285
  misc_feature (6)..(12): Xaa can be any naturally occurring amino acid
KNTLSXXXXXXXNRNMLSYIFFVIVFDNYMQTWTNYFSIIMLFNAYSKPVFETALK

SEQ ID NO: 25649 - protein, 64 aa, Diabrotica virgifera
  misc_feature: Coding regions on vcDNA: vcDNA=SeqID_5346; Strand=+; Position=86-280
FESPLNVHLNTDALWTIKELEFFVTHDVTYAVFLYLMDPICWESWMIILRTTTFVTFAVNRYHL

SEQ ID NO: 25650 - protein, 99 aa, Diabrotica virgifera
  misc_feature: Coding regions on vcDNA: vcDNA=SeqID_5347; Strand=-; Position=99-398
YLLSSGSDKIPQNFLNIFSVICTIQTVCGLMCITYFAQFCDHTAVYTLRLSDLCELGKLTHQLHQSYFRSVNQSPNQEMLDSRVKKKYCEKLNMNFGDA

SEQ ID NO: 25651 - protein, 42 aa, Diabrotica virgifera
  misc_feature: Coding regions on vcDNA: vcDNA=SeqID_5348; Strand=-; Position=119-247
HVTECALNCLPYPRPSSQAQYLVRIHIPTTLCNSESYYTNDT

SEQ ID NO: 25652 - protein, 68 aa, Diabrotica virgifera
  misc_feature: Coding regions on vcDNA: vcDNA=SeqID_5349; Strand=-; Position=20-226
TGTLAGWGCSAGTAMVSRAGKCTRCCTVTNIGSARTAAYDLGTATGRSTGTGTPIGCVILPRCQVVVF

SEQ ID NO: 25653 - protein, 131 aa, Diabrotica virgifera
  misc_feature: Coding regions on vcDNA: vcDNA=SeqID_5350; Strand=+; Position=42-434
  misc_feature: Homolog annotation: Hit_ID=XP_307960.1; Match level="QueryCoverage =93%, HitCoverage=9%, E-value=3e-27, Identity=47%"; Hit description =ENSANGP00000013501 [Anopheles gambiae] gb|EAA03817.1| ENSANGP00000013501 [Anopheles gambiae
  misc_feature: Gene Ontology Annotation: Molecular function=chromatin binding; Cellular component=dosage compensation complex (sensu Drosophila); Biological process=dosage compensation, by hyperactivation of X chromosome
ASERNESVGRTVGHQVRLNSNFNPVTGRILYCTTGILLRHVQSDSTLSEFSHIILDEAHERDVNTDLLMNLLKFSLNNNPHLKLIVMSATIDTDMFKKYYDGAPVIEIPGITYPIDRHFAHSIDGVDLTKT

SEQ ID NO: 25654 - protein, 62 aa, Diabrotica virgifera
  misc_feature: Coding regions on vcDNA: vcDNA=SeqID_5351; Strand=-; Position=0-185
  misc_feature (12)..(20): Xaa can be any naturally occurring amino acid
  misc_feature (24)..(50): Xaa can be any naturally occurring amino acid
  misc_feature (53)..(59): Xaa can be any naturally occurring amino acid
YSKKFDQKMSNXXXXXXXXXPITXXXXXXXXXXXXXXXXXXXXXXXXXXXISXXXXXXXSLV

SEQ ID NO: 25655 - protein, 24 aa, Diabrotica virgifera
  misc_feature: Coding regions on vcDNA: vcDNA=SeqID_5352; Strand=+; Position=2-76
QHPIARHRIVLDSLTGVVESYSTQ

SEQ ID NO: 25656 - protein, 17 aa, Diabrotica virgifera
  misc_feature: Coding regions on vcDNA: vcDNA=SeqID_5353; Strand=+; Position=10-63
KLGMEYKGTCYLIGPTF

SEQ ID NO: 25657 - protein, 70 aa, Diabrotica virgifera
  misc_feature: Coding regions on vcDNA: vcDNA=SeqID_5354; Strand=-; Position=2-211
MYISNVNNDILNLFLTNSVYLEMNNIQLQENKLRFKGTINKMKHLARPSVNPRDISRVIRSLCRGVCRPT

SEQ ID NO: 25658 - protein, 119 aa, Diabrotica virgifera
  misc_feature: Coding regions on vcDNA: vcDNA=SeqID_5355; Strand=+; Position=20-376
  misc_feature: Homolog annotation: Hit_ID=XP_396437.1; Match level="QueryCoverage =98%, HitCoverage=25%, E-value=4e-33, Identity=54%"; Hit description =similar to ENSANGP00000011354 [Apis mellifera]
RVGENLGLNNKDIETLINEVNVVFHMGATLKLEAKLCDAIEQNTAGTARVIDIAKKMKNIEAFLHFSTAFCSADVDVFEEKVYSSQDNPRDVMDVTKWLNPNALELATPSIIQPHPNTY

SEQ ID NO: 25659 - protein, 26 aa, Diabrotica virgifera
  misc_feature: Coding regions on vcDNA: vcDNA=SeqID_5356; Strand=-; Position=1-78
  misc_feature (11)..(19): Xaa can be any naturally occurring amino acid
RREHHVIQLDXXXXXXXXXFPRSPLE

SEQ ID NO: 25660 - protein, 81 aa, Diabrotica virgifera
  misc_feature: Coding regions on vcDNA: vcDNA=SeqID_5357; Strand=+; Position=66-311
  misc_feature (9)..(10): Xaa can be any naturally occurring amino acid
  misc_feature (21)..(22): Xaa can be any naturally occurring amino acid
  misc_feature (67)..(67): Xaa can be any naturally occurring amino acid
  misc_feature (71)..(71): Xaa can be any naturally occurring amino acid
  misc_feature (76)..(77): Xaa can be any naturally occurring amino acid
TFRKPPANXXGKGSYFKGKRXXSNVSPLFPRKVTFPEGNFSRGVFVAPCSKAGRREQNLNAKQMSLXVIPXAESNXXQSRY

SEQ ID NO: 25661 - protein, 94 aa, Diabrotica virgifera
  misc_feature: Coding regions on vcDNA: vcDNA=SeqID_5358; Strand=+; Position=71-353
  misc_feature: Homolog annotation: Hit_ID=XP_321920.1; Match level="QueryCoverage =86%, HitCoverage=25%, E-value=8e-13, Identity=40%"; Hit description =ENSANGP00000023238 [Anopheles gambiae]
  misc_feature (42)..(42): Xaa can be any naturally occurring amino acid
LVNYFFVKSSSEWHQPSTRFLRIGICLVAVMQWRALMKRAVXRIARKWEIKCYCLLPLRTVATCWGYITDVTLADVLTPPVYKMYSNAFGVNIA

SEQ ID NO: 25662 - protein, 75 aa, Diabrotica virgifera
  misc_feature: Coding regions on vcDNA: vcDNA=SeqID_5359; Strand=-; Position=46-273
VVNKVEYGYQSTTSYIMTRDGVLLSEPGKDVKEWKMYFETVLNSDDEDQSDHVRQNSGCRSKDCRTIQRRSAKSR

SEQ ID NO: 25663 - protein, 126 aa, Diabrotica virgifera
  misc_feature: Coding regions on vcDNA: vcDNA=SeqID_5360; Strand=+; Position=46-423
  misc_feature: Homolog annotation: Hit_ID=NP_652048.2; Match level="QueryCoverage =97%, HitCoverage=80%, E-value=8e-13, Identity=34%"; Hit description =CG6421-PA [Drosophila melanogaster] gb|AAF57939.1| CG6421-PA [Drosophila melanogaster]
  misc_feature: Pfam annotation: Pfam_ID=Destabilase; Match level="Score=11.8, E -value=2.5e-07, Copies=1"; Pfam description=Destabilase
  misc_feature (102)..(102): Xaa can be any naturally occurring amino acid
MRFAMLAICLALVAVTAVESVQTNWLNDPLYSCVRCLCHARSGCWIRQNCAKYSINQDYWIKAGSLTASPDESSTSPSAYQNCMRDENCIVGTIINYTGRLXDMDCNCDGVFDCKDMAAIHLMGAG

SEQ ID NO: 25664 - protein, 56 aa, Diabrotica virgifera
  misc_feature: Coding regions on vcDNA: vcDNA=SeqID_5361; Strand=-; Position=8-178
GNTQSGTECFMFFPPLAHDGASNPLDWTARCTYGMNVCSHHPFVWTISWFWGCRSS

SEQ ID NO: 25665 - protein, 78 aa, Diabrotica virgifera
  misc_feature: Coding regions on vcDNA: vcDNA=SeqID_5362; Strand=-; Position=0-233
TGEAHCNSVMFGQPFCCISSLPKKFMRQSPFSTRHFVLSSESVSAWHNIATLSSCRGPFPEVVSKLCLPYEVSRLSVV

SEQ ID NO: 25666 - protein, 55 aa, Diabrotica virgifera
  misc_feature: Coding regions on vcDNA: vcDNA=SeqID_5363; Strand=-; Position=50-217
LECCKHTFFIYDDLLPVCVNIFLDMIFLTRIRLNIREVLFYYLKEAKLFVWVSLR

SEQ ID NO: 25667 - protein, 31 aa, Diabrotica virgifera
  misc_feature: Coding regions on vcDNA: vcDNA=SeqID_5364; Strand=+; Position=2-94
  misc_feature (1)..(1): Xaa can be any naturally occurring amino acid
  misc_feature (3)..(3): Xaa can be any naturally occurring amino acid
XRXKLGEFTGKELEQTSIRYYSGTSGTGHIL

SEQ ID NO: 25668 - protein, 17 aa, Diabrotica virgifera
  misc_feature: Coding regions on vcDNA: vcDNA=SeqID_5365; Strand=+; Position=2-52
IVSRTKNYDSLYGVVLI

SEQ ID NO: 25669 - protein, 52 aa, Diabrotica virgifera
  misc_feature: Coding regions on vcDNA: vcDNA=SeqID_5366; Strand=+; Position=1-159
QHPKINSYKHVSEYFRFDLPFYANLTQLEDENHDDDIIFDDFARLRLTRMRN

SEQ ID NO: 25670 - protein, 43 aa, Diabrotica virgifera
  misc_feature: Coding regions on vcDNA: vcDNA=SeqID_5367; Strand=+; Position=1-132
SWDVTTPYSDVVLRRHMDHRYIFGIVCLEWIGTKFIRRWTPLK

SEQ ID NO: 25671 - protein, 75 aa, Diabrotica virgifera
  misc_feature: Coding regions on vcDNA: vcDNA=SeqID_5368; Strand=+; Position=58-285
RRDISNTCKYRPIALLPVLSKIIERLIKDRLMSFLVENNILSQNQFGFLNNKCTTDAIFSVLHNNLHTAHCHRFL

SEQ ID NO: 25672 - protein, 57 aa, Diabrotica virgifera
  misc_feature: Coding regions on vcDNA: vcDNA=SeqID_5369; Strand=-; Position=55-228
SDVSWKPQQICLHASGHAECSDLSRCVRARTLITRVYETSPISCWRPKDFSASYTPV

SEQ ID NO: 25673 - protein, 50 aa, Diabrotica virgifera
  misc_feature: Coding regions on vcDNA: vcDNA=SeqID_5370; Strand=+; Position=26-178
  misc_feature: Homolog annotation: Hit_ID=NP_731093.2; Match level="QueryCoverage =98%, HitCoverage=94%, E-value=2e-19, Identity=64%"; Hit description =CG31483-PA [Drosophila melanogaster] gb|AAF54113.3| CG31483-PA [Drosophila melanogaster]
MSCCPPCCSPCCSPCCVPCYPCCVPCVYYPCCFPCCSPCCSPCCPPKGCC

SEQ ID NO: 25674 - protein, 23 aa, Diabrotica virgifera
  misc_feature: Coding regions on vcDNA: vcDNA=SeqID_5371; Strand=-; Position=1-69
HVKTPLESDTWVVQLITTPCSES

SEQ ID NO: 25675 - protein, 26 aa, Diabrotica virgifera
  misc_feature: Coding regions on vcDNA: vcDNA=SeqID_5372; Strand=-; Position=2-79
  misc_feature (8)..(8): Xaa can be any naturally occurring amino acid
GSPYFATXSMYTSIIRHTIQYREVQR

SEQ ID NO: 25676 - protein, 81 aa, Diabrotica virgifera
  misc_feature: Coding regions on vcDNA: vcDNA=SeqID_5373; Strand=+; Position=135-380
  misc_feature (7)..(22): Xaa can be any naturally occurring amino acid
  misc_feature (27)..(43): Xaa can be any naturally occurring amino acid
  misc_feature (53)..(60): Xaa can be any naturally occurring amino acid
ELTILIXXXXXXXXXXXXXXXXVKFKXXXXXXXXXXXXXXXXXIYVYRSLVVXXXXXXXXYKFKLFKFSNDDNISSKKLYM

SEQ ID NO: 25677 - protein, 92 aa, Diabrotica virgifera
  misc_feature: Coding regions on vcDNA: vcDNA=SeqID_5374; Strand=+; Position=94-372
  misc_feature: Homolog annotation: Hit_ID=XP_315692.1; Match level="QueryCoverage =85%, HitCoverage=35%, E-value=2e-23, Identity=54%"; Hit description =ENSANGP00000021877 [Anopheles gambiae]
YLYNKYLRKHQYGDFTPFHITITSCSNLALTIFLINLFLGCCSRHSEYWQDRYTGNRWIVSLWTSTPHQQSSLHYTELQHVQIENQGPRVIY

SEQ ID NO: 25678 - protein, 63 aa, Diabrotica virgifera
  misc_feature: Coding regions on vcDNA: vcDNA=SeqID_5375; Strand=-; Position=48-239
  misc_feature (14)..(24): Xaa can be any naturally occurring amino acid
  misc_feature (48)..(58): Xaa can be any naturally occurring amino acid
QSKVCSATVTILNXXXXXXXXXXXFIYIQNNAVFIIGFGVVQPYRVSXXXXXXXXXXXLKKMK

SEQ ID NO: 25679 - protein, 104 aa, Diabrotica virgifera
  misc_feature: Coding regions on vcDNA: vcDNA=SeqID_5376; Strand=+; Position=21-332
  misc_feature: Homolog annotation: Hit_ID=EAL33439.1; Match level="QueryCoverage =95%, HitCoverage=13%, E-value=6e-32, Identity=63%"; Hit description =GA18151-PA [Drosophila pseudoobscura]
  misc_feature: Gene Ontology Annotation: Molecular function=enoyl-CoA hydratase activity; Cellular component=mitochondrion; Biological process=growth
  misc_feature (5)..(5): Xaa can be any naturally occurring amino acid
RYNTXVFSKAKKQVMKQTQGLYPAPLKALEVLRISLDKGETVGFKEEARAFGELAITPQCKGLISLFKGQTQCKKNRFGKPNKEVKTVRVLGAGLMGAGIAQVT

SEQ ID NO: 25680 - protein, 44 aa, Diabrotica virgifera
  misc_feature: Coding regions on vcDNA: vcDNA=SeqID_5377; Strand=-; Position=3-137
SNIVCTRNLLHVLSNFRPSLILEYLNQPINMLKLFISGFRIRRM

SEQ ID NO: 25681 - protein, 112 aa, Diabrotica virgifera
  misc_feature: Coding regions on vcDNA: vcDNA=SeqID_5378; Strand=+; Position=3-341
  misc_feature: Homolog annotation: Hit_ID=XP_319845.1; Match level="QueryCoverage =95%, HitCoverage=25%, E-value=2e-48, Identity=89%"; Hit description =ENSANGP00000016500 [Anopheles gambiae]
  misc_feature: Gene Ontology Annotation: Cellular component=nucleus; Biological process=sulfur amino acid metabolism
ARVDTPPKIESSYAYVEGESLLMALKDVALSSGSACTSASLEPSYVLRAIGTDEDLAHSSIRFGIGRFTTEAEVDYTAKKCIQHVTRLREMSPLWEMVQEGVDLKTIKWSQH

SEQ ID NO: 25682 - protein, 51 aa, Diabrotica virgifera
  misc_feature: Coding regions on vcDNA: vcDNA=SeqID_5379; Strand=-; Position=22-177
ETLASAQHQSHRVAGRFVPSDRLGCFQIGMIIAQLCPDSKMYARILHNRSS

SEQ ID NO: 25683 - protein, 59 aa, Diabrotica virgifera
  misc_feature: Coding regions on vcDNA: vcDNA=SeqID_5380; Strand=-; Position=27-206
SEPLSFLYSFQICKRILKIWMYRVTLGCTFGCFKVTMNLYFLLIRNWIFLRLLVGWFDF

SEQ ID NO: 25684 - protein, 49 aa, Diabrotica virgifera
  misc_feature: Coding regions on vcDNA: vcDNA=SeqID_5381; Strand=+; Position=45-194
  misc_feature (44)..(49): Xaa can be any naturally occurring amino acid
YSLHTSLLTLICRSTGRGQDTHCEIRSLRRSLATDFDAIFFILXXXXXX

SEQ ID NO: 25685 - protein, 80 aa, Diabrotica virgifera
  misc_feature: Coding regions on vcDNA: vcDNA=SeqID_5382; Strand=-; Position=2-241
  misc_feature (32)..(59): Xaa can be any naturally occurring amino acid
ITKSWKGWNTLDIWVARLTAGLKATRKFRPEXXXXXXXXXXXXXXXXXXXXXXXXXXXXILINQKHLSCGVTIVCSELKD

SEQ ID NO: 25686 - protein, 115 aa, Diabrotica virgifera
  misc_feature: Coding regions on vcDNA: vcDNA=SeqID_5383; Strand=+; Position=79-423
  misc_feature: Homolog annotation: Hit_ID=XP_314543.1; Match level="QueryCoverage =100%, HitCoverage=22%, E-value=7e-54, Identity=81%"; Hit description= ENSANGP00000016257 [Anopheles gambiae]
  misc_feature: Pfam annotation: Pfam_ID=WD40; Match level="Score=51.6, E-value=2.2e -12, Copies=2"; Pfam description=WD domain, G-beta repeat
MNLELLESFGQNYPEEFDGTLDSLSIAVTCQFNKRGTLLAVGCNDGRIVIWDFLTRGIAKVIAAHVHPVCSISWSRNGHKVASASTDNNVCIWNILSGECEQKYKFPWSVPKVQF

SEQ ID NO: 25687 - protein, 71 aa, Diabrotica virgifera
  misc_feature: Coding regions on vcDNA: vcDNA=SeqID_5384; Strand=-; Position=103-318
CRHVSEKKLCDNFLLIPVFVSFLFLGTTWASSVKEVRFLNICGVVKREYFSTQSVTEKFGCMNKNYFVNKY

SEQ ID NO: 25688 - protein, 36 aa, Diabrotica virgifera
  misc_feature: Coding regions on vcDNA: vcDNA=SeqID_5385; Strand=+; Position=1-108
STHQSHSAVSTTNIYVIHIQSSDSGKSCPSMTGQLQ

SEQ ID NO: 25689 - protein, 86 aa, Diabrotica virgifera
  misc_feature: Coding regions on vcDNA: vcDNA=SeqID_5386; Strand=+; Position=45-302
  misc_feature: Homolog annotation: Hit_ID=S13251; Match level="QueryCoverage=100%, HitCoverage=21%, E-value=2e-20, Identity=59%"; Hit description =troponin T - fruit fly (Drosophila melanogaster)
  misc_feature (9)..(17): Xaa can be any naturally occurring amino acid
  misc_feature (64)..(70): Xaa can be any naturally occurring amino acid
MSDEEEVYXXXXXXXXXVETTTTTTTKVEEGAGDPEFIKRQDQKRSDLDEQLREYITEWRKQRXXXXXXXKKLKEKQAKRKITRAD

SEQ ID NO: 25690 - protein, 94 aa, Diabrotica virgifera
  misc_feature: Coding regions on vcDNA: vcDNA=SeqID_5387; Strand=+; Position=5-289
  misc_feature: Homolog annotation: Hit_ID=XP_393150.1; Match level="QueryCoverage =93%, HitCoverage=75%, E-value=3e-29, Identity=41%"; Hit description =similar to CG33196-PB [Apis mellifera]
  misc_feature: Pfam annotation: Pfam_ID=WAP; Match level="Score=-1.7, E-value=0.055, Copies=1"; Pfam description=WAP-type (Whey Acidic Protein) 'four-
  misc_feature (25)..(25): Xaa can be any naturally occurring amino acid
MHASKMTLAKCKVYNHVVECVCPPXTISDGNTGCLTIEEKCRVDSDCPLQFACIGFKCINPCIATEPCGINAECTVLNTEPVRTMVCLCLPRYQ

SEQ ID NO: 25691 - protein, 64 aa, Diabrotica virgifera
  misc_feature: Coding regions on vcDNA: vcDNA=SeqID_5388; Strand=+; Position=3-197
  misc_feature (50)..(58): Xaa can be any naturally occurring amino acid
HITFITFSFTSNRRYNTPPNIYNLFKILTNPRYLKLLLFTNILPSRFNIXXXXXXXXXQGRAVL

SEQ ID NO: 25692 - protein, 45 aa, Diabrotica virgifera
  misc_feature: Coding regions on vcDNA: vcDNA=SeqID_5389; Strand=+; Position=201-338
SPMLFIVQQVFYTIFCVTTRDSILTRPTFLSNACRLMMNDIFRIN

SEQ ID NO: 25693 - protein, 117 aa, Diabrotica virgifera
  misc_feature: Coding regions on vcDNA: vcDNA=SeqID_5390; Strand=+; Position=2-354
  misc_feature: Homolog annotation: Hit_ID=XP_393195.1; Match level="QueryCoverage =96%, HitCoverage=34%, E-value=3e-31, Identity=48%"; Hit description =similar to CG3937-PD [Apis mellifera]
  misc_feature: Gene Ontology Annotation: Molecular function=actin binding; Cellular component=actin cytoskeleton; Biological process=cell surface receptor linked signal transduction
  misc_feature: Pfam annotation: Pfam_ID=Filamin; Match level="Score=21.5, E-value =2.6e-06, Copies=1"; Pfam description=Filamin/ABP280 repeat
  misc_feature (62)..(62): Xaa can be any naturally occurring amino acid
  misc_feature (102)..(102): Xaa can be any naturally occurring amino acid
IMYDSRGKCVHELAVIFNGEDSTCSPYKIHLDSFSSGYVTAYGLGRSHGITGEPINLTNSTXDPSAGGLSITVECPSKADISCHDVNHCNVSVSYLPTAPGXFKISVIFGDYHNNRS

SEQ ID NO: 25694 - protein, 59 aa, Diabrotica virgifera
  misc_feature: Coding regions on vcDNA: vcDNA=SeqID_5391; Strand=-; Position=189-368
VGAIGEPKNSSHMLVPSLSFEYGCRYSRIRILKLMLKCTGYSICLSVGLLINGTVKTFY

SEQ ID NO: 25695 - protein, 58 aa, Diabrotica virgifera
  misc_feature: Coding regions on vcDNA: vcDNA=SeqID_5392; Strand=-; Position=147-323
NCVYLLFSNCINPFLSLNHLMLSDRKVVEYTVTIITSISTLFKTTTFVRHLKAVICNA

SEQ ID NO: 25696 - protein, 53 aa, Diabrotica virgifera
  misc_feature: Coding regions on vcDNA: vcDNA=SeqID_5393; Strand=+; Position=29-190
  misc_feature (28)..(35): Xaa can be any naturally occurring amino acid
HIHIPSRQSTTINTIQGNLYTLIQHNSXXXXXXXXLQIAFDMKDDLRLIGLHH

SEQ ID NO: 25697 - protein, 89 aa, Diabrotica virgifera
  misc_feature: Coding regions on vcDNA: vcDNA=SeqID_5394; Strand=-; Position=0-266
KISDGILMTIKANPVMLYTIGSFYLHNSTVIFRDTHGPQSNDVVFEHNLFSHIPNSVSMSKCFKSSNSGMWYYHTITHRYCTRVCSSDP

SEQ ID NO: 25698 - protein, 108 aa, Diabrotica virgifera
  misc_feature: Coding regions on vcDNA: vcDNA=SeqID_5395; Strand=+; Position=3-326
  misc_feature: Homolog annotation: Hit_ID=EAL30028.1; Match level="QueryCoverage =91%, HitCoverage=17%, E-value=2e-13, Identity=42%"; Hit description =GA18703-PA [Drosophila pseudoobscura]
  misc_feature: Gene Ontology Annotation: Cellular component=mitochondrion
HASGHASGESDTTNDMMNHLATLALAGALVGTAFTSDSISNAVNIAYIFSYVDTIDNSLSNHQRIRIRFDYGSRLICTLSSRGSIGATIGIYIDNYVLTNVLSDAQHM

SEQ ID NO: 25699 - protein, 102 aa, Diabrotica virgifera
  misc_feature: Coding regions on vcDNA: vcDNA=SeqID_5396; Strand=+; Position=57-362
ARFSISDTEYVVMVIFVLLHVAIISISNAQFRTWLQIPGALAVLDNSRSFQLRHYGLNAHDFVPLPSSPNPIPTREIATVIEEPQDNYPSVQPEPQSSLTSL

SEQ ID NO: 25700 - protein, 126 aa, Diabrotica virgifera
  misc_feature: Coding regions on vcDNA: vcDNA=SeqID_5397; Strand=+; Position=3-380
LHRFHDEMITSSYTSHKTTITDEHYDYVSTFSVSKLSILKNFVQPPRSIIISLSQSGGYNDEDFLYVVTIHGNADLFDEVYHHKNHDDAPQWFVFNPEHSTDIDTEDNHEHVVLKVSNSSYYQEVS

SEQ ID NO: 25701 - protein, 66 aa, Diabrotica virgifera
  misc_feature: Coding regions on vcDNA: vcDNA=SeqID_5398; Strand=+; Position=1-201
QASRGSRSRRIVNRMPYNRRPNRGRIRERPRYDYDDEEDDLVDDEEDVNSRRACPIETDSISSSRK

SEQ ID NO: 25702 - protein, 34 aa, Diabrotica virgifera
  misc_feature: Coding regions on vcDNA: vcDNA=SeqID_5399; Strand=-; Position=2-103
  misc_feature (17)..(24): Xaa can be any naturally occurring amino acid
NYSIINILLLHKSSLSXXXXXXXXHEPINTSHYR

SEQ ID NO: 25703 - protein, 135 aa, Diabrotica virgifera
  misc_feature: Coding regions on vcDNA: vcDNA=SeqID_5400; Strand=+; Position=3-407
  misc_feature: Homolog annotation: Hit_ID=XP_394490.1; Match level="QueryCoverage =98%, HitCoverage=8%, E-value=1e-40, Identity=61%"; Hit description =similar to CG7806-PA [Apis mellifera]
  misc_feature: Gene Ontology Annotation: Molecular function=arsenite transporter activity; Cellular component=vacuolar membrane; Biological process =bilirubin transport
TIRAMRVIHKFKHDNNQHLEANLKAQFASQAAARWLGLRLQFIGVIIITGVSFIAVIQHQYDIADPGFIGLAISYALGITGSLSGVVNSFTETEREMVAVERINQYVESIPMESKYFVMDPPFAWPSQGVISFEH

SEQ ID NO: 25704 - protein, 56 aa, Diabrotica virgifera
  misc_feature: Coding regions on vcDNA: vcDNA=SeqID_5401; Strand=-; Position=2-169
IVEEKSCKMHYSRRKRFSTINLRPSFITDSKPCDFLPRPFLWLNRIYICLVLADAW

SEQ ID NO: 25705 - protein, 121 aa, Diabrotica virgifera
  misc_feature: Coding regions on vcDNA: vcDNA=SeqID_5402; Strand=+; Position=11-373
LPTEKYDSRYDYRYSNTKVIIVIQSFLSLKQIGEGRCYIGIPIQNTYLLGYDSRYDYRYSNTKVIIVMKSFLSLKQIGEGRCYIGIPIQNTYLLGYDSRYDYRYSNTKVIIVIKSFLSLKQ

SEQ ID NO: 25706 - protein, 72 aa, Diabrotica virgifera
  misc_feature: Coding regions on vcDNA: vcDNA=SeqID_5403; Strand=+; Position=1-219
RTRGKNYLENLMSKSATVDCSNKANKLFFRSRMYFRIKELNKSLNNLTLRKRKIMKTATYLLYVRLFHMHKI

SEQ ID NO: 25707 - protein, 86 aa, Diabrotica virgifera
  misc_feature: Coding regions on vcDNA: vcDNA=SeqID_5404; Strand=+; Position=98-355
  misc_feature: Homolog annotation: Hit_ID=AAV68692.1; Match level="QueryCoverage =68%, HitCoverage=13%, E-value=4e-12, Identity=59%"; Hit description =putative IDGF [Diaprepes abbreviatus]
  misc_feature (30)..(36): Xaa can be any naturally occurring amino acid
MYCRQLQRSHIINGCNSAKLRLNYKQYDVXXXXXXXITDLKKTHPKLKVLLSVGGNEDVSGSGDEKNEQYRTILESTAHRLSFVNS

SEQ ID NO: 25708 - protein, 120 aa, Diabrotica virgifera
  misc_feature: Coding regions on vcDNA: vcDNA=SeqID_5405; Strand=+; Position=1-363
  misc_feature: Homolog annotation: Hit_ID=XP_395748.1; Match level="QueryCoverage =93%, HitCoverage=19%, E-value=2e-30, Identity=56%"; Hit description =similar to guanosine monophosphate reductase [Apis mellifera]
  misc_feature: Gene Ontology Annotation: Molecular function=FK506 binding; Cellular component=cytoplasm; Biological process=biological_process unknown
  misc_feature: Pfam annotation: Pfam_ID=TPR_1; Match level="Score=29.1, E-value=1.3e- 05, Copies=1"; Pfam description=Tetratricopeptide repeat
ALFRRGQAYIQLREPELARQDFTRCLEIDPNNTAAKSQLTICSKTLKEQLQKEKKIYANMFDKFAKMDTQREEYENRKLPNVMSSVGEWGQEDREREPSEFEKENPDIILLNKTGEFKDM

SEQ ID NO: 25709 - protein, 46 aa, Diabrotica virgifera
  misc_feature: Coding regions on vcDNA: vcDNA=SeqID_5406; Strand=-; Position=2-139
  misc_feature (20)..(20): Xaa can be any naturally occurring amino acid
SYTKNTKHNTLSIYRALSYXTLTCQFTQLSCKYIKRHIKAKIVSVS

SEQ ID NO: 25710 - protein, 139 aa, Diabrotica virgifera
  misc_feature: Coding regions on vcDNA: vcDNA=SeqID_5407; Strand=+; Position=2-418
  misc_feature: Pfam annotation: Pfam_ID=SWIM; Match level="Score=15.4, E-value =0.038, Copies=1"; Pfam description=SWIM zinc finger
IYISMSEAREVKLTLSQLFMWLQGRQRSLVEGEAVFDAGHIIFCKLKKQDALEVVALCVQTSSINTLPHEISIKIPCEEDLTTWSCKCSCKAGESGCCKHVVATLIYINRKSKLEFCSPTELEQAWGVNKPLIKETYQR

SEQ ID NO: 25711 - protein, 93 aa, Diabrotica virgifera
  misc_feature: Coding regions on vcDNA: vcDNA=SeqID_5408; Strand=+; Position=45-323
LFMGTFDALTIIYINIDVNYYLLIRMLLYSTVRKHMRTIFDIVSGAEILPINMRISQDDKPSYDHKCRYAHHSYNPPSQYSVTGGEYNHIYVL

SEQ ID NO: 25712 - protein, 125 aa, Diabrotica virgifera
  misc_feature: Coding regions on vcDNA: vcDNA=SeqID_5409; Strand=+; Position=3-377
PNAPSRTLQIDESRNGHQLGYSTLQSVYNDRVNHTDVLADHFSHYDGIVYDHTFYSLLITLQHSVHAGVINRLVLDVVINCDQQGVQGVSDIVSLQGLSGYGNFQRSTTVYSPLNEIVKNRLQGK

SEQ ID NO: 25713 - protein, 42 aa, Diabrotica virgifera
  misc_feature: Coding regions on vcDNA: vcDNA=SeqID_5410; Strand=+; Position=88-216
ESRFFRDNFRIIALDIAQFYLERQQDIAGVVLIVKITQILHK

SEQ ID NO: 25714 - protein, 64 aa, Diabrotica virgifera
  misc_feature: Coding regions on vcDNA: vcDNA=SeqID_5411; Strand=+; Position=149-340
  misc_feature: Homolog annotation: Hit_ID=AAV91413.1; Match level="QueryCoverage =96%, HitCoverage=62%, E-value=2e-16, Identity=67%"; Hit description =myosin 3 light chain [Lonomia obliqua]
SSSKKAKASGSNVISMSPESQVAEFKEAFQLMDHDSDGNSSNSDVRATFDAVGSLASDNELDEM

SEQ ID NO: 25715 - protein, 126 aa, Diabrotica virgifera
  misc_feature: Coding regions on vcDNA: vcDNA=SeqID_5412; Strand=-; Position=0-377
  misc_feature (42)..(61): Xaa can be any naturally occurring amino acid
SSSSRFLLCSSISLRGSSIGSLTFLISLGGESGLLSSITGAXXXXXXXXXXXXXXXXXXXXMTISSSTLGLGFGLGGGGGLSEGRRRRLGRSSSVDSNFNCPSSVIVDSPGKNIGVDSSSPITRPA

SEQ ID NO: 25716 - protein, 80 aa, Diabrotica virgifera
  misc_feature: Coding regions on vcDNA: vcDNA=SeqID_5413; Strand=-; Position=12-254
  misc_feature (13)..(32): Xaa can be any naturally occurring amino acid
  misc_feature (43)..(50): Xaa can be any naturally occurring amino acid
  misc_feature (55)..(67): Xaa can be any naturally occurring amino acid
YYLQILDINNLNXXXXXXXXXXXXXXXXXXXXTDLKIWKLLIXXXXXXXXLNNMXXXXXXXXXXXXXLITIFNSNINVNK

SEQ ID NO: 25717 - protein, 85 aa, Diabrotica virgifera
  misc_feature: Coding regions on vcDNA: vcDNA=SeqID_5414; Strand=-; Position=144-401
PAECTENTIVSATPPRARGLKTSQEGWQSVLGNHSVHADRPIDYNVDTDLCDHPIRSVVSFYIALSYKLSKKLSDIITEYTKFFT

SEQ ID NO: 25718 - protein, 108 aa, Diabrotica virgifera
  misc_feature: Coding regions on vcDNA: vcDNA=SeqID_5415; Strand=+; Position=2-328
  misc_feature: Homolog annotation: Hit_ID=CAD31740.4; Match level="QueryCoverage =100%, HitCoverage=83%, E-value=3e-43, Identity=53%"; Hit description= chitinase [Tenebrio molitor]
  misc_feature: Gene Ontology Annotation: Molecular function=chitinase activity; Cellular component=extracellular space; Biological process=response to bacteria
  misc_feature (67)..(72): Xaa can be any naturally occurring amino acid
FTTAGGFLSFYEICERVRKQGWTVTRDPEGRIGPYATHGNQWVSYDDISEVKRKAQLVKDLGLGGGXXXXXXLDDFRNRCGCGKHPLLKTLNKELRGIRTDIYVQNCT

SEQ ID NO: 25719 - protein, 121 aa, Diabrotica virgifera
  misc_feature: Coding regions on vcDNA: vcDNA=SeqID_5416; Strand=+; Position=61-423
  misc_feature: Homolog annotation: Hit_ID=EAL28511.1; Match level="QueryCoverage =78%, HitCoverage=30%, E-value=2e-12, Identity=31%"; Hit description =GA15415-PA [Drosophila pseudoobscura]
MESENFLITDYKKVWTHFGKTEETVDKDVKIIKNWIKSNHYFPEIPDDIMIQHFLTNCNFSIERTKQCLDMYYAVRIVVPEMYNYTNPTSSYMAAAYELILCCPLPRLTDQLERILFLKLN

SEQ ID NO: 25720 - protein, 70 aa, Diabrotica virgifera
  misc_feature: Coding regions on vcDNA: vcDNA=SeqID_5417; Strand=+; Position=1-213
  misc_feature (15)..(27): Xaa can be any naturally occurring amino acid
  misc_feature (35)..(47): Xaa can be any naturally occurring amino acid
STRPSAYINICIYVXXXXXXXXXXXXXVCNLSIKXXXXXXXXXXXXXRAHKFDTPGILSCFKIYLNLVRM

SEQ ID NO: 25721 - protein, 18 aa, Diabrotica virgifera
  misc_feature: Coding regions on vcDNA: vcDNA=SeqID_5418; Strand=+; Position=3-56
RRTLRPPKVSHISREVYT

SEQ ID NO: 25722 - protein, 92 aa, Diabrotica virgifera
  misc_feature: Coding regions on vcDNA: vcDNA=SeqID_5419; Strand=-; Position=122-400
  misc_feature (5)..(5): Xaa can be any naturally occurring amino acid
  misc_feature (16)..(25): Xaa can be any naturally occurring amino acid
  misc_feature (48)..(48): Xaa can be any naturally occurring amino acid
LLVYXKKTPRHSSPSXXXXXXXXXXVLNVVTRVYCEICRIAHDFFAHXPPGRPELFEISSKGVANPNGCSYYAFLHGLLPPPFASSDSLCSV

SEQ ID NO: 25723 - protein, 65 aa, Diabrotica virgifera
  misc_feature: Coding regions on vcDNA: vcDNA=SeqID_5420; Strand=+; Position=96-293
  misc_feature (28)..(35): Xaa can be any naturally occurring amino acid
IFELHHFLYYLTLQLYLHLSRFALITMXXXXXXXXESNVINFLAVILNWCRVQHIYIVNHLQFER

SEQ ID NO: 25724 - protein, 43 aa, Diabrotica virgifera
  misc_feature: Coding regions on vcDNA: vcDNA=SeqID_5421; Strand=-; Position=139-270
ESNQHPVMTDNRVRLFPLRKCIAVSYQYCILGVNFSITIFNYV

SEQ ID NO: 25725 - protein, 88 aa, Diabrotica virgifera
  misc_feature: Coding regions on vcDNA: vcDNA=SeqID_5422; Strand=+; Position=3-269
  misc_feature (4)..(11): Xaa can be any naturally occurring amino acid
  misc_feature (19)..(26): Xaa can be any naturally occurring amino acid
  misc_feature (63)..(73): Xaa can be any naturally occurring amino acid
ASRXXXXXXXXCSSVREIXXXXXXXXYIGNLINFSLRPVSQEYQAPRRRLSKRSHYVVWIHIXXXXXXXXXXXYACLGVPVCGVTKGL

SEQ ID NO: 25726 - protein, 80 aa, Diabrotica virgifera
  misc_feature: Coding regions on vcDNA: vcDNA=SeqID_5423; Strand=-; Position=25-267
  misc_feature (44)..(53): Xaa can be any naturally occurring amino acid
EIYQCQSLDVTTFQMSKLDVILSNVNCSPIEMWLFPKRTEINSXXXXXXXXXXKFIKICSYCSIFIMINDTYDLLKFLSP

SEQ ID NO: 25727 - protein, 70 aa, Diabrotica virgifera
  misc_feature: Coding regions on vcDNA: vcDNA=SeqID_5424; Strand=+; Position=3-215
  misc_feature (10)..(16): Xaa can be any naturally occurring amino acid
ASTESRINAXXXXXXXLSKGAIFISSSSLGFTMFPKALMNLMSHQVLLSVSSGKIWYVYCFIDSPNSLNL

SEQ ID NO: 25728 - protein, 59 aa, Diabrotica virgifera
  misc_feature: Coding regions on vcDNA: vcDNA=SeqID_5425; Strand=-; Position=0-176
TSRKQRPTITQFPSLTKFIPEQSKSFNKGRCIEIILTNGVSFCQTLISPTHSRLLRPPA

SEQ ID NO: 25729 - protein, 48 aa, Diabrotica virgifera
  misc_feature: Coding regions on vcDNA: vcDNA=SeqID_5426; Strand=-; Position=5-151
PVPITGLQAGRPTPDVLGILGDLLLSKDGILLAYMMVNGQDNIELHEP

SEQ ID NO: 25730 - protein, 70 aa, Diabrotica virgifera
  misc_feature: Coding regions on vcDNA: vcDNA=SeqID_5427; Strand=+; Position=189-399
  misc_feature: Homolog annotation: Hit_ID=CAH70100.1; Match level="QueryCoverage =100%, HitCoverage=47%, E-value=2e-14, Identity=61%"; Hit description= polymerase (DNA directed), epsilon 3 (p17 subunit) [Homo sapiens] gb|AAH04170.1| Polymerase (DNA directed
  misc_feature: Gene Ontology Annotation: Molecular function=protein binding
  misc_feature: Pfam annotation: Pfam_ID=CBFD_NFYB_HMF; Match level="Score=38.6, E -value=1.9e-08, Copies=1"; Pfam description=Histone-like transcription factor (CBF
  misc_feature (17)..(17): Xaa can be any naturally occurring amino acid
  misc_feature (27)..(27): Xaa can be any naturally occurring amino acid
RLEDLNLPNNTVQIIMXEALPDSVNIXKDARSALSRAASVYVLYVTSQASNEAHFNSRQTLMAGDVLKGI

SEQ ID NO: 25731 - protein, 62 aa, Diabrotica virgifera
  misc_feature: Coding regions on vcDNA: vcDNA=SeqID_5428; Strand=-; Position=120-308
MAQRIFATRGIWFKMHTVSRLISYVHIHVEYLQFYSLMTCHIRALIEFHNPFGSFVRHSLIR

SEQ ID NO: 25732 - protein, 93 aa, Diabrotica virgifera
  misc_feature: Coding regions on vcDNA: vcDNA=SeqID_5429; Strand=-; Position=98-379
NIKLLMPTYYGRSQGKILGNDGLREQCGVQHVVRWGRQRRREWFSHVKRMEEHRLPRIALEGKLAGKHPPGRPPKRWRDSWKFTSQEILQSRN

SEQ ID NO: 25733 - protein, 92 aa, Diabrotica virgifera
  misc_feature: Coding regions on vcDNA: vcDNA=SeqID_5430; Strand=-; Position=153-431
  misc_feature (92)..(92): Xaa can be any naturally occurring amino acid
FMNQLETISKHPVFKQFLYWWRYVDDILVCFTGTNRQLDQFLSYINSLHSNIELTIEPEQNKSINFLDVTITRLHNKHEFSVYHKHTHITDX

SEQ ID NO: 25734 - protein, 58 aa, Diabrotica virgifera
  misc_feature: Coding regions on vcDNA: vcDNA=SeqID_5431; Strand=+; Position=1-177
  misc_feature: Homolog annotation: Hit_ID=XP_393452.1; Match level="QueryCoverage =100%, HitCoverage=18%, E-value=5e-17, Identity=71%"; Hit description= similar to ENSANGP00000018395 [Apis mellifera]
SPQYGVPSYQYRVVGIDLEGIKQAIQVAQYNQISQGPSFGGYPSGPSSIPSGSYGAPY

SEQ ID NO: 25735 - protein, 33 aa, Diabrotica virgifera
  misc_feature: Coding regions on vcDNA: vcDNA=SeqID_5432; Strand=-; Position=87-188
EGIKLTGLGYHRKIDPYEKSPVMGHKRGKNDFI

SEQ ID NO: 25736 - protein, 56 aa, Diabrotica virgifera
  misc_feature: Coding regions on vcDNA: vcDNA=SeqID_5433; Strand=-; Position=213-383
  misc_feature (12)..(12): Xaa can be any naturally occurring amino acid
KLKIIPKYYVIXLIYWYIIIGLMLIFTVERLRKKTAIFKSESHVCTKKLFRVLKER

SEQ ID NO: 25737 - protein, 149 aa, Diabrotica virgifera
  misc_feature: Coding regions on vcDNA: vcDNA=SeqID_5434; Strand=+; Position=12-458
  misc_feature: Homolog annotation: Hit_ID=P26967; Match level="QueryCoverage=90%, HitCoverage=62%, E-value=1e-39, Identity=64%"; Hit description=Adult- specific cuticular protein ACP-20 precursor pir||S23463 cuticular protein ACP20 precursor,
  misc_feature: Gene Ontology Annotation: Molecular function=structural constituent of eye lens
  misc_feature: Pfam annotation: Pfam_ID=Chitin_bind_4; Match level="Score=99.8, E -value=6.9e-27, Copies=1"; Pfam description=Insect cuticle protein
MIAKVVLVCAFVAVAHGVGISVLDGGLGLGLGGHGLLGSGALVTGHSVAVAQPSVDLHAPANYQFKYGVQDAHTGDNKQQSEVRVGDTVRGEYSLAEPDGTIRVVKYTADPHNGFNAIVSRVGHAAHPQVVQRTVVAAPVISHAPVIAH

SEQ ID NO: 25738 - protein, 32 aa, Diabrotica virgifera
  misc_feature: Coding regions on vcDNA: vcDNA=SeqID_5435; Strand=-; Position=1-96
  misc_feature (2)..(24): Xaa can be any naturally occurring amino acid
YXXXXXXXXXXXXXXXXXXXXXXXPFLTRGRP

SEQ ID NO: 25739 - protein, 63 aa, Diabrotica virgifera
  misc_feature: Coding regions on vcDNA: vcDNA=SeqID_5436; Strand=+; Position=48-239
HTFPIFGISRAPNKLHSICYIVTKLKYLFVSYLDLENFWSLVKFIFQLTQVLSLGVVVKLVAY

SEQ ID NO: 25740 - protein, 103 aa, Diabrotica virgifera
  misc_feature: Coding regions on vcDNA: vcDNA=SeqID_5437; Strand=+; Position=34-345
  misc_feature: Homolog annotation: Hit_ID=EAL31424.1; Match level="QueryCoverage =94%, HitCoverage=16%, E-value=2e-15, Identity=47%"; Hit description =GA11433-PA [Drosophila pseudoobscura]
  misc_feature: Gene Ontology Annotation: Molecular function=lysine-tRNA ligase activity; Cellular component=soluble fraction; Biological process =protein biosynthesis
  misc_feature (7)..(7): Xaa can be any naturally occurring amino acid
  misc_feature (88)..(88): Xaa can be any naturally occurring amino acid
LPVAEDXSPVVYLTVNSSADVTLKGIGGEDSFYPHVFHVSSSVESFIDKYSYLTDGDILSIDDLNVGGSFHAINESGRMLVFYSFMGXGVKIYFMANAKYYSH

SEQ ID NO: 25741 - protein, 82 aa, Diabrotica virgifera
  misc_feature: Coding regions on vcDNA: vcDNA=SeqID_5438; Strand=+; Position=1-249
CNKPLVLLKAKYQNRNINIKVTPVNLTRSNTGFAKTMSEALEESLSADTQDSVEAPRHAFTEVASLNAEDPSFHPQNKSAMS

SEQ ID NO: 25742 - protein, 65 aa, Diabrotica virgifera
  misc_feature: Coding regions on vcDNA: vcDNA=SeqID_5439; Strand=-; Position=267-464
LFAHSIEVDQDICNLYIAIYNDGLPWSSPHVSGGFIYLKVLIHKFIINLINLYRGDWCCNQIYVL

SEQ ID NO: 25743 - protein, 117 aa, Diabrotica virgifera
  misc_feature: Coding regions on vcDNA: vcDNA=SeqID_5440; Strand=+; Position=3-353
  misc_feature: Homolog annotation: Hit_ID=NP_652607.1; Match level="QueryCoverage =97%, HitCoverage=7%, E-value=9e-39, Identity=67%"; Hit description =CG7487-PA [Drosophila melanogaster] gb|AAF50477.1| CG7487-PA [Drosophila melanogaster]
  misc_feature: Gene Ontology Annotation: Molecular function=DNA helicase activity; Cellular component=nucleus; Biological process=development
  misc_feature: Pfam annotation: Pfam_ID=Helicase_C; Match level="Score=27.5, E-value= 4.1e-05, Copies=1"; Pfam description=Helicase conserved C-terminal domain
  misc_feature (58)..(63): Xaa can be any naturally occurring amino acid
HASELLLSDRFKDCKSIIVYCTRRQECERIAGFLRTCLKGEEPVNNSNTKKRKRMNLXXXXXXAGLSASRRRTIQNAFMSGQLRIVVATVAFGMGINKSDIRAVIHYNMPSNFESYV

SEQ ID NO: 25744 - protein, 103 aa, Diabrotica virgifera
  misc_feature: Coding regions on vcDNA: vcDNA=SeqID_5441; Strand=+; Position=49-358
  misc_feature: Homolog annotation: Hit_ID=AAB18243.1; Match level="QueryCoverage =81%, HitCoverage=18%, E-value=8e-11, Identity=40%"; Hit description =microsomal epoxide hydrolase [Trichoplusia ni]
  misc_feature: Pfam annotation: Pfam_ID=EHN; Match level="Score=-25.5, E-value=4.6e -05, Copies=1"; Pfam description=Epoxide hydrolase N terminus
  misc_feature (44)..(44): Xaa can be any naturally occurring amino acid
  misc_feature (91)..(91): Xaa can be any naturally occurring amino acid
VVYRTTSLFQSRKVSGLGEKWWSVAAPARVGTSSRPFMIQISEXILKDLNDRLYRCLPFQASLDGVKQHYRMNTNLLTTKVDYWQNTCDGXQREGFFNQYPQF

SEQ ID NO: 25745 - protein, 141 aa, Diabrotica virgifera
  misc_feature: Coding regions on vcDNA: vcDNA=SeqID_5442; Strand=+; Position=46-467
  misc_feature: Homolog annotation: Hit_ID=XP_321263.1; Match level="QueryCoverage =70%, HitCoverage=24%, E-value=9e-20, Identity=45%"; Hit description =ENSANGP00000018359 [Anopheles gambiae]
  misc_feature: Gene Ontology Annotation: Molecular function=receptor activity; Cellular component=integral to plasma membrane; Biological process =cell proliferation
  misc_feature: Pfam annotation: Pfam_ID=Ldl_recept_a; Match level="Score=61.4, E -value=2.6e-15, Copies=2"; Pfam description=Low-density lipoprotein receptor doma
  misc_feature (68)..(68): Xaa can be any naturally occurring amino acid
  misc_feature (95)..(95): Xaa can be any naturally occurring amino acid
  misc_feature (113)..(113): Xaa can be any naturally occurring amino acid
MTSDGFVKCFLCFYFVSSVLVISHGYTISLVRSPRAVKKCDGFVCATSGTCIKAEDRCDGKVDCPDGXDEFSDCKTAVQCPGYLYVCDYGACINXDKQCNGVQDCRDNSDENXCPDAPSVNCKPNEFECSNGQCIHRDLKC

SEQ ID NO: 25746 - protein, 37 aa, Diabrotica virgifera
  misc_feature: Coding regions on vcDNA: vcDNA=SeqID_5443; Strand=-; Position=1-111
  misc_feature (1)..(16): Xaa can be any naturally occurring amino acid
  misc_feature (22)..(37): Xaa can be any naturally occurring amino acid
XXXXXXXXXXXXXXXXPCYPRXXXXXXXXXXXXXXXX

SEQ ID NO: 25747 - protein, 42 aa, Diabrotica virgifera
  misc_feature: Coding regions on vcDNA: vcDNA=SeqID_5444; Strand=-; Position=92-220
QPWIKIFVILYNNPILPYAPTEVEDYNKYISHVTSDVLSNIN

SEQ ID NO: 25748 - protein, 86 aa, Diabrotica virgifera
  misc_feature: Coding regions on vcDNA: vcDNA=SeqID_5445; Strand=+; Position=59-319
YYFLKFMADTKYYVNFSLIMLLMVCKAMCSRNNSRIVTLTLSQSRKMSFCANLGFLFKEENNLINRYKLAKQAGFYSVKNTLSLRI

SEQ ID NO: 25749 - protein, 43 aa, Diabrotica virgifera
  misc_feature: Coding regions on vcDNA: vcDNA=SeqID_5446; Strand=-; Position=183-314
PQLTCYPLQTMYIFLGYSYHHNNTSLKIQSFNTYTEDTLTPIC

SEQ ID NO: 25750 - protein, 42 aa, Diabrotica virgifera
  misc_feature: Coding regions on vcDNA: vcDNA=SeqID_5447; Strand=-; Position=54-182
YTRLTHPYLYDQMLTLSSSISQHLQRVTAKTSKNHYCINNSY

SEQ ID NO: 25751 - protein, 43 aa, Diabrotica virgifera
  misc_feature: Coding regions on vcDNA: vcDNA=SeqID_5448; Strand=+; Position=2-133
ANSVQRRSRLTNLSSNGFTLGTKFGVIELRQSIDGKQDFFRHR

SEQ ID NO: 25752 - protein, 47 aa, Diabrotica virgifera
  misc_feature: Coding regions on vcDNA: vcDNA=SeqID_5449; Strand=+; Position=2-145
  misc_feature (18)..(26): Xaa can be any naturally occurring amino acid
RLCTDVVVLSYFYILVFXXXXXXXXXYRFRLFTFSTDDNISTKTLYI

SEQ ID NO: 25753 - protein, 80 aa, Diabrotica virgifera
  misc_feature: Coding regions on vcDNA: vcDNA=SeqID_5450; Strand=+; Position=3-245
  misc_feature (13)..(23): Xaa can be any naturally occurring amino acid
  misc_feature (25)..(46): Xaa can be any naturally occurring amino acid
TIKSRIKFTIRKXXXXXXXXXXXYXXXXXXXXXXXXXXXXXXXXXXLVYQGLIINNSRIISFELTRANKLTFLLSSKYFS

SEQ ID NO: 25754 - protein, 125 aa, Diabrotica virgifera
  misc_feature: Coding regions on vcDNA: vcDNA=SeqID_5451; Strand=+; Position=3-380
  misc_feature: Homolog annotation: Hit_ID=XP_312393.1; Match level="QueryCoverage =85%, HitCoverage=43%, E-value=6e-14, Identity=38%"; Hit description =ENSANGP00000012754 [Anopheles gambiae]
  misc_feature (106)..(112): Xaa can be any naturally occurring amino acid
HASGFLWTVKEKQLSSILENTVLFSEIALRFPEISTSLLKRNKNWDLVLQWGIAFTYHMRHLLDDNTIQLLRLVSQELNHVERHPDYVNPYRKSPEVQKDIVQPKXXXXXXXIKKGPKLSSRFEL

SEQ ID NO: 25755 - protein, 49 aa, Diabrotica virgifera
  misc_feature: Coding regions on vcDNA: vcDNA=SeqID_5452; Strand=+; Position=157-303
DSKSLCNQLAIVGSNMISIVYLVRILILHLVVLHVIQQYPVIINIYVAQ

SEQ ID NO: 25756 - protein, 63 aa, Diabrotica virgifera
  misc_feature: Coding regions on vcDNA: vcDNA=SeqID_5453; Strand=+; Position=81-272
  misc_feature (3)..(11): Xaa can be any naturally occurring amino acid
KGXXXXXXXXXQEHTKHLQVAEEAQKMGRDDFKIATEQTDQECLSFDLEKTLPLPRRPTGIVF

SEQ ID NO: 25757 - protein, 36 aa, Diabrotica virgifera
  misc_feature: Coding regions on vcDNA: vcDNA=SeqID_5454; Strand=-; Position=0-107
TLTLEMLSLHPYYRPAHLTFHTNSQLSPTPHVIIRL

SEQ ID NO: 25758 - protein, 141 aa, Diabrotica virgifera
  misc_feature: Coding regions on vcDNA: vcDNA=SeqID_5455; Strand=+; Position=55-477
  misc_feature: Homolog annotation: Hit_ID=XP_396405.1; Match level="QueryCoverage =96%, HitCoverage=69%, E-value=5e-33, Identity=49%"; Hit description =similar to CG3587-PA [Apis mellifera]
  misc_feature: Gene Ontology Annotation: Molecular function=enzyme regulator activity; Cellular component=DNA-directed RNA polymerase II, holoenzyme; Biological process=transcription from Pol II promoter
  misc_feature (65)..(65): Xaa can be any naturally occurring amino acid
  misc_feature (106)..(106): Xaa can be any naturally occurring amino acid
  misc_feature (110)..(110): Xaa can be any naturally occurring amino acid
ATTQGKEVHIINELDHIVNAGFDKNSFYDDKDKENHIRGLLKSEVLKLVSANNIVILDALNYIIXYRYELFCGTKANKCTQCTVHTEINREEAWQFNENRTNDAEXYNRXTFDALVMRYEDPNGNNRWDAPLFTNFPNQDL

SEQ ID NO: 25759 - protein, 19 aa, Diabrotica virgifera
  misc_feature: Coding regions on vcDNA: vcDNA=SeqID_5456; Strand=+; Position=1-60
IESRIKLHTDNEITLLPLT

SEQ ID NO: 25760 - protein, 68 aa, Diabrotica virgifera
  misc_feature: Coding regions on vcDNA: vcDNA=SeqID_5457; Strand=+; Position=1-207
SDAGCPRKLIIDGTTDIIDNNAFGQRISLGPKALGICTIDLKRYYPYNTLGTLITISTRRFHYNIVTN

SEQ ID NO: 25761 - protein, 51 aa, Diabrotica virgifera
  misc_feature: Coding regions on vcDNA: vcDNA=SeqID_5458; Strand=-; Position=23-178
CLICVRHGSVTKASLSCSIFLSRMSSYVCMCRMCGDLNYKGFRSYKSNRTP

SEQ ID NO: 25762 - protein, 69 aa, Diabrotica virgifera
  misc_feature: Coding regions on vcDNA: vcDNA=SeqID_5459; Strand=+; Position=229-435
IVLTKQVMTEFTRLAKNEALLLYLSTIFVRNTCIMVPIWTNDSTQRINHEVRPSRADVVPHQSYNYLNQ

SEQ ID NO: 25763 - protein, 51 aa, Diabrotica virgifera
  misc_feature: Coding regions on vcDNA: vcDNA=SeqID_5460; Strand=-; Position=179-334
VVICRCSFTIVGWNLYLSAGDVLHSNIDGPMLGDVPITVADVQAAAVSHAR

SEQ ID NO: 25764 - protein, 97 aa, Diabrotica virgifera
  misc_feature: Coding regions on vcDNA: vcDNA=SeqID_5461; Strand=+; Position=1-294
  misc_feature (65)..(76): Xaa can be any naturally occurring amino acid
  misc_feature (85)..(92): Xaa can be any naturally occurring amino acid
QKMNNNYQKLTKTQQCQKNNMNRPGFEPAISQSLDLWSNALPTRLSRRLLLTFRIYIITHHGDKXXXXXXXXXXXXPKEDKSKDXXXXXXXXFTKKH

SEQ ID NO: 25765 - protein, 42 aa, Diabrotica virgifera
  misc_feature: Coding regions on vcDNA: vcDNA=SeqID_5462; Strand=+; Position=3-128
SESRVTCFVTGYFFVCCAHRQSTRVSLIVGLLLLATAGVWAV

SEQ ID NO: 25766 - protein, 72 aa, Diabrotica virgifera
  misc_feature: Coding regions on vcDNA: vcDNA=SeqID_5463; Strand=+; Position=219-434
  misc_feature: Homolog annotation: Hit_ID=XP_395461.1; Match level="QueryCoverage =95%, HitCoverage=14%, E-value=4e-15, Identity=50%"; Hit description =similar to CG7134-PA [Apis mellifera]
MTNNTDSTLLNASEFIKDRLYFTCVECTVDLKPTPTHHYFTLNNSIYYDSFYEDFGPLNLAKIYRFCTKLKK

SEQ ID NO: 25767 - protein, 145 aa, Diabrotica virgifera
  misc_feature: Coding regions on vcDNA: vcDNA=SeqID_5464; Strand=+; Position=2-436
  misc_feature: Homolog annotation: Hit_ID=XP_320878.1; Match level="QueryCoverage =98%, HitCoverage=39%, E-value=2e-10, Identity=29%"; Hit description =ENSANGP00000019142 [Anopheles gambiae]
  misc_feature (67)..(74): Xaa can be any naturally occurring amino acid
PAINSPNFRYTAARLCWTIEPVSPQFRAELHLKCKKQIDDNPDPKNVLPLIAELYIQLPHLHVYGTXXXXXXXXLLDIGGNENIKTICQALKLTGYSLEQSNKSELDMIFSHLRSVRNRVDGSAAFLLDSLYPLRASNWGHFTEE

SEQ ID NO: 25768 - protein, 70 aa, Diabrotica virgifera
  misc_feature: Coding regions on vcDNA: vcDNA=SeqID_5465; Strand=-; Position=248-460
  misc_feature (34)..(51): Xaa can be any naturally occurring amino acid
VKYVIFFWVTHYMTKVFQFAPFNRVHYFATFIQXXXXXXXXXXXXXXXXXXTVVDPHTYSEYDGWCYKKT

SEQ ID NO: 25769 - protein, 79 aa, Diabrotica virgifera
  misc_feature: Coding regions on vcDNA: vcDNA=SeqID_5466; Strand=+; Position=78-317
  misc_feature (55)..(55): Xaa can be any naturally occurring amino acid
PEKKNLYPELYSRITNYTNADCKVYIDNEEFNCHLIVLQCYSELFDAYIAVKKVXLPSDKCTATSFAFIYEWMITGEPS

SEQ ID NO: 25770 - protein, 81 aa, Diabrotica virgifera
  misc_feature: Coding regions on vcDNA: vcDNA=SeqID_5467; Strand=+; Position=103-345
  misc_feature: Homolog annotation: Hit_ID=NP_523889.1; Match level="QueryCoverage =100%, HitCoverage=54%, E-value=3e-22, Identity=59%"; Hit description= CG1320-PA [Drosophila melanogaster] gb|AAF47639.1| CG1320-PA [Drosophila melanogaster]
  misc_feature (51)..(60): Xaa can be any naturally occurring amino acid
MSTRWYPIYQKGGPQLRVFLPNFWMKLVRPPHAQPANIVTFSCSMEMTKHXXXXXXXXXXEVKCADVHTKIHMPKTKREKT

SEQ ID NO: 25771 - protein, 37 aa, Diabrotica virgifera
  misc_feature: Coding regions on vcDNA: vcDNA=SeqID_5468; Strand=-; Position=3-113
PLLYNVHLEAFDTRLEDSHHTNSKSLDVKVNTTLYRV

SEQ ID NO: 25772 - protein, 44 aa, Diabrotica virgifera
  misc_feature: Coding regions on vcDNA: vcDNA=SeqID_5469; Strand=+; Position=40-174
VMVTDITTGIFSGKLCSISHTHSVTALRDFEMYRNWLRFSFIVL

SEQ ID NO: 25773 - protein, 58 aa, Diabrotica virgifera
  misc_feature: Coding regions on vcDNA: vcDNA=SeqID_5470; Strand=-; Position=243-419
  misc_feature (10)..(16): Xaa can be any naturally occurring amino acid
  misc_feature (26)..(37): Xaa can be any naturally occurring amino acid
GQLTAAIQLXXXXXXXPYLIQNDMFXXXXXXXXXXXXVVNAYMSTRYRIPRYEYDHHY

SEQ ID NO: 25774 - protein, 68 aa, Diabrotica virgifera
  misc_feature: Coding regions on vcDNA: vcDNA=SeqID_5471; Strand=+; Position=1-207
TLYSRVVLMCIRIKVHHVYVLPAVCDVDSYCVRCVSTANGPLVLKDVCAGDMNVGDTFDCEHSDIWIH

SEQ ID NO: 25775 - protein, 140 aa, Diabrotica virgifera
  misc_feature: Coding regions on vcDNA: vcDNA=SeqID_5472; Strand=+; Position=39-461
  misc_feature: Homolog annotation: Hit_ID=Q9N2N6; Match level="QueryCoverage=92%, HitCoverage=29%, E-value=1e-42, Identity=63%"; Hit description =Tubulin beta chain (Beta-tubulin) gb|AAB31932.1| beta-tubulin [Euplotes focardii]
  misc_feature: Gene Ontology Annotation: Molecular function=structural constituent of cytoskeleton; Cellular component=cytoskeleton; Biological process= natural killer cell mediated cytolysis
  misc_feature (47)..(47): Xaa can be any naturally occurring amino acid
  misc_feature (62)..(62): Xaa can be any naturally occurring amino acid
  misc_feature (77)..(77): Xaa can be any naturally occurring amino acid
  misc_feature (103)..(103): Xaa can be any naturally occurring amino acid
  misc_feature (120)..(120): Xaa can be any naturally occurring amino acid
YVLKSDYRNIILREIVHIETGQCGYQIGAFIWEVMSDKDGIDPTGTXQGDSDLQLERINVYXNEATWRKICMKGSIXDLKSGTMDTVRSGSFGQLYRPDYLVXGQCETGYKWTNGHYTEXAELVDTVLEVVRIYTDCRNC

SEQ ID NO: 25776 - protein, 53 aa, Diabrotica virgifera
  misc_feature: Coding regions on vcDNA: vcDNA=SeqID_5473; Strand=+; Position=47-208
YFLEIIMWHSAQMHSGHRGKLYVANLGEHGSVVHCYSLTEIRPLETSEPPYLI

SEQ ID NO: 25777 - protein, 54 aa, Diabrotica virgifera
  misc_feature: Coding regions on vcDNA: vcDNA=SeqID_5474; Strand=+; Position=2-163
RGSTHASIESRTNLALTSYNWQLLQFLIFHSSCYQCMSLDSQHISCVRADLAVS

SEQ ID NO: 25778 - protein, 22 aa, Diabrotica virgifera
  misc_feature: Coding regions on vcDNA: vcDNA=SeqID_5475; Strand=-; Position=2-67
SPPDMSSHNMCSDVLIRLSIGC

SEQ ID NO: 25779 - protein, 56 aa, Diabrotica virgifera
  misc_feature: Coding regions on vcDNA: vcDNA=SeqID_5476; Strand=+; Position=91-259
  misc_feature: Homolog annotation: Hit_ID=BAB78527.1; Match level="QueryCoverage =96%, HitCoverage=17%, E-value=6e-10, Identity=57%"; Hit description =ribosome-associated protein P40 [Bombyx mori]
  misc_feature (31)..(31): Xaa can be any naturally occurring amino acid
SSNEEEVTNMLAASSHLGTANVALHVEQYVXNRPHDGTHSSSLRKTWERIRVAAGA

SEQ ID NO: 25780 - protein, 151 aa, Diabrotica virgifera
  misc_feature: Coding regions on vcDNA: vcDNA=SeqID_5477; Strand=+; Position=2-454
  misc_feature: Homolog annotation: Hit_ID=EAL42139.1; Match level="QueryCoverage =81%, HitCoverage=93%, E-value=8e-21, Identity=42%"; Hit description =ENSANGP00000028124 [Anopheles gambiae str. PEST] ref|XP_560772.1| ENSANGP00000028124 [Anopheles gambiae st
  misc_feature: Pfam annotation: Pfam_ID=rve; Match level="Score=40.7, E-value=4.3e -09, Copies=1"; Pfam description=Integrase core domain
  misc_feature (89)..(95): Xaa can be any naturally occurring amino acid
GETHSRNCEREPLMCHEVPKLPFEIAASDILDFGGKSYLVIVDYYSNWTELIRIKSKSISEVISQLKNVFATHGLPRKFVSDNVPYNSXXXXXXXNYYNIEYSFSSPRYPRSNGLAEKAVGICKQMLRKCSHDDSFYYLLEYRNSPLCGLN

SEQ ID NO: 25781 - protein, 48 aa, Diabrotica virgifera
  misc_feature: Coding regions on vcDNA: vcDNA=SeqID_5478; Strand=+; Position=3-146
HPIESRIRRCDWQPGGSRQLAMHPLSISASSLLLYLETSYVGRFEYHS

SEQ ID NO: 25782 - protein, 129 aa, Diabrotica virgifera
  misc_feature: Coding regions on vcDNA: vcDNA=SeqID_5479; Strand=+; Position=3-389
AGRHKPLDRVVLMWLKFLLLFVMWWSVNTAEQVNGTGELPLKDCLDSENIVPCLAEKAASTFEKSLNSNIHLLDGLELLRNDQKINPRRAKSLDGVQRLFTAVSDFIDTHSFSIDLTRGRALDDDDEEY

SEQ ID NO: 25783 - protein, 79 aa, Diabrotica virgifera
  misc_feature: Coding regions on vcDNA: vcDNA=SeqID_5480; Strand=-; Position=53-292
IAFTVIFVCNQYPESADEDWTHCLHVSSYRSLCNDLFPLVLECREYIRAMTMDDSCKSLRRRLQTSNPKIRKSSVPRLD

SEQ ID NO: 25784 - protein, 59 aa, Diabrotica virgifera
  misc_feature: Coding regions on vcDNA: vcDNA=SeqID_5481; Strand=+; Position=180-359
IEHLSVAKDVPASSSMGKTTIWLTVHSNTPAKASKLGHGERVELPLILPSVNWRQLDSI

SEQ ID NO: 25785 - protein, 75 aa, Diabrotica virgifera
  misc_feature: Coding regions on vcDNA: vcDNA=SeqID_5482; Strand=-; Position=281-508
HIRALTTKCSDKQKFIENAHFHNLALELKNYITNTIKFIIDNKTLEWLGFYIVESLKVFTSDFVEPSSIFMEIGE

SEQ ID NO: 25786 - protein, 91 aa, Diabrotica virgifera
  misc_feature: Coding regions on vcDNA: vcDNA=SeqID_5483; Strand=+; Position=204-479
GYKYVTISFFLIPVLTFRARNTNNFKFCTSNGWPRRWPYHLLKLNLLTVQVSLSSLCVIVETILNSATVTGIIFLVSPFFQVSSIPILSGY

SEQ ID NO: 25787 - protein, 83 aa, Diabrotica virgifera
  misc_feature: Coding regions on vcDNA: vcDNA=SeqID_5484; Strand=-; Position=2-250
SCALIDKWCALHYNVESSYRFPYFLPAFLIANRGFCKSSLVYVRIIDFLYSVVLWPLEWKMVTLLCTTSLFVEKSCALVSSIF

SEQ ID NO: 25788 - protein, 162 aa, Diabrotica virgifera
  misc_feature: Coding regions on vcDNA: vcDNA=SeqID_5485; Strand=+; Position=1-486
  misc_feature: Homolog annotation: Hit_ID=XP_396782.1; Match level="QueryCoverage =85%, HitCoverage=12%, E-value=5e-22, Identity=38%"; Hit description =similar to CG9776-PA [Apis mellifera]
  misc_feature: Pfam annotation: Pfam_ID=zf-U1; Match level="Score=6.1, E-value=0.02, Copies=1"; Pfam description=U1 zinc finger
  misc_feature (92)..(143): Xaa can be any naturally occurring amino acid
SRVDTRLYRNSYYFASEFQVTGLQFFVAAPSWYCRLCDVWIGDLHCASHHLKSKVHHQNFEIFTTQNPHWEMEWLKDREKSMTRKRDEASSXXXXXXXXXXXXXXXXXXXXXXXXXXXXXXXXXXXXXXXXXXXXXXXXXXXXDTDRSKSIRVAMRNMNEKW

SEQ ID NO: 25789 - protein, 60 aa, Diabrotica virgifera
  misc_feature: Coding regions on vcDNA: vcDNA=SeqID_5486; Strand=+; Position=266-445
  misc_feature (11)..(19): Xaa can be any naturally occurring amino acid
  misc_feature (42)..(42): Xaa can be any naturally occurring amino acid
  misc_feature (49)..(49): Xaa can be any naturally occurring amino acid
  misc_feature (58)..(58): Xaa can be any naturally occurring amino acid
KIELKETYMPXXXXXXXXXFCLISIEYLFLTYLNTITYSLIXKKSVTTXKTTFFQGRXIW

SEQ ID NO: 25790 - protein, 32 aa, Diabrotica virgifera
  misc_feature: Coding regions on vcDNA: vcDNA=SeqID_5487; Strand=+; Position=2-100
  misc_feature (3)..(9): Xaa can be any naturally occurring amino acid
QHXXXXXXXAFIQYMDVIYDIWLRLLNIKRII

SEQ ID NO: 25791 - protein, 61 aa, Diabrotica virgifera
  misc_feature: Coding regions on vcDNA: vcDNA=SeqID_5488; Strand=-; Position=129-314
SNQWIHIHYRTYVIDRLYEIIVLTISNTRFISVNTIMYATTMYLSVKCTEKFQRQVSINTP

SEQ ID NO: 25792 - protein, 44 aa, Diabrotica virgifera
  misc_feature: Coding regions on vcDNA: vcDNA=SeqID_5489; Strand=+; Position=83-217
FDTITLGNDSSHHNIFVIGHVQSGTATTTGHLIYTCCGINNYPI

SEQ ID NO: 25793 - protein, 130 aa, Diabrotica virgifera
  misc_feature: Coding regions on vcDNA: vcDNA=SeqID_5490; Strand=-; Position=5-397
  misc_feature (7)..(7): Xaa can be any naturally occurring amino acid
  misc_feature (18)..(18): Xaa can be any naturally occurring amino acid
TGPRPSXTGPRPRPRPRXPPRIPGATRPGAPSTPAPSTPGPWATGTSGIHCPPRAPSRAPLALAPAATTPGATIPAGPCPATGTSGIHWPLSAPSRAPLSATRPAPRRPLALAAATATKSTVTDNGFMLF

SEQ ID NO: 25794 - protein, 59 aa, Diabrotica virgifera
  misc_feature: Coding regions on vcDNA: vcDNA=SeqID_5491; Strand=+; Position=187-363
  misc_feature: Homolog annotation: Hit_ID=XP_397149.1; Match level="QueryCoverage =88%, HitCoverage=41%, E-value=9e-09, Identity=53%"; Hit description =similar to CG10335-PA [Apis mellifera]
MTAKINFQVKNKDILQSGIFNQTLRDWQSIQCEITAKNLMYPVFIVEDDDVVQPISSMP

SEQ ID NO: 25795 - protein, 60 aa, Diabrotica virgifera
  misc_feature: Coding regions on vcDNA: vcDNA=SeqID_5492; Strand=-; Position=141-323
FSFFYVYEIYDLSLNLSFLTKLDEVNYIVRDYPGNQVTSITSRKRQFLVEYIHVFELKFV

SEQ ID NO: 25796 - protein, 45 aa, Diabrotica virgifera
  misc_feature: Coding regions on vcDNA: vcDNA=SeqID_5493; Strand=-; Position=82-219
FELVYIQNLFQYKVLDEYLNTPIPELHFSVSNIHGLMIYKYELKN

SEQ ID NO: 25797 - protein, 80 aa, Diabrotica virgifera
  misc_feature: Coding regions on vcDNA: vcDNA=SeqID_5494; Strand=+; Position=110-350
  misc_feature: Homolog annotation: Hit_ID=XP_395028.1; Match level="QueryCoverage =100%, HitCoverage=20%, E-value=3e-15, Identity=48%"; Hit description= similar to ENSANGP00000009978 [Apis mellifera]
  misc_feature (23)..(23): Xaa can be any naturally occurring amino acid
  misc_feature (38)..(38): Xaa can be any naturally occurring amino acid
  misc_feature (51)..(51): Xaa can be any naturally occurring amino acid
CLLIVNIYIPARLDYINSLQMYXCTMFFIFYHDITHQXGIWVNYLRYHFMXLDNYTLRHHYLILLHEVVYESTVCLMGHD

SEQ ID NO: 25798 - protein, 131 aa, Diabrotica virgifera
  misc_feature: Coding regions on vcDNA: vcDNA=SeqID_5495; Strand=+; Position=30-422
  misc_feature: Homolog annotation: Hit_ID=XP_392962.1; Match level="QueryCoverage =96%, HitCoverage=39%, E-value=3e-67, Identity=91%"; Hit description =similar to putative activated protein kinase C receptor [Apis mellifera]
  misc_feature: Gene Ontology Annotation: Molecular function=molecular_function unknown; Cellular component=actin filament; Biological process =signal transduction
  misc_feature: Pfam annotation: Pfam_ID=WD40; Match level="Score=82.7, E-value=9.7e -22, Copies=2"; Pfam description=WD domain, G-beta repeat
  misc_feature (6)..(6): Xaa can be any naturally occurring amino acid
VHARVXFSVDNRQIVSGSRDKTIKLWNTLAECKYTIQDDGHSDWVSCVRFSPNHANPIIVSAGWDRMVKVWNLTNCRLKINHSGHTGYLNTVAVSPDGILCASGSKDCKAMLWDLNDGKHLHILEHNDIIN

SEQ ID NO: 25799 - protein, 130 aa, Diabrotica virgifera
  misc_feature: Coding regions on vcDNA: vcDNA=SeqID_5496; Strand=+; Position=31-420
  misc_feature: Homolog annotation: Hit_ID=XP_392726.1; Match level="QueryCoverage =100%, HitCoverage=67%, E-value=3e-39, Identity=66%"; Hit description= similar to CG3395-PA [Apis mellifera]
  misc_feature: Gene Ontology Annotation: Molecular function=structural constituent of ribosome; Cellular component=cytosolic ribosome (sensu Eukarya); Biological process=protein biosynthesis
  misc_feature: Pfam annotation: Pfam_ID=Ribosomal_S4; Match level="Score=55.6, E -value=1.4e-13, Copies=1"; Pfam description=Ribosomal protein S4/S9 N- terminal do
  misc_feature (48)..(48): Xaa can be any naturally occurring amino acid
  misc_feature (56)..(56): Xaa can be any naturally occurring amino acid
MEYGRIPSVHSITYVTPMRPYESVRLDQELNIIGAFGLRYKCELWRVXYTLSNFRXAAIELLTLNENEPMWLYESNARLRRVVRIGVLNENRMKLYYLMGHKIEHVLGRRLLAAVFISGLGKSIHHAMVL

SEQ ID NO: 25800 - protein, 78 aa, Diabrotica virgifera
  misc_feature: Coding regions on vcDNA: vcDNA=SeqID_5497; Strand=+; Position=1-237
  misc_feature (38)..(51): Xaa can be any naturally occurring amino acid
GPPPLTMTTNDNDDNDDDNDNDNPVSDLFDDDDDDDDXXXXXXXXXXXXXXTGLEDVIEAKRSRESKKLKHTKNAKKI

SEQ ID NO: 25801 - protein, 106 aa, Diabrotica virgifera
  misc_feature: Coding regions on vcDNA: vcDNA=SeqID_5498; Strand=+; Position=60-380
  misc_feature: Homolog annotation: Hit_ID=XP_322064.1; Match level="QueryCoverage =83%, HitCoverage=20%, E-value=1e-13, Identity=53%"; Hit description =ENSANGP00000020473 [Anopheles gambiae]
  misc_feature: Gene Ontology Annotation: Biological process=MAPKKK cascade
PPKLIYRYYSSNFYSRNVIEIFTMSKNKLNLTLPPGSIDQTPAVTPTSSFQETPVASNLVRGNSIENLTARIEELDSTLEMDDTQRKRIEVFLCQKEKIGGEFSDE

SEQ ID NO: 25802 - protein, 35 aa, Diabrotica virgifera
  misc_feature: Coding regions on vcDNA: vcDNA=SeqID_5499; Strand=-; Position=0-104
RSYTQQYFQRPKKPLTIKRSLIKLTNPSPLISSDA

SEQ ID NO: 25803 - protein, 57 aa, Diabrotica virgifera
  misc_feature: Coding regions on vcDNA: vcDNA=SeqID_5500; Strand=+; Position=2-175
  misc_feature (5)..(11): Xaa can be any naturally occurring amino acid
  misc_feature (49)..(56): Xaa can be any naturally occurring amino acid
PRIRXXXXXXXWFRTCLSIWDLRTGMLQASYYDLCWCTLCIMGLLLDQXXXXXXXXI

SEQ ID NO: 25804 - protein, 38 aa, Diabrotica virgifera
  misc_feature: Coding regions on vcDNA: vcDNA=SeqID_5501; Strand=-; Position=38-154
PSKHTELKTHPYKELNIHLNKTKSETSGLQKPITNKCV

SEQ ID NO: 25805 - protein, 52 aa, Diabrotica virgifera
  misc_feature: Coding regions on vcDNA: vcDNA=SeqID_5502; Strand=-; Position=0-155
HCTRPSYPVENLIDSSSLATHTSDVATSHFVKLSYGLLPNSSRFDTVLGCVG

SEQ ID NO: 25806 - protein, 108 aa, Diabrotica virgifera
  misc_feature: Coding regions on vcDNA: vcDNA=SeqID_5503; Strand=+; Position=98-421
  misc_feature: Homolog annotation: Hit_ID=XP_320147.1; Match level="QueryCoverage =89%, HitCoverage=15%, E-value=5e-23, Identity=54%"; Hit description =ENSANGP00000011586 [Anopheles gambiae]
  misc_feature: Pfam annotation: Pfam_ID=RRM_1; Match level="Score=25.0, E-value =0.00012, Copies=1"; Pfam description=RNA recognition motif. (a.k.a. RRM, RB
  misc_feature (101)..(108): Xaa can be any naturally occurring amino acid
MESPLKSENDTVTEENPYAYLDRDFSSENFKIEVKNMPKYYGISEFRKLLNEKLKLNSNKIKTTKRNSSFAFVCFRNTEDRDNAMQVLSKYKWKGKELQVXXXXXXXX

SEQ ID NO: 25807 - protein, 101 aa, Diabrotica virgifera
  misc_feature: Coding regions on vcDNA: vcDNA=SeqID_5504; Strand=+; Position=111-413
  misc_feature: Homolog annotation: Hit_ID=AAT77077.1; Match level="QueryCoverage =99%, HitCoverage=22%, E-value=2e-39, Identity=72%"; Hit description =alpha tubulin [Oryza sativa (japonica cultivar-group)] gb|AAG16905.1| alpha-tubulin [Oryza sativa]
  misc_feature: Gene Ontology Annotation: Molecular function=GTP binding; Cellular component=microtubule; Biological process=microtubule-based process
  misc_feature (45)..(45): Xaa can be any naturally occurring amino acid
MPDCIAVDVGQAGVESGDACWELYCLEHGIQTDCQMPADRTVGRXDDSFNTFFTETGVGKHVPRAVVVDLEPSVLDEVCSGIYRQLFHTDELINGKDDAAK

SEQ ID NO: 25808 - protein, 57 aa, Diabrotica virgifera
  misc_feature: Coding regions on vcDNA: vcDNA=SeqID_5505; Strand=-; Position=185-358
  misc_feature (16)..(22): Xaa can be any naturally occurring amino acid
TKNFLLLKIFLVNLSXXXXXXXRFCLSNQSKNIVRCSYLFYRNLCQTNVIKLQFFTR

SEQ ID NO: 25809 - protein, 67 aa, Diabrotica virgifera
  misc_feature: Coding regions on vcDNA: vcDNA=SeqID_5506; Strand=-; Position=26-229
GVPCLVVMWTINHKVSIRISSFLVSQKTKRCDVCENNYVNVNVQTILPLTTLVSVQHIVTATIMNAI

SEQ ID NO: 25810 - protein, 79 aa, Diabrotica virgifera
  misc_feature: Coding regions on vcDNA: vcDNA=SeqID_5507; Strand=+; Position=16-255
  misc_feature (4)..(22): Xaa can be any naturally occurring amino acid
IVLXXXXXXXXXXXXXXXXXXXYKIKKEIRQKKGGPAKGFKLYLPVIATSDPFKRAHINLLTGPSFKTSESGKTLGSPN

SEQ ID NO: 25811 - protein, 143 aa, Diabrotica virgifera
  misc_feature: Coding regions on vcDNA: vcDNA=SeqID_5508; Strand=+; Position=2-430
  misc_feature: Homolog annotation: Hit_ID=XP_320364.1; Match level="QueryCoverage =100%, HitCoverage=17%, E-value=4e-76, Identity=93%"; Hit description= ENSANGP00000013970 [Anopheles gambiae]
  misc_feature: Gene Ontology Annotation: Molecular function=RNA polymerase II transcription factor activity; Cellular component=transcription factor TFIIH complex; Biological process=transcription-coupled nucleotide-excision repair
TSEAKDKPMGCAILVTTYSMITHTQRRSWEAEQTMKWLQEQEWGIMLLDEVHTIPAKMFRRVLTIVQSHCKLGLTATLLREDDKIADLNFLIGPKLYEANWLELQKRGYIARVQCAEVWCPMTPEFYREYLVCRTSKRLLLYV

SEQ ID NO: 25812 - protein, 97 aa, Diabrotica virgifera
  misc_feature: Coding regions on vcDNA: vcDNA=SeqID_5509; Strand=+; Position=40-330
  misc_feature: Homolog annotation: Hit_ID=EAL32677.1; Match level="QueryCoverage =93%, HitCoverage=18%, E-value=2e-17, Identity=43%"; Hit description =GA15510-PA [Drosophila pseudoobscura]
YYNILAVSIDTLLLEANFRAQEAGETGFVHVVGLGLGVWKISPQQEKVYMDAFASRIAIPGEQLNHISDMCFAWMFQDVCGNYVDGEHSSIPDHPSC

SEQ ID NO: 25813 - protein, 142 aa, Diabrotica virgifera
  misc_feature: Coding regions on vcDNA: vcDNA=SeqID_5510; Strand=+; Position=2-427
  misc_feature: Homolog annotation: Hit_ID=NP_728587.1; Match level="QueryCoverage =91%, HitCoverage=75%, E-value=3e-14, Identity=34%"; Hit description =CG9134-PC, isoform C [Drosophila melanogaster] ref|NP_728586.1| CG9134-PA, isoform A [Drosophila
  misc_feature: Pfam annotation: Pfam_ID=Lectin_C; Match level="Score=19.1, E-value =9.7e-06, Copies=1"; Pfam description=Lectin C-type domain
GPRTRPTLFNLKSVILFTLVGSTLVTSRKVPNWEDVFRDYQSKVVPLRHWGNKSYWMGTSFQATWFEALTFCSQMHMQLLTINSEEENSVIYRYIREASKGFEYWTSSTRLIDGNKWVWFPYGDLIEYTRWSNGQPNDPNGE

SEQ ID NO: 25814 - protein, 93 aa, Diabrotica virgifera
  misc_feature: Coding regions on vcDNA: vcDNA=SeqID_5511; Strand=+; Position=54-332
  misc_feature: Homolog annotation: Hit_ID=XP_308019.1; Match level="QueryCoverage =92%, HitCoverage=46%, E-value=5e-42, Identity=89%"; Hit description =ENSANGP00000019471 [Anopheles gambiae]
  misc_feature: Gene Ontology Annotation: Molecular function=ubiquitin conjugating enzyme activity; Cellular component=endoplasmic reticulum; Biological process=male courtship behavior
  misc_feature: Pfam annotation: Pfam_ID=UQ_con; Match level="Score=36.0, E-value =1.1e-08, Copies=1"; Pfam description=Ubiquitin-conjugating enzyme
YCNKLINISIMAGSALRRLMAEYKQLTLNPPEGIIAGPINEENFFEWEALITGPEGTCFEGGVFPAKLIFPPDYPLSPPKMQFTCEMFHPNIY

SEQ ID NO: 25815 - protein, 88 aa, Diabrotica virgifera
  misc_feature: Coding regions on vcDNA: vcDNA=SeqID_5512; Strand=+; Position=92-358
  misc_feature: Homolog annotation: Hit_ID=XP_319316.1; Match level="QueryCoverage =96%, HitCoverage=6%, E-value=1e-21, Identity=61%"; Hit description =ENSANGP00000023510 [Anopheles gambiae]
  misc_feature: Gene Ontology Annotation: Molecular function=structural constituent of muscle; Cellular component=muscle myosin; Biological process =striated muscle contraction
MAETEPSIEITKDDNTLQKLEEKAQKAQEAFEREEKAKKELEALYAKLLAEKTELLSNLEGEKGSLSETQERANKLQAQKNDLESQLF

SEQ ID NO: 25816 - protein, 44 aa, Diabrotica virgifera
  misc_feature: Coding regions on vcDNA: vcDNA=SeqID_5513; Strand=+; Position=228-362
  misc_feature (4)..(10): Xaa can be any naturally occurring amino acid
RTCXXXXXXXGTVFPLGSFPNYIFLTRPLQNIFLTTRRSTFNVF

SEQ ID NO: 25817 - protein, 121 aa, Diabrotica virgifera
  misc_feature: Coding regions on vcDNA: vcDNA=SeqID_5514; Strand=+; Position=20-382
  misc_feature (24)..(24): Xaa can be any naturally occurring amino acid
ILEEIICTNENKKSGKVDFYTYRXYGNYGGGILVIAIVLVFFIGSQFSKSYTDKILSNWVNHIHHNTTNINEENTVWDFSLKIYSAFTLSTTILSIFSAFLLLNFTRKASIKLHRCLSNTV

SEQ ID NO: 25818 - protein, 105 aa, Diabrotica virgifera
  misc_feature: Coding regions on vcDNA: vcDNA=SeqID_5515; Strand=+; Position=35-349
  misc_feature: Homolog annotation: Hit_ID=XP_393016.1; Match level="QueryCoverage =100%, HitCoverage=12%, E-value=4e-40, Identity=73%"; Hit description= similar to CG9210-PA [Apis mellifera]
  misc_feature: Gene Ontology Annotation: Molecular function=adenylate cyclase activity; Cellular component=plasma membrane; Biological process=G -protein signaling, coupled to cAMP nucleotide second messenger
  misc_feature: Pfam annotation: Pfam_ID=Guanylate_cyc; Match level="Score=-12.4, E -value=1.2e-06, Copies=1"; Pfam description=Adenylate and Guanylate cyclase catal
FRQSTMATMENFIIQFADIVGFTKMSGSKSAEELVDILNNLFQRFDSLCKIHNCEKISTLGDCYYCVSGCPEARSDHAQCCVEMGLSMIQAIKQFDHEKNERVNM

SEQ ID NO: 25819 - protein, 28 aa, Diabrotica virgifera
  misc_feature: Coding regions on vcDNA: vcDNA=SeqID_5516; Strand=+; Position=14-97
VSRVQSERQFNSVMCLNCDQVKVPLLQT

SEQ ID NO: 25820 - protein, 37 aa, Diabrotica virgifera
  misc_feature: Coding regions on vcDNA: vcDNA=SeqID_5517; Strand=-; Position=0-110
LVFAQLLPRDSHSSMVANCRDTRPMPLLACLLSHRLA

SEQ ID NO: 25821 - protein, 65 aa, Diabrotica virgifera
  misc_feature: Coding regions on vcDNA: vcDNA=SeqID_5518; Strand=+; Position=1-198
SRLSRSTYAWLISNRCSSTLRRITPICDSCRRARRGSVHSIQPLFDVAAGFRFQNHSRIWNWLTL

SEQ ID NO: 25822 - protein, 98 aa, Diabrotica virgifera
  misc_feature: Coding regions on vcDNA: vcDNA=SeqID_5519; Strand=+; Position=48-341
RVQALLSWSPAVHSDIPTIGLASLGAEPSRDGTTPWRVYCPGSVNIWPYHVMSGLWIELICTDELANVSVNSRAFRIRLPEDSAMVILQSPDMLLIAD

SEQ ID NO: 25823 - protein, 59 aa, Diabrotica virgifera
  misc_feature: Coding regions on vcDNA: vcDNA=SeqID_5520; Strand=+; Position=208-384
  misc_feature: Homolog annotation: Hit_ID=CAH04312.1; Match level="QueryCoverage =88%, HitCoverage=21%, E-value=5e-09, Identity=57%"; Hit description =S2e ribosomal protein [Meladema coriacea]
VPVTMLRHLFKDGRIHSLEDIDQFSMPINEFEIIDHFHGSDLLDNVQMITPVHIHALTC

SEQ ID NO: 25824 - protein, 56 aa, Diabrotica virgifera
  misc_feature: Coding regions on vcDNA: vcDNA=SeqID_5521; Strand=-; Position=207-377
  misc_feature (17)..(27): Xaa can be any naturally occurring amino acid
SENDIFSRKKGTFLYVXXXXXXXXXXXWREYESGLSQYTMIILLLINVFRQVMKTD

SEQ ID NO: 25825 - protein, 49 aa, Diabrotica virgifera
  misc_feature: Coding regions on vcDNA: vcDNA=SeqID_5522; Strand=+; Position=15-164
LTTVSLWSKPLSGLRPQEHPVFMIACQVVNNSKLFNPRLFQLRNLTGLR

SEQ ID NO: 25826 - protein, 73 aa, Diabrotica virgifera
  misc_feature: Coding regions on vcDNA: vcDNA=SeqID_5523; Strand=-; Position=1-219
  misc_feature (44)..(53): Xaa can be any naturally occurring amino acid
RTAPICRSVPPWQVRDTELYPFFPSNLSLTIWTPTRDVQCYCAXXXXXXXXXXTSCCGLDADTRLRQATTQRR

SEQ ID NO: 25827 - protein, 43 aa, Diabrotica virgifera
  misc_feature: Coding regions on vcDNA: vcDNA=SeqID_5524; Strand=-; Position=87-218
LLPSPSIIPSDCYCINNLLIPICPSIPNLTKINLYMLKKLLKY

SEQ ID NO: 25828 - protein, 41 aa, Diabrotica virgifera
  misc_feature: Coding regions on vcDNA: vcDNA=SeqID_5525; Strand=+; Position=1-123
VRVCAEFASIVAIVMTARMAQNVVRILTPCFGDEGPLGSFL

SEQ ID NO: 25829 - protein, 108 aa, Diabrotica virgifera
  misc_feature: Coding regions on vcDNA: vcDNA=SeqID_5526; Strand=+; Position=85-408
  misc_feature: Homolog annotation: Hit_ID=XP_315740.1; Match level="QueryCoverage =88%, HitCoverage=38%, E-value=8e-16, Identity=39%"; Hit description =ENSANGP00000016479 [Anopheles gambiae]
MSQKHTQKMGSNLEYVDSSQVYATSYVRDSKAVRMLWGSFTKCYAIIATVSFITAEWIGTTSGETPGKTGLYSNCYIGQNAAQCIEKFWDTFIDHAHALQASRVSVRL

SEQ ID NO: 25830 - protein, 47 aa, Diabrotica virgifera
  misc_feature: Coding regions on vcDNA: vcDNA=SeqID_5527; Strand=+; Position=163-306
CRIRNTSITSTSIDRPTSSHNLWMTPCSTFVNSLQFFINSIILSYQR
